United States Patent 9,782,462 (MODIFIED POLYNUCLEOTIDES FOR THE PRODUCTION OF PROTEINS ASSOCIATED WITH HUMAN DISEASE) - sequence listing, part 52

SEQ ID NO: 99000 - DNA, 5169 bp, Artificial Sequence
  Description of Artificial Sequence: Synthetic coding sequence
atgagcgaccccagacagagccaggaggagaagcacaagctgggcagagccagcagcaagttcaaggacccccccagaatcatgcagagcgacgactacttcgccagaaagttcaaggccatcaacggcaacatgggccccaccaccagcctgaacgccagcaacagcaacgagaccggcggcggcggccccgccaacggcacccccgccgtgcccaagatgggcgtgagagccagagtgagcgagtggccccccaagaaggactgcagcaaggagctgacctgcaaggccctgtgggagagcagaagccagaccagctacgagagcatcaccagcgtgctgcagaacggccagagcgaccagagcgagggccagcaggacgagcagctggacctggacttcgtggaggccaagtacaccatcggcgacatcttcgtgcacagcccccagagaggcctgcaccccatcagacagagaagcaacagcgacgtgaccatcagcgacatcgacgccgaggacgtgctggaccagaacgccgtgaaccccaacaccggcgccgccctgcacagagagtacggcagcaccagcagcatcgacagacagggcctgagcggcgagaacttcttcgccatgctgagaggctacagagtggagaactacgaccacaaggccatggtgcccttcggcttccccgagttcttcagatgcgaccccgccatcagccccagcctgcacgccgccgcccagatcagcagaggcgagttcgtgagaatcagcggcctggactacgtggacagcgccctgctgatgggcagagacagagacaagcccttcaagagaagactgaagagcgagagcgtggagaccagcctgttcagaaagctgagaaccgtgaagagcgagcacgagaccttcaagttcaccagcgagctggaggagagcagactggagagaggcatcagaccctggaactgccagagatgcttcgcccactacgacgtgcagagcatcctgttcaacatcaacgaggccatggccaccagagccaacgtgggcaagagaaagaacatcaccaccggcgccagcgccgccagccagacccagatgcccaccggccagaccggcaactgcgagagccccctgggcagcaaggaggacctgaacagcaaggagaacctggacgccgacgagggcgacggcaagagcaacgacctggtgctgagctgcccctacttcagaaacgagaccggcggcgagggcgacagaagaatcgccctgagcagagccaacagcagcagcttcagcagcggcgagagctgcagcttcgagagcagcctgagcagccactgcaccaacgccggcgtgagcgtgctggaggtgcccagagagaaccagcccatccacagagagaaggtgaagagatacatcatcgagcacatcgacctgggcgcctactactacagaaagttcttctacggcaaggagcaccagaactacttcggcatcgacgagaacctgggccccgtggccgtgagcatcagaagagagaaggtggaggacgccaaggagaaggagggcagccagttcaactacagagtggccttcagaaccagcgagctgaccaccctgagaggcgccatcctggaggacgccatccccagcaccgccagacacggcaccgccagaggcctgcccctgaaggaggtgctggagtacgtgatccccgagctgagcatccagtgcctgagacaggccagcaacagccccaaggtgagcgagcagctgctgaagctggacgagcagggcctgagcttccagcacaagatcggcatcctgtactgcaaggccggccagagcaccgaggaggagatgtacaacaacgagaccgccggccccgccttcgaggagttcctggacctgctgggccagagagtgagactgaagggcttcagcaagtacagagcccagctggacaacaagaccgacagcaccggcacccacagcctgtacaccacctacaaggactacgagctgatgttccacgtgagcaccctgctgccctacatgcccaacaacagacagcagctgctgagaaagagacacatcggcaacgacatcgtgaccatcgtgttccaggagcccggcgccctgcccttcacccccaagagcatcagaagccacttccagcacgtgttcgtgatcgtgaaggtgcacaacccctgcaccgagaacgtgtgctacagcgtgggcgtgagcagaagcaaggacgtgccccccttcggcccccccatccccaagggcgtgaccttccccaagagcgccgtgttcagagacttcctgctggccaaggtgatcaacgccgagaacgccgcccacaagagcgagaagttcagagccatggccaccagaaccagacaggagtacctgaaggacctggccgagaacttcgtgaccaccgccaccgtggacaccagcgtgaagttcagcttcatcaccctgggcgccaagaagaaggagaaggtgaagcccagaaaggacgcccacctgttcagcatcggcgccatcatgtggcacgtgatcgccagagacttcggccagagcgccgacatcgagtgcctgctgggcatcagcaacgagttcatcatgctgatcgagaaggacagcaagaacgtggtgttcaactgcagctgcagagacgtgatcggctggaccagcggcctggtgagcatcaaggtgttctacgagagaggcgagtgcgtgctgctgagcagcgtggacaactgcgccgaggacatcagagagatcgtgcagagactggtgatcgtgaccagaggctgcgagaccgtggagatgaccctgagaagaaacggcctgggccagctgggcttccacgtgaacttcgagggcatcgtggccgacgtggagcccttcggcttcgcctggaaggccggcctgagacagggcagcagactggtggagatctgcaaggtggccgtggccaccctgacccacgagcagatgatcgacctgctgagaaccagcgtgaccgtgaaggtggtgatcatccagccccacgacgacggcagccccagaagaggctgcagcgagctgtgcagaatccccatggtggagtacaagctggacagcgagggcaccccctgcgagtacaagacccccttcagaagaaacaccacctggcacagagtgcccacccccgccctgcagcccctgagcagagccagccccatccccggcacccccgacagactgccctgccagcagctgctgcagcaggcccaggccgccatccccagaagcaccagcttcgacagaaagctgcccgacggcaccagaagcagccccagcaaccagagcagcagcagcgaccccggccccggcggcagcggcccctggagaccccaggtgggctacgacggctgccagagccccctgctgctggagcaccagggcagcggccccctggagtgcgacggcgccagagagagagaggacaccatggaggccagcagacaccccgagaccaagtggcacggcccccccagcaaggtgctgggcagctacaaggagagagccctgcagaaggacggcagctgcaaggacagccccaacaagctgagccacatcggcgacaagagctgcagcagccacagcagcagcaacaccctgagcagcaacaccagcagcaacagcgacgacaagcacttcggcagcggcgacctgatggaccccgagctgctgggcctgacctacatcaagggcgccagcaccgacagcggcatcgacaccgccccctgcatgcccgccaccatcctgggccccgtgcacctggccggcagcagaagcctgatccacagcagagccgagcagtgggccgacgccgccgacgtgagcggccccgacgacgagcccgccaagctgtacagcgtgcacggctacgccagcaccatcagcgccggcagcgccgccgagggcagcatgggcgacctgagcgagatcagcagccacagcagcggcagccaccacagcggcagccccagcgcccactgcagcaagagcagcggcagcctggacagcagcaaggtgtacatcgtgagccacagcagcggccagcaggtgcccggcagcatgagcaagccctaccacagacagggcgccgtgaacaagtacgtgatcggctggaagaagagcgagggcagccccccccccgaggagcccgaggtgaccgagtgccccggcatgtacagcgagatggacgtgatgagcaccgccacccagcaccagaccgtggtgggcgacgccgtggccgagacccagcacgtgctgagcaaggaggacttcctgaagctgatgctgcccgacagccccctggtggaggagggcagaagaaagttcagcttctacggcaacctgagccccagaagaagcctgtacagaaccctgagcgacgagagcatctgcagcaacagaagaggcagcagcttcggcagcagcagaagcagcgtgctggaccaggccctgcccaacgacatcctgttcagcaccacccccccctaccacagcaccctgccccccagagcccaccccgcccccagcatgggcagcctgagaaacgagttctggttcagcgacggcagcctgagcgacaagagcaagtgcgccgaccccggcctgatgcccctgcccgacaccgccaccggcctggactggacccacctggtggacgccgccagagccttcgagggcctggacagcgacgaggagctgggcctgctgtgccaccacaccagctacctggaccagagagtggccagcttctgcaccctgaccgacatgcagcacggccaggacctggagggcgcccaggagctgcccctgtgcgtggaccccggcagcggcaaggagttcatggacaccaccggcgagagaagccccagccccctgaccggcaaggtgaaccagctggagctgatcctgagacagctgcagaccgacctgagaaaggagaagcaggacaaggccgtgctgcaggccgaggtgcagcacctgagacaggacaacatgagactgcaggaggagagccagaccgccaccgcccagctgagaaagttcaccgagtggttcttcaccaccatcgacaagaagagctag

SEQ ID NO: 99001 - DNA, 2337 bp, Artificial Sequence
  Description of Artificial Sequence: Synthetic coding sequence
atgagcccctgcttcagcttcatcggctgcaagctgtgcagcatcgtgaccagaggctgcgagaccgtggagatgaccctgagaagaaacggcctgggccagctgggcttccacgtgaacttcgagggcatcgtggccgacgtggagcccttcggcttcgcctggaaggccggcctgagacagggcagcagactggtggagatctgcaaggtggccgtggccaccctgacccacgagcagatgatcgacctgctgagaaccagcgtgaccgtgaaggtggtgatcatccagccccacgacgacggcagccccagaagaggctgcagcgagctgtgcagaatccccatggtggagtacaagctggacagcgagggcaccccctgcgagtacaagacccccttcagaagaaacaccacctggcacagagtgcccacccccgccctgcagcccctgagcagagccagccccatccccggcacccccgacagactgccctgccagcagctgctgcagcaggcccaggccgccatccccagaagcaccagcttcgacagaaagctgcccgacggcaccagaagcagccccagcaaccagagcagcagcagcgaccccggccccggcggcagcggcccctggagaccccaggtgggctacgacggctgccagagccccctgctgctggagcaccagggcagcggccccctggagtgcgacggcgccagagagagagaggacaccatggaggccagcagacaccccgagaccaagtggcacggcccccccagcaaggtgctgggcagctacaaggagagagccctgcagaaggacggcagctgcaaggacagccccaacaagctgagccacatcggcgacaagagctgcagcagccacagcagcagcaacaccctgagcagcaacaccagcagcaacagcgacgacaagcacttcggcagcggcgacctgatggaccccgagctgctgggcctgacctacatcaagggcgccagcaccgacagcggcatcgacaccgccccctgcatgcccgccaccatcctgggccccgtgcacctggccggcagcagaagcctgatccacagcagagccgagcagtgggccgacgccgccgacgtgagcggccccgacgacgagcccgccaagctgtacagcgtgcacggctacgccagcaccatcagcgccggcagcgccgccgagggcagcatgggcgacctgagcgagatcagcagccacagcagcggcagccaccacagcggcagccccagcgcccactgcagcaagagcagcggcagcctggacagcagcaaggtgtacatcgtgagccacagcagcggccagcaggtgcccggcagcatgagcaagccctaccacagacagggcgccgtgaacaagtacgtgatcggctggaagaagagcgagggcagccccccccccgaggagcccgaggtgaccgagtgccccggcatgtacagcgagatggacgtgatgagcaccgccacccagcaccagaccgtggtgggcgacgccgtggccgagacccagcacgtgctgagcaaggaggacttcctgaagctgatgctgcccgacagccccctggtggaggagggcagaagaaagttcagcttctacggcaacctgagccccagaagaagcctgtacagaaccctgagcgacgagagcatctgcagcaacagaagaggcagcagcttcggcagcagcagaagcagcgtgctggaccaggccctgcccaacgacatcctgttcagcaccacccccccctaccacagcaccctgccccccagagcccaccccgcccccagcatgggcagcctgagaaacgagttctggttcagcgacggcagcctgagcgacaagagcaagtgcgccgaccccggcctgatgcccctgcccgacaccgccaccggcctggactggacccacctggtggacgccgccagagccttcgaggaccagagagtggccagcttctgcaccctgaccgacatgcagcacggccaggacctggagggcgcccaggagctgcccctgtgcgtggaccccggcagcggcaaggagttcatggacaccaccggcgagagaagccccagccccctgaccggcaaggtgaaccagctggagctgatcctgagacagctgcagaccgacctgagaaaggagaagcaggacaaggccgtgctgcaggccgaggtgcagcacctgagacaggacaacatgagactgcaggaggagagccagaccgccaccgcccagctgagaaagttcaccgagtggttcttcaccaccatcgacaagaagagctag

SEQ ID NO: 99002 - DNA, 5169 bp, Artificial Sequence; identical to SEQ ID NO: 99000
  Description of Artificial Sequence: Synthetic coding sequence

SEQ ID NO: 99003 - DNA, 918 bp, Artificial Sequence
  Description of Artificial Sequence: Synthetic coding sequence
atggaccccaagggcctgctgagcctgaccttcgtgctgttcctgagcctggccttcggcgccagctacggcaccggcggcagaatgatgaactgccccaagatcctgagacagctgggcagcaaggtgctgctgcccctgacctacgagagaatcaacaagagcatgaacaagagcatccacatcgtggtgaccatggccaagagcctggagaacagcgtggagaacaagatcgtgagcctggaccccagcgaggccggcccccccagatacctgggcgacagatacaagttctacctggagaacctgaccctgggcatcagagagagcagaaaggaggacgagggctggtacctgatgaccctggagaagaacgtgagcgtgcagagattctgcctgcagctgagactgtacgagcaggtgagcacccccgagatcaaggtgctgaacaagacccaggagaacggcacctgcaccctgatcctgggctgcaccgtggagaagggcgaccacgtggcctacagctggagcgagaaggccggcacccaccccctgaaccccgccaacagcagccacctgctgagcctgaccctgggcccccagcacgccgacaacatctacatctgcaccgtgagcaaccccatcagcaacaacagccagaccttcagcccctggcccggctgcagaaccgaccccagcggcaagaccaaccactaccagaccaccgtggagaagaagagcctgaccatctacgcccaggtgcagaagcccggccccctgcagaagaagctggacagcttccccgcccaggacccctgcaccaccatctacgtggccgccaccgagcccgtgcccgagagcgtgcaggagaccaacagcatcaccgtgtacgccagcgtgaccctgcccgagagctag

SEQ ID NO: 99004 - DNA, 1008 bp, Artificial Sequence
  Description of Artificial Sequence: Synthetic coding sequence
atggaccccaagggcctgctgagcctgaccttcgtgctgttcctgagcctggccttcggcgccagctacggcaccggcggcagaatgatgaactgccccaagatcctgagacagctgggcagcaaggtgctgctgcccctgacctacgagagaatcaacaagagcatgaacaagagcatccacatcgtggtgaccatggccaagagcctggagaacagcgtggagaacaagatcgtgagcctggaccccagcgaggccggcccccccagatacctgggcgacagatacaagttctacctggagaacctgaccctgggcatcagagagagcagaaaggaggacgagggctggtacctgatgaccctggagaagaacgtgagcgtgcagagattctgcctgcagctgagactgtacgagcaggtgagcacccccgagatcaaggtgctgaacaagacccaggagaacggcacctgcaccctgatcctgggctgcaccgtggagaagggcgaccacgtggcctacagctggagcgagaaggccggcacccaccccctgaaccccgccaacagcagccacctgctgagcctgaccctgggcccccagcacgccgacaacatctacatctgcaccgtgagcaaccccatcagcaacaacagccagaccttcagcccctggcccggctgcagaaccgaccccagcgagaccaagccctgggccgtgtacgccggcctgctgggcggcgtgatcatgatcctgatcatggtggtgatcctgcagctgagaagaagaggcaagaccaaccactaccagaccaccgtggagaagaagagcctgaccatctacgcccaggtgcagaagcccggccccctgcagaagaagctggacagcttccccgcccaggacccctgcaccaccatctacgtggccgccaccgagcccgtgcccgagagcgtgcaggagaccaacagcatcaccgtgtacgccagcgtgaccctgcccgagagctag

SEQ ID NO: 99005 - DNA, 897 bp, Artificial Sequence
  Description of Artificial Sequence: Synthetic coding sequence
atggaccccaagggcctgctgagcctgaccttcgtgctgttcctgagcctggccttcggcgccagctacggcaccggcggcagaatgatgaactgccccaagatcctgagacagctgggcagcaaggtgctgctgcccctgacctacgagagaatcaacaagagcatgaacaagagcatccacatcgtggtgaccatggccaagagcctggagaacagcgtggagaacaagatcgtgagcctggaccccagcgaggccggcccccccagatacctgggcgacagatacaagttctacctggagaacctgaccctgggcatcagagagagcagaaaggaggacgagggctggtacctgatgaccctggagaagaacgtgagcgtgcagagattctgcctgcagctgagactgtacgagcaggtgagcacccccgagatcaaggtgctgaacaagacccaggagaacggcacctgcaccctgatcctgggctgcaccgtggagaagggcgaccacgtggcctacagctggagcgagaaggccggcacccaccccctgaaccccgccaacagcagccacctgctgagcctgaccctgggcccccagcacgccgacaacatctacatctgcaccgtgagcaaccccatcagcaacaacagccagaccttcagcccctggcccggctgcagaaccgaccccagcgagaccaagccctgggccgtgtacgccggcctgctgggcggcgtgatcatgatcctgatcatggtggtgatcctgcagctgagaagaagaggcaagaccaaccactaccagaccaccgtggagaagaagagcctgaccatctacgcccaggtgcagaagcccggcgacagccaccaccagaccagcgacctgttctag

SEQ ID NO: 99006 - DNA, 435 bp, Artificial Sequence
  Description of Artificial Sequence: Synthetic coding sequence
atggaccccaagggcctgctgagcctgaccttcgtgctgttcctgagcctggccttcggcgccagctacggcaccggcggcagaatgatgaactgccccaagatcctgagacagctgggcagcaaggtgctgctgcccctgacctacgagagaatcaacaagagcatgaacaagagcatccacatcgtggtgaccatggccaagagcctggagaacagcgtggagaacaagatcgtgagcctggaccccagcgaggccggcccccccagatacctgggcgacagatacaagttctacctggagaacctgaccctgggcatcagagagagcagaaaggaggacgagggctggtacctgatgaccctggagaagagcctgcacttcggctacctgtacttcgtgctgggcgccgaccacgacaacctgcagacctag

SEQ ID NO: 99007 - DNA, 810 bp, Artificial Sequence
  Description of Artificial Sequence: Synthetic coding sequence
atggaccccaagggcctgctgagcctgaccttcgtgctgttcctgagcctggccttcggcgccagctacggcaccggcggcagaatgatgaactgccccaagatcctgagacagctgggcagcaaggtgctgctgcccctgacctacgagagaatcaacaagagcatgaacaagagcatccacatcgtggtgaccatggccaagagcctggagaacagcgtggagaacaagatcgtgagcctggaccccagcgaggccggcccccccagatacctgggcgacagatacaagttctacctggagaacctgaccctgggcatcagagagagcagaaaggaggacgagggctggtacctgatgaccctggagaagaacgtgagcgtgcagagattctgcctgcagctgagactgtacgagcaggtgagcacccccgagatcaaggtgctgaacaagacccaggagaacggcacctgcaccctgatcctgggctgcaccgtggagaagggcgaccacgtggcctacagctggagcgagaaggccggcacccaccccctgaaccccgccaacagcagccacctgctgagcctgaccctgggcccccagcacgccgacaacatctacatctgcaccgtgagcaaccccatcagcaacaacagccagaccttcagcccctggcccggctgcagaaccgaccccagcgagaccaagccctgggccgtgtacgccggcctgctgggcggcgtgatcatgatcctgatcatggtggtgatcctgcagctgagaagaagagccagcagcgaggagacctag

SEQ ID NO: 99008 - DNA, 1029 bp, Artificial Sequence
  Description of Artificial Sequence: Synthetic coding sequence
atgtgcagcaccatgagcgcccccacctgcctggcccacctgcccccctgcttcctgctgctggccctggtgctggtgcccagcgacgccagcggccagagcagcagaaacgactggcaggtgctgcagcccgagggccccatgctggtggccgagggcgagaccctgctgctgagatgcatggtggtgggcagctgcaccgacggcatgatcaagtgggtgaaggtgagcacccaggaccagcaggagatctacaacttcaagagaggcagcttccccggcgtgatgcccatgatccagagaaccagcgagcccctgaactgcgactacagcatctacatccacaacgtgaccagagagcacaccggcacctaccactgcgtgagattcgacggcctgagcgagcacagcgagatgaagagcgacgagggcaccagcgtgctggtgaagggcgccggcgaccccgagcccgacctgtggatcatccagccccaggagctggtgctgggcaccaccggcgacaccgtgttcctgaactgcaccgtgctgggcgacggcccccccggccccatcagatggttccagggcgccggcctgagcagagaggccatctacaacttcggcggcatcagccaccccaaggagaccgccgtgcaggccagcaacaacgacttcagcatcctgctgcagaacgtgagcagcgaggacgccggcacctactactgcgtgaagttccagagaaagcccaacagacagtacctgagcggccagggcaccagcctgaaggtgaaggccaagagcaccagcagcaaggaggccgagttcaccagcgagcccgccaccgagatgagccccaccggcctgctggtggtgttcgcccccgtggtgctgggcctgaaggccatcaccctggccgccctgctgctggccctggccaccagcagaagaagccccggccaggaggacgtgaagaccaccggccccgccggcgccatgaacaccctggcctggagcaagggccaggagtag

SEQ ID NO: 99009 - DNA, 624 bp, Artificial Sequence
  Description of Artificial Sequence: Synthetic coding sequence
atgtgcagcaccatgagcgcccccacctgcctggcccacctgcccccctgcttcctgctgctggccctggtgctggtgcccagcgacgccagcggccagagcagcagaaacgactggcaggtgctgcagcccgagggccccatgctggtggccgagggcgccggcgaccccgagcccgacctgtggatcatccagccccaggagctggtgctgggcaccaccggcgacaccgtgttcctgaactgcaccgtgctgggcgacggcccccccggccccatcagatggttccagggcgccggcctgagcagagaggccatctacaacttcggcggcatcagccaccccaaggagaccgccgtgcaggccagcaacaacgacttcagcatcctgctgcagaacgtgagcagcgaggacgccggcacctactactgcgtgaagttccagagaaagcccaacagacagtacctgagcggccagggcaccagcctgaaggtgaaggagcagaacctgcccctgcccaagagacagaacagccccgtgaacctgcagctgagatgcctgcagcaggtgagcgtgcccaccagcgtggagagcatgagccccccccaggccagaggcccctag

SEQ ID NO: 99010 - DNA, 624 bp, Artificial Sequence; identical to SEQ ID NO: 99009
  Description of Artificial Sequence: Synthetic coding sequence

SEQ ID NO: 99011 - DNA, 735 bp, Artificial Sequence
  Description of Artificial Sequence: Synthetic coding sequence
atgtgcagcaccatgagcgcccccacctgcctggcccacctgcccccctgcttcctgctgctggccctggtgctggtgcccagcgacgccagcggccagagcagcagaaacgactggcaggtgctgcagcccgagggccccatgctggtggccgagggcgccggcgaccccgagcccgacctgtggatcatccagccccaggagctggtgctgggcaccaccggcgacaccgtgttcctgaactgcaccgtgctgggcgacggcccccccggccccatcagatggttccagggcgccggcctgagcagagaggccatctacaacttcggcggcatcagccaccccaaggagaccgccgtgcaggccagcaacaacgacttcagcatcctgctgcagaacgtgagcagcgaggacgccggcacctactactgcgtgaagttccagagaaagcccaacagacagtacctgagcggccagggcaccagcctgaaggtgaaggccaagagcaccagcagcaaggaggccgagttcaccagcgagcccgccaccgagatgagccccaccggcctgctggtggtgttcgcccccgtggtgctgggcctgaaggccatcaccctggccgccctgctgctggccctggccaccagcagaagaagccccggccaggaggacgtgaagaccaccggccccgccggcgccatgaacaccctggcctggagcaagggccaggagtag

SEQ ID NO: 99012 - DNA, 633 bp, Artificial Sequence
  Description of Artificial Sequence: Synthetic coding sequence
atgaagagcgacgagggcaccagcgtgctggtgaagggcgccggcgaccccgagcccgacctgtggatcatccagccccaggagctggtgctgggcaccaccggcgacaccgtgttcctgaactgcaccgtgctgggcgacggcccccccggccccatcagatggttccagggcgccggcctgagcagagaggccatctacaacttcggcggcatcagccaccccaaggagaccgccgtgcaggccagcaacaacgacttcagcatcctgctgcagaacgtgagcagcgaggacgccggcacctactactgcgtgaagttccagagaaagcccaacagacagtacctgagcggccagggcaccagcctgaaggtgaaggccaagagcaccagcagcaaggaggccgagttcaccagcgagcccgccaccgagatgagccccaccggcgagagaacccacctgagcggcgtgaacgagagccccaccggcaagggcgccatgaacggcctggtgatgggcagagagcagagccagacccccggcgccaacctgccccccagaatgctgcccggcctgcacctgaactgcagaaccagaacccccgagaaccacgtgatcaccgcccagctgtag

SEQ ID NO: 99013 - DNA, 2046 bp, Artificial Sequence
  Description of Artificial Sequence: Synthetic coding sequence
atgaacgccagcagcgagggcgagagcttcgccggcagcgtgcagatccccggcggcaccaccgtgctggtggagctgacccccgacatccacatctgcggcatctgcaagcagcagttcaacaacctggacgccttcgtggcccacaagcagagcggctgccagctgaccggcaccagcgccgccgcccccagcaccgtgcagttcgtgagcgaggagaccgtgcccgccacccagacccagaccaccaccagaaccatcaccagcgagacccagaccatcaccgtgagcgcccccgagttcgtgttcgagcacggctaccagacctacctgcccaccgagagcaacgagaaccagaccgccaccgtgatcagcctgcccgccaagagcagaaccaagaagcccaccaccccccccgcccagaagagactgaactgctgctaccccggctgccagttcaagaccgcctacggcatgaaggacatggagagacacctgaagatccacaccggcgacaagccccacaagtgcgaggtgtgcggcaagtgcttcagcagaaaggacaagctgaagacccacatgagatgccacaccggcgtgaagccctacaagtgcaagacctgcgactacgccgccgccgacagcagcagcctgaacaagcacctgagaatccacagcgacgagagacccttcaagtgccagatctgcccctacgccagcagaaacagcagccagctgaccgtgcacctgagaagccacaccggcgacgcccccttccagtgctggctgtgcagcgccaagttcaagatcagcagcgacctgaagagacacatgagagtgcacagcggcgagaagcccttcaagtgcgagttctgcaacgtgagatgcaccatgaagggcaacctgaagagccacatcagaatcaagcacagcggcaacaacttcaagtgcccccactgcgacttcctgggcgacagcaaggccaccctgagaaagcacagcagagtgcaccagagcgagcaccccgagaagtgcagcgagtgcagctacagctgcagcagcaaggccgccctgagaatccacgagagaatccactgcaccgacagacccttcaagtgcaactactgcagcttcgacaccaagcagcccagcaacctgagcaagcacatgaagaagttccacggcgacatggtgaagaccgaggccctggagagaaaggacaccggcagacagagcagcagacaggtggccaagctggacgccaagaagagcttccactgcgacatctgcgacgccagcttcatgagagaggacagcctgagaagccacaagagacagcacagcgagtacagcgagagcaagaacagcgacgtgaccgtgctgcagttccagatcgaccccagcaagcagcccgccacccccctgaccgtgggccacctgcaggtgcccctgcagcccagccaggtgccccagttcagcgagggcagagtgaagatcatcgtgggccaccaggtgccccaggccaacaccatcgtgcaggccgccgccgccgccgtgaacatcgtgccccccgccctggtggcccagaaccccgaggagctgcccggcaacagcagactgcagatcctgagacaggtgagcctgatcgcccccccccagagcagcagatgccccagcgaggccggcgccatgacccagcccgccgtgctgctgaccacccacgagcagaccgacggcgccaccctgcaccagaccctgatccccaccgccagcggcggcccccaggagggcagcggcaaccagaccttcatcaccagcagcggcatcacctgcaccgacttcgagggcctgaacgccctgatccaggagggcaccgccgaggtgaccgtggtgagcgacggcggccagaacatcgccgtggccaccaccgccccccccgtgttcagcagcagcagccagcaggagctgcccaagcagacctacagcatcatccagggcgccgcccaccccgccctgctgtgccccgccgacagcatccccgactag

SEQ ID NO: 99014 - DNA, 1164 bp, Artificial Sequence
  Description of Artificial Sequence: Synthetic coding sequence
atgcccgtgcccgccagctggccccacccccccggccccttcctgctgctgaccctgctgctgggcctgaccgaggtggccggcgaggaggagctgcagatgatccagcccgagaagctgctgctggtgaccgtgggcaagaccgccaccctgcactgcaccgtgaccagcctgctgcccgtgggccccgtgctgtggttcagaggcgtgggccccggcagagagctgatctacaaccagaaggagggccacttccccagagtgaccaccgtgagcgacctgaccaagagaaacaacatggacttcagcatcagaatcagcagcatcacccccgccgacgtgggcacctactactgcgtgaagttcagaaagggcagccccgagaacgtggagttcaagagcggccccggcaccgagatggccctgggcgccaagcccagcgcccccgtggtgctgggccccgccgccagaaccacccccgagcacaccgtgagcttcacctgcgagagccacggcttcagccccagagacatcaccctgaagtggttcaagaacggcaacgagctgagcgacttccagaccaacgtggaccccaccggccagagcgtggcctacagcatcagaagcaccgccagagtggtgctggacccctgggacgtgagaagccaggtgatctgcgaggtggcccacgtgaccctgcagggcgaccccctgagaggcaccgccaacctgagcgaggccatcagagtgccccccaccctggaggtgacccagcagcccatgagagtgggcaaccaggtgaacgtgacctgccaggtgagaaagttctacccccagagcctgcagctgacctggagcgagaacggcaacgtgtgccagagagagaccgccagcaccctgaccgagaacaaggacggcacctacaactggaccagctggttcctggtgaacatcagcgaccagagagacgacgtggtgctgacctgccaggtgaagcacgacggccagctggccgtgagcaagagactggccctggaggtgaccgtgcaccagaaggaccagagcagcgacgccacccccggccccgccagcagcctgaccgccctgctgctgatcgccgtgctgctgggccccatctacgtgccctggaagcagaagacctag

SEQ ID NO: 99015 - DNA, 513 bp, Artificial Sequence
  Description of Artificial Sequence: Synthetic coding sequence
atgcccgtgcccgccagctggccccacccccccggccccttcctgctgctgaccctgctgctgggcctgaccgaggtggccggcgaggaggagctgcagatgatccagcccgagaagctgctgctggtgaccgtgggcaagaccgccaccctgcactgcaccgtgaccagcctgctgcccgtgggccccgtgctgtggttcagaggcgtgggccccggcagagagctgatctacaaccagaaggagggccacttccccagagtgaccaccgtgagcgacctgaccaagagaaacaacatggacttcagcatcagaatcagcagcatcacccccgccgacgtgggcacctactactgcgtgaagttcagaaagggcagccccgagaacgtggagttcaagagcggccccggcaccgagatggccctgggcggccccgccagcagcctgaccgccctgctgctgatcgccgtgctgctgggccccatctacgtgccctggaagcagaagacctag

SEQ ID NO: 99016 - DNA, 1065 bp, Artificial Sequence
  Description of Artificial Sequence: Synthetic coding sequence
atgatccagcccgagaagctgctgctggtgaccgtgggcaagaccgccaccctgcactgcaccgtgaccagcctgctgcccgtgggccccgtgctgtggttcagaggcgtgggccccggcagagagctgatctacaaccagaaggagggccacttccccagagtgaccaccgtgagcgacctgaccaagagaaacaacatggacttcagcatcagaatcagcagcatcacccccgccgacgtgggcacctactactgcgtgaagttcagaaagggcagccccgagaacgtggagttcaagagcggccccggcaccgagatggccctgggcgccaagcccagcgcccccgtggtgctgggccccgccgccagaaccacccccgagcacaccgtgagcttcacctgcgagagccacggcttcagccccagagacatcaccctgaagtggttcaagaacggcaacgagctgagcgacttccagaccaacgtggaccccaccggccagagcgtggcctacagcatcagaagcaccgccagagtggtgctggacccctgggacgtgagaagccaggtgatctgcgaggtggcccacgtgaccctgcagggcgaccccctgagaggcaccgccaacctgagcgaggccatcagagtgccccccaccctggaggtgacccagcagcccatgagagtgggcaaccaggtgaacgtgacctgccaggtgagaaagttctacccccagagcctgcagctgacctggagcgagaacggcaacgtgtgccagagagagaccgccagcaccctgaccgagaacaaggacggcacctacaactggaccagctggttcctggtgaacatcagcgaccagagagacgacgtggtgctgacctgccaggtgaagcacgacggccagctggccgtgagcaagagactggccctggaggtgaccgtgcaccagaaggaccagagcagcgacgccacccccggccccgccagcagcctgaccgccctgctgctgatcgccgtgctgctgggccccatctacgtgccctggaagcagaagacctag

SEQ ID NO: 99017 - DNA, 831 bp, Artificial Sequence; identical to SEQ ID NO: 83331
  Description of Artificial Sequence: Synthetic coding sequence

SEQ ID NO: 99018 - DNA, 1386 bp, Artificial Sequence
  Description of Artificial Sequence: Synthetic coding sequence
atggccccccagagcctgcccagcagcagaatggcccccctgggcatgctgctgggcctgctgatggccgcctgcttcaccttctgcctgagccaccagaacctgaaggagttcgccctgaccaaccccgagaagagcagcaccaaggagaccgagagaaaggagaccaaggccgaggaggagctggacgccgaggtgctggaggtgttccaccccacccacgagtggcaggccctgcagcccggccaggccgtgcccgccggcagccacgtgagactgaacctgcagaccggcgagagagaggccaagctgcagtacgaggacaagttcagaaacaacctgaagggcaagagactggacatcaacaccaacacctacaccagccaggacctgaagagcgccctggccaagttcaaggagggcgccgagatggagagcagcaaggaggacaaggccagacaggccgaggtgaagagactgttcagacccatcgaggagctgaagaaggacttcgacgagctgaacgtggtgatcgagaccgacatgcagatcatggtgagactgatcaacaagttcaacagcagcagcagcagcctggaggagaagatcgccgccctgttcgacctggagtactacgtgcaccagatggacaacgcccaggacctgctgagcttcggcggcctgcaggtggtgatcaacggcctgaacagcaccgagcccctggtgaaggagtacgccgccttcgtgctgggcgccgccttcagcagcaaccccaaggtgcaggtggaggccatcgagggcggcgccctgcagaagctgctggtgatcctggccaccgagcagcccctgaccgccaagaagaaggtgctgttcgccctgtgcagcctgctgagacacttcccctacgcccagagacagttcctgaagctgggcggcctgcaggtgctgagaaccctggtgcaggagaagggcaccgaggtgctggccgtgagagtggtgaccctgctgtacgacctggtgaccgagaagatgttcgccgaggaggaggccgagctgacccaggagatgagccccgagaagctgcagcagtacagacaggtgcacctgctgcccggcctgtgggagcagggctggtgcgagatcaccgcccacctgctggccctgcccgagcacgacgccagagagaaggtgctgcagaccctgggcgtgctgctgaccacctgcagagacagatacagacaggacccccagctgggcagaaccctggccagcctgcaggccgagtaccaggtgctggccagcctggagctgcaggacggcgaggacgagggctacttccaggagctgctgggcagcgtgaacagcctgctgaaggagctgagatag

SEQ ID NO: 99019 - DNA, 1386 bp, Artificial Sequence; identical to SEQ ID NO: 99018
  Description of Artificial Sequence: Synthetic coding sequence

SEQ ID NO: 99020 - DNA, 288 bp, Artificial Sequence
  Description of Artificial Sequence: Synthetic coding sequence
atggccccccagagcctgcccagcagcagaatggcccccctgggcatgctgctgggcctgctgatggccgcctgcttcaccttctgcctgagccaccagaacctgaaggagttcgccctgaccaaccccgagaagagcagcaccaaggagaccgagagaaaggagaccaaggccgaggaggagctggacgccgaggtgctggaggtgttccaccccacccacgagtggcaggccctgcagcccggccaggccgtgcccgccggcagccacgtgagactgaacctgtag

SEQ ID NO: 99021 - DNA, 492 bp, Artificial Sequence
  Description of Artificial Sequence: Synthetic coding sequence
atggccccccagagcctgcccagcagcagaatggcccccctgggcatgctgctgggcctgctgatggccgcctgcttcaccttctgcctgagccaccagaacctgaaggagttcgccctgaccaaccccgagaagagcagcaccaaggagaccgagagaaaggagaccaaggccgaggaggagctggacgccgaggtgctggaggtgttccaccccacccacgagtggcaggccctgcagcccggccaggccgtgcccgccggcagccacgtgagactgaacctgcagaccggcgagagagaggccaagctgcagtacgaggacaagttcagaaacaacctgaagggcaagagactggacatcaacaccaacacctacaccagccaggacctgaagagcgccctggccaagttcaaggagggcgccgagatggagagcagcaaggaggacaaggccagacaggccgaggtgaagagactgttcagaccctag

SEQ ID NO: 99022 - DNA, 372 bp, Artificial Sequence
  Description of Artificial Sequence: Synthetic coding sequence
atggccccccagagcctgcccagcagcagaatggcccccctgggcatgctgctgggcctgctgatggccgcctgcttcaccttctgcctgagccaccagaacctgaaggagttcgccctgaccaaccccgagaagagcagcaccaaggagaccgagagaaaggagaccaaggccgaggaggagctggacgccgaggtgctggaggtgttccaccccacccacgagtggcaggccctgcagcccggccaggccgtgcccgccggcagccacgtgagactgaacctgcagaccggcgagagagaggccaagctgcagtacgaggacaagttcagaaacaacctgaagggcaagagactggacatcaacacctag

SEQ ID NO: 99023 - DNA, 579 bp, Artificial Sequence
  Description of Artificial Sequence: Synthetic coding sequence
atggccgcctgcttcaccttctgcctgagccaccagaacctgaaggagttcgccctgaccaaccccgagaagagcagcaccaaggagaccgagagaaaggagaccaaggccgaggaggagctggacgccgaggtgctggaggtgttccaccccacccacgagtggcaggccctgcagcccggccaggccgtgcccgccggcagccacgtgagactgaacctgcagaccggcgagagagaggccaagctgcagtacgaggacaagttcagaaacaacctgaagggcaagagactggacatcaacaccaacacctacaccagccaggacctgaagagcgccctggccaagttcaaggagggcgccgagatggagagcagcaaggaggacaagatggacaacgcccaggacctgctgagcttcggcggcctgcaggtggtgatcaacggcctgaacagcaccgagcccctggtgaaggagtacgccgccttcgtgctgggcgccgccttcagcagcaaccccaaggtgcaggtggaggccatcgagggcggcgccctgcagaagctgctggtgatcctgtag

SEQ ID NO: 99024 - DNA, 3822 bp, Artificial Sequence
  Description of Artificial Sequence: Synthetic coding sequence
atgaagagaagactggacgaccaggagagccccgtgtacgccgcccagcagagaagaatccccggcagcaccgaggccttcccccaccagcacagagtgctggcccccgccccccccgtgtacgaggccgtgagcgagaccatgcagagcgccaccggcatccagtacagcgtgacccccagctaccaggtgagcgccatgccccagagcagcggcagccacggccccgccatcgccgccgtgcacagcagccaccaccaccccaccgccgtgcagccccacggcggccaggtggtgcagagccacgcccaccccgccccccccgtggcccccgtgcagggccagcagcagttccagagactgaaggtggaggacgccctgagctacctggaccaggtgaagctgcagttcggcagccagccccaggtgtacaacgacttcctggacatcatgaaggagttcaagagccagagcatcgacacccccggcgtgatcagcagagtgagccagctgttcaagggccaccccgacctgatcatgggcttcaacaccttcctgccccccggctacaagatcgaggtgcagaccaacgacatggtgaacgtgaccacccccggccaggtgcaccagatccccacccacggcatccagccccagccccagccccccccccagcaccccagccagcccagcgcccagagcgcccccgcccccgcccagcccgccccccagcccccccccgccaaggtgagcaagcccagccagctgcaggcccacacccccgccagccagcagaccccccccctgcccccctacgccagccccagaagcccccccgtgcagccccacacccccgtgaccatcagcctgggcaccgcccccagcctgcagaacaaccagcccgtggagttcaaccacgccatcaactacgtgaacaagatcaagaacagattccagggccagcccgacatctacaaggccttcctggagatcctgcacacctaccagaaggagcagagaaacgccaaggaggccggcggcaactacacccccgccctgaccgagcaggaggtgtacgcccaggtggccagactgttcaagaaccaggaggacctgctgagcgagttcggccagttcctgcccgacgccaacagcagcgtgctgctgagcaagaccaccgccgagaaggtggacagcgtgagaaacgaccacggcggcaccgtgaagaagccccagctgaacaacaagccccagagacccagccagaacggctgccagatcagaagacaccccaccggcaccaccccccccgtgaagaagaagcccaagctgctgaacctgaaggacagcagcatggccgacgccagcaagcacggcggcggcaccgagagcctgttcttcgacaaggtgagaaaggccctgagaagcgccgaggcctacgagaacttcctgagatgcctggtgatcttcaaccaggaggtgatcagcagagccgagctggtgcagctggtgagccccttcctgggcaagttccccgagctgttcaactggttcaagaacttcctgggctacaaggagagcgtgcacctggagacctaccccaaggagagagccaccgagggcatcgccatggagatcgactacgccagctgcaagagactgggcagcagctacagagccctgcccaagagctaccagcagcccaagtgcaccggcagaacccccctgtgcaaggaggtgctgaacgacacctgggtgagcttccccagctggagcgaggacagcaccttcgtgagcagcaagaagacccagtacgaggagcacatctacagatgcgaggacgagagattcgagctggacgtggtgctggagaccaacctggccaccatcagagtgctggaggccatccagaagaagctgagcagactgagcgccgaggagcaggccaagttcagactggacaacaccctgggcggcaccagcgaggtgatccacagaaaggccctgcagagaatctacgccgacaaggccgccgacatcatcgacggcctgagaaagaaccccagcatcgccgtgcccatcgtgctgaagagactgaagatgaaggaggaggagtggagagaggcccagagaggcttcaacaaggtgtggagagagcagaacgagaagtactacctgaagagcctggaccaccagggcatcaacttcaagcagaacgacaccaaggtgctgagaagcaagagcctgctgaacgagatcgagagcatctacgacgagagacaggagcaggccaccgaggagaacgccggcgtgcccgtgggcccccacctgagcctggcctacgaggacaagcagatcctggaggacgccgccgccctgatcatccaccacgtgaagagacagaccggcatccagaaggaggacaagtacaagatcaagcagatcatgcaccacttcatccccgacctgctgttcgcccagagaggcgacctgagcgacgtggaggaggaggaggaggaggagatggacgtggacgaggccaccggcgccgtgaagaagcacaacggcgtgggcggcagcccccccaagagcaagctgctgttcagcaacaccgccgcccagaagctgagaggcatggacgaggtgtacaacctgttctacgtgaacaacaactggtacatcttcatgagactgcaccagatcctgtgcctgagactgctgagaatctgcagccaggccgagagacagatcgaggaggagaacagagagagagagtgggagagagaggtgctgggcatcaagagagacaagagcgacagccccgccatccagctgagactgaaggagcccatggacgtggacgtggaggactactaccccgccttcctggacatggtgagaagcctgctggacggcaacatcgacagcagccagtacgaggacagcctgagagagatgttcaccatccacgcctacatcgccttcaccatggacaagctgatccagagcatcgtgagacagctgcagcacatcgtgagcgacgagatctgcgtgcaggtgaccgacctgtacctggccgagaacaacaacggcgccaccggcggccagctgaacacccagaacagcagaagcctgctggagagcacctaccagagaaaggccgagcagctgatgagcgacgagaactgcttcaagctgatgttcatccagagccagggccaggtgcagctgaccatcgagctgctggacaccgaggaggagaacagcgacgaccccgtggaggccgagagatggagcgactacgtggagagatacatgaacagcgacaccaccagccccgagctgagagagcacctggcccagaagcccgtgttcctgcccagaaacctgagaagaatcagaaagtgccagagaggcagagagcagcaggagaaggagggcaaggagggcaacagcaagaagaccatggagaacgtggacagcctggacaagctggagtgcagattcaagctgaacagctacaagatggtgtacgtgatcaagagcgaggactacatgtacagaagaaccgccctgctgagagcccaccagagccacgagagagtgagcaagagactgcaccagagattccaggcctgggtggacaagtggaccaaggagcacgtgcccagagagatggccgccgagaccagcaagtggctgatgggcgagggcctggagggcctggtgccctgcaccaccacctgcgacaccgagaccctgcacttcgtgagcatcaacaagtacagagtgaagtacggcaccgtgttcaaggccccctag

SEQ ID NO: 99025 - DNA, 3822 bp, Artificial Sequence; identical to SEQ ID NO: 99024
  Description of Artificial Sequence: Synthetic coding sequence

SEQ ID NO: 99026 - DNA, 3822 bp, Artificial Sequence; identical to SEQ ID NO: 99024
  Description of Artificial Sequence: Synthetic coding sequence

SEQ ID NO: 99027 - DNA, 3393 bp, Artificial Sequence
  Description of Artificial Sequence: Synthetic coding sequence
atggcccacgccggcggcggcagcggcggcagcggcgccggcggccccgccggcagaggcctgagcggcgccagatggggcagaagcggcagcgccggccacgagaagctgcccgtgcacgtggaggacgccctgacctacctggaccaggtgaagatcagattcggcagcgaccccgccacctacaacggcttcctggagatcatgaaggagttcaagagccagagcatcgacacccccggcgtgatcagaagagtgagccagctgttccacgagcaccccgacctgatcgtgggcttcaacgccttcctgcccctgggctacagaatcgacatccccaagaacggcaagctgaacatccagagccccctgaccagccaggagaacagccacaaccacggcgacggcgccgaggacttcaagcagcaggtgccctacaaggaggacaagccccaggtgcccctggagagcgacagcgtggagttcaacaacgccatcagctacgtgaacaagatcaagaccagattcctggaccaccccgagatctacagaagcttcctggagatcctgcacacctaccagaaggagcagctgaacaccagaggcagacccttcagaggcatgagcgaggaggaggtgttcaccgaggtggccaacctgttcagaggccaggaggacctgctgagcgagttcggccagttcctgcccgaggccaagagaagcctgttcaccggcaacggcccctgcgagatgcacagcgtgcagaagaacgagcacgacaagacccccgagcacagcagaaagagaagcagacccagcctgctgagacccgtgagcgcccccgccaagaagaagatgaagctgagaggcaccaaggacctgagcatcgccgccgtgggcaagtacggcaccctgcaggagttcagcttcttcgacaaggtgagaagagtgctgaagagccaggaggtgtacgagaacttcctgagatgcatcgccctgttcaaccaggagctggtgagcggcagcgagctgctgcagctggtgagccccttcctgggcaagttccccgagctgttcgcccagttcaagagcttcctgggcgtgaaggagctgagcttcgccccccccatgagcgacagaagcggcgacggcatcagcagagagatcgactacgccagctgcaagagaatcggcagcagctacagagccctgcccaagacctaccagcagcccaagtgcagcggcagaaccgccatctgcaaggaggtgctgaacgacacctgggtgagcttccccagctggagcgaggacagcaccttcgtgagcagcaagaagaccccctacgaggagcagctgcacagatgcgaggacgagagattcgagctggacgtggtgctggagaccaacctggccaccatcagagtgctggagagcgtgcagaagaagctgagcagaatggcccccgaggaccaggagaagttcagactggacgacagcctgggcggcaccagcgaggtgatccagagaagagccatctacagaatctacggcgacaaggcccccgagatcatcgagagcctgaagaagaaccccgtgaccgccgtgcccgtggtgctgaagagactgaaggccaaggaggaggagtggagagaggcccagcagggcttcaacaagatctggagagagcagtacgagaaggcctacctgaagagcctggaccaccaggccgtgaacttcaagcagaacgacaccaaggccctgagaagcaagagcctgctgaacgagatcgagagcgtgtacgacgagcaccaggagcagcacagcgagggcagaagcgcccccagcagcgagccccacctgatcttcgtgtacgaggacagacagatcctggaggacgccgccgccctgatcagctactacgtgaagagacagcccgccatccagaaggaggaccagggcaccatccaccagctgctgcaccagttcgtgcccagcctgttcttcagccagcagctggacctgggcgccagcgaggagagcgccgacgaggacagagacagcccccagggccagaccaccgaccccagcgagagaaagaagcccgcccccggcccccacagcagcccccccgaggagaagggcgccttcggcgacgcccccgccaccgagcagccccccctgcccccccccgccccccacaagcccctggacgacgtgtacagcctgttcttcgccaacaacaactggtacttcttcctgagactgcaccagaccctgtgcagcagactgctgaagatctacagacaggcccagaagcagctgctggagtacagaaccgagaaggagagagagaagctgctgtgcgagggcagaagagagaagggcagcgaccccgccatggagctgagactgaagcagcccagcgaggtggagctggaggagtactaccccgccttcctggacatggtgagaagcctgctggagggcagcatcgaccccacccagtacgaggacaccctgagagagatgttcaccatccacgcctacgtgggcttcaccatggacaagctggtgcagaacatcgccagacagctgcaccacctggtgagcgacgacgtgtgcctgaaggtggtggagctgtacctgaacgagaagaagagaggcgccgccggcggcaacctgagcagcagatgcgtgagagccgccagagagaccagctaccagtggaaggccgagagatgcatggccgacgagaactgcttcaaggtgatgttcctgcagagaaagggccaggtgatcatgaccatcgagctgctggacaccgaggaggcccagaccgaggaccccgtggaggtgcagcacctggccagatacgtggagcagtacgtgggcaccgagggcgccagcagcagccccaccgagggcttcctgctgaagcccgtgttcctgcagagaaacctgaagaagttcagaagaagatggcagagcgagcaggccagagccctgagaggcgaggccagaagcagctggaagagactggtgggcgtggagagcgcctgcgacgtggactgcagattcaagctgagcacccacaagatggtgttcatcgtgaacagcgaggactacatgtacagaagaggcaccctgtgcagagccaagcaggtgcagcccctggtgctgctgagacaccaccagcacttcgaggagtggcacagcagatggctggaggacaacgtgaccgtggaggccgccagcctggtgcaggactggctgatgggcgaggaggacgaggacatggtgccctgcaagaccctgtgcgagaccgtgcacgtgcacggcctgcccgtgaccagatacagagtgcagtacagcagaagacccgccagcccctag

SEQ ID NO: 99028 - DNA, 3489 bp, Artificial Sequence
  Description of Artificial Sequence: Synthetic coding sequence
atggcccacgccggcggcggcagcggcggcagcggcgccggcggccccgccggcagaggcctgagcggcgccagatggggcagaagcggcagcgccggccacgagaagctgcccgtgcacgtggaggacgccctgacctacctggaccaggtgaagatcagattcggcagcgaccccgccacctacaacggcttcctggagatcatgaaggagttcaagagccagagcatcgacacccccggcgtgatcagaagagtgagccagctgttccacgagcaccccgacctgatcgtgggcttcaacgccttcctgcccctgggctacagaatcgacatccccaagaacggcaagctgaacatccagagccccctgaccagccaggagaacagccacaaccacggcgacggcgccgaggacttcaagcagcaggtgccctacaaggaggacaagccccaggtgcccctggagagcgacagcgtggagttcaacaacgccatcagctacgtgaacaagatcaagaccagattcctggaccaccccgagatctacagaagcttcctggagatcctgcacacctaccagaaggagcagctgaacaccagaggcagacccttcagaggcatgagcgaggaggaggtgttcaccgaggtggccaacctgttcagaggccaggaggacctgctgagcgagttcggccagttcctgcccgaggccaagagaagcctgttcaccggcaacggcccctgcgagatgcacagcgtgcagaagaacgagcacgacaagacccccgagcacagcagaaagagaagcagacccagcctgctgagacccgtgagcgcccccgccaagaagaagatgaagctgagaggcaccaaggacctgagcatcgccgccgtgggcaagtacggcaccctgcaggagttcagcttcttcgacaaggtgagaagagtgctgaagagccaggaggtgtacgagaacttcctgagatgcatcgccctgttcaaccaggagctggtgagcggcagcgagctgctgcagctggtgagccccttcctgggcaagttccccgagctgttcgcccagttcaagagcttcctgggcgtgaaggagctgagcttcgccccccccatgagcgacagaagcggcgacggcatcagcagagagatcgactacgccagctgcaagagaatcggcagcagctacagagccctgcccaagacctaccagcagcccaagtgcagcggcagaaccgccatctgcaaggagctggaccactggaccctgctgcagggcagctggaccgacgactactgcatgagcaagttcaagaacacctgctggatccccggctacagcgccggcgtgctgaacgacacctgggtgagcttccccagctggagcgaggacagcaccttcgtgagcagcaagaagaccccctacgaggagcagctgcacagatgcgaggacgagagattcgagctggacgtggtgctggagaccaacctggccaccatcagagtgctggagagcgtgcagaagaagctgagcagaatggcccccgaggaccaggagaagttcagactggacgacagcctgggcggcaccagcgaggtgatccagagaagagccatctacagaatctacggcgacaaggcccccgagatcatcgagagcctgaagaagaaccccgtgaccgccgtgcccgtggtgctgaagagactgaaggccaaggaggaggagtggagagaggcccagcagggcttcaacaagatctggagagagcagtacgagaaggcctacctgaagagcctggaccaccaggccgtgaacttcaagcagaacgacaccaaggccctgagaagcaagagcctgctgaacgagatcgagagcgtgtacgacgagcaccaggagcagcacagcgagggcagaagcgcccccagcagcgagccccacctgatcttcgtgtacgaggacagacagatcctggaggacgccgccgccctgatcagctactacgtgaagagacagcccgccatccagaaggaggaccagggcaccatccaccagctgctgcaccagttcgtgcccagcctgttcttcagccagcagctggacctgggcgccagcgaggagagcgccgacgaggacagagacagcccccagggccagaccaccgaccccagcgagagaaagaagcccgcccccggcccccacagcagcccccccgaggagaagggcgccttcggcgacgcccccgccaccgagcagccccccctgcccccccccgccccccacaagcccctggacgacgtgtacagcctgttcttcgccaacaacaactggtacttcttcctgagactgcaccagaccctgtgcagcagactgctgaagatctacagacaggcccagaagcagctgctggagtacagaaccgagaaggagagagagaagctgctgtgcgagggcagaagagagaagggcagcgaccccgccatggagctgagactgaagcagcccagcgaggtggagctggaggagtactaccccgccttcctggacatggtgagaagcctgctggagggcagcatcgaccccacccagtacgaggacaccctgagagagatgttcaccatccacgcctacgtgggcttcaccatggacaagctggtgcagaacatcgccagacagctgcaccacctggtgagcgacgacgtgtgcctgaaggtggtggagctgtacctgaacgagaagaagagaggcgccgccggcggcaacctgagcagcagatgcgtgagagccgccagagagaccagctaccagtggaaggccgagagatgcatggccgacgagaactgcttcaaggtgatgttcctgcagagaaagggccaggtgatcatgaccatcgagctgctggacaccgaggaggcccagaccgaggaccccgtggaggtgcagcacctggccagatacgtggagcagtacgtgggcaccgagggcgccagcagcagccccaccgagggcttcctgctgaagcccgtgttcctgcagagaaacctgaagaagttcagaagaagatggcagagcgagcaggccagagccctgagaggcgaggccagaagcagctggaagagactggtgggcgtggagagcgcctgcgacgtggactgcagattcaagctgagcacccacaagatggtgttcatcgtgaacagcgaggactacatgtacagaagaggcaccctgtgcagagccaagcaggtgcagcccctggtgctgctgagacaccaccagcacttcgaggagtggcacagcagatggctggaggacaacgtgaccgtggaggccgccagcctggtgcaggactggctgatgggcgaggaggacgaggacatggtgccctgcaagaccctgtgcgagaccgtgcacgtgcacggcctgcccgtgaccagatacagagtgcagtacagcagaagacccgccagcccctag

SEQ ID NO: 99029 - DNA, 3171 bp, Artificial Sequence
  Description of Artificial Sequence: Synthetic coding sequence
atgagcagccagcagttccccagactgggcgcccccagcaccggcctgagccaggcccccagccagatcgccaacagcggcagcgccggcctgatcaaccccgccgccaccgtgaacgacgagagcggcagagacagcgaggtgagcgccagagagcacatgagcagcagcagcagcctgcagagcagagaggagaagcaggagcccgtggtggtgagaccctacccccaggtgcagatgctgagcacccaccacgccgtggccagcgccacccccgtggccgtgaccgccccccccgcccacctgacccccgccgtgcccctgagcttcagcgagggcctgatgaagcccccccccaagcccaccatgcccagcagacccatcgcccccgccccccccagcaccctgagcctgccccccaaggtgcccggccaggtgaccgtgaccatggagagcagcatcccccaggccagcgccatccccgtggccaccatcagcggccagcagggccaccccagcaacctgcaccacatcatgaccaccaacgtgcagatgagcatcatcagaagcaacgcccccggcccccccctgcacatcggcgccagccacctgcccagaggcgccgccgccgccgccgtgatgagcagcagcaaggtgaccaccgtgctgagacccaccagccagctgcccaacgccgccaccgcccagcccgccgtgcagcacatcatccaccagcccatccagagcagaccccccgtgaccaccagcaacgccatcccccccgccgtggtggccaccgtgagcgccaccagagcccagagccccgtgatcaccaccaccgccgcccacgccaccgacagcgccctgagcagacccaccctgagcatccagcacccccccagcgccgccatcagcatccagagacccgcccagagcagagacgtgaccaccagaatcaccctgcccagccaccccgccctgggcacccccaagcagcagctgcacaccatggcccagaagaccatcttcagcaccggcacccccgtggccgccgccaccgtggcccccatcctggccaccaacaccatccccagcgccaccaccgccggcagcgtgagccacacccaggcccccaccagcaccatcgtgaccatgaccgtgcccagccacagcagccacgccaccgccgtgaccaccagcaacatccccgtggccaaggtggtgccccagcagatcacccacaccagccccagaatccagcccgactaccccgccgagagaagcagcctgatccccatcagcggccacagagccagccccaaccccgtggccatggagaccagaagcgacaacagacccagcgtgcccgtgcagttccagtacttcctgcccacctacccccccagcgcctaccccctggccgcccacacctacacccccatcaccagcagcgtgagcaccatcagacagtaccccgtgagcgcccaggcccccaacagcgccatcaccgcccagaccggcgtgggcgtggccagcaccgtgcacctgaaccccatgcagctgatgaccgtggacgccagccacgccagacacatccagggcatccagcccgcccccatcagcacccagggcatccagcccgcccccatcggcacccccggcatccagcccgcccccctgggcacccagggcatccacagcgccacccccatcaacacccagggcctgcagcccgcccccatgggcacccagcagccccagcccgagggcaagaccagcgtggtgctggccgacggcgccaccatcgtggccaaccccatcagcaaccccttcagcgccgcccccgccgccaccaccgtggtgcagacccacagccagagcgccagcaccaacgcccccgcccagggcagcagccccagacccagcatcctgagaaagaagcccgccaccgacggcatggccgtgagaaagaccctgatccccccccagccccccgacgtggccagccccagagtggagagcagcatgagaagcaccagcggcagccccagacccgccggcgccaagcccaagagcgagatccacgtgagcatggccacccccgtgaccgtgagcatggagaccgtgagcaaccagaacaacgaccagcccaccatcgccgtgccccccaccgcccagcagcccccccccaccatccccaccatgatcgccgccgccagcccccccagccagcccgccgtggccctgagcaccatccccggcgccgtgcccatcaccccccccatcaccaccatcgccgccgcccccccccccagcgtgaccgtgggcggcagcctgagcagcgtgctgggcccccccgtgcccgagatcaaggtgaaggaggaggtggagcccatggacatcatgagacccgtgagcgccgtgccccccctggccaccaacaccgtgagccccagcctggccctgctggccaacaacctgagcatgcccaccagcgacctgccccccggcgccagccccagaaagaagcccagaaagcagcagcacgtgatcagcaccgaggagggcgacatgatggagaccaacagcaccgacgacgagaagagcaccgccaagagcctgctggtgaaggccgagaagagaaagagcccccccaaggagtacatcgacgaggagggcgtgagatacgtgcccgtgagacccagaccccccatcaccctgctgagacactacagaaacccctggaaggccgcctaccaccacttccagagatacagcgacgtgagagtgaaggaggagaagaaggccatgctgcaggagatcgccaaccagaagggcgtgagctgcagagcccagggctggaaggtgcacctgtgcgccgcccagctgctgcagctgaccaacctggagcacgacgtgtacgagagactgaccaacctgcaggagggcatcatccccaagaagaaggccgccaccgacgacgacctgcacagaatcaacgagctgatccagggcaacatgcagagatgcaagctggtgatggaccagatcagcgaggccagagacagcatgctgaaggtgctggaccacaaggacagagtgctgaagctgctgaacaagaacggcaccgtgaagaaggtgagcaagctgaagagaaaggagaaggtgtag

SEQ ID NO: 99030 - DNA, 3147 bp, Artificial Sequence
  Description of Artificial Sequence: Synthetic coding sequence
atgggcccccccagacacccccaggccggcgagatcgaggccggcggcgccggcggcggcagaagactgcaggtggagatgagcagccagcagttccccagactgggcgcccccagcaccggcctgagccaggcccccagccagatcgccaacagcggcagcgccggcctgatcaaccccgccgccaccgtgaacgacgagagcggcagagacagcgaggtgagcgccagagagcacatgagcagcagcagcagcctgcagagcagagaggagaagcaggagcccgtggtggtgagaccctacccccaggtgcagatgctgagcacccaccacgccgtggccagcgccacccccgtggccgtgaccgccccccccgcccacctgacccccgccgtgcccctgagcttcagcgagggcctgatgaagcccccccccaagcccaccatgcccagcagacccatcgcccccgccccccccagcaccctgagcctgccccccaaggtgcccggccaggtgaccgtgaccatggagagcagcatcccccaggccagcgccatccccgtggccaccatcagcggccagcagggccaccccagcaacctgcaccacatcatgaccaccaacgtgcagatgagcatcatcagaagcaacgcccccggcccccccctgcacatcggcgccagccacctgcccagaggcgccgccgccgccgccgtgatgagcagcagcaaggtgaccaccgtgctgagacccaccagccagctgcccaacgccgccaccgcccagcccgccgtgcagcacatcatccaccagcccatccagagcagaccccccgtgaccaccagcaacgccatcccccccgccgtggtggccaccgtgagcgccaccagagcccagagccccgtgatcaccaccaccgccgcccacgccaccgacagcgccctgagcagacccaccctgagcatccagcacccccccagcgccgccatcagcatccagagacccgcccagagcagagacgtgaccaccagaatcaccctgcccagccaccccgccctgggcacccccaagcagcagctgcacaccatggcccagaagaccatcttcagcaccggcacccccgtggccgccgccaccgtggcccccatcctggccaccaacaccatccccagcgccaccaccgccggcagcgtgagccacacccaggcccccaccagcaccatcgtgaccatgaccgtgcccagccacagcagccacgccaccgccgtgaccaccagcaacatccccgtggccaaggtggtgccccagcagatcacccacaccagccccagaatccagcccgactaccccgccgagagaagcagcctgatccccatcagcggccacagagccagccccaaccccgtggccatggagaccagaagcgacaacagacccagcgtgcccgtgcagttccagtacttcctgcccacctacccccccagcgcctaccccctggccgcccacacctacacccccatcaccagcagcgtgagcaccatcagacagtaccccgtgagcgcccaggcccccaacagcgccatcaccgcccagaccggcgtgggcgtggccagcaccgtgcacctgaaccccatgcagctgatgaccgtggacgccagccacgccagacacatccagggcatccagcccgcccccatcagcacccagggcatccagcccgcccccatcggcacccccggcatccagcccgcccccctgggcacccagggcatccacagcgccacccccatcaacacccagggcctgcagcccgcccccatgggcacccagcagccccagcccgagggcaagaccagcgccgtggtgctggccgacggcgccaccatcgtggccaaccccatcagcaaccccttcagcgccgcccccgccgccaccaccgtggtgcagacccacagccagagcgccagcaccaacgcccccgcccagggcagcagccccagacccagcatcctgagaaagaagcccgccaccgacggcgccaagcccaagagcgagatccacgtgagcatggccacccccgtgaccgtgagcatggagaccgtgagcaaccagaacaacgaccagcccaccatcgccgtgccccccaccgcccagcagcccccccccaccatccccaccatgatcgccgccgccagcccccccagccagcccgccgtggccctgagcaccatccccggcgccgtgcccatcaccccccccatcaccaccatcgccgccgcccccccccccagcgtgaccgtgggcggcagcctgagcagcgtgctgggcccccccgtgcccgagatcaaggtgaaggaggaggtggagcccatggacatcatgagacccgtgagcgccgtgccccccctggccaccaacaccgtgagccccagcctggccctgctggccaacaacctgagcatgcccaccagcgacctgccccccggcgccagccccagaaagaagcccagaaagcagcagcacgtgatcagcaccgaggagggcgacatgatggagaccaacagcaccgacgacgagaagagcaccgccaagagcctgctggtgaaggccgagaagagaaagagcccccccaaggagtacatcgacgaggagggcgtgagatacgtgcccgtgagacccagaccccccatcaccctgctgagacactacagaaacccctggaaggccgcctaccaccacttccagagatacagcgacgtgagagtgaaggaggagaagaaggccatgctgcaggagatcgccaaccagaagggcgtgagctgcagagcccagggctggaaggtgcacctgtgcgccgcccagctgctgcagctgaccaacctggagcacgacgtgtacgagagactgaccaacctgcaggagggcatcatccccaagaagaaggccgccaccgacgacgacctgcacagaatcaacgagctgatccagggcaacatgcagagatgcaagctggtgatggaccagatcagcgaggccagagacagcatgctgaaggtgctggaccacaaggacagagtgctgaagctgctgaacaagaacggcaccgtgaagaaggtgagcaagctgaagagaaaggagaaggtgtag

SEQ ID NO: 99031 - DNA, 3252 bp, Artificial Sequence
  Description of Artificial Sequence: Synthetic coding sequence
atgggcccccccagacacccccaggccggcgagatcgaggccggcggcgccggcggcggcagaagactgcaggtggagatgagcagccagcagttccccagactgggcgcccccagcaccggcctgagccaggcccccagccagatcgccaacagcggcagcgccggcctgatcaaccccgccgccaccgtgaacgacgagagcggcagagacagcgaggtgagcgccagagagcacatgagcagcagcagcagcctgcagagcagagaggagaagcaggagcccgtggtggtgagaccctacccccaggtgcagatgctgagcacccaccacgccgtggccagcgccacccccgtggccgtgaccgccccccccgcccacctgacccccgccgtgcccctgagcttcagcgagggcctgatgaagcccccccccaagcccaccatgcccagcagacccatcgcccccgccccccccagcaccctgagcctgccccccaaggtgcccggccaggtgaccgtgaccatggagagcagcatcccccaggccagcgccatccccgtggccaccatcagcggccagcagggccaccccagcaacctgcaccacatcatgaccaccaacgtgcagatgagcatcatcagaagcaacgcccccggcccccccctgcacatcggcgccagccacctgcccagaggcgccgccgccgccgccgtgatgagcagcagcaaggtgaccaccgtgctgagacccaccagccagctgcccaacgccgccaccgcccagcccgccgtgcagcacatcatccaccagcccatccagagcagaccccccgtgaccaccagcaacgccatcccccccgccgtggtggccaccgtgagcgccaccagagcccagagccccgtgatcaccaccaccgccgcccacgccaccgacagcgccctgagcagacccaccctgagcatccagcacccccccagcgccgccatcagcatccagagacccgcccagagcagagacgtgaccaccagaatcaccctgcccagccaccccgccctgggcacccccaagcagcagctgcacaccatggcccagaagaccatcttcagcaccggcacccccgtggccgccgccaccgtggcccccatcctggccaccaacaccatccccagcgccaccaccgccggcagcgtgagccacacccaggcccccaccagcaccatcgtgaccatgaccgtgcccagccacagcagccacgccaccgccgtgaccaccagcaacatccccgtggccaaggtggtgccccagcagatcacccacaccagccccagaatccagcccgactaccccgccgagagaagcagcctgatccccatcagcggccacagagccagccccaaccccgtggccatggagaccagaagcgacaacagacccagcgtgcccgtgcagttccagtacttcctgcccacctacccccccagcgcctaccccctggccgcccacacctacacccccatcaccagcagcgtgagcaccatcagacagtaccccgtgagcgcccaggcccccaacagcgccatcaccgcccagaccggcgtgggcgtggccagcaccgtgcacctgaaccccatgcagctgatgaccgtggacgccagccacgccagacacatccagggcatccagcccgcccccatcagcacccagggcatccagcccgcccccatcggcacccccggcatccagcccgcccccctgggcacccagggcatccacagcgccacccccatcaacacccagggcctgcagcccgcccccatgggcacccagcagccccagcccgagggcaagaccagcgccgtggtgctggccgacggcgccaccatcgtggccaaccccatcagcaaccccttcagcgccgcccccgccgccaccaccgtggtgcagacccacagccagagcgccagcaccaacgcccccgcccagggcagcagccccagacccagcatcctgagaaagaagcccgccaccgacggcatggccgtgagaaagaccctgatccccccccagccccccgacgtggccagccccagagtggagagcagcatgagaagcaccagcggcagccccagacccgccggcgccaagcccaagagcgagatccacgtgagcatggccacccccgtgaccgtgagcatggagaccgtgagcaaccagaacaacgaccagcccaccatcgccgtgccccccaccgcccagcagcccccccccaccatccccaccatgatcgccgccgccagcccccccagccagcccgccgtggccctgagcaccatccccggcgccgtgcccatcaccccccccatcaccaccatcgccgccgcccccccccccagcgtgaccgtgggcggcagcctgagcagcgtgctgggcccccccgtgcccgagatcaaggtgaaggaggaggtggagcccatggacatcatgagacccgtgagcgccgtgccccccctggccaccaacaccgtgagccccagcctggccctgctggccaacaacctgagcatgcccaccagcgacctgccccccggcgccagccccagaaagaagcccagaaagcagcagcacgtgatcagcaccgaggagggcgacatgatggagaccaacagcaccgacgacgagaagagcaccgccaagagcctgctggtgaaggccgagaagagaaagagcccccccaaggagtacatcgacgaggagggcgtgagatacgtgcccgtgagacccagaccccccatcaccctgctgagacactacagaaacccctggaaggccgcctaccaccacttccagagatacagcgacgtgagagtgaaggaggagaagaaggccatgctgcaggagatcgccaaccagaagggcgtgagctgcagagcccagggctggaaggtgcacctgtgcgccgcccagctgctgcagctgaccaacctggagcacgacgtgtacgagagactgaccaacctgcaggagggcatcatccccaagaagaaggccgccaccgacgacgacctgcacagaatcaacgagctgatccagggcaacatgcagagatgcaagctggtgatggaccagatcagcgaggccagagacagcatgctgaaggtgctggaccacaaggacagagtgctgaagctgctgaacaagaacggcaccgtgaagaaggtgagcaagctgaagagaaaggagaaggtgtag

SEQ ID NO: 99032 - DNA, 789 bp, Artificial Sequence
  Description of Artificial Sequence: Synthetic coding sequence
atgagcagccagcagttccccagactgggcgcccccagcaccggcctgagccaggcccccagccagatcgccaacagcggcagcgccggcctgatcaaccccgccgccaccgtgaacgacgagagcggcagagacagcgaggtgagcgccagagagcacatgagcagcagcagcagcctgcagagcagagaggagaagcaggagcccgtggtggtgagaccctacccccaggtgcagatgctgagcacccaccacgccgtggccagcgccacccccgtggccgtgaccgccccccccgcccacctgacccccgccgtgcccctgagcttcagcgagggcctgatgaagcccccccccaagcccaccatgcccagcagacccatcgcccccgccccccccagcaccctgagcctgccccccaaggtgcccggccaggtgaccgtgaccatggagagcagcatcccccaggccagcgccatccccgtggccaccatcagcggccagcagggccaccccagcaacctgcaccacatcatgaccaccaacgtgcagatgagcatcatcagaagcaacgcccccggcccccccctgcacatcggcgccagccacctgcccagaggcgccgccgccgccgccgtgatgagcagcagcaaggtgaccaccgtgctgagacccaccagccagctgcccaacgccgccaccgcccagcccgccgtgcagcacatcatccaccagcccatccagagcagaccccccgtgaccaccagcaacgccatcccccccgcctag

SEQ ID NO: 99033 - DNA, 630 bp, Artificial Sequence
  Description of Artificial Sequence: Synthetic coding sequence
atgaaccccagcatgaagcagaagcaggaggagatcaaggagaacatcaagaacagcagcgtgcccagaagaaccctgaagatgatccagcccagcgccagcggcagcctggtgggcagagagaacgagctgagcgccggcctgagcaagagaaagcacagaaacgaccacctgaccagcaccaccagcagccccggcgtgatcgtgcccgagagcagcgagaacaagaacctgggcggcgtgacccaggagagcttcgacctgatgatcaaggagaaccccagcagccagtactggaaggaggtggccgagaagagaagaaaggccctgtacgaggccctgaaggagaacgagaagctgcacaaggagatcgagcagaaggacaacgagatcgccagactgaagaaggagaacaaggagctggccgaggtggccgagcacgtgcagtacatggccgagctgatcgagagactgaacggcgagcccctggacaacttcgagagcctggacaaccaggagttcgacagcgaggaggagaccgtggaggacagcctggtggaggacagcgagatcggcacctgcgccgagggcaccgtgagcagcagcaccgacgccaagccctgcatctag

SEQ ID NO: 99034 - DNA, 2622 bp, Artificial Sequence
  Description of Artificial Sequence: Synthetic coding sequence
atggccgagatggagaaggagggcagaccccccgagaacaagagaagcagaaagcccgcccaccccgtgaagagagagatcaacgaggagatgaagaacttcgccgagaacaccatgaacgagctgctgggctggtacggctacgacaaggtggagctgaaggacggcgaggacatcgagttcagaagctaccccaccgacggcgagagcagacagcacatcagcgtgctgaaggagaacagcctgcccaagcccaagctgcccgaggacagcgtgatcagcccctacaacatcagcaccggctacagcggcctggccaccggcaacggcctgagcgacagccccgccggcagcaaggaccacggcagcgtgcccatcatcgtgcccctgatccccccccccttcatcaagccccccgccgaggacgacgtgagcaacgtgcagatcatgtgcgcctggtgccagaaggtgggcatcaagagatacagcctgagcatgggcagcgaggtgaagagcttctgcagcgagaagtgcttcgccgcctgcagaagagcctacttcaagagaaacaaggccagagacgaggacggccacgccgagaacttcccccagcagcactacgccaaggagacccccagactggccttcaagaacaactgcgagctgctggtgtgcgactggtgcaagcacatcagacacaccaaggagtacctggacttcggcgacggcgagagaagactgcagttctgcagcgccaagtgcctgaaccagtacaagatggacatcttctacaaggagacccaggccaacctgcccgccggcctgtgcagcaccctgcacccccccatggagaacaaggccgagggcaccggcgtgcagctgctgacccccgacagctggaacatccccctgaccgacgccagaagaaaggcccccagccccgtggccaccgccggccagagccagggccccggccccagcgccagcaccaccgtgagccccagcgacaccgccaactgcagcgtgaccaagatccccacccccgtgcccaagagcatccccatcagcgagacccccaacatcccccccgtgagcgtgcagccccccgccagcatcggcccccccctgggcgtgccccccagaagcccccccatggtgatgaccaacagaggccccgtgcccctgcccatcttcatggagcagcagatcatgcagcagatcagaccccccttcatcagaggccccccccaccacgccagcaaccccaacagccccctgagcaaccccatgctgcccggcatcggccccccccccggcggccccagaaacctgggccccaccagcagccccatgcacagacccatgctgagcccccacatccacccccccagcacccccaccatgcccggcaacccccccggcctgctgcccccccccccccccggcgcccccctgcccagcctgcccttcccccccgtgagcatgatgcccaacggccccatgcccgtgccccagatgatgaacttcggcctgcccagcctggcccccctggtgcccccccccaccctgctggtgccctaccccgtgatcgtgcccctgcccgtgcccatccccatccccatccccatcccccacgtgagcgacagcaagccccccaacggcttcagcagcaacggcgagaacttcatccccaacgcccccggcgacagcgccgccgccggcggcaagcccagcggccacagcctgagccccagagacagcaagcagggcagcagcaagagcgccgacagcccccccggctgcagcggccaggccctgagcctggcccccacccccgccgagcacggcagaagcgaggtggtggacctgaccagaagagccggcagcccccccggcccccccggcgccggcggccagctgggcttccccggcgtgctgcagggcccccaggacggcgtgatcgacctgaccgtgggccacagagccagactgcacaacgtgatccacagagccctgcacgcccacgtgaaggccgagagagagcccagcgccgccgagagaagaacctgcggcggctgcagagacggccactgcagcccccccgccgccggcgaccccggccccggcgcccccgccggccccgaggccgccgccgcctgcaacgtgatcgtgaacggcaccagaggcgccgccgccgagggcgccaagagcgccgagcccccccccgagcagcccccccccccccccccccccgccccccccaagaagctgctgagccccgaggagcccgccgtgagcgagctggagagcgtgaaggagaacaactgcgccagcaactgccacctggacggcgaggccgccaagaagctgatgggcgaggaggccctggccggcggcgacaagagcgaccccaacctgaacaaccccgccgacgaggaccacgcctacgccctgagaatgctgcccaagaccggctgcgtgatccagcccgtgcccaagcccgccgagaaggccgccatggccccctgcatcatcagcagccccatgctgagcgccggccccgaggacctggagccccccctgaagagaagatgcctgagaatcagaaaccagaacaagtag

SEQ ID NO: 99035 - DNA, 1233 bp, Artificial Sequence
  Description of Artificial Sequence: Synthetic coding sequence
atgcccggcgtgtgcgacagagcccccgacttcctgagccccagcgaggaccaggtgctgagacccgccctgggcagcagcgtggccctgaactgcaccgcctgggtggtgagcggcccccactgcagcctgcccagcgtgcagtggctgaaggacggcctgcccctgggcatcggcggccactacagcctgcacgagtacagctgggtgaaggccaacctgagcgaggtgctggtgagcagcgtgctgggcgtgaacgtgaccagcaccgaggtgtacggcgccttcacctgcagcatccagaacatcagcttcagcagcttcaccctgcagagagccggccccaccagccacgtggccgccgtgctggccagcctgctggtgctgctggccctgctgctggccgccctgctgtacgtgaagtgcagactgaacgtgctgctgtggtaccaggacgcctacggcgaggtggagatcaacgacggcaagctgtacgacgcctacgtgagctacagcgactgccccgaggacagaaagttcgtgaacttcatcctgaagccccagctggagagaagaagaggctacaagctgttcctggacgacagagacctgctgcccagagccgagcccagcgccgacctgctggtgaacctgagcagatgcagaagactgatcgtggtgctgagcgacgccttcctgagcagagcctggtgcagccacagcttcagagagggcctgtgcagactgctggagctgaccagaagacccatcttcatcaccttcgagggccagagaagagaccccgcccaccccgccctgagactgctgagacagcacagacacctggtgaccctgctgctgtggagacccggcagcgtgacccccagcagcgacttctggaaggaggtgcagctggccctgcccagaaaggtgcagtacagacccgtggagggcgacccccagacccagctgcaggacgacaaggaccccatgctgatcctgagaggcagagtgcccgagggcagagccctggacagcgaggtggaccccgaccccgagggcgacctgggcgtgagaggccccgtgttcggcgagcccagcgcccccccccacaccagcggcgtgagcctgggcgagagcagaagcagcgaggtggacgtgagcgacctgggcagcagaaactacagcgccagaaccgacttctactgcctggtgagcaaggacgacatgtag

SEQ ID NO: 99036 - DNA, 1515 bp, Artificial Sequence
  Description of Artificial Sequence: Synthetic coding sequence
atgcccggcgtgtgcgacagagcccccgacttcctgagccccagcgaggaccaggtgctgagacccgccctgggcagcagcgtggccctgaactgcaccgcctgggtggtgagcggcccccactgcagcctgcccagcgtgcagtggctgaaggacggcctgcccctgggcatcggcggccactacagcctgcacgagtacagctgggtgaaggccaacctgagcgaggtgctggtgagcagcgtgctgggcgtgaacgtgaccagcaccgaggtgtacggcgccttcacctgcagcatccagaacatcagcttcagcagcttcaccctgcagagagccggccccaccagccacgtggccgccgtgctggccagcctgctggtgctgctggccctgctgctggccgccctgctgtacgtgaagtgcagactgaacgtgctgctgtggtaccaggacgcctacggcgaggtggagatcaacgacggcaagctgtacgacgcctacgtgagctacagcgactgccccgaggacagaaagttcgtgaacttcatcctgaagccccagctggagagaagaagaggctacaagctgttcctggacgacagagacctgctgcccagagccgagcccagcgccgacctgctggtgaacctgagcagatgcagaagactgatcgtggtgctgagcgacgccttcctgagcagagcctggtgcagccacagcttcagagagggcctgtgcagactgctggagctgaccagaagacccatcttcatcaccttcgagggccagagaagagaccccgcccaccccgccctgagactgctgagacagcacagacacctggtgaccctgctgctgtggagacccggcagcgtgacccccagcagcgacttctggaaggaggtgcagctggccctgcccagaaaggtgcagtacagacccgtggagggcgacccccagacccagctgcaggacgacaaggaccccatgctgatcctgagaggcagagtgcccgagggcagagccctggacagcgaggtggaccccgaccccgagggcgacctgggcatgcccgcccagccccacagccccaccggcgaggcccagcacagagccgagtggggccaggcccagggcaccggccccggcggcgcccccggcgtggaggacagcagcagacacagagagcccctgcacggcctgtgccccggcggcgccagacccagcgtgtgcctgggcaccagctgggccagccaggccatcaccgccggcggcgagcagggccagcccctggccgtgggcctgggccagggctgcggctggcccccccaggccagcagaagcccccaccccagatgccccggcgcctgcctgtggagagccatcagcagcaccgcccaccagtggggcctggccggcagagagcccgagcagagaagcggcagactgggcagcagactggccaagctgcagtgcccccacagactgctgctgcccggcgtgcagggctag

SEQ ID NO: 99037 - DNA, 1233 bp, Artificial Sequence; identical to SEQ ID NO: 99035
  Description of Artificial Sequence: Synthetic coding sequence

SEQ ID NO: 99038 - DNA, 1233 bp, Artificial Sequence; identical to SEQ ID NO: 99035
  Description of Artificial Sequence: Synthetic coding sequence

SEQ ID NO: 99039 - DNA, 1515 bp, Artificial Sequence; identical to SEQ ID NO: 99036
  Description of Artificial Sequence: Synthetic coding sequence

SEQ ID NO: 99040 - DNA, 1107 bp, Artificial Sequence
  Description of Artificial Sequence: Synthetic coding sequence
atgttcgccaagggcaagggcagcgccgtgcccagcgacggccaggccagagagaagctggccctgtacgtgtacgagtacctgctgcacgtgggcgcccagaagagcgcccagaccttcctgagcgagatcagatgggagaagaacatcaccctgggcgagccccccggcttcctgcacagctggtggtgcgtgttctgggacctgtactgcgccgcccccgagagaagagacacctgcgagcacagcagcgaggccaaggccttccacgactacagcgccgccgccgcccccagccccgtgctgggcaacatcccccccaacgacggcatgcccggcggccccatcccccccggcttcttccagggcccccccggcagccagcccagcccccacgcccagccccccccccacaaccccagcagcatgatgggcccccacagccagccccccggcggcgtgcccggcacccagcccctgctgcccaacagcatggaccccaccagacagcagggccaccccaacatgggcggcagcatgcagagaatgaacccccccagaggcatgggccccatgggccccggcccccagaactacggcagcggcatgagacccccccccaacagcctgggccccgccatgcccggcatcaacatgggccccggcgccggcagaccctggcccaaccccaacagcgccaacagcatcccctacagcagcagcagccccggcacctacgtgggcccccccggcggcggcggcccccccggcacccccatcatgcccagccccgccgacagcaccaacagcagcgacaacatctacaccatgatcaaccccgtgccccccggcggcagcagaagcaacttccccatgggccccggcagcgacggccccatgggcggcatgggcggcatggagccccaccacatgaacggcagcctgggcagcggcgacatcgacggcctgcccaagaacagccccaacaacatcagcggcatcagcaacccccccggcacccccagagacgacggcgagctgggcggcaacttcctgcacagcttccagaacgacaactacagccccagcatgaccatgagcgtgtag

SEQ ID NO: 99041 - DNA, 1086 bp, Artificial Sequence
  Description of Artificial Sequence: Synthetic coding sequence
atgttcgccaagggcaagggcagcgccgtgcccagcgacggccaggccagagagaagctggccctgtacgtgtacgagtacctgctgcacgtgggcgcccagaagagcgcccagaccttcctgagcgagatcagatgggagaagaacatcaccctgggcgagccccccggcttcctgcacagctggtggtgcgtgttctgggacctgtactgcgccgcccccgagagaagagacacctgcgagcacagcagcgaggccaaggccttccacgactacagcgccgccgccgcccccagccccgtgctgggcaacatcccccccaacgacggcatgcccggcggccccatcccccccggcttcttccagcccttcatgagccccagatacgccggcggccccagaccccccatcagaatgggcaaccagccccccggcggcgtgcccggcacccagcccctgctgcccaacagcatggaccccaccagacagcagggccaccccaacatgggcggcagcatgcagagaatgaacccccccagaggcatgggccccatgggccccggcccccagaactacggcagcggcatgagacccccccccaacagcctgggccccgccatgcccggcatcaacatgggccccggcgccggcagaccctggcccaaccccaacagcgccaacagcatcccctacagcagcagcagccccggcacctacgtgggcccccccggcggcggcggcccccccggcacccccatcatgcccagccccgccgacagcaccaacagcagcgacaacatctacaccatgatcaaccccgtgccccccggcggcagcagaagcaacttccccatgggccccggcagcgacggccccatgggcggcatgggcggcatggagccccaccacatgaacggcagcctgggcagcggcgacatcgacggcctgcccaagaacagccccaacaacatcagcggcatcagcaacccccccggcacccccagagacgacggcgagctgggcggcaacttcctgcacagcttccagaacgacaactacagccccagcatgaccatgagcgtgtag

SEQ ID NO: 99042 - DNA, 1167 bp, Artificial Sequence
  Description of Artificial Sequence: Synthetic coding sequence
atgttcgccaagggcaagggcagcgccgtgcccagcgacggccaggccagagagaagctggccctgtacgtgtacgagtacctgctgcacgtgggcgcccagaagagcgcccagaccttcctgagcgagatcagatgggagaagaacatcaccctgggcgagccccccggcttcctgcacagctggtggtgcgtgttctgggacctgtactgcgccgcccccgagagaagagacacctgcgagcacagcagcgaggccaaggccttccacgactacagcgccgccgccgcccccagccccgtgctgggcaacatcccccccaacgacggcatgcccggcggccccatcccccccggcttcttccagggcccccccggcagccagcccagcccccacgcccagccccccccccacaaccccagcagcatgatgggcccccacagccagcccttcatgagccccagatacgccggcggccccagaccccccatcagaatgggcaaccagccccccggcggcgtgcccggcacccagcccctgctgcccaacagcatggaccccaccagacagcagggccaccccaacatgggcggcagcatgcagagaatgaacccccccagaggcatgggccccatgggccccggcccccagaactacggcagcggcatgagacccccccccaacagcctgggccccgccatgcccggcatcaacatgggccccggcgccggcagaccctggcccaaccccaacagcgccaacagcatcccctacagcagcagcagccccggcacctacgtgggcccccccggcggcggcggcccccccggcacccccatcatgcccagccccgccgacagcaccaacagcagcgacaacatctacaccatgatcaaccccgtgccccccggcggcagcagaagcaacttccccatgggccccggcagcgacggccccatgggcggcatgggcggcatggagccccaccacatgaacggcagcctgggcagcggcgacatcgacggcctgcccaagaacagccccaacaacatcagcggcatcagcaacccccccggcacccccagagacgacggcgagctgggcggcaacttcctgcacagcttccagaacgacaactacagccccagcatgaccatgagcgtgtag

SEQ ID NO: 99043 - DNA, 837 bp, Artificial Sequence
  Description of Artificial Sequence: Synthetic coding sequence
atgcccggcggccccatcccccccggcttcttccagggcccccccggcagccagcccagcccccacgcccagccccccccccacaaccccagcagcatgatgggcccccacagccagcccttcatgagccccagatacgccggcggccccagaccccccatcagaatgggcaaccagccccccggcggcgtgcccggcacccagcccctgctgcccaacagcatggaccccaccagacagcagggccaccccaacatgggcggcagcatgcagagaatgaacccccccagaggcatgggccccatgggccccggcccccagaactacggcagcggcatgagacccccccccaacagcctgggccccgccatgcccggcatcaacatgggccccggcgccggcagaccctggcccaaccccaacagcgccaacagcatcccctacagcagcagcagccccggcacctacgtgggcccccccggcggcggcggcccccccggcacccccatcatgcccagccccgccgacagcaccaacagcagcgacaacatctacaccatgatcaaccccgtgccccccggcggcagcagaagcaacttccccatgggccccggcagcgacggccccatgggcggcatgggcggcatggagccccaccacatgaacggcagcctgggcagcggcgacatcgacggcctgcccaagaacagccccaacaacatcagcggcatcagcaacccccccggcacccccagagacgacggcgagctgggcggcaacttcctgcacagcttccagaacgacaactacagccccagcatgaccatgagcgtgtag

SEQ ID NO: 99044 - DNA, 471 bp, Artificial Sequence
  Description of Artificial Sequence: Synthetic coding sequence
ccccccggcggcgtgcccggcacccagcccctgctgcccaacagcatggaccccaccagacagcagggccaccccaacatgggcggcagcatgcagagaatgaacccccccagaggcatgggccccatgggccccggcccccagaactacggcagcggcatgagacccccccccaacagcctgggccccgccatgcccggcatcaacatgggccccggcgccggcagaccctggcccaaccccaacagcgccaacagcatcccctacagcagcagcagccccggcacctacgtgggcccccccggcggcggcggcccccccggcacccccatcatgcccagccccgccgacagcaccaacagcagcgacaacatctacaccatgatcaaccccgtgccccccggcggcagcagaagcaacgtgagcctgctgagcaacaacctgcacatcagacaccacaacaagagctag

SEQ ID NO: 99045 - DNA, 1158 bp, Artificial Sequence
  Description of Artificial Sequence: Synthetic coding sequence
atgtacgccaagggcggcaagggcagcgccgtgcccagcgacagccaggccagagagaagctggccctgtacgtgtacgagtacctgctgcacatcggcgcccagaagagcgcccagaccttcctgagcgagatcagatgggagaagaacatcaccctgggcgagccccccggcttcctgcacagctggtggtgcgtgttctgggacctgtactgcgccgcccccgacagaagagaggcctgcgagcacagcggcgaggccaaggccttccaggactacagcgccgccgccgcccccagccccgtgatgggcagcatggcccccggcgacaccatggccgccggcagcatggccgccggcttcttccagggcccccccggcagccagcccagcccccacaaccccaacgcccccatgatgggcccccacggccagcccttcatgagccccagattccccggcggccccagacccaccctgagaatgcccagccagccccccgccggcctgcccggcagccagcccctgctgcccggcgccatggagcccagccccagagcccagggccaccccagcatgggcggccccatgcagagagtgaccccccccagaggcatggccagcgtgggcccccagagctacggcggcggcatgagacccccccccaacagcctggccggccccggcctgcccgccatgaacatgggccccggcgtgagaggcccctgggccagccccagcggcaacagcatcccctacagcagcagcagccccggcagctacaccggcccccccggcggcggcggcccccccggcacccccatcatgcccagccccggcgacagcaccaacagcagcgagaacatgtacaccatcatgaaccccatcggccagggcgccggcagagccaacttccccctgggccccggccccgagggccccatggccgccatgagcgccatggagccccaccacgtgaacggcagcctgggcagcggcgacatggacggcctgcccaagagcagccccggcgccgtggccggcctgagcaacgcccccggcacccccagagacgacggcgagatggccgccgccggcaccttcctgcaccccttccccagcgagagctacagccccggcatgaccatgagcgtgtag

SEQ ID NO: 99046 - DNA, 1092 bp, Artificial Sequence
  Description of Artificial Sequence: Synthetic coding sequence
atgtacgccaagggcggcaagggcagcgccgtgcccagcgacagccaggccagagagaagctggccctgtacgtgtacgagtacctgctgcacatcggcgcccagaagagcgcccagaccttcctgagcgagatcagatgggagaagaacatcaccctgggcgagccccccggcttcctgcacagctggtggtgcgtgttctgggacctgtactgcgccgcccccgacagaagagaggcctgcgagcacagcggcgaggccaaggccttccaggactacagcgccgccgccgcccccagccccgtgatgggcagcatggcccccggcgacaccatggccgccggcagcatggccgccggcttcttccagcccttcatgagccccagattccccggcggccccagacccaccctgagaatgcccagccagccccccgccggcctgcccggcagccagcccctgctgcccggcgccatggagcccagccccagagcccagggccaccccagcatgggcggccccatgcagagagtgaccccccccagaggcatggccagcgtgggcccccagagctacggcggcggcatgagacccccccccaacagcctggccggccccggcctgcccgccatgaacatgggccccggcgtgagaggcccctgggccagccccagcggcaacagcatcccctacagcagcagcagccccggcagctacaccggcccccccggcggcggcggcccccccggcacccccatcatgcccagccccggcgacagcaccaacagcagcgagaacatgtacaccatcatgaaccccatcggccagggcgccggcagagccaacttccccctgggccccggccccgagggccccatggccgccatgagcgccatggagccccaccacgtgaacggcagcctgggcagcggcgacatggacggcctgcccaagagcagccccggcgccgtggccggcctgagcaacgcccccggcacccccagagacgacggcgagatggccgccgccggcaccttcctgcaccccttccccagcgagagctacagccccggcatgaccatgagcgtgtag

SEQ ID NO: 99047 - DNA, 2301 bp, Artificial Sequence
  Description of Artificial Sequence: Synthetic coding sequence
atgaaggagaagagcaagaacgccgccagaaccagaagagagaaggagaacagcgagttctacgagctggccaagctgctgcccctgcccagcgccatcaccagccagctggacaaggccagcatcatcagactgaccaccagctacctgaagatgagagtggtgttccccgagggcctgggcgaggcctggggccacagcagcagaaccagccccctggacaacgtgggcagagagctgggcagccacctgctgcagaccctggacggcttcatcttcgtggtggcccccgacggcaagatcatgtacatcagcgagaccgccagcgtgcacctgggcctgagccaggtggagctgaccggcaacagcatctacgagtacatccaccccgccgaccacgacgagatgaccgccgtgctgaccgcccaccagccctaccacagccacttcgtgcaggagtacgagatcgagagaagcttcttcctgagaatgaagtgcgtgctggccaagagaaacgccggcctgacctgcggcggctacaaggtgatccactgcagcggctacctgaagatcagacagtacagcctggacatgagccccttcgacggctgctaccagaacgtgggcctggtggccgtgggccacagcctgccccccagcgccgtgaccgagatcaagctgcacagcaacatgttcatgttcagagccagcctggacatgaagctgatcttcctggacagcagagtggccgagctgaccggctacgagccccaggacctgatcgagaagaccctgtaccaccacgtgcacggctgcgacaccttccacctgagatgcgcccaccacctgctgctggtgaagggccaggtgaccaccaagtactacagattcctggccaagcacggcggctgggtgtgggtgcagagctacgccaccatcgtgcacaacagcagaagcagcagaccccactgcatcgtgagcgtgaactacgtgctgaccgacaccgagtacaagggcctgcagctgagcctggaccagatcagcgccagcaagcccgccttcagctacaccagcagcagcacccccaccatgaccgacaacagaaagggcgccaagagcagactgagcagcagcaagagcaagagcagaaccagcccctacccccagtacagcggcttccacaccgagagaagcgagagcgaccacgacagccagtggggcggcagccccctgaccgacaccgccagcccccagctgctggaccccgccgacagacccggcagccagcacgacgccagctgcgcctacagacagttcagcgacagaagcagcctgtgctacggcttcgccctggaccacagcagactggtggaggagagacacttccacacccaggcctgcgagggcggcagatgcgaggccggcagatacttcctgggcaccccccaggccggcagagagccctggtggggcagcagagccgccctgcccctgaccaaggccagccccgagagcagagaggcctacgagaacagcatgccccacatcgccagcgtgcacagaatccacggcagaggccactgggacgaggacagcgtggtgagcagccccgaccccggcagcgccagcgagagcggcgacagatacagaaccgagcagtaccagagcagcccccacgagcccagcaagatcgagaccctgatcagagccacccagcagatgatcaaggaggaggagaacagactgcagctgagaaaggcccccagcgaccagctggccagcatcaacggcgccggcaagaagcacagcctgtgcttcgccaactaccagcagcccccccccaccggcgaggtgtgccacggcagcgccctggccaacaccagcccctgcgaccacatccagcagagagagggcaagatgctgagcccccacgagaacgactacgacaacagccccaccgccctgagcagaatcagcagccccaacagcgacagaatcagcaagagcagcctgatcctggccaaggactacctgcacagcgacatcagcccccaccagaccgccggcgaccaccccaccgtgagccccaactgcttcggcagccacagacagtacttcgacaagcacgcctacaccctgaccggctacgccctggagcacctgtacgacagcgagaccatcagaaactacagcctgggctgcaacggcagccacttcgacgtgaccagccacctgagaatgcagcccgaccccgcccagggccacaagggcaccagcgtgatcatcaccaacggcagctag

SEQ ID NO: 99048 - DNA, 2301 bp, Artificial Sequence; identical to SEQ ID NO: 99047
  Description of Artificial Sequence: Synthetic coding sequence

SEQ ID NO: 99049 - DNA, 2004 bp, Artificial Sequence
  Description of Artificial Sequence: Synthetic coding sequence
atgaaggagaagagcaagaacgccgccaagaccagaagagagaaggagaacggcgagttctacgagctggccaagctgctgcccctgcccagcgccatcaccagccagctggacaaggccagcatcatcagactgaccaccagctacctgaagatgagagccgtgttccccgagggcctgggcgacgcctggggccagcccagcagagccggccccctggacggcgtggccaaggagctgggcagccacctgctgcagaccctggacggcttcgtgttcgtggtggccagcgacggcaagatcatgtacatcagcgagaccgccagcgtgcacctgggcctgagccaggtggagctgaccggcaacagcatctacgagtacatccaccccagcgaccacgacgagatgaccgccgtgctgaccgcccaccagcccctgcaccaccacctgctgcaggagtacgagatcgagagaagcttcttcctgagaatgaagtgcgtgctggccaagagaaacgccggcctgacctgcagcggctacaaggtgatccactgcagcggctacctgaagatcagacagtacatgctggacatgagcctgtacgacagctgctaccagatcgtgggcctggtggccgtgggccagagcctgccccccagcgccatcaccgagatcaagctgtacagcaacatgttcatgttcagagccagcctggacctgaagctgatcttcctggacagcagagtgaccgaggtgaccggctacgagccccaggacctgatcgagaagaccctgtaccaccacgtgcacggctgcgacgtgttccacctgagatacgcccaccacctgctgctggtgaagggccaggtgaccaccaagtactacagactgctgagcaagagaggcggctgggtgtgggtgcagagctacgccaccgtggtgcacaacagcagaagcagcagaccccactgcatcgtgagcgtgaactacgtgctgaccgagatcgagtacaaggagctgcagctgagcctggagcaggtgagcaccgccaagagccaggacagctggagaaccgccctgagcaccagccaggagaccagaaagctggtgaagcccaagaacaccaagatgaagaccaagctgagaaccaacccctaccccccccagcagtacagcagcttccagatggacaagctggagtgcggccagctgggcaactggagagccagcccccccgccagcgccgccgccccccccgagctgcagccccacagcgagagcagcgacctgctgtacacccccagctacagcctgcccttcagctaccactacggccacttccccctggacagccacgtgttcagcagcaagaagcccatgctgcccgccaagttcggccagccccagggcagcccctgcgaggtggccagattcttcctgagcaccctgcccgccagcggcgagtgccagtggcactacgccaaccccctggtgcccagcagcagcagccccgccaagaacccccccgagccccccgccaacaccgccagacacagcctggtgcccagctacgaggcccccgccgccgccgtgagaagattcggcgaggacaccgccccccccagcttccccagctgcggccactacagagaggagcccgccctgggccccgccaaggccgccagacaggccgccagagacggcgccagactggccctggccagagccgcccccgagtgctgcgccccccccacccccgaggcccccggcgcccccgcccagctgcccttcgtgctgctgaactaccacagagtgctggccagaagaggccccctgggcggcgccgcccccgccgccagcggcctggcctgcgcccccggcggccccgaggccgccaccggcgccctgagactgagacaccccagccccgccgccaccagcccccccggcgcccccctgccccactacctgggcgccagcgtgatcatcaccaacggcagatag

SEQ ID NO: 99050 - DNA, 1713 bp, Artificial Sequence
  Description of Artificial Sequence: Synthetic coding sequence
atgaaggagaagagcaagaacgccgccaagaccagaagagagaaggagaacggcgagttctacgagctggccaagctgctgcccctgcccagcgccatcaccagccagctggacaaggccagcatcatcagactgaccaccagctacctgaagatgagagccgtgttccccgagggcctgggcgacgcctggggccagcccagcagagccggccccctggacggcgtggccaaggagctgggcagccacctgctgcagaccctggacggcttcgtgttcgtggtggccagcgacggcaagatcatgtacatcagcgagaccgccagcgtgcacctgggcctgagccaggtggagctgaccggcaacagcatctacgagtacatccaccccagcgaccacgacgagatgaccgccgtgctgaccgcccaccagcccctgcaccaccacctgctgcaggagtacgagatcgagagaagcttcttcctgagaatgaagtgcgtgctggccaagagaaacgccggcctgacctgcagcggctacaaggtgatccactgcagcggctacctgaagatcagacagtacatgctggacatgagcctgtacgacagctgctaccagatcgtgggcctggtggccgtgggccagagcctgccccccagcgccatcaccgagatcaagctgtacagcaacatgttcatgttcagagccagcctggacctgaagctgatcttcctggacagcagagtgaccgaggtgaccggctacgagccccaggacctgatcgagaagaccctgtaccaccacgtgcacggctgcgacgtgttccacctgagatacgcccaccacctgctgctggtgaagggccaggtgaccaccaagtactacagactgctgagcaagagaggcggctgggtgtgggtgcagagctacgccaccgtggtgcacaacagcagaagcagcagaccccactgcatcgtgagcgtgaactacgtgctgaccgagatcgagtacaaggagctgcagctgagcctggagcaggtgagcaccgccaagagccaggacagctggagaaccgccctgagcaccagccaggagaccagaaagctggtgaagcccaagaacaccaagatgaagaccaagctgagaaccaacccctaccccccccagcagtacagcagcttccagatggacaagctggagtgcggccagctgggcaactggagagccagcccccccgccagcgccgccgccccccccgagctgcagccccacagcgagagcagcgacctgctgtacacccccagctacagcctgcccttcagctaccactacggccacttccccctggacagccacgtgttcagcagcaagaagcccatgctgcccgccaagttcggccagccccagggcagcccctgcgaggtggccagattcttcctgagcaccctgcccgccagcggcgagtgccagtggcactacgccaaccccctggtgcccagcagcagcagccccgccaagaacccccccgagccccccgccaacaccgccagacacagcctggtgcccagctacgagggcggcagcggcctgctggtgggcaaggtgggcggcctgagaaccgccggcagcagaagcagccacggcggcggctggcagatggagaccgagcccagcagattcggccagacctgccccctgagcgccagcaagtag

SEQ ID NO: 99051 - DNA, 447 bp, Artificial Sequence
  Description of Artificial Sequence: Synthetic coding sequence
atgttcagaagacccgtgctgcaggtgctgagacagttcgtgagacacgagagcgagaccaccaccagcctggtgctggagagaagcctgaacagagtgcacctgctgggcagagtgggccaggaccccgtgctgagacaggtggagggcaagaaccccgtgaccatcttcagcctggccaccaacgagatgtggagaagcggcgacagcgaggtgtaccagctgggcgacgtgagccagaagaccacctggcacagaatcagcgtgttcagacccggcctgagagacgtggcctaccagtacgtgaagaagggcagcagaatctacctggagggcaagatcgactacggcgagtacatggacaagaacaacgtgagaagacaggccaccaccatcatcgccgacaacatcatcttcctgagcgaccagaccaaggagaaggagtag

SEQ ID NO: 99052 - DNA, 366 bp, Artificial Sequence
  Description of Artificial Sequence: Synthetic coding sequence
atgttcagaagacccgtgctgcaggtgctgagacagttcgtgagacacgagagcgagaccaccaccagcctggtgctggagagaagcctgaacagagtgcacctgctgggcagagtgggccaggaccccgtgctgagacaggtggagggcaagaaccccgtgaccatcttcagcctggccaccaacgagatgtggagaagcggcgacagcgaggtgtaccagctgggcgacgtgagccagaagaccacctggcacagaatcagcgtgttcagacccggcctgagagacgtggcctaccagtacgtgaagaagggcagcagaatctacctggagggcaagatcgactacggcgagtacatggactag

SEQ ID NO: 99053 - DNA, 447 bp, Artificial Sequence; identical to SEQ ID NO: 99051
  Description of Artificial Sequence: Synthetic coding sequence

SEQ ID NO: 99054 - DNA, 408 bp, Artificial Sequence
  Description of Artificial Sequence: Synthetic coding sequence
atgttcagaagacccgtgctgcaggtgctgagacagttcgtgagacacgagagcgagaccaccaccagcctggtgctggagagaagcctgaacagagtgcacctgctgggcagagtgggccaggaccccgtgctgagacaggtggagggcaagaaccccgtgaccatcttcagcctggccaccaacgagatgtggagaagcggcgacagcgaggtgtaccagctgggcgacgtgagccagaagaccacctggcacagaatcagcgtgttcagacccggcctgagagacgtggcctaccagtacgtgaagaagggcagcagaatctacctggagggcaagatcgactacggcgagtacatggacaagaacaacgtgagaagacaggccaccaccatcatcgccgactag

SEQ ID NO: 99055 - DNA, 87 bp, Artificial Sequence
  Description of Artificial Sequence: Synthetic coding sequence
atgttcagaagacccgtgctgcaggtgctgagacagttcgtgagacacgagagcgagaccaccaccagcctggtgctggagagatag

SEQ ID NO: 99056 - DNA, 447 bp, Artificial Sequence; identical to SEQ ID NO: 99051
  Description of Artificial Sequence: Synthetic coding sequence

SEQ ID NO: 99057 - DNA, 447 bp, Artificial Sequence; identical to SEQ ID NO: 99051
  Description of Artificial Sequence: Synthetic coding sequence

SEQ ID NO: 99058 - DNA, 447 bp, Artificial Sequence; identical to SEQ ID NO: 99051
  Description of Artificial Sequence: Synthetic coding sequence

SEQ ID NO: 99059 - DNA, 1086 bp, Artificial Sequence
  Description of Artificial Sequence: Synthetic coding sequence
atgtacggcaagggcaagagcaacagcagcgccgtgcccagcgacagccaggccagagagaagctggccctgtacgtgtacgagtacctgctgcacgtgggcgcccagaagagcgcccagaccttcctgagcgagatcagatgggagaagaacatcaccctgggcgagccccccggcttcctgcacagctggtggtgcgtgttctgggacctgtactgcgccgcccccgagagaagagagacctgcgagcacagcagcgaggccaaggccttccacgactacagcgccgccgccgcccccagccccgtgctgggcaacatcccccccggcgacggcatgcccgtgggccccgtgccccccggcttcttccagcccttcatgagccccagataccccggcggccccagaccccccctgagaatccccaaccaggccctgggcggcgtgcccggcagccagcccctgctgcccagcggcatggaccccaccagacagcagggccaccccaacatgggcggccccatgcagagaatgaccccccccagaggcatggtgcccctgggcccccagaactacggcggcgccatgagaccccccctgaacgccctgggcggccccggcatgcccggcatgaacatgggccccggcggcggcagaccctggcccaaccccaccaacgccaacagcatcccctacagcagcgccagccccggcaactacgtgggcccccccggcggcggcggcccccccggcacccccatcatgcccagccccgccgacagcaccaacagcggcgacaacatgtacaccctgatgaacgccgtgccccccggccccaacagacccaacttccccatgggccccggcagcgacggccccatgggcggcctgggcggcatggagagccaccacatgaacggcagcctgggcagcggcgacatggacagcatcagcaagaacagccccaacaacatgagcctgagcaaccagcccggcacccccagagacgacggcgagatgggcggcaacttcctgaaccccttccagagcgagagctacagccccagcatgaccatgagcgtgtag

SEQ ID NO: 99060 - DNA, 945 bp, Artificial Sequence
  Description of Artificial Sequence: Synthetic coding sequence
atgggcaagaacatcaccctgggcgagccccccggcttcctgcacagctggtggtgcgtgttctgggacctgtactgcgccgcccccgagagaagagagacctgcgagcacagcagcgaggccaaggccttccacgactacagcgccgccgccgcccccagccccgtgctgggcaacatcccccccggcgacggcatgcccgtgggccccgtgccccccggcttcttccagcccttcatgagccccagataccccggcggccccagaccccccctgagaatccccaaccaggccctgggcggcgtgcccggcagccagcccctgctgcccagcggcatggaccccaccagacagcagggccaccccaacatgggcggccccatgcagagaatgaccccccccagaggcatggtgcccctgggcccccagaactacggcggcgccatgagaccccccctgaacgccctgggcggccccggcatgcccggcatgaacatgggccccggcggcggcagaccctggcccaaccccaccaacgccaacagcatcccctacagcagcgccagccccggcaactacgtgggcccccccggcggcggcggcccccccggcacccccatcatgcccagccccgccgacagcaccaacagcggcgacaacatgtacaccctgatgaacgccgtgccccccggccccaacagacccaacttccccatgggccccggcagcgacggccccatgggcggcctgggcggcatggagagccaccacatgaacggcagcctgggcagcggcgacatggacagcatcagcaagaacagccccaacaacatgagcctgagcaaccagcccggcacccccagagacgacggcgagatgggcggcaacttcctgaaccccttccagagcgagagctacagccccagcatgaccatgagcgtgtag

SEQ ID NO: 99061 - DNA, 1026 bp, Artificial Sequence
  Description of Artificial Sequence: Synthetic coding sequence
atgtacggcaagggcaagagcaacagcagcgccgtgcccagcgacagccaggccagagagaagctggccctgtacgtgtacgagtacctgctgcacgtgggcgcccagaagagcgcccagaccttcctgagcgagatcagatgggagaagaacatcaccctgggcgagccccccggcttcctgcacagctggtggtgcgtgttctgggacctgtactgcgccgcccccgagagaagagagacctgcgagcacagcagcgaggccaaggccttccacgactacagcgccgccgccgcccccagccccgtgctgggcaacatcccccccggcgacggcatgcccgtgggccccgtgccccccggcttcttccaggccctgggcggcgtgcccggcagccagcccctgctgcccagcggcatggaccccaccagacagcagggccaccccaacatgggcggccccatgcagagaatgaccccccccagaggcatggtgcccctgggcccccagaactacggcggcgccatgagaccccccctgaacgccctgggcggccccggcatgcccggcatgaacatgggccccggcggcggcagaccctggcccaaccccaccaacgccaacagcatcccctacagcagcgccagccccggcaactacgtgggcccccccggcggcggcggcccccccggcacccccatcatgcccagccccgccgacagcaccaacagcggcgacaacatgtacaccctgatgaacgccgtgccccccggccccaacagacccaacttccccatgggccccggcagcgacggccccatgggcggcctgggcggcatggagagccaccacatgaacggcagcctgggcagcggcgacatggacagcatcagcaagaacagccccaacaacatgagcctgagcaaccagcccggcacccccagagacgacggcgagatgggcggcaacttcctgaaccccttccagagcgagagctacagccccagcatgaccatgagcgtgtag

SEQ ID NO: 99062 - DNA, 1200 bp, Artificial Sequence
  Description of Artificial Sequence: Synthetic coding sequence
atggccttctggggctggagagccgccgccgccctgagactgtggggcagagtggtggagagagtggaggccggcggcggcgtgggccccttccaggcctgcggctgcagactggtgctgggcggcagagacgacgtgagcgccggcctgagaggcagccacggcgccagaggcgagcccctggaccccgccagacccctgcagagaccccccagacccgaggtgcccagagccttcagaagacagcccagagccgccgcccccagcttcttcttcagcagcatcaagggcggcagaagaagcatcagcttcagcgtgggcgccagcagcgtggtgggcagcggcggcagcagcgacaagggcaagctgagcctgcaggacgtggccgagctgatcagagccagagcctgccagagagtggtggtgatggtgggcgccggcatcagcacccccagcggcatccccgacttcagaagccccggcagcggcctgtacagcaacctgcagcagtacgacctgccctaccccgaggccatcttcgagctgcccttcttcttccacaaccccaagcccttcttcaccctggccaaggagctgtaccccggcaactacaagcccaacgtgacccactacttcctgagactgctgcacgacaagggcctgctgctgagactgtacacccagaacatcgacggcctggagagagtgagcggcatccccgccagcaagctggtggaggcccacggcaccttcgccagcgccacctgcaccgtgtgccagagacccttccccggcgaggacatcagagccgacgtgatggccgacagagtgcccagatgccccgtgtgcaccggcgtggtgaagcccgacatcgtgttcttcggcgagcccctgccccagagattcctgctgcacgtggtggacttccccatggccgacctgctgctgatcctgggcaccagcctggaggtggagcccttcgccagcctgaccgaggccgtgagaagcagcgtgcccagactgctgatcaacagagacctggtgggccccctggcctggcaccccagaagcagagacgtggcccagctgggcgacgtggtgcacggcgtggagagcctggtggagctgctgggctggaccgaggagatgagagacctggtgcagagagagaccggcaagctggacggccccgacaagtag

SEQ ID NO: 99063 - DNA, 957 bp, Artificial Sequence
  Description of Artificial Sequence: Synthetic coding sequence
atggccttctggggctggagagccgccgccgccctgagactgtggggcagagtggtggagagagtggaggccggcggcggcgtgggccccttccaggcctgcggctgcagactggtgctgggcggcagagacgacgacgtggccgagctgatcagagccagagcctgccagagagtggtggtgatggtgggcgccggcatcagcacccccagcggcatccccgacttcagaagccccggcagcggcctgtacagcaacctgcagcagtacgacctgccctaccccgaggccatcttcgagctgcccttcttcttccacaaccccaagcccttcttcaccctggccaaggagctgtaccccggcaactacaagcccaacgtgacccactacttcctgagactgctgcacgacaagggcctgctgctgagactgtacacccagaacatcgacggcctggagagagtgagcggcatccccgccagcaagctggtggaggcccacggcaccttcgccagcgccacctgcaccgtgtgccagagacccttccccggcgaggacatcagagccgacgtgatggccgacagagtgcccagatgccccgtgtgcaccggcgtggtgaagcccgacatcgtgttcttcggcgagcccctgccccagagattcctgctgcacgtggtggacttccccatggccgacctgctgctgatcctgggcaccagcctggaggtggagcccttcgccagcctgaccgaggccgtgagaagcagcgtgcccagactgctgatcaacagagacctggtgggccccctggcctggcaccccagaagcagagacgtggcccagctgggcgacgtggtgcacggcgtggagagcctggtggagctgctgggctggaccgaggagatgagagacctggtgcagagagagaccggcaagctggacggccccgacaagtag

SEQ ID NO: 99064 - DNA, 774 bp, Artificial Sequence
  Description of Artificial Sequence: Synthetic coding sequence
atggtgggcgccggcatcagcacccccagcggcatccccgacttcagaagccccggcagcggcctgtacagcaacctgcagcagtacgacctgccctaccccgaggccatcttcgagctgcccttcttcttccacaaccccaagcccttcttcaccctggccaaggagctgtaccccggcaactacaagcccaacgtgacccactacttcctgagactgctgcacgacaagggcctgctgctgagactgtacacccagaacatcgacggcctggagagagtgagcggcatccccgccagcaagctggtggaggcccacggcaccttcgccagcgccacctgcaccgtgtgccagagacccttccccggcgaggacatcagagccgacgtgatggccgacagagtgcccagatgccccgtgtgcaccggcgtggtgaagcccgacatcgtgttcttcggcgagcccctgccccagagattcctgctgcacgtggtggacttccccatggccgacctgctgctgatcctgggcaccagcctggaggtggagcccttcgccagcctgaccgaggccgtgagaagcagcgtgcccagactgctgatcaacagagacctggtgggccccctggcctggcaccccagaagcagagacgtggcccagctgggcgacgtggtgcacggcgtggagagcctggtggagctgctgggctggaccgaggagatgagagacctggtgcagagagagaccggcaagctggacggccccgacaagtag

SEQ ID NO: 99065 - DNA, 945 bp, Artificial Sequence
  Description of Artificial Sequence: Synthetic coding sequence
atgaagatgagcttcgccctgaccttcagaagcgccaagggcagatggatcgccaaccccagccagccctgcagcaaggccagcatcggcctgttcgtgcccgccagcccccccctggaccccgagaaggtgaaggagctgcagagattcatcaccctgagcaagagactgctggtgatgaccggcgccggcatcagcaccgagagcggcatccccgactacagaagcgagaaggtgggcctgtacgccagaaccgacagaagacccatccagcacggcgacttcgtgagaagcgcccccatcagacagagatactgggccagaaacttcgtgggctggccccagttcagcagccaccagcccaaccccgcccactgggccctgagcacctgggagaagctgggcaagctgtactggctggtgacccagaacgtggacgccctgcacaccaaggccggcagcagaagactgaccgagctgcacggctgcatggacagagtgctgtgcctggactgcggcgagcagacccccagaggcgtgctgcaggagagattccaggtgctgaaccccacctggagcgccgaggcccacggcctggcccccgacggcgacgtgttcctgagcgaggagcaggtgagaagcttccaggtgcccacctgcgtgcagtgcggcggccacctgaagcccgacgtggtgttcttcggcgacaccgtgaaccccgacaaggtggacttcgtgcacaagagagtgaaggaggccgacagcctgctggtggtgggcagcagcctgcaggtgtacagcggctacagattcatcctgaccgcctgggagaagaagctgcccatcgccatcctgaacatcggccccaccagaagcgacgacctggcctgcctgaagctgaacagcagatgcggcgagctgctgcccctgatcgacccctgctag

SEQ ID NO: 99066 - DNA, 879 bp, Artificial Sequence
  Description of Artificial Sequence: Synthetic coding sequence
atgagacccctgcagatcgtgcccagcagactgatcagccagctgtactgcggcctgaagccccccgccagcaccagaaaccagatctgcctgaagatggccagacccagcagcagcatggccgacttcagaaagttcttcgccaaggccaagcacatcgtgatcatcagcggcgccggcgtgagcgccgagagcggcgtgcccaccttcagaggcgccggcggctactggagaaagtggcaggcccaggacctggccacccccctggccttcgcccacaaccccagcagagtgtgggagttctaccactacagaagagaggtgatgggcagcaaggagcccaacgccggccacagagccatcgccgagtgcgagaccagactgggcaagcagggcagaagagtggtggtgatcacccagaacatcgacgagctgcacagaaaggccggcaccaagaacctgctggagatccacggcagcctgttcaagaccagatgcaccagctgcggcgtggtggccgagaactacaagagccccatctgccccgccctgagcggcaagggctgcgaggaggccggctgcggcggcctgctgagaccccacgtggtgtggttcggcgagaacctggaccccgccatcctggaggaggtggacagagagctggcccactgcgacctgtgcctggtggtgggcaccagcagcgtggtgtaccccgccgccatgttcgccccccaggtggccgccagaggcgtgcccgtggccgagttcaacaccgagaccacccccgccaccaacagattcagattccacttccagggcccctgcggcaccaccctgcccgaggccctggcctgccacgagaacgagaccgtgagctag

SEQ ID NO: 99067 - DNA, 933 bp, Artificial Sequence
  Description of Artificial Sequence: Synthetic coding sequence
atgagacccctgcagatcgtgcccagcagactgatcagccagctgtactgcggcctgaagccccccgccagcaccagaaaccagatctgcctgaagatggccagacccagcagcagcatggccgacttcagaaagttcttcgccaaggccaagcacatcgtgatcatcagcggcgccggcgtgagcgccgagagcggcgtgcccaccttcagaggcgccggcggctactggagaaagtggcaggcccaggacctggccacccccctggccttcgcccacaaccccagcagagtgtgggagttctaccactacagaagagaggtgatgggcagcaaggagcccaacgccggccacagagccatcgccgagtgcgagaccagactgggcaagcagggcagaagagtggtggtgatcacccagaacatcgacgagctgcacagaaaggccggcaccaagaacctgctggagatccacggcagcctgttcaagaccagatgcaccagctgcggcgtggtggccgagaactacaagagccccatctgccccgccctgagcggcaagggcgcccccgagcccggcacccaggacgccagcatccccgtggagaagctgcccagatgcgaggaggccggctgcggcggcctgctgagaccccacgtggtgtggttcggcgagaacctggaccccgccatcctggaggaggtggacagagagctggcccactgcgacctgtgcctggtggtgggcaccagcagcgtggtgtaccccgccgccatgttcgccccccaggtggccgccagaggcgtgcccgtggccgagttcaacaccgagaccacccccgccaccaacagattcagattccacttccagggcccctgcggcaccaccctgcccgaggccctggcctgccacgagaacgagaccgtgagctag

SEQ ID NO: 99068 - DNA, 900 bp, Artificial Sequence
  Description of Artificial Sequence: Synthetic coding sequence
atgagacccctgcagatcgtgcccagcagactgatcagccagctgtactgcggcctgaagccccccgccagcaccagaaaccagatctgcctgaagatggccagacccagcagcagcatggccgacttcagaaagttcttcgccaaggccaagcacatcgtgatcatcagcggcgccggcgtgagcgccgagagcggcgtgcccaccttcagaggcgccggcggctactggagaaagtggcaggcccaggacctggccacccccctggccttcgcccacaaccccagcagagtgtgggagttctaccactacagaagagaggtgatgggcagcaaggagcccaacgccggccacagagccatcgccgagtgcgagaccagactgggcaagcagggcagaagagtggtggtgatcacccagaacatcgacgagctgcacagaaaggccggcaccaagaacctgctggagatccacggcagcctgttcaagaccagatgcaccagctgcggcgtggtggccgagaactacaagagccccatctgccccgccctgagcggcaagggcgcccccgagcccggcacccaggacgccagcatccccgtggagaagctgcccagatgcgaggaggccggctgcggcggcctgctgagaccccacgtggtgtggttcggcgagaacctggaccccgccatcctggaggaggtggacagagagctggcccactgcgacctgtgcctggtggtgggcaccagcagcgtggtgtaccccgccgccatgttcgccccccaggtggccgccagaggcgtgcccgtggccgagttcaacaccgagaccacccccgccaccaacagattcagccacctgatcagcatcagcagcctgatcatcatcaagaactag

SEQ ID NO: 99069 - DNA, 609 bp, Artificial Sequence
  Description of Artificial Sequence: Synthetic coding sequence
atgggcagcaaggagcccaacgccggccacagagccatcgccgagtgcgagaccagactgggcaagcagggcagaagagtggtggtgatcacccagaacatcgacgagctgcacagaaaggccggcaccaagaacctgctggagatccacggcagcctgttcaagaccagatgcaccagctgcggcgtggtggccgagaactacaagagccccatctgccccgccctgagcggcaagggcgcccccgagcccggcacccaggacgccagcatccccgtggagaagctgcccagatgcgaggaggccggctgcggcggcctgctgagaccccacgtggtgtggttcggcgagaacctggaccccgccatcctggaggaggtggacagagagctggcccactgcgacctgtgcctggtggtgggcaccagcagcgtggtgtaccccgccgccatgttcgccccccaggtggccgccagaggcgtgcccgtggccgagttcaacaccgagaccacccccgccaccaacagattcagattccacttccagggcccctgcggcaccaccctgcccgaggccctggcctgccacgagaacgagaccgtgagctag

SEQ ID NO: 99070 - DNA, 1203 bp, Artificial Sequence
  Description of Artificial Sequence: Synthetic coding sequence
atggccgccggcggcctgagcagaagcgagagaaaggccgccgagagagtgagaagactgagagaggagcagcagagagagagactgagacaggtgagcagaatcctgagaaaggccgccgccgagagaagcgccgaggagggcagactgctggccgagagcgccgacctggtgaccgagctgcagggcagaagcagaagaagagagggcctgaagagaagacaggaggaggtgtgcgacgaccccgaggagctgagaggcaaggtgagagagctggccagcgccgtgagaaacgccaagtacctggtggtgtacaccggcgccggcatcagcaccgccgccagcatccccgactacagaggccccaacggcgtgtggaccctgctgcagaagggcagaagcgtgagcgccgccgacctgagcgaggccgagcccaccctgacccacatgagcatcaccagactgcacgagcagaagctggtgcagcacgtggtgagccagaactgcgacggcctgcacctgagaagcggcctgcccagaaccgccatcagcgagctgcacggcaacatgtacatcgaggtgtgcaccagctgcgtgcccaacagagagtacgtgagagtgttcgacgtgaccgagagaaccgccctgcacagacaccagaccggcagaacctgccacaagtgcggcacccagctgagagacaccatcgtgcacttcggcgagagaggcaccctgggccagcccctgaactgggaggccgccaccgaggccgccagcagagccgacaccatcctgtgcctgggcagcagcctgaaggtgctgaagaagtaccccagactgtggtgcatgaccaagccccccagcagaagacccaagctgtacatcgtgaacctgcagtggacccccaaggacgactgggccgccctgaagctgcacggcaagtgcgacgacgtgatgagactgctgatggccgagctgggcctggagatccccgcctacagcagatggcaggaccccatcttcagcctggccacccccctgagagccggcgaggagggcagccacagcagaaagagcctgtgcagaagcagagaggaggccccccccggcgacagaggcgcccccctgagcagcgcccccatcctgggcggctggttcggcagaggctgcaccaagagaaccaagagaaagaaggtgacctag

SEQ ID NO: 99071 - DNA, 963 bp, Artificial Sequence
  Description of Artificial Sequence: Synthetic coding sequence
atgcccggccccagaagaagaagccccagcgcctgcccccaggtgagcagaatcctgagaaaggccgccgccgagagaagcgccgaggagggcagactgctggccgagagcgccgacctggtgaccgagctgcagggcagaagcagaagaagagagggcctgaagagaagacaggaggaggtgtgcgacgaccccgaggagctgagaggcaaggtgagagagctggccagcgccgtgagaaacgccaagtacctggtggtgtacaccggcgccggcatcagcaccgccgccagcatccccgactacagaggccccaacggcgtgtggaccctgctgcagaagggcagaagcgtgagcgccgccgacctgagcgaggccgagcccaccctgacccacatgagcatcaccagactgcacgagcagaagctggtgcagcacgtggtgagccagaactgcgacggcctgcacctgagaagcggcctgcccagaaccgccatcagcgagctgcacggcaacatgtacatcgaggtgtgcaccagctgcgtgcccaacagagagtacgtgagagtgttcgacgtgaccgagagaaccgccctgcacagacaccagaccggcagaacctgccacaagtgcggcacccagctgagagacaccatcgtgcacttcggcgagagaggcaccctgggccagcccctgaactgggaggccgccaccgaggccgccagcagagccgacaccatcctgtgcctgggcagcagcctgaaggtgctgaagaagtaccccagactgtggtgcatgaccaagccccccagcagaagacccaagctgtacatcgtgaacctgcagtggacccccaaggacgactgggccgccctgaagctgcacggcaagtgcgacgacgtgatgagactgctgatggccgagctgggcctggagatccccgcctacagcagagtgctgtag

SEQ ID NO: 99072 - DNA, 855 bp, Artificial Sequence
  Description of Artificial Sequence: Synthetic coding sequence
atgagcatgctgcccagcttcggcttcacccaggagcaggtggcctgcgtgtgcgaggtgctgcagcagggcggcaacctggagagactgggcagattcctgtggagcctgcccgcctgcgaccacctgcacaagaacgagagcgtgctgaaggccaaggccgtggtggccttccacagaggcaacttcagagagctgtacaagatcctggagagccaccagttcagcccccacaaccaccccaagctgcagcagctgtggctgaaggcccactacgtggaggccgagaagctgagaggcagacccctgggcgccgtgggcaagtacagagtgagaagaaagttccccctgcccagaaccatctgggacggcgaggagaccagctactgcttcaaggagaagagcagaggcgtgctgagagagtggtacgcccacaacccctaccccagccccagagagaagagagagctggccgaggccaccggcctgaccaccacccaggtgagcaactggttcaagaacagaagacagagagacagagccgccgaggccaaggagagagagaacaccgagaacaacaacagcagcagcaacaagcagaaccagctgagccccctggagggcggcaagcccctgatgagcagcagcgaggaggagttcagccccccccagagccccgaccagaacagcgtgctgctgctgcagggcaacatgggccacgccagaagcagcaactacagcctgcccggcctgaccgccagccagcccagccacggcctgcagacccaccagcaccagctgcaggacagcctgctgggccccctgaccagcagcctggtggacctgggcagctag

SEQ ID NO: 99073 - DNA, 876 bp, Artificial Sequence
  Description of Artificial Sequence: Synthetic coding sequence
atgagcatgctgcccaccttcggcttcacccaggagcaggtggcctgcgtgtgcgaggtgctgcagcagggcggcaacatcgagagactgggcagattcctgtggagcctgcccgcctgcgagcacctgcacaagaacgagagcgtgctgaaggccaaggccgtggtggccttccacagaggcaacttcagagagctgtacaagatcctggagagccaccagttcagcccccacaaccacgccaagctgcagcagctgtggctgaaggcccactacatcgaggccgagaagctgagaggcagacccctgggcgccgtgggcaagtacagagtgagaagaaagttccccctgcccagaagcatctgggacggcgaggagaccagctactgcttcaaggagaagagcagaagcgtgctgagagagtggtacgcccacaacccctaccccagccccagagagaagagagagctggccgaggccaccggcctgaccaccacccaggtgagcaactggttcaagaacagaagacagagagacagagccgccgaggccaaggagagagagaacaacgagaacagcaacagcaacagccacaaccccctgaacggcagcggcaagagcgtgctgggcagcagcgaggacgagaagacccccagcggcacccccgaccacagcagcagcagccccgccctgctgctgagcccccccccccccggcctgcccagcctgcacagcctgggccacccccccggccccagcgccgtgcccgtgcccgtgcccggcggcggcggcgccgaccccctgcagcaccaccacggcctgcaggacagcatcctgaaccccatgagcgccaacctggtggacctgggcagctag

SEQ ID NO: 99074 - DNA, 999 bp, Artificial Sequence
  Description of Artificial Sequence: Synthetic coding sequence
atggtgttcagaagccccctggacctgtacagcagccacttcctgctgcccaacttcgccgacagccaccacagaagcatcctgctggccagcagcggcggcggcaacggcgccggcggcggcggcggcgccggcggcggcagcggcggcggcaacggcgccggcggcggcggcgccggcggcgccggcggcggcggcggcggcggcagcagagccccccccgaggagctgagcatgttccagctgcccaccctgaacttcagccccgagcaggtggccagcgtgtgcgagaccctggaggagaccggcgacatcgagagactgggcagattcctgtggagcctgcccgtggcccccggcgcctgcgaggccatcaacaagcacgagagcatcctgagagccagagccgtggtggccttccacaccggcaacttcagagacctgtaccacatcctggagaaccacaagttcaccaaggagagccacggcaagctgcaggccatgtggctggaggcccactaccaggaggccgagaagctgagaggcagacccctgggccccgtggacaagtacagagtgagaaagaagttccccctgcccagaaccatctgggacggcgagcagaagacccactgcttcaaggagagaaccagaagcctgctgagagagtggtacctgcaggacccctaccccaaccccagcaagaagagagagctggcccaggccaccggcctgacccccacccaggtgggcaactggttcaagaacagaagacagagagacagagccgccgccgccaagaacagactgcagcaccaggccatcggccccagcggcatgagaagcctggccgagcccggctgccccacccacggcagcgccgagagccccagcaccgccgccagccccaccaccagcgtgagcagcctgaccgagagagccgacaccggcaccagcatcctgagcgtgaccagcagcgacagcgagtgcgacgtgtag

SEQ ID NO: 99075 - DNA, 1020 bp, Artificial Sequence; identical to SEQ ID NO: 78904
  Description of Artificial Sequence: Synthetic coding sequence

SEQ ID NO: 99076 - DNA, 2220 bp, Artificial Sequence
  Description of Artificial Sequence: Synthetic coding sequence
atggccaccctgcccgccgagcccagcgccggccccgccgccggcggcgaggccgtggccgccgccgccgccaccgaggaggaggaggaggaggccagacagctgctgcagaccctgcaggccgccgagggcgaggccgccgccgccgccggcgccggcgccggcgccgccgccgccggcgccgagggccccggcagccccggcgtgcccggcagcccccccgaggccgccagcgagccccccaccggcctgagattcagccccgagcaggtggcctgcgtgtgcgaggccctgctgcaggccggccacgccggcagactgagcagattcctgggcgccctgccccccgccgagagactgagaggcagcgaccccgtgctgagagccagagccctggtggccttccagagaggcgagtacgccgagctgtacagactgctggagagcagacccttccccgccgcccaccacgccttcctgcaggacctgtacctgagagccagataccacgaggccgagagagccagaggcagagccctgggcgccgtggacaagtacagactgagaaagaagttccccctgcccaagaccatctgggacggcgaggagaccgtgtactgcttcaaggagagaagcagagccgccctgaaggcctgctacagaggcaacagataccccacccccgacgagaagagaagactggccaccctgaccggcctgagcctgacccaggtgagcaactggttcaagaacagaagacagagagacagaaccggcgccggcggcggcgccccctgcaagagcgagagcgacggcaaccccaccaccgaggacgagagcagcagaagccccgaggacctggagagaggcgccgcccccgtgagcgccgaggccgccgcccagggcagcatcttcctggccggcaccggcccccccgccccctgccccgccagcagcagcatcctggtgaacggcagcttcctggccgccagcggcagccccgccgtgctgctgaacggcggccccgtgatcatcaacggcctggccctgggcgaggccagcagcctgggccccctgctgctgaccggcggcggcggcgccccccccccccagcccagcccccagggcgccagcgagaccaagaccagcctggtgctggacccccagaccggcgaggtgagactggaggaggcccagagcgaggcccccgagaccaagggcgcccaggtggccgcccccggccccgccctgggcgaggaggtgctgggccccctggcccaggtggtgcccggcccccccaccgccgccaccttccccctgccccccggccccgtgcccgccgtggccgccccccaggtggtgcccctgagccccccccccggctaccccaccggcctgagccccaccagccccctgctgaacctgccccaggtggtgcccaccagccaggtggtgaccctgccccaggccgtgggccccctgcagctgctggccgccggccccggcagccccgtgaaggtggccgccgccgccggccccgccaacgtgcacctgatcaacagcggcgtgggcgtgaccgccctgcagctgcccagcgccaccgcccccggcaacttcctgctggccaaccccgtgagcggcagccccatcgtgaccggcgtggccctgcagcagggcaagatcatcctgaccgccaccttccccaccagcatgctggtgagccaggtgctgccccccgcccccggcctggccctgcccctgaagcccgagaccgccatcagcgtgcccgagggcggcctgcccgtggcccccagccccgccctgcccgaggcccacgccctgggcaccctgagcgcccagcagcccccccccgccgccgccaccaccagcagcaccagcctgcccttcagccccgacagccccggcctgctgcccaacttccccgcccccccccccgagggcctgatgctgagccccgccgccgtgcccgtgtggagcgccggcctggagctgagcgccggcaccgagggcctgctggaggccgagaagggcctgggcacccaggccccccacaccgtgctgagactgcccgaccccgaccccgagggcctgctgctgggcgccaccgccggcggcgaggtggacgagggcctggaggccgaggccaaggtgctgacccagctgcagagcgtgcccgtggaggagcccctggagctgtag

SEQ ID NO: 99077 - DNA, 741 bp, Artificial Sequence
  Description of Artificial Sequence: Synthetic coding sequence
atgttccagctgcccatcctgaacttcagcccccagcaggtggccggcgtgtgcgagaccctggaggagagcggcgacgtggagagactgggcagattcctgtggagcctgcccgtggcccccgccgcctgcgaggccctgaacaagaacgagagcgtgctgagagccagagccatcgtggccttccacggcggcaactacagagagctgtaccacatcctggagaaccacaagttcaccaaggagagccacgccaagctgcaggccctgtggctggaggcccactaccaggaggccgagaagctgagaggcagacccctgggccccgtggacaagtacagagtgagaaagaagttccccctgcccagaaccatctgggacggcgagcagaagacccactgcttcaaggagagaaccagacacctgctgagagagtggtacctgcaggacccctaccccaaccccagcaagaagagagagctggcccaggccaccggcctgacccccacccaggtgggcaactggttcaagaacagaagacagagagacagagccgccgccgccaagaacagactgcagcagcaggtgctgagccagggcagcggcagagccctgagagccgagggcgacggcacccccgaggtgctgggcgtggccaccagccccgccgccagcctgagcagcaaggccgccaccagcgccatcagcatcaccagcagcgacagcgagtgcgacatctag

SEQ ID NO: 99078 - DNA, 360 bp, Artificial Sequence
  Description of Artificial Sequence: Synthetic coding sequence
atgacccagcagggcgccgccctgcagaactacaacaacgagctggtgaagtgcatcgaggagctgtgccagaagagagaggagctgtgcagacagatccaggaggaggaggacgagaagcagagactgcagaacgaggtgagacagctgaccgagaagctggccagagtgaacgagaacctggccagaaagatcgccagcagaaacgagttcgacagaaccatcgccgagaccgaggccgcctacctgaagatcctggagagcagccagaccctgctgagcgtgctgaagagagaggccggcaacctgaccaaggccaccgcccccgaccagaagagcagcggcggcagagacagctag

SEQ ID NO: 99079 - DNA, 666 bp, Artificial Sequence
  Description of Artificial Sequence: Synthetic coding sequence
atgctgtggctgttccagagcctgctgttcgtgttctgcttcggccccggccagctgagaaacatccaggtgaccaaccacagccagctgttccagaacatgacctgcgagctgcacctgacctgcagcgtggaggacgccgacgacaacgtgagcttcagatgggaggccctgggcaacaccctgagcagccagcccaacctgaccgtgagctgggaccccagaatcagcagcgagcaggactacacctgcatcgccgagaacgccgtgagcaacctgagcttcagcgtgagcgcccagaagctgtgcgaggacgtgaagatccagtacaccgacaccaagatgatcctgttcatggtgagcggcatctgcatcgtgttcggcttcatcatcctgctgctgctggtgctgagaaagagaagagacagcctgagcctgagcacccagagaacccagggccccgccgagagcgccagaaacctggagtacgtgagcgtgagccccaccaacaacaccgtgtacgccagcgtgacccacagcaacagagagaccgagatctggacccccagagagaacgacaccatcaccatctacagcaccatcaaccacagcaaggagagcaagcccaccttcagcagagccaccgccctggacaacgtggtgtag

SEQ ID NO: 99080 - DNA, 999 bp, Artificial Sequence
  Description of Artificial Sequence: Synthetic coding sequence
atgctgtggctgttccagagcctgctgttcgtgttctgcttcggccccggcaacgtggtgagccagagcagcctgacccccctgatggtgaacggcatcctgggcgagagcgtgaccctgcccctggagttccccgccggcgagaaggtgaacttcatcacctggctgttcaacgagaccagcctggccttcatcgtgccccacgagaccaagagccccgagatccacgtgaccaaccccaagcagggcaagagactgaacttcacccagagctacagcctgcagctgagcaacctgaagatggaggacaccggcagctacagagcccagatcagcaccaagaccagcgccaagctgagcagctacaccctgagaatcctgagacagctgagaaacatccaggtgaccaaccacagccagctgttccagaacatgacctgcgagctgcacctgacctgcagcgtggaggacgccgacgacaacgtgagcttcagatgggaggccctgggcaacaccctgagcagccagcccaacctgaccgtgagctgggaccccagaatcagcagcgagcaggactacacctgcatcgccgagaacgccgtgagcaacctgagcttcagcgtgagcgcccagaagctgtgcgaggacgtgaagatccagtacaccgacaccaagatgatcctgttcatggtgagcggcatctgcatcgtgttcggcttcatcatcctgctgctgctggtgctgagaaagagaagagacagcctgagcctgagcacccagagaacccagggccccgccgagagcgccagaaacctggagtacgtgagcgtgagccccaccaacaacaccgtgtacgccagcgtgacccacagcaacagagagaccgagatctggacccccagagagaacgacaccatcaccatctacagcaccatcaaccacagcaaggagagcaagcccaccttcagcagagccaccgccctggacaacgtggtgtag

SEQ ID NO: 99081 - DNA, 996 bp, Artificial Sequence
  Description of Artificial Sequence: Synthetic coding sequence
atgctgtggctgttccagagcctgctgttcgtgttctgcttcggccccggcaacgtggtgagccagagcagcctgacccccctgatggtgaacggcatcctgggcgagagcgtgaccctgcccctggagttccccgccggcgagaaggtgaacttcatcacctggctgttcaacgagaccagcctggccttcatcgtgccccacgagaccaagagccccgagatccacgtgaccaaccccaagcagggcaagagactgaacttcacccagagctacagcctgcagctgagcaacctgaagatggaggacaccggcagctacagagcccagatcagcaccaagaccagcgccaagctgagcagctacaccctgagaatcctgagacagctgagaaacatccaggtgaccaaccacagccagctgttccagaacatgacctgcgagctgcacctgacctgcagcgtggaggacgccgacgacaacgtgagcttcagatgggaggccctgggcaacaccctgagcagccagcccaacctgaccgtgagctgggaccccagaatcagcagcgagcaggactacacctgcatcgccgagaacgccgtgagcaacctgagcttcagcgtgagcgcccagaagctgtgcgaggacgtgaagatccagtacaccgacaccaagatgatcctgttcatggtgagcggcatctgcatcgtgttcggcttcatcatcctgctgctgctggtgctgagaaagagaagagacagcctgagcctgagcacccagagaacccagggccccgagagcgccagaaacctggagtacgtgagcgtgagccccaccaacaacaccgtgtacgccagcgtgacccacagcaacagagagaccgagatctggacccccagagagaacgacaccatcaccatctacagcaccatcaaccacagcaaggagagcaagcccaccttcagcagagccaccgccctggacaacgtggtgtag

SEQ ID NO: 99082 - DNA, 891 bp, Artificial Sequence
  Description of Artificial Sequence: Synthetic coding sequence
atggccggcagccccacctgcctgaccctgatctacatcctgtggcagctgaccggcagcgccgccagcggccccgtgaaggagctggtgggcagcgtgggcggcgccgtgaccttccccctgaagagcaaggtgaagcaggtggacagcatcgtgtggaccttcaacaccacccccctggtgaccatccagcccgagggcggcaccatcatcgtgacccagaacagaaacagagagagagtggacttccccgacggcggctacagcctgaagctgagcaagctgaagaagaacgacagcggcatctactacgtgggcatctacagcagcagcctgcagcagcccagcacccaggagtacgtgctgcacgtgtacgagcacctgagcaagcccaaggtgaccatgggcctgcagagcaacaagaacggcacctgcgtgaccaacctgacctgctgcatggagcacggcgaggaggacgtgatctacacctggaaggccctgggccaggccgccaacgagagccacaacggcagcatcctgcccatcagctggagatggggcgagagcgacatgaccttcatctgcgtggccagaaaccccgtgagcagaaacttcagcagccccatcctggccagaaagctgtgcgagggcgccgccgacgaccccgacagcagcatggtgctgctgtgcctgctgctggtgcccctgctgctgagcctgttcgtgctgggcctgttcctgtggttcctgaagagagagagacaggaggagaacaaccccaagggcagaagcagcaagtacggcctgctgcactgcggcaacaccgagaaggacggcaagagccccctgaccgcccacgacgccagacacaccaaggccatctgcctgtag

SEQ ID NO: 99083 - DNA, 687 bp, Artificial Sequence
  Description of Artificial Sequence: Synthetic coding sequence
atggccggcagccccacctgcctgaccctgatctacatcctgtggcagctgaccgagcacctgagcaagcccaaggtgaccatgggcctgcagagcaacaagaacggcacctgcgtgaccaacctgacctgctgcatggagcacggcgaggaggacgtgatctacacctggaaggccctgggccaggccgccaacgagagccacaacggcagcatcctgcccatcagctggagatggggcgagagcgacatgaccttcatctgcgtggccagaaaccccgtgagcagaaacttcagcagccccatcctggccagaaagctgtgcgagggcgccgccgacgaccccgacagcagcatggtgctgctgtgcctgctgctggtgcccctgctgctgagcctgttcgtgctgggcctgttcctgtggttcctgaagagagagagacaggaggagtacatcgaggagaagaagagagtggacatctgcagagagacccccaacatctgcccccacagcggcgagaacaccgagtacgacaccatcccccacaccaacagaaccatcctgaaggaggaccccgccaacaccgtgtacagcaccgtggagatccccaagaagatggagaacccccacagcctgctgaccatgcccgacacccccagactgttcgcctacgagaacgtgatctag

SEQ ID NO: 99084 - DNA, 1008 bp, Artificial Sequence
  Description of Artificial Sequence: Synthetic coding sequence
atggccggcagccccacctgcctgaccctgatctacatcctgtggcagctgaccggcagcgccgccagcggccccgtgaaggagctggtgggcagcgtgggcggcgccgtgaccttccccctgaagagcaaggtgaagcaggtggacagcatcgtgtggaccttcaacaccacccccctggtgaccatccagcccgagggcggcaccatcatcgtgacccagaacagaaacagagagagagtggacttccccgacggcggctacagcctgaagctgagcaagctgaagaagaacgacagcggcatctactacgtgggcatctacagcagcagcctgcagcagcccagcacccaggagtacgtgctgcacgtgtacgagcacctgagcaagcccaaggtgaccatgggcctgcagagcaacaagaacggcacctgcgtgaccaacctgacctgctgcatggagcacggcgaggaggacgtgatctacacctggaaggccctgggccaggccgccaacgagagccacaacggcagcatcctgcccatcagctggagatggggcgagagcgacatgaccttcatctgcgtggccagaaaccccgtgagcagaaacttcagcagccccatcctggccagaaagctgtgcgagggcgccgccgacgaccccgacagcagcatggtgctgctgtgcctgctgctggtgcccctgctgctgagcctgttcgtgctgggcctgttcctgtggttcctgaagagagagagacaggaggagtacatcgaggagaagaagagagtggacatctgcagagagacccccaacatctgcccccacagcggcgagaacaccgagtacgacaccatcccccacaccaacagaaccatcctgaaggaggaccccgccaacaccgtgtacagcaccgtggagatccccaagaagatggagaacccccacagcctgctgaccatgcccgacacccccagactgttcgcctacgagaacgtgatctag

SEQ ID NO: 99085 - DNA, 615 bp, Artificial Sequence
  Description of Artificial Sequence: Synthetic coding sequence
atggccggcagccccacctgcctgaccctgatctacatcctgtggcagctgaccggcagcgccgccagcggccccgtgaaggagctggtgggcagcgtgggcggcgccgtgaccttccccctgaagagcaaggtgaagcaggtggacagcatcgtgtggaccttcaacaccacccccctggtgaccatccagcccgagggcggcaccatcatcgtgacccagaacagaaacagagagagagtggacttccccgacggcggctacagcctgaagctgagcaagctgaagaagaacgacagcggcatctactacgtgggcatctacagcagcagcctgcagcagcccagcacccaggagtacgtgctgcacgtgtacgagtacatcgaggagaagaagagagtggacatctgcagagagacccccaacatctgcccccacagcggcgagaacaccgagtacgacaccatcccccacaccaacagaaccatcctgaaggaggaccccgccaacaccgtgtacagcaccgtggagatccccaagaagatggagaacccccacagcctgctgaccatgcccgacacccccagactgttcgcctacgagaacgtgatctag

SEQ ID NO: 99086 - DNA, 498 bp, Artificial Sequence
  Description of Artificial Sequence: Synthetic coding sequence
atggccggcagccccacctgcctgaccctgatctacatcctgtggcagctgaccggcagcgccgccagcggccccgtgaaggagctggtgggcagcgtgggcggcgccgtgaccttccccctgaagagcaaggtgaagcaggtggacagcatcgtgtggaccttcaacaccacccccctggtgaccatccagcccgagggcggcaccatcatcgtgacccagaacagaaacagagagagagtggacttccccgacggcggctacagcctgaagctgagcaagctgaagaagaacgacagcggcatctactacgtgggcatctacagcagcagcctgcagcagcccagcacccaggagtacgtgctgcacgtgtacgagaacaaccccaagggcagaagcagcaagtacggcctgctgcactgcggcaacaccgagaaggacggcaagagccccctgaccgcccacgacgccagacacaccaaggccatctgcctgtag

SEQ ID NO: 99087 - DNA, 450 bp, Artificial Sequence
  Description of Artificial Sequence: Synthetic coding sequence
atggccggcagccccacctgcctgaccctgatctacatcctgtggcagctgaccgagcacctgagcaagcccaaggtgaccatgggcctgcagagcaacaagaacggcacctgcgtgaccaacctgacctgctgcatggagcacggcgaggaggacgtgatctacacctggaaggccctgggccaggccgccaacgagagccacaacggcagcatcctgcccatcagctggagatggggcgagagcgacatgaccttcatctgcgtggccagaaaccccgtgagcagaaacttcagcagccccatcctggccagaaagctgtgcgaggagaacaaccccaagggcagaagcagcaagtacggcctgctgcactgcggcaacaccgagaaggacggcaagagccccctgaccgcccacgacgccagacacaccaaggccatctgcctgtag

SEQ ID NO: 99088 - DNA, 567 bp, Artificial Sequence
  Description of Artificial Sequence: Synthetic coding sequence
atggccggcagccccacctgcctgaccctgatctacatcctgtggcagctgaccgagcacctgagcaagcccaaggtgaccatgggcctgcagagcaacaagaacggcacctgcgtgaccaacctgacctgctgcatggagcacggcgaggaggacgtgatctacacctggaaggccctgggccaggccgccaacgagagccacaacggcagcatcctgcccatcagctggagatggggcgagagcgacatgaccttcatctgcgtggccagaaaccccgtgagcagaaacttcagcagccccatcctggccagaaagctgtgcgaggagtacatcgaggagaagaagagagtggacatctgcagagagacccccaacatctgcccccacagcggcgagaacaccgagtacgacaccatcccccacaccaacagaaccatcctgaaggaggaccccgccaacaccgtgtacagcaccgtggagatccccaagaagatggagaacccccacagcctgctgaccatgcccgacacccccagactgttcgcctacgagaacgtgatctag

SEQ ID NO: 99089 - DNA, 858 bp, Artificial Sequence
  Description of Artificial Sequence: Synthetic coding sequence
atggtgatgagacccctgtggagcctgctgctgtgggaggccctgctgcccatcaccgtgaccggcgcccaggtgctgagcaaggtgggcggcagcgtgctgctggtggccgccagaccccccggcttccaggtgagagaggccatctggagaagcctgtggcccagcgaggagctgctggccaccttcttcagaggcagcctggagaccctgtaccacagcagattcctgggcagagcccagctgcacagcaacctgagcctggagctgggccccctggagagcggcgacagcggcaacttcagcgtgctgatggtggacaccagaggccagccctggacccagaccctgcagctgaaggtgtacgacgccgtgcccagacccgtggtgcaggtgttcatcgccgtggagagagacgcccagcccagcaagacctgccaggtgttcctgagctgctgggcccccaacatcagcgagatcacctacagctggagaagagagaccaccatggacttcggcatggagccccacagcctgttcaccgacggccaggtgctgagcatcagcctgggccccggcgacagagacgtggcctacagctgcatcgtgagcaaccccgtgagctgggacctggccaccgtgaccccctgggacagctgccaccacgaggccgcccccggcaaggccagctacaaggacgtgctgctggtggtggtgcccgtgagcctgctgctgatgctggtgaccctgttcagcgcctggcactggtgcccctgcagcggcaagaagaagaaggacgtgcacgccgacagagtgggccccgagaccgagaaccccctggtgcaggacctgccctag

SEQ ID NO: 99090 - DNA, 531 bp, Artificial Sequence
  Description of Artificial Sequence: Synthetic coding sequence
atggtgatgagacccctgtggagcctgctgctgtgggaggacgccgtgcccagacccgtggtgcaggtgttcatcgccgtggagagagacgcccagcccagcaagacctgccaggtgttcctgagctgctgggcccccaacatcagcgagatcacctacagctggagaagagagaccaccatggacttcggcatggagccccacagcctgttcaccgacggccaggtgctgagcatcagcctgggccccggcgacagagacgtggcctacagctgcatcgtgagcaaccccgtgagctgggacctggccaccgtgaccccctgggacagctgccaccacgaggccgcccccggcaaggccagctacaaggacgtgctgctggtggtggtgcccgtgagcctgctgctgatgctggtgaccctgttcagcgcctggcactggtgcccctgcagcggcaagaagaagaaggacgtgcacgccgacagagtgggccccgagaccgagaaccccctggtgcaggacctgccctag

SEQ ID NO: 99091 - DNA, 444 bp, Artificial Sequence
  Description of Artificial Sequence: Synthetic coding sequence
atgggcggcagacaccacctgcagagacaggtgagcgagagcatgagcgccctgttccaggccgtgagactggagagcgcctgggccgacagagtgagatacatggtggtggtgtacagcagcggcagacaggacaccgaggagaacatcctgctgggcgtggacttcagcagcaaggagagcggcttcagcgtgagcaccgccggcagaatgcacatcttcaagcccgtgagcgtgcaggccatgtggagcgccctgcaggtgctgcacaaggcctgcgaggtggccagaagacacaactacttccccggcggcgtggccctgatctgggccacctactacgagagctgcatcagcagcgagcagagctgcatcaacgagtggaacgccatgcaggacctggagagcaccagacccgacagccccgccctgttcgtggactag

SEQ ID NO: 99092 - DNA, 2112 bp, Artificial Sequence
  Description of Artificial Sequence: Synthetic coding sequence
atggccagagccagaagagccgtggtgggcagcgtgagagacgtgagcaccgccgccaccaacctgttctacttcaccgacttctgcatcttcctgcagcccacccactgcttctgctgccccgaggtgagcagcagcaactacctgagcgagagcttcttcatggtgaagggcgccgccctgttcctgcagcagggcagcagcccccagggccagagaagcctgcagcacccccacaagcacgccggcgacctgccccagcacctgcaggtgatgatcaacctgctgagatgcgaggacagaatcaagctggccgtgagactggagagcgcctgggccgacagagtgagatacatggtggtggtgtacagcagcggcagacaggacaccgaggagaacatcctgctgggcgtggacttcagcagcaaggagagcaagagctgcaccatcggcatggtgctgagactgtggagcgacaccaagatccacctggacggcgacggcggcttcagcgtgagcaccgccggcagaatgcacatcttcaagcccgtgagcgtgcaggccatgtggagcgccctgcaggtgctgcacaaggcctgcgaggtggccagaagacacaactacttccccggcggcgtggccctgatctgggccacctactacgagagctgcatcagcagcgagcagagctgcatcaacgagtggaacgccatgcaggacctggagagcaccagacccgacagccccgccctgttcgtggacaagcccaccgagggcgagagaaccgagagactgatcaaggccaagctgagaagcatcatgatgagccaggacctggagaacgtgaccagcaaggagatcagaaacgagctggagaagcagatgaactgcaacctgaaggagctgaaggagttcatcgacaacgagatgctgctgatcctgggccagatggacaagcccagcctgatcttcgaccacctgtacctgggcagcgagtggaacgccagcaacctggaggagctgcagggcagcggcgtggactacatcctgaacgtgaccagagagatcgacaacttcttccccggcctgttcgcctaccacaacatcagagtgtacgacgaggagaccaccgacctgctggcccactggaacgaggcctaccacttcatcaacaaggccaagagaaaccacagcaagtgcctggtgcactgcaagatgggcgtgagcagaagcgccagcaccgtgatcgcctacgccatgaaggagttcggctggcccctggagaaggcctacaactacgtgaagcagaagagaagcatcaccagacccaacgccggcttcatgagacagctgagcgagtacgagggcatcctggacgccagcaagcagagacacaacaagctgtggagacagcagaccgacagcagcctgcagcagcccgtggacgaccccgccggccccggcgacttcctgcccgagacccccgacggcacccccgagagccagctgcccttcctggacgacgccgcccagcccggcctgggcccccccctgccctgctgcttcagaagactgagcgaccccctgctgcccagccccgaggacgagaccggcagcctggtgcacctggaggaccccgagagagaggccctgctggaggaggccgccccccccgccgaggtgcacagacccgccagacagccccagcagggcagcggcctgtgcgagaaggacgtgaagaagaagctggagttcggcagccccaagggcagaagcggcagcctgctgcaggtggaggagaccgagagagaggagggcctgggcgccggcagatggggccagctgcccacccagctggaccagaacctgctgaacagcgagaacctgaacaacaacagcaagagaagctgccccaacggcatggaggtgggcagagccagacccgccggctggcacacccccagcctgcccagccacagcaactggcccaccagcgccagcgtggtgggcaccaccggcaccagacaccacacccagctgatcttcttctactgcctgctgtgggcccccagcagccacctgcagggccccgagggcagcttcaccggctag

SEQ ID NO: 99093 - DNA, 3150 bp, Artificial Sequence
  Description of Artificial Sequence: Synthetic coding sequence
atggccctggtgaccctgcagagaagccccacccccagcgccgccagcagcagcgccagcaacagcgagctggaggccggcagcgaggaggacagaaagctgaacctgagcctgagcgagagcttcttcatggtgaagggcgccgccctgttcctgcagcagggcagcagcccccagggccagagaagcctgcagcacccccacaagcacgccggcgacctgccccagcacctgcaggtgatgatcaacctgctgagatgcgaggacagaatcaagctggccgtgagactggagagcgcctgggccgacagagtgagatacatggtggtggtgtacagcagcggcagacaggacaccgaggagaacatcctgctgggcgtggacttcagcagcaaggagagcaagagctgcaccatcggcatggtgctgagactgtggagcgacaccaagatccacctggacggcgacggcggcttcagcgtgagcaccgccggcagaatgcacatcttcaagcccgtgagcgtgcaggccatgtggagcgccctgcaggtgctgcacaaggcctgcgaggtggccagaagacacaactacttccccggcggcgtggccctgatctgggccacctactacgagagctgcatcagcagcgagcagagctgcatcaacgagtggaacgccatgcaggacctggagagcaccagacccgacagccccgccctgttcgtggacaagcccaccgagggcgagagaaccgagagactgatcaaggccaagctgagaagcatcatgatgagccaggacctggagaacgtgaccagcaaggagatcagaaacgagctggagaagcagatgaactgcaacctgaaggagctgaaggagttcatcgacaacgagatgctgctgatcctgggccagatggacaagcccagcctgatcttcgaccacctgtacctgggcagcgagtggaacgccagcaacctggaggagctgcagggcagcggcgtggactacatcctgaacgtgaccagagagatcgacaacttcttccccggcctgttcgcctaccacaacatcagagtgtacgacgaggagaccaccgacctgctggcccactggaacgaggcctaccacttcatcaacaaggccaagagaaaccacagcaagtgcctggtgcactgcaagatgggcgtgagcagaagcgccagcaccgtgatcgcctacgccatgaaggagttcggctggcccctggagaaggcctacaactacgtgaagcagaagagaagcatcaccagacccaacgccggcttcatgagacagctgagcgagtacgagggcatcctggacgccagcaagcagagacacaacaagctgtggagacagcagaccgacagcagcctgcagcagcccgtggacgaccccgccggccccggcgacttcctgcccgagacccccgacggcacccccgagagccagctgcccttcctggacgacgccgcccagcccggcctgggcccccccctgccctgctgcttcagaagactgagcgaccccctgctgcccagccccgaggacgagaccggcagcctggtgcacctggaggaccccgagagagaggccctgctggaggaggccgccccccccgccgaggtgcacagacccgccagacagccccagcagggcagcggcctgtgcgagaaggacgtgaagaagaagctggagttcggcagccccaagggcagaagcggcagcctgctgcaggtggaggagaccgagagagaggagggcctgggcgccggcagatggggccagctgcccacccagctggaccagaacctgctgaacagcgagaacctgaacaacaacagcaagagaagctgccccaacggcatggaggacgacgccatcttcggcatcctgaacaaggtgaagcccagctacaagagctgcgccgactgcatgtaccccaccgccagcggcgcccccgaggccagcagagagagatgcgaggaccccaacgcccccgccatctgcacccagcccgccttcctgccccacatcaccagcagccccgtggcccacctggccagcagaagcagagtgcccgagaagcccgccagcggccccaccgagcccccccccttcctgccccccgccggcagcagaagagccgacaccagcggccccggcgccggcgccgccctggagccccccgccagcctgctggagcccagcagagagacccccaaggtgctgcccaagagcctgctgctgaagaacagccactgcgacaagaacccccccagcaccgaggtggtgatcaaggaggagagcagccccaagaaggacatgaagcccgccaaggacctgagactgctgttcagcaacgagagcgagaagcccaccaccaacagctacctgatgcagcaccaggagagcatcatccagctgcagaaggccggcctggtgagaaagcacaccaaggagctggagagactgaagagcgtgcccgccgaccccgccccccccagcagagacggccccgccagcagactggaggccagcatccccgaggagagccaggaccccgccgccctgcacgagctgggccccctggtgatgcccagccaggccggcagcgacgagaagagcgaggccgcccccgccagcctggagggcggcagcctgaagagccccccccccttcttctacagactggaccacaccagcagcttcagcaaggacttcctgaagaccatctgctacacccccaccagcagcagcatgagcagcaacctgaccagaagcagcagcagcgacagcatccacagcgtgagaggcaagcccggcctggtgaagcagagaacccaggagatcgagaccagactgagactggccggcctgaccgtgagcagccccctgaagagaagccacagcctggccaagctgggcagcctgaccttcagcaccgaggacctgagcagcgaggccgaccccagcaccgtggccgacagccaggacaccaccctgagcgagagcagcttcctgcacgagccccagggcacccccagagaccccgccgccaccagcaagcccagcggcaagcccgcccccgagaacctgaagagccccagctggatgagcaagagctag

SEQ ID NO: 99094 - DNA, 2214 bp, Artificial Sequence
  Description of Artificial Sequence: Synthetic coding sequence
atgagatgctacctgagctgggacagatggaccagcccccccctgagcagcatcatcttcatcagcgtggactacatcctgaacgtgaccagagagatcgacaacttcttccccggcctgttcgcctaccacaacatcagagtgtacgacgaggagaccaccgacctgctggcccactggaacgaggcctaccacttcatcaacaaggccaagagaaaccacagcaagtgcctggtgcactgcaagatgggcgtgagcagaagcgccagcaccgtgatcgcctacgccatgaaggagttcggctggcccctggagaaggcctacaactacgtgaagcagaagagaagcatcaccagacccaacgccggcttcatgagacagctgagcgagtacgagggcatcctggacgccagcaagcagagacacaacaagctgtggagacagcagaccgacagcagcctgcagcagcccgtggacgaccccgccggccccggcgacttcctgcccgagacccccgacggcacccccgagagccagctgcccttcctggacgacgccgcccagcccggcctgggcccccccctgccctgctgcttcagaagactgagcgaccccctgctgcccagccccgaggacgagaccggcagcctggtgcacctggaggaccccgagagagaggccctgctggaggaggccgccccccccgccgaggtgcacagacccgccagacagccccagcagggcagcggcctgtgcgagaaggacgtgaagaagaagctggagttcggcagccccaagggcagaagcggcagcctgctgcaggtggaggagaccgagagagaggagggcctgggcgccggcagatggggccagctgcccacccagctggaccagaacctgctgaacagcgagaacctgaacaacaacagcaagagaagctgccccaacggcatggaggacgacgccatcttcggcatcctgaacaaggtgaagcccagctacaagagctgcgccgactgcatgtaccccaccgccagcggcgcccccgaggccagcagagagagatgcgaggaccccaacgcccccgccatctgcacccagcccgccttcctgccccacatcaccagcagccccgtggcccacctggccagcagaagcagagtgcccgagaagcccgccagcggccccaccgagcccccccccttcctgccccccgccggcagcagaagagccgacaccagcggccccggcgccggcgccgccctggagccccccgccagcctgctggagcccagcagagagacccccaaggtgctgcccaagagcctgctgctgaagaacagccactgcgacaagaacccccccagcaccgaggtggtgatcaaggaggagagcagccccaagaaggacatgaagcccgccaaggacctgagactgctgttcagcaacgagagcgagaagcccaccaccaacagctacctgatgcagcaccaggagagcatcatccagctgcagaaggccggcctggtgagaaagcacaccaaggagctggagagactgaagagcgtgcccgccgaccccgccccccccagcagagacggccccgccagcagactggaggccagcatccccgaggagagccaggaccccgccgccctgcacgagctgggccccctggtgatgcccagccaggccggcagcgacgagaagagcgaggccgcccccgccagcctggagggcggcagcctgaagagccccccccccttcttctacagactggaccacaccagcagcttcagcaaggacttcctgaagaccatctgctacacccccaccagcagcagcatgagcagcaacctgaccagaagcagcagcagcgacagcatccacagcgtgagaggcaagcccggcctggtgaagcagagaacccaggagatcgagaccagactgagactggccggcctgaccgtgagcagccccctgaagagaagccacagcctggccaagctgggcagcctgaccttcagcaccgaggacctgagcagcgaggccgaccccagcaccgtggccgacagccaggacaccaccctgagcgagagcagcttcctgcacgagccccagggcacccccagagaccccgccgccaccagcaagcccagcggcaagcccgcccccgagaacctgaagagccccagctggatgagcaagagctag

SEQ ID NO: 99095 - DNA, 2079 bp, Artificial Sequence
  Description of Artificial Sequence: Synthetic coding sequence
atggccctggtgaccctgcagagaagccccacccccagcgccgccagcagcagcgccagcaacagcgagctggaggccggcagcgaggaggacagaaagctgaacctgagcctgagcgagagcttcttcatggtgaagggcgccgccctgttcctgcagcagggcagcagcccccagggccagagaagcctgcagcacccccacaagcacgccggcgacctgccccagcacctgcaggtgatgatcaacctgctgagatgcgaggacagaatcaagctggccgtgagactggagagcgcctgggccgacagagtgagatacatggtggtggtgtacagcagcggcagacaggacaccgaggagaacatcctgctgggcgtggacttcagcagcaaggagagcaagagctgcaccatcggcatggtgctgagactgtggagcgacaccaagatccacctggacggcgacggcggcttcagcgtgagcaccgccggcagaatgcacatcttcaagcccgtgagcgtgcaggccatgtggagcgccctgcaggtgctgcacaaggcctgcgaggtggccagaagacacaactacttccccggcggcgtggccctgatctgggccacctactacgagagctgcatcagcagcgagcagagctgcatcaacgagtggaacgccatgcaggacctggagagcaccagacccgacagccccgccctgttcgtggacaagcccaccgagggcgagagaaccgagagactgatcaaggccaagctgagaagcatcatgatgagccaggacctggagaacgtgaccagcaaggagatcagaaacgagctggagaagcagatgaactgcaacctgaaggagctgaaggagttcatcgacaacgagatgctgctgatcctgggccagatggacaagcccagcctgatcttcgaccacctgtacctgggcagcgagtggaacgccagcaacctggaggagctgcagggcagcggcgtggactacatcctgaacgtgaccagagagatcgacaacttcttccccggcctgttcgcctaccacaacatcagagtgtacgacgaggagaccaccgacctgctggcccactggaacgaggcctaccacttcatcaacaaggccaagagaaaccacagcaagtgcctggtgcactgcaagatgggcgtgagcagaagcgccagcaccgtgatcgcctacgccatgaaggagttcggctggcccctggagaaggcctacaactacgtgaagcagaagagaagcatcaccagacccaacgccggcttcatgagacagctgagcgagtacgagggcatcctggacgccagcaagcagagacacaacaagctgtggagacagcagaccgacagcagcctgcagcagcccgtggacgaccccgccggccccggcgacttcctgcccgagacccccgacggcacccccgagagccagctgcccttcctggacgacgccgcccagcccggcctgggcccccccctgccctgctgcttcagaagactgagcgaccccctgctgcccagccccgaggacgagaccggcagcctggtgcacctggaggaccccgagagagaggccctgctggaggaggccgccccccccgccgaggtgcacagacccgccagacagccccagcagggcagcggcctgtgcgagaaggacgtgaagaagaagctggagttcggcagccccaagggcagaagcggcagcctgctgcaggtggaggagaccgagagagaggagggcctgggcgccggcagatggggccagctgcccacccagctggaccagaacctgctgaacagcgagaacctgaacaacaacagcaagagaagctgccccaacggcatggaggtgggcagagccagacccgccggctggcacacccccagcctgcccagccacagcaactggcccaccagcgccagcgtggtgggcaccaccggcaccagacaccacacccagctgatcttcttctactgcctgctgtgggcccccagcagccacctgcagggccccgagggcagcttcaccggctag

SEQ ID NO: 99096 - DNA, 4272 bp, Artificial Sequence
  Description of Artificial Sequence: Synthetic coding sequence
atggccctggtgaccgtgcagagaagccccacccccagcaccaccagcagcccctgcgccagcgaggccgacagcggcgaggaggagtgcagaagccagcccagaagcatcagcgagagcttcctgaccgtgaagggcgccgccctgttcctgcccagaggcaacggcagcagcacccccagaatcagccacagaagaaacaagcacgccggcgacctgcagcagcacctgcaggccatgttcatcctgctgagacccgaggacaacatcagactggccgtgagactggagagcacctaccagaacagaaccagatacatggtggtggtgagcaccaacggcagacaggacaccgaggagagcatcgtgctgggcatggacttcagcagcaacgacagcagcacctgcaccatgggcctggtgctgcccctgtggagcgacaccctgatccacctggacggcgacggcggcttcagcgtgagcaccgacaacagagtgcacatcttcaagcccgtgagcgtgcaggccatgtggagcgccctgcagagcctgcacaaggcctgcgaggtggccagagcccacaactactaccccggcagcctgttcctgacctgggtgagctactacgagagccacatcaacagcgaccagagcagcgtgaacgagtggaacgccatgcaggacgtgcagagccacagacccgacagccccgccctgttcaccgacatccccaccgagagagagagaaccgagagactgatcaagaccaagctgagagagatcatgatgcagaaggacctggagaacatcaccagcaaggagatcagaaccgagctggagatgcagatggtgtgcaacctgagagagttcaaggagttcatcgacaacgagatgatcgtgatcctgggccagatggacagccccacccagatcttcgagcacgtgttcctgggcagcgagtggaacgccagcaacctggaggacctgcagaacagaggcgtgagatacatcctgaacgtgaccagagagatcgacaacttcttccccggcgtgttcgagtaccacaacatcagagtgtacgacgaggaggccaccgacctgctggcctactggaacgacacctacaagttcatcagcaaggccaagaagcacggcagcaagtgcctggtgcactgcaagatgggcgtgagcagaagcgccagcaccgtgatcgcctacgccatgaaggagtacggctggaacctggacagagcctacgactacgtgaaggagagaagaaccgtgaccaagcccaaccccagcttcatgagacagctggaggagtaccagggcatcctgctggccagcaagcagagacacaacaagctgtggagaagccacagcgacagcgacctgagcgaccaccacgagcccatctgcaagcccggcctggagctgaacaagaaggacatcaccaccagcgccgaccagatcgccgaggtgaagaccatggagagccacccccccatcccccccgtgttcgtggagcacatggtgccccaggacgccaaccagaagggcctgtgcaccaaggagagaatgatctgcctggagttcaccagcagagagttccacgccggccagatcgaggacgagctgaacctgaacgacatcaacggctgcagcagcggctgctgcctgaacgagagcaagttccccctggacaactgccacgccagcaaggccctgatccagcccggccacgtgcccgagatggccaacaagttccccgacctgaccgtggaggacctggagaccgacgccctgaaggccgacatgaacgtgcacctgctgcccatggaggagctgaccagccccctgaaggacccccccatgagccccgaccccgagagccccagcccccagcccagctgccagaccgagatcagcgacttcagcaccgacagaatcgacttcttcagcgccctggagaagttcgtggagctgagccaggagaccagaagcagaagcttcagccacagcagaatggaggagctgggcggcggcagaaacgagagctgcagactgagcgtggtggaggtggcccccagcaaggtgaccgccgacgaccagagaagcagcagcctgagcaacaccccccacgccagcgaggagagcagcatggacgaggagcagagcaaggccatcagcgagctggtgagccccgacatcttcatgcagagccacagcgagaacgccatcagcgtgaaggagatcgtgaccgagatcgagagcatcagccagggcgtgggccagatccagctgaagggcgacatcctgcccaacccctgccacacccccaagaagaacagcatccacgagctgctgctggagagagcccagacccccgagaacaagcccggccacatggagcaggacgaggacagctgcaccgcccagcccgagctggccaaggacagcggcatgtgcaaccccgagggctgcctgaccacccacagcagcatcgccgacctggaggagggcgagcccgccgagggcgagcaggagctgcagggcagcggcatgcaccccggcgccaagtggtaccccggcagcgtgagaagagccaccctggagttcgaggagagactgagacaggagcaggagcaccacggcgccgcccccacctgcaccagcctgagcaccagaaagaacagcaagaacgacagcagcgtggccgacctggcccccaagggcaagagcgacgaggccccccccgagcacagcttcgtgctgaaggagcccgagatgagcaagggcaagggcaagtacagcggcagcgaggccggcagcctgagccacagcgagcagaacgccaccgtgcccgcccccagagtgctggagttcgaccacctgcccgacccccaggagggccccggcagcgacaccggcacccagcaggagggcgtgctgaaggacctgagaaccgtgatcccctaccaggagagcgagacccaggccgtgcccctgcccctgcccaagagagtggagatcatcgagtacacccacatcgtgaccagccccaaccacaccggccccggcagcgagatcgccaccagcgagaagagcggcgagcagggcctgagaaaggtgaacatggagaagagcgtgaccgtgctgtgcaccctggacgagaacctgaacagaaccctggaccccaaccaggtgagcctgcacccccaggtgctgcccctgccccacagcagcagccccgagcacaacagacccaccgaccaccccaccagcatcctgagcagccccgaggacagaggcagcagcctgagcaccgccctggagaccgccgcccccttcgtgagccacaccacccacctgctgagcgccagcctggactacctgcacccccagaccatggtgcacctggagggcttcaccgagcagagcagcaccaccgacgagcccagcgccgagcaggtgagctgggaggagagccaggagagccccctgagcagcggcagcgaggtgccctacaaggacagccagctgagcagcgccgacctgagcctgatcagcaagctgggcgacaacaccggcgagctgcaggagaagatggaccccctgcccgtggcctgcagactgccccacagcagcagcagcgagaacatcaagagcctgagccacagccccggcgtggtgaaggagagagccaaggagatcgagagcagagtggtgttccaggccggcctgaccaagcccagccagatgagaagaagcgccagcctggccaagctgggctacctggacctgtgcaaggactgcctgcccgagagagagcccgccagctgcgagagcccccacctgaagctgctgcagcccttcctgagaaccgacagcggcatgcacgccatggaggaccaggagagcctggagaaccccggcgccccccacaaccccgagcccaccaagagcttcgtggagcagctgaccaccaccgagtgcatcgtgcagagcaagcccgtggagagacccctggtgcagtacgccaaggagttcggcagcagccagcagtacctgctgcccagagccggcctggagctgaccagcagcgagggcggcctgcccgtgctgcagacccagggcctgcagtgcgcctgccccgcccccggcctggccgtggcccccagacagcagcacggcagaacccaccccctgagaagactgaagaaggccaacgacaagaagagaaccaccaaccccttctacaacaccatgtag

SEQ ID NO: 99097 - DNA, 609 bp, Artificial Sequence
  Description of Artificial Sequence: Synthetic coding sequence
atgaccctgagcaccctggccagaaagagaaaggcccccctggcctgcacctgcagcctgggcggccccgacatgatcccctacttcagcgccaacgccgtgatcagccagaacgccatcaaccagctgatcagcgagagcttcctgaccgtgaagggcgccgccctgttcctgcccagaggcaacggcagcagcacccccagaatcagccacagaagaaacaagcacgccggcgacctgcagcagcacctgcaggccatgttcatcctgctgagacccgaggacaacatcagactggccgtgagactggagagcacctaccagaacagaaccagatacatggtggtggtgagcaccaacggcagacaggacaccgaggagagcatcgtgctgggcatggacttcagcagcaacgacagcagcacctgcaccatgggcctggtgctgcccctgtggagcgacaccctgatccacctggacggcgacggcggcttcagcgtgagcaccgacaacagagtgcacatcttcaagcccgtgagcgtgcaggccatgtgggtggacagagacagcagaaacaagcactgcgacgtgctgctggtggaggagtag

SEQ ID NO: 99098 - DNA, 1350 bp, Artificial Sequence
  Description of Artificial Sequence: Synthetic coding sequence
atggccctggtgaccgtgcagagaagccccacccccagcaccaccagcagcccctgcgccagcgaggccgacagcggcgaggaggagtgcagaagccagcccagaagcatcagcgagagcttcctgaccgtgaagggcgccgccctgttcctgcccagaggcaacggcagcagcacccccagaatcagccacagaagaaacaagcacgccggcgacctgcagcagcacctgcaggccatgttcatcctgctgagacccgaggacaacatcagactggccgtgagactggagagcacctaccagaacagaaccagatacatggtggtggtgagcaccaacggcagacaggacaccgaggagagcatcgtgctgggcatggacttcagcagcaacgacagcagcacctgcaccatgggcctggtgctgcccctgtggagcgacaccctgatccacctggacggcgacggcggcttcagcgtgagcaccgacaacagagtgcacatcttcaagcccgtgagcgtgcaggccatgtggagcgccctgcagagcctgcacaaggcctgcgaggtggccagagcccacaactactaccccggcagcctgttcctgacctgggtgagctactacgagagccacatcaacagcgaccagagcagcgtgaacgagtggaacgccatgcaggacgtgcagagccacagacccgacagccccgccctgttcaccgacatccccaccgagagagagagaaccgagagactgatcaagaccaagctgagagagatcatgatgcagaaggacctggagaacatcaccagcaaggagatcagaaccgagctggagatgcagatggtgtgcaacctgagagagttcaaggagttcatcgacaacgagatgatcgtgatcctgggccagatggacagccccacccagatcttcgagcacgtgttcctgggcagcgagtggaacgccagcaacctggaggacctgcagaacagaggcgtgagatacatcctgaacgtgaccagagagatcgacaacttcttccccggcgtgttcgagtaccacaacatcagagtgtacgacgaggaggccaccgacctgctggcctactggaacgacacctacaagttcatcagcaaggccaagaagcacggcagcaagtgcctggtgcactgcaagatgggcgtgagcagaagcgccagcaccgtgatcgcctacgccatgaaggagtacggctggaacctggacagagcctacgactacgtgaaggagagaagaaccgtgaccaagcccaaccccagcttcatgagacagctggaggagtaccagggcatcctgctggccagatag

SEQ ID NO: 99099 - DNA, 4353 bp, Artificial Sequence
  Description of Artificial Sequence: Synthetic coding sequence
atggccctggtgaccgtgcagagaagccccacccccagcaccaccagcagcccctgcgccagcagcagccacctggaggacagcgagagcgccgccctgctgtgctgcgagtgcgaggagagcgagatcttcaccgacagcaacgaggccgacagcggcgaggaggagtgcagaagccagcccagaagcatcagcgagagcttcctgaccgtgaagggcgccgccctgttcctgcccagaggcaacggcagcagcacccccagaatcagccacagaagaaacaagcacgccggcgacctgcagcagcacctgcaggccatgttcatcctgctgagacccgaggacaacatcagactggccgtgagactggagagcacctaccagaacagaaccagatacatggtggtggtgagcaccaacggcagacaggacaccgaggagagcatcgtgctgggcatggacttcagcagcaacgacagcagcacctgcaccatgggcctggtgctgcccctgtggagcgacaccctgatccacctggacggcgacggcggcttcagcgtgagcaccgacaacagagtgcacatcttcaagcccgtgagcgtgcaggccatgtggagcgccctgcagagcctgcacaaggcctgcgaggtggccagagcccacaactactaccccggcagcctgttcctgacctgggtgagctactacgagagccacatcaacagcgaccagagcagcgtgaacgagtggaacgccatgcaggacgtgcagagccacagacccgacagccccgccctgttcaccgacatccccaccgagagagagagaaccgagagactgatcaagaccaagctgagagagatcatgatgcagaaggacctggagaacatcaccagcaaggagatcagaaccgagctggagatgcagatggtgtgcaacctgagagagttcaaggagttcatcgacaacgagatgatcgtgatcctgggccagatggacagccccacccagatcttcgagcacgtgttcctgggcagcgagtggaacgccagcaacctggaggacctgcagaacagaggcgtgagatacatcctgaacgtgaccagagagatcgacaacttcttccccggcgtgttcgagtaccacaacatcagagtgtacgacgaggaggccaccgacctgctggcctactggaacgacacctacaagttcatcagcaaggccaagaagcacggcagcaagtgcctggtgcactgcaagatgggcgtgagcagaagcgccagcaccgtgatcgcctacgccatgaaggagtacggctggaacctggacagagcctacgactacgtgaaggagagaagaaccgtgaccaagcccaaccccagcttcatgagacagctggaggagtaccagggcatcctgctggccagcaagcagagacacaacaagctgtggagaagccacagcgacagcgacctgagcgaccaccacgagcccatctgcaagcccggcctggagctgaacaagaaggacatcaccaccagcgccgaccagatcgccgaggtgaagaccatggagagccacccccccatcccccccgtgttcgtggagcacatggtgccccaggacgccaaccagaagggcctgtgcaccaaggagagaatgatctgcctggagttcaccagcagagagttccacgccggccagatcgaggacgagctgaacctgaacgacatcaacggctgcagcagcggctgctgcctgaacgagagcaagttccccctggacaactgccacgccagcaaggccctgatccagcccggccacgtgcccgagatggccaacaagttccccgacctgaccgtggaggacctggagaccgacgccctgaaggccgacatgaacgtgcacctgctgcccatggaggagctgaccagccccctgaaggacccccccatgagccccgaccccgagagccccagcccccagcccagctgccagaccgagatcagcgacttcagcaccgacagaatcgacttcttcagcgccctggagaagttcgtggagctgagccaggagaccagaagcagaagcttcagccacagcagaatggaggagctgggcggcggcagaaacgagagctgcagactgagcgtggtggaggtggcccccagcaaggtgaccgccgacgaccagagaagcagcagcctgagcaacaccccccacgccagcgaggagagcagcatggacgaggagcagagcaaggccatcagcgagctggtgagccccgacatcttcatgcagagccacagcgagaacgccatcagcgtgaaggagatcgtgaccgagatcgagagcatcagccagggcgtgggccagatccagctgaagggcgacatcctgcccaacccctgccacacccccaagaagaacagcatccacgagctgctgctggagagagcccagacccccgagaacaagcccggccacatggagcaggacgaggacagctgcaccgcccagcccgagctggccaaggacagcggcatgtgcaaccccgagggctgcctgaccacccacagcagcatcgccgacctggaggagggcgagcccgccgagggcgagcaggagctgcagggcagcggcatgcaccccggcgccaagtggtaccccggcagcgtgagaagagccaccctggagttcgaggagagactgagacaggagcaggagcaccacggcgccgcccccacctgcaccagcctgagcaccagaaagaacagcaagaacgacagcagcgtggccgacctggcccccaagggcaagagcgacgaggccccccccgagcacagcttcgtgctgaaggagcccgagatgagcaagggcaagggcaagtacagcggcagcgaggccggcagcctgagccacagcgagcagaacgccaccgtgcccgcccccagagtgctggagttcgaccacctgcccgacccccaggagggccccggcagcgacaccggcacccagcaggagggcgtgctgaaggacctgagaaccgtgatcccctaccaggagagcgagacccaggccgtgcccctgcccctgcccaagagagtggagatcatcgagtacacccacatcgtgaccagccccaaccacaccggccccggcagcgagatcgccaccagcgagaagagcggcgagcagggcctgagaaaggtgaacatggagaagagcgtgaccgtgctgtgcaccctggacgagaacctgaacagaaccctggaccccaaccaggtgagcctgcacccccaggtgctgcccctgccccacagcagcagccccgagcacaacagacccaccgaccaccccaccagcatcctgagcagccccgaggacagaggcagcagcctgagcaccgccctggagaccgccgcccccttcgtgagccacaccacccacctgctgagcgccagcctggactacctgcacccccagaccatggtgcacctggagggcttcaccgagcagagcagcaccaccgacgagcccagcgccgagcaggtgagctgggaggagagccaggagagccccctgagcagcggcagcgaggtgccctacaaggacagccagctgagcagcgccgacctgagcctgatcagcaagctgggcgacaacaccggcgagctgcaggagaagatggaccccctgcccgtggcctgcagactgccccacagcagcagcagcgagaacatcaagagcctgagccacagccccggcgtggtgaaggagagagccaaggagatcgagagcagagtggtgttccaggccggcctgaccaagcccagccagatgagaagaagcgccagcctggccaagctgggctacctggacctgtgcaaggactgcctgcccgagagagagcccgccagctgcgagagcccccacctgaagctgctgcagcccttcctgagaaccgacagcggcatgcacgccatggaggaccaggagagcctggagaaccccggcgccccccacaaccccgagcccaccaagagcttcgtggagcagctgaccaccaccgagtgcatcgtgcagagcaagcccgtggagagacccctggtgcagtacgccaaggagttcggcagcagccagcagtacctgctgcccagagccggcctggagctgaccagcagcgagggcggcctgcccgtgctgcagacccagggcctgcagtgcgcctgccccgcccccggcctggccgtggcccccagacagcagcacggcagaacccaccccctgagaagactgaagaaggccaacgacaagaagagaaccaccaaccccttctacaacaccatgtag

SEQ ID NO: 99100 - DNA, 1980 bp, Artificial Sequence
  Description of Artificial Sequence: Synthetic coding sequence
atggccctggtgaccgtgagcagaagcccccccggcagcggcgccagcacccccgtgggcccctgggaccaggccgtgcagagaagaagcagactgcagagaagacagagcttcgccgtgctgagaggcgccgtgctgggcctgcaggacggcggcgacaacgacgacgccgccgaggccagcagcgagcccaccgagaaggcccccagcgaggaggagctgcacggcgaccagaccgacttcggccagggcagccagagcccccagaagcaggaggagcagagacagcacctgcacctgatggtgcagctgctgagaccccaggacgacatcagactggccgcccagctggaggcccccagaccccccagactgagatacctgctggtggtgagcaccagagagggcgagggcctgagccaggacgagaccgtgctgctgggcgtggacttccccgacagcagcagccccagctgcaccctgggcctggtgctgcccctgtggagcgacacccaggtgtacctggacggcgacggcggcttcagcgtgaccagcggcggccagagcagaatcttcaagcccatcagcatccagaccatgtgggccaccctgcaggtgctgcaccaggcctgcgaggccgccctgggcagcggcctggtgcccggcggcagcgccctgacctgggccagccactaccaggagagactgaacagcgagcagagctgcctgaacgagtggaccgccatggccgacctggagagcctgagaccccccagcgccgagcccggcggcagcagcgagcaggagcagatggagcaggccatcagagccgagctgtggaaggtgctggacgtgagcgacctggagagcgtgaccagcaaggagatcagacaggccctggagctgagactgggcctgcccctgcagcagtacagagacttcatcgacaaccagatgctgctgctggtggcccagagagacagagccagcagaatcttcccccacctgtacctgggcagcgagtggaacgccgccaacctggaggagctgcagagaaacagagtgacccacatcctgaacatggccagagagatcgacaacttctaccccgagagattcacctaccacaacgtgagactgtgggacgaggagagcgcccagctgctgccccactggaaggagacccacagattcatcgaggccgccagagcccagggcacccacgtgctggtgcactgcaagatgggcgtgagcagaagcgccgccaccgtgctggcctacgccatgaagcagtacgagtgcagcctggagcaggccctgagacacgtgcaggagctgagacccatcgccagacccaaccccggcttcctgagacagctgcagatctaccagggcatcctgaccgccagcagacagagccacgtgtgggagcagaaggtgggcggcgtgagccccgaggagcaccccgcccccgaggtgagcacccccttcccccccctgccccccgagcccgagggcggcggcgaggagaaggtggtgggcatggaggagagccaggccgcccccaaggaggagcccggccccagacccagaatcaacctgagaggcgtgatgagaagcatcagcctgctggagcccagcctggagctggagagcaccagcgagaccagcgacatgcccgaggtgttcagcagccacgagagcagccacgaggagcccctgcagcccttcccccagctggccagaaccaagggcggccagcaggtggacagaggcccccagcccgccctgaagagcagacagagcgtggtgaccctgcagggcagcgccgtggtggccaacagaacccaggccttccaggagcaggagcagggccagggccagggccagggcgagccctgcatcagcagcacccccagattcagaaaggtggtgagacaggccagcgtgcacgacagcggcgaggagggcgaggcctag

SEQ ID NO: 99101 - DNA, 2091 bp, Artificial Sequence
  Description of Artificial Sequence: Synthetic coding sequence
atgctgctgtggatcctgctgctggagaccagcctgtgcttcgccgccggcaacgtgaccggcgacgtgtgcaaggagaagatctgcagctgcaacgagatcgagggcgacctgcacgtggactgcgagaagaagggcttcaccagcctgcagagattcaccgcccccaccagccagttctaccacctgttcctgcacggcaacagcctgaccagactgttccccaacgagttcgccaacttctacaacgccgtgagcctgcacatggagaacaacggcctgcacgagatcgtgcccggcgccttcctgggcctgcagctggtgaagagactgcacatcaacaacaacaagatcaagagcttcagaaagcagaccttcctgggcctggacgacctggagtacctgcaggccgacttcaacctgctgagagacatcgaccccggcgccttccaggacctgaacaagctggaggtgctgatcctgaacgacaacctgatcagcaccctgcccgccaacgtgttccagtacgtgcccatcacccacctggacctgagaggcaacagactgaagaccctgccctacgaggaggtgctggagcagatccccggcatcgccgagatcctgctggaggacaacccctgggactgcacctgcgacctgctgagcctgaaggagtggctggagaacatccccaagaacgccctgatcggcagagtggtgtgcgaggcccccaccagactgcagggcaaggacctgaacgagaccaccgagcaggacctgtgccccctgaagaacagagtggacagcagcctgcccgccccccccgcccaggaggagaccttcgcccccggccccctgcccacccccttcaagaccaacggccaggaggaccacgccacccccggcagcgcccccaacggcggcaccaagatccccggcaactggcagatcaagatcagacccaccgccgccatcgccaccggcagcagcagaaacaagcccctggccaacagcctgccctgccccggcggctgcagctgcgaccacatccccggcagcggcctgaagatgaactgcaacaacagaaacgtgagcagcctggccgacctgaagcccaagctgagcaacgtgcaggagctgttcctgagagacaacaagatccacagcatcagaaagagccacttcgtggactacaagaacctgatcctgctggacctgggcaacaacaacatcgccaccgtggagaacaacaccttcaagaacctgctggacctgagatggctgtacatggacagcaactacctggacaccctgagcagagagaagttcgccggcctgcagaacctggagtacctgaacgtggagtacaacgccatccagctgatcctgcccggcaccttcaacgccatgcccaagctgagaatcctgatcctgaacaacaacctgctgagaagcctgcccgtggacgtgttcgccggcgtgagcctgagcaagctgagcctgcacaacaactacttcatgtacctgcccgtggccggcgtgctggaccagctgaccagcatcatccagatcgacctgcacggcaacccctgggagtgcagctgcaccatcgtgcccttcaagcagtgggccgagagactgggcagcgaggtgctgatgagcgacctgaagtgcgagacccccgtgaacttcttcagaaaggacttcatgctgctgagcaacgacgagatctgcccccagctgtacgccagaatcagccccaccctgaccagccacagcaagaacagcaccggcctggccgagaccggcacccacagcaacagctacctggacaccagcagagtgagcatcagcgtgctggtgcccggcctgctgctggtgttcgtgaccagcgccttcaccgtggtgggcatgctggtgttcatcctgagaaacagaaagagaagcaagagaagagacgccaacagcagcgccagcgagatcaacagcctgcagaccgtgtgcgacagcagctactggcacaacggcccctacaacgccgacggcgcccacagagtgtacgactgcggcagccacagcctgagcgactag

SEQ ID NO: 99102 - DNA, 2175 bp, Artificial Sequence
  Description of Artificial Sequence: Synthetic coding sequence
atgctgagcggcgtgtggttcctgagcgtgctgaccgtggccggcatcctgcagaccgagagcagaaagaccgccaaggacatctgcaagatcagatgcctgtgcgaggagaaggagaacgtgctgaacatcaactgcgagaacaagggcttcaccaccgtgagcctgctgcagcccccccagtacagaatctaccagctgttcctgaacggcaacctgctgaccagactgtaccccaacgagttcgtgaactacagcaacgccgtgaccctgcacctgggcaacaacggcctgcaggagatcagaaccggcgccttcagcggcctgaagaccctgaagagactgcacctgaacaacaacaagctggagatcctgagagaggacaccttcctgggcctggagagcctggagtacctgcaggccgactacaactacatcagcgccatcgaggccggcgccttcagcaagctgaacaagctgaaggtgctgatcctgaacgacaacctgctgctgagcctgcccagcaacgtgttcagattcgtgctgctgacccacctggacctgagaggcaacagactgaaggtgatgcccttcgccggcgtgctggagcacatcggcggcatcatggagatccagctggaggagaacccctggaactgcacctgcgacctgctgcccctgaaggcctggctggacaccatcaccgtgttcgtgggcgagatcgtgtgcgagacccccttcagactgcacggcaaggacgtgacccagctgaccagacaggacctgtgccccagaaagagcgccagcgacagcagccagagaggcagccacgccgacacccacgtgcagagactgagccccaccatgaaccccgccctgaaccccaccagagcccccaaggccagcagaccccccaagatgagaaacagacccacccccagagtgaccgtgagcaaggacagacagagcttcggccccatcatggtgtaccagaccaagagccccgtgcccctgacctgccccagcagctgcgtgtgcaccagccagagcagcgacaacggcctgaacgtgaactgccaggagagaaagttcaccaacatcagcgacctgcagcccaagcccaccagccccaagaagctgtacctgaccggcaactacctgcagaccgtgtacaagaacgacctgctggagtacagcagcctggacctgctgcacctgggcaacaacagaatcgccgtgatccaggagggcgccttcaccaacctgaccagcctgagaagactgtacctgaacggcaactacctggaggtgctgtaccccagcatgttcgacggcctgcagagcctgcagtacctgtacctggagtacaacgtgatcaaggagatcaagcccctgaccttcgacgccctgatcaacctgcagctgctgttcctgaacaacaacctgctgagaagcctgcccgacaacatcttcggcggcaccgccctgaccagactgaacctgagaaacaaccacttcagccacctgcccgtgaagggcgtgctggaccagctgcccgccttcatccagatcgacctgcaggagaacccctgggactgcacctgcgacatcatgggcctgaaggactggaccgagcacgccaacagccccgtgatcatcaacgaggtgacctgcgagagccccgccaagcacgccggcgagatcctgaagttcctgggcagagaggccatctgccccgacagccccaacctgagcgacggcaccgtgctgagcatgaaccacaacaccgacacccccagaagcctgagcgtgagccccagcagctaccccgagctgcacaccgaggtgcccctgagcgtgctgatcctgggcctgctggtggtgttcatcctgagcgtgtgcttcggcgccggcctgttcgtgttcgtgctgaagagaagaaagggcgtgcccagcgtgcccagaaacaccaacaacctggacgtgagcagcttccagctgcagtacggcagctacaacaccgagacccacgacaagaccgacggccacgtgtacaactacatccccccccccgtgggccagatgtgccagaaccccatctacatgcagaaggagggcgaccccgtggcctactacagaaacctgcaggagttcagctacagcaacctggagtag

SEQ ID NO: 99103 - DNA, 2538 bp, Artificial Sequence
  Description of Artificial Sequence: Synthetic coding sequence
atgctgagcggcgtgtggttcctgagcgtgctgaccgtggccggcatcctgcagaccgagagcagaaagaccgccaaggacatctgcaagatcagatgcctgtgcgaggagaaggagaacgtgctgaacatcaactgcgagaacaagggcttcaccaccgtgagcctgctgcagcccccccagtacagaatctaccagctgttcctgaacggcaacctgctgaccagactgtaccccaacgagttcgtgaactacagcaacgccgtgaccctgcacctgggcaacaacggcctgcaggagatcagaaccggcgccttcagcggcctgaagaccctgaagagactgcacctgaacaacaacaagctggagatcctgagagaggacaccttcctgggcctggagagcctggagtacctgcaggccgactacaactacatcagcgccatcgaggccggcgccttcagcaagctgaacaagctgaaggtgctgatcctgaacgacaacctgctgctgagcctgcccagcaacgtgttcagattcgtgctgctgacccacctggacctgagaggcaacagactgaaggtgatgcccttcgccggcgtgctggagcacatcggcggcatcatggagatccagctggaggagaacccctggaactgcacctgcgacctgctgcccctgaaggcctggctggacaccatcaccgtgttcgtgggcgagatcgtgtgcgagacccccttcagactgcacggcaaggacgtgacccagctgaccagacaggacctgtgccccagaaagagcgccagcgacagcagccagagaggcagccacgccgacacccacgtgcagagactgagccccaccatgaaccccgccctgaaccccaccagagcccccaaggccagcagaccccccaagatgagaaacagacccacccccagagtgaccgtgagcaaggacagacagagcttcggccccatcatggtgtaccagaccaagagccccgtgcccctgacctgccccagcagctgcgtgtgcaccagccagagcagcgacaacggcctgaacgtgaactgccaggagagaaagttcaccaacatcagcgacctgcagcccaagcccaccagccccaagaagctgtacctgaccggcaactacctgcagaccgtgtacaagaacgacctgctggagtacagcagcctggacctgctgcacctgggcaacaacagaatcgccgtgatccaggagggcgccttcaccaacctgaccagcctgagaagactgtacctgaacggcaactacctggaggtgctgtaccccagcatgttcgacggcctgcagagcctgcagtacctgtacctggagtacaacgtgatcaaggagatcaagcccctgaccttcgacgccctgatcaacctgcagctgctgttcctgaacaacaacctgctgagaagcctgcccgacaacatcttcggcggcaccgccctgaccagactgaacctgagaaacaaccacttcagccacctgcccgtgaagggcgtgctggaccagctgcccgccttcatccagatcgacctgcaggagaacccctgggactgcacctgcgacatcatgggcctgaaggactggaccgagcacgccaacagccccgtgatcatcaacgaggtgacctgcgagagccccgccaagcacgccggcgagatcctgaagttcctgggcagagaggccatctgccccgacagccccaacctgagcgacggcaccgtgctgagcatgaaccacaacaccgacacccccagaagcctgagcgtgagccccagcagctaccccgagctgcacaccgaggtgcccctgagcgtgctgatcctgggcctgctggtggtgttcatcctgagcgtgtgcttcggcgccggcctgttcgtgttcgtgctgaagagaagaaagggcgtgcccagcgtgcccagaaacaccaacaacctggacgtgagcagcttccagctgcagtacggcagctacaacaccgagacccacgacaagaccgacggccacgtgtacaactacatccccccccccgtgggccagatgtgccagaaccccatctacatgcagaaggagggcgaccccgtggcctactacagaaacctgcaggagttcagctacagcaacctggaggagaagaaggaggagcccgccacccccgcctacaccatcagcgccaccgagctgctggagaagcaggccacccccagagagcccgagctgctgtaccagaacatcgccgagagagtgaaggagctgcccagcgccggcctggtgcactacaacttctgcaccctgcccaagagacagttcgcccccagctacgagagcagaagacagaaccaggacagaatcaacaagaccgtgctgtacggcacccccagaaagtgcttcgtgggccagagcaagcccaaccaccccctgctgcaggccaagccccagagcgagcccgactacctggaggtgctggagaagcagaccgccatcagccagctgtag

SEQ ID NO: 99104 - DNA, 2538 bp, Artificial Sequence; identical to SEQ ID NO: 99103
  Description of Artificial Sequence: Synthetic coding sequence

SEQ ID NO: 99105 - DNA, 2538 bp, Artificial Sequence; identical to SEQ ID NO: 99103
  Description of Artificial Sequence: Synthetic coding sequence

SEQ ID NO: 99106 - DNA, 2538 bp, Artificial Sequence; identical to SEQ ID NO: 99103
  Description of Artificial Sequence: Synthetic coding sequence

SEQ ID NO: 99107 - DNA, 2538 bp, Artificial Sequence; identical to SEQ ID NO: 99103
  Description of Artificial Sequence: Synthetic coding sequence

SEQ ID NO: 99108 - DNA, 2934 bp, Artificial Sequence
  Description of Artificial Sequence: Synthetic coding sequence
atgaagcccagcatcgccgagatgctgcacagaggcagaatgctgtggatcatcctgctgagcaccatcgccctgggctggaccacccccatccccctgatcgaggacagcgaggagatcgacgagccctgcttcgacccctgctactgcgaggtgaaggagagcctgttccacatccactgcgacagcaagggcttcaccaacatcagccagatcaccgagttctggagcagacccttcaagctgtacctgcagagaaacagcatgagaaagctgtacaccaacagcttcctgcacctgaacaacgccgtgagcatcaacctgggcaacaacgccctgcaggacatccagaccggcgccttcaacggcctgaagatcctgaagagactgtacctgcacgagaacaagctggacgtgttcagaaacgacaccttcctgggcctggagagcctggagtacctgcaggccgactacaacgtgatcaagagaatcgagagcggcgccttcagaaacctgagcaagctgagagtgctgatcctgaacgacaacctgatccccatgctgcccaccaacctgttcaaggccgtgagcctgacccacctggacctgagaggcaacagactgaaggtgctgttctacagaggcatgctggaccacatcggcagaagcctgatggagctgcagctggaggagaacccctggaactgcacctgcgagatcgtgcagctgaagagctggctggagagaatcccctacaccgccctggtgggcgacatcacctgcgagacccccttccacttccacggcaaggacctgagagagatcagaaagaccgagctgtgccccctgctgagcgacagcgaggtggaggccagcctgggcatcccccacagcagcagcagcaaggagaacgcctggcccaccaagcccagcagcatgctgagcagcgtgcacttcaccgccagcagcgtggagtacaagagcagcaacaagcagcccaagcccaccaagcagcccagaacccccagaccccccagcaccagccaggccctgtaccccggccccaaccagccccccatcgccccctaccagaccagaccccccatccccatcatctgccccaccggctgcacctgcaacctgcacatcaacgacctgggcctgaccgtgaactgcaaggagagaggcttcaacaacatcagcgagctgctgcccagacccctgaacgccaagaagctgtacctgagcagcaacctgatccagaagatctacagaagcgacttctggaacttcagcagcctggacctgctgcacctgggcaacaacagaatcagctacgtgcaggacggcgccttcatcaacctgcccaacctgaagagcctgttcctgaacggcaacgacatcgagaagctgacccccggcatgttcagaggcctgcagagcctgcactacctgtacttcgagttcaacgtgatcagagagatccagcccgccgccttcagcctgatgcccaacctgaagctgctgttcctgaacaacaacctgctgagaaccctgcccaccgacgccttcgccggcaccagcctggccagactgaacctgagaaagaactacttcctgtacctgcccgtggccggcgtgctggagcacctgaacgccatcgtgcagatcgacctgaacgagaacccctgggactgcacctgcgacctggtgcccttcaagcagtggatcgagaccatcagcagcgtgagcgtggtgggcgacgtgctgtgcagaagccccgagaacctgacccacagagacgtgagaaccatcgagctggaggtgctgtgccccgagatgctgcacgtggcccccgccggcgagagccccgcccagcccggcgacagccacctgatcggcgcccccaccagcgccagcccctacgagttcagcccccccggcggccccgtgcccctgagcgtgctgatcctgagcctgctggtgctgttcttcagcgccgtgttcgtggccgccggcctgttcgcctacgtgctgagaagaagaagaaagaagctgcccttcagaagcaagagacaggagggcgtggacctgaccggcatccagatgcagtgccacagactgttcgaggacggcggcggcggcggcggcggcagcggcggcggcggcagacccaccctgagcagccccgagaaggccccccccgtgggccacgtgtacgagtacatcccccaccccgtgacccagatgtgcaacaaccccatctacaagcccagagaggaggaggaggtggccgtgagcagcgcccaggaggccggcagcgccgagagaggcggccccggcacccagccccccggcatgggcgaggccctgctgggcagcgagcagttcgccgagacccccaaggagaaccacagcaactacagaaccctgctggagaaggagaaggagtgggccctggccgtgagcagcagccagctgaacaccatcgtgaccgtgaaccaccaccacccccaccaccccgccgtgggcggcgtgagcggcgtggtgggcggcaccggcggcgacctggccggcttcagacaccacgagaagaacggcggcgtggtgctgttcccccccggcggcggctgcggcagcggcagcatgctgctggacagagagagaccccagcccgccccctgcaccgtgggcttcgtggactgcctgtacggcaccgtgcccaagctgaaggagctgcacgtgcacccccccggcatgcagtaccccgacctgcagcaggacgccagactgaaggagaccctgctgttcagcgccggcaagggcttcaccgaccaccagacccagaagagcgactacctggagctgagagccaagctgcagaccaagcccgactacctggaggtgctggagaagaccacctacagattctag

SEQ ID NO: 99109 - DNA, 2934 bp, Artificial Sequence; identical to SEQ ID NO: 99108
  Description of Artificial Sequence: Synthetic coding sequence

SEQ ID NO: 99110 - DNA, 492 bp, Artificial Sequence
  Description of Artificial Sequence: Synthetic coding sequence
atgaagcccagcatcgccgagatgctgcacagaggcagaatgctgtggatcatcctgctgagcaccatcgccctgggctggaccacccccatccccctgatcgaggacagcgaggagatcgacgagccctgcttcgacccctgctactgcgaggtgaaggagagcctgttccacatccactgcgacagcaagggcttcaccaacatcagccagatcaccgagttctggagcagacccttcaagctgtacctgcagagaaacagcatgagaaagctgtacaccaacagcttcctgcacctgaacaacgccgtgagcatcaacctgggcaacaacgccctgcaggacatccagaccggcgccttcaacggcctgaagatcctgaagagactgtacctgcacgagaacaagctggacgtgttcagaaacgacaccttcctgggcctggagagcctggagtacctgcaggccgactacaacgtgatcaagagatag

SEQ ID NO: 99111 - DNA, 2514 bp, Artificial Sequence
  Description of Artificial Sequence: Synthetic coding sequence
atgttcctgtggctgttcctgatcctgagcgccctgatcagcagcaccaacgccgacagcgacatcagcgtggagatctgcaacgtgtgcagctgcgtgagcgtggagaacgtgctgtacgtgaactgcgagaaggtgagcgtgtacagacccaaccagctgaagcccccctggagcaacttctaccacctgaacttccagaacaacttcctgaacatcctgtaccccaacaccttcctgaacttcagccacgccgtgagcctgcacctgggcaacaacaagctgcagaacatcgagggcggcgccttcctgggcctgagcgccctgaagcagctgcacctgaacaacaacgagctgaagatcctgagagccgacaccttcctgggcatcgagaacctggagtacctgcaggccgactacaacctgatcaagtacatcgagagaggcgccttcaacaagctgcacaagctgaaggtgctgatcctgaacgacaacctgatcagcttcctgcccgacaacatcttcagattcgccagcctgacccacctggacatcagaggcaacagaatccagaagctgccctacatcggcgtgctggagcacatcggcagagtggtggagctgcagctggaggacaacccctggaactgcagctgcgacctgctgcccctgaaggcctggctggagaacatgccctacaacatctacatcggcgaggccatctgcgagacccccagcgacctgtacggcagactgctgaaggagaccaacaagcaggagctgtgccccatgggcaccggcagcgacttcgacgtgagaatcctgccccccagccagctggagaacggctacaccacccccaacggccacaccacccagaccagcctgcacagactggtgaccaagccccccaagaccaccaaccccagcaagatcagcggcatcgtggccggcaaggccctgagcaacagaaacctgagccagatcgtgagctaccagaccagagtgccccccctgaccccctgccccgccccctgcttctgcaagacccaccccagcgacctgggcctgagcgtgaactgccaggagaagaacatccagagcatgagcgagctgatccccaagcccctgaacgccaagaagctgcacgtgaacggcaacagcatcaaggacgtggacgtgagcgacttcaccgacttcgagggcctggacctgctgcacctgggcagcaaccagatcaccgtgatcaagggcgacgtgttccacaacctgaccaacctgagaagactgtacctgaacggcaaccagatcgagagactgtaccccgagatcttcagcggcctgcacaacctgcagtacctgtacctggagtacaacctgatcaaggagatcagcgccggcaccttcgacagcatgcccaacctgcagctgctgtacctgaacaacaacctgctgaagagcctgcccgtgtacatcttcagcggcgcccccctggccagactgaacctgagaaacaacaagttcatgtacctgcccgtgagcggcgtgctggaccagctgcagagcctgacccagatcgacctggagggcaacccctgggactgcacctgcgacctggtggccctgaagctgtgggtggagaagctgagcgacggcatcgtggtgaaggagctgaagtgcgagacccccgtgcagttcgccaacatcgagctgaagagcctgaagaacgagatcctgtgccccaagctgctgaacaagcccagcgcccccttcaccagccccgcccccgccatcaccttcaccacccccctgggccccatcagaagcccccccggcggccccgtgcccctgagcatcctgatcctgagcatcctggtggtgctgatcctgaccgtgttcgtggccttctgcctgctggtgttcgtgctgagaagaaacaagaagcccaccgtgaagcacgagggcctgggcaaccccgactgcggcagcatgcagctgcagctgagaaagcacgaccacaagaccaacaagaaggacggcctgagcaccgaggccttcatcccccagaccatcgagcagatgagcaagagccacacctgcggcctgaaggagagcgagaccggcttcatgttcagcgacccccccggccagaaggtggtgatgagaaacgtggccgacaaggagaaggacctgctgcacgtggacaccagaaagagactgagcaccatcgacgagctggacgagctgttccccagcagagacagcaacgtgttcatccagaacttcctggagagcaagaaggagtacaacagcatcggcgtgagcggcttcgagatcagataccccgagaagcagcccgacaagaagagcaagaagagcctgatcggcggcaaccacagcaagatcgtggtggagcagagaaagagcgagtacttcgagctgaaggccaagctgcagagcagccccgactacctgcaggtgctggaggagcagaccgccctgaacaagatctag

SEQ ID NO: 99112 - DNA, 2514 bp, Artificial Sequence; identical to SEQ ID NO: 99111
  Description of Artificial Sequence: Synthetic coding sequence

SEQ ID NO: 99113 - DNA, 2514 bp, Artificial Sequence; identical to SEQ ID NO: 99111
  Description of Artificial Sequence: Synthetic coding sequence

SEQ ID NO: 99114 - DNA, 2877 bp, Artificial Sequence
  Description of Artificial Sequence: Synthetic coding sequence
atgcacacctgctgcccccccgtgaccctggagcaggacctgcacagaaagatgcacagctggatgctgcagaccctggccttcgccgtgaccagcctggtgctgagctgcgccgagaccatcgactactacggcgagatctgcgacaacgcctgcccctgcgaggagaaggacggcatcctgaccgtgagctgcgagaacagaggcatcatcagcctgagcgagatcagcccccccagattccccatctaccacctgctgctgagcggcaacctgctgaacagactgtaccccaacgagttcgtgaactacaccggcgccagcatcctgcacctgggcagcaacgtgatccaggacatcgagaccggcgccttccacggcctgagaggcctgagaagactgcacctgaacaacaacaagctggagctgctgagagacgacaccttcctgggcctggagaacctggagtacctgcaggtggactacaactacatcagcgtgatcgagcccaacgccttcggcaagctgcacctgctgcaggtgctgatcctgaacgacaacctgctgagcagcctgcccaacaacctgttcagattcgtgcccctgacccacctggacctgagaggcaacagactgaagctgctgccctacgtgggcctgctgcagcacatggacaaggtggtggagctgcagctggaggagaacccctggaactgcagctgcgagctgatcagcctgaaggactggctggacagcatcagctacagcgccctggtgggcgacgtggtgtgcgagacccccttcagactgcacggcagagacctggacgaggtgagcaagcaggagctgtgccccagaagactgatcagcgactacgagatgagaccccagacccccctgagcaccaccggctacctgcacaccacccccgccagcgtgaacagcgtggccaccagcagcagcgccgtgtacaagccccccctgaagccccccaagggcaccagacagcccaacaagcccagagtgagacccaccagcagacagcccagcaaggacctgggctacagcaactacggccccagcatcgcctaccagaccaagagccccgtgcccctggagtgccccaccgcctgcagctgcaacctgcagatcagcgacctgggcctgaacgtgaactgccaggagagaaagatcgagagcatcgccgagctgcagcccaagccctacaaccccaagaagatgtacctgaccgagaactacatcgccgtggtgagaagaaccgacttcctggaggccaccggcctggacctgctgcacctgggcaacaacagaatcagcatgatccaggacagagccttcggcgacctgaccaacctgagaagactgtacctgaacggcaacagaatcgagagactgagccccgagctgttctacggcctgcagagcctgcagtacctgttcctgcagtacaacctgatcagagagatccagagcggcaccttcgaccccgtgcccaacctgcagctgctgttcctgaacaacaacctgctgcaggccatgcccagcggcgtgttcagcggcctgaccctgctgagactgaacctgagaagcaaccacttcaccagcctgcccgtgagcggcgtgctggaccagctgaagagcctgatccagatcgacctgcacgacaacccctgggactgcacctgcgacatcgtgggcatgaagctgtgggtggagcagctgaaggtgggcgtgctggtggacgaggtgatctgcaaggcccccaagaagttcgccgagaccgacatgagaagcatcaagagcgagctgctgtgccccgactacagcgacgtggtggtgagcacccccacccccagcagcatccaggtgcccgccagaaccagcgccgtgacccccgccgtgagactgaacagcaccggcgcccccgccagcctgggcgccggcggcggcgccagcagcgtgcccctgagcgtgctgatcctgagcctgctgctggtgttcatcatgagcgtgttcgtggccgccggcctgttcgtgctggtgatgaagagaagaaagaagaaccagagcgaccacaccagcaccaacaacagcgacgtgagcagcttcaacatgcagtacagcgtgtacggcggcggcggcggcaccggcggccacccccacgcccacgtgcaccacagaggccccgccctgcccaaggtgaagacccccgccggccacgtgtacgagtacatcccccaccccctgggccacatgtgcaagaaccccatctacagaagcagagagggcaacagcgtggaggactacaaggacctgcacgagctgaaggtgacctacagcagcaaccaccacctgcagcagcagcagcagccccccccccccccccagcagccccagcagcagccccccccccagctgcagctgcagcccggcgaggaggagagaagagagagccaccacctgagaagccccgcctacagcgtgagcaccatcgagcccagagaggacctgctgagccccgtgcaggacgccgacagattctacagaggcatcctggagcccgacaagcactgcagcaccacccccgccggcaacagcctgcccgagtaccccaagttcccctgcagccccgccgcctacaccttcagccccaactacgacctgagaagaccccaccagtacctgcaccccggcgccggcgacagcagactgagagagcccgtgctgtacagcccccccagcgccgtgttcgtggagcccaacagaaacgagtacctggagctgaaggccaagctgaacgtggagcccgactacctggaggtgctggagaagcagaccaccttcagccagttctag

SEQ ID NO: 99115 - DNA, 2154 bp, Artificial Sequence
  Description of Artificial Sequence: Synthetic coding sequence
atgggcgccggcaagcacagagagggcggcggcggcgaccccaccagcctgaacggctgcgccgacctgatccagagaagaaccgagatcagcagagacctggacgaggtgagcaagcaggagctgtgccccagaagactgatcagcgactacgagatgagaccccagacccccctgagcaccaccggctacctgcacaccacccccgccagcgtgaacagcgtggccaccagcagcagcgccgtgtacaagccccccctgaagccccccaagggcaccagacagcccaacaagcccagagtgagacccaccagcagacagcccagcaaggacctgggctacagcaactacggccccagcatcgcctaccagaccaagagccccgtgcccctggagtgccccaccgcctgcagctgcaacctgcagatcagcgacctgggcctgaacgtgaactgccaggagagaaagatcgagagcatcgccgagctgcagcccaagccctacaaccccaagaagatgtacctgaccgagaactacatcgccgtggtgagaagaaccgacttcctggaggccaccggcctggacctgctgcacctgggcaacaacagaatcagcatgatccaggacagagccttcggcgacctgaccaacctgagaagactgtacctgaacggcaacagaatcgagagactgagccccgagctgttctacggcctgcagagcctgcagtacctgttcctgcagtacaacctgatcagagagatccagagcggcaccttcgaccccgtgcccaacctgcagctgctgttcctgaacaacaacctgctgcaggccatgcccagcggcgtgttcagcggcctgaccctgctgagactgaacctgagaagcaaccacttcaccagcctgcccgtgagcggcgtgctggaccagctgaagagcctgatccagatcgacctgcacgacaacccctgggactgcacctgcgacatcgtgggcatgaagctgtgggtggagcagctgaaggtgggcgtgctggtggacgaggtgatctgcaaggcccccaagaagttcgccgagaccgacatgagaagcatcaagagcgagctgctgtgccccgactacagcgacgtggtggtgagcacccccacccccagcagcatccaggtgcccgccagaaccagcgccgtgacccccgccgtgagactgaacagcaccggcgcccccgccagcctgggcgccggcggcggcgccagcagcgtgcccctgagcgtgctgatcctgagcctgctgctggtgttcatcatgagcgtgttcgtggccgccggcctgttcgtgctggtgatgaagagaagaaagaagaaccagagcgaccacaccagcaccaacaacagcgacgtgagcagcttcaacatgcagtacagcgtgtacggcggcggcggcggcaccggcggccacccccacgcccacgtgcaccacagaggccccgccctgcccaaggtgaagacccccgccggccacgtgtacgagtacatcccccaccccctgggccacatgtgcaagaaccccatctacagaagcagagagggcaacagcgtggaggactacaaggacctgcacgagctgaaggtgacctacagcagcaaccaccacctgcagcagcagcagcagccccccccccccccccagcagccccagcagcagccccccccccagctgcagctgcagcccggcgaggaggagagaagagagagccaccacctgagaagccccgcctacagcgtgagcaccatcgagcccagagaggacctgctgagccccgtgcaggacgccgacagattctacagaggcatcctggagcccgacaagcactgcagcaccacccccgccggcaacagcctgcccgagtaccccaagttcccctgcagccccgccgcctacaccttcagccccaactacgacctgagaagaccccaccagtacctgcaccccggcgccggcgacagcagactgagagagcccgtgctgtacagcccccccagcgccgtgttcgtggagcccaacagaaacgagtacctggagctgaaggccaagctgaacgtggagcccgactacctggaggtgctggagaagcagaccaccttcagccagttctag

SEQ ID NO: 99116 - DNA, 2526 bp, Artificial Sequence
  Description of Artificial Sequence: Synthetic coding sequence
atgaagctgtggatccacctgttctacagcagcctgctggcctgcatcagcctgcacagccagacccccgtgctgagcagcagaggcagctgcgacagcctgtgcaactgcgaggagaaggacggcaccatgctgatcaactgcgaggccaagggcatcaagatggtgagcgagatcagcgtgccccccagcagacccttccagctgagcctgctgaacaacggcctgaccatgctgcacaccaacgacttcagcggcctgaccaacgccatcagcatccacctgggcttcaacaacatcgccgacatcgagatcggcgccttcaacggcctgggcctgctgaagcagctgcacatcaaccacaacagcctggagatcctgaaggaggacaccttccacggcctggagaacctggagttcctgcaggccgacaacaacttcatcaccgtgatcgagcccagcgccttcagcaagctgaacagactgaaggtgctgatcctgaacgacaacgccatcgagagcctgccccccaacatcttcagattcgtgcccctgacccacctggacctgagaggcaaccagctgcagaccctgccctacgtgggcttcctggagcacatcggcagaatcctggacctgcagctggaggacaacaagtgggcctgcaactgcgacctgctgcagctgaagacctggctggagaacatgcccccccagagcatcatcggcgacgtggtgtgcaacagcccccccttcttcaagggcagcatcctgagcagactgaagaaggagagcatctgccccaccccccccgtgtacgaggagcacgaggaccccagcggcagcctgcacctggccgccaccagcagcatcaacgacagcagaatgagcaccaagaccaccagcatcctgaagctgcccaccaaggcccccggcctgatcccctacatcaccaagcccagcacccagctgcccggcccctactgccccatcccctgcaactgcaaggtgctgagccccagcggcctgctgatccactgccaggagagaaacatcgagagcctgagcgacctgagaccccccccccagaaccccagaaagctgatcctggccggcaacatcatccacagcctgatgaagagcgacctggtggagtacttcaccctggagatgctgcacctgggcaacaacagaatcgaggtgctggaggagggcagcttcatgaacctgaccagactgcagaagctgtacctgaacggcaaccacctgaccaagctgagcaagggcatgttcctgggcctgcacaacctggagtacctgtacctggagtacaacgccatcaaggagatcctgcccggcaccttcaaccccatgcccaagctgaaggtgctgtacctgaacaacaacctgctgcaggtgctgcccccccacatcttcagcggcgtgcccctgaccaaggtgaacctgaagaccaaccagttcacccacctgcccgtgagcaacatcctggacgacctggacctgctgacccagatcgacctggaggacaacccctgggactgcagctgcgacctggtgggcctgcagcagtggatccagaagctgagcaagaacaccgtgaccgacgacatcctgtgcaccagccccggccacctggacaagaaggagctgaaggccctgaacagcgagatcctgtgccccggcctggtgaacaaccccagcatgcccacccagaccagctacctgatggtgaccacccccgccaccaccaccaacaccgccgacaccatcctgagaagcctgaccgacgccgtgcccctgagcgtgctgatcctgggcctgctgatcatgttcatcaccatcgtgttctgcgccgccggcatcgtggtgctggtgctgcacagaagaagaagatacaagaagaagcaggtggacgagcagatgagagacaacagccccgtgcacctgcagtacagcatgtacggccacaagaccacccaccacaccaccgagagacccagcgccagcctgtacgagcagcacatggtgagccccatggtgcacgtgtacagaagccccagcttcggccccaagcacctggaggaggaggaggagagaaacgagaaggagggcagcgacgccaagcacctgcagagaagcctgctggagcaggagaaccacagccccctgaccggcagcaacatgaagtacaagaccaccaaccagagcaccgagttcctgagcttccaggacgccagcagcctgtacagaaacatcctggagaaggagagagagctgcagcagctgggcatcaccgagtacctgagaaagaacatcgcccagctgcagcccgacatggaggcccactaccccggcgcccacgaggagctgaagctgatggagaccctgatgtacagcagacccagaaaggtgctggtggagcagaccaagaacgagtacttcgagctgaaggccaacctgcacgccgagcccgactacctggaggtgctggagcagcagacctag

SEQ ID NO: 99117 - DNA, 4578 bp, Artificial Sequence
  Description of Artificial Sequence: Synthetic coding sequence
atgagaggcgtgggctggcagatgctgagcctgagcctgggcctggtgctggccatcctgaacaaggtggccccccaggcctgccccgcccagtgcagctgcagcggcagcaccgtggactgccacggcctggccctgagaagcgtgcccagaaacatccccagaaacaccgagagactggacctgaacggcaacaacatcaccagaatcaccaagaccgacttcgccggcctgagacacctgagagtgctgcagctgatggagaacaagatcagcaccatcgagagaggcgccttccaggacctgaaggagctggagagactgagactgaacagaaaccacctgcagctgttccccgagctgctgttcctgggcaccgccaagctgtacagactggacctgagcgagaaccagatccaggccatccccagaaaggccttcagaggcgccgtggacatcaagaacctgcagctggactacaaccagatcagctgcatcgaggacggcgccttcagagccctgagagacctggaggtgctgaccctgaacaacaacaacatcaccagactgagcgtggccagcttcaaccacatgcccaagctgagaaccttcagactgcacagcaacaacctgtactgcgactgccacctggcctggctgagcgactggctgagacagagacccagagtgggcctgtacacccagtgcatgggccccagccacctgagaggccacaacgtggccgaggtgcagaagagagagttcgtgtgcagcggcaagggcgagggccaccagagcttcatggcccccagctgcagcgtgctgcactgccccgccgcctgcacctgcagcaacaacatcgtggactgcagaggcaagggcctgaccgagatccccaccaacctgcccgagaccatcaccgagatcagactggagcagaacaccatcaaggtgatcccccccggcgccttcagcccctacaagaagctgagaagaatcgacctgagcaacaaccagatcagcgagctggcccccgacgccttccagggcctgagaagcctgaacagcctggtgctgtacggcaacaagatcaccgagctgcccaagagcctgttcgagggcctgttcagcctgcagctgctgctgctgaacgccaacaagatcaactgcctgagagtggacgccttccaggacctgcacaacctgaacctgctgagcctgtacgacaacaagctgcagaccatcgccaagggcaccttcagccccctgagagccatccagaccatgcacctggcccagaaccccttcatctgcgactgccacctgaagtggctggccgactacctgcacaccaaccccatcgagaccagcggcgccagatgcaccagccccagaagactggccaacaagagaatcggccagatcaagagcaagaagttcagatgcagcggcaccgaggactacagaagcaagctgagcggcgactgcttcgccgacctggcctgccccgagaagtgcagatgcgagggcaccaccgtggactgcagcaaccagaagctgaacaagatccccgagcacatcccccagtacaccgccgagctgagactgaacaacaacgagttcaccgtgctggaggccaccggcatcttcaagaagctgccccagctgagaaagatcaacttcagcaacaacaagatcaccgacatcgaggagggcgccttcgagggcgccagcggcgtgaacgagatcctgctgaccagcaacagactggagaacgtgcagcacaagatgttcaagggcctggagagcctgaagaccctgatgctgagaagcaacagaatcacctgcgtgggcaacgacagcttcatcggcctgagcagcgtgagactgctgagcctgtacgacaaccagatcaccaccgtggcccccggcgccttcgacaccctgcacagcctgagcaccctgaacctgctggccaaccccttcaactgcaactgctacctggcctggctgggcgagtggctgagaaagaagagaatcgtgaccggcaaccccagatgccagaagccctacttcctgaaggagatccccatccaggacgtggccatccaggacttcacctgcgacgacggcaacgacgacaacagctgcagccccctgagcagatgccccaccgagtgcacctgcctggacaccgtggtgagatgcagcaacaagggcctgaaggtgctgcccaagggcatccccagagacgtgaccgagctgtacctggacggcaaccagttcaccctggtgcccaaggagctgagcaactacaagcacctgaccctgatcgacctgagcaacaacagaatcagcaccctgagcaaccagagcttcagcaacatgacccagctgctgaccctgatcctgagctacaacagactgagatgcatcccccccagaaccttcgacggcctgaagagcctgagactgctgagcctgcacggcaacgacatcagcgtggtgcccgagggcgccttcaacgacctgagcgccctgagccacctggccatcggcgccaaccccctgtactgcgactgcaacatgcagtggctgagcgactgggtgaagagcgagtacaaggagcccggcatcgccagatgcgccggccccggcgagatggccgacaagctgctgctgaccacccccagcaagaagttcacctgccagggccccgtggacgtgaacatcctggccaagtgcaacccctgcctgagcaacccctgcaagaacgacggcacctgcaacagcgaccccgtggacttctacagatgcacctgcccctacggcttcaagggccaggactgcgacgtgcccatccacgcctgcatcagcaacccctgcaagcacggcggcacctgccacctgaaggagggcgaggaggacggcttctggtgcatctgcgccgacggcttcgagggcgagaactgcgaggtgaacgtggacgactgcgaggacaacgactgcgagaacaacagcacctgcgtggacggcatcaacaactacacctgcctgtgcccccccgagtacaccggcgagctgtgcgaggagaagctggacttctgcgcccaggacctgaacccctgccagcacgacagcaagtgcatcctgacccccaagggcttcaagtgcgactgcacccccggctacgtgggcgagcactgcgacatcgacttcgacgactgccaggacaacaagtgcaagaacggcgcccactgcaccgacgccgtgaacggctacacctgcatctgccccgagggctacagcggcctgttctgcgagttcagcccccccatggtgctgcccagaaccagcccctgcgacaacttcgactgccagaacggcgcccagtgcatcgtgagaatcaacgagcccatctgccagtgcctgcccggctaccagggcgagaagtgcgagaagctggtgagcgtgaacttcatcaacaaggagagctacctgcagatccccagcgccaaggtgagaccccagaccaacatcaccctgcagatcgccaccgacgaggacagcggcatcctgctgtacaagggcgacaaggaccacatcgccgtggagctgtacagaggcagagtgagagccagctacgacaccggcagccaccccgccagcgccatctacagcgtggagaccatcaacgacggcaacttccacatcgtggagctgctggccctggaccagagcctgagcctgagcgtggacggcggcaaccccaagatcatcaccaacctgagcaagcagagcaccctgaacttcgacagccccctgtacgtgggcggcatgcccggcaagagcaacgtggccagcctgagacaggcccccggccagaacggcaccagcttccacggctgcatcagaaacctgtacatcaacagcgagctgcaggacttccagaaggtgcccatgcagaccggcatcctgcccggctgcgagccctgccacaagaaggtgtgcgcccacggcacctgccagcccagcagccaggccggcttcacctgcgagtgccaggagggctggatgggccccctgtgcgaccagagaaccaacgacccctgcctgggcaacaagtgcgtgcacggcacctgcctgcccatcaacgccttcagctacagctgcaagtgcctggagggccacggcggcgtgctgtgcgacgaggaggaggacctgttcaacccctgccaggccatcaagtgcaagcacggcaagtgcagactgagcggcctgggccagccctactgcgagtgcagcagcggctacaccggcgacagctgcgacagagagatcagctgcagaggcgagagaatcagagactactaccagaagcagcagggctacgccgcctgccagaccaccaagaaggtgagcagactggagtgcagaggcggctgcgccggcggccagtgctgcggccccctgagaagcaagagaagaaagtacagcttcgagtgcaccgacggcagcagcttcgtggacgaggtggagaaggtggtgaagtgcggctgcaccagatgcgtgagctag

SEQ ID NO: 99118 - DNA, 4566 bp, Artificial Sequence
  Description of Artificial Sequence: Synthetic coding sequence
atgagaggcgtgggctggcagatgctgagcctgagcctgggcctggtgctggccatcctgaacaaggtggccccccaggcctgccccgcccagtgcagctgcagcggcagcaccgtggactgccacggcctggccctgagaagcgtgcccagaaacatccccagaaacaccgagagactggacctgaacggcaacaacatcaccagaatcaccaagaccgacttcgccggcctgagacacctgagagtgctgcagctgatggagaacaagatcagcaccatcgagagaggcgccttccaggacctgaaggagctggagagactgagactgaacagaaaccacctgcagctgttccccgagctgctgttcctgggcaccgccaagctgtacagactggacctgagcgagaaccagatccaggccatccccagaaaggccttcagaggcgccgtggacatcaagaacctgcagctggactacaaccagatcagctgcatcgaggacggcgccttcagagccctgagagacctggaggtgctgaccctgaacaacaacaacatcaccagactgagcgtggccagcttcaaccacatgcccaagctgagaaccttcagactgcacagcaacaacctgtactgcgactgccacctggcctggctgagcgactggctgagacagagacccagagtgggcctgtacacccagtgcatgggccccagccacctgagaggccacaacgtggccgaggtgcagaagagagagttcgtgtgcagcggccaccagagcttcatggcccccagctgcagcgtgctgcactgccccgccgcctgcacctgcagcaacaacatcgtggactgcagaggcaagggcctgaccgagatccccaccaacctgcccgagaccatcaccgagatcagactggagcagaacaccatcaaggtgatcccccccggcgccttcagcccctacaagaagctgagaagaatcgacctgagcaacaaccagatcagcgagctggcccccgacgccttccagggcctgagaagcctgaacagcctggtgctgtacggcaacaagatcaccgagctgcccaagagcctgttcgagggcctgttcagcctgcagctgctgctgctgaacgccaacaagatcaactgcctgagagtggacgccttccaggacctgcacaacctgaacctgctgagcctgtacgacaacaagctgcagaccatcgccaagggcaccttcagccccctgagagccatccagaccatgcacctggcccagaaccccttcatctgcgactgccacctgaagtggctggccgactacctgcacaccaaccccatcgagaccagcggcgccagatgcaccagccccagaagactggccaacaagagaatcggccagatcaagagcaagaagttcagatgcagcggcaccgaggactacagaagcaagctgagcggcgactgcttcgccgacctggcctgccccgagaagtgcagatgcgagggcaccaccgtggactgcagcaaccagaagctgaacaagatccccgagcacatcccccagtacaccgccgagctgagactgaacaacaacgagttcaccgtgctggaggccaccggcatcttcaagaagctgccccagctgagaaagatcaacttcagcaacaacaagatcaccgacatcgaggagggcgccttcgagggcgccagcggcgtgaacgagatcctgctgaccagcaacagactggagaacgtgcagcacaagatgttcaagggcctggagagcctgaagaccctgatgctgagaagcaacagaatcacctgcgtgggcaacgacagcttcatcggcctgagcagcgtgagactgctgagcctgtacgacaaccagatcaccaccgtggcccccggcgccttcgacaccctgcacagcctgagcaccctgaacctgctggccaaccccttcaactgcaactgctacctggcctggctgggcgagtggctgagaaagaagagaatcgtgaccggcaaccccagatgccagaagccctacttcctgaaggagatccccatccaggacgtggccatccaggacttcacctgcgacgacggcaacgacgacaacagctgcagccccctgagcagatgccccaccgagtgcacctgcctggacaccgtggtgagatgcagcaacaagggcctgaaggtgctgcccaagggcatccccagagacgtgaccgagctgtacctggacggcaaccagttcaccctggtgcccaaggagctgagcaactacaagcacctgaccctgatcgacctgagcaacaacagaatcagcaccctgagcaaccagagcttcagcaacatgacccagctgctgaccctgatcctgagctacaacagactgagatgcatcccccccagaaccttcgacggcctgaagagcctgagactgctgagcctgcacggcaacgacatcagcgtggtgcccgagggcgccttcaacgacctgagcgccctgagccacctggccatcggcgccaaccccctgtactgcgactgcaacatgcagtggctgagcgactgggtgaagagcgagtacaaggagcccggcatcgccagatgcgccggccccggcgagatggccgacaagctgctgctgaccacccccagcaagaagttcacctgccagggccccgtggacgtgaacatcctggccaagtgcaacccctgcctgagcaacccctgcaagaacgacggcacctgcaacagcgaccccgtggacttctacagatgcacctgcccctacggcttcaagggccaggactgcgacgtgcccatccacgcctgcatcagcaacccctgcaagcacggcggcacctgccacctgaaggagggcgaggaggacggcttctggtgcatctgcgccgacggcttcgagggcgagaactgcgaggtgaacgtggacgactgcgaggacaacgactgcgagaacaacagcacctgcgtggacggcatcaacaactacacctgcctgtgcccccccgagtacaccggcgagctgtgcgaggagaagctggacttctgcgcccaggacctgaacccctgccagcacgacagcaagtgcatcctgacccccaagggcttcaagtgcgactgcacccccggctacgtgggcgagcactgcgacatcgacttcgacgactgccaggacaacaagtgcaagaacggcgcccactgcaccgacgccgtgaacggctacacctgcatctgccccgagggctacagcggcctgttctgcgagttcagcccccccatggtgctgcccagaaccagcccctgcgacaacttcgactgccagaacggcgcccagtgcatcgtgagaatcaacgagcccatctgccagtgcctgcccggctaccagggcgagaagtgcgagaagctggtgagcgtgaacttcatcaacaaggagagctacctgcagatccccagcgccaaggtgagaccccagaccaacatcaccctgcagatcgccaccgacgaggacagcggcatcctgctgtacaagggcgacaaggaccacatcgccgtggagctgtacagaggcagagtgagagccagctacgacaccggcagccaccccgccagcgccatctacagcgtggagaccatcaacgacggcaacttccacatcgtggagctgctggccctggaccagagcctgagcctgagcgtggacggcggcaaccccaagatcatcaccaacctgagcaagcagagcaccctgaacttcgacagccccctgtacgtgggcggcatgcccggcaagagcaacgtggccagcctgagacaggcccccggccagaacggcaccagcttccacggctgcatcagaaacctgtacatcaacagcgagctgcaggacttccagaaggtgcccatgcagaccggcatcctgcccggctgcgagccctgccacaagaaggtgtgcgcccacggcacctgccagcccagcagccaggccggcttcacctgcgagtgccaggagggctggatgggccccctgtgcgaccagagaaccaacgacccctgcctgggcaacaagtgcgtgcacggcacctgcctgcccatcaacgccttcagctacagctgcaagtgcctggagggccacggcggcgtgctgtgcgacgaggaggaggacctgttcaacccctgccaggccatcaagtgcaagcacggcaagtgcagactgagcggcctgggccagccctactgcgagtgcagcagcggctacaccggcgacagctgcgacagagagatcagctgcagaggcgagagaatcagagactactaccagaagcagcagggctacgccgcctgccagaccaccaagaaggtgagcagactggagtgcagaggcggctgcgccggcggccagtgctgcggccccctgagaagcaagagaagaaagtacagcttcgagtgcaccgacggcagcagcttcgtggacgaggtggagaaggtggtgaagtgcggctgcaccagatgcgtgagctag

SEQ ID NO: 99119 - DNA, 4578 bp, Artificial Sequence
  Description of Artificial Sequence: Synthetic coding sequence
atgagaggcgtgggctggcagatgctgagcctgagcctgggcctggtgctggccatcctgaacaaggtggccccccaggcctgccccgcccagtgcagctgcagcggcagcaccgtggactgccacggcctggccctgagaagcgtgcccagaaacatccccagaaacaccgagagactggacctgaacggcaacaacatcaccagaatcaccaagaccgacttcgccggcctgagacacctgagagtgctgcagctgatggagaacaagatcagcaccatcgagagaggcgccttccaggacctgaaggagctggagagactgagactgaacagaaaccacctgcagctgttccccgagctgctgttcctgggcaccgccaagctgtacagactggacctgagcgagaaccagatccaggccatccccagaaaggccttcagaggcgccgtggacatcaagaacctgcagctggactacaaccagatcagctgcatcgaggacggcgccttcagagccctgagagacctggaggtgctgaccctgaacaacaacaacatcaccagactgagcgtggccagcttcaaccacatgcccaagctgagaaccttcagactgcacagcaacaacctgtactgcgactgccacctggcctggctgagcgactggctgagacagagacccagagtgggcctgtacacccagtgcatgggccccagccacctgagaggccacaacgtggccgaggtgcagaagagagagttcgtgtgcagcgacgaggaggagggccaccagagcttcatggcccccagctgcagcgtgctgcactgccccgccgcctgcacctgcagcaacaacatcgtggactgcagaggcaagggcctgaccgagatccccaccaacctgcccgagaccatcaccgagatcagactggagcagaacaccatcaaggtgatcccccccggcgccttcagcccctacaagaagctgagaagaatcgacctgagcaacaaccagatcagcgagctggcccccgacgccttccagggcctgagaagcctgaacagcctggtgctgtacggcaacaagatcaccgagctgcccaagagcctgttcgagggcctgttcagcctgcagctgctgctgctgaacgccaacaagatcaactgcctgagagtggacgccttccaggacctgcacaacctgaacctgctgagcctgtacgacaacaagctgcagaccatcgccaagggcaccttcagccccctgagagccatccagaccatgcacctggcccagaaccccttcatctgcgactgccacctgaagtggctggccgactacctgcacaccaaccccatcgagaccagcggcgccagatgcaccagccccagaagactggccaacaagagaatcggccagatcaagagcaagaagttcagatgcagcggcaccgaggactacagaagcaagctgagcggcgactgcttcgccgacctggcctgccccgagaagtgcagatgcgagggcaccaccgtggactgcagcaaccagaagctgaacaagatccccgagcacatcccccagtacaccgccgagctgagactgaacaacaacgagttcaccgtgctggaggccaccggcatcttcaagaagctgccccagctgagaaagatcaacttcagcaacaacaagatcaccgacatcgaggagggcgccttcgagggcgccagcggcgtgaacgagatcctgctgaccagcaacagactggagaacgtgcagcacaagatgttcaagggcctggagagcctgaagaccctgatgctgagaagcaacagaatcacctgcgtgggcaacgacagcttcatcggcctgagcagcgtgagactgctgagcctgtacgacaaccagatcaccaccgtggcccccggcgccttcgacaccctgcacagcctgagcaccctgaacctgctggccaaccccttcaactgcaactgctacctggcctggctgggcgagtggctgagaaagaagagaatcgtgaccggcaaccccagatgccagaagccctacttcctgaaggagatccccatccaggacgtggccatccaggacttcacctgcgacgacggcaacgacgacaacagctgcagccccctgagcagatgccccaccgagtgcacctgcctggacaccgtggtgagatgcagcaacaagggcctgaaggtgctgcccaagggcatccccagagacgtgaccgagctgtacctggacggcaaccagttcaccctggtgcccaaggagctgagcaactacaagcacctgaccctgatcgacctgagcaacaacagaatcagcaccctgagcaaccagagcttcagcaacatgacccagctgctgaccctgatcctgagctacaacagactgagatgcatcccccccagaaccttcgacggcctgaagagcctgagactgctgagcctgcacggcaacgacatcagcgtggtgcccgagggcgccttcaacgacctgagcgccctgagccacctggccatcggcgccaaccccctgtactgcgactgcaacatgcagtggctgagcgactgggtgaagagcgagtacaaggagcccggcatcgccagatgcgccggccccggcgagatggccgacaagctgctgctgaccacccccagcaagaagttcacctgccagggccccgtggacgtgaacatcctggccaagtgcaacccctgcctgagcaacccctgcaagaacgacggcacctgcaacagcgaccccgtggacttctacagatgcacctgcccctacggcttcaagggccaggactgcgacgtgcccatccacgcctgcatcagcaacccctgcaagcacggcggcacctgccacctgaaggagggcgaggaggacggcttctggtgcatctgcgccgacggcttcgagggcgagaactgcgaggtgaacgtggacgactgcgaggacaacgactgcgagaacaacagcacctgcgtggacggcatcaacaactacacctgcctgtgcccccccgagtacaccggcgagctgtgcgaggagaagctggacttctgcgcccaggacctgaacccctgccagcacgacagcaagtgcatcctgacccccaagggcttcaagtgcgactgcacccccggctacgtgggcgagcactgcgacatcgacttcgacgactgccaggacaacaagtgcaagaacggcgcccactgcaccgacgccgtgaacggctacacctgcatctgccccgagggctacagcggcctgttctgcgagttcagcccccccatggtgctgcccagaaccagcccctgcgacaacttcgactgccagaacggcgcccagtgcatcgtgagaatcaacgagcccatctgccagtgcctgcccggctaccagggcgagaagtgcgagaagctggtgagcgtgaacttcatcaacaaggagagctacctgcagatccccagcgccaaggtgagaccccagaccaacatcaccctgcagatcgccaccgacgaggacagcggcatcctgctgtacaagggcgacaaggaccacatcgccgtggagctgtacagaggcagagtgagagccagctacgacaccggcagccaccccgccagcgccatctacagcgtggagaccatcaacgacggcaacttccacatcgtggagctgctggccctggaccagagcctgagcctgagcgtggacggcggcaaccccaagatcatcaccaacctgagcaagcagagcaccctgaacttcgacagccccctgtacgtgggcggcatgcccggcaagagcaacgtggccagcctgagacaggcccccggccagaacggcaccagcttccacggctgcatcagaaacctgtacatcaacagcgagctgcaggacttccagaaggtgcccatgcagaccggcatcctgcccggctgcgagccctgccacaagaaggtgtgcgcccacggcacctgccagcccagcagccaggccggcttcacctgcgagtgccaggagggctggatgggccccctgtgcgaccagagaaccaacgacccctgcctgggcaacaagtgcgtgcacggcacctgcctgcccatcaacgccttcagctacagctgcaagtgcctggagggccacggcggcgtgctgtgcgacgaggaggaggacctgttcaacccctgccaggccatcaagtgcaagcacggcaagtgcagactgagcggcctgggccagccctactgcgagtgcagcagcggctacaccggcgacagctgcgacagagagatcagctgcagaggcgagagaatcagagactactaccagaagcagcagggctacgccgcctgccagaccaccaagaaggtgagcagactggagtgcagaggcggctgcgccggcggccagtgctgcggccccctgagaagcaagagaagaaagtacagcttcgagtgcaccgacggcagcagcttcgtggacgaggtggagaaggtggtgaagtgcggctgcaccagatgcgtgagctag

SEQ ID NO: 99120 - DNA, 4590 bp, Artificial Sequence
  Description of Artificial Sequence: Synthetic coding sequence
atgagaggcgtgggctggcagatgctgagcctgagcctgggcctggtgctggccatcctgaacaaggtggccccccaggcctgccccgcccagtgcagctgcagcggcagcaccgtggactgccacggcctggccctgagaagcgtgcccagaaacatccccagaaacaccgagagactggacctgaacggcaacaacatcaccagaatcaccaagaccgacttcgccggcctgagacacctgagagtgctgcagctgatggagaacaagatcagcaccatcgagagaggcgccttccaggacctgaaggagctggagagactgagactgaacagaaaccacctgcagctgttccccgagctgctgttcctgggcaccgccaagctgtacagactggacctgagcgagaaccagatccaggccatccccagaaaggccttcagaggcgccgtggacatcaagaacctgcagctggactacaaccagatcagctgcatcgaggacggcgccttcagagccctgagagacctggaggtgctgaccctgaacaacaacaacatcaccagactgagcgtggccagcttcaaccacatgcccaagctgagaaccttcagactgcacagcaacaacctgtactgcgactgccacctggcctggctgagcgactggctgagacagagacccagagtgggcctgtacacccagtgcatgggccccagccacctgagaggccacaacgtggccgaggtgcagaagagagagttcgtgtgcagcggccaccagagcttcatggcccccagctgcagcgtgctgcactgccccgccgcctgcacctgcagcaacaacatcgtggactgcagaggcaagggcctgaccgagatccccaccaacctgcccgagaccatcaccgagatcagactggagcagaacaccatcaaggtgatcccccccggcgccttcagcccctacaagaagctgagaagaatcgacctgagcaacaaccagatcagcgagctggcccccgacgccttccagggcctgagaagcctgaacagcctggtgctgtacggcaacaagatcaccgagctgcccaagagcctgttcgagggcctgttcagcctgcagctgctgctgctgaacgccaacaagatcaactgcctgagagtggacgccttccaggacctgcacaacctgaacctgctgagcctgtacgacaacaagctgcagaccatcgccaagggcaccttcagccccctgagagccatccagaccatgcacctggcccagaaccccttcatctgcgactgccacctgaagtggctggccgactacctgcacaccaaccccatcgagaccagcggcgccagatgcaccagccccagaagactggccaacaagagaatcggccagatcaagagcaagaagttcagatgcagcgccaaggagcagtacttcatccccggcaccgaggactacagaagcaagctgagcggcgactgcttcgccgacctggcctgccccgagaagtgcagatgcgagggcaccaccgtggactgcagcaaccagaagctgaacaagatccccgagcacatcccccagtacaccgccgagctgagactgaacaacaacgagttcaccgtgctggaggccaccggcatcttcaagaagctgccccagctgagaaagatcaacttcagcaacaacaagatcaccgacatcgaggagggcgccttcgagggcgccagcggcgtgaacgagatcctgctgaccagcaacagactggagaacgtgcagcacaagatgttcaagggcctggagagcctgaagaccctgatgctgagaagcaacagaatcacctgcgtgggcaacgacagcttcatcggcctgagcagcgtgagactgctgagcctgtacgacaaccagatcaccaccgtggcccccggcgccttcgacaccctgcacagcctgagcaccctgaacctgctggccaaccccttcaactgcaactgctacctggcctggctgggcgagtggctgagaaagaagagaatcgtgaccggcaaccccagatgccagaagccctacttcctgaaggagatccccatccaggacgtggccatccaggacttcacctgcgacgacggcaacgacgacaacagctgcagccccctgagcagatgccccaccgagtgcacctgcctggacaccgtggtgagatgcagcaacaagggcctgaaggtgctgcccaagggcatccccagagacgtgaccgagctgtacctggacggcaaccagttcaccctggtgcccaaggagctgagcaactacaagcacctgaccctgatcgacctgagcaacaacagaatcagcaccctgagcaaccagagcttcagcaacatgacccagctgctgaccctgatcctgagctacaacagactgagatgcatcccccccagaaccttcgacggcctgaagagcctgagactgctgagcctgcacggcaacgacatcagcgtggtgcccgagggcgccttcaacgacctgagcgccctgagccacctggccatcggcgccaaccccctgtactgcgactgcaacatgcagtggctgagcgactgggtgaagagcgagtacaaggagcccggcatcgccagatgcgccggccccggcgagatggccgacaagctgctgctgaccacccccagcaagaagttcacctgccagggccccgtggacgtgaacatcctggccaagtgcaacccctgcctgagcaacccctgcaagaacgacggcacctgcaacagcgaccccgtggacttctacagatgcacctgcccctacggcttcaagggccaggactgcgacgtgcccatccacgcctgcatcagcaacccctgcaagcacggcggcacctgccacctgaaggagggcgaggaggacggcttctggtgcatctgcgccgacggcttcgagggcgagaactgcgaggtgaacgtggacgactgcgaggacaacgactgcgagaacaacagcacctgcgtggacggcatcaacaactacacctgcctgtgcccccccgagtacaccggcgagctgtgcgaggagaagctggacttctgcgcccaggacctgaacccctgccagcacgacagcaagtgcatcctgacccccaagggcttcaagtgcgactgcacccccggctacgtgggcgagcactgcgacatcgacttcgacgactgccaggacaacaagtgcaagaacggcgcccactgcaccgacgccgtgaacggctacacctgcatctgccccgagggctacagcggcctgttctgcgagttcagcccccccatggtgctgcccagaaccagcccctgcgacaacttcgactgccagaacggcgcccagtgcatcgtgagaatcaacgagcccatctgccagtgcctgcccggctaccagggcgagaagtgcgagaagctggtgagcgtgaacttcatcaacaaggagagctacctgcagatccccagcgccaaggtgagaccccagaccaacatcaccctgcagatcgccaccgacgaggacagcggcatcctgctgtacaagggcgacaaggaccacatcgccgtggagctgtacagaggcagagtgagagccagctacgacaccggcagccaccccgccagcgccatctacagcgtggagaccatcaacgacggcaacttccacatcgtggagctgctggccctggaccagagcctgagcctgagcgtggacggcggcaaccccaagatcatcaccaacctgagcaagcagagcaccctgaacttcgacagccccctgtacgtgggcggcatgcccggcaagagcaacgtggccagcctgagacaggcccccggccagaacggcaccagcttccacggctgcatcagaaacctgtacatcaacagcgagctgcaggacttccagaaggtgcccatgcagaccggcatcctgcccggctgcgagccctgccacaagaaggtgtgcgcccacggcacctgccagcccagcagccaggccggcttcacctgcgagtgccaggagggctggatgggccccctgtgcgaccagagaaccaacgacccctgcctgggcaacaagtgcgtgcacggcacctgcctgcccatcaacgccttcagctacagctgcaagtgcctggagggccacggcggcgtgctgtgcgacgaggaggaggacctgttcaacccctgccaggccatcaagtgcaagcacggcaagtgcagactgagcggcctgggccagccctactgcgagtgcagcagcggctacaccggcgacagctgcgacagagagatcagctgcagaggcgagagaatcagagactactaccagaagcagcagggctacgccgcctgccagaccaccaagaaggtgagcagactggagtgcagaggcggctgcgccggcggccagtgctgcggccccctgagaagcaagagaagaaagtacagcttcgagtgcaccgacggcagcagcttcgtggacgaggtggagaaggtggtgaagtgcggctgcaccagatgcgtgagctag

SEQ ID NO: 99121 - DNA, 4419 bp, Artificial Sequence
  Description of Artificial Sequence: Synthetic coding sequence
atggcccccggctgggccggcgtgggcgccgccgtgagagccagactggccctggccctggccctggccagcgtgctgagcggcccccccgccgtggcctgccccaccaagtgcacctgcagcgccgccagcgtggactgccacggcctgggcctgagagccgtgcccagaggcatccccagaaacgccgagagactggacctggacagaaacaacatcaccagaatcaccaagatggacttcgccggcctgaagaacctgagagtgctgcacctggaggacaaccaggtgagcgtgatcgagagaggcgccttccaggacctgaagcagctggagagactgagactgaacaagaacaagctgcaggtgctgcccgagctgctgttccagagcacccccaagctgaccagactggacctgagcgagaaccagatccagggcatccccagaaaggccttcagaggcatcaccgacgtgaagaacctgcagctggacaacaaccacatcagctgcatcgaggacggcgccttcagagccctgagagacctggagatcctgaccctgaacaacaacaacatcagcagaatcctggtgaccagcttcaaccacatgcccaagatcagaaccctgagactgcacagcaaccacctgtactgcgactgccacctggcctggctgagcgactggctgagacagagaagaaccgtgggccagttcaccctgtgcatggcccccgtgcacctgagaggcttcaacgtggccgacgtgcagaagaaggagtacgtgtgccccgccccccacagcgagccccccagctgcaacgccaacagcatcagctgccccagcccctgcacctgcagcaacaacatcgtggactgcagaggcaagggcctgatggagatccccgccaacctgcccgagggcatcgtggagatcagactggagcagaacagcatcaaggccatccccgccggcgccttcacccagtacaagaagctgaagagaatcgacatcagcaagaaccagatcagcgacatcgcccccgacgccttccagggcctgaagagcctgaccagcctggtgctgtacggcaacaagatcaccgagatcgtgaagggcctgttcgacggcctggtgagcctgcagctgctgctgctgaacgccaacaagatcaactgcctgagagtgaacaccttccaggacctgcagaacctgaacctgctgagcctgtacgacaacaagctgcagaccatcagcaagggcctgttcgcccccctgcagagcatccagaccctgcacctggcccagaaccccttcgtgtgcgactgccacctgaagtggctggccgactacctgcaggacaaccccatcgagaccagcggcgccagatgcagcagccccagaagactggccaacaagagaatcagccagatcaagagcaagaagttcagatgcagcggcagcgaggactacagaagcagattcagcagcgagtgcttcatggacctggtgtgccccgagaagtgcagatgcgagggcaccatcgtggactgcagcaaccagaagctggtgagaatccccagccacctgcccgagtacgtgaccgacctgagactgaacgacaacgaggtgagcgtgctggaggccaccggcatcttcaagaagctgcccaacctgagaaagatcaacctgagcaacaacaagatcaaggaggtgagagagggcgccttcgacggcgccgccagcgtgcaggagctgatgctgaccggcaaccagctggagaccgtgcacggcagagtgttcagaggcctgagcggcctgaagaccctgatgctgagaagcaacctgatcggctgcgtgagcaacgacaccttcgccggcctgagcagcgtgagactgctgagcctgtacgacaacagaatcaccaccatcacccccggcgccttcaccaccctggtgagcctgagcaccatcaacctgctgagcaaccccttcaactgcaactgccacctggcctggctgggcaagtggctgagaaagagaagaatcgtgagcggcaaccccagatgccagaagcccttcttcctgaaggagatccccatccaggacgtggccatccaggacttcacctgcgacggcaacgaggagagcagctgccagctgagccccagatgccccgagcagtgcacctgcatggagaccgtggtgagatgcagcaacaagggcctgagagccctgcccagaggcatgcccaaggacgtgaccgagctgtacctggagggcaaccacctgaccgccgtgcccagagagctgagcgccctgagacacctgaccctgatcgacctgagcaacaacagcatcagcatgctgaccaactacaccttcagcaacatgagccacctgagcaccctgatcctgagctacaacagactgagatgcatccccgtgcacgccttcaacggcctgagaagcctgagagtgctgaccctgcacggcaacgacatcagcagcgtgcccgagggcagcttcaacgacctgaccagcctgagccacctggccctgggcaccaaccccctgcactgcgactgcagcctgagatggctgagcgagtgggtgaaggccggctacaaggagcccggcatcgccagatgcagcagccccgagcccatggccgacagactgctgctgaccacccccacccacagattccagtgcaagggccccgtggacatcaacatcgtggccaagtgcaacgcctgcctgagcagcccctgcaagaacaacggcacctgcacccaggaccccgtggagctgtacagatgcgcctgcccctacagctacaagggcaaggactgcaccgtgcccatcaacacctgcatccagaacccctgccagcacggcggcacctgccacctgagcgacagccacaaggacggcttcagctgcagctgccccctgggcttcgagggccagagatgcgagatcaaccccgacgactgcgaggacaacgactgcgagaacaacgccacctgcgtggacggcatcaacaactacgtgtgcatctgcccccccaactacaccggcgagctgtgcgacgaggtgatcgaccactgcgtgcccgagctgaacctgtgccagcacgaggccaagtgcatccccctggacaagggcttcagctgcgagtgcgtgcccggctacagcggcaagctgtgcgagaccgacaacgacgactgcgtggcccacaagtgcagacacggcgcccagtgcgtggacaccatcaacggctacacctgcacctgcccccagggcttcagcggccccttctgcgagcaccccccccccatggtgctgctgcagaccagcccctgcgaccagtacgagtgccagaacggcgcccagtgcatcgtggtgcagcaggagcccacctgcagatgcccccccggcttcgccggccccagatgcgagaagctgatcaccgtgaacttcgtgggcaaggacagctacgtggagctggccagcgccaaggtgagaccccaggccaacatcagcctgcaggtggccaccgacaaggacaacggcatcctgctgtacaagggcgacaacgaccccctggccctggagctgtaccagggccacgtgagactggtgtacgacagcctgagcagcccccccaccaccgtgtacagcgtggagaccgtgaacgacggccagttccacagcgtggagctggtgaccctgaaccagaccctgaacctggtggtggacaagggcacccccaagagcctgggcaagctgcagaagcagcccgccgtgggcatcaacagccccctgtacctgggcggcatccccaccagcaccggcctgagcgccctgagacagggcaccgacagacccctgggcggcttccacggctgcatccacgaggtgagaatcaacaacgagctgcaggacttcaaggccctgcccccccagagcctgggcgtgagccccggctgcaagagctgcaccgtgtgcaagcacggcctgtgcagaagcgtggagaaggacagcgtggtgtgcgagtgcagacccggctggaccggccccctgtgcgaccaggaggccagagacccctgcctgggccacagatgccaccacggcaagtgcgtggccaccggcaccagctacatgtgcaagtgcgccgagggctacggcggcgacctgtgcgacaacaagaacgacagcgccaacgcctgcagcgccttcaagtgccaccacggccagtgccacatcagcgaccagggcgagccctactgcctgtgccagcccggcttcagcggcgagcactgccagcaggtgttcagagcccaggtgttccagagcagcctgcccggcaactgcagctggagctgctggccccccagaccccccatgccctag

SEQ ID NO: 99122 - DNA, 4572 bp, Artificial Sequence
  Description of Artificial Sequence: Synthetic coding sequence
atggcccccggctgggccggcgtgggcgccgccgtgagagccagactggccctggccctggccctggccagcgtgctgagcggcccccccgccgtggcctgccccaccaagtgcacctgcagcgccgccagcgtggactgccacggcctgggcctgagagccgtgcccagaggcatccccagaaacgccgagagactggacctggacagaaacaacatcaccagaatcaccaagatggacttcgccggcctgaagaacctgagagtgctgcacctggaggacaaccaggtgagcgtgatcgagagaggcgccttccaggacctgaagcagctggagagactgagactgaacaagaacaagctgcaggtgctgcccgagctgctgttccagagcacccccaagctgaccagactggacctgagcgagaaccagatccagggcatccccagaaaggccttcagaggcatcaccgacgtgaagaacctgcagctggacaacaaccacatcagctgcatcgaggacggcgccttcagagccctgagagacctggagatcctgaccctgaacaacaacaacatcagcagaatcctggtgaccagcttcaaccacatgcccaagatcagaaccctgagactgcacagcaaccacctgtactgcgactgccacctggcctggctgagcgactggctgagacagagaagaaccgtgggccagttcaccctgtgcatggcccccgtgcacctgagaggcttcaacgtggccgacgtgcagaagaaggagtacgtgtgccccgccccccacagcgagccccccagctgcaacgccaacagcatcagctgccccagcccctgcacctgcagcaacaacatcgtggactgcagaggcaagggcctgatggagatccccgccaacctgcccgagggcatcgtggagatcagactggagcagaacagcatcaaggccatccccgccggcgccttcacccagtacaagaagctgaagagaatcgacatcagcaagaaccagatcagcgacatcgcccccgacgccttccagggcctgaagagcctgaccagcctggtgctgtacggcaacaagatcaccgagatcgtgaagggcctgttcgacggcctggtgagcctgcagctgctgctgctgaacgccaacaagatcaactgcctgagagtgaacaccttccaggacctgcagaacctgaacctgctgagcctgtacgacaacaagctgcagaccatcagcaagggcctgttcgcccccctgcagagcatccagaccctgcacctggcccagaaccccttcgtgtgcgactgccacctgaagtggctggccgactacctgcaggacaaccccatcgagaccagcggcgccagatgcagcagccccagaagactggccaacaagagaatcagccagatcaagagcaagaagttcagatgcagcggcagcgaggactacagaagcagattcagcagcgagtgcttcatggacctggtgtgccccgagaagtgcagatgcgagggcaccatcgtggactgcagcaaccagaagctggtgagaatccccagccacctgcccgagtacgtgaccgacctgagactgaacgacaacgaggtgagcgtgctggaggccaccggcatcttcaagaagctgcccaacctgagaaagatcaacctgagcaacaacaagatcaaggaggtgagagagggcgccttcgacggcgccgccagcgtgcaggagctgatgctgaccggcaaccagctggagaccgtgcacggcagagtgttcagaggcctgagcggcctgaagaccctgatgctgagaagcaacctgatcggctgcgtgagcaacgacaccttcgccggcctgagcagcgtgagactgctgagcctgtacgacaacagaatcaccaccatcacccccggcgccttcaccaccctggtgagcctgagcaccatcaacctgctgagcaaccccttcaactgcaactgccacctggcctggctgggcaagtggctgagaaagagaagaatcgtgagcggcaaccccagatgccagaagcccttcttcctgaaggagatccccatccaggacgtggccatccaggacttcacctgcgacggcaacgaggagagcagctgccagctgagccccagatgccccgagcagtgcacctgcatggagaccgtggtgagatgcagcaacaagggcctgagagccctgcccagaggcatgcccaaggacgtgaccgagctgtacctggagggcaaccacctgaccgccgtgcccagagagctgagcgccctgagacacctgaccctgatcgacctgagcaacaacagcatcagcatgctgaccaactacaccttcagcaacatgagccacctgagcaccctgatcctgagctacaacagactgagatgcatccccgtgcacgccttcaacggcctgagaagcctgagagtgctgaccctgcacggcaacgacatcagcagcgtgcccgagggcagcttcaacgacctgaccagcctgagccacctggccctgggcaccaaccccctgcactgcgactgcagcctgagatggctgagcgagtgggtgaaggccggctacaaggagcccggcatcgccagatgcagcagccccgagcccatggccgacagactgctgctgaccacccccacccacagattccagtgcaagggccccgtggacatcaacatcgtggccaagtgcaacgcctgcctgagcagcccctgcaagaacaacggcacctgcacccaggaccccgtggagctgtacagatgcgcctgcccctacagctacaagggcaaggactgcaccgtgcccatcaacacctgcatccagaacccctgccagcacggcggcacctgccacctgagcgacagccacaaggacggcttcagctgcagctgccccctgggcttcgagggccagagatgcgagatcaaccccgacgactgcgaggacaacgactgcgagaacaacgccacctgcgtggacggcatcaacaactacgtgtgcatctgcccccccaactacaccggcgagctgtgcgacgaggtgatcgaccactgcgtgcccgagctgaacctgtgccagcacgaggccaagtgcatccccctggacaagggcttcagctgcgagtgcgtgcccggctacagcggcaagctgtgcgagaccgacaacgacgactgcgtggcccacaagtgcagacacggcgcccagtgcgtggacaccatcaacggctacacctgcacctgcccccagggcttcagcggccccttctgcgagcaccccccccccatggtgctgctgcagaccagcccctgcgaccagtacgagtgccagaacggcgcccagtgcatcgtggtgcagcaggagcccacctgcagatgcccccccggcttcgccggccccagatgcgagaagctgatcaccgtgaacttcgtgggcaaggacagctacgtggagctggccagcgccaaggtgagaccccaggccaacatcagcctgcaggtggccaccgacaaggacaacggcatcctgctgtacaagggcgacaacgaccccctggccctggagctgtaccagggccacgtgagactggtgtacgacagcctgagcagcccccccaccaccgtgtacagcgtggagaccgtgaacgacggccagttccacagcgtggagctggtgaccctgaaccagaccctgaacctggtggtggacaagggcacccccaagagcctgggcaagctgcagaagcagcccgccgtgggcatcaacagccccctgtacctgggcggcatccccaccagcaccggcctgagcgccctgagacagggcaccgacagacccctgggcggcttccacggctgcatccacgaggtgagaatcaacaacgagctgcaggacttcaaggccctgcccccccagagcctgggcgtgagccccggctgcaagagctgcaccgtgtgcaagcacggcctgtgcagaagcgtggagaaggacagcgtggtgtgcgagtgcagacccggctggaccggccccctgtgcgaccaggaggccagagacccctgcctgggccacagatgccaccacggcaagtgcgtggccaccggcaccagctacatgtgcaagtgcgccgagggctacggcggcgacctgtgcgacaacaagaacgacagcgccaacgcctgcagcgccttcaagtgccaccacggccagtgccacatcagcgaccagggcgagccctactgcctgtgccagcccggcttcagcggcgagcactgccagcaggagaacccctgcctgggccaggtggtgagagaggtgatcagaagacagaagggctacgccagctgcgccaccgccagcaaggtgcccatcatggagtgcagaggcggctgcggcccccagtgctgccagcccaccagaagcaagagaagaaagtacgtgttccagtgcaccgacggcagcagcttcgtggaggaggtggagagacacctggagtgcggctgcctggcctgcagctag

SEQ ID NO: 99123 - DNA, 3258 bp, Artificial Sequence
  Description of Artificial Sequence: Synthetic coding sequence
atgagcacccccagcagattcaagaaggacaaggagatcatcgccgagtacgagagccaggtgaaggagatcagagcccagctggtggagcagcagaagtgcctggagcagcagaccgagatgagagtgcagctgctgcaggacctgcaggacttcttcagaaagaaggccgagatcgagaccgagtacagcagaaacctggagaagctggccgagagattcatggccaagaccagaagcaccaaggaccaccagcagtacaagaaggaccagaacctgctgagccccgtgaactgctggtacctgctgctgaaccaggtgagaagagagagcaaggaccacgccaccctgagcgacatctacctgaacaacgtgatcatgagattcatgcagatcagcgaggacagcaccagaatgttcaagaagagcaaggagatcgccttccagctgcacgaggacctgatgaaggtgctgaacgagctgtacaccgtgatgaagacctaccacatgtaccacgccgagagcatcagcgccgagagcaagctgaaggaggccgagaagcaggaggagaagcagatcggcagaagcggcgaccccgtgttccacatcagactggaggagagacaccagagaagaagcagcgtgaagaagatcgagaagatgaaggagaagagacaggccaagtacagcgagaacaagctgaagagcatcaaggccagaaacgagtacctgctgaccctggaggccaccaacgccagcgtgttcaagtactacatccacgacctgagcgacctgatcgactgctgcgacctgggctaccacgccagcctgaacagagccctgagaacctacctgagcgccgagtacaacctggagaccagcagacacgagggcctggacatcatcgagaacgccgtggacaacctggagcccagaagcgacaagcagagattcatggagatgtaccccgccgccttctgcccccccatgaagttcgagttccagagccacatgggcgacgaggtgtgccaggtgagcgcccagcagcccgtgcaggccgagctgatgctgagataccagcagctgcagagcagactggccaccctgaagatcgagaacgaggaggtgaagaagaccaccgaggccaccctgcagaccatccaggacatggtgaccatcgaggactacgacgtgagcgagtgcttccagcacagcagaagcaccgagagcgtgaagagcaccgtgagcgagacctacctgagcaagcccagcatcgccaagagaagagccaaccagcaggagaccgagcagttctacttcatgaagctgagagagtacctggagggcagcaacctgatcaccaagctgcaggccaagcacgacctgctgcagagaaccctgggcgagggccacagagccgagtacatgaccaccagaccccccaacgtgccccccaagccccagaagcacagaaagagcagacccagaagccagtacaacaccaagctgttcaacggcgacctggagaccttcgtgaaggacagcggccaggtgatccccctgatcgtggagagctgcatcagattcatcaacctgtacggcctgcagcaccagggcatcttcagagtgagcggcagccaggtggaggtgaacgacatcaagaacagcttcgagagaggcgagaaccccctggccgacgaccagagcaaccacgacatcaacagcgtggccggcgtgctgaagctgtacttcagaggcctggagaaccccctgttccccaaggagagattcaacgacctgatcagctgcatcagaatcgacaacctgtacgagagagccctgcacatcagaaagctgctgctgaccctgcccagaagcgtgctgatcgtgatgagatacctgttcgccttcctgaaccacctgagccagtacagcgacgagaacatgatggacccctacaacctggccatctgcttcggccccaccctgatgcccgtgcccgagatccaggaccaggtgagctgccaggcccacgtgaacgagatcatcaagaccatcatcatccaccacgagaccatcttccccgacgccaaggagctggacggccccgtgtacgagaagtgcatggccggcgacgactactgcgacagcccctacagcgagcacggcaccctggaggaggtggaccaggacgccggcaccgagccccacaccagcgaggacgagtgcgagcccatcgaggccatcgccaagttcgactacgtgggcagaagcgccagagagctgagcttcaagaagggcgccagcctgctgctgtaccacagagccagcgaggactggtgggagggcagacacaacggcatcgacggcctggtgccccaccagtacatcgtggtgcaggacatggacgacaccttcagcgacaccctgagccagaaggccgacagcgaggccagcagcggccccgtgaccgaggacaagagcagcagcaaggacatgaacagccccaccgacagacaccccgacggctacctggccagacagagaaagagaggcgagccccccccccccgtgagaagacccggcagaaccagcgacggccactgccccctgcaccccccccacgccctgagcaacagcagcgtggacctgggcagccccagcctggccagccaccccagaggcctgctgcagaacagaggcctgaacaacgacagccccgagagaagaagaagacccggccacggcagcctgaccaacatcagcagacacgacagcctgaagaagatcgacagcccccccatcagaagaagcaccagcagcggccagtacaccggcttcaacgaccacaagcccctggaccccgagaccatcgcccaggacatcgaggagaccatgaacaccgccctgaacgagctgagagagctggagagacagagcaccgccaagcacgcccccgacgtggtgctggacaccctggagcaggtgaagaacagccccacccccgccaccagcaccgagagcctgagccccctgcacaacgtggccctgagaagcagcgagccccagatcagaagaagcaccagcagcagcagcgacaccatgagcaccttcaagcccatggtggcccccagaatgggcgtgcagctgaagccccccgccctgagacccaagcccgccgtgctgcccaagaccaaccccaccatcggccccgccccccccccccagggccccaccgacaagagctgcaccatgtag

SEQ ID NO: 99124 - DNA, 3189 bp, Artificial Sequence
  Description of Artificial Sequence: Synthetic coding sequence
atgagcacccccagcagattcaagaaggacaaggagatcatcgccgagtacgagagccaggtgaaggagatcagagcccagctggtggagcagcagaagtgcctggagcagcagaccgagatgagagtgcagctgctgcaggacctgcaggacttcttcagaaagaaggccgagatcgagaccgagtacagcagaaacctggagaagctggccgagagattcatggccaagaccagaagcaccaaggaccaccagcagtacaagaaggaccagaacctgctgagccccgtgaactgctggtacctgctgctgaaccaggtgagaagagagagcaaggaccacgccaccctgagcgacatctacctgaacaacgtgatcatgagattcatgcagatcagcgaggacagcaccagaatgttcaagaagagcaaggagatcgccttccagctgcacgaggacctgatgaaggtgctgaacgagctgtacaccgtgatgaagacctaccacatgtaccacgccgagagcatcagcgccgagagcaagctgaaggaggccgagaagcaggaggagaagcagatcggcagaagcggcgaccccgtgttccacatcagactggaggagagacaccagagaagaagcagcgtgaagaagatcgagaagatgaaggagaagagacaggccaagtacagcgagaacaagctgaagagcatcaaggccagaaacgagtacctgctgaccctggaggccaccaacgccagcgtgttcaagtactacatccacgacctgagcgacctgatcgactgctgcgacctgggctaccacgccagcctgaacagagccctgagaacctacctgagcgccgagtacaacctggagaccagcagacacgagggcctggacatcatcgagaacgccgtggacaacctggagcccagaagcgacaagcagagattcatggagatgtaccccgccgccttctgcccccccatgaagttcgagttccagagccacatgggcgacgaggtgtgccaggtgagcgcccagcagcccgtgcaggccgagctgatgctgagataccagcagctgcagagcagactggccaccctgaagatcgagaacgaggaggtgaagaagaccaccgaggccaccctgcagaccatccaggacatggtgaccatcgaggactacgacgtgagcgagtgcttccagcacagcagaagcaccgagagcgtgaagagcaccgtgagcgagacctacctgagcaagcccagcatcgccaagagaagagccaaccagcaggagaccgagcagttctacttcatgaagctgagagagtacctggagggcagcaacctgatcaccaagctgcaggccaagcacgacctgctgcagagaaccctgggcgagggccacagagccgagtacatgaccaccagcagaggcagaagaaacagccacaccagacaccaggacagcggccaggtgatccccctgatcgtggagagctgcatcagattcatcaacctgtacggcctgcagcaccagggcatcttcagagtgagcggcagccaggtggaggtgaacgacatcaagaacagcttcgagagaggcgagaaccccctggccgacgaccagagcaaccacgacatcaacagcgtggccggcgtgctgaagctgtacttcagaggcctggagaaccccctgttccccaaggagagattcaacgacctgatcagctgcatcagaatcgacaacctgtacgagagagccctgcacatcagaaagctgctgctgaccctgcccagaagcgtgctgatcgtgatgagatacctgttcgccttcctgaaccacctgagccagtacagcgacgagaacatgatggacccctacaacctggccatctgcttcggccccaccctgatgcccgtgcccgagatccaggaccaggtgagctgccaggcccacgtgaacgagatcatcaagaccatcatcatccaccacgagaccatcttccccgacgccaaggagctggacggccccgtgtacgagaagtgcatggccggcgacgactactgcgacagcccctacagcgagcacggcaccctggaggaggtggaccaggacgccggcaccgagccccacaccagcgaggacgagtgcgagcccatcgaggccatcgccaagttcgactacgtgggcagaagcgccagagagctgagcttcaagaagggcgccagcctgctgctgtaccacagagccagcgaggactggtgggagggcagacacaacggcatcgacggcctggtgccccaccagtacatcgtggtgcaggacatggacgacaccttcagcgacaccctgagccagaaggccgacagcgaggccagcagcggccccgtgaccgaggacaagagcagcagcaaggacatgaacagccccaccgacagacaccccgacggctacctggccagacagagaaagagaggcgagccccccccccccgtgagaagacccggcagaaccagcgacggccactgccccctgcaccccccccacgccctgagcaacagcagcgtggacctgggcagccccagcctggccagccaccccagaggcctgctgcagaacagaggcctgaacaacgacagccccgagagaagaagaagacccggccacggcagcctgaccaacatcagcagacacgacagcctgaagaagatcgacagcccccccatcagaagaagcaccagcagcggccagtacaccggcttcaacgaccacaagcccctggaccccgagaccatcgcccaggacatcgaggagaccatgaacaccgccctgaacgagctgagagagctggagagacagagcaccgccaagcacgcccccgacgtggtgctggacaccctggagcaggtgaagaacagccccacccccgccaccagcaccgagagcctgagccccctgcacaacgtggccctgagaagcagcgagccccagatcagaagaagcaccagcagcagcagcgacaccatgagcaccttcaagcccatggtggcccccagaatgggcgtgcagctgaagccccccgccctgagacccaagcccgccgtgctgcccaagaccaaccccaccatcggccccgccccccccccccagggccccaccgacaagagctgcaccatgtag

SEQ ID NO: 99125 - DNA, 2958 bp, Artificial Sequence
  Description of Artificial Sequence: Synthetic coding sequence
tgaaaggaccagaacgtgctgagccccgtgaactgctggaacctgctgctgaaccaggtgaagagagagagcagagaccacaccaccctgagcgacatctacctgaacaacatcatccccagattcgtgcaggtgagcgaggacagcggcagactgttcaagaagagcaaggaggtgggccagcagctgcaggacgacctgatgaaggtgctgaacgagctgtacagcgtgatgaagacctaccacatgtacaacgccgacagcatcagcgcccagagcaagctgaaggaggccgagaagcaggaggagaagcagatcggcaagagcgtgaagcaggaggacagacagacccccagaagccccgacagcaccgccaacgtgagaatcgaggagaagcacgtgagaagaagcagcgtgaagaagatcgagaagatgaaggagaagagacaggccaagtacaccgagaacaagctgaaggccatcaaggccagaaacgagtacctgctggccctggaggccaccaacgccagcgtgttcaagtactacatccacgacctgagcgacctgatcgaccagtgctgcgacctgggctaccacgccagcctgaacagagccctgagaaccttcctgagcgccgagctgaacctggagcagagcaagcacgagggcctggacgccatcgagaacgccgtggagaacctggacgccaccagcgacaagcagagactgatggagatgtacaacaacgtgttctgcccccccatgaagttcgagttccagccccacatgggcgacatggccagccagctgtgcgcccagcagcccgtgcagagcgagctggtgcagagatgccagcagctgcagagcagactgagcaccctgaagatcgagaacgaggaggtgaagaagaccatggaggccaccctgcagaccatccaggacatcgtgaccgtggaggacttcgacgtgagcgactgcttccagtacagcaacagcatggagagcgtgaagagcaccgtgagcgagaccttcatgagcaagcccagcatcgccaagagaagagccaaccagcaggagaccgagcagttctacttcaccaagatgaaggagtacctggagggcagaaacctgatcaccaagctgcaggccaagcacgacctgctgcagaagaccctgggcgagagccagagaaccgactgcagcctggccagaagaagcagcaccgtgagaaagcaggacagcagccaggccatccccctggtggtggagagctgcatcagattcatcagcagacacggcctgcagcacgagggcatcttcagagtgagcggcagccaggtggaggtgaacgacatcaagaacgccttcgagagaggcgaggaccccctggccggcgaccagaacgaccacgacatggacagcatcgccggcgtgctgaagctgtacttcagaggcctggagcaccccctgttccccaaggacatcttccacgacctgatggcctgcgtgaccatggacaacctgcaggagagagccctgcacatcagaaaggtgctgctggtgctgcccaagaccaccctgatcatcatgagatacctgttcgccttcctgaaccacctgagccagttcagcgaggagaacatgatggacccctacaacctggccatctgcttcggccccagcctgatgagcgtgcccgagggccacgaccaggtgagctgccaggcccacgtgaacgagctgatcaagaccatcatcatccagcacgagaacatcttccccagccccagagagctggagggccccgtgtacagcagaggcggcagcatggaggactactgcgacagcccccacggcgagaccaccagcgtggaggacagcacccaggacgtgaccgccgagcaccacaccagcgacgacgagtgcgagcccatcgaggccatcgccaagttcgactacgtgggcagaaccgccagagagctgagcttcaagaagggcgccagcctgctgctgtaccagagagccagcgacgactggtgggagggcagacacaacggcatcgacggcctgatcccccaccagtacatcgtggtgcaggacaccgaggacggcgtggtggagagaagcagccccaagagcgagatcgaggtgatcagcgagccccccgaggagaaggtgaccgccagagccggcgccagctgccccagcggcggccacgtggccgacatctacctggccaacatcaacaagcagagaaagagacccgagagcggcagcatcagaaagaccttcagaagcgacagccacggcctgagcagcagcctgaccgacagcagcagccccggcgtgggcgccagctgcagacccagcagccagcccatcatgagccagagcctgcccaaggagggccccgacaagtgcagcatcagcggccacggcagcctgaacagcatcagcagacacagcagcctgaagaacagactggacagcccccagatcagaaagaccgccaccgccggcagaagcaagagcttcaacaaccacagacccatggaccccgaggtgatcgcccaggacatcgaggccaccatgaacagcgccctgaacgagctgagagagctggagagacagagcagcgtgaagcacacccccgacgtggtgctggacaccctggagcccctgaagaccagccccgtggtggcccccaccagcgagcccagcagccccctgcacacccagctgctgaaggaccccgagcccgccttccagagaagcgccagcaccgccggcgacatcgcctgcgccttcagacccgtgaagagcgtgaagatggccgcccccgtgaagccccccgccaccagacccaagcccaccgtgttccccaagaccaacgccaccagccccggcgtgaacagcagcaccagcccccagagcaccgacaagagctgcaccgtgtag

SEQ ID NO: 99126 - DNA, 2796 bp, Artificial Sequence
  Description of Artificial Sequence: Synthetic coding sequence
cagagcaaggaggtgggccagcagctgcaggacgacctgatgaaggtgctgaacgagctgtacagcgtgatgaagacctaccacatgtacaacgccgacagcatcagcgcccagagcaagctgaaggaggccgagaagcaggaggagaagcagatcggcaagagcgtgaagcaggaggacagacagacccccagaagccccgacagcaccgccaacgtgagaatcgaggagaagcacgtgagaagaagcagcgtgaagaagatcgagaagatgaaggagaagagacaggccaagtacaccgagaacaagctgaaggccatcaaggccagaaacgagtacctgctggccctggaggccaccaacgccagcgtgttcaagtactacatccacgacctgagcgacctgatcgaccagtgctgcgacctgggctaccacgccagcctgaacagagccctgagaaccttcctgagcgccgagctgaacctggagcagagcaagcacgagggcctggacgccatcgagaacgccgtggagaacctggacgccaccagcgacaagcagagactgatggagatgtacaacaacgtgttctgcccccccatgaagttcgagttccagccccacatgggcgacatggccagccagctgtgcgcccagcagcccgtgcagagcgagctggtgcagagatgccagcagctgcagagcagactgagcaccctgaagatcgagaacgaggaggtgaagaagaccatggaggccaccctgcagaccatccaggacatcgtgaccgtggaggacttcgacgtgagcgactgcttccagtacagcaacagcatggagagcgtgaagagcaccgtgagcgagaccttcatgagcaagcccagcatcgccaagagaagagccaaccagcaggagaccgagcagttctacttcaccaagatgaaggagtacctggagggcagaaacctgatcaccaagctgcaggccaagcacgacctgctgcagaagaccctgggcgagagccagagaaccgactgcagcctggccagaagaagcagcaccgtgagaaagcaggacagcagccaggccatccccctggtggtggagagctgcatcagattcatcagcagacacggcctgcagcacgagggcatcttcagagtgagcggcagccaggtggaggtgaacgacatcaagaacgccttcgagagaggcgaggaccccctggccggcgaccagaacgaccacgacatggacagcatcgccggcgtgctgaagctgtacttcagaggcctggagcaccccctgttccccaaggacatcttccacgacctgatggcctgcgtgaccatggacaacctgcaggagagagccctgcacatcagaaaggtgctgctggtgctgcccaagaccaccctgatcatcatgagatacctgttcgccttcctgaaccacctgagccagttcagcgaggagaacatgatggacccctacaacctggccatctgcttcggccccagcctgatgagcgtgcccgagggccacgaccaggtgagctgccaggcccacgtgaacgagctgatcaagaccatcatcatccagcacgagaacatcttccccagccccagagagctggagggccccgtgtacagcagaggcggcagcatggaggactactgcgacagcccccacggcgagaccaccagcgtggaggacagcacccaggacgtgaccgccgagcaccacaccagcgacgacgagtgcgagcccatcgaggccatcgccaagttcgactacgtgggcagaaccgccagagagctgagcttcaagaagggcgccagcctgctgctgtaccagagagccagcgacgactggtgggagggcagacacaacggcatcgacggcctgatcccccaccagtacatcgtggtgcaggacaccgaggacggcgtggtggagagaagcagccccaagagcgagatcgaggtgatcagcgagccccccgaggagaaggtgaccgccagagccggcgccagctgccccagcggcggccacgtggccgacatctacctggccaacatcaacaagcagagaaagagacccgagagcggcagcatcagaaagaccttcagaagcgacagccacggcctgagcagcagcctgaccgacagcagcagccccggcgtgggcgccagctgcagacccagcagccagcccatcatgagccagagcctgcccaaggagggccccgacaagtgcagcatcagcggccacggcagcctgaacagcatcagcagacacagcagcctgaagaacagactggacagcccccagatcagaaagaccgccaccgccggcagaagcaagagcttcaacaaccacagacccatggaccccgaggtgatcgcccaggacatcgaggccaccatgaacagcgccctgaacgagctgagagagctggagagacagagcagcgtgaagcacacccccgacgtggtgctggacaccctggagcccctgaagaccagccccgtggtggcccccaccagcgagcccagcagccccctgcacacccagctgctgaaggaccccgagcccgccttccagagaagcgccagcaccgccggcgacatcgcctgcgccttcagacccgtgaagagcgtgaagatggccgcccccgtgaagccccccgccaccagacccaagcccaccgtgttccccaagaccaacgccaccagccccggcgtgaacagcagcaccagcccccagagcaccgacaagagctgcaccgtgtag

SEQ ID NO: 99127 - DNA, 2112 bp, Artificial Sequence
  Description of Artificial Sequence: Synthetic coding sequence
agaaaggaccagaacgtgctgagccccgtgaactgctggaacctgctgctgaaccaggtgaagagagagagcagagaccacaccaccctgagcgacatctacctgaacaacatcatccccagattcgtgcaggtgagcgaggacagcggcagactgttcaagaagagcaaggaggtgggccagcagctgcaggacgacctgatgaaggtgctgaacgagctgtacagcgtgatgaagacctaccacatgtacaacgccgacagcatcagcgcccagagcaagctgaaggaggccgagaagcaggaggagaagcagatcggcaagagcgtgaagcaggaggacagacagacccccagaagccccgacagcaccgccaacgtgagaatcgaggagaagcacgtgagaagaagcagcgtgaagaagatcgagaagatgaaggagaagagacaggccaagtacaccgagaacaagctgaaggccatcaaggccagaaacgagtacctgctggccctggaggccaccaacgccagcgtgttcaagtactacatccacgacctgagcgacctgatcgactgctgcgacctgggctaccacgccagcctgaacagagccctgagaaccttcctgagcgccgagctgaacctggagcagagcaagcacgagggcctggacgccatcgagaacgccgtggagaacctggacgccaccagcgacaagcagagactgatggagatgtacaacaacgtgttctgcccccccatgaagttcgagttccagccccacatgggcgacatggccagccagctgtgcgcccagcagcccgtgcagagcgagctggtgcagagatgccagcagctgcagagcagactgagcaccctgaagatcgagaacgaggaggtgaagaagaccatggaggccaccctgcagaccatccaggacatcgtgaccgtggaggacttcgacgtgagcgactgcttccagtacagcaacagcatggagagcgtgaagagcaccgtgagcgagaccttcatgagcaagcccagcatcgccaagagaagagccaaccagcaggagaccgagcagttctacttcaccaagatgaaggagtacctggagggcagaaacctgatcaccaagctgcaggccaagcacgacctgctgcagaagaccctgggcgagagccagagaaccgactgcagcctggccagaagaagcagcaccgtgagaaagcaggacagcagccaggccatccccctggtggtggagagctgcatcagattcatcagcagacacggcctgcagcacgagggcatcttcagagtgagcggcagccaggtggaggtgaacgacatcaagaacgccttcgagagaggcgaggaccccctggccggcgaccagaacgaccacgacatggacagcatcgccggcgtgctgaagctgtacttcagaggcctggagcaccccctgttccccaaggacatcttccacgacctgatggcctgcgtgaccatggacaacctgcaggagagagccctgcacatcagaaaggtgctgctggtgctgcccaagaccaccctgatcatcatgagatacctgttcgccttcctgaaccacctgagccagttcagcgaggagaacatgatggacccctacaacctggccatctgcttcggccccagcctgatgagcgtgcccgagggccacgaccaggtgagctgccaggcccacgtgaacgagctgatcaagaccatcatcatccagcacgagaacatcttccccagccccagagagctggagggccccgtgtacagcagaggcggcagcatggaggactactgcgacagcccccacggcgagaccaccagcgtggaggacagcacccaggacgtgaccgccgagcaccacaccagcgacgacgagtgcgagcccatcgaggccatcgccaagttcgactacgtgggcagaaccgccagagagctgagcttcaagaagggcgccagcctgctgctgtaccagagagccagcgacgactggtgggagggcagacacaacggcatcgacggcctgatcccccaccagtacatcgtggtgcaggacaccctgatcagctag

SEQ ID NO: 99128 - DNA, 759 bp, Artificial Sequence
  Description of Artificial Sequence: Synthetic coding sequence
atggaggactactgcgacagcccccacggcgagaccaccagcgtggaggacagcacccaggacgtgaccgccgagcaccacaccagcgacgacgagtgcgagcccatcgaggccatcgccaagttcgactacgtgggcagaaccgccagagagctgagcttcaagaagggcgccagcctgctgctgtaccagagagccagcgacgactggtgggagggcagacacaacggcatcgacggcctgatcccccaccagtacatcgtggtgcaggacaccgaggacggcgtggtggagagaagcagccccaagagcgagatcgaggtgatcagcgagccccccgaggagaaggtgaccgccagagccggcgccagctgccccagcggcggccacgtggccgacatctacctggccaacatcaacaacaacctgcacctggacaacaccaagcccgtgaccaccaagcagagaaagagacccgagagcggcagcatcagaaagaccttcagaagcgacagccacggcctgagcagcagcctgaccgacagcagcagccccggcgtgggcgccagctgcagacccagcagccagcccatcatgagccagagcctgcccaaggagggccccgacaagtgcagcatcagcggccacggcagcctgaacagcatcagcagacacagcagcctgaagaacagactggacagcccccagatcagaaagaccgccaccgccggcagaagcaagagcttcaacaaccactag

SEQ ID NO: 99129 - DNA, 693 bp, Artificial Sequence
  Description of Artificial Sequence: Synthetic coding sequence
tgagccgagcaccacaccagcgacgacgagtgcgagcccatcgaggccatcgccaagttcgactacgtgggcagaaccgccagagagctgagcttcaagaagggcgccagcctgctgctgtaccagagagccagcgacgactggtgggagggcagacacaacggcatcgacggcctgatcccccaccagtacatcgtggtgcaggacaccgaggacggcgtggtggagagaagcagccccaagagcgagatcgaggtgatcagcgagccccccgaggagaaggtgaccgccagagccggcgccagctgccccagcggcggccacgtggccgacatctacctggccaacatcaacaacaacctgcacctggacaacaccaagcccgtgaccaccaagcagagaaagagacccgagagcggcagcatcagaaagaccttcagaagcgacagccacggcctgagcagcagcctgaccgacagcagcagccccggcgtgggcgccagctgcagacccagcagccagcccatcatgagccagagcctgcccaaggagggccccgacaagtgcagcatcagcggccacggcagcctgaacagcatcagcagacacagcagcctgaagaacagactggacagcccccagatcagaaagaccgccaccgccggcagaagcaagagcttcaacaaccactag

SEQ ID NO: 99130 - DNA, 1353 bp, Artificial Sequence
  Description of Artificial Sequence: Synthetic coding sequence
gtgaagaagaccatggaggccaccctgcagaccatccaggacatcgtgaccgtggaggacttcgacgtgagcgactgcttccagtacagcaacagcatggagagcgtgaagagcaccgtgagcgagaccttcatgagcaagcccagcatcgccaagagaagagccaaccagcaggagaccgagcagttctacttcaccaagatgaaggagtacctggagggcagaaacctgatcaccaagctgcaggccaagcacgacctgctgcagaagaccctgggcgagagccagagaaccgactgcagcctggccagaagaagcagcaccgtgagaaagcaggacagcagccaggccatccccctggtggtggagagctgcatcagattcatcagcagacacggcctgcagcacgagggcatcttcagagtgagcggcagccaggtggaggtgaacgacatcaagaacgccttcgagagaggcgaggaccccctggccggcgaccagaacgaccacgacatggacagcatcgccggcgtgctgaagctgtacttcagaggcctggagcaccccctgttccccaaggacatcttccacgacctgatggcctgcgtgaccatggacaacctgcaggagagagccctgcacatcagaaaggtgctgctggtgctgcccaagaccaccctgatcatcatgagatacctgttcgccttcctgaaccacctgagccagttcagcgaggagaacatgatggacccctacaacctggccatctgcttcggccccagcctgatgagcgtgcccgagggccacgaccaggtgagctgccaggcccacgtgaacgagctgatcaagaccatcatcatccagcacgagaacatcttccccagccccagagagctggagggccccgtgtacagcagaggcggcagcatggaggactactgcgacagcccccacggcgagaccaccagcgtggaggacagcacccaggacgtgaccgccgagcaccacaccagcgacgacgagtgcgagcccatcgaggccatcgccaagttcgactacgtgggcagaaccgccagagagctgagcttcaagaagggcgccagcctgctgctgtaccagagagccagcgacgactggtgggagggcagacacaacggcatcgacggcctgatcccccaccagtacatcgtggtgcaggacaccgaggacggcgtggtggagagaagcagccccaagagcgagatcgaggtgatcagcgagccccccgaggagaaggtgaccgccagagccggcgccagctgccccagcggcggccacgtggccgacatctacctggccaacatcaacaagtag

SEQ ID NO: 99131 - DNA, 3228 bp, Artificial Sequence
  Description of Artificial Sequence: Synthetic coding sequence
atgagcagccagaccaagttcaagaaggacaaggagatcatcgccgagtacgaggcccagatcaaggagatcagaacccagctggtggagcagttcaagtgcctggagcagcagagcgagagcagactgcagctgctgcaggacctgcaggagttcttcagaagaaaggccgagatcgagctggagtacagcagaagcctggagaagctggccgagagattcagcagcaagatcagaagcagcagagagcaccagttcaagaaggaccagtacctgctgagccccgtgaactgctggtacctggtgctgcaccagaccagaagagagagcagagaccacgccaccctgaacgacatcttcatgaacaacgtgatcgtgagactgagccagatcagcgaggacgtgatcagactgttcaagaagagcaaggagatcggcctgcagatgcacgaggagctgctgaaggtgaccaacgagctgtacaccgtgatgaagacctaccacatgtaccacgccgagagcatcagcgccgagagcaagctgaaggaggccgagaagcaggaggagaagcagttcaacaagagcggcgacctgagcatgaacctgctgagacacgaggacagaccccagagaagaagcagcgtgaagaagatcgagaagatgaaggagaagagacaggccaagtacagcgagaacaagctgaagtgcaccaaggccagaaacgactacctgctgaacctggccgccaccaacgccgccatcagcaagtactacatccacgacgtgagcgacctgatcgactgctgcgacctgggcttccacgccagcctggccagaaccttcagaacctacctgagcgccgagtacaacctggagaccagcagacacgagggcctggacgtgatcgagaacgccgtggacaacctggacagcagaagcgacaagcacaccgtgatggacatgtgcaaccaggtgttctgcccccccctgaagttcgagttccagccccacatgggcgacgaggtgtgccaggtgagcgcccagcagcccgtgcagaccgagctgctgatgagataccaccagctgcagagcagactggccaccctgaagatcgagaacgaggaggtgagaaagaccctggacgccaccatgcagaccctgcaggacatgctgaccgtggaggacttcgacgtgagcgacgccttccagcacagcagaagcaccgagagcgtgaagagcgccgccagcgagacctacatgagcaagatcaacatcgccaagagaagagccaaccagcaggagaccgagatgttctacttcaccaagttcaaggagtacgtgaacggcagcaacctgatcaccaagctgcaggccaagcacgacctgctgaagcagaccctgggcgagggcgagagagccgagtgcggcaccaccagaggcagaagaaacgccagaaccagaaaccaggacagcggccaggccatccccctggtggtggagagctgcatcagatacatcaacctgtacggcctgcagcagcagggcatcttcagagtgcccggcagccaggtggaggtgaacgacatcaagaacagcttcgagagaggcgaggaccccctggtggacgaccagaacgagagagacatcaacagcgtggccggcgtgctgaagctgtacttcagaggcctggagaaccccctgttccccaaggagagattccaggacctgatcagcaccatcaagctggagaaccccgccgagagagtgcaccagatccagcagatcctggtgaccctgcccagagtggtgatcgtggtgatgagatacctgttcgccttcctgaaccacctgagccagtacagcgacgagaacatgatggacccctacaacctggccatctgcttcggccccaccctgatgcacatccccgacggccaggaccccgtgagctgccaggcccacatcaacgaggtgatcaagaccatcatcatccaccacgaggccatcttccccagccccagagagctggagggccccgtgtacgagaagtgcatggccggcggcgaggagtactgcgacagcccccacagcgagcccggcgccatcgacgaggtggaccacgacaacggcaccgagccccacaccagcgacgaggaggtggagcagatcgaggccatcgccaagttcgactacatgggcagaagccccagagagctgagcttcaagaagggcgccagcctgctgctgtaccacagagccagcgaggactggtgggagggcagacacaacggcgtggacggcctgatcccccaccagtacatcgtggtgcaggacatggacgacgccttcagcgacagcctgagccagaaggccgacagcgaggccagcagcggccccctgctggacgacaaggccagcagcaagaacgacctgcagagccccaccgagcacatcagcgactacggcttcggcggcgtgatgggcagagtgagactgagaagcgacggcgccgccatccccagaagaagaagcggcggcgacacccacagcccccccagaggcctgggccccagcatcgacaccccccccagagccgccgcctgccccagcagcccccacaagatccccctgaccagaggcagaatcgagagccccgagaagagaagaatggccaccttcggcagcgccggcagcatcaactaccccgacaagaaggccctgagcgagggccacagcatgagaagcacctgcggcagcaccagacacagcagcctgggcgaccacaagagcctggaggccgaggccctggccgaggacatcgagaagaccatgagcaccgccctgcacgagctgagagagctggagagacagaacaccgtgaagcaggcccccgacgtggtgctggacaccctggagcccctgaagaacccccccggccccgtgagcagcgagcccgccagccccctgcacaccatcgtgatcagagaccccgacgccgccatgagaagaagcagcagcagcagcaccgagatgatgaccaccttcaagcccgccctgagcgccagactggccggcgcccagctgagacccccccccatgagacccgtgagacccgtggtgcagcacagaagcagcagcagcagcagcagcggcgtgggcagccccgccgtgacccccaccgagaagatgttccccaacagcagcgccgacaagagcggcaccatgtag

SEQ ID NO: 99132 - DNA, 3300 bp, Artificial Sequence
  Description of Artificial Sequence: Synthetic coding sequence
atgagcagccagaccaagttcaagaaggacaaggagatcatcgccgagtacgaggcccagatcaaggagatcagaacccagctggtggagcagttcaagtgcctggagcagcagagcgagagcagactgcagctgctgcaggacctgcaggagttcttcagaagaaaggccgagatcgagctggagtacagcagaagcctggagaagctggccgagagattcagcagcaagatcagaagcagcagagagcaccagttcaagaaggaccagtacctgctgagccccgtgaactgctggtacctggtgctgcaccagaccagaagagagagcagagaccacgccaccctgaacgacatcttcatgaacaacgtgatcgtgagactgagccagatcagcgaggacgtgatcagactgttcaagaagagcaaggagatcggcctgcagatgcacgaggagctgctgaaggtgaccaacgagctgtacaccgtgatgaagacctaccacatgtaccacgccgagagcatcagcgccgagagcaagctgaaggaggccgagaagcaggaggagaagcagttcaacaagagcggcgacctgagcatgaacctgctgagacacgaggacagaccccagagaagaagcagcgtgaagaagatcgagaagatgaaggagaagagacaggccaagtacagcgagaacaagctgaagtgcaccaaggccagaaacgactacctgctgaacctggccgccaccaacgccgccatcagcaagtactacatccacgacgtgagcgacctgatcgactgctgcgacctgggcttccacgccagcctggccagaaccttcagaacctacctgagcgccgagtacaacctggagaccagcagacacgagggcctggacgtgatcgagaacgccgtggacaacctggacagcagaagcgacaagcacaccgtgatggacatgtgcaaccaggtgttctgcccccccctgaagttcgagttccagccccacatgggcgacgaggtgtgccaggtgagcgcccagcagcccgtgcagaccgagctgctgatgagataccaccagctgcagagcagactggccaccctgaagatcgagaacgaggaggtgagaaagaccctggacgccaccatgcagaccctgcaggacatgctgaccgtggaggacttcgacgtgagcgacgccttccagcacagcagaagcaccgagagcgtgaagagcgccgccagcgagacctacatgagcaagatcaacatcgccaagagaagagccaaccagcaggagaccgagatgttctacttcaccaagttcaaggagtacgtgaacggcagcaacctgatcaccaagctgcaggccaagcacgacctgctgaagcagaccctgggcgagggcgagagagccgagtgcggcaccaccagacccccctgcctgccccccaagccccagaagatgagaagacccagacccctgagcgtgtacagccacaagctgttcaacggcagcatggaggccttcatcaaggacagcggccaggccatccccctggtggtggagagctgcatcagatacatcaacctgtacggcctgcagcagcagggcatcttcagagtgcccggcagccaggtggaggtgaacgacatcaagaacagcttcgagagaggcgaggaccccctggtggacgaccagaacgagagagacatcaacagcgtggccggcgtgctgaagctgtacttcagaggcctggagaaccccctgttccccaaggagagattccaggacctgatcagcaccatcaagctggagaaccccgccgagagagtgcaccagatccagcagatcctggtgaccctgcccagagtggtgatcgtggtgatgagatacctgttcgccttcctgaaccacctgagccagtacagcgacgagaacatgatggacccctacaacctggccatctgcttcggccccaccctgatgcacatccccgacggccaggaccccgtgagctgccaggcccacatcaacgaggtgatcaagaccatcatcatccaccacgaggccatcttccccagccccagagagctggagggccccgtgtacgagaagtgcatggccggcggcgaggagtactgcgacagcccccacagcgagcccggcgccatcgacgaggtggaccacgacaacggcaccgagccccacaccagcgacgaggaggtggagcagatcgaggccatcgccaagttcgactacatgggcagaagccccagagagctgagcttcaagaagggcgccagcctgctgctgtaccacagagccagcgaggactggtgggagggcagacacaacggcgtggacggcctgatcccccaccagtacatcgtggtgcaggacatggacgacgccttcagcgacagcctgagccagaaggccgacagcgaggccagcagcggccccctgctggacgacaaggccagcagcaagaacgacctgcagagccccaccgagcacatcagcgactacggcttcggcggcgtgatgggcagagtgagactgagaagcgacggcgccgccatccccagaagaagaagcggcggcgacacccacagcccccccagaggcctgggccccagcatcgacaccccccccagagccgccgcctgccccagcagcccccacaagatccccctgaccagaggcagaatcgagagccccgagaagagaagaatggccaccttcggcagcgccggcagcatcaactaccccgacaagaaggccctgagcgagggccacagcatgagaagcacctgcggcagcaccagacacagcagcctgggcgaccacaagagcctggaggccgaggccctggccgaggacatcgagaagaccatgagcaccgccctgcacgagctgagagagctggagagacagaacaccgtgaagcaggcccccgacgtggtgctggacaccctggagcccctgaagaacccccccggccccgtgagcagcgagcccgccagccccctgcacaccatcgtgatcagagaccccgacgccgccatgagaagaagcagcagcagcagcaccgagatgatgaccaccttcaagcccgccctgagcgccagactggccggcgcccagctgagacccccccccatgagacccgtgagacccgtggtgcagcacagaagcagcagcagcagcagcagcggcgtgggcagccccgccgtgacccccaccgagaagatgttccccaacagcagcgccgacaagagcggcaccatgtag

SEQ ID NO: 99133 - DNA, 1008 bp, Artificial Sequence
  Description of Artificial Sequence: Synthetic coding sequence
atgaacaacgtgatcgtgagactgagccagatcagcgaggacgtgatcagactgttcaagaagagcaaggagatcggcctgcagatgcacgaggagctgctgaaggtgaccaacgagctgtacaccgtgatgaagacctaccacatgtaccacgccgagagcatcagcgccgagagcaagctgaaggaggccgagaagcaggaggagaagcagttcaacaagagcggcgacctgagcatgaacctgctgagacacgaggacagaccccagagaagaagcagcgtgaagaagatcgagaagatgaaggagaagagacaggccaagtacagcgagaacaagctgaagtgcaccaaggccagaaacgactacctgctgaacctggccgccaccaacgccgccatcagcaagtactacatccacgacgtgagcgacctgatcgactgctgcgacctgggcttccacgccagcctggccagaaccttcagaacctacctgagcgccgagtacaacctggagaccagcagacacgagggcctggacgtgatcgagaacgccgtggacaacctggacagcagaagcgacaagcacaccgtgatggacatgtgcaaccaggtgttctgcccccccctgaagttcgagttccagccccacatgggcgacgaggtgtgccaggtgagcgcccagcagcccgtgcagaccgagctgctgatgagataccaccagctgcagagcagactggccaccctgaagatcgagaacgaggaggtgagaaagaccctggacgccaccatgcagaccctgcaggacatgctgaccgtggaggacttcgacgtgagcgacgccttccagcacagcagaagcaccgagagcgtgaagagcgccgccagcgagacctacatgagcaagatcaacatcgccaagagaagagccaaccagcaggagaccgagatgttctacttcaccaagggccccgacgacgtgttccccatctgccaccccagactgtag

SEQ ID NO: 99134 - DNA, 360 bp, Artificial Sequence
  Description of Artificial Sequence: Synthetic coding sequence
atgagctggtggagaaacaacttctggatcatcctggccgtggccatcatcgtggtgagcgtgggcctgggcctgatcctgtactgcgtgtgcaagtggcagctgagaagaggcaagaagtgggagatcgccaagcccctgaagcacaagcaggtggacgaggagaagatgtacgacttcctgctgctgagaaccgcctgcagcctgccccccctgcccctgcactacagaaccagcatgaccgagacctacggcgtgctgctgtgcagacccggctggagcgccctggccagaagcagactgaccgccgccagcgccagctgggtgcaggccatcctgctgccccagccccccaagtag

SEQ ID NO: 99135 - DNA, 438 bp, Artificial Sequence
  Description of Artificial Sequence: Synthetic coding sequence
atggacaccttcaccgtgcaggacagcaccgccatgagctggtggagaaacaacttctggatcatcctggccgtggccatcatcgtggtgagcgtgggcctgggcctgatcctgtactgcgtgtgcaagtggcagctgagaagaggcaagaagtgggagatcgccaagcccctgaagcacaagcaggtggacgaggagaagatgtacgagaacgtgctgaacgagagccccgtgcagctgccccccctgccccccagaaactggcccagcctggaggacagcagcccccaggaggcccccagccagccccccgccacctacagcctggtgaacaaggtgaagaacaagaagaccgtgagcatccccagctacatcgagcccgaggacgactacgacgacgtggagatccccgccaacaccgagaaggccagcttctag

SEQ ID NO: 99136 - DNA, 438 bp, Artificial Sequence; identical to SEQ ID NO: 99135
  Description of Artificial Sequence: Synthetic coding sequence

SEQ ID NO: 99137 - DNA, 1398 bp, Artificial Sequence
  Description of Artificial Sequence: Synthetic coding sequence
atgaacgtgaccagcctgttcagcttcaccagccccgccgtgaagagactgctgggctggaagcagggcgacgaggaggagaagtgggccgagaaggccgtggacgccctggtgaagaagctgaagaagaagaagggcgccatggaggagctggagaaggccctgagctgccccggccagcccagcaactgcgtgaccatccccagaagcctggacggcagactgcaggtgagccacagaaagggcctgccccacgtgatctactgcagagtgtggagatggcccgacctgcagagccaccacgagctgaagcccctggagtgctgcgagttccccttcggcagcaagcagaaggaggtgtgcatcaacccctaccactacaagagagtggagagccccgtgctgccccccgtgctggtgcccagacacagcgagtacaacccccagcacagcctgctggcccagttcagaaacctgggccagaacgagccccacatgcccctgaacgccaccttccccgacagcttccagcagcccaacagccaccccttcccccacagccccaacagcagctaccccaacagccccggcagcagcagcagcacctacccccacagccccaccagcagcgaccccggcagccccttccagatgcccgccgacacccccccccccgcctacctgccccccgaggaccccatgacccaggacggcagccagcccatggacaccaacatgatggccccccccctgcccagcgagatcaacagaggcgacgtgcaggccgtggcctacgaggagcccaagcactggtgcagcatcgtgtactacgagctgaacaacagagtgggcgaggccttccacgccagcagcaccagcgtgctggtggacggcttcaccgaccccagcaacaacaagaacagattctgcctgggcctgctgagcaacgtgaacagaaacagcaccatcgagaacaccagaagacacatcggcaagggcgtgcacctgtactacgtgggcggcgaggtgtacgccgagtgcctgagcgacagcagcatcttcgtgcagagcagaaactgcaactaccaccacggcttccaccccaccaccgtgtgcaagatccccagcggctgcagcctgaagatcttcaacaaccaggagttcgcccagctgctggcccagagcgtgaaccacggcttcgagaccgtgtacgagctgaccaagatgtgcaccatcagaatgagcttcgtgaagggctggggcgccgagtaccacagacaggacgtgaccagcaccccctgctggatcgagatccacctgcacggccccctgcagtggctggacaaggtgctgacccagatgggcagcccccacaaccccatcagcagcgtgagctag

SEQ ID NO: 99138 - DNA, 1398 bp, Artificial Sequence; identical to SEQ ID NO: 99137
  Description of Artificial Sequence: Synthetic coding sequence

SEQ ID NO: 99139 - DNA, 177 bp, Artificial Sequence
  Description of Artificial Sequence: Synthetic coding sequence
atgaacgtgaccagcctgttcagcttcaccagccccgccgtgaagagactgctgggctggaagcagggcgacgaggaggagaagtgggccgagaaggccgtggacgccctggtgaagaagctgaagaagaagaagggcgccatggaggagctggagaaggccctgagctgcccctag

SEQ ID NO: 99140 - DNA, 33 bp, Artificial Sequence
  Description of Artificial Sequence: Synthetic coding sequence
atgaacgtgaccagcctgttcagcttcacctag

SEQ ID NO: 99141 - DNA, 288 bp, Artificial Sequence
  Description of Artificial Sequence: Synthetic coding sequence
atgaacgtgaccagcctgttcagcttcaccagccccgccgtgaagagactgctgggctggaagcagggcgacgaggaggagaagtgggccgagaaggccgtggacgccctggtgaagaagctgaagaagaagaagggcgccatggaggagctggagaaggccctgagctgccccggccagcccagcaactgcgtgaccatccccagaagcctggacggcagactgcaggtgagccacagaaagggcctgccccacgtgatctactgcagagtgtggagatggccctag

SEQ ID NO: 99142 - DNA, 402 bp, Artificial Sequence
  Description of Artificial Sequence: Synthetic coding sequence
atgaacgtgaccagcctgttcagcttcaccagccccgccgtgaagagactgctgggctggaagcagggcgacgaggaggagaagtgggccgagaaggccgtggacgccctggtgaagaagctgaagaagaagaagggcgccatggaggagctggagaaggccctgagctgccccggccagcccagcaactgcgtgaccatccccagaagcctggacggcagactgcaggtgagccacagaaagggcctgccccacgtgatctactgcagagtgtggagatggcccgacctgcagagccaccacgagctgaagcccctggagtgctgcgagttccccttcggcagcaagcagaaggaggtgtgcatcaacccctaccactacaagagagtggagagcccctag

SEQ ID NO: 99143 - DNA, 321 bp, Artificial Sequence
  Description of Artificial Sequence: Synthetic coding sequence
atgaacgtgaccagcctgttcagcttcaccagccccgccgtgaagagactgctgggctggaagcagggcgacgaggaggagaagtgggccgagaaggccgtggacgccctggtgaagaagctgaagaagaagaagggcgccatggaggagctggagaaggccctgagctgccccggccagcccagcaactgcgtgaccatccccagaagcctggacggcagactgcaggtgagccacagaaagggcctgccccacgtgatctactgcagagtgtggagatggcccgacctgcagagccaccacgagctgaagcccctgtag

SEQ ID NO: 99144 - DNA, 339 bp, Artificial Sequence
  Description of Artificial Sequence: Synthetic coding sequence
atgaacgtgaccagcctgttcagcttcaccagccccgccgtgaagagactgctgggctggaagcagggcgacgaggaggagaagtgggccgagaaggccgtggacgccctggtgaagaagctgaagaagaagaagggcgccatggaggagctggagaaggccctgagctgccccggccagcccagcaactgcgtgaccatccccagaagcctggacggcagactgcaggtgagccacagaaagggcctgccccacgtgatctactgcagagtgtggagatggcccgacctgcagagccaccacgagctgaagcccctggagtgctgcgagttcccctag

SEQ ID NO: 99145 - DNA, 1398 bp, Artificial Sequence; identical to SEQ ID NO: 99137
  Description of Artificial Sequence: Synthetic coding sequence

SEQ ID NO: 99146 - DNA, 1659 bp, Artificial Sequence
  Description of Artificial Sequence: Synthetic coding sequence
atggacaacatgagcatcaccaacacccccaccagcaacgacgcctgcctgagcatcgtgcacagcctgatgtgccacagacagggcggcgagagcgagaccttcgccaagagagccatcgagagcctggtgaagaagctgaaggagaagaaggacgagctggacagcctgatcaccgccatcaccaccaacggcgcccaccccagcaagtgcgtgaccatccagagaaccctggacggcagactgcaggtggccggcagaaagggcttcccccacgtgatctacgccagactgtggagatggcccgacctgcacaagaacgagctgaagcacgtgaagtactgccagtacgccttcgacctgaagtgcgacagcgtgtgcgtgaacccctaccactacgagagagtggtgagccccggcatcgacctgagcggcctgaccctgcagagcaacgcccccagcagcatgatggtgaaggacgagtacgtgcacgacttcgagggccagcccagcctgagcaccgagggccacagcatccagaccatccagcacccccccagcaacagagccagcaccgagacctacagcacccccgccctgctggcccccagcgagagcaacgccaccagcaccgccaacttccccaacatccccgtggccagcaccagccagcccgccagcatcctgggcggcagccacagcgagggcctgctgcagatcgccagcggcccccagcccggccagcagcagaacggcttcaccggccagcccgccacctaccaccacaacagcaccaccacctggaccggcagcagaaccgccccctacacccccaacctgccccaccaccagaacggccacctgcagcaccacccccccatgcccccccaccccggccactactggcccgtgcacaacgagctggccttccagccccccatcagcaaccaccccgcccccgagtactggtgcagcatcgcctacttcgagatggacgtgcaggtgggcgagaccttcaaggtgcccagcagctgccccatcgtgaccgtggacggctacgtggaccccagcggcggcgacagattctgcctgggccagctgagcaacgtgcacagaaccgaggccatcgagagagccagactgcacatcggcaagggcgtgcagctggagtgcaagggcgagggcgacgtgtgggtgagatgcctgagcgaccacgccgtgttcgtgcagagctactacctggacagagaggccggcagagcccccggcgacgccgtgcacaagatctaccccagcgcctacatcaaggtgttcgacctgagacagtgccacagacagatgcagcagcaggccgccaccgcccaggccgccgccgccgcccaggccgccgccgtggccggcaacatccccggccccggcagcgtgggcggcatcgcccccgccatcagcctgagcgccgccgccggcatcggcgtggacgacctgagaagactgtgcatcctgagaatgagcttcgtgaagggctggggccccgactaccccagacagagcatcaaggagaccccctgctggatcgagatccacctgcacagagccctgcagctgctggacgaggtgctgcacaccatgcccatcgccgacccccagcccctggactag

SEQ ID NO: 99147 - DNA, 1659 bp, Artificial Sequence; identical to SEQ ID NO: 99146
  Description of Artificial Sequence: Synthetic coding sequence

SEQ ID NO: 99148 - DNA, 534 bp, Artificial Sequence
  Description of Artificial Sequence: Synthetic coding sequence
atggacaacatgagcatcaccaacacccccaccagcaacgacgcctgcctgagcatcgtgcacagcctgatgtgccacagacagggcggcgagagcgagaccttcgccaagagagccatcgagagcctggtgaagaagctgaaggagaagaaggacgagctggacagcctgatcaccgccatcaccaccaacggcgcccaccccagcaagtgcgtgaccatccagagaaccctggacggcagactgcaggtggccggcagaaagggcttcccccacgtgatctacgccagactgtggagatggcccgacctgcacaagaacgagctgaagcacgtgaagtactgccagtacgccttcgacctgaagtgcgacagcgtgtgcgtgaacccctaccactacgagagagtggtgagccccggcatcgacctgagcggcctgaccctgcagagcaacgagaacaactggtacttcagccagctgctgctggacctggacaagggcatgatccaggagcaggccatccacggcccctag

SEQ ID NO: 99149 - DNA, 1311 bp, Artificial Sequence
  Description of Artificial Sequence: Synthetic coding sequence
atggacaacatgagcatcaccaacacccccaccagcaacgacgcctgcctgagcatcgtgcacagcctgatgtgccacagacagggcggcgagagcgagaccttcgccaagagagccatcgagagcctggtgaagaagctgaaggagaagaaggacgagctggacagcctgatcaccgccatcaccaccaacggcgcccaccccagcaagtgcgtgaccatccagagaaccctggacggcagactgcaggtggccggcagaaagggcttcccccacgtgatctacgccagactgtggagatggcccgacctgcacaagaacgagctgaagcacgtgaagtactgccagtacgccttcgacctgaagtgcgacagcgtgtgcgtgaacccctaccactacgagagagtggtgagccccggcatcgacctgagcggcctgaccctgcagagcaacgcccccagcagcatgatggtgaaggacgagtacgtgcacgacttcgagggccagcccagcctgagcaccgagggccacagcatccagaccatccagcacccccccagcaacagagccagcaccgagacctacagcacccccgccctgctggcccccagcgagagcaacgccaccagcaccgccaacttccccaacatccccgtggccagcaccagccagcccgccagcatcctgggcggcagccacagcgagggcctgctgcagatcgccagcggcccccagcccggccagcagcagaacggcttcaccggccagcccgccacctaccaccacaacagcaccaccacctggaccggcagcagaaccgccccctacacccccaacctgccccaccaccagaacggccacctgcagcaccacccccccatgcccccccaccccggccactactggcccgtgcacaacgagctggccttccagccccccatcagcaaccaccccgcccccgagtactggtgcagcatcgcctacttcgagatggacgtgcaggtgggcgagaccttcaaggtgcccagcagctgccccatcgtgaccgtggacggctacgtggaccccagcggcggcgacagattctgcctgggccagctgagcaacgtgcacagaaccgaggccatcgagagagccagactgcacatcggcaagggcgtgcagctggagtgcaagggcgagggcgacgtgtgggtgagatgcctgagcgaccacgccgtgttcgtgcagagctactacctggacagagaggccggcagagcccccggcgacgccgtgcacaagatctaccccagcgcctacatcaagtag

SEQ ID NO: 99150 - DNA, 243 bp, Artificial Sequence
  Description of Artificial Sequence: Synthetic coding sequence
atgaccagcatggccagcctgttcagcttcaccagccccgccgtgaagagactgctgggctggaagcagggcgacgaggaggagaagtgggccgagaaggccgtggacgccctggtgaagaagctgaagaagaagaagggcgccatggaggagctggagaaggccctgagcagccccggccagcccagcaagtgcgtgaccatccccagaagcctggacggcagactgcaggtgagccactag

SEQ ID NO: 99151 - DNA, 387 bp, Artificial Sequence
  Description of Artificial Sequence: Synthetic coding sequence
atgaccagcatggccagcctgttcagcttcaccagccccgccgtgaagagactgctgggctggaagcagggcgacgaggaggagaagtgggccgagaaggccgtggacgccctggtgaagaagctgaagaagaagaagggcgccatggaggagctggagaaggccctgagcagccccggccagcccagcaagtgcgtgaccatccccagaagcctggacggcagactgcaggtgagccacagaaagggcctgccccacgtgatctactgcagagtgtggagatggcccgacctgcagagccaccacgagctgaagcccctggacatctgcgagttccccttcggcagcaagcagaaggaggtgtgcatcaacccctaccactactag

SEQ ID NO: 99152 - DNA, 6 bp, Artificial Sequence
  Description of Artificial Sequence: Synthetic coding sequence
atgtag

SEQ ID NO: 99153 - DNA, 405 bp, Artificial Sequence
  Description of Artificial Sequence: Synthetic coding sequence
atgaccagcatggccagcctgttcagcttcaccagccccgccgtgaagagactgctgggctggaagcagggcgacgaggaggagaagtgggccgagaaggccgtggacgccctggtgaagaagctgaagaagaagaagggcgccatggaggagctggagaaggccctgagcagccccggccagcccagcaagtgcgtgaccatccccagaagcctggacggcagactgcaggtgagccacagaaagggcctgccccacgtgatctactgcagagtgtggagatggcccgacctgcagagccaccacgagctgaagcccctggacatctgcgagttccccttcggcagcaagcagaaggaggtgtgcatcaacccctaccactacaagagagtggagagcccctag

SEQ ID NO: 99154 - DNA, 6 bp, Artificial Sequence
  Description of Artificial Sequence: Synthetic coding sequence
atgtag

SEQ ID NO: 99155 - DNA, 1395 bp, Artificial Sequence
  Description of Artificial Sequence: Synthetic coding sequence
atgaccagcatggccagcctgttcagcttcaccagccccgccgtgaagagactgctgggctggaagcagggcgacgaggaggagaagtgggccgagaaggccgtggacgccctggtgaagaagctgaagaagaagaagggcgccatggaggagctggagaaggccctgagcagccccggccagcccagcaagtgcgtgaccatccccagaagcctggacggcagactgcaggtgagccacagaaagggcctgccccacgtgatctactgcagagtgtggagatggcccgacctgcagagccaccacgagctgaagcccctggacatctgcgagttccccttcggcagcaagcagaaggaggtgtgcatcaacccctaccactacaagagagtggagagccccgtgctgccccccgtgctggtgcccagacacaacgagttcaacccccagcacagcctgctggtgcagttcagaaacctgagccacaacgagccccacatgccccagaacgccaccttccccgacagcttccaccagcccaacaacacccccttccccctgagccccaacagcccctacccccccagccccgccagcagcacctaccccaacagccccgccagcagcggccccggcagccccttccagctgcccgccgacacccccccccccgcctacatgccccccgacgaccagatgggccaggacaacagccagcccatggacaccagcaacaacatgatcccccagatcatgcccagcatcagcagcagagacgtgcagcccgtggcctacgaggagcccaagcactggtgcagcatcgtgtactacgagctgaacaacagagtgggcgaggccttccacgccagcagcaccagcgtgctggtggacggcttcaccgaccccagcaacaacaagagcagattctgcctgggcctgctgagcaacgtgaacagaaacagcaccatcgagaacaccagaagacacatcggcaagggcgtgcacctgtactacgtgggcggcgaggtgtacgccgagtgcctgagcgacagcagcatcttcgtgcagagcagaaactgcaacttccaccacggcttccaccccaccaccgtgtgcaagatccccagcagctgcagcctgaagatcttcaacaaccaggagttcgcccagctgctggcccagagcgtgaaccacggcttcgaggccgtgtacgagctgaccaagatgtgcaccatcagaatgagcttcgtgaagggctggggcgccgagtaccacagacaggacgtgaccagcaccccctgctggatcgagatcctgcacggccccctgcagtggctggacaaggtgctgacccagatgggcagccccctgaaccccatcagcagcgtgagctag

SEQ ID NO: 99156 - DNA, 1395 bp, Artificial Sequence; identical to SEQ ID NO: 99155
  Description of Artificial Sequence: Synthetic coding sequence

SEQ ID NO: 99157 - DNA, 1491 bp, Artificial Sequence
  Description of Artificial Sequence: Synthetic coding sequence
atgttcagaagcaagagaagcggcctggtgagaagactgtggagaagcagagtggtgcccgacagagaggagggcggcagcggcggcggcggcggcggcgacgaggacggcagcctgggcagcagagccgagcccgcccccagagccagagagggcggcggctgcggcagaagcgaggtgagacccgtggcccccagaagacccagagacgccgtgggccagagaggcgcccagggcgccggcagaagaagaagagccggcggcccccccagacccatgagcgagcccggcgccggcgccggcagcagcctgctggacgtggccgagcccggcggccccggctggctgcccgagagcgactgcgagaccgtgacctgctgcctgttcagcgagagagacgccgccggcgcccccagagacgccagcgaccccctggccggcgccgccctggagcccgccggcggcggcagaagcagagaggccagaagcagactgctgctgctggagcaggagctgaagaccgtgacctacagcctgctgaagagactgaaggagagaagcctggacaccctgctggaggccgtggagagcagaggcggcgtgcccggcggctgcgtgctggtgcccagagccgacctgagactgggcggccagcccgcccccccccagctgctgctgggcagactgttcagatggcccgacctgcagcacgccgtggagctgaagcccctgtgcggctgccacagcttcgccgccgccgccgacggccccaccgtgtgctgcaacccctaccacttcagcagactgtgcggccccgagagccccccccccccctacagcagactgagccccagagacgagtacaagcccctggacctgagcgacagcaccctgagctacaccgagaccgaggccaccaacagcctgatcaccgcccccggcgagttcagcgacgccagcatgagccccgacgccaccaagcccagccactggtgcagcgtggcctactgggagcacagaaccagagtgggcagactgtacgccgtgtacgaccaggccgtgagcatcttctacgacctgccccagggcagcggcttctgcctgggccagctgaacctggagcagagaagcgagagcgtgagaagaaccagaagcaagatcggcttcggcatcctgctgagcaaggagcccgacggcgtgtgggcctacaacagaggcgagcaccccatcttcgtgaacagccccaccctggacgcccccggcggcagagccctggtggtgagaaaggtgccccccggctacagcatcaaggtgttcgacttcgagagaagcggcctgcagcacgcccccgagcccgacgccgccgacggcccctacgaccccaacagcgtgagaatcagcttcgccaagggctggggcccctgctacagcagacagttcatcaccagctgcccctgctggctggagatcctgctgaacaaccccagatag

SEQ ID NO: 99158 - DNA, 708 bp, Artificial Sequence
  Description of Artificial Sequence: Synthetic coding sequence
atgagcagaatgggcaagcccatcgagacccagaagagccccccccccccctacagcagactgagccccagagacgagtacaagcccctggacctgagcgacagcaccctgagctacaccgagaccgaggccaccaacagcctgatcaccgcccccggcgagttcagcgacgccagcatgagccccgacgccaccaagcccagccactggtgcagcgtggcctactgggagcacagaaccagagtgggcagactgtacgccgtgtacgaccaggccgtgagcatcttctacgacctgccccagggcagcggcttctgcctgggccagctgaacctggagcagagaagcgagagcgtgagaagaaccagaagcaagatcggcttcggcatcctgctgagcaaggagcccgacggcgtgtgggcctacaacagaggcgagcaccccatcttcgtgaacagccccaccctggacgcccccggcggcagagccctggtggtgagaaaggtgccccccggctacagcatcaaggtgttcgacttcgagagaagcggcctgcagcacgcccccgagcccgacgccgccgacggcccctacgaccccaacagcgtgagaatcagcttcgccaagggctggggcccctgctacagcagacagttcatcaccagctgcccctgctggctggagatcctgctgaacaaccccagatag

SEQ ID NO: 99159 - DNA, 1017 bp, Artificial Sequence
  Description of Artificial Sequence: Synthetic coding sequence
atgttcagaagcaagagaagcggcctggtgagaagactgtggagaagcagagtggtgcccgacagagaggagggcggcagcggcggcggcggcggcggcgacgaggacggcagcctgggcagcagagccgagcccgcccccagagccagagagggcggcggctgcggcagaagcgaggtgagacccgtggcccccagaagacccagagacgccgtgggccagagaggcgcccagggcgccggcagaagaagaagagccggcggcccccccagacccatgagcgagcccggcgccggcgccggcagcagcctgctggacgtggccgagcccggcggccccggctggctgcccgagagcgactgcgagaccgtgacctgctgcctgttcagcgagagagacgccgccggcgcccccagagacgccagcgaccccctggccggcgccgccctggagcccgccggcggcggcagaagcagagaggccagaagcagactgctgctgctggagcaggagctgaagaccgtgacctacagcctgctgaagagactgaaggagagaagcctggacaccctgctggaggccgtggagagcagaggcggcgtgcccggcggctgcgtgctggtgcccagagccgacctgagactgggcggccagcccgcccccccccagctgctgctgggcagactgttcagatggcccgacctgcagcacgccgtggagctgaagcccctgtgcggctgccacagcttcgccgccgccgccgacggccccaccgtgtgctgcaacccctaccacttcagcagactgtgcggccccgagagccccccccccccctacagcagactgagccccagagacgagtacaagcccctggacctgagcgacagcaccctgagctacaccgagaccgaggccaccaacagcctgatcaccgcccccggcgagttcagcgccgccgacgccggcatcggcagcagaggcaacagaggcctggagagcagcgtgccctgcagctag

SEQ ID NO: 99160 - DNA, 1293 bp, Artificial Sequence
  Description of Artificial Sequence: Synthetic coding sequence
atgcacagcaccacccccatcagcagcctgttcagcttcaccagccccgccgtgaagagactgctgggctggaagcagggcgacgaggaggagaagtgggccgagaaggccgtggacagcctggtgaagaagctgaagaagaagaagggcgccatggacgagctggagagagccctgagctgccccggccagcccagcaagtgcgtgaccatccccagaagcctggacggcagactgcaggtgagccacagaaagggcctgccccacgtgatctactgcagagtgtggagatggcccgacctgcagagccaccacgagctgaagcccctggagtgctgcgagttccccttcggcagcaagcagaaggaggtgtgcatcaacccctaccactacagaagagtggagacccccgtgctgccccccgtgctggtgcccagacacagcgagtacaacccccagctgagcctgctggccaagttcagaagcgccagcctgcacagcgagcccctgatgccccacaacgccacctaccccgacagcttccagcagcccccctgcagcgccctgccccccagccccagccacgccttcagccagagcccctgcaccgccagctacccccacagccccggcagccccagcgagcccgagagcccctaccagcacagcgacttcagacccgtgtgctacgaggagccccagcactggtgcagcgtggcctactacgagctgaacaacagagtgggcgagaccttccaggccagcagcagaagcgtgctgatcgacggcttcaccgaccccagcaacaacagaaacagattctgcctgggcctgctgagcaacgtgaacagaaacagcaccatcgagaacaccagaagacacatcggcaagggcgtgcacctgtactacgtgggcggcgaggtgtacgccgagtgcgtgagcgacagcagcatcttcgtgcagagcagaaactgcaactaccagcacggcttccaccccgccaccgtgtgcaagatccccagcggctgcagcctgaaggtgttcaacaaccagctgttcgcccagctgctggcccagagcgtgcaccacggcttcgaggtggtgtacgagctgaccaagatgtgcaccatcagaatgagcttcgtgaagggctggggcgccgagtaccacagacaggacgtgaccagcaccccctgctggatcgagatccacctgcacggccccctgcagtggctggacaaggtgctgacccagatgggcagcccccacaaccccatcagcagcgtgagctag

SEQ ID NO: 99161 - DNA, 1404 bp, Artificial Sequence
  Description of Artificial Sequence: Synthetic coding sequence
atgcacagcaccacccccatcagcagcctgttcagcttcaccagccccgccgtgaagagactgctgggctggaagcagggcgacgaggaggagaagtgggccgagaaggccgtggacagcctggtgaagaagctgaagaagaagaagggcgccatggacgagctggagagagccctgagctgccccggccagcccagcaagtgcgtgaccatccccagaagcctggacggcagactgcaggtgagccacagaaagggcctgccccacgtgatctactgcagagtgtggagatggcccgacctgcagagccaccacgagctgaagcccctggagtgctgcgagttccccttcggcagcaagcagaaggaggtgtgcatcaacccctaccactacagaagagtggagacccccgtgctgccccccgtgctggtgcccagacacagcgagtacaacccccagctgagcctgctggccaagttcagaagcgccagcctgcacagcgagcccctgatgccccacaacgccacctaccccgacagcttccagcagcccccctgcagcgccctgccccccagccccagccacgccttcagccagagcccctgcaccgccagctacccccacagccccggcagccccagcgagcccgagagcccctaccagcacagcgtggacaccccccccctgccctaccacgccaccgaggccagcgagacccagagcggccagcccgtggacgccaccgccgacagacacgtggtgctgagcatccccaacggcgacttcagacccgtgtgctacgaggagccccagcactggtgcagcgtggcctactacgagctgaacaacagagtgggcgagaccttccaggccagcagcagaagcgtgctgatcgacggcttcaccgaccccagcaacaacagaaacagattctgcctgggcctgctgagcaacgtgaacagaaacagcaccatcgagaacaccagaagacacatcggcaagggcgtgcacctgtactacgtgggcggcgaggtgtacgccgagtgcgtgagcgacagcagcatcttcgtgcagagcagaaactgcaactaccagcacggcttccaccccgccaccgtgtgcaagatccccagcggctgcagcctgaaggtgttcaacaaccagctgttcgcccagctgctggcccagagcgtgcaccacggcttcgaggtggtgtacgagctgaccaagatgtgcaccatcagaatgagcttcgtgaagggctggggcgccgagtaccacagacaggacgtgaccagcaccccctgctggatcgagatccacctgcacggccccctgcagtggctggacaaggtgctgacccagatgggcagcccccacaaccccatcagcagcgtgagctag

SEQ ID NO: 99162 - DNA, 1404 bp, Artificial Sequence; identical to SEQ ID NO: 99161
  Description of Artificial Sequence: Synthetic coding sequence

SEQ ID NO: 99163 - DNA, 1191 bp, Artificial Sequence
  Description of Artificial Sequence: Synthetic coding sequence
atgaaggccgtgaagagcgagagagagagaggcagcagaagaagacacagagacggcgacgtggtgctgcccgccggcgtggtggtgaagcaggagagactgagccccgaggtggccccccccgcccacagaagacccgaccacagcggcggcagccccagcccccccaccagcgagcccgccagaagcggccacagaggcaacagagccagaggcgtgagcagaagcccccccaagaagaagaacaaggccagcggcagaagaagcaagagccccagaagcaagagaaacagaagcccccaccacagcaccgtgaaggtgaagcaggagagagaggaccaccccagaagaggcagagaggacagacagcacagagagcccagcgagcaggagcacagaagagccagaaacagcgacagagacagacacagaggccacagccaccagagaagaaccagcaacgagagacccggcagcggccagggccagggcagagacagagacacccagaacctgcaggcccaggaggaggagagagagttctacaacgccagaagaagagagcacagacagagaaacgacgtgggcggcggcggcagcgagagccaggagctggtgcccagacccggcggcaacaacaaggagaaggaggtgcccgccaaggagaagcccagcttcgagctgagcggcgccctgctggaggacaccaacaccttcagaggcgtggtgatcaagtacagcgagccccccgaggccagaatccccaagaagagatggagactgtaccccttcaagaacgacgaggtgctgcccgtgatgtacatccacagacagagcgcctacctgctgggcagacacagaagaatcgccgacatccccatcgaccaccccagctgcagcaagcagcacgccgtgttccagtacagactggtggagtacaccagagccgacggcaccgtgggcagaagagtgaagccctacatcatcgacctgggcagcggcaacggcaccttcctgaacaacaagagaatcgagccccagagatactacgagctgaaggagaaggacgtgctgaagttcggcttcagcagcagagagtacgtgctgctgcacgagagcagcgacaccagcgagatcgacagaaaggacgacgaggacgaggaggaggaggaggaggtgagcgacagctag

SEQ ID NO: 99164 - DNA, 1143 bp, Artificial Sequence
  Description of Artificial Sequence: Synthetic coding sequence
atgaaggccgtgaagagcgagagagagggcgtggtggtgaagcaggagagactgagccccgaggtggccccccccgcccacagaagacccgaccacagcggcggcagccccagcccccccaccagcgagcccgccagaagcggccacagaggcaacagagccagaggcgtgagcagaagcccccccaagaagaagaacaaggccagcggcagaagaagcaagagccccagaagcaagagaaacagaagcccccaccacagcaccgtgaaggtgaagcaggagagagaggaccaccccagaagaggcagagaggacagacagcacagagagcccagcgagcaggagcacagaagagccagaaacagcgacagagacagacacagaggccacagccaccagagaagaaccagcaacgagagacccggcagcggccagggccagggcagagacagagacacccagaacctgcaggcccaggaggaggagagagagttctacaacgccagaagaagagagcacagacagagaaacgacgtgggcggcggcggcagcgagagccaggagctggtgcccagacccggcggcaacaacaaggagaaggaggtgcccgccaaggagaagcccagcttcgagctgagcggcgccctgctggaggacaccaacaccttcagaggcgtggtgatcaagtacagcgagccccccgaggccagaatccccaagaagagatggagactgtaccccttcaagaacgacgaggtgctgcccgtgatgtacatccacagacagagcgcctacctgctgggcagacacagaagaatcgccgacatccccatcgaccaccccagctgcagcaagcagcacgccgtgttccagtacagactggtggagtacaccagagccgacggcaccgtgggcagaagagtgaagccctacatcatcgacctgggcagcggcaacggcaccttcctgaacaacaagagaatcgagccccagagatactacgagctgaaggagaaggacgtgctgaagttcggcttcagcagcagagagtacgtgctgctgcacgagagcagcgacaccagcgagatcgacagaaaggacgacgaggacgaggaggaggaggaggaggtgagcgacagctag

SEQ ID NO: 99165 - DNA, 2274 bp, Artificial Sequence
  Description of Artificial Sequence: Synthetic coding sequence
atgagcaaccccggcaccagaagaaacggcagcagcatcaagatcagactgaccgtgctgtgcgccaagaacctggccaagaaggacttcttcagactgcccgaccccttcgccaagatcgtggtggacggcagcggccagtgccacagcaccgacaccgtgaagaacaccctggaccccaagtggaaccagcactacgacctgtacgtgggcaagaccgacagcatcaccatcagcgtgtggaaccacaagaagatccacaagaagcagggcgccggcttcctgggctgcgtgagactgctgagcaacgccatcagcagactgaaggacaccggctaccagagactggacctgtgcaagctgaaccccagcgacaccgacgccgtgagaggccagatcgtggtgagcctgcagaccagagacagaatcggcaccggcggcagcgtggtggactgcagaggcctgctggagaacgagggcaccgtgtacgaggacagcggccccggcagacccctgagctgcttcatggaggagcccgccccctacaccgacagcaccggcgccgccgccggcggcggcaactgcagattcgtggagagccccagccaggaccagagactgcaggcccagagactgagaaaccccgacgtgagaggcagcctgcagaccccccagaacagaccccacggccaccagagccccgagctgcccgagggctacgagcagagaaccaccgtgcagggccaggtgtacttcctgcacacccagaccggcgtgagcacctggcacgaccccagaatccccagccccagcggcaccatccccggcggcgacgccgccttcctgtacgagttcctgctgcagggccacaccagcgagcccagagacctgaacagcgtgaactgcgacgagctgggccccctgccccccggctgggaggtgagaagcaccgtgagcggcagaatctacttcgtggaccacaacaacagaaccacccagttcaccgaccccagactgcaccacatcatgaaccaccagtgccagctgaaggagcccagccagcccctgcccctgcccagcgagggcagcctggaggacgaggagctgcccgcccagagatacgagagagacctggtgcagaagctgaaggtgctgagacacgagctgagcctgcagcagccccaggccggccactgcagaatcgaggtgagcagagaggagatcttcgaggagagctacagacagatcatgaagatgagacccaaggacctgaagaagagactgatggtgaagttcagaggcgaggagggcctggactacggcggcgtggccagagagtggctgtacctgctgtgccacgagatgctgaacccctactacggcctgttccagtacagcaccgacaacatctacatgctgcagatcaaccccgacagcagcatcaaccccgaccacctgagctacttccacttcgtgggcagaatcatgggcctggccgtgttccacggccactacatcaacggcggcttcaccgtgcccttctacaagcagctgctgggcaagcccatccagctgagcgacctggagagcgtggaccccgagctgcacaagagcctggtgtggatcctggagaacgacatcacccccgtgctggaccacaccttctgcgtggagcacaacgccttcggcagaatcctgcagcacgagctgaagcccaacggcagaaacgtgcccgtgaccgaggagaacaagaaggagtacgtgagactgtacgtgaactggagattcatgagaggcatcgaggcccagttcctggccctgcagaagggcttcaacgagctgatcccccagcacctgctgaagcccttcgaccagaaggagctggagctgatcatcggcggcctggacaagatcgacctgaacgactggaagagcaacaccagactgaagcactgcgtggccgacagcaacatcgtgagatggttctggcaggccgtggagaccttcgacgaggagagaagagccagactgctgcagttcgtgaccggcagcaccagagtgcccctgcagggcttcaaggccctgcagggcagcaccggcgccgccggccccagactgttcaccatccacctgatcgacgccaacaccgacaacctgcccaaggcccacacctgcttcaacagaatcgacatccccccctacgagagctacgagaagctgtacgagaagctgctgaccgccgtggaggagacctgcggcttcgccgtggagtag

SEQ ID NO: 99166 - DNA, 2196 bp, Artificial Sequence
  Description of Artificial Sequence: Synthetic coding sequence
atgagcaaccccggcaccagaagaaacggcagcagcatcaagatcagactgaccgtgctgtgcgccaagaacctggccaagaaggacttcttcagactgcccgaccccttcgccaagatcgtggtggacggcagcggccagtgccacagcaccgacaccgtgaagaacaccctggaccccaagtggaaccagcactacgacctgtacgtgggcaagaccgacagcatcaccatcagcgtgtggaaccacaagaagatccacaagaagcagggcgccggcttcctgggctgcgtgagactgctgagcaacgccatcagcagactgaaggacaccggctaccagagactggacctgtgcaagctgaaccccagcgacaccgacgccgtgagaggccagatcgtggtgagcctgcagaccagagacagaatcggcaccggcggcagcgtggtggactgcagaggcctgctggagaacgagggcaccgtgtacgaggacagcggccccggcagacccctgagctgcttcatggaggagcccgccccctacaccgacagcaccggcgccgccgccggcggcggcaactgcagattcgtggagagccccagccaggaccagagactgcaggcccagagactgagaaaccccgacgtgagaggcagcctgcagaccccccagaacagaccccacggccaccagagccccgagctgcccgagggctacgagcagagaaccaccgtgcagggccaggtgtacttcctgcacacccagaccggcgtgagcacctggcacgaccccagaatccccagagacctgaacagcgtgaactgcgacgagctgggccccctgccccccggctgggaggtgagaagcaccgtgagcggcagaatctacttcgtggaccacaacaacagaaccacccagttcaccgaccccagactgcaccacatcatgaaccaccagtgccagctgaaggagcccagccagcccctgcccctgcccagcgagggcagcctggaggacgaggagctgcccgcccagagatacgagagagacctggtgcagaagctgaaggtgctgagacacgagctgagcctgcagcagccccaggccggccactgcagaatcgaggtgagcagagaggagatcttcgaggagagctacagacagatcatgaagatgagacccaaggacctgaagaagagactgatggtgaagttcagaggcgaggagggcctggactacggcggcgtggccagagagtggctgtacctgctgtgccacgagatgctgaacccctactacggcctgttccagtacagcaccgacaacatctacatgctgcagatcaaccccgacagcagcatcaaccccgaccacctgagctacttccacttcgtgggcagaatcatgggcctggccgtgttccacggccactacatcaacggcggcttcaccgtgcccttctacaagcagctgctgggcaagcccatccagctgagcgacctggagagcgtggaccccgagctgcacaagagcctggtgtggatcctggagaacgacatcacccccgtgctggaccacaccttctgcgtggagcacaacgccttcggcagaatcctgcagcacgagctgaagcccaacggcagaaacgtgcccgtgaccgaggagaacaagaaggagtacgtgagactgtacgtgaactggagattcatgagaggcatcgaggcccagttcctggccctgcagaagggcttcaacgagctgatcccccagcacctgctgaagcccttcgaccagaaggagctggagctgatcatcggcggcctggacaagatcgacctgaacgactggaagagcaacaccagactgaagcactgcgtggccgacagcaacatcgtgagatggttctggcaggccgtggagaccttcgacgaggagagaagagccagactgctgcagttcgtgaccggcagcaccagagtgcccctgcagggcttcaaggccctgcagggcagcaccggcgccgccggccccagactgttcaccatccacctgatcgacgccaacaccgacaacctgcccaaggcccacacctgcttcaacagaatcgacatccccccctacgagagctacgagaagctgtacgagaagctgctgaccgccgtggaggagacctgcggcttcgccgtggagtag

SEQ ID NO: 99167 - DNA, 1323 bp, Artificial Sequence
  Description of Artificial Sequence: Synthetic coding sequence
atggccaccagaagctgcagagagaaggcccagaagctgaacgagcagcaccagctgatcctgagcaagctgctgagagaggaggacaacaagtactgcgccgactgcgaggccaagggccccagatgggccagctggaacatcggcgtgttcatctgcatcagatgcgccggcatccacagaaacctgggcgtgcacatcagcagagtgaagagcgtgaacctggaccagtggaccgccgagcagatccagtgcatgcaggacatgggcaacaccaaggccagactgctgtacgaggccaacctgcccgagaacttcagaagaccccagaccgaccaggccgtggagttcttcatcagagacaagtacgagaagaagaagtactacgacaagaacgccatcgccatcaccaacaaggagaaggagaagaagaaggaggagaagaagagagagaaggagcccgagaagcccgccaagcccctgaccgccgagaagctgcagaagaaggaccagcagctggagcccaagaagagcaccagccccaagaaggccgccgagcccaccgtggacctgctgggcctggacggccccgccgtggcccccgtgaccaacggcaacaccaccgtgccccccctgaacgacgacctggacatcttcggccccatgatcagcaaccccctgcccgccaccgtgatgccccccgcccagggcacccccagcgcccccgccgccgccaccctgagcaccgtgaccagcggcgacctggacctgttcaccgagcagaccaccaagagcgaggaggtggccaagaagcagctgagcaaggacagcatcctgagcctgtacggcaccggcaccatccagcagcagagcacccccggcgtgttcatgggccccaccaacatccccttcaccagccaggcccccgccgccttccagggcttccccagcatgggcgtgcccgtgcccgccgcccccggcctgatcggcaacgtgatgggccagagccccagcatgatggtgggcatgcccatgcccaacggcttcatgggcaacgcccagaccggcgtgatgcccctgccccagaacgtggtgggcccccagggcggcatggtgggccagatgggcgccccccagagcaagttcggcctgccccaggcccagcagccccagtggagcctgagccagatgaaccagcagatggccggcatgagcatcagcagcgccacccccaccgccggcttcggccagcccagcagcaccaccgccggctggagcggcagcagcagcggccagaccctgagcacccagctgtggaagtag

SEQ ID NO: 99168 - DNA, 489 bp, Artificial Sequence
  Description of Artificial Sequence: Synthetic coding sequence
atgggcaacaccaaggccagactgctgtacgaggccaacctgcccgagaacttcagaagaccccagaccgaccaggccgtggagttcttcatcagagacaagtacgagaagaagaagtactacgacaagaacgccatcgccatcaccaacatcagcagcagcgacgcccccctgcagcccctggtgagcagccccagcctgcaggccgccgtggacaagaacaagctggagaaggagaaggagaagaagaaggaggagaagaagagagagaaggagcccgagaagcccgccaagcccctgaccgccgagaagctgcagaagaaggaccagcagctggagcccaagaagagcaccagccccaagaaggccgccgagcccaccgtggacctgctgggcctggtgtggagaaagatcgagaaggagaagagcgagagacagctggtggaggtggaggagctgaccttcatgtactgcttccccaagaactag

SEQ ID NO: 99169 - DNA, 1311 bp, Artificial Sequence
  Description of Artificial Sequence: Synthetic coding sequence
atggccaccagaagctgcagagagaaggcccagaagctgaacgagcagcaccagctgatcctgagcaagctgctgagagaggaggacaacaagtactgcgccgactgcgaggccaagggccccagatgggccagctggaacatcggcgtgttcatctgcatcagatgcgccggcatccacagaaacctgggcgtgcacatcagcagagtgaagagcgtgaacctggaccagtggaccgccgagcagatccagtgcatgcaggacatgggcaacaccaaggccagactgctgtacgaggccaacctgcccgagaacttcagaagaccccagaccgaccaggccgtggagttcttcatcagagacaagtacgagaagaagaagtactacgacaagaacgccatcgccatcaccaacaaggagaaggagaagaagaaggaggagaagaagagagagaaggagcccgagaagcccgccaagcccctgaccgccgagaagctgcagaagaaggaccagcagctggagcccaagaagagcaccagccccaagaaggccgccgagcccaccgtggacctgctgggcctggacggccccgccgtggcccccgtgaccaacggcaacaccaccgtgccccccctgaacgacgacctggacatcttcggccccatgatcagcaaccccctgcccgccaccgtgatgccccccgcccagggcacccccagcgcccccgccgccgccaccctgagcaccgtgaccagcggcgacctggacctgttcaccgagcagaccaccaagagcgaggaggtggccaagaagcagctgagcaaggacagcatcctgagcctgtacggcaccggcaccatccagcagcagagcacccccggcgtgttcatgggccccaccaacatccccttcaccagccaggcccccgccgccttccagggcttccccagcatgggcgtgcccgtgcccgccgcccccggcctgatcggcaacgtgatgggccagagccccagcatgatggtgggcatgcccatgcccaacggcttcatgggcaacgcccagaccggcgtgatgcccctgccccagaacgtggtgggcccccagggcggcatggtgggccagatgggcgccccccagagcaagttcggcctgccccaggcccagcagccccagtggagcctgagccagatcatgcagaagggcgacgccgtgctgcagcacagcatcagcgccatctactggcccatgaccagatggctgaagtgccccctggtggacgagagcgccgacggctggcacgagtaccagtag

SEQ ID NO: 99170 - DNA, 1404 bp, Artificial Sequence
  Description of Artificial Sequence: Synthetic coding sequence
atggccaccagaagctgcagagagaaggcccagaagctgaacgagcagcaccagctgatcctgagcaagctgctgagagaggaggacaacaagtactgcgccgactgcgaggccaagggccccagatgggccagctggaacatcggcgtgttcatctgcatcagatgcgccggcatccacagaaacctgggcgtgcacatcagcagagtgaagagcgtgaacctggaccagtggaccgccgagcagatccagtgcatgcaggacatgggcaacaccaaggccagactgctgtacgaggccaacctgcccgagaacttcagaagaccccagaccgaccaggccgtggagttcttcatcagagacaagtacgagaagaagaagtactacgacaagaacgccatcgccatcaccaacatcagcagcagcgacgcccccctgcagcccctggtgagcagccccagcctgcaggccgccgtggacaagaacaagctggagaaggagaaggagaagaagaaggaggagaagaagagagagaaggagcccgagaagcccgccaagcccctgaccgccgagaagctgcagaagaaggaccagcagctggagcccaagaagagcaccagccccaagaaggccgccgagcccaccgtggacctgctgggcctggacggccccgccgtggcccccgtgaccaacggcaacaccaccgtgccccccctgaacgacgacctggacatcttcggccccatgatcagcaaccccctgcccgccaccgtgatgccccccgcccagggcacccccagcgcccccgccgccgccaccctgagcaccgtgaccagcggcgacctggacctgttcaccgagcagaccaccaagagcgaggaggtggccaagaagcagctgagcaaggacagcatcctgagcctgtacggcaccggcaccatccagcagcagagcacccccggcgtgttcatgggccccaccaacatccccttcaccagccaggcccccgccgccttccagggcttccccagcatgggcgtgcccgtgcccgccgcccccggcctgatcggcaacgtgatgggccagagccccagcatgatggtgggcatgcccatgcccaacggcttcatgggcaacgcccagaccggcgtgatgcccctgccccagaacgtggtgggcccccagggcggcatggtgggccagatgggcgccccccagagcaagttcggcctgccccaggcccagcagccccagtggagcctgagccagatgaaccagcagatggccggcatgagcatcagcagcgccacccccaccgccggcttcggccagcccagcagcaccaccgccggctggagcggcagcagcagcggccagaccctgagcacccagctgtggaagtag

SEQ ID NO: 99171 - DNA, 414 bp, Artificial Sequence
  Description of Artificial Sequence: Synthetic coding sequence
atggccaccagaagctgcagagagaaggcccagaagctgaacgagcagcaccagctgatcctgagcaagctgctgagagaggaggacaacaagtactgcgccgactgcgaggccaagggccccagatgggccagctggaacatcggcgtgttcatctgcatcagatgcgccggcatccacagaaacctgggcgtgcacatcagcagagtgaagagcgtgaacctggaccagtggaccgccgagcagatccagtgcatgcaggacatgggcaacaccaaggccagactgctgtacgaggccaacctgcccgagaacttcagaagaccccagaccgaccacgaggacatcatcctggagaccaccgccgtgatcaccctgctgctgaacaagtgcctgccctacgccaagccctag

SEQ ID NO: 99172 - DNA, 378 bp, Artificial Sequence
  Description of Artificial Sequence: Synthetic coding sequence
tgaaagtactacgacaagaacgccatcgccatcaccaacatcagcagcagcgacgcccccctgcagcccctggtgagcagccccagcctgcaggccgccgtggacaagaacaagctggagaaggagaaggagaagaagaaggaggagaagaagagagagaaggagcccgagaagcccgccaagcccctgaccgccgagaagctgcagaagaaggaccagcagctggagcccaagaagagcaccagccccaagaaggccgccgagcccaccgtggacctgctgggcctggtgtggagaaagatcgagaaggagaagagcgagagacagctggtggaggtggaggagctgaccttcatgtactgcttccccaagaactag

SEQ ID NO: 99173 - DNA, 189 bp, Artificial Sequence
  Description of Artificial Sequence: Synthetic coding sequence
atgctgttcctgaagctgagcgtgttcagagccgtggagttcttcatcagagacaagtacgagaagaagaagtactacgacaagaacgccatcgccatcaccaacatcagcagcagcgacgcccccctgcagcccctggtgagcagccccagcctgcaggccgccgtggacaagaacaagctggagtag

SEQ ID NO: 99174 - DNA, 1200 bp, Artificial Sequence
  Description of Artificial Sequence: Synthetic coding sequence
atgatcttcaagggccccagatgggccagctggaacatcggcgtgttcatctgcatcagatgcgccggcatccacagaaacctgggcgtgcacatcagcagagtgaagagcgtgaacctggaccagtggacccaggagcagatccagtgcatgcaggagatgggcaacggcaaggccaacagactgtacgaggcctacctgcccgagaccttcagaagaccccagatcgaccccgccgtggagggcttcatcagagacaagtacgagaagaagaagtacatggacagaagcctggacatcaacgccttcagaaaggagaaggacgacaagtggaagagaggcagcgagcccgtgcccgagaagaagctggagcccgtggtgttcgagaaggtgaagatgccccagaagaaggaggacccccagctgcccagaaagagcagccccaagagcaccgcccccgtgatggacctgctgggcctggacgcccccgtggcctgcagcatcgccaacagcaagaccagcaacaccctggagaaggacctggacctgctggccagcgtgcccagccccagcagcagcggcagcagaaaggtggtgggcagcatgcccaccgccggcagcgccggcagcgtgcccgagaacctgaacctgttccccgagcccggcagcaagagcgaggagatcggcaagaagcagctgagcaaggacagcatcctgagcctgtacggcagccagaccccccagatgcccacccaggccatgttcatggcccccgcccagatggcctaccccaccgcctaccccagcttccccggcgtgaccccccccaacagcatcatgggcagcatgatgcccccccccgtgggcatggtggcccagcccggcgccagcggcatggtggcccccatggccatgcccgccggctacatgggcggcatgcaggccagcatgatgggcgtgcccaacggcatgatgaccacccagcaggccggctacatggccggcatggccgccatgccccagaccgtgtacggcgtgcagcccgcccagcagctgcagtggaacctgacccagatgacccagcagatggccggcatgaacttctacggcgccaacggcatgatgaactacggccagagcatgagcggcggcaacggccaggccgccaaccagaccctgagcccccagatgtggaagtag

SEQ ID NO: 99175 - DNA, 1290 bp, Artificial Sequence
  Description of Artificial Sequence: Synthetic coding sequence
atgaccggcaagagcgtgaaggacgtggacagataccaggccgtgctggccaacctgctgctggaggaggacaacaagttctgcgccgactgccagagcaagggccccagatgggccagctggaacatcggcgtgttcatctgcatcagatgcgccggcatccacagaaacctgggcgtgcacatcagcagagtgaagagcgtgaacctggaccagtggacccaggagcagatccagtgcatgcaggagatgggcaacggcaaggccaacagactgtacgaggcctacctgcccgagaccttcagaagaccccagatcgaccccgccgtggagggcttcatcagagacaagtacgagaagaagaagtacatggacagaagcctggacatcaacgccttcagaaaggagaaggacgacaagtggaagagaggcagcgagcccgtgcccgagaagaagctggagcccgtggtgttcgagaaggtgaagatgccccagaagaaggaggacccccagctgcccagaaagagcagccccaagagcaccgcccccgtgatggacctgctgggcctggacgcccccgtggcctgcagcatcgccaacagcaagaccagcaacaccctggagaaggacctggacctgctggccagcgtgcccagccccagcagcagcggcagcagaaaggtggtgggcagcatgcccaccgccggcagcgccggcagcgtgcccgagaacctgaacctgttccccgagcccggcagcaagagcgaggagatcggcaagaagcagctgagcaaggacagcatcctgagcctgtacggcagccagaccccccagatgcccacccaggccatgttcatggcccccgcccagatggcctaccccaccgcctaccccagcttccccggcgtgaccccccccaacagcatcatgggcagcatgatgcccccccccgtgggcatggtggcccagcccggcgccagcggcatggtggcccccatggccatgcccgccggctacatgggcggcatgcaggccagcatgatgggcgtgcccaacggcatgatgaccacccagcaggccggctacatggccggcatggccgccatgccccagaccgtgtacggcgtgcagcccgcccagcagctgcagtggaacctgacccagatgacccagcagatggccggcatgaacttctacggcgccaacggcatgatgaactacggccagagcatgagcggcggcaacggccaggccgccaaccagaccctgagcccccagatgtggaagtag

SEQ ID NO: 99176 - DNA, 684 bp, Artificial Sequence
  Description of Artificial Sequence: Synthetic coding sequence
atgaccggcaagagcgtgaaggacgtggacagataccaggccgtgctggccaacctgctgctggaggaggacaacaagttctgcgccgactgccagagcaagggccccagatgggccagctggaacatcggcgtgttcatctgcatcagatgcgccggcatccacagaaacctgggcgtgcacatcagcagagtgaagagcgtgaacctggaccagtggacccaggagcagatccagtgcatgcaggagatgggcaacggcaaggccaacagactgtacgaggcctacctgcccgagaccttcagaagaccccagatcgaccccgccgtggagggcttcatcagagacaagtacgagaagaagaagtacatggacagaagcctggacatcaacgccttcagaaaggagaaggacgacaagtggaagagaggcagcgagcccgtgcccgagaagaagctggagcccgtggtgttcgagaaggtgaagatgccccagaagaaggaggacccccagctgcccagaaagagcagccccaagagcaccgcccccgtgatggacctgctgggcctggacgcccccgtggcctgcagcatcgccaacagcaagaccagcaacaccctggagaaggacctggacctgctggccagcgtgcccagccccagcagcagcggcagcagaaagtag

SEQ ID NO: 99177 - DNA, 1050 bp, Artificial Sequence
  Description of Artificial Sequence: Synthetic coding sequence
atgcaggagatgggcaacggcaaggccaacagactgtacgaggcctacctgcccgagaccttcagaagaccccagatcgaccccgccgtggagggcttcatcagagacaagtacgagaagaagaagtacatggacagaagcctggacatcaacgccttcagaaaggagaaggacgacaagtggaagagaggcagcgagcccgtgcccgagaagaagctggagcccgtggtgttcgagaaggtgaagatgccccagaagaaggaggacccccagctgcccagaaagagcagccccaagagcaccgcccccgtgatggacctgctgggcctggacgcccccgtggcctgcagcatcgccaacagcaagaccagcaacaccctggagaaggacctggacctgctggccagcgtgcccagccccagcagcagcggcagcagaaaggtggtgggcagcatgcccaccgccggcagcgccggcagcgtgcccgagaacctgaacctgttccccgagcccggcagcaagagcgaggagatcggcaagaagcagctgagcaaggacagcatcctgagcctgtacggcagccagaccccccagatgcccacccaggccatgttcatggcccccgcccagatggcctaccccaccgcctaccccagcttccccggcgtgaccccccccaacagcatcatgggcagcatgatgcccccccccgtgggcatggtggcccagcccggcgccagcggcatggtggcccccatggccatgcccgccggctacatgggcggcatgcaggccagcatgatgggcgtgcccaacggcatgatgaccacccagcaggccggctacatggccggcatggccgccatgccccagaccgtgtacggcgtgcagcccgcccagcagctgcagtggaacctgacccagatgacccagcagatggccggcatgaacttctacggcgccaacggcatgatgaactacggccagagcatgagcggcggcaacggccaggccgccaaccagaccctgagcccccagatgtggaagtag

SEQ ID NO: 99178 - DNA, 189 bp, Artificial Sequence
  Description of Artificial Sequence: Synthetic coding sequence
atggccagaggcaaccagagagagctggccagacagaagaacatgaagaagacccaggagatcagcaagggcaagagaaaggaggacagcctgaccgccagccagagaaagcagagagacagcgagatcatgcaggagaagcagaaggccgccaacgagaagaagagcatgcagaccagagagaagtag

SEQ ID NO: 99179 - DNA, 333 bp, Artificial Sequence
  Description of Artificial Sequence: Synthetic coding sequence
atggccagaggcaaccagagagagctggccagacagaagaacatgaagaagacccaggagatcagcaagggcaagagaaaggaggacagcctgaccgccagccagagaaagcagagcagcggcggccagaagagcgagagcaagatgagcgccggcccccacctgcccctgaaggcccccagagagaacccctgcttccccctgcccgccgccggcggcagcagatactacctggcctacggcagcatcacccccatcagcgccttcgtgttcgtggtgttcttcagcgtgttcttccccagcttctacgaggacttctgctgctggatctag

SEQ ID NO: 99180 - DNA, 147 bp, Artificial Sequence
  Description of Artificial Sequence: Synthetic coding sequence
atgaagaagacccaggagatcagcaagggcaagagaaaggaggacagcctgaccgccagccagagaaagcagagagacagcgagatcatgcaggagaagcagaaggccgccaacgagaagaagagcatgcagaccagagagaagtag

SEQ ID NO: 99181 - DNA, 63 bp, Artificial Sequence
  Description of Artificial Sequence: Synthetic coding sequence
atgaagaagacccaggagatcagcaagggcaagagaaaggaggacagcctgaccgccagctag

SEQ ID NO: 99182 - DNA, 291 bp, Artificial Sequence
  Description of Artificial Sequence: Synthetic coding sequence
atgaagaagacccaggagatcagcaagggcaagagaaaggaggacagcctgaccgccagccagagaaagcagagcagcggcggccagaagagcgagagcaagatgagcgccggcccccacctgcccctgaaggcccccagagagaacccctgcttccccctgcccgccgccggcggcagcagatactacctggcctacggcagcatcacccccatcagcgccttcgtgttcgtggtgttcttcagcgtgttcttccccagcttctacgaggacttctgctgctggatctag

SEQ ID NO: 99183 - DNA, 270 bp, Artificial Sequence
  Description of Artificial Sequence: Synthetic coding sequence
atgaagaagacccaggagatcagcaagggcaagagaaaggaggacagcctgaccgccagccagagaaagcagagcagcggcggccagaagagcgagagcaagatgagcgccggcccccacctgcccctgaaggcccccagagagaacccctgcttccccctgcccgccgccggcggcagcagatactacctggcctacggcagcatcacccccatcagcgccttcgtgttcgtggtgttcttcagcgtgttcttccccagcttctactag

SEQ ID NO: 99184 - DNA, 3156 bp, Artificial Sequence
  Description of Artificial Sequence: Synthetic coding sequence
atgggcagcgccgaggacgccgtgaaggagaagctgctgtggaacgtgaagaaggaggtgaagcagatcatggaggaggccgtgaccagaaagttcgtgcacgaggacagcagccacatcatcgccctgtgcggcgccgtggaggcctgcctgctgcaccagctgagaagaagagccgccggcttcctgagaagcgacaagatggccgccctgttcaccaaggtgggcaagacctgccccgtggccggcgagatctgccacaaggtgcaggagctgcagcagcaggccgagggcagaaagcccagcggcgtgagccaggaggccctgagaagacagggcagcgccagcggcaaggcccccgccctgagcccccaggccctgaagcacgtgtgggtgagaaccgccctgatcgagaaggtgctggacaaggtggtgcagtacctggccgagaactgcagcaagtactacgagaaggaggccctgctggccgaccccgtgttcggccccatcctggccagcctgctggtgggcccctgcgccctggagtacaccaagctgaagaccgccgaccactactggaccgaccccagcgccgacgagctggtgcagagacacagaatcagaggcccccccaccagacaggacagccccgccaagagacccgccctgggcatcagaaagagacacagcagcggcagcgccagcgaggacagactggccgcctgcgccagagagtgcgtggagagcctgcaccagaacagcagaaccagactgctgtacggcaagaaccacgtgctggtgcagcccaaggaggacatggaggccgtgcccggctacctgagcctgcaccagagcgccgagagcctgaccctgaagtggacccccaaccagctgatgaacggcaccctgggcgacagcgagctggagaagagcgtgtactgggactacgccctggtggtgcccttcagccaggtggtgtgcatccactgccaccagcagaagagcggcggcaccctggtgctggtgagccaggacggcatccagagaccccccctgcacttcccccagggcggccacctgctgagcttcctgagctgcctggagaacggcctgctgcccagaggccagctggagccccccctgtggacccagcagggcaagggcaaggtgttccccaagctgagaaagagaagcagcatcagaagcgtggacatggaggagatgggcaccggcagagccaccgactacgtgttcagaatcatctaccccggccacagacacgagcacatcaccatcaactaccaccacctggccgccagcagagccgccagcgtggacgacgacgaggaggaggaggacaagctgcacgccatgctgagcatgatctgcagcagaaacctgaccgcccccaaccccatgaaggacgccggcgacatgatcgagatgcagggcttcggccccagcctgcccgcctggcacctggagcccctgtgcagccagggcagcagctgcctgagctgcagcagcagcagcagcccccacgccacccccagccactgcagctgcatccccgacagactgcccctgagactgctgtgcgagagcatgaagagacagatcgtgagcagagccttctacggctggctggcccactgcagacacctgagcaccgtgagaacccacctgagcgccctggtgcaccacagcgtgatcccccccgacagaccccccggcgccagcgccggcctgaccaaggacgtgtggagcaagtaccagaaggacaagaagaactacaaggagctggagctgctgagacaggtgtactacggcggcatcgagcacgagatcagaaaggacgtgtggcccttcctgctgggccactacaagttcggcatgagcaagaaggagatggagcaggtggacgccgtggtggccgccagataccagcaggtgctggccgagtggaaggcctgcgaggtggtggtgagacagagagagagagaggcccaccccgccaccagaaccaagttcagcagcggcagcagcatcgacagccacgtgcagagactgatccacagagacagcaccatcagcaacgacgtgttcatcagcgtggacgacctggagccccccgagccccaggaccccgaggacagcagacccaagcccgagcaggaggccggccccggcacccccggcaccgccgtggtggagcagcagcacagcgtggagttcgacagccccgacagcggcctgcccagcagcagaaactacagcgtggccagcggcatccagagcagcctggacgagggccagagcgtgggcttcgaggaggaggacggcggcggcgaggagggcagcagcggccccggccccgccgcccacaccctgagagagccccaggaccccagccaggagaagccccaggccggcgagctggaggccggcgaggagctggccgccgtgtgcgccgccgcctacaccatcgagctgctggacaccgtggccctgaacctgcacagaatcgacaaggacgtgcagagatgcgacagaaactactggtacttcaccccccccaacctggagagactgagagacgtgatgtgcagctacgtgtgggagcacctggacgtgggctacgtgcagggcatgtgcgacctgctggcccccctgctggtgaccctggacaacgaccagctggcctacagctgcttcagccacctgatgaagagaatgagccagaacttccccaacggcggcgccatggacacccacttcgccaacatgagaagcctgatccagatcctggacagcgagctgttcgagctgatgcaccagaacggcgactacacccacttctacttctgctacagatggttcctgctggacttcaagagagagctgctgtacgaggacgtgttcgccgtgtgggaggtgatctgggccgccagacacatcagcagcgagcacttcgtgctgttcatcgccctggccctggtggaggcctacagagagatcatcagagacaacaacatggacttcaccgacatcatcaagttcttcaacgagagagccgagcaccacgacgcccaggagatcctgagaatcgccagagacctggtgcacaaggtgcagatgctgatcgagaacaagtag

SEQ ID NO: 99185 - DNA, 3021 bp, Artificial Sequence
  Description of Artificial Sequence: Synthetic coding sequence
atgggcagcgccgaggacgccgtgaaggagaagctgctgtggaacgtgaagaaggaggtgaagcagatcatggaggaggccgtgaccagaaagttcgtgcacgaggacagcagccacatcatcgccctgtgcggcgccgtggaggcctgcctgctgcaccagctgagaagaagagccgccggcttcctgagaagcgacaagatggccgccctgttcaccaaggtgggcaagacctgccccgtggccggcgagatctgccacaaggtgcaggagctgcagcagcaggccgagggcagaaagcccagcggcgtgagccaggaggccctgagaagacagggcagcgccagcggcaaggcccccgccctgagcccccaggccctgaagcacgtgtgggtgagaaccgccctgatcgagaaggtgctggacaaggtggtgcagtacctggccgagaactgcagcaagtactacgagaaggaggccctgctggccgaccccgtgttcggccccatcctggccagcctgctggtgggcccctgcgccctggagtacaccaagctgaagaccgccgaccactactggaccgaccccagcgccgacgagctggtgcagagacacagaatcagaggcccccccaccagacaggacagccccgccaagagacccgccctgggcatcagaaagagacacagcagcggcagcgccagcgaggacagactggccgcctgcgccagagagtgcgtggagagcctgcaccagaacagcagaaccagactgctgtacggcaagaaccacgtgctggtgcagcccaaggaggacatggaggccgtgcccggctacctgagcctgcaccagagcgccgagagcctgaccctgaagtggacccccaaccagctgatgaacggcaccctgggcgacagcgagctggagaagagcgtgtactgggactacgccctggtggtgcccttcagccaggtggtgtgcatccactgccaccagcagaagagcggcggcaccctggtgctggtgagccaggacggcatccagagaccccccctgcacttcccccagggcggccacctgctgagcttcctgagctgcctggagaacggcctgctgcccagaggccagctggagccccccctgtggacccagcagggcaagggcaaggtgttccccaagctgagaaagagaagcagcatcagaagcgtggacatggaggagatgggcaccggcagagccaccgactacgtgttcagaatcatctaccccggccacagacacgagcacaacgccggcgacatgatcgagatgcagggcttcggccccagcctgcccgcctggcacctggagcccctgtgcagccagggcagcagctgcctgagctgcagcagcagcagcagcccccacgccacccccagccactgcagctgcatccccgacagactgcccctgagactgctgtgcgagagcatgaagagacagatcgtgagcagagccttctacggctggctggcccactgcagacacctgagcaccgtgagaacccacctgagcgccctggtgcaccacagcgtgatcccccccgacagaccccccggcgccagcgccggcctgaccaaggacgtgtggagcaagtaccagaaggacaagaagaactacaaggagctggagctgctgagacaggtgtactacggcggcatcgagcacgagatcagaaaggacgtgtggcccttcctgctgggccactacaagttcggcatgagcaagaaggagatggagcaggtggacgccgtggtggccgccagataccagcaggtgctggccgagtggaaggcctgcgaggtggtggtgagacagagagagagagaggcccaccccgccaccagaaccaagttcagcagcggcagcagcatcgacagccacgtgcagagactgatccacagagacagcaccatcagcaacgacgtgttcatcagcgtggacgacctggagccccccgagccccaggaccccgaggacagcagacccaagcccgagcaggaggccggccccggcacccccggcaccgccgtggtggagcagcagcacagcgtggagttcgacagccccgacagcggcctgcccagcagcagaaactacagcgtggccagcggcatccagagcagcctggacgagggccagagcgtgggcttcgaggaggaggacggcggcggcgaggagggcagcagcggccccggccccgccgcccacaccctgagagagccccaggaccccagccaggagaagccccaggccggcgagctggaggccggcgaggagctggccgccgtgtgcgccgccgcctacaccatcgagctgctggacaccgtggccctgaacctgcacagaatcgacaaggacgtgcagagatgcgacagaaactactggtacttcaccccccccaacctggagagactgagagacgtgatgtgcagctacgtgtgggagcacctggacgtgggctacgtgcagggcatgtgcgacctgctggcccccctgctggtgaccctggacaacgaccagctggcctacagctgcttcagccacctgatgaagagaatgagccagaacttccccaacggcggcgccatggacacccacttcgccaacatgagaagcctgatccagatcctggacagcgagctgttcgagctgatgcaccagaacggcgactacacccacttctacttctgctacagatggttcctgctggacttcaagagagagctgctgtacgaggacgtgttcgccgtgtgggaggtgatctgggccgccagacacatcagcagcgagcacttcgtgctgttcatcgccctggccctggtggaggcctacagagagatcatcagagacaacaacatggacttcaccgacatcatcaagttcttcaacgagagagccgagcaccacgacgcccaggagatcctgagaatcgccagagacctggtgcacaaggtgcagatgctgatcgagaacaagtag

SEQ ID NO: 99186 - DNA, 795 bp, Artificial Sequence
  Description of Artificial Sequence: Synthetic coding sequence
atgtgccacaagaacggcttcccccaggagggcggcatcaccgccgccttcctgcagaagagaaagctgagactgagcaagaaccacagacccgccagagccaaggtgaccgagcacgtgagaggcaccagacccggcagagccaccgccggccccgccgccagcaccagagccgccggcagcctgttcttcgacagatggggcaacagaggccccgccggctgcagaggcagcagccacctgccccagcagctgaagttcaccaccagcgacagctgcgacagaatcaaggacgagttccagctgctgcaggcccagtaccacagcctgaagctggagtgcgacaagctggccagcgagaagagcgagatgcagagacactacgtgatgtactacgagatgagctacggcctgaacatcgagatgcacaagcaggccgagatcgtgaagagactgaacggcatctgcgcccaggtgctgccctacctgagccaggagcaccagcagcaggtgctgggcgccatcgagagagccaagcaggtgaccgcccccgagctgaacagcatcatcagacagcagctgcaggcccaccagctgagccagctgcaggccctggccctgcccctgacccccctgcccgtgggcctgcagccccccagcctgcccgccgtgagcgccggcaccggcctgctgagcctgagcgccctgggcagccaggcccacctgagcaaggaggacaagaacggccacgacggcgacacccaccaggaggacgacggcgagaagagcgactag

SEQ ID NO: 99187 - DNA, 267 bp, Artificial Sequence
  Description of Artificial Sequence: Synthetic coding sequence
atgaacatgagcaagcagcccgtgagcaacgtgagagccatccaggccaacatcaacatccccatgggcgccttcagacccggcgccggccagccccccagaagaaaggagtgcacccccgaggtggaggagggcgtgccccccaccagcgacgaggagaagaagcccatccccggcgccaagaagctgcccggccccgccgtgaacctgagcgagatccagaacatcaagagcgagctgaagtacgtgcccaaggccgagcagtag

SEQ ID NO: 99188 - DNA, 6411 bp, Artificial Sequence
  Description of Artificial Sequence: Synthetic coding sequence
atggccgacgtgaccgccagaagcctgcagtacgagtacaaggccaacagcaacctggtgctgcaggccgacagaagcctgatcgacagaaccagaagagacgagcccaccggcgaggtgctgagcctggtgggcaagctggagggcaccagaatgggcgacaaggcccagagaaccaagccccagatgcaggaggagagaagagccaagagaagaaagagagacgaggacagacacgacatcaacaagatgaagggctacaccctgctgagcgagggcatcgacgagatggtgggcatcatctacaagcccaagaccaaggagaccagagagacctacgaggtgctgctgagcttcatccaggccgccctgggcgaccagcccagagacatcctgtgcggcgccgccgacgaggtgctggccgtgctgaagaacgagaagctgagagacaaggagagaagaaaggagatcgacctgctgctgggccagaccgacgacaccagataccacgtgctggtgaacctgggcaagaagatcaccgactacggcggcgacaaggagatccagaacatggacgacaacatcgacgagacctacggcgtgaacgtgcagttcgagagcgacgaggaggagggcgacgaggacgtgtacggcgaggtgagagaggaggccagcgacgacgacatggagggcgacgaggccgtggtgagatgcaccctgagcgccaacctggtggccagcggcgagctgatgagcagcaagaagaaggacctgcaccccagagacatcgacgccttctggctgcagagacagctgagcagattctacgacgacgccatcgtgagccagaagaaggccgacgaggtgctggagatcctgaagaccgccagcgacgacagagagtgcgagaaccagctggtgctgctgctgggcttcaacaccttcgacttcatcaaggtgctgagacagcacagaatgatgatcctgtactgcaccctgctggccagcgcccagagcgaggccgagaaggagagaatcatgggcaagatggaggccgaccccgagctgagcaagttcctgtaccagctgcacgagaccgagaaggaggacctgatcagagaggagagaagcagaagagagagagtgagacagagcagaatggacaccgacctggagaccatggacctggaccagggcggcgaggccctggcccccagacaggtgctggacctggaggacctggtgttcacccagggcagccacttcatggccaacaagagatgccagctgcccgacggcagcttcagaagacagagaaagggctacgaggaggtgcacgtgcccgccctgaagcccaagcccttcggcagcgaggagcagctgctgcccgtggagaagctgcccaagtacgcccaggccggcttcgagggcttcaagaccctgaacagaatccagagcaagctgtacagagccgccctggagaccgacgagaacctgctgctgtgcgcccccaccggcgccggcaagaccaacgtggccctgatgtgcatgctgagagagatcggcaagcacatcaacatggacggcaccatcaacgtggacgacttcaagatcatctacatcgcccccatgagaagcctggtgcaggagatggtgggcagcttcggcaagagactggccacctacggcatcaccgtggccgagctgaccggcgaccaccagctgtgcaaggaggagatcagcgccacccagatcatcgtgtgcacccccgagaagtgggacatcatcaccagaaagggcggcgagagaacctacacccagctggtgagactgatcatcctggacgagatccacctgctgcacgacgacagaggccccgtgctggaggccctggtggccagagccatcagaaacatcgagatgacccaggaggacgtgagactgatcggcctgagcgccaccctgcccaactacgaggacgtggccaccttcctgagagtggaccccgccaagggcctgttctacttcgacaacagcttcagacccgtgcccctggagcagacctacgtgggcatcaccgagaagaaggccatcaagagattccagatcatgaacgagatcgtgtacgagaagatcatggagcacgccggcaagaaccaggtgctggtgttcgtgcacagcagaaaggagaccggcaagaccgccagagccatcagagacatgtgcctggagaaggacaccctgggcctgttcctgagagagggcagcgccagcaccgaggtgctgagaaccgaggccgagcagtgcaagaacctggagctgaaggacctgctgccctacggcttcgccatccaccacgccggcatgaccagagtggacagaaccctggtggaggacctgttcgccgacaagcacatccaggtgctggtgagcaccgccaccctggcctggggcgtgaacctgcccgcccacaccgtgatcatcaagggcacccaggtgtacagccccgagaagggcagatggaccgagctgggcgccctggacatcctgcagatgctgggcagagccggcagaccccagtacgacaccaagggcgagggcatcctgatcaccagccacggcgagctgcagtactacctgagcctgctgaaccagcagctgcccatcgagagccagatggtgagcaagctgcccgacatgctgaacgccgagatcgtgctgggcaacgtgcagaacgccaaggacgccgtgaactggctgggctacgcctacctgtacatcagaatgctgagaagccccaccctgtacggcatcagccacgacgacctgaagggcgaccccctgctggaccagagaagactggacctggtgcacaccgccgccctgatgctggacaagaacaacctggtgaagtacgacaagaagaccggcaacttccaggtgaccgagctgggcagaatcgccagccactactacatcaccaacgacaccgtgcagacctacaaccagctgctgaagcccaccctgagcgagatcgagctgttcagagtgttcagcctgagcagcgagttcaagaacatcaccgtgagagaggaggagaagctggagctgcagaagctgctggagagagtgcccatccccgtgaaggagagcatcgaggagcccagcgccaagatcaacgtgctgctgcaggccttcatcagccagctgaagctggagggcttcgccctgatggccgacatggtgtacgtgacccagagcgccggcagactgatgagagccatcttcgagatcgtgctgaacagaggctgggcccagctgaccgacaagaccctgaacctgtgcaagatgatcgacaagagaatgtggcagagcatgtgccccctgagacagttcagaaagctgcccgaggaggtggtgaagaagatcgagaagaagaacttccccttcgagagactgtacgacctgaaccacaacgagatcggcgagctgatcagaatgcccaagatgggcaagaccatccacaagtacgtgcacctgttccccaagctggagctgagcgtgcacctgcagcccatcaccagaagcaccctgaaggtggagctgaccatcacccccgacttccagtgggacgagaaggtgcacggcagcagcgaggccttctggatcctggtggaggacgtggacagcgaggtgatcctgcaccacgagtacttcctgctgaaggccaagtacgcccaggacgagcacctgatcaccttcttcgtgcccgtgttcgagcccctgcccccccagtacttcatcagagtggtgagcgacagatggctgagctgcgagacccagctgcccgtgagcttcagacacctgatcctgcccgagaagtaccccccccccaccgagctgctggacctgcagcccctgcccgtgagcgccctgagaaacagcgccttcgagagcctgtaccaggacaagttccccttcttcaaccccatccagacccaggtgttcaacaccgtgtacaacagcgacgacaacgtgttcgtgggcgcccccaccggcagcggcaagaccatctgcgccgagttcgccatcctgagaatgctgctgcagagcagcgagggcagatgcgtgtacatcacccccatggaggccctggccgagcaggtgtacatggactggtacgagaagttccaggacagactgaacaagaaggtggtgctgctgaccggcgagaccagcaccgacctgaagctgctgggcaagggcaacatcatcatcagcacccccgagaagtgggacatcctgagcagaagatggaagcagagaaagaacgtgcagaacatcaacctgttcgtggtggacgaggtgcacctgatcggcggcgagaacggccccgtgctggaggtgatctgcagcagaatgagatacatcagcagccagatcgagagacccatcagaatcgtggccctgagcagcagcctgagcaacgccaaggacgtggcccactggctgggctgcagcgccaccagcaccttcaacttccaccccaacgtgagacccgtgcccctggagctgcacatccagggcttcaacatcagccacacccagaccagactgctgagcatggccaagcccgtgtaccacgccatcaccaagcacagccccaagaagcccgtgatcgtgttcgtgcccagcagaaagcagaccagactgaccgccatcgacatcctgaccacctgcgccgccgacatccagagacagagattcctgcactgcaccgagaaggacctgatcccctacctggagaagctgagcgacagcaccctgaaggagaccctgctgaacggcgtgggctacctgcacgagggcctgagccccatggagagaagactggtggagcagctgttcagcagcggcgccatccaggtggtggtggccagcagaagcctgtgctggggcatgaacgtggccgcccacctggtgatcatcatggacacccagtactacaacggcaagatccacgcctacgtggactaccccatctacgacgtgctgcagatggtgggccacgccaacagacccctgcaggacgacgagggcagatgcgtgatcatgtgccagggcagcaagaaggacttcttcaagaagttcctgtacgagcccctgcccgtggagagccacctggaccactgcatgcacgaccacttcaacgccgagatcgtgaccaagaccatcgagaacaagcaggacgccgtggactacctgacctggaccttcctgtacagaagaatgacccagaaccccaactactacaacctgcagggcatcagccacagacacctgagcgaccacctgagcgagctggtggagcagaccctgagcgacctggagcagagcaagtgcatcagcatcgaggacgagatggacgtggcccccctgaacctgggcatgatcgccgcctactactacatcaactacaccaccatcgagctgttcagcatgagcctgaacgccaagaccaaggtgagaggcctgatcgagatcatcagcaacgccgccgagtacgagaacatccccatcagacaccacgaggacaacctgctgagacagctggcccagaaggtgccccacaagctgaacaaccccaagttcaacgacccccacgtgaagaccaacctgctgctgcaggcccacctgagcagaatgcagctgagcgccgagctgcagagcgacaccgaggagatcctgagcaaggccatcagactgatccaggcctgcgtggacgtgctgagcagcaacggctggctgagccccgccctggccgccatggagctggcccagatggtgacccaggccatgtggagcaaggacagctacctgaagcagctgccccacttcaccagcgagcacatcaagagatgcaccgacaagggcgtggagagcgtgttcgacatcatggagatggaggacgaggagagaaacgccctgctgcagctgaccgacagccagatcgccgacgtggccagattctgcaacagataccccaacatcgagctgagctacgaggtggtggacaaggacagcatcagaagcggcggccccgtggtggtgctggtgcagctggagagagaggaggaggtgaccggccccgtgatcgcccccctgttcccccagaagagagaggagggctggtgggtggtgatcggcgacgccaagagcaacagcctgatcagcatcaagagactgaccctgcagcagaaggccaaggtgaagctggacttcgtggcccccgccaccggcgcccacaactacaccctgtacttcatgagcgacgcctacatgggctgcgaccaggagtacaagttcagcgtggacgtgaaggaggccgagaccgacagcgacagcgactag

SEQ ID NO: 99189 - DNA, 1878 bp, Artificial Sequence
  Description of Artificial Sequence: Synthetic coding sequence
atggccgacgtgaccgccagaagcctgcagtacgagtacaaggccaacagcaacctggtgctgcaggccgacagaagcctgatcgacagaaccagaagagacgagcccaccggcgaggtgctgagcctggtgggcaagctggagggcaccagaatgggcgacaaggcccagagaaccaagccccagatgcaggaggagagaagagccaagagaagaaagagagacgaggacagacacgacatcaacaagatgaagggctacaccctgctgagcgagggcatcgacgagatggtgggcatcatctacaagcccaagaccaaggagaccagagagacctacgaggtgctgctgagcttcatccaggccgccctgggcgaccagcccagagacatcctgtgcggcgccgccgacgaggtgctggccgtgctgaagaacgagaagctgagagacaaggagagaagaaaggagatcgacctgctgctgggccagaccgacgacaccagataccacgtgctggtgaacctgggcaagaagatcaccgactacggcggcgacaaggagatccagaacatggacgacaacatcgacgagacctacggcgtgaacgtgcagttcgagagcgacgaggaggagggcgacgaggacgtgtacggcgaggtgagagaggaggccagcgacgacgacatggagggcgacgaggccgtggtgagatgcaccctgagcgccaacctggtggccagcggcgagctgatgagcagcaagaagaaggacctgcaccccagagacatcgacgccttctggctgcagagacagctgagcagattctacgacgacgccatcgtgagccagaagaaggccgacgaggtgctggagatcctgaagaccgccagcgacgacagagagtgcgagaaccagctggtgctgctgctgggcttcaacaccttcgacttcatcaaggtgctgagacagcacagaatgatgatcctgtactgcaccctgctggccagcgcccagagcgaggccgagaaggagagaatcatgggcaagatggaggccgaccccgagctgagcaagttcctgtaccagctgcacgagaccgagaaggaggacctgatcagagaggagagaagcagaagagagagagtgagacagagcagaatggacaccgacctggagaccatggacctggaccagggcggcgaggccctggcccccagacaggtgctggacctggaggacctggtgttcacccagggcagccacttcatggccaacaagagatgccagctgcccgacggcagcttcagaagacagagaaagggctacgaggaggtgcacgtgcccgccctgaagcccaagcccttcggcagcgaggagcagctgctgcccgtggagaagctgcccaagtacgcccaggccggcttcgagggcttcaagaccctgaacagaatccagagcaagctgtacagagccgccctggagaccgacgagaacctgctgctgtgcgcccccaccggcgccggcaagaccaacgtggccctgatgtgcatgctgagagagatcggcaagcacatcaacatggacggcaccatcaacgtggacgacttcaagatcatctacatcgcccccatgagaagcctggtgcaggagatggtgggcagcttcggcaagagagacgccaagagcaacagcctgatcagcatcaagagactgaccctgcagcagaaggccaaggtgaagctggacttcgtggcccccgccaccggcgcccacaactacaccctgtacttcatgagcgacgcctacatgggctgcgaccaggagtacaagttcagcgtggacgtgaaggaggccgagaccgacagcgacagcgactag

SEQ ID NO: 99190 - DNA, 1788 bp, Artificial Sequence
  Description of Artificial Sequence: Synthetic coding sequence
atgagatacatcagcagccagatcgagagacccatcagaatcgtggccctgagcagcagcctgagcaacgccaaggacgtggcccactggctgggctgcagcgccaccagcaccttcaacttccaccccaacgtgagacccgtgcccctggagctgcacatccagggcttcaacatcagccacacccagaccagactgctgagcatggccaagcccgtgtaccacgccatcaccaagcacagccccaagaagcccgtgatcgtgttcgtgcccagcagaaagcagaccagactgaccgccatcgacatcctgaccacctgcgccgccgacatccagagacagagattcctgcactgcaccgagaaggacctgatcccctacctggagaagctgagcgacagcaccctgaaggagaccctgctgaacggcgtgggctacctgcacgagggcctgagccccatggagagaagactggtggagcagctgttcagcagcggcgccatccaggtggtggtggccagcagaagcctgtgctggggcatgaacgtggccgcccacctggtgatcatcatggacacccagtactacaacggcaagatccacgcctacgtggactaccccatctacgacgtgctgcagatggtgggccacgccaacagacccctgcaggacgacgagggcagatgcgtgatcatgtgccagggcagcaagaaggacttcttcaagaagttcctgtacgagcccctgcccgtggagagccacctggaccactgcatgcacgaccacttcaacgccgagatcgtgaccaagaccatcgagaacaagcaggacgccgtggactacctgacctggaccttcctgtacagaagaatgacccagaaccccaactactacaacctgcagggcatcagccacagacacctgagcgaccacctgagcgagctggtggagcagaccctgagcgacctggagcagagcaagtgcatcagcatcgaggacgagatggacgtggcccccctgaacctgggcatgatcgccgcctactactacatcaactacaccaccatcgagctgttcagcatgagcctgaacgccaagaccaaggtgagaggcctgatcgagatcatcagcaacgccgccgagtacgagaacatccccatcagacaccacgaggacaacctgctgagacagctggcccagaaggtgccccacaagctgaacaaccccaagttcaacgacccccacgtgaagaccaacctgctgctgcaggcccacctgagcagaatgcagctgagcgccgagctgcagagcgacaccgaggagatcctgagcaaggccatcagactgatccaggcctgcgtggacgtgctgagcagcaacggctggctgagccccgccctggccgccatggagctggcccagatggtgacccaggccatgtggagcaaggacagctacctgaagcagctgccccacttcaccagcgagcacatcaagagatgcaccgacaagggcgtggagagcgtgttcgacatcatggagatggaggacgaggagagaaacgccctgctgcagctgaccgacagccagatcgccgacgtggccagattctgcaacagataccccaacatcgagctgagctacgaggtggtggacaaggacagcatcagaagcggcggccccgtggtggtgctggtgcagctggagagagaggaggaggtgaccggccccgtgatcgcccccctgttcccccagttcagagccggcagaagcggcagcagactgtag

SEQ ID NO: 99191 - DNA, 1788 bp, Artificial Sequence
  Description of Artificial Sequence: Synthetic coding sequence
atggccaagcccgtgtaccacgccatcaccaagcacagccccaagaagcccgtgatcgtgttcgtgcccagcagaaagcagaccagactgaccgccatcgacatcctgaccacctgcgccgccgacatccagagacagagattcctgcactgcaccgagaaggacctgatcccctacctggagaagctgagcgacagcaccctgaaggagaccctgctgaacggcgtgggctacctgcacgagggcctgagccccatggagagaagactggtggagcagctgttcagcagcggcgccatccaggtggtggtggccagcagaagcctgtgctggggcatgaacgtggccgcccacctggtgatcatcatggacacccagtactacaacggcaagatccacgcctacgtggactaccccatctacgacgtgctgcagatggtgggccacgccaacagacccctgcaggacgacgagggcagatgcgtgatcatgtgccagggcagcaagaaggacttcttcaagaagttcctgtacgagcccctgcccgtggagagccacctggaccactgcatgcacgaccacttcaacgccgagatcgtgaccaagaccatcgagaacaagcaggacgccgtggactacctgacctggaccttcctgtacagaagaatgacccagaaccccaactactacaacctgcagggcatcagccacagacacctgagcgaccacctgagcgagctggtggagcagaccctgagcgacctggagcagagcaagtgcatcagcatcgaggacgagatggacgtggcccccctgaacctgggcatgatcgccgcctactactacatcaactacaccaccatcgagctgttcagcatgagcctgaacgccaagaccaaggtgagaggcctgatcgagatcatcagcaacgccgccgagtacgagaacatccccatcagacaccacgaggacaacctgctgagacagctggcccagaaggtgccccacaagctgaacaaccccaagttcaacgacccccacgtgaagaccaacctgctgctgcaggcccacctgagcagaatgcagctgagcgccgagctgcagagcgacaccgaggagatcctgagcaaggccatcagactgatccaggcctgcgtggacgtgctgagcagcaacggctggctgagccccgccctggccgccatggagctggcccagatggtgacccaggccatgtggagcaaggacagctacctgaagcagctgccccacttcaccagcgagcacatcaagagatgcaccgacaagggcgtggagagcgtgttcgacatcatggagatggaggacgaggagagaaacgccctgctgcagctgaccgacagccagatcgccgacgtggccagattctgcaacagataccccaacatcgagctgagctacgaggtggtggacaaggacagcatcagaagcggcggccccgtggtggtgctggtgcagctggagagagaggaggaggtgaccggccccgtgatcgcccccctgttcccccagaagagagaggagggctggtgggtggtgatcggcgacgccaagagcaacagcctgatcagcatcaagagactgaccctgcagcagaaggccaaggtgaagctggacttcgtggcccccgccaccggcgcccacaactacaccctgtacttcatgagcgacgcctacatgggctgcgaccaggagtacaagttcagcgtggacgtgaaggaggccgagaccgacagcgacagcgactag

SEQ ID NO: 99192 - DNA, 2325 bp, Artificial Sequence
  Description of Artificial Sequence: Synthetic coding sequence
atgatgatcctgtactgcaccctgctggccagcgcccagagcgaggccgagaaggagagaatcatgggcaagatggaggccgaccccgagctgagcaagttcctgtaccagctgcacgagaccgagaaggaggacctgatcagagaggagagaagcagaagagagagagtgagacagagcagaatggacaccgacctggagaccatggacctggaccagggcggcgaggccctggcccccagacaggtgctggacctggaggacctggtgttcacccagggcagccacttcatggccaacaagagatgccagctgcccgacggcagcttcagaagacagagaaagggctacgaggaggtgcacgtgcccgccctgaagcccaagcccttcggcagcgaggagcagctgctgcccgtggagaagctgcccaagtacgcccaggccggcttcgagggcttcaagaccctgaacagaatccagagcaagctgtacagagccgccctggagaccgacgagaacctgctgctgtgcgcccccaccggcgccggcaagaccaacgtggccctgatgtgcatgctgagagagatcggcaagcacatcaacatggacggcaccatcaacgtggacgacttcaagatcatctacatcgcccccatgagaagcctggtgcaggagatggtgggcagcttcggcaagagactggccacctacggcatcaccgtggccgagctgaccggcgaccaccagctgtgcaaggaggagatcagcgccacccagatcatcgtgtgcacccccgagaagtgggacatcatcaccagaaagggcggcgagagaacctacacccagctggtgagactgatcatcctggacgagatccacctgctgcacgacgacagaggccccgtgctggaggccctggtggccagagccatcagaaacatcgagatgacccaggaggacgtgagactgatcggcctgagcgccaccctgcccaactacgaggacgtggccaccttcctgagagtggaccccgccaagggcctgttctacttcgacaacagcttcagacccgtgcccctggagcagacctacgtgggcatcaccgagaagaaggccatcaagagattccagatcatgaacgagatcgtgtacgagaagatcatggagcacgccggcaagaaccaggtgctggtgttcgtgcacagcagaaaggagaccggcaagaccgccagagccatcagagacatgtgcctggagaaggacaccctgggcctgttcctgagagagggcagcgccagcaccgaggtgctgagaaccgaggccgagcagtgcaagaacctggagctgaaggacctgctgccctacggcttcgccatccaccacgccggcatgaccagagtggacagaaccctggtggaggacctgttcgccgacaagcacatccaggtgctggtgagcaccgccaccctggcctggggcgtgaacctgcccgcccacaccgtgatcatcaagggcacccaggtgtacagccccgagaagggcagatggaccgagctgggcgccctggacatcctgcagatgctgggcagagccggcagaccccagtacgacaccaagggcgagggcatcctgatcaccagccacggcgagctgcagtactacctgagcctgctgaaccagcagctgcccatcgagagccagatggtgagcaagctgcccgacatgctgaacgccgagatcgtgctgggcaacgtgcagaacgccaaggacgccgtgaactggctgggctacgcctacctgtacatcagaatgctgagaagccccaccctgtacggcatcagccacgacgacctgaagggcgaccccctgctggaccagagaagactggacctggtgcacaccgccgccctgatgctggacaagaacaacctggtgaagtacgacaagaagaccggcaacttccaggtgaccgagctgggcagaatcgccagccactactacatcaccaacgacaccgtgcagacctacaaccagctgctgaagcccaccctgagcgagatcgagctgttcagagtgttcagcctgagcagcgagttcaagaacatcaccgtgagagaggaggagaagctggagctgcagaagctgctggagagagtgcccatccccgtgaaggagagcatcgaggagcccagcgccaagatcaacgtgctgctgcaggccttcatcagccagctgaagctggagggcttcgccctgatggccgacatggtgtacgtgacccagagcgccggcagactgatgagagccatcctgaagctgagctag

SEQ ID NO: 99193 - DNA, 2160 bp, Artificial Sequence
  Description of Artificial Sequence: Synthetic coding sequence
atgctgctgcagagcagcgagggcagatgcgtgtacatcacccccatggaggccctggccgagcaggtgtacatggactggtacgagaagttccaggacagactgaacaagaaggtggtgctgctgaccggcgagaacggccccgtgctggaggtgatctgcagcagaatgagatacatcagcagccagatcgagagacccatcagaatcgtggccctgagcagcagcctgagcaacgccaaggacgtggcccactggctgggctgcagcgccaccagcaccttcaacttccaccccaacgtgagacccgtgcccctggagctgcacatccagggcttcaacatcagccacacccagaccagactgctgagcatggccaagcccgtgtaccacgccatcaccaagcacagccccaagaagcccgtgatcgtgttcgtgcccagcagaaagcagaccagactgaccgccatcgacatcctgaccacctgcgccgccgacatccagagacagagattcctgcactgcaccgagaaggacctgatcccctacctggagaagctgagcgacagcaccctgaaggagaccctgctgaacggcgtgggctacctgcacgagggcctgagccccatggagagaagactggtggagcagctgttcagcagcggcgccatccaggtggtggtggccagcagaagcctgtgctggggcatgaacgtggccgcccacctggtgatcatcatggacacccagtactacaacggcaagatccacgcctacgtggactaccccatctacgacgtgctgcagatggtgggccacgccaacagacccctgcaggacgacgagggcagatgcgtgatcatgtgccagggcagcaagaaggacttcttcaagaagttcctgtacgagcccctgcccgtggagagccacctggaccactgcatgcacgaccacttcaacgccgagatcgtgaccaagaccatcgagaacaagcaggacgccgtggactacctgacctggaccttcctgtacagaagaatgacccagaaccccaactactacaacctgcagggcatcagccacagacacctgagcgaccacctgagcgagctggtggagcagaccctgagcgacctggagcagagcaagtgcatcagcatcgaggacgagatggacgtggcccccctgaacctgggcatgatcgccgcctactactacatcaactacaccaccatcgagctgttcagcatgagcctgaacgccaagaccaaggtgagaggcctgatcgagatcatcagcaacgccgccgagtacgagaacatccccatcagacaccacgaggacaacctgctgagacagctggcccagaaggtgccccacaagctgaacaaccccaagttcaacgacccccacgtgaagaccaacctgctgctgcaggcccacctgagcagaatgcagctgagcgccgagctgcagagcgacaccgaggagatcctgagcaaggccatcagactgatccaggcctgcgtggacgtgctgagcagcaacggctggctgagccccgccctggccgccatggagctggcccagatggtgacccaggccatgtggagcaaggacagctacctgaagcagctgccccacttcaccagcgagcacatcaagagatgcaccgacaagggcgtggagagcgtgttcgacatcatggagatggaggacgaggagagaaacgccctgctgcagctgaccgacagccagatcgccgacgtggccagattctgcaacagataccccaacatcgagctgagctacgaggtggtggacaaggacagcatcagaagcggcggccccgtggtggtgctggtgcagctggagagagaggaggaggtgaccggccccgtgatcgcccccctgttcccccagaagagagaggagggctggtgggtggtgatcggcgacgccaagagcaacagcctgatcagcatcaagagactgaccctgcagcagaaggccaaggtgaagctggacttcgtggcccccgccaccggcgcccacaactacaccctgtacttcatgagcgacgcctacatgggctgcgaccaggagtacaagttcagcgtggacgtgaaggaggccgagaccgacagcgacagcgactag

SEQ ID NO: 99194 - DNA, 1074 bp, Artificial Sequence
  Description of Artificial Sequence: Synthetic coding sequence
atgatcgagcagcagaagagaaagggccccgagctgcccctggtgcccgtgaagagacagagacacgagctgctgctgggcgccggcagcggccccggcgccggccagcagcaggccacccccggcgccctgctgcaggccggcccccccagatgcagcagcctgcaggcccccatcatgctgctgagcggccacgagggcgaggtgtactgctgcaagttccaccccaacggcagcaccctggccagcgccggcttcgacagactgatcctgctgtggaacgtgtacggcgactgcgacaactacgccaccctgaagggccacagcggcgccgtgatggagctgcactacaacaccgacggcagcatgctgttcagcgccagcaccgacaagaccgtggccgtgtgggacagcgagaccggcgagagagtgaagagactgaagggccacaccagcttcgtgaacagctgctaccccgccagaagaggcccccagctggtgtgcaccggcagcgacgacggcaccgtgaagctgtgggacatcagaaagaaggccgccatccagaccttccagaacacctaccaggtgctggccgtgaccttcaacgacaccagcgaccagatcatcagcggcggcatcgacaacgacatcaaggtgtgggacctgagacagaacaagctgacctacaccatgagaggccacgccgacagcgtgaccggcctgagcctgagcagcgagggcagctacctgctgagcaacgccatggacaacaccgtgagagtgtgggacgtgagacccttcgcccccaaggagagatgcgtgaagatcttccagggcaacgtgcacaacttcgagaagaacctgctgagatgcagctggagccccgacggcagcaagatcgccgccggcagcgccgacagattcgtgtacgtgtgggacaccaccagcagaagaatcctgtacaagctgcccggccacgccggcagcatcaacgaggtggccttccaccccgacgagcccatcatcatcagcgccagcagcgacaagagactgtacatgggcgagatccagtag

SEQ ID NO: 99195 - DNA, 384 bp, Artificial Sequence
  Description of Artificial Sequence: Synthetic coding sequence
atgatcctgatcagcgccggctgccccggcggcctgtggcccatcgtggtgctggtgggcctgttcatctggatctgcttcgccgtgagagtgtgggacgtgagacccttcgcccccaaggagagatgcgtgaagatcttccagggcaacgtgcacaacttcgagaagaacctgctgagatgcagctggagccccgacggcagcaagatcgccgccggcagcgccgacagattcgtgtacgtgtgggacaccaccagcagaagaatcctgtacaagctgcccggccacgccggcagcatcaacgaggtggccttccaccccgacgagcccatcatcatcagcgccagcagcgacaagagactgtacatgggcgagatccagtag

SEQ ID NO: 99196 - DNA, 1230 bp, Artificial Sequence
  Description of Artificial Sequence: Synthetic coding sequence
atgatcgagcagcagaagagaaagggccccgagctgcccctggtgcccgtgaagagacagagacacgagctgctgctgggcgccggcagcggccccggcgccggccagcagcaggccacccccggcgccctgctgcaggccggcccccccagatgcagcagcctgcaggcccccatcatgctgctgagcggccacgagggcgaggtgtactgctgcaagttccaccccaacggcagcaccctggccagcgccggcttcgacagactgatcctgctgtggaacgtgtacggcgactgcgacaactacgccaccctgaagggccacagcggcgccgtgatggagctgcactacaacaccgacggcagcatgctgttcagcgccagcaccgacaagaccgtggccgtgtgggacagcgagaccggcgagagagtgaagagactgaagggccacaccagcttcgtgaacagctgctaccccgccagaagaggcccccagctggtgtgcaccggcagcgacgacggcaccgtgaagctgtgggacatcagaaagaaggccgccatccagaccttccagaacacctaccaggtgctggccgtgaccttcaacgacaccagcgaccagatcatcagcggcggcatcgacaacgacatcaaggtgtgggacctgagacagaacaagctgacctacaccatgagaggccacgccgacagcgtgaccggcctgagcctgagcagcgagggcagctacctgctgagcaacgccatggacaacaccgtgagagtgtgggacgtgagacccttcgcccccaaggagagatgcgtgaagatcttccagggcaacgtgcacaacttcgagaagaacctgctgagatgcagctggagccccgacggcagcaagatcgccgccggcagcgccgacagattcgtgtacgtgtgggacaccaccagcagaagaatcctgtacaagctgcccggccacgccggcagcatcaacgaggtggccttccaccccgacgagcccatcatcgagaccggcttccacagaatcggccagggcggccacgagctgctgaccagcagcaacccccccgccagcgccagccagagcgccggcatcaccggcgtgagccactgcgcccagctgcagaccgtgttcatgtgggtgagcatgagcgtgagccccctgctgatcagcggcgagagcaagagcaacgcccccttcagcagctag

SEQ ID NO: 99197 - DNA, 849 bp, Artificial Sequence
  Description of Artificial Sequence: Synthetic coding sequence
atggccgtgcccgagaccagacccaaccacaccatctacatcaacaacctgaacgagaagatcaagaaggacgagctgaagaagagcctgtacgccatcttcagccagttcggccagatcctggacatcctggtgagcagaagcctgaagatgagaggccaggccttcgtgatcttcaaggaggtgagcagcgccaccaacgccctgagaagcatgcagggcttccccttctacgacaagcccatgagaatccagtacgccaagaccgacagcgacatcatcgccaagatgaagggcaccttcgtggagagagacagaaagagagagaagagaaagcccaagagccaggagacccccgccaccaagaaggccgtgcagggcggcggcgccacccccgtggtgggcgccgtgcagggccccgtgcccggcatgccccccatgacccaggcccccagaatcatgcaccacatgcccggccagcccccctacatgcccccccccggcatgatccccccccccggcctggcccccggccagatcccccccggcgccatgcccccccagcagctgatgcccggccagatgccccccgcccagcccctgagcgagaacccccccaaccacatcctgttcctgaccaacctgcccgaggagaccaacgagctgatgctgagcatgctgttcaaccagttccccggcttcaaggaggtgagactggtgcccggcagacacgacatcgccttcgtggagttcgacaacgaggtgcaggccggcgccgccagagacgccctgcagggcttcaagatcacccagaacaacgccatgaagatcagcttcgccaagaagtag

SEQ ID NO: 99198 - DNA, 612 bp, Artificial Sequence
  Description of Artificial Sequence: Synthetic coding sequence
atggccgtgcccgagaccagacccaaccacaccatctacatcatcgccaagatgaagggcaccttcgtggagagagacagaaagagagagaagagaaagcccaagagccaggagacccccgccaccaagaaggccgtgcagggcggcggcgccacccccgtggtgggcgccgtgcagggccccgtgcccggcatgccccccatgacccaggcccccagaatcatgcaccacatgcccggccagcccccctacatgcccccccccggcatgatccccccccccggcctggcccccggccagatcccccccggcgccatgcccccccagcagctgatgcccggccagatgccccccgcccagcccctgagcgagaacccccccaaccacatcctgttcctgaccaacctgcccgaggagaccaacgagctgatgctgagcatgctgttcaaccagttccccggcttcaaggaggtgagactggtgcccggcagacacgacatcgccttcgtggagttcgacaacgaggtgcaggccggcgccgccagagacgccctgcagggcttcaagatcacccagaacaacgccatgaagatcagcttcgccaagaagtag

SEQ ID NO: 99199 - DNA, 768 bp, Artificial Sequence
  Description of Artificial Sequence: Synthetic coding sequence
atggtgaagctgaccgccgagctgatcgagcaggccgcccagtacaccaacgccgtgagagacagagagctggacctgagaggctacaagatccccgtgatcgagaacctgggcgccaccctggaccagttcgacgccatcgacttcagcgacaacgagatcagaaagctggacggcttccccctgctgagaagactgaagaccctgctggtgaacaacaacagaatctgcagaatcggcgagggcctggaccaggccctgccctgcctgaccgagctgatcctgaccaacaacagcctggtggagctgggcgacctggaccccctggccagcctgaagagcctgacctacctgagcatcctgagaaaccccgtgaccaacaagaagcactacagactgtacgtgatctacaaggtgccccaggtgagagtgctggacttccagaaggtgaagctgaaggagagacaggaggccgagaagatgttcaagggcaagagaggcgcccagctggccaaggacatcgccagaagaagcaagaccttcaaccccggcgccggcctgcccaccgacaagaagaagggcggccccagccccggcgacgtggaggccatcaagaacgccatcgccaacgccagcaccctggccgaggtggagagactgaagggcctgctgcagagcggccagatccccggcagagagagaagaagcggccccaccgacgacggcgaggaggagatggaggaggacaccgtgaccaacggcagctag

SEQ ID NO: 99200 - DNA, 480 bp, Artificial Sequence
  Description of Artificial Sequence: Synthetic coding sequence
atgcccaagttctactgcgactactgcgacacctacctgacccacgacagccccagcgtgagaaagacccactgcagcggcagaaagcacaaggagaacgtgaaggactactaccagaagtggatggaggagcaggcccagagcctgatcgacaagaccaccgccgccttccagcagggcaagatcccccccacccccttcagcgcccccccccccgccggcgccatgatcccccccccccccagcctgcccggcccccccagacccggcatgatgcccgccccccacatgggcggcccccccatgatgcccatgatgggcccccccccccccggcatgatgcccgtgggccccgcccccggcatgagaccccccatgggcggccacatgcccatgatgcccggcccccccatgatgagaccccccgccagacccatgatggtgcccaccagacccggcatgaccagacccgacagatag

SEQ ID NO: 99201 - DNA, 543 bp, Artificial Sequence
  Description of Artificial Sequence: Synthetic coding sequence
atgaacagcgccagcgtggacggccacctgagcggctgcagactgttcctgttcctgagccccctgttcagattctactgcgactactgcgacacctacctgacccacgacagccccagcgtgagaaagacccactgcagcggcagaaagcacaaggagaacgtgaaggactactaccagaagtggatggaggagcaggcccagagcctgatcgacaagaccaccgccgccttccagcagggcaagatcccccccacccccttcagcgcccccccccccgccggcgccatgatcccccccccccccagcctgcccggcccccccagacccggcatgatgcccgccccccacatgggcggcccccccatgatgcccatgatgggcccccccccccccggcatgatgcccgtgggccccgcccccggcatgagaccccccatgggcggccacatgcccatgatgcccggcccccccatgatgagaccccccgccagacccatgatggtgcccaccagacccggcatgaccagacccgacagatag

SEQ ID NO: 99202 - DNA, 357 bp, Artificial Sequence
  Description of Artificial Sequence: Synthetic coding sequence
atggaggagcaggcccagagcctgatcgacaagaccaccgccgccttccagcagggcaagatcccccccacccccttcagcgcccccccccccgccggcgccatgatcccccccccccccagcctgcccggcccccccagacccggcatgatgcccgccccccacatgggcggcccccccatgatgcccatgatgggcccccccccccccggcatgatgcccgtgggccccgcccccggcatgagaccccccatgggcggccacatgcccatgatgcccggcccccccatgatgagaccccccgccagacccatgatggtgcccaccagacccggcatgaccagacccgacagatag

SEQ ID NO: 99203 - DNA, 159 bp, Artificial Sequence
  Description of Artificial Sequence: Synthetic coding sequence
atgagaatcgagggctgcatcatcggcttcgacgagtacatgaacctggtgctggacgacgccgaggagatccacagcaagaccaagagcagaaagcagctgggcagaatcatgctgaagggcgacaacatcaccctgctgcagagcgtgagcaactag

SEQ ID NO: 99204 - DNA, 279 bp, Artificial Sequence
  Description of Artificial Sequence: Synthetic coding sequence
atggcctacagaggccagggccagaaggtgcagaaggtgatggtgcagcccatcaacctgatcttcagatacctgcagaacagaagcagaatccaggtgtggctgtacgagcaggtgaacatgagaatcgagggctgcatcatcggcttcgacgagtacatgaacctggtgctggacgacgccgaggagatccacagcaagaccaagagcagaaagcagctgggcagaatcatgctgaagggcgacaacatcaccctgctgcagagcgtgagcaactag

SEQ ID NO: 99205 - DNA, 723 bp, Artificial Sequence
  Description of Artificial Sequence: Synthetic coding sequence
atgaccgtgggcaagagcagcaagatgctgcagcacatcgactacagaatgagatgcatcctgcaggacggcagaatcttcatcggcaccttcaaggccttcgacaagcacatgaacctgatcctgtgcgactgcgacgagttcagaaagatcaagcccaagaacgccaagcagcccgagagagaggagaagagagtgctgggcctggtgctgctgagaggcgagaacctggtgagcatgaccgtggagggccccccccccaaggacaccggcatcgccagagtgcccctggccggcgccgccggcggccccggcgtgggcagagccgccggcagaggcgtgcccgccggcgtgcccatcccccaggcccccgccggcctggccggccccgtgagaggcgtgggcggccccagccagcaggtgatgaccccccagggcagaggcaccgtggccgccgccgccgtggccgccaccgccagcatcgccggcgcccccacccagtacccccccggcagaggcaccccccccccccccgtgggcagagccacccccccccccggcatcatggcccccccccccggcatgagaccccccatgggcccccccatcggcctgccccccgccagaggcacccccatcggcatgcccccccccggcatgagaccccccccccccggcatcagaggcccccccccccccggcatgagaccccccagaccctag

SEQ ID NO: 99206 - DNA, 723 bp, Artificial Sequence; identical to SEQ ID NO: 99205
  Description of Artificial Sequence: Synthetic coding sequence

SEQ ID NO: 99207 - DNA, 723 bp, Artificial Sequence; identical to SEQ ID NO: 99205
  Description of Artificial Sequence: Synthetic coding sequence

SEQ ID NO: 99208 - DNA, 723 bp, Artificial Sequence; identical to SEQ ID NO: 99205
  Description of Artificial Sequence: Synthetic coding sequence

SEQ ID NO: 99209 - DNA, 735 bp, Artificial Sequence
  Description of Artificial Sequence: Synthetic coding sequence
atgatggacagccagaccgtgggcaagagcagcaagatgctgcagcacatcgactacagaatgagatgcatcctgcaggacggcagaatcttcatcggcaccttcaaggccttcgacaagcacatgaacctgatcctgtgcgactgcgacgagttcagaaagatcaagcccaagaacgccaagcagcccgagagagaggagaagagagtgctgggcctggtgctgctgagaggcgagaacctggtgagcatgaccgtggagggccccccccccaaggacaccggcatcgccagagtgcccctggccggcgccgccggcggccccggcgtgggcagagccgccggcagaggcgtgcccgccggcgtgcccatcccccaggcccccgccggcctggccggccccgtgagaggcgtgggcggccccagccagcaggtgatgaccccccagggcagaggcaccgtggccgccgccgccgtggccgccaccgccagcatcgccggcgcccccacccagtacccccccggcagaggcaccccccccccccccgtgggcagagccacccccccccccggcatcatggcccccccccccggcatgagaccccccatgggcccccccatcggcctgccccccgccagaggcacccccatcggcatgcccccccccggcatgagaccccccccccccggcatcagaggcccccccccccccggcatgagaccccccagaccctag

SEQ ID NO: 99210 - DNA, 945 bp, Artificial Sequence; identical to SEQ ID NO: 77814
  Description of Artificial Sequence: Synthetic coding sequence

SEQ ID NO: 99211 - DNA, 1248 bp, Artificial Sequence
  Description of Artificial Sequence: Synthetic coding sequence
atggccaccgtgggcgagtggagctgcgtgagatgcaccttcctgaaccccgccggccagagacagtgcagcatctgcgaggcccccagacacaagcccgacctgaaccacatcctgagactgagcgtggaggagcagaagtggccctgcgccagatgcaccttcagaaacttcctgggcaaggaggcctgcgaggtgtgcggcttcacccccgagcccgcccccggcgccgccttcctgcccgtgctgaacggcgtgctgcccaagccccccgccatcctgggcgagcccaagggcagctgccaggaggaggccggccccgtgagaaccgccggcctggtggccaccgagcccgccagaggccagtgcgaggacaaggacgaggaggagaaggaggagcaggaggaggaggagggcgccgccgagcccagaggcggctgggcctgccccagatgcaccctgcacaacacccccgtggccagcagctgcagcgtgtgcggcggccccagaagactgagcctgcccagaatcccccccgaggccctggtggtgcccgaggtggtggcccccgccggcttccacgtggtgcccgccgcccccccccccggcctgcccggcgagggcgccgaggccaacccccccgccaccagccagggccccgccgccgagcccgagccccccagagtgccccccttcagccccttcagcagcaccctgcagaacaaccccgtgcccagaagcagaagagaggtgcccccccagctgcagccccccgtgcccgaggccgcccagcccagccccagcgccggctgcagaggcgccccccagggcagcggctgggccggcgccagcagactggccgagctgctgagcggcaagagactgagcgtgctggaggaggaggccaccgagggcggcaccagcagagtggaggccggcagcagcaccagcggcagcgacatcatcgacctggccggcgacaccgtgagatacacccccgccagccccagcagccccgacttcaccacctggagctgcgccaagtgcaccctgagaaaccccagcccccccagcctgcagcccctgggcagaggccccgagagcctgcccagagccgccggccccagagccggctgcgtgcagctggaggccggccacggcggcgccagaggcagccccgccgaccacgccggcagaagacaccaccccgcccacagagagcccagaagagccgccagaggcccctag

SEQ ID NO: 99212 - DNA, 270 bp, Artificial Sequence
  Description of Artificial Sequence: Synthetic coding sequence
atgagcagccagcagcagaagcagccctgcaccccccccccccagctgcagcagcagcaggtgaagcagccctgccagccccccccccaggagccctgcatccccaagaccaaggagccctgccaccccaaggtgcccgagccctgccaccccaaggtgcccgagccctgccagcccaaggtgcccgagccctgccaccccaaggtgcccgagccctgccccagcatcgtgacccccgcccccgcccagcagaagaccaagcagaagtag

SEQ ID NO: 99213 - DNA, 222 bp, Artificial Sequence
  Description of Artificial Sequence: Synthetic coding sequence
atgagcagccagcagcagaagcagccctgcaccccccccccccagctgcagcagcagcaggtgaagcagccctgccagccccccccccaggagccctgcatccccaagaccaaggagccctgccaccccaaggtgcccgagccctgccaccccaaggtgcccgagccctgccccagcatcgtgacccccgcccccgcccagcagaagaccaagcagaagtag

SEQ ID NO: 99214 - DNA, 219 bp, Artificial Sequence
  Description of Artificial Sequence: Synthetic coding sequence
atgagctaccagcagcagcagtgcaagcagccctgccagcccccccccgtgtgccccacccccaagtgccccgagccctgccccccccccaagtgccccgagccctgccccccccccaagtgcccccagccctgccccccccagcagtgccagcagaagtacccccccgtgacccccagccccccctgccagagcaagtacccccccaagagcaagtag

SEQ ID NO: 99215 - DNA, 219 bp, Artificial Sequence
  Description of Artificial Sequence: Synthetic coding sequence
atgagctaccagcagcagcagtgcaagcagccctgccagcccccccccgtgtgccccacccccaagtgccccgagccctgccccccccccaagtgccccgagccctgccccccccccaagtgcccccagccctgccccccccagcagtgccagcagaagtacccccccgtgacccccagccccccctgccagcccaagtacccccccaagagcaagtag

SEQ ID NO: 99216 - DNA, 219 bp, Artificial Sequence; identical to SEQ ID NO: 99215
  Description of Artificial Sequence: Synthetic coding sequence

SEQ ID NO: 99217 - DNA, 219 bp, Artificial Sequence; identical to SEQ ID NO: 99215
  Description of Artificial Sequence: Synthetic coding sequence

SEQ ID NO: 99218 - DNA, 510 bp, Artificial Sequence
  Description of Artificial Sequence: Synthetic coding sequence
atgagcagctaccagcagaagcagaccttcaccccccccccccagctgcagcagcagcaggtgaagcagcccagccagccccccccccaggagatcttcgtgcccaccaccaaggagccctgccacagcaaggtgccccagcccggcaacaccaagatccccgagcccggctgcaccaaggtgcccgagcccggctgcaccaaggtgcccgagcccggctgcaccaaggtgcccgagcccggctgcaccaaggtgcccgagcccggctgcaccaaggtgcccgagcccggctgcaccaaggtgcccgagcccggctacaccaaggtgcccgagcccggcagcatcaaggtgcccgaccagggcttcatcaagttccccgagcccggcgccatcaaggtgcccgagcagggctacaccaaggtgcccgtgcccggctacaccaagctgcccgagccctgccccagcaccgtgacccccggccccgcccagcagaagaccaagcagaagtag

SEQ ID NO: 99219 - DNA, 510 bp, Artificial Sequence; identical to SEQ ID NO: 99218
  Description of Artificial Sequence: Synthetic coding sequence

SEQ ID NO: 99220 - DNA, 480 bp, Artificial Sequence
  Description of Artificial Sequence: Synthetic coding sequence
atgagcagctaccagcagaagcagaccttcaccccccccccccagctgcagcagcagcaggtgaagcagcccagccagccccccccccaggagatcttcgtgcccaccaccaaggagccctgccacagcaaggtgccccagcccggcaacaccaagatccccgagcccggctgcaccaaggtgcccgagcccggctgcaccaaggtgcccgagcccggctgcaccaaggtgcccgagcccggctgcaccaaggtgcccgagcccggctgcaccaaggtgcccgagcccggctgcaccaaggtgcccgagcccggctacaccaaggtgcccgagcccggcagcatcaaggtgcccgaccagggcttcatcaagttccccgagcccggcgccatcaaggtgcccgagcagggctacaccaaggtgcccgtgcccggctacaccaagctgcccgagccctgccccagcaccgtgaccccctag

SEQ ID NO: 99221 - DNA, 486 bp, Artificial Sequence
  Description of Artificial Sequence: Synthetic coding sequence
atgagcagctaccagcagaagcagaccttcaccccccccccccagctgcagcagcagcaggtgaagcagcccagccagccccccccccaggagatcttcgtgcccaccaccaaggagccctgccacagcaaggtgccccagcccggcaacaccaagatccccgagcccggctgcaccaaggtgcccgagcccggctgcaccaaggtgcccgagcccggctgcaccaaggtgcccgagcccggctgcaccaaggtgcccgagcccggctgcaccaaggtgcccgagcccggctacaccaaggtgcccgagcccggcagcatcaaggtgcccgaccagggcttcatcaagttccccgagcccggcgccatcaaggtgcccgagcagggctacaccaaggtgcccgtgcccggctacaccaagctgcccgagccctgccccagcaccgtgacccccggccccgcccagcagaagaccaagcagaagtag

SEQ ID NO: 99222 - DNA, 10989 bp, Artificial Sequence
  Description of Artificial Sequence: Synthetic coding sequence
atgagcagaagagcccccggcagcagactgagcagcggcggcggcggcggcggcaccaagtaccccagaagctggaacgactggcagcccagaaccgacagcgccagcgccgaccccgacaacctgaagtacagcagcagcagagacagaggcggcagcagcagctacggcctgcagcccagcaacagcgccgtggtgagcagacagagacacgacgacaccagagtgcacgccgacatccagaacgacgagaagggcggctacagcgtgaacggcggcagcggcgagaacacctacggcagaaagagcctgggccaggagctgagagtgaacaacgtgaccagccccgagttcaccagcgtgcagcacggcagcagagccctggccaccaaggacatgagaaagagccaggagagaagcatgagctacagcgacgagagcagactgagcaacctgctgagaagaatcaccagagaggacgacagagacagaagactggccaccgtgaagcagctgaaggagttcatccagcagcccgagaacaagctggtgctggtgaagcagctggacaacatcctggccgccgtgcacgacgtgctgaacgagagcagcaagctgctgcaggagctgagacaggagggcgcctgctgcctgggcctgctgtgcgccagcctgagctacgaggccgagaagatcttcaagtggatcttcagcaagttcagcagcagcgccaaggacgaggtgaagctgctgtacctgtgcgccacctacaaggccctggagaccgtgggcgagaagaaggccttcagcagcgtgatgcagctggtgatgaccagcctgcagagcatcctggagaacgtggacacccccgagctgctgtgcaagtgcgtgaagtgcatcctgctggtggccagatgctacccccacatcttcagcaccaacttcagagacaccgtggacatcctggtgggctggcacatcgaccacacccagaagcccagcctgacccagcaggtgagcggctggctgcagagcctggagcccttctgggtggccgacctggccttcagcaccaccctgctgggccagttcctggaggacatggaggcctacgccgaggacctgagccacgtggccagcggcgagagcgtggacgaggacgtgcccccccccagcgtgagcctgcccaagctggccgccctgctgagagtgttcagcaccgtggtgagaagcatcggcgagagattcagccccatcagaggcccccccatcaccgaggcctacgtgaccgacgtgctgtacagagtgatgagatgcgtgaccgccgccaaccaggtgttcttcagcgaggccgtgctgaccgccgccaacgagtgcgtgggcgtgctgctgggcagcctggaccccagcatgaccatccactgcgacatggtgatcacctacggcctggaccagctggagaactgccagacctgcggcaccgactacatcatcagcgtgctgaacctgctgaccctgatcgtggagcagatcaacaccaagctgcccagcagcttcgtggagaagctgttcatccccagcagcaagctgctgttcctgagataccacaaggagaaggaggtggtggccgtggcccacgccgtgtaccaggccgtgctgagcctgaagaacatccccgtgctggagaccgcctacaagctgatcctgggcgagatgacctgcgccctgaacaacctgctgcacagcctgcagctgcccgaggcctgcagcgagatcaagcacgaggccttcaagaaccacgtgttcaacgtggacaacgccaagttcgtggtgatcttcgacctgagcgccctgaccaccatcggcaacgccaagaacagcctgatcggcatgtgggccctgagccccaccgtgttcgccctgctgagcaagaacctgatgatcgtgcacagcgacctggccgtgcacttccccgccatccagtacgccgtgctgtacaccctgtacagccactgcaccagacacgaccacttcatcagcagcagcctgagcagcagcagccccagcctgttcgacggcgccgtgatcagcaccgtgaccaccgccaccaagaagcacttcagcatcatcctgaacctgctgggcatcctgctgaagaaggacaacctgaaccaggacaccagaaagctgctgatgacctgggccctggaggccgccgtgctgatgaagaagagcgagacctacgcccccctgttcagcctgcccagcttccacaagttctgcaagggcctgctggccaacaccctggtggaggacgtgaacatctgcctgcaggcctgcagcagcctgcacgccctgagcagcagcctgcccgacgacctgctgcagagatgcgtggacgtgtgcagagtgcagctggtgcacagcggcaccagaatcagacaggccttcggcaagctgctgaagagcatccccctggacgtggtgctgagcaacaacaaccacaccgagatccaggagatcagcctggccctgagaagccacatgagcaaggcccccagcaacaccttccacccccaggacttcagcgacgtgatcagcttcatcctgtacggcaacagccacagaaccggcaaggacaactggctggagagactgttctacagctgccagagactggacaagagagaccagagcaccatccccagaaacctgctgaagaccgacgccgtgctgtggcagtgggccatctgggaggccgcccagttcaccgtgctgagcaagctgagaacccccctgggcagagcccaggacaccttccagaccatcgagggcatcatcagaagcctggccgcccacaccctgaaccccgaccaggacgtgagccagtggaccaccgccgacaacgacgagggccacggcaacaaccagctgagactggtgctgctgctgcagtacctggagaacctggagaagctgatgtacaacgcctacgagggctgcgccaacgccctgaccagcccccccaaggtgatcagaaccttcttctacaccaacagacagacctgccaggactggctgaccagaatcagactgagcatcatgagagtgggcctgctggccggccagcccgccgtgaccgtgagacacggcttcgacctgctgaccgagatgaagaccaccagcctgagccagggcaacgagctggaggtgaccatcatgatggtggtggaggccctgtgcgagctgcactgccccgaggccatccagggcatcgccgtgtggagcagcagcatcgtgggcaagaacctgctgtggatcaacagcgtggcccagcaggccgagggcagattcgagaaggccagcgtggagtaccaggagcacctgtgcgccatgaccggcgtggactgctgcatcagcagcttcgacaagagcgtgctgaccctggccaacgccggcagaaacagcgccagccccaagcacagcctgaacggcgagagcagaaagaccgtgctgagcaagcccaccgacagcagccccgaggtgatcaactacctgggcaacaaggcctgcgagtgctacatcagcatcgccgactgggccgccgtgcaggagtggcagaacgccatccacgacctgaagaagagcaccagcagcaccagcctgaacctgaaggccgacttcaactacatcaagagcctgagcagcttcgagagcggcaagttcgtggagtgcaccgagcagctggagctgctgcccggcgagaacatcaacctgctggccggcggcagcaaggagaagatcgacatgaagaagctgctgcccaacatgctgagccccgaccccagagagctgcagaagagcatcgaggtgcagctgctgagaagcagcgtgtgcctggccaccgccctgaaccccatcgagcaggaccagaagtggcagagcatcaccgagaacgtggtgaagtacctgaagcagaccagcagaatcgccatcggccccctgagactgagcaccctgaccgtgagccagagcctgcccgtgctgagcaccctgcagctgtactgcagcagcgccctggagaacaccgtgagcaacagactgagcaccgaggactgcctgatccccctgttcagcgaggccctgagaagctgcaagcagcacgacgtgagaccctggatgcaggccctgagatacaccatgtaccagaaccagctgctggagaagatcaaggagcagaccgtgcccatcagaagccacctgatggagctgggcctgaccgccgccaagttcgccagaaagagaggcaacgtgagcctggccaccagactgctggcccagtgcagcgaggtgcagctgggcaagaccaccaccgcccaggacctggtgcagcacttcaagaagctgagcacccagggccaggtggacgagaagtggggccccgagctggacatcgagaagaccaagctgctgtacaccgccggccagagcacccacgccatggagatgctgagcagctgcgccatcagcttctgcaagagcgtgaaggccgagtacgccgtggccaagagcatcctgaccctggccaagtggatccaggccgagtggaaggagatcagcggccagctgaagcaggtgtacagagcccagcaccagcagaacttcaccggcctgagcaccctgagcaagaacatcctgaccctgatcgagctgcccagcgtgaacaccatggaggaggagtaccccagaatcgagagcgagagcaccgtgcacatcggcgtgggcgagcccgacttcatcctgggccagctgtaccacctgagcagcgtgcaggcccccgaggtggccaagagctgggccgccctggccagctgggcctacagatggggcagaaaggtggtggacaacgccagccagggcgagggcgtgagactgctgcccagagagaagagcgaggtgcagaacctgctgcccgacaccatcaccgaggaggagaaggagagaatctacggcatcctgggccaggccgtgtgcagacccgccggcatccaggacgaggacatcaccctgcagatcaccgagagcgaggacaacgaggaggacgacatggtggacgtgatctggagacagctgatcagcagctgcccctggctgagcgagctggacgagagcgccaccgagggcgtgatcaaggtgtggagaaaggtggtggacagaatcttcagcctgtacaagctgagctgcagcgcctacttcaccttcctgaagctgaacgccggccagatccccctggacgaggacgaccccagactgcacctgagccacagagtggagcagagcaccgacgacatgatcgtgatggccaccctgagactgctgagactgctggtgaagcacgccggcgagctgagacagtacctggagcacggcctggagaccacccccaccgccccctggagaggcatcatcccccagctgttcagcagactgaaccaccccgaggtgtacgtgagacagagcatctgcaacctgctgtgcagagtggcccaggacagcccccacctgatcctgtaccccgccatcgtgggcaccatcagcctgagcagcgagagccaggccagcggcaacaagttcagcaccgccatccccaccctgctgggcaacatccagggcgaggagctgctggtgagcgagtgcgagggcggcagcccccccgccagccaggacagcaacaaggacgagcccaagagcggcctgaacgaggaccaggccatgatgcaggactgctacagcaagatcgtggacaagctgagcagcgccaaccccaccatggtgctgcaggtgcagatgctggtggccgagctgagaagagtgaccgtgctgtgggacgagctgtggctgggcgtgctgctgcagcagcacatgtacgtgctgagaagaatccagcagctggaggacgaggtgaagagagtgcagaacaacaacaccctgagaaaggaggagaagatcgccatcatgagagagaagcacaccgccctgatgaagcccatcgtgttcgccctggagcacgtgagaagcatcaccgccgcccccgccgagaccccccacgagaagtggttccaggacaactacggcgacgccatcgagaacgccctggagaagctgaagacccccctgaaccccgccaagcccggcagcagctggatccccttcaaggagatcatgctgagcctgcagcagagagcccagaagagagccagctacatcctgagactggaggagatcagcccctggctggccgccatgaccaacaccgagatcgccctgcccggcgaggtgagcgccagagacaccgtgaccatccacagcgtgggcggcaccatcaccatcctgcccaccaagaccaagcccaagaagctgctgttcctgggcagcgacggcaagagctacccctacctgttcaagggcctggaggacctgcacctggacgagagaatcatgcagttcctgagcatcgtgaacaccatgttcgccaccatcaacagacaggagacccccagattccacgccagacactacagcgtgacccccctgggcaccagaagcggcctgatccagtgggtggacggcgccacccccctgttcggcctgtacaagagatggcagcagagagaggccgccctgcaggcccagaaggcccaggacagctaccagaccccccagaaccccggcatcgtgcccagacccagcgagctgtactacagcaagatcggccccgccctgaagaccgtgggcctgagcctggacgtgagcagaagagactggcccctgcacgtgatgaaggccgtgctggaggagctgatggaggccaccccccccaacctgctggccaaggagctgtggagcagctgcaccacccccgacgagtggtggagagtgacccagagctacgccagaagcaccgccgtgatgagcatggtgggctacatcatcggcctgggcgacagacacctggacaacgtgctgatcgacatgaccaccggcgaggtggtgcacatcgactacaacgtgtgcttcgagaagggcaagagcctgagagtgcccgagaaggtgcccttcagaatgacccagaacatcgagaccgccctgggcgtgaccggcgtggagggcgtgttcagactgagctgcgagcaggtgctgcacatcatgagaagaggcagagagaccctgctgaccctgctggaggccttcgtgtacgaccccctggtggactggaccgccggcggcgaggccggcttcgccggcgccgtgtacggcggcggcggccagcaggccgagagcaagcagagcaagagagagatggagagagagatcaccagaagcctgttcagcagcagagtggccgagatcaaggtgaactggttcaagaacagagacgagatgctggtggtgctgcccaagctggacggcagcctggacgagtacctgagcctgcaggagcagctgaccgacgtggagaagctgcagggcaagctgctggaggagatcgagttcctggagggcgccgagggcgtggaccaccccagccacaccctgcagcacagatacagcgagcacacccagctgcagacccagcagagagccgtgcaggaggccatccaggtgaagctgaacgagttcgagcagtggatcacccactaccaggccgccttcaacaacctggaggccacccagctggccagcctgctgcaggagatcagcacccagatggacctgggcccccccagctacgtgcccgccaccgccttcctgcagaacgccggccaggcccacctgatcagccagtgcgagcagctggagggcgaggtgggcgccctgctgcagcagagaagaagcgtgctgagaggctgcctggagcagctgcaccactacgccaccgtggccctgcagtaccccaaggccatcttccagaagcacagaatcgagcagtggaagacctggatggaggagctgatctgcaacaccaccgtggagagatgccaggagctgtacagaaagtacgagatgcagtacgccccccagcccccccccaccgtgtgccagttcatcaccgccaccgagatgaccctgcagagatacgccgccgacatcaacagcagactgatcagacaggtggagagactgaagcaggaggccgtgaccgtgcccgtgtgcgaggaccagctgaaggagatcgagagatgcatcaaggtgttcctgcacgagaacggcgaggagggcagcctgagcctggccagcgtgatcatcagcgccctgtgcaccctgaccagaagaaacctgatgatggagggcgccgccagcagcgccggcgagcagctggtggacctgaccagcagagacggcgcctggttcctggaggagctgtgcagcatgagcggcaacgtgacctgcctggtgcagctgctgaagcagtgccacctggtgccccaggacctggacatccccaaccccatggaggccagcgagaccgtgcacctggccaacggcgtgtacaccagcctgcaggagctgaacagcaacttcagacagatcatcttccccgaggccctgagatgcctgatgaagggcgagtacaccctggagagcatgctgcacgagctggacggcctgatcgagcagaccaccgacggcgtgcccctgcagaccctggtggagagcctgcaggcctacctgagaaacgccgccatgggcctggaggaggagacccacgcccactacatcgacgtggccagactgctgcacgcccagtacggcgagctgatccagcccagaaacggcagcgtggacgagacccccaagatgagcgccggccagatgctgctggtggccttcgacggcatgttcgcccaggtggagaccgccttcagcctgctggtggagaagctgaacaagatggagatccccatcgcctggagaaagatcgacatcatcagagaggccagaagcacccaggtgaacttcttcgacgacgacaaccacagacaggtgctggaggagatcttcttcctgaagagactgcagaccatcaaggagttcttcagactgtgcggcaccttcagcaagaccctgagcggcagcagcagcctggaggaccagaacaccgtgaacggccccgtgcagatcgtgaacgtgaagaccctgttcagaaacagctgcttcagcgaggaccagatggccaagcccatcaaggccttcaccgccgacttcgtgagacagctgctgatcggcctgcccaaccaggccctgggcctgaccctgtgcagcttcatcagcgccctgggcgtggacatcatcgcccaggtggaggccaaggacttcggcgccgagagcaaggtgagcgtggacgacctgtgcaagaaggccgtggagcacaacatccagatcggcaagttcagccagctggtgatgaacagagccaccgtgctggccagcagctacgacaccgcctggaagaagcacgacctggtgagaagactggagaccagcatcagcagctgcaagaccagcctgcagagagtgcagctgcacatcgccatgttccagcagtggcagcacgaggacctgctgatcaacagaccccaggccatgagcgtgacccccccccccagaagcgccatcctgaccagcatgaagaagaagctgcacaccctgagccagatcgagaccagcatcgccaccgtgcaggagaagctggccgccctggagagcagcatcgagcagagactgaagtgggccggcggcgccaaccccgccctggcccccgtgctgcaggacttcgaggccaccatcgccgagagaagaaacctggtgctgaaggagagccagagagccagccaggtgaccttcctgtgcagcaacatcatccacttcgagagcctgagaaccagaaccgccgaggccctgaacctggacgccgccctgttcgagctgatcaagagatgccagcagatgtgcagcttcgccagccagttcaacagcagcgtgagcgagctggagctgagactgctgcagagagtggacaccggcctggagcaccccatcggcagcagcgagtggctgctgagcgcccacaagcagctgacccaggacatgagcacccagagagccatccagaccgagaaggagcagcagatcgagaccgtgtgcgagaccatccagaacctggtggacaacatcaagaccgtgctgaccggccacaacagacagctgggcgacgtgaagcacctgctgaaggccatggccaaggacgaggaggccgccctggccgacggcgaggacgtgccctacgagaacagcgtgagacagttcctgggcgagtacaagagctggcaggacaacatccagaccgtgctgttcaccctggtgcaggccatgggccaggtgagaagccaggagcacgtggagatgctgcaggagatcacccccaccctgaaggagctgaagacccagagccagagcatctacaacaacctggtgagcttcgccagccccctggtgaccgacgccaccaacgagtgcagcagccccaccagcagcgccacctaccagcccagcttcgccgccgccgtgagaagcaacaccggccagaagacccagcccgacgtgatgagccagaacgccagaaagctgatccagaagaacctggccaccagcgccgacaccccccccagcaccgtgcccggcaccggcaagagcgtggcctgcagccccaagaaggccgtgagagaccccaagaccggcaaggccgtgcaggagagaaacagctacgccgtgagcgtgtggaagagagtgaaggccaagctggagggcagagacgtggaccccaacagaagaatgagcgtggccgagcaggtggactacgtgatcaaggaggccaccaacctggacaacctggcccagctgtacgagggctggaccgcctgggtgtag

SEQ ID NO: 99223 - DNA, 10986 bp, Artificial Sequence
  Description of Artificial Sequence: Synthetic coding sequence
atgagcagaagagcccccggcagcagactgagcagcggcggcggcggcggcggcaccaagtaccccagaagctggaacgactggcagcccagaaccgacagcgccagcgccgaccccgacaacctgaagtacagcagcagcagagacagaggcggcagcagcagctacggcctgcagcccagcaacagcgccgtggtgagcagacagagacacgacgacaccagagtgcacgccgacatccagaacgacgagaagggcggctacagcgtgaacggcggcagcggcgagaacacctacggcagaaagagcctgggccaggagctgagagtgaacaacgtgaccagccccgagttcaccagcgtgcagcacggcagcagagccctggccaccaaggacatgagaaagagccaggagagaagcatgagctacagcgacgagagcagactgagcaacctgctgagaagaatcaccagagaggacgacagagacagaagactggccaccgtgaagcagctgaaggagttcatccagcagcccgagaacaagctggtgctggtgaagcagctggacaacatcctggccgccgtgcacgacgtgctgaacgagagcagcaagctgctgcaggagctgagacaggagggcgcctgctgcctgggcctgctgtgcgccagcctgagctacgaggccgagaagatcttcaagtggatcttcagcaagttcagcagcagcgccaaggacgaggtgaagctgctgtacctgtgcgccacctacaaggccctggagaccgtgggcgagaagaaggccttcagcagcgtgatgcagctggtgatgaccagcctgcagagcatcctggagaacgtggacacccccgagctgctgtgcaagtgcgtgaagtgcatcctgctggtggccagatgctacccccacatcttcagcaccaacttcagagacaccgtggacatcctggtgggctggcacatcgaccacacccagaagcccagcctgacccagcaggtgagcggctggctgcagagcctggagcccttctgggtggccgacctggccttcagcaccaccctgctgggccagttcctggaggacatggaggcctacgccgaggacctgagccacgtggccagcggcgagagcgtggacgaggacgtgcccccccccagcgtgagcctgcccaagctggccgccctgctgagagtgttcagcaccgtggtgagaagcatcggcgagagattcagccccatcagaggcccccccatcaccgaggcctacgtgaccgacgtgctgtacagagtgatgagatgcgtgaccgccgccaaccaggtgttcttcagcgaggccgtgctgaccgccgccaacgagtgcgtgggcgtgctgctgggcagcctggaccccagcatgaccatccactgcgacatggtgatcacctacggcctggaccagctggagaactgccagacctgcggcaccgactacatcatcagcgtgctgaacctgctgaccctgatcgtggagcagatcaacaccaagctgcccagcagcttcgtggagaagctgttcatccccagcagcaagctgctgttcctgagataccacaaggagaaggaggtggtggccgtggcccacgccgtgtaccaggccgtgctgagcctgaagaacatccccgtgctggagaccgcctacaagctgatcctgggcgagatgacctgcgccctgaacaacctgctgcacagcctgcagctgcccgaggcctgcagcgagatcaagcacgaggccttcaagaaccacgtgttcaacgtggacaacgccaagttcgtggtgatcttcgacctgagcgccctgaccaccatcggcaacgccaagaacagcctgatcggcatgtgggccctgagccccaccgtgttcgccctgctgagcaagaacctgatgatcgtgcacagcgacctggccgtgcacttccccgccatccagtacgccgtgctgtacaccctgtacagccactgcaccagacacgaccacttcatcagcagcagcctgagcagcagcagccccagcctgttcgacggcgccgtgatcagcaccgtgaccaccgccaccaagaagcacttcagcatcatcctgaacctgctgggcatcctgctgaagaaggacaacctgaaccaggacaccagaaagctgctgatgacctgggccctggaggccgccgtgctgatgaagaagagcgagacctacgcccccctgttcagcctgcccagcttccacaagttctgcaagggcctgctggccaacaccctggtggaggacgtgaacatctgcctgcaggcctgcagcagcctgcacgccctgagcagcagcctgcccgacgacctgctgcagagatgcgtggacgtgtgcagagtgcagctggtgcacagcggcaccagaatcagacaggccttcggcaagctgctgaagagcatccccctggacgtggtgctgagcaacaacaaccacaccgagatccaggagatcagcctggccctgagaagccacatgagcaaggcccccagcaacaccttccacccccaggacttcagcgacgtgatcagcttcatcctgtacggcaacagccacagaaccggcaaggacaactggctggagagactgttctacagctgccagagactggacaagagagaccagagcaccatccccagaaacctgctgaagaccgacgccgtgctgtggcagtgggccatctgggaggccgcccagttcaccgtgctgagcaagctgagaacccccctgggcagagcccaggacaccttccagaccatcgagggcatcatcagaagcctggccgcccacaccctgaaccccgaccaggacgtgagccagtggaccaccgccgacaacgacgagggccacggcaacaaccagctgagactggtgctgctgctgcagtacctggagaacctggagaagctgatgtacaacgcctacgagggctgcgccaacgccctgaccagcccccccaaggtgatcagaaccttcttctacaccaacagacagacctgccaggactggctgaccagaatcagactgagcatcatgagagtgggcctgctggccggccagcccgccgtgaccgtgagacacggcttcgacctgctgaccgagatgaagaccaccagcctgagccagggcaacgagctggaggtgaccatcatgatggtggtggaggccctgtgcgagctgcactgccccgaggccatccagggcatcgccgtgtggagcagcagcatcgtgggcaagaacctgctgtggatcaacagcgtggcccagcaggccgagggcagattcgagaaggccagcgtggagtaccaggagcacctgtgcgccatgaccggcgtggactgctgcatcagcagcttcgacaagagcgtgctgaccctggccaacgccggcagaaacagcgccagccccaagcacagcctgaacggcgagagcagaaagaccgtgctgagcaagcccaccgacagcagccccgaggtgatcaactacctgggcaacaaggcctgcgagtgctacatcagcatcgccgactgggccgccgtgcaggagtggcagaacgccatccacgacctgaagaagagcaccagcagcaccagcctgaacctgaaggccgacttcaactacatcaagagcctgagcagcttcgagagcggcaagttcgtggagtgcaccgagcagctggagctgctgcccggcgagaacatcaacctgctggccggcggcagcaaggagaagatcgacatgaagaagctgctgcccaacatgctgagccccgaccccagagagctgcagaagagcatcgaggtgcagctgctgagaagcagcgtgtgcctggccaccgccctgaaccccatcgagcaggaccagaagtggcagagcatcaccgagaacgtggtgaagtacctgaagcagaccagcagaatcgccatcggccccctgagactgagcaccctgaccgtgagccagagcctgcccgtgctgagcaccctgcagctgtactgcagcagcgccctggagaacaccgtgagcaacagactgagcaccgaggactgcctgatccccctgttcagcgaggccctgagaagctgcaagcagcacgacgtgagaccctggatgcaggccctgagatacaccatgtaccagaaccagctgctggagaagatcaaggagcagaccgtgcccatcagaagccacctgatggagctgggcctgaccgccgccaagttcgccagaaagagaggcaacgtgagcctggccaccagactgctggcccagtgcagcgaggtgcagctgggcaagaccaccaccgcccaggacctggtgcagcacttcaagaagctgagcacccagggccaggtggacgagaagtggggccccgagctggacatcgagaagaccaagctgctgtacaccgccggccagagcacccacgccatggagatgctgagcagctgcgccatcagcttctgcaagagcgtgaaggccgagtacgccgtggccaagagcatcctgaccctggccaagtggatccaggccgagtggaaggagatcagcggccagctgaagcaggtgtacagagcccagcaccagcagaacttcaccggcctgagcaccctgagcaagaacatcctgaccctgatcgagctgcccagcgtgaacaccatggaggaggagtaccccagaatcgagagcgagagcaccgtgcacatcggcgtgggcgagcccgacttcatcctgggccagctgtaccacctgagcagcgtgcaggcccccgaggtggccaagagctgggccgccctggccagctgggcctacagatggggcagaaaggtggtggacaacgccagccagggcgagggcgtgagactgctgcccagagagaagagcgaggtgcagaacctgctgcccgacaccatcaccgaggaggagaaggagagaatctacggcatcctgggccaggccgtgtgcagacccgccggcatccaggacgaggacatcaccctgcagatcaccgagagcgaggacaacgaggaggacgacatggtggacgtgatctggagacagctgatcagcagctgcccctggctgagcgagctggacgagagcgccaccgagggcgtgatcaaggtgtggagaaaggtggtggacagaatcttcagcctgtacaagctgagctgcagcgcctacttcaccttcctgaagctgaacgccggccagatccccctggacgaggacgaccccagactgcacctgagccacagagtggagcagagcaccgacgacatgatcgtgatggccaccctgagactgctgagactgctggtgaagcacgccggcgagctgagacagtacctggagcacggcctggagaccacccccaccgccccctggagaggcatcatcccccagctgttcagcagactgaaccaccccgaggtgtacgtgagacagagcatctgcaacctgctgtgcagagtggcccaggacagcccccacctgatcctgtaccccgccatcgtgggcaccatcagcctgagcagcgagagccaggccagcggcaacaagttcagcaccgccatccccaccctgctgggcaacatccagggcgaggagctgctggtgagcgagtgcgagggcggcagcccccccgccagccaggacagcaacaaggacgagcccaagagcggcctgaacgaggaccaggccatgatgcaggactgctacagcaagatcgtggacaagctgagcagcgccaaccccaccatggtgctgcaggtgcagatgctggtggccgagctgagaagagtgaccgtgctgtgggacgagctgtggctgggcgtgctgctgcagcagcacatgtacgtgctgagaagaatccagcagctggaggacgaggtgaagagagtgcagaacaacaacaccctgagaaaggaggagaagatcgccatcatgagagagaagcacaccgccctgatgaagcccatcgtgttcgccctggagcacgtgagaagcatcaccgccgcccccgccgagaccccccacgagaagtggttccaggacaactacggcgacgccatcgagaacgccctggagaagctgaagacccccctgaaccccgccaagcccggcagcagctggatccccttcaaggagatcatgctgagcctgcagcagagagcccagaagagagccagctacatcctgagactggaggagatcagcccctggctggccgccatgaccaacaccgagatcgccctgcccggcgaggtgagcgccagagacaccgtgaccatccacagcgtgggcggcaccatcaccatcctgcccaccaagaccaagcccaagaagctgctgttcctgggcagcgacggcaagagctacccctacctgttcaagggcctggaggacctgcacctggacgagagaatcatgcagttcctgagcatcgtgaacaccatgttcgccaccatcaacagacaggagacccccagattccacgccagacactacagcgtgacccccctgggcaccagaagcggcctgatccagtgggtggacggcgccacccccctgttcggcctgtacaagagatggcagcagagagaggccgccctgcaggcccagaaggcccaggacagctaccagaccccccagaaccccggcatcgtgcccagacccagcgagctgtactacagcaagatcggccccgccctgaagaccgtgggcctgagcctggacgtgagcagaagagactggcccctgcacgtgatgaaggccgtgctggaggagctgatggaggccaccccccccaacctgctggccaaggagctgtggagcagctgcaccacccccgacgagtggtggagagtgacccagagctacgccagaagcaccgccgtgatgagcatggtgggctacatcatcggcctgggcgacagacacctggacaacgtgctgatcgacatgaccaccggcgaggtggtgcacatcgactacaacgtgtgcttcgagaagggcaagagcctgagagtgcccgagaaggtgcccttcagaatgacccagaacatcgagaccgccctgggcgtgaccggcgtggagggcgtgttcagactgagctgcgagcaggtgctgcacatcatgagaagaggcagagagaccctgctgaccctgctggaggccttcgtgtacgaccccctggtggactggaccgccggcggcgaggccggcttcgccggcgccgtgtacggcggcggcggccagcaggccgagagcaagcagagcaagagagagatggagagagagatcaccagaagcctgttcagcagcagagtggccgagatcaaggtgaactggttcaagaacagagacgagatgctggtggtgctgcccaagctggacggcagcctggacgagtacctgagcctgcaggagcagctgaccgacgtggagaagctgcagggcaagctgctggaggagatcgagttcctggagggcgccgagggcgtggaccaccccagccacaccctgcagcacagatacagcgagcacacccagctgcagacccagcagagagccgtgcaggaggccatccaggtgaagctgaacgagttcgagcagtggatcacccactaccaggccgccttcaacaacctggaggccacccagctggccagcctgctgcaggagatcagcacccagatggacctgggcccccccagctacgtgcccgccaccgccttcctgcagaacgccggccaggcccacctgatcagccagtgcgagcagctggagggcgaggtgggcgccctgctgcagcagagaagaagcgtgctgagaggctgcctggagcagctgcaccactacgccaccgtggccctgcagtaccccaaggccatcttccagaagcacagaatcgagcagtggaagacctggatggaggagctgatctgcaacaccaccgtggagagatgccaggagctgtacagaaagtacgagatgcagtacgccccccagcccccccccaccgtgtgccagttcatcaccgccaccgagatgaccctgcagagatacgccgccgacatcaacagcagactgatcagacaggtggagagactgaagcaggaggccgtgaccgtgcccgtgtgcgaggaccagctgaaggagatcgagagatgcatcaaggtgttcctgcacgagaacggcgaggagggcagcctgagcctggccagcgtgatcatcagcgccctgtgcaccctgaccagaagaaacctgatgatggagggcgccgccagcagcgccggcgagcagctggtggacctgaccagcagagacggcgcctggttcctggaggagctgtgcagcatgagcggcaacgtgacctgcctggtgcagctgctgaagcagtgccacctggtgccccaggacctggacatccccaaccccatggaggccagcgagaccgtgcacctggccaacggcgtgtacaccagcctgcaggagctgaacagcaacttcagacagatcatcttccccgaggccctgagatgcctgatgaagggcgagtacaccctggagagcatgctgcacgagctggacggcctgatcgagcagaccaccgacggcgtgcccctgcagaccctggtggagagcctgcaggcctacctgagaaacgccgccatgggcctggaggaggagacccacgcccactacatcgacgtggccagactgctgcacgcccagtacggcgagctgatccagcccagaaacggcagcgtggacgagacccccaagatgagcgccggccagatgctgctggtggccttcgacggcatgttcgcccaggtggagaccgccttcagcctgctggtggagaagctgaacaagatggagatccccatcgcctggagaaagatcgacatcatcagagaggccagaagcacccaggtgaacttcttcgacgacgacaaccacagacaggtgctggaggagatcttcttcctgaagagactgcagaccatcaaggagttcttcagactgtgcggcaccttcagcaagaccctgagcggcagcagcagcctggaggaccagaacaccgtgaacggccccgtgcagatcgtgaacgtgaagaccctgttcagaaacagctgcttcagcgaggaccagatggccaagcccatcaaggccttcaccgccgacttcgtgagacagctgctgatcggcctgcccaaccaggccctgggcctgaccctgtgcagcttcatcagcgccctgggcgtggacatcatcgcccaggtggaggccaaggacttcggcgccgagagcaaggtgagcgtggacgacctgtgcaagaaggccgtggagcacaacatccagatcggcaagttcagccagctggtgatgaacagagccaccgtgctggccagcagctacgacaccgcctggaagaagcacgacctggtgagaagactggagaccagcatcagcagctgcaagaccagcctgcagagagtgcagctgcacatcgccatgttccagtggcagcacgaggacctgctgatcaacagaccccaggccatgagcgtgacccccccccccagaagcgccatcctgaccagcatgaagaagaagctgcacaccctgagccagatcgagaccagcatcgccaccgtgcaggagaagctggccgccctggagagcagcatcgagcagagactgaagtgggccggcggcgccaaccccgccctggcccccgtgctgcaggacttcgaggccaccatcgccgagagaagaaacctggtgctgaaggagagccagagagccagccaggtgaccttcctgtgcagcaacatcatccacttcgagagcctgagaaccagaaccgccgaggccctgaacctggacgccgccctgttcgagctgatcaagagatgccagcagatgtgcagcttcgccagccagttcaacagcagcgtgagcgagctggagctgagactgctgcagagagtggacaccggcctggagcaccccatcggcagcagcgagtggctgctgagcgcccacaagcagctgacccaggacatgagcacccagagagccatccagaccgagaaggagcagcagatcgagaccgtgtgcgagaccatccagaacctggtggacaacatcaagaccgtgctgaccggccacaacagacagctgggcgacgtgaagcacctgctgaaggccatggccaaggacgaggaggccgccctggccgacggcgaggacgtgccctacgagaacagcgtgagacagttcctgggcgagtacaagagctggcaggacaacatccagaccgtgctgttcaccctggtgcaggccatgggccaggtgagaagccaggagcacgtggagatgctgcaggagatcacccccaccctgaaggagctgaagacccagagccagagcatctacaacaacctggtgagcttcgccagccccctggtgaccgacgccaccaacgagtgcagcagccccaccagcagcgccacctaccagcccagcttcgccgccgccgtgagaagcaacaccggccagaagacccagcccgacgtgatgagccagaacgccagaaagctgatccagaagaacctggccaccagcgccgacaccccccccagcaccgtgcccggcaccggcaagagcgtggcctgcagccccaagaaggccgtgagagaccccaagaccggcaaggccgtgcaggagagaaacagctacgccgtgagcgtgtggaagagagtgaaggccaagctggagggcagagacgtggaccccaacagaagaatgagcgtggccgagcaggtggactacgtgatcaaggaggccaccaacctggacaacctggcccagctgtacgagggctggaccgcctgggtgtag

SEQ ID NO: 99224 - DNA, 3051 bp, Artificial Sequence
  Description of Artificial Sequence: Synthetic coding sequence
atgagccagggcccccccaccggcgagagcagcgagcccgaggccaaggtgctgcacaccaagagactgtacagagccgtggtggaggccgtgcacagactggacctgatcctgtgcaacaagaccgcctaccaggaggtgttcaagcccgagaacatcagcctgagaaacaagctgagagagctgtgcgtgaagctgatgttcctgcaccccgtggactacggcagaaaggccgaggagctgctgtggagaaaggtgtactacgaggtgatccagctgatcaagaccaacaagaagcacatccacagcagaagcaccctggagtgcgcctacagaacccacctggtggccggcatcggcttctaccagcacctgctgctgtacatccagagccactaccagctggagctgcagtgctgcatcgactggacccacgtgaccgaccccctgatcggctgcaagaagcccgtgagcgccagcggcaaggagatggactgggcccagatggcctgccacagatgcctggtgtacctgggcgacctgagcagataccagaacgagctggccggcgtggacaccgagctgctggccgagagattctactaccaggccctgagcgtggccccccagatcggcatgcccttcaaccagctgggcaccctggccggcagcaagtactacaacgtggaggccatgtactgctacctgagatgcatccagagcgaggtgagcttcgagggcgcctacggcaacctgaagagactgtacgacaaggccgccaagatgtaccaccagctgaagaagtgcgagaccagaaagctgagccccggcaagaagagatgcaaggacatcaagagactgctggtgaacttcatgtacctgcagagcctgctgcagcccaagagcagcagcgtggacagcgagctgaccagcctgtgccagagcgtgctggaggacttcaacctgtgcctgttctacctgcccagcagccccaacctgagcctggccagcgaggacgaggaggagtacgagagcggctacgccttcctgcccgacctgctgatcttccagatggtgatcatctgcctgatgtgcgtgcacagcctggagagagccggcagcaagcagtacagcgccgccatcgccttcaccctggccctgttcagccacctggtgaaccacgtgaacatcagactgcaggccgagctggaggagggcgagaaccccgtgcccgccttccagagcgacggcaccgacgagcccgagagcaaggagcccgtggagaaggaggaggagcccgaccccgagcccccccccgtgaccccccaggtgggcgagggcagaaagagcagaaagttcagcagactgagctgcctgagaagaagaagacacccccccaaggtgggcgacgacagcgacctgagcgagggcttcgagagcgacagcagccacgacagcgccagagccagcgagggcagcgacagcggcagcgacaagagcctggagggcggcggcaccgccttcgacgccgagaccgacagcgagatgaacagccaggagagcagaagcgacctggaggacatggaggaggaggagggcaccagaagccccaccctggagccccccagaggcagaagcgaggcccccgacagcctgaacggccccctgggccccagcgaggccagcatcgccagcaacctgcaggccatgagcacccagatgttccagaccaagagatgcttcagactggcccccaccttcagcaacctgctgctgcagcccaccaccaacccccacaccagcgccagccacagaccctgcgtgaacggcgacgtggacaagcccagcgagcccgccagcgaggagggcagcgagagcgagggcagcgagagcagcggcagaagctgcagaaacgagagaagcatccaggagaagctgcaggtgctgatggccgagggcctgctgcccgccgtgaaggtgttcctggactggctgagaaccaaccccgacctgatcatcgtgtgcgcccagagcagccagagcctgtggaacagactgagcgtgctgctgaacctgctgcccgccgccggcgagctgcaggagagcggcctggccctgtgccccgaggtgcaggacctgctggagggctgcgagctgcccgacctgcccagcagcctgctgctgcccgaggacatggccctgagaaacctgccccccctgagagccgcccacagaagattcaacttcgacaccgacagacccctgctgagcaccctggaggagagcgtggtgagaatctgctgcatcagaagcttcggccacttcatcgccagactgcagggcagcatcctgcagttcaaccccgaggtgggcatcttcgtgagcatcgcccagagcgagcaggagagcctgctgcagcaggcccaggcccagttcagaatggcccaggaggaggccagaagaaacagactgatgagagacatggcccagctgagactgcagctggaggtgagccagctggagggcagcctgcagcagcccaaggcccagagcgccatgagcccctacctggtgcccgacacccaggccctgtgccaccacctgcccgtgatcagacagctggccaccagcggcagattcatcgtgatcatccccagaaccgtgatcgacggcctggacctgctgaagaaggagcaccccggcgccagagacggcatcagatacctggaggccgagttcaagaagggcaacagatacatcagatgccagaaggaggtgggcaagagcttcgagagacacaagctgaagagacaggacgccgacgcctggaccctgtacaagatcctggacagctgcaagcagctgaccctggcccagggcgccggcgaggaggaccccagcggcatggtgaccatcatcaccggcctgcccctggacaaccccagcgtgctgagcggccccatgcaggccgccctgcaggccgccgcccacgccagcgtggacatcaagaacgtgctggacttctacaagcagtggaaggagatcggctag

SEQ ID NO: 99225 - DNA, 1125 bp, Artificial Sequence
  Description of Artificial Sequence: Synthetic coding sequence
atgagccagggcccccccaccggcgagagcagcgagcccgaggccaaggtgctgcacaccaagagactgtacagagccgtggtggaggccgtgcacagactggacctgatcctgtgcaacaagaccgcctaccaggaggtgttcaagcccgagaacatcagcctgagaaacaagctgagagagctgtgcgtgaagctgatgttcctgcaccccgtggactacggcagaaaggccgaggagctgctgtggagaaaggtgtactacgaggtgatccagctgatcaagaccaacaagaagcacatccacagcagaagcaccctggagtgcgcctacagaacccacctggtggccggcatcggcttctaccagcacctgctgctgtacatccagagccactaccagctggagctgcagtgctgcatcgactggacccacgtgaccgaccccctgatcggctgcaagaagcccgtgagcgccagcggcaaggagatggactgggcccagatggcctgccacagatgcctggtgtacctgggcgacctgagcagataccagaacgagctggccggcgtggacaccgagctgctggccgagagattctactaccaggccctgagcgtggccccccagatcggcatgcccttcaaccagctgggcaccctggccggcagcaagtactacaacgtggaggccatgtactgctacctgagatgcatccagagcgaggtgagcttcgagggcgcctacggcaacctgaagagactgtacgacaaggccgccaagatgtaccaccagctgaagaagtgcgagaccagaaagctgagccccggcaagaagagatgcaaggacatcaagagactgctggtgaacttcatgtacctgcagagcctgctgcagcccaagagcagaggctgcaccagccactgccccaccagcgccctgtgcctgcccctgagcagcttccagggcagagagcaggccccccccagagccgccggcagcctggcctgcgccagcaccgtgagctgcgcccaccagccccacagatgctgcgccctgtgcagctggctgctgtgctgggacagaatgggctgccaggaggagaagaagggcggcgccgtgtag

SEQ ID NO: 99226 - DNA, 417 bp, Artificial Sequence
  Description of Artificial Sequence: Synthetic coding sequence
tgattcatcgtgatcatccccagaaccgtgatcgacggcctggacctgctgaagaaggagcaccccggcgccagagacggcatcagatacctggaggccgagttcaagaagggcaacagatacatcagatgccagaaggaggtgggcaagagcttcgagagacacaagctgaagagacaggacgccgacgcctggaccctgtacaagatcctggacagctgcaagcagctgaccctggcccagggcgccggcgaggaggaccccagcggcatggtgaccatcatcaccggcctgcccctggacaaccccagcgtgctgagcggccccatgcaggccgccctgcaggccgccgcccacgccagcgtggacatcaagaacgtgctggacttctacaagcagtggaaggagatcggctag

SEQ ID NO: 99227 - DNA, 3438 bp, Artificial Sequence
  Description of Artificial Sequence: Synthetic coding sequence
atgctggtgaccgacctggagtacgccctggacaagaaggtggagcaggacctgtggaaccacgccttcaagaaccagatcaccaccctgcagggccaggccaagaacagagccaaccccaacagaagcgaggtgcaggccaacctgagcctgttcctggaggccgccagcggcttctacacccagctgctgcaggagctgtgcaccgtgttcaacgtggacctgccctgcagagtgaagagcagccagctgggcatcatcagcaacaagcagacccacaccagcgccatcgtgaagccccagagcagcagctgcagctacatctgccagcactgcctggtgcacctgggcgacatcgccagatacagaaaccagaccagccaggccgagagctactacagacacgccgcccagctggtgcccagcaacggccagccctacaaccagctggccatcctggccagcagcaagggcgaccacctgaccaccatcttctactactgcagaagcatcgccgtgaagttccccttccccgccgccagcaccaacctgcagaaggccctgagcaaggccctggagagcagagacgaggtgaagaccaagtggggcgtgagcgacttcatcaaggccttcatcaagttccacggccacgtgtacctgagcaagagcctggagaagctgagccccctgagagagaagctggaggagcagttcaagagactgctgttccagaaggccttcaacagccagcagctggtgcacgtgaccgtgatcaacctgttccagctgcaccacctgagagacttcagcaacgagaccgagcagcacacctacagccaggacgagcagctgtgctggacccagctgctggccctgttcatgagcttcctgggcatcctgtgcaagtgccccctgcagaacgagagccaggaggagagctacaacgcctaccccctgcccgccgtgaaggtgagcatggactggctgagactgagacccagagtgttccaggaggccgtggtggacgagagacagtacatctggccctggctgatcagcctgctgaacagcttccacccccacgaggaggacctgagcagcatcagcgccacccccctgcccgaggagttcgagctgcagggcttcctggccctgagacccagcttcagaaacctggacttcagcaagggccaccagggcatcaccggcgacaaggagggccagcagagaagaatcagacagcagagactgatcagcatcggcaagtggatcgccgacaaccagcccagactgatccagtgcgagaacgaggtgggcaagctgctgttcatcaccgagatccccgagctgatcctggaggaccccagcgaggccaaggagaacctgatcctgcaggagaccagcgtgatcgagagcctggccgccgacggcagccccggcctgaagagcgtgctgagcaccagcagaaacctgagcaacaactgcgacaccggcgagaagcccgtggtgaccttcaaggagaacatcaagaccagagaggtgaacagagaccagggcagaagcttcccccccaaggaggtgagaagagactacagcaagggcatcaccgtgaccaagaacgacggcaagaaggacaacaacaagagaaagaccgagaccaagaagtgcaccctggagaagctgcaggagaccggcaagcagaacgtggccgtgcaggtgaagagccagaccgagctgagaaagacccccgtgagcgaggccagaaagacccccgtgacccagacccccacccaggccagcaacagccagttcatccccatccaccaccccggcgccttcccccccctgcccagcagacccggcttccccccccccacctacgtgatccccccccccgtggccttcagcatgggcagcggctacaccttccccgccggcgtgagcgtgcccggcaccttcctgcagcccaccgcccacagccccgccggcaaccaggtgcaggccggcaagcagagccacatcccctacagccagcagagacccagcggccccggccccatgaaccagggcccccagcagagccagccccccagccagcagcccctgaccagcctgcccgcccagcccaccgcccagagcaccagccagctgcaggtgcaggccctgacccagcagcagcagagccccaccaaggccgtgcccgccctgggcaagagccccccccaccacagcggcttccagcagtaccagcaggccgacgccagcaagcagctgtggaaccccccccaggtgcagggccccctgggcaagatcatgcccgtgaagcagccctactacctgcagacccaggaccccatcaagctgttcgagcccagcctgcagccccccgtgatgcagcagcagcccctggagaagaagatgaagcccttccccatggagccctacaaccacaaccccagcgaggtgaaggtgcccgagttctactgggacagcagctacagcatggccgacaacagaagcgtgatggcccagcaggccaacatcgacagaagaggcaagagaagccccggcgtgttcagacccgagcaggaccccgtgcccagaatgcccttcgaggaccccaagagcagccccctgctgccccccgacctgctgaagagcctggccgccctggaggaggaggaggagctgatcttcagcaacccccccgacctgtaccccgccctgctgggccccctggccagcctgcccggcagaagcctgttcaagagcctgctggagaagcccagcgagctgatgagccacagcagcagcttcctgagcctgaccggcttcagcctgaaccaggagagataccccaacaacagcatgttcaacgaggtgtacggcaagaacctgaccagcagcagcaaggccgagctgagccccagcatggccccccaggagaccagcctgtacagcctgttcgagggcaccccctggagccccagcctgcccgccagcagcgaccacagcacccccgccagccagagcccccacagcagcaaccccagcagcctgcccagcagcccccccacccacaaccacaacagcgtgcccttcagcaacttcggccccatcggcacccccgacaacagagacagaagaaccgccgacagatggaagaccgacaagcccgccatgggcggcttcggcatcgactacctgagcgccaccagcagcagcgagagcagctggcaccaggccagcacccccagcggcacctggaccggccacggccccagcatggaggacagcagcgccgtgctgatggagagcctgaagagcatctggagcagcagcatgatgcaccccggccccagcgccctggagcagctgctgatgcagcagaagcagaagcagcagagaggccagggcaccatgaaccccccccactag

SEQ ID NO: 99228 - DNA, 3414 bp, Artificial Sequence
  Description of Artificial Sequence: Synthetic coding sequence
atgagcctgcagagcgcccagtacctgagacaggccgaggtgctgaaggccgacatgaccgacagcaagctgggccccgccgaggtgtggaccagcagacaggccctgcaggacctgtaccagaagatgctggtgaccgacctggagtacgccctggacaagaaggtggagcaggacctgtggaaccacgccttcaagaaccagatcaccaccctgcagggccaggccaagaacagagccaaccccaacagaagcgaggtgcaggccaacctgagcctgttcctggaggccgccagcggcttctacacccagctgctgcaggagctgtgcaccgtgttcaacgtggacctgccctgcagagtgaagagcagccagctgggcatcatcagcaacaagcagacccacaccagcgccatcgtgaagccccagagcagcagctgcagctacatctgccagcactgcctggtgcacctgggcgacatcgccagatacagaaaccagaccagccaggccgagagctactacagacacgccgcccagctggtgcccagcaacggccagccctacaaccagctggccatcctggccagcagcaagggcgaccacctgaccaccatcttctactactgcagaagcatcgccgtgaagttccccttccccgccgccagcaccaacctgcagaaggccctgagcaaggccctggagagcagagacgaggtgaagaccaagtggggcgtgagcgacttcatcaaggccttcatcaagttccacggccacgtgtacctgagcaagagcctggagaagctgagccccctgagagagaagctggaggagcagttcaagagactgctgttccagaaggccttcaacagccagcagctggtgcacgtgaccgtgatcaacctgttccagctgcaccacctgagagacttcagcaacgagaccgagcagcacacctacagccaggacgagcagctgtgctggacccagctgctggccctgttcatgagcttcctgggcatcctgtgcaagtgccccctgcagaacgagagccaggaggagagctacaacgcctaccccctgcccgccgtgaaggtgagcatggactggctgagactgagacccagagtgttccaggaggccgtggtggacgagagacagtacatctggccctggctgatcagcctgctgaacagcttccacccccacgaggaggacctgagcagcatcagcgccacccccctgcccgaggagttcgagctgcagggcttcctggccctgagacccagcttcagaaacctggacttcagcaagggccaccagggcatcaccggcgacaaggagggccagcagagaagaatcagacagcagagactgatcagcatcggcaagtggatcgccgacaaccagcccagactgatccagtgcgagaacgaggtgggcaagctgctgttcatcaccgagatccccgagctgatcctggaggaccccagcgaggccaaggagaacctgatcctgcaggagaccagcgtgatcgagagcctggccgccgacggcagccccggcctgaagagcgtgctgagcaccagcagaaacctgagcaacaactgcgacaccggcgagaagcccgtggtgaccttcaaggagaacatcaagaccagagaggtgaacagagaccagggcagaagcttcccccccaaggaggtgagaagagactacagcaagggcatcaccgtgaccaagaacgacggcaagaaggacaacaacaagagaaagaccgagaccaagaagtgcaccctggagaagctgcaggagaccggcaagcagaacgtggccgtgcaggtgaagagccagaccgagctgagaaagacccccgtgagcgaggccagaaagacccccgtgacccagacccccacccaggccagcaacagccagttcatccccatccaccaccccggcgccttcccccccctgcccagcagacccggcttccccccccccacctacgtgatccccccccccgtggccttcagcatgggcagcggctacaccttccccgccggcgtgagcgtgcccggcaccttcctgcagcccaccgcccacagccccgccggcaaccaggtgcaggccggcaagcagagccacatcccctacagccagcagagacccagcggccccggccccatgaaccagggcccccagcagagccagccccccagccagcagcccctgaccagcctgcccgcccagcccaccgcccagagcaccagccagctgcaggtgcaggccctgacccagcagcagcagagccccaccaaggccgtgcccgccctgggcaagagccccccccaccacagcggcttccagcagtaccagcaggccgacgccagcaagcagctgtggaaccccccccaggtgcagggccccctgggcaagatcatgcccgtgaagcagccctactacctgcagacccaggaccccatcaagctgttcgagcccagcctgcagccccccgtgatgcagcagcagcccctggagaagaagatgaagcccttccccatggagccctacaaccacaaccccagcgaggtgaaggtgcccgagttctactgggacagcagctacagcatggccgacaacagaagcgtgatggcccagcaggccaacatcgacagaagaggcaagagaagccccggcgtgttcagacccgagcaggaccccgtgcccagaatgcccttcgagaagagcctgctggagaagcccagcgagctgatgagccacagcagcagcttcctgagcctgaccggcttcagcctgaaccaggagagataccccaacaacagcatgttcaacgaggtgtacggcaagaacctgaccagcagcagcaaggccgagctgagccccagcatggccccccaggagaccagcctgtacagcctgttcgagggcaccccctggagccccagcctgcccgccagcagcgaccacagcacccccgccagccagagcccccacagcagcaaccccagcagcctgcccagcagcccccccacccacaaccacaacagcgtgcccttcagcaacttcggccccatcggcacccccgacaacagagacagaagaaccgccgacagatggaagaccgacaagcccgccatgggcggcttcggcatcgactacctgagcgccaccagcagcagcgagagcagctggcaccaggccagcacccccagcggcacctggaccggccacggccccagcatggaggacagcagcgccgtgctgatggagagcctgaagagcatctggagcagcagcatgatgcaccccggccccagcgccctggagcagctgctgatgcagcagaagcagaagcagcagagaggccagggcaccatgaaccccccccactag

SEQ ID NO: 99229 - DNA, 3513 bp, Artificial Sequence
  Description of Artificial Sequence: Synthetic coding sequence
atgagaaactggatgttcctgcagatcgtgatcgtgggcgagaacgtgagcttcaagagccagatgagaaccgagaacctgaagagcgaggagcacctgaagagcagcaacatcagacaggccgaggtgctgaaggccgacatgaccgacagcaagctgggccccgccgaggtgtggaccagcagacaggccctgcaggacctgtaccagaagatgctggtgaccgacctggagtacgccctggacaagaaggtggagcaggacctgtggaaccacgccttcaagaaccagatcaccaccctgcagggccaggccaagaacagagccaaccccaacagaagcgaggtgcaggccaacctgagcctgttcctggaggccgccagcggcttctacacccagctgctgcaggagctgtgcaccgtgttcaacgtggacctgccctgcagagtgaagagcagccagctgggcatcatcagcaacaagcagacccacaccagcgccatcgtgaagccccagagcagcagctgcagctacatctgccagcactgcctggtgcacctgggcgacatcgccagatacagaaaccagaccagccaggccgagagctactacagacacgccgcccagctggtgcccagcaacggccagccctacaaccagctggccatcctggccagcagcaagggcgaccacctgaccaccatcttctactactgcagaagcatcgccgtgaagttccccttccccgccgccagcaccaacctgcagaaggccctgagcaaggccctggagagcagagacgaggtgaagaccaagtggggcgtgagcgacttcatcaaggccttcatcaagttccacggccacgtgtacctgagcaagagcctggagaagctgagccccctgagagagaagctggaggagcagttcaagagactgctgttccagaaggccttcaacagccagcagctggtgcacgtgaccgtgatcaacctgttccagctgcaccacctgagagacttcagcaacgagaccgagcagcacacctacagccaggacgagcagctgtgctggacccagctgctggccctgttcatgagcttcctgggcatcctgtgcaagtgccccctgcagaacgagagccaggaggagagctacaacgcctaccccctgcccgccgtgaaggtgagcatggactggctgagactgagacccagagtgttccaggaggccgtggtggacgagagacagtacatctggccctggctgatcagcctgctgaacagcttccacccccacgaggaggacctgagcagcatcagcgccacccccctgcccgaggagttcgagctgcagggcttcctggccctgagacccagcttcagaaacctggacttcagcaagggccaccagggcatcaccggcgacaaggagggccagcagagaagaatcagacagcagagactgatcagcatcggcaagtggatcgccgacaaccagcccagactgatccagtgcgagaacgaggtgggcaagctgctgttcatcaccgagatccccgagctgatcctggaggaccccagcgaggccaaggagaacctgatcctgcaggagaccagcgtgatcgagagcctggccgccgacggcagccccggcctgaagagcgtgctgagcaccagcagaaacctgagcaacaactgcgacaccggcgagaagcccgtggtgaccttcaaggagaacatcaagaccagagaggtgaacagagaccagggcagaagcttcccccccaaggaggtgaagagccagaccgagctgagaaagacccccgtgagcgaggccagaaagacccccgtgacccagacccccacccaggccagcaacagccagttcatccccatccaccaccccggcgccttcccccccctgcccagcagacccggcttccccccccccacctacgtgatccccccccccgtggccttcagcatgggcagcggctacaccttccccgccggcgtgagcgtgcccggcaccttcctgcagcccaccgcccacagccccgccggcaaccaggtgcaggccggcaagcagagccacatcccctacagccagcagagacccagcggccccggccccatgaaccagggcccccagcagagccagccccccagccagcagcccctgaccagcctgcccgcccagcccaccgcccagagcaccagccagctgcaggtgcaggccctgacccagcagcagcagagccccaccaaggccgtgcccgccctgggcaagagccccccccaccacagcggcttccagcagtaccagcaggccgacgccagcaagcagctgtggaaccccccccaggtgcagggccccctgggcaagatcatgcccgtgaagcagccctactacctgcagacccaggaccccatcaagctgttcgagcccagcctgcagccccccgtgatgcagcagcagcccctggagaagaagatgaagcccttccccatggagccctacaaccacaaccccagcgaggtgaaggtgcccgagttctactgggacagcagctacagcatggccgacaacagaagcgtgatggcccagcaggccaacatcgacagaagaggcaagagaagccccggcgtgttcagacccgagcaggaccccgtgcccagaatgcccttcgaggaccccaagagcagccccctgctgccccccgacctgctgaagagcctggccgccctggaggaggaggaggagctgatcttcagcaacccccccgacctgtaccccgccctgctgggccccctggccagcctgcccggcagaagcctgttcaagagcctgctggagaagcccagcgagctgatgagccacagcagcagcttcctgagcctgaccggcttcagcctgaaccaggagagataccccaacaacagcatgttcaacgaggtgtacggcaagaacctgaccagcagcagcaaggccgagctgagccccagcatggccccccaggagaccagcctgtacagcctgttcgagggcaccccctggagccccagcctgcccgccagcagcgaccacagcacccccgccagccagagcccccacagcagcaaccccagcagcctgcccagcagcccccccacccacaaccacaacagcgtgcccttcagcaacttcggccccatcggcacccccgacaacagagacagaagaaccgccgacagatggaagaccgacaagcccgccatgggcggcttcggcatcgactacctgagcgccaccagcagcagcgagagcagctggcaccaggccagcacccccagcggcacctggaccggccacggccccagcatggaggacagcagcgccgtgctgatggagagcctgaagagcatctggagcagcagcatgatgcaccccggccccagcgccctggagcagctgctgatgcagcagaagcagaagcagcagagaggccagggcaccatgaaccccccccactag

SEQ ID NO: 99230 - DNA, 2274 bp, Artificial Sequence
  Description of Artificial Sequence: Synthetic coding sequence
atgctggtgaccgacctggagtacgccctggacaagaaggtggagcaggacctgtggaaccacgccttcaagaaccagatcaccaccctgcagggccaggccaagaacagagccaaccccaacagaagcgaggtgcaggccaacctgagcctgttcctggaggccgccagcggcttctacacccagctgctgcaggagctgtgcaccgtgttcaacgtggacctgccctgcagagtgaagagcagccagctgggcatcatcagcaacaagcagacccacaccagcgccatcgtgaagccccagagcagcagctgcagctacatctgccagcactgcctggtgcacctgggcgacatcgccagatacagaaaccagaccagccaggccgagagctactacagacacgccgcccagctggtgcccagcaacggccagccctacaaccagctggccatcctggccagcagcaagggcgaccacctgaccaccatcttctactactgcagaagcatcgccgtgaagttccccttccccgccgccagcaccaacctgcagaaggccctgagcaaggccctggagagcagagacgaggtgaagaccaagtggggcgtgagcgacttcatcaaggccttcatcaagttccacggccacgtgtacctgagcaagagcctggagaagctgagccccctgagagagaagctggaggagcagttcaagagactgctgttccagaaggccttcaacagccagcagctggtgcacgtgaccgtgatcaacctgttccagctgcaccacctgagagacttcagcaacgagaccgagcagcacacctacagccaggacgagcagctgtgctggacccagctgctggccctgttcatgagcttcctgggcatcctgtgcaagtgccccctgcagaacgagagccaggaggagagctacaacgcctaccccctgcccgccgtgaaggtgagcatggactggctgagactgagacccagagtgttccaggaggccgtggtggacgagagacagtacatctggccctggctgatcagcctgctgaacagcttccacccccacgaggaggacctgagcagcatcagcgccacccccctgcccgaggagttcgagctgcagggcttcctggccctgagacccagcttcagaaacctggacttcagcaagggccaccagggcatcaccggcgacaaggagggccagcagagaagaatcagacagcagagactgatcagcatcggcaagtggatcgccgacaaccagcccagactgatccagtgcgagaacgaggtgggcaagctgctgttcatcaccgagatccccgagctgatcctggaggaccccagcgaggccaaggagaacctgatcctgcaggagaccagcgtgatcgagagcctggccgccgacggcagccccggcctgaagagcgtgctgagcaccagcagaaacctgagcaacaactgcgacaccggcgagaagcccgtggtgaccttcaaggagaacatcaagaccagagaggtgaacagagaccagggcagaagcttcccccccaaggaggtgaagagccagaccgagctgagaaagacccccgtgagcgaggccagaaagacccccgtgacccagacccccacccaggccagcaacagccagttcatccccatccaccaccccggcgccttcccccccctgcccagcagacccggcttccccccccccacctacgtgatccccccccccgtggccttcagcatgggcagcggctacaccttccccgccggcgtgagcgtgcccggcaccttcctgcagcccaccgcccacagccccgccggcaaccaggtgcaggccggcaagcagagccacatcccctacagccagcagagacccagcggccccggccccatgaaccagggcccccagcagagccagccccccagccagcagcccctgaccagcctgcccgcccagcccaccgcccagagcaccagccagctgcaggtgcaggccctgacccagcagcagcagagccccaccaaggccgtgcccgccctgggcaagagccccccccaccacagcggcttccagcagtaccagcaggccgacgccagcaagcagctgtggaaccccccccaggtgcagggccccctgggcaagatcatgcccgtgaagcagccctactacctgcagacccaggaccccatcaagctgttcgagcccagcctgcagccccccgtgatgcagcagcagcccctgtag

SEQ ID NO: 99231 - DNA, 3150 bp, Artificial Sequence
  Description of Artificial Sequence: Synthetic coding sequence
atgctggtgaccgacctggagtacgccctggacaagaaggtggagcaggacctgtggaaccacgccttcaagaaccagatcaccaccctgcagggccaggccaagaacagagccaaccccaacagaagcgaggtgcaggccaacctgagcctgttcctggaggccgccagcggcttctacacccagctgctgcaggagctgtgcaccgtgttcaacgtggacctgccctgcagagtgaagagcagccagctgggcatcatcagcaacaagcagacccacaccagcgccatcgtgaagccccagagcagcagctgcagctacatctgccagcactgcctggtgcacctgggcgacatcgccagatacagaaaccagaccagccaggccgagagctactacagacacgccgcccagctggtgcccagcaacggccagccctacaaccagctggccatcctggccagcagcaagggcgaccacctgaccaccatcttctactactgcagaagcatcgccgtgaagttccccttccccgccgccagcaccaacctgcagaaggccctgagcaaggccctggagagcagagacgaggtgaagaccaagtggggcgtgagcgacttcatcaaggccttcatcaagttccacggccacgtgtacctgagcaagagcctggagaagctgagccccctgagagagaagctggaggagcagttcaagagactgctgttccagaaggccttcaacagccagcagctggtgcacgtgaccgtgatcaacctgttccagctgcaccacctgagagacttcagcaacgagaccgagcagcacacctacagccaggacgagcagctgtgctggacccagctgctggccctgttcatgagcttcctgggcatcctgtgcaagtgccccctgcagaacgagagccaggaggagagctacaacgcctaccccctgcccgccgtgaaggtgagcatggactggctgagactgagacccagagtgttccaggaggccgtggtggacgagagacagtacatctggccctggctgatcagcctgctgaacagcttccacccccacgaggaggacctgagcagcatcagcgccacccccctgcccgaggagttcgagctgcagggcttcctggccctgagacccagcttcagaaacctggacttcagcaagggccaccagggcatcaccggcgacaaggagggccagcagagaagaatcagacagcagagactgatcagcatcggcaagtggatcgccgacaaccagcccagactgatccagtgcgagaacgaggtgggcaagctgctgttcatcaccgagatccccgagctgatcctggaggaccccagcgaggccaaggagaacctgatcctgcaggagaccagcgtgatcgagagcctggccgccgacggcagccccggcctgaagagcgtgctgagcaccagcagaaacctgagcaacaactgcgacaccggcgagaagcccgtggtgaccttcaaggagaacatcaagaccagagaggtgaacagagaccagggcagaagcttcccccccaaggaggtgaagagccagaccgagctgagaaagacccccgtgagcgaggccagaaagacccccgtgacccagacccccacccaggccagcaacagccagttcatccccatccaccaccccggcgccttcccccccctgcccagcagacccggcttccccccccccacctacgtgatccccccccccgtggccttcagcatgggcagcggctacaccttccccgccggcgtgagcgtgcccggcaccttcctgcagcccaccgcccacagccccgccggcaaccaggtgcaggccggcaagcagagccacatcccctacagccagcagagacccagcggccccggccccatgaaccagggcccccagcagagccagccccccagccagcagcccctgaccagcctgcccgcccagcccaccgcccagagcaccagccagctgcaggtgcaggccctgacccagcagcagcagagccccaccaaggccgtgcccgccctgggcaagagccccccccaccacagcggcttccagcagtaccagcaggccgacgccagcaagcagctgtggaaccccccccaggtgcagggccccctgggcaagatcatgcccgtgaagcagccctactacctgcagacccaggaccccatcaagctgttcgagcccagcctgcagccccccgtgatgcagcagcagcccctggagaagaagatgaagcccttccccatggagccctacaaccacaaccccagcgaggtgaaggtgcccgagttctactgggacagcagctacagcatggccgacaacagaagcgtgatggcccagcaggccaacatcgacagaagaggcaagagaagccccggcgtgttcagacccgagcaggaccccgtgcccagaatgcccttcgagaagagcctgctggagaagcccagcgagctgatgagccacagcagcagcttcctgagcctgaccggcttcagcctgaaccaggagagataccccaacaacagcatgttcaacgaggtgtacggcaagaacctgaccagcagcagcaaggccgagctgagccccagcatggccccccaggagaccagcctgtacagcctgttcgagggcaccccctggagccccagcctgcccgccagcagcgaccacagcacccccgccagccagagcccccacagcagcaaccccagcagcctgcccagcagcccccccacccacaaccacaacagcgtgcccttcagcaacttcggccccatcggcacccccgacaacagagacagaagaaccgccgacagatggaagaccgacaagcccgccatgggcggcttcggcatcgactacctgagcgccaccagcagcagcgagagcagctggcaccaggccagcacccccagcggcacctggaccggccacggccccagcatggaggacagcagcgccgtgctgatggagagcctgaagagcatctggagcagcagcatgatgcaccccggccccagcgccctggagcagctgctgatgcagcagaagcagaagcagcagagaggccagggcaccatgaaccccccccactag

SEQ ID NO: 99232 - DNA, 3537 bp, Artificial Sequence
  Description of Artificial Sequence: Synthetic coding sequence
atgagcctgcagagcgcccagtacctgagacaggccgaggtgctgaaggccgacatgaccgacagcaagctgggccccgccgaggtgtggaccagcagacaggccctgcaggacctgtaccagaagatgctggtgaccgacctggagtacgccctggacaagaaggtggagcaggacctgtggaaccacgccttcaagaaccagatcaccaccctgcagggccaggccaagaacagagccaaccccaacagaagcgaggtgcaggccaacctgagcctgttcctggaggccgccagcggcttctacacccagctgctgcaggagctgtgcaccgtgttcaacgtggacctgccctgcagagtgaagagcagccagctgggcatcatcagcaacaagcagacccacaccagcgccatcgtgaagccccagagcagcagctgcagctacatctgccagcactgcctggtgcacctgggcgacatcgccagatacagaaaccagaccagccaggccgagagctactacagacacgccgcccagctggtgcccagcaacggccagccctacaaccagctggccatcctggccagcagcaagggcgaccacctgaccaccatcttctactactgcagaagcatcgccgtgaagttccccttccccgccgccagcaccaacctgcagaaggccctgagcaaggccctggagagcagagacgaggtgaagaccaagtggggcgtgagcgacttcatcaaggccttcatcaagttccacggccacgtgtacctgagcaagagcctggagaagctgagccccctgagagagaagctggaggagcagttcaagagactgctgttccagaaggccttcaacagccagcagctggtgcacgtgaccgtgatcaacctgttccagctgcaccacctgagagacttcagcaacgagaccgagcagcacacctacagccaggacgagcagctgtgctggacccagctgctggccctgttcatgagcttcctgggcatcctgtgcaagtgccccctgcagaacgagagccaggaggagagctacaacgcctaccccctgcccgccgtgaaggtgagcatggactggctgagactgagacccagagtgttccaggaggccgtggtggacgagagacagtacatctggccctggctgatcagcctgctgaacagcttccacccccacgaggaggacctgagcagcatcagcgccacccccctgcccgaggagttcgagctgcagggcttcctggccctgagacccagcttcagaaacctggacttcagcaagggccaccagggcatcaccggcgacaaggagggccagcagagaagaatcagacagcagagactgatcagcatcggcaagtggatcgccgacaaccagcccagactgatccagtgcgagaacgaggtgggcaagctgctgttcatcaccgagatccccgagctgatcctggaggaccccagcgaggccaaggagaacctgatcctgcaggagaccagcgtgatcgagagcctggccgccgacggcagccccggcctgaagagcgtgctgagcaccagcagaaacctgagcaacaactgcgacaccggcgagaagcccgtggtgaccttcaaggagaacatcaagaccagagaggtgaacagagaccagggcagaagcttcccccccaaggaggtgaagagccagaccgagctgagaaagacccccgtgagcgaggccagaaagacccccgtgacccagacccccacccaggccagcaacagccagttcatccccatccaccaccccggcgccttcccccccctgcccagcagacccggcttccccccccccacctacgtgatccccccccccgtggccttcagcatgggcagcggctacaccttccccgccggcgtgagcgtgcccggcaccttcctgcagcccaccgcccacagccccgccggcaaccaggtgcaggccggcaagcagagccacatcccctacagccagcagagacccagcggccccggccccatgaaccagggcccccagcagagccagccccccagccagcagcccctgaccagcctgcccgcccagcccaccgcccagagcaccagccagctgcaggtgcaggccctgacccagcagcagcagagccccaccaaggccgtgcccgccctgggcaagagccccccccaccacagcggcttccagcagtaccagcaggccgacgccagcaagcagctgtggaaccccccccaggtgcagggccccctgggcaagatcatgcccgtgaagcagccctactacctgcagacccaggaccccatcaagctgttcgagcccagcctgcagccccccgtgatgcagcagcagcccctggagaagaagatgaagcccttccccatggagccctacaaccacaaccccagcgaggtgaaggtgcccgagttctactgggacagcagctacagcatggccgacaacagaagcgtgatggcccagcaggccaacatcgacagaagaggcaagagaagccccggcgtgttcagacccgagcaggaccccgtgcccagaatgcccttcgaggaccccaagagcagccccctgctgccccccgacctgctgaagagcctggccgccctggaggaggaggaggagctgatcttcagcaacccccccgacctgtaccccgccctgctgggccccctggccagcctgcccggcagaagcctgttcaagagcctgctggagaagcccagcgagctgatgagccacagcagcagcttcctgagcctgaccggcttcagcctgaaccaggagagataccccaacaacagcatgttcaacgaggtgtacggcaagaacctgaccagcagcagcaaggccgagctgagccccagcatggccccccaggagaccagcctgtacagcctgttcgagggcaccccctggagccccagcctgcccgccagcagcgaccacagcacccccgccagccagagcccccacagcagcaaccccagcagcctgcccagcagcccccccacccacaaccacaacagcgtgcccttcagcaacttcggccccatcggcacccccgacaacagagacagaagaaccgccgacagatggaagaccgacaagcccgccatgggcggcttcggcatcgactacctgagcgccaccagcagcagcgagagcagctggcaccaggccagcacccccagcggcacctggaccggccacggccccagcatggaggacagcagcgccgtgctgatggagagcctgaagaagcagcagcacggcgtgcagcagctgggccccaagagacagagcgaggaggagggcagcagcagcatctgcgtggcccacagaggccccagacccctgcccagctgcagcctgcccgccagcaccttcagagtgaagttcaaggccgccagaacctgcgcccaccaggcccagaagaagaccagaagaagacccttctggaagagaagaaagaagggcaagtag

SEQ ID NO: 99233 - DNA, 3276 bp, Artificial Sequence
  Description of Artificial Sequence: Synthetic coding sequence
atgagcctgcagagcgcccagtacctgagacaggccgaggtgctgaaggccgacatgaccgacagcaagctgggccccgccgaggtgtggaccagcagacaggccctgcaggacctgtaccagaagatgctggtgaccgacctggagtacgccctggacaagaaggtggagcaggacctgtggaaccacgccttcaagaaccagatcaccaccctgcagggccaggccaagaacagagccaaccccaacagaagcgaggtgcaggccaacctgagcctgttcctggaggccgccagcggcttctacacccagctgctgcaggagctgtgcaccgtgttcaacgtggacctgccctgcagagtgaagagcagccagctgggcatcatcagcaacaagcagacccacaccagcgccatcgtgaagccccagagcagcagctgcagctacatctgccagcactgcctggtgcacctgggcgacatcgccagatacagaaaccagaccagccaggccgagagctactacagacacgccgcccagctggtgcccagcaacggccagccctacaaccagctggccatcctggccagcagcaagggcgaccacctgaccaccatcttctactactgcagaagcatcgccgtgaagttccccttccccgccgccagcaccaacctgcagaaggccctgagcaaggccctggagagcagagacgaggtgaagaccaagtggggcgtgagcgacttcatcaaggccttcatcaagttccacggccacgtgtacctgagcaagagcctggagaagctgagccccctgagagagaagctggaggagcagttcaagagactgctgttccagaaggccttcaacagccagcagctggtgcacgtgaccgtgatcaacctgttccagctgcaccacctgagagacttcagcaacgagaccgagcagcacacctacagccaggacgagcagctgtgctggacccagctgctggccctgttcatgagcttcctgggcatcctgtgcaagtgccccctgcagaacgagagccaggaggagagctacaacgcctaccccctgcccgccgtgaaggtgagcatggactggctgagactgagacccagagtgttccaggaggccgtggtggacgagagacagtacatctggccctggctgatcagcctgctgaacagcttccacccccacgaggaggacctgagcagcatcagcgccacccccctgcccgaggagttcgagctgcagggcttcctggccctgagacccagcttcagaaacctggacttcagcaagggccaccagggcatcaccggcgacaaggagggccagcagagaagaatcagacagcagagactgatcagcatcggcaagtggatcgccgacaaccagcccagactgatccagtgcgagaacgaggtgggcaagctgctgttcatcaccgagatccccgagctgatcctggaggaccccagcgaggccaaggagaacctgatcctgcaggagaccagcgtgatcgagagcctggccgccgacggcagccccggcctgaagagcgtgctgagcaccagcagaaacctgagcaacaactgcgacaccggcgagaagcccgtggtgaccttcaaggagaacatcaagaccagagaggtgaacagagaccagggcagaagcttcccccccaaggaggtgaagagccagaccgagctgagaaagacccccgtgagcgaggccagaaagacccccgtgacccagacccccacccaggccagcaacagccagttcatccccatccaccaccccggcgccttcccccccctgcccagcagacccggcttccccccccccacctacgtgatccccccccccgtggccttcagcatgggcagcggctacaccttccccgccggcgtgagcgtgcccggcaccttcctgcagcccaccgcccacagccccgccggcaaccaggtgcaggccggcaagcagagccacatcccctacagccagcagagacccagcggccccggccccatgaaccagggcccccagcagagccagccccccagccagcagcccctgaccagcctgcccgcccagcccaccgcccagagcaccagccagctgcaggtgcaggccctgacccagcagcagcagagccccaccaaggccgtgcccgccctgggcaagagccccccccaccacagcggcttccagcagtaccagcaggccgacgccagcaagcagctgtggaaccccccccaggtgcagggccccctgggcaagatcatgcccgtgaagcagccctactacctgcagacccaggaccccatcaagctgttcgagcccagcctgcagccccccgtgatgcagcagcagcccctggagaagaagatgaagcccttccccatggagccctacaaccacaaccccagcgaggtgaaggtgcccgagttctactgggacagcagctacagcatggccgacaacagaagcgtgatggcccagcaggccaacatcgacagaagaggcaagagaagccccggcgtgttcagacccgagcaggaccccgtgcccagaatgcccttcgagaagagcctgctggagaagcccagcgagctgatgagccacagcagcagcttcctgagcctgaccggcttcagcctgaaccaggagagataccccaacaacagcatgttcaacgaggtgtacggcaagaacctgaccagcagcagcaaggccgagctgagccccagcatggccccccaggagaccagcctgtacagcctgttcgagggcaccccctggagccccagcctgcccgccagcagcgaccacagcacccccgccagccagagcccccacagcagcaaccccagcagcctgcccagcagcccccccacccacaaccacaacagcgtgcccttcagcaacttcggccccatcggcacccccgacaacagagacagaagaaccgccgacagatggaagaccgacaagcccgccatgggcggcttcggcatcgactacctgagcgccaccagcagcagcgagagcagctggcaccaggccagcacccccagcggcacctggaccggccacggccccagcatggaggacagcagcgccgtgctgatggagagcctgaagagcatctggagcagcagcatgatgcaccccggccccagcgccctggagcagctgctgatgcagcagaagcagaagcagcagagaggccagggcaccatgaaccccccccactag

SEQ ID NO: 99234 - DNA, 2976 bp, Artificial Sequence
  Description of Artificial Sequence: Synthetic coding sequence
atggccggccccgtgagcctgagagacctgctgatgggcgccagcgcctggatgggcagcgagagccccggcggcagccccaccgagggcggcggcagcgccgccggcggccccgagcccccctggagagaggacgagatctgcgtggtgggcatcttcggcaagaccgccctgagactgaacagcgagaagttcagcctggtgaacaccgtgtgcgacagacaggtgttccccctgttcagacaccaggaccccggcgaccccggccccggcatcagaaccgaggccggcgccgtgggcgaggccggcggcgccgaggaccccggcgccgccgccggcggcagcgtgagaggcagcggcgccgtggccgagggcaacagaaccgaggccggcagccaggactacagcctgctgcaggcctactacagccaggagagcaaggtgctgtacctgctgctgaccagcatctgcgacaacagccagctgctgagagcctgcagagccctgcagagcggcgaggccggcggcggcctgagcctgccccacgccgaggcccacgagttctggaagcaccaggagaagctgcagtgcctgagcctgctgtacctgttcagcgtgtgccacatcctgctgctggtgcaccccacctgcagcttcgacatcacctacgacagagtgttcagagccctggacggcctgagacagaaggtgctgcccctgctgaagaccgccatcaaggactgccccgtgggcaaggactggaagctgaactgcagaccctgcccccccagactgctgttcctgttccagctgaacggcgccctgaaggtggagccccccagaaaccaggaccccgcccaccccgacaagcccaagaagcacagccccaagagaagactgcagcacgccctggaggaccagatctacagaatcttcagaaagagcagagtgctgaccaaccagagcatcaactgcctgttcaccgtgcccgccaaccaggccttcgtgtacatcgtgcccggcagccaggaggaggaccccgtgggcatgctgctggaccagctgagaagccactgcaccgtgaaggaccccgagagcctgctggtgcccgcccccctgagcggccccagaagataccaggtgatgagacagcacagcagacagcagctgagcttccacatcgacagcagcagcagcagcagcagcggccagctggtggacttcaccctgagagagttcctgtggcagcacgtggagctggtgctgagcaagaagggcttcgacgacagcgtgggcagaaacccccagcccagccacttcgagctgcccacctaccagaagtggatcagcgccgccagcaagctgtacgaggtggccatcgacggcaaggaggaggacctgggcagccccaccggcgagctgaccagcaagatcctgagcagcatcaaggtgctggagggcttcctggacatcgacaccaagttcagcgagaacagatgccagaaggccctgcccatggcccacagcgcctaccagagcaacctgccccacaactacaccatgaccgtgcacaagaaccagctggcccaggccctgagagtgtacagccagcacgccagaggccccgccttccacaagtacgccatgcagctgcacgaggactgctacaagttctggagcaacggccaccagctgtgcgaggagagaagcctgaccgaccagcactgcgtgcacaagttccacagcctgcccaagagcggcgagaagcccgaggccgacagaaacccccccgtgctgtaccacaacagcagagccagaagcaccggcgcctgcaactgcggcagaaagcaggcccccagagacgaccccttcgacatcaaggccgccaactacgacttctaccagctgctggaggagaagtgctgcggcaagctggaccacatcaacttccccgtgttcgagcccagcacccccgaccccgcccccgccaagaacgagagcagccccgccccccccgacagcgacgccgacaagctgaaggagaaggagccccagacccagggcgagagcaccagcctgagcctggccctgagcctgggccagagcaccgacagcctgggcacctaccccgccgacccccaggccggcggcgacaaccccgaggtgcacggccaggtggaggtgaagaccgagaagagacccaacttcgtggacagacaggccagcaccgtggagtacctgcccggcatgctgcacagcaactgccccaagggcctgctgcccaagttcagcagctggagcctggtgaagctgggccccgccaagagctacaacttccacaccggcctggaccagcagggcttcatccccggcaccaactacctgatgccctgggacatcgtgatcagaaccagagccgaggacgagggcgacctggacaccaacagctggcccgcccccaacaaggccatccccggcaagagaagcgccgtggtgatgggcagaggcagaagaagagacgacatcgccagagccttcgtgggcttcgagtacgaggacagcagaggcagaagattcatgtgcagcggccccgacaaggtgatgaaggtgatgggcagcggccccaaggagagcgccctgaaggccctgaacagcgacatgcccctgtacatcctgagcagcagccagggcagaggcctgaagccccactacgcccagctgatgagactgttcgtggtggtgcccgacgcccccctgcagatcatcctgatgccccaggtgcagcccggcccccccccctgccccgtgttctaccccgagaagcaggagatcaccctgccccccgacggcctgtgggtgctgagattcccctacgcctacgtgaccgagagaggcccctgcttcccccccaaggagaacgtgcagctgatgagctacaaggtgctgagaggcgtgctgaaggccgtgacccagtag

SEQ ID NO: 99235 - DNA, 2925 bp, Artificial Sequence
  Description of Artificial Sequence: Synthetic coding sequence
atggccggccccgtgagcctgagagacctgctgatgggcgccagcgcctggatgggcagcgagagccccggcggcagccccaccgagggcggcggcagcgccgccggcggccccgagcccccctggagagaggacgagatctgcgtggtgggcatcttcggcaagaccgccctgagactgaacagcgagaagttcagcctggtgaacaccgtgtgcgacagacaggtgttccccctgttcagacaccaggaccccggcgaccccggccccggcatcagaaccgaggccggcgccgtgggcgaggccggcggcgccgaggaccccggcgccgccgccggcggcagcgtgagaggcagcggcgccgtggccgagggcaacagaaccgaggccggcagccaggactacagcctgctgcaggcctactacagccaggagagcaaggtgctgtacctgctgctgaccagcatctgcgacaacagccagctgctgagagcctgcagagccctgcagagcggcgaggccggcggcggcctgagcctgccccacgccgaggcccacgagttctggaagcaccaggagaagctgcagtgcctgagcctgctgtacctgttcagcgtgtgccacatcctgctgctggtgcaccccacctgcagcttcgacatcacctacgacagagtgttcagagccctggacggcctgagacagaaggtgctgcccctgctgaagaccgccatcaaggactgccccgtgggcaaggactggaagctgaactgcagaccctgcccccccagactgctgttcctgttccagctgaacggcgccctgaaggtggagccccccagaaaccaggaccccgcccaccccgacaagcccaagaagcacagccccaagagaagactgcagcacgccctggaggaccagatctacagaatcttcagaaagagcagagtgctgaccaaccagagcatcaactgcctgttcaccgtgcccgccaaccaggccttcgtgtacatcgtgcccggcagccaggaggaggaccccgtgggcatgctgctggaccagctgagaagccactgcaccgtgaaggaccccgagagcctgctggtgcccgcccccctgagcggccccagaagataccaggtgatgagacagcacagcagacagcagctgagcttccacatcgacagcagcagcagcagcagcagcggccagctggtggacttcaccctgagagagttcctgtggcagcacgtggagctggtgctgagcaagaagggcttcgacgacagcgtgggcagaaacccccagcccagccacttcgagctgcccacctaccagaagtggatcagcgccgccagcaagctgtacgaggtggccatcgacggcaaggaggaggacctgggcagccccaccggcgagctgaccagcaagatcctgagcagcatcaaggtgctggagggcttcctggacatcgacaccaagttcagcgagaacagatgccagaaggccctgcccatggcccacagcgcctaccagagcaacctgccccacaactacaccatgaccgtgcacaagaaccagctggcccaggccctgagagtgtacagccagcacgccagaggccccgccttccacaagtacgccatgcagctgcacgaggactgctacaagttctggagcaacggccaccagctgtgcgaggagagaagcctgaccgaccagcactgcgtgcacaagttccacagcctgcccaagagcggcgagaagcccgaggccgacagaaacccccccgtgctgtaccacaacagcagagccagaagcaccggcgcctgcaactgcggcagaaagcaggcccccagagacgaccccttcgacatcaaggccgccaactacgacttctaccagctgctggaggagaagtgctgcggcaagctggaccacatcaacttccccgtgttcgagcccagcacccccgaccccgcccccgccaagaacgagagcagccccgccccccccgacagcgacgccgacaagctgaaggagaaggagccccagacccagggcgagagcaccagcctgagcctggccctgagcctgggccagagcaccgacagcctgggcacctaccccgccgacccccaggccggcggcgacaaccccgaggtgcacggccaggtggaggtgaagaccgagaagagacccaacttcgtggacagacaggccagcaccgtggagtacctgcccggcatgctgcacagcaactgccccaagggcctgctgcccaagttcagcagctggagcctggtgaagctgggccccgccaagagctacaacttccacaccggcctggaccagcagggcttcatccccggcaccaactacctgatgccctgggacatcgtgatcagaaccagagccgaggacgagggcgacctggacaccaacagctggcccgcccccaacaaggccatccccggcaagagaagcgccgtggtgatgggcagaggcagaagaagagacgacatcgccagagccttcgtgggcttcgagtacgaggacagcagaggcagaagattcatgtgcagcggccccgacaaggtgatgaaggtgatgggcagcggccccaaggagagcgccctgaaggccctgaacagcgacatgcccctgtacatcctgagcagcagccagggcagaggcctgaagccccactacgcccagctgatgagactgttcgtggtggtgcccgacgcccccctgcagatcatcctgatgccccaggtgcagcccggcccccccccctgccccgtgttctaccccgagaagcaggagatcaccctgccccccgacggcctgtgggtgctgagattcccctacgcctacctgagagaggacctggtgagccccctgagaaagatgtgcagctag

SEQ ID NO: 99236 - DNA, 1563 bp, Artificial Sequence
  Description of Artificial Sequence: Synthetic coding sequence
atgagcgagagcggccacagccagcccggcctgtacggcatcgagagaagaagaagatggaaggagcccggcagcggcggcccccagaacctgagcggccccggcggcagagagagagactacatcgccccctgggagagagagagaagagacgccagcgaggagaccagcaccagcgtgatgcagaagacccccatcatcctgagcaagccccccgccgagagaagcaagcagccccccccccccaccgcccccgccgccccccccgcccccgcccccctggagaagcccatcgtgctgatgaagcccagagaggagggcaagggccccgtggccgtgaccggcgccagcacccccgagggcaccgccccccccccccccgccgcccccgccccccccaagggcgagaaggagggccagagacccacccagcccgtgtaccagatccagaacagaggcatgggcaccgccgcccccgccgccatggaccccgtggtgggccaggccaagctgctgccccccgagagaatgaagcacagcatcaagctggtggacgaccagatgaactggtgcgacagcgccatcgagtacctgctggaccagaccgacgtgctggtggtgggcgtgctgggcctgcagggcaccggcaagagcatggtgatgagcctgctgagcgccaacacccccgaggaggaccagagaacctacgtgttcagagcccagagcgccgagatgaaggagagaggcggcaaccagaccagcggcatcgacttcttcatcacccaggagagaatcgtgttcctggacacccagcccatcctgagccccagcatcctggaccacctgatcaacaacgacagaaagctgccccccgagtacaacctgccccacacctacgtggagatgcagagcctgcagatcgccgccttcctgttcaccgtgtgccacgtggtgatcgtggtgcaggactggttcaccgacctgagcctgtacagattcctgcagaccgccgagatggtgaagcccagcacccccagccccagccacgagagcagcagcagcagcggcagcgacgagggcaccgagtactacccccacctggtgttcctgcagaacaaggccagaagagaggacttctgccccagaaagctgagacagatgcacctgatgatcgaccagctgatggcccacagccacctgagatacaagggcaccctgagcatgctgcagtgcaacgtgttccccggcctgccccccgacttcctggacagcgaggtgaacctgttcctggtgcccttcatggacagcgaggccgagagcgagaacccccccagagccggccccggcagcagccccctgttcagcctgctgcccggctacagaggccaccccagcttccagagcctggtgagcaagctgagaagccaggtgatgagcatggccagaccccagctgagccacaccatcctgaccgagaagaactggttccactacgccgccagaatctgggacggcgtgagaaagagcagcgccctggccgagtacagcagactgctggcctag

SEQ ID NO: 99237 - DNA, 2742 bp, Artificial Sequence
  Description of Artificial Sequence: Synthetic coding sequence
atggccgacgaggccctggccggcctggacgagggcgccctgagaaagctgctggaggtgaccgccgacctggccgagagaagaagaatcagaagcgccatcagagagctgcagagacaggagctggagagagaggaggaggccctggccagcaagagattcagagccgagagacaggacaacaaggagaactggctgcacagccagcagagagaggccgagcagagagccgccctggccagactggccggccagctggagagcatgaacgacgtggaggagctgaccgccctgctgagaagcgccggcgagtacgaggagagaaagctgatcagagccgccatcagaagagtgagagcccaggagatcgaggccgccaccctggccggcagactgtacagcggcagacccaacagcggcagcagagaggacagcaagggcctggccgcccacagactggagcagtgcgaggtgcccgagagagaggagcaggagcagcaggccgaggtgagcaagcccacccccacccccgagggcaccagccaggacgtgaccaccgtgaccctgctgctgagagccccccccggcagcaccagcagcagccccgccagccccagcagcagccccacccccgccagccccgagccccccctggagcccgccgaggcccagtgcctgaccgccgaggtgcccggcagccccgagcccccccccagcccccccaagaccaccagccccgagccccaggagagccccaccctgcccagcaccgagggccaggtggtgaacaagctgctgagcggccccaaggagacccccgccgcccagagccccaccagaggccccagcgacaccaagagagccgacgtggccggccccagaccctgccagagaagcctgagcgtgctgagccccagacagcccgcccagaacagagagagcacccccctggccagcggccccagcagcttccagagagccggcagcgtgagagacagagtgcacaagttcaccagcgacagccccatggccgccagactgcaggacggcaccccccaggccgccctgagccccctgcccagaaaggcccccggccccctgccccaccagcaccacccctgcctgctgctgcagagactgctgctgagcggccccgacaccagcagcagattcagcaaggagcagagaggcgtggcccagcccctggcccagctgagaagctgcccccaggaggagggccccagaggcagaggcctggccgccagacccctggagaacagagccggcggccccgtggccagaagcgaggagcccggcgcccccctgcccgtggccgtgggcaccgccgagcccggcggcagcatgaagaccaccttcaccatcgagatcaaggacggcagaggccaggccagcaccggcagagtgctgctgcccaccggcaaccagagagccgagctgaccctgggcctgagagccccccccaccctgctgagcaccagcagcggcggcaagagcaccatcaccagagtgaacagccccggcaccctggccagactgggcagcgtgacccacgtgaccagcttcagccacgccccccccagcagcagaggcggctgcagcatcaagatggaggccgagcccgccgagcccctggccgccgccgtggaggccgccaacggcgccgagcagaccagagtgaacaaggcccccgagggcagaagccccctgagcgccgaggagctgatgaccatcgaggacgagggcgtgctggacaagatgctggaccagagcaccgacttcgaggagagaaagctgatcagagccgccctgagagagctgagacagagaaagagagaccagagagacaaggagagagagagaagactgcaggaggccagaggcagacccggcgagggcagaggcaacaccgccaccgagaccaccaccagacacagccagagagccgccgacggcagcgccgtgagcaccgtgaccaagaccgagagactggtgcacagcaacgacggcaccagaaccgccagaaccaccaccgtggagagcagcttcgtgagaagaagcgagaacggcagcggcagcaccatgatgcagaccaagaccttcagcagcagcagcagcagcaagaagatgggcagcatcttcgacagagaggaccaggccagccccagagccggcagcctggccgccctggagaagagacaggccgagaagaagaaggagctgatgaaggcccagagcctgcccaagaccagcgccagccaggccagaaaggccatgatcgagaagctggagaaggagggcgccgccggcagccccggcggccccagagccgccgtgcagagaagcaccagcttcggcgtgcccaacgccaacagcatcaagcagatgctgctggactggtgcagagccaagaccagaggctacgagcacgtggacatccagaacttcagcagcagctggagcgacggcatggccttctgcgccctggtgcacaacttcttccccgaggccttcgactacggccagctgagcccccagaacagaagacagaacttcgaggtggccttcagcagcgccgagacccacgccgactgcccccagctgctggacaccgaggacatggtgagactgagagagcccgactggaagtgcgtgtacacctacatccaggagttctacagatgcctggtgcagaagggcctggtgaagaccaagaagagctag

SEQ ID NO: 99238 - DNA, 2748 bp, Artificial Sequence
  Description of Artificial Sequence: Synthetic coding sequence
atggccgacgaggccctggccggcctggacgagggcgccctgagaaagctgctggaggtgaccgccgacctggccgagagaagaagaatcagaagcgccatcagagagctgcagagacaggagctggagagagaggaggaggccctggccagcaagagattcagagccgagagacaggacaacaaggagaactggctgcacagccagcagagagaggccgagcagagagccgccctggccagactggccggccagctggagagcatgaacgacgtggaggagctgaccgccctgctgagaagcgccggcgagtacgaggagagaaagctgatcagagccgccatcagaagagtgagagcccaggagatcgaggccgccaccctggccggcagactgtacagcggcagacccaacagcggcagcagagaggacagcaagggcctggccgcccacagactggagcagtgcgaggtgcccgagagagaggagcaggagcagcaggccgaggtgagcaagcccacccccacccccgagggcaccagccaggacgtgaccaccgtgaccctgctgctgagagccccccccggcagcaccagcagcagccccgccagccccagcagcagccccacccccgccagccccgagccccccctggagcccgccgaggcccagtgcctgaccgccgaggtgcccggcagccccgagcccccccccagcccccccaagaccaccagccccgagccccaggagagccccaccctgcccagcaccgagggccaggtggtgaacaagctgctgagcggccccaaggagacccccgccgcccagagccccaccagaggccccagcgacaccaagagagccgacgtggccggccccagaccctgccagagaagcctgagcgtgctgagccccagacagcccgcccagaacagagagagcacccccctggccagcggccccagcagcttccagagagccggcagcgtgagagacagagtgcacaagttcaccagcgacagccccatggccgccagactgcaggacggcaccccccaggccgccctgagccccctgacccccgccagactgctgggccccagcctgaccagcaccacccccgccagcagcagcagcggcagcagcagcagaggccccagcgacaccagcagcagattcagcaaggagcagagaggcgtggcccagcccctggcccagctgagaagctgcccccaggaggagggccccagaggcagaggcctggccgccagacccctggagaacagagccggcggccccgtggccagaagcgaggagcccggcgcccccctgcccgtggccgtgggcaccgccgagcccggcggcagcatgaagaccaccttcaccatcgagatcaaggacggcagaggccaggccagcaccggcagagtgctgctgcccaccggcaaccagagagccgagctgaccctgggcctgagagccccccccaccctgctgagcaccagcagcggcggcaagagcaccatcaccagagtgaacagccccggcaccctggccagactgggcagcgtgacccacgtgaccagcttcagccacgccccccccagcagcagaggcggctgcagcatcaagatggaggccgagcccgccgagcccctggccgccgccgtggaggccgccaacggcgccgagcagaccagagtgaacaaggcccccgagggcagaagccccctgagcgccgaggagctgatgaccatcgaggacgagggcgtgctggacaagatgctggaccagagcaccgacttcgaggagagaaagctgatcagagccgccctgagagagctgagacagagaaagagagaccagagagacaaggagagagagagaagactgcaggaggccagaggcagacccggcgagggcagaggcaacaccgccaccgagaccaccaccagacacagccagagagccgccgacggcagcgccgtgagcaccgtgaccaagaccgagagactggtgcacagcaacgacggcaccagaaccgccagaaccaccaccgtggagagcagcttcgtgagaagaagcgagaacggcagcggcagcaccatgatgcagaccaagaccttcagcagcagcagcagcagcaagaagatgggcagcatcttcgacagagaggaccaggccagccccagagccggcagcctggccgccctggagaagagacaggccgagaagaagaaggagctgatgaaggcccagagcctgcccaagaccagcgccagccaggccagaaaggccatgatcgagaagctggagaaggagggcgccgccggcagccccggcggccccagagccgccgtgcagagaagcaccagcttcggcgtgcccaacgccaacagcatcaagcagatgctgctggactggtgcagagccaagaccagaggctacgagcacgtggacatccagaacttcagcagcagctggagcgacggcatggccttctgcgccctggtgcacaacttcttccccgaggccttcgactacggccagctgagcccccagaacagaagacagaacttcgaggtggccttcagcagcgccgagacccacgccgactgcccccagctgctggacaccgaggacatggtgagactgagagagcccgactggaagtgcgtgtacacctacatccaggagttctacagatgcctggtgcagaagggcctggtgaagaccaagaagagctag

SEQ ID NO: 99239 - DNA, 2754 bp, Artificial Sequence
  Description of Artificial Sequence: Synthetic coding sequence
atggccgacgaggccctggccggcctggacgagggcgccctgagaaagctgctggaggtgaccgccgacctggccgagagaagaagaatcagaagcgccatcagagagctgcagagacaggagctggagagagaggaggaggccctggccagcaagagattcagagccgagagacaggacaacaaggagaactggctgcacagccagcagagagaggccgagcagagagccgccctggccagactggccggccagctggagagcatgaacgacgtggaggagctgaccgccctgctgagaagcgccggcgagtacgaggagagaaagctgatcagagccgccatcagaagagtgagagcccaggagatcgaggccgccaccctggccggcagactgtacagcggcagacccaacagcggcagcagagaggacagcaagggcctggccgcccacagactggagcagtgcgaggtgcccgagagagaggagcaggagcagcaggccgaggtgagcaagcccacccccacccccgagggcaccagccaggacgtgaccaccgtgaccctgctgctgagagccccccccggcagcaccagcagcagccccgccagccccagcagcagccccacccccgccagccccgagccccccctggagcccgccgaggcccagtgcctgaccgccgaggtgcccggcagccccgagcccccccccagcccccccaagaccaccagccccgagccccaggagagccccaccctgcccagcaccgagggccaggtggtgaacaagctgctgagcggccccaaggagacccccgccgcccagagccccaccagaggccccagcgacaccaagagagccgacgtggccggccccagaccctgccagagaagcctgagcgtgctgagccccagacagcccgcccagaacagagagagcacccccctggccagcggccccagcagcttccagagagccggcagcgtgagagacagagtgcacaagttcaccagcgacagccccatggccgccagactgcaggacggcaccccccaggccgccctgagccccctgacccccgccagactgctgggccccagcctgaccagcaccacccccgccagcagcagcagcggcagcagcagcagaggccccagcgacaccagcagcagattcagcaaggagcagagaggcgtggcccagcccctggcccagctgagaagctgcccccaggaggagggccccagaggcagaggcctggccgccagacccctggagaacagagccggcggccccgtggccagaagcgaggagcccggcgcccccctgcccgtggccgtgggcaccgccgagcccggcggcagcatgaagaccaccttcaccatcgagatcaaggacggcagaggccaggccagcaccggcagagtgctgctgcccaccggcaaccagagagccgagctgaccctgggcctgagagccccccccaccctgctgagcaccagcagcggcggcaagagcaccatcaccagagtgaacagccccggcaccctggccagactgggcagcgtgacccacgtgaccagcttcagccacgccccccccagcagcagaggcggctgcagcatcaagatggaggccgagcccgccgagcccctggccgccgccgtggaggccgccaacggcgccgagcagaccagagtgaacaaggcccccgagggcagaagccccctgagcgccgaggagctgatgaccatcgaggacgagggcgtgctggacaagatgctggaccagagcaccgacttcgaggagagaaagctgatcagagccgccctgagagagctgagacagagaaagagagaccagagagacaaggagagagagagaagactgcaggaggccagaggcagacccggcgagggcagaggcaacaccgccaccgagaccaccaccagacacagccagagagccgccgacggcagcgccgtgagcaccgtgaccaagaccgagagactggtgcacagcaacgacggcaccagaaccgccagaaccaccaccgtggagagcagcttcgtgagaagaagcgagaacggcagcggcagcaccatgatgcagaccaagaccttcagcagcagcagcagcagcaagaagatgggcagcatcttcgacagagaggaccaggccagccccagagccggcagcctggccgccctggagaagagacaggccgagaagaagaaggagctgatgaaggcccagagcctgcccaagaccagcgccagccaggccagaaaggccatgatcgagaagctggagaaggagggcgccgccggcagccccggcggccccagagccgccgtgcagagaagcaccagcttcggcgtgcccaacgccaacagcatcaagcagatgctgctggactggtgcagagccaagaccagaggctacgagcacgtggacatccagaacttcagcagcagctggagcgacggcatggccttctgcgccctggtgcacaacttcttccccgaggccttcgactacggccagctgagcccccagaacagaagacagaacttcgaggtggccttcagcagcgccgagatgctggtggactgcgtgcccctggtggaggtggacgacatgatgatcatgggcaagaagcccgaccccaagtgcgtgttcacctacgtgcagagcctgtacaaccacctgagaagacacgagctgagactgagaggcaagaacgtgtag

SEQ ID NO: 99240 - DNA, 888 bp, Artificial Sequence
  Description of Artificial Sequence: Synthetic coding sequence
atggaggccgagcccgccgagcccctggccgccgccgtggaggccgccaacggcgccgagcagaccagagtgaacaaggcccccgagggcagaagccccctgagcgccgaggagctgatgaccatcgaggacgagggcgtgctggacaagatgctggaccagagcaccgacttcgaggagagaaagctgatcagagccgccctgagagagctgagacagagaaagagagacggcagcggcagcaccatgatgcagaccaagaccttcagcagcagcagcagcagcaagaagatgggcagcatcttcgacagagaggaccaggccagccccagagccggcagcctggccgccctggagaagagacaggccgagaagaagaaggagctgatgaaggcccagagcctgcccaagaccagcgccagccaggccagaaaggccatgatcgagaagctggagaaggagggcgccgccggcagccccggcggccccagagccgccgtgcagagaagcaccagcttcggcgtgcccaacgccaacagcatcaagcagatgctgctggactggtgcagagccaagaccagaggctacgagcacgtggacatccagaacttcagcagcagctggagcgacggcatggccttctgcgccctggtgcacaacttcttccccgaggccttcgactacggccagctgagcccccagaacagaagacagaacttcgaggtggccttcagcagcgccgagacccacgccgactgcccccagctgctggacaccgaggacatggtgagactgagagagcccgactggaagtgcgtgtacacctacatccaggagttctacagatgcctggtgcagaagggcctggtgaagaccaagaagagctag

SEQ ID NO: 99241 - DNA, 2817 bp, Artificial Sequence
  Description of Artificial Sequence: Synthetic coding sequence
atgacctgcctgagccaccccctgcagctggaggtgaccgccgacctggccgagagaagaagaatcagaagcgccatcagagagctgcagagacaggagctggagagagaggaggaggccctggccagcaagagattcagagccgagagacaggacaacaaggagaactggctgcacagccagcagagagaggccgagcagagagccgccctggccagactggccggccagctggagagcatgaacgacgtggaggagctgaccgccctgctgagaagcgccggcgagtacgaggagagaaagctgatcagagccgccatcagaagagtgagagcccaggagatcgaggccgccaccctggccggcagactgtacagcggcagacccaacagcggcagcagagaggacagcaagggcctggccgcccacagactggagcagtgcgaggtgcccgagagagaggagcaggagcagcaggccgaggtgagcaagcccacccccacccccgagggcaccagccaggacgtgaccaccgtgaccctgctgctgagagccccccccggcagcaccagcagcagccccgccagccccagcagcagccccacccccgccagccccgagccccccctggagcccgccgaggcccagtgcctgaccgccgaggtgcccggcagccccgagcccccccccagcccccccaagaccaccagccccgagccccaggagagccccaccctgcccagcaccgagggccaggtggtgaacaagctgctgagcggccccaaggagacccccgccgcccagagccccaccagaggccccagcgacaccaagagagccgacgtggccggccccagaccctgccagagaagcctgagcgtgctgagccccagacagcccgcccagaacagagagagcacccccctggccagcggccccagcagcttccagagagccggcagcgtgagagacagagtgcacaagttcaccagcgacagccccatggccgccagactgcaggacggcaccccccaggccgccctgagccccctgacccccgccagactgctgggccccagcctgaccagcaccacccccgccagcagcagcagcggcagcagcagcagaggccccagcgacaccagcagcagattcagcaaggagcagagaggcgtggcccagcccctggcccagctgagaagctgcccccaggaggagggccccagaggcagaggcctggccgccagacccctggagaacagagccggcggccccgtggccagaagcgaggagcccggcgcccccctgcccgtggccgtgggcaccgccgagcccggcggcagcatgaagaccaccttcaccatcgagatcaaggacggcagaggccaggccagcaccggcagagtgctgctgcccaccggcaaccagagagccgagctgaccctgggcctgagagccccccccaccctgctgagcaccagcagcggcggcaagagcaccatcaccagagtgaacagccccggcaccctggccagactgggcagcgtgacccacgtgaccagcttcagccacgccccccccagcagcagaggcggctgcagcatcaaggccgccgaggacgccggcacccccgtggcccacccccccgccttcagcaccagaagaagaagcagcaccggcaccaccagaagcaccagcctgatggaggccgagcccgccgagcccctggccgccgccgtggaggccgccaacggcgccgagcagaccagagtgaacaaggcccccgagggcagaagccccctgagcgccgaggagctgatgaccatcgaggacgagggcgtgctggacaagatgctggaccagagcaccgacttcgaggagagaaagctgatcagagccgccctgagagagctgagacagagaaagagagaccagagagacaaggagagagagagaagactgcaggaggccagaggcagacccggcgagggcagaggcaacaccgccaccgagaccaccaccagacacagccagagagccgccgacggcagcgccgtgagcaccgtgaccaagaccgagagactggtgcacagcaacgacggcaccagaaccgccagaaccaccaccgtggagagcagcttcgtgagaagaagcgagaacggcagcggcagcaccatgatgcagaccaagaccttcagcagcagcagcagcagcaagaagatgggcagcatcttcgacagagaggaccaggccagccccagagccggcagcctggccgccctggagaagagacaggccgagaagaagaaggagctgatgaaggcccagagcctgcccaagaccagcgccagccaggccagaaaggccatgatcgagaagctggagaaggagggcgccgccggcagccccggcggccccagagccgccgtgcagagaagcaccagcttcggcgtgcccaacgccaacagcatcaagcagatgctgctggactggtgcagagccaagaccagaggctacgagcacgtggacatccagaacttcagcagcagctggagcgacggcatggccttctgcgccctggtgcacaacttcttccccgaggccttcgactacggccagctgagcccccagaacagaagacagaacttcgaggtggccttcagcagcgccgagacccacgccgactgcccccagctgctggacaccgaggacatggtgagactgagagagcccgactggaagtgcgtgtacacctacatccaggagttctacagatgcctggtgcagaagggcctggtgaagaccaagaagagctag

SEQ ID NO: 99242 - DNA, 114 bp, Artificial Sequence
  Description of Artificial Sequence: Synthetic coding sequence
atggccgacgaggccctggccggcctggacgagggcgccctgagaaagctgctggaggtgaccgccgacctggccgagagaagaagaatcagaagcgccatcagagagctgtag

SEQ ID NO: 99243 - DNA, 2823 bp, Artificial Sequence
  Description of Artificial Sequence: Synthetic coding sequence
atggccgacgaggccctggccggcctggacgagggcgccctgagaaagctgctggaggtgaccgccgacctggccgagagaagaagaatcagaagcgccatcagagagctgcagagacaggagctggagagagaggaggaggccctggccagcaagagattcagagccgagagacaggacaacaaggagaactggctgcacagccagcagagagaggccgagcagagagccgccctggccagactggccggccagctggagagcatgaacgacgtggaggagctgaccgccctgctgagaagcgccggcgagtacgaggagagaaagctgatcagagccgccatcagaagagtgagagcccaggagatcgaggccgccaccctggccggcagactgtacagcggcagacccaacagcggcagcagagaggacagcaagggcctggccgcccacagactggagcagtgcgaggtgcccgagagagaggagcaggagcagcaggccgaggtgagcaagcccacccccacccccgagggcaccagccaggacgtgaccaccgtgaccctgctgctgagagccccccccggcagcaccagcagcagccccgccagccccagcagcagccccacccccgccagccccgagccccccctggagcccgccgaggcccagtgcctgaccgccgaggtgcccggcagccccgagcccccccccagcccccccaagaccaccagccccgagccccaggagagccccaccctgcccagcaccgagggccaggtggtgaacaagctgctgagcggccccaaggagacccccgccgcccagagccccaccagaggccccagcgacaccaagagagccgacgtggccggccccagaccctgccagagaagcctgagcgtgctgagccccagacagcccgcccagaacagagagagcacccccctggccagcggccccagcagcttccagagagccggcagcgtgagagacagagtgcacaagttcaccagcgacagccccatggccgccagactgcaggacggcaccccccaggccgccctgagccccctgacccccgccagactgctgggccccagcctgaccagcaccacccccgccagcagcagcagcggcagcagcagcagaggccccagcgacaccagcagcagattcagcaaggagcagagaggcgtggcccagcccctggcccagctgagaagctgcccccaggaggagggccccagaggcagaggcctggccgccagacccctggagaacagagccggcggccccgtggccagaagcgaggagcccggcgcccccctgcccgtggccgtgggcaccgccgagcccggcggcagcatgaagaccaccttcaccatcgagatcaaggacggcagaggccaggccagcaccggcagagtgctgctgcccaccggcaaccagagagccgagctgaccctgggcctgagagccccccccaccctgctgagcaccagcagcggcggcaagagcaccatcaccagagtgaacagccccggcaccctggccagactgggcagcgtgacccacgtgaccagcttcagccacgccccccccagcagcagaggcggctgcagcatcaagatggaggccgagcccgccgagcccctggccgccgccgtggaggccgccaacggcgccgagcagaccagagtgaacaaggcccccgagggcagaagccccctgagcgccgaggagctgatgaccatcgaggacgagggcgtgctggacaagatgctggaccagagcaccgacttcgaggagagaaagctgatcagagccgccctgagagagctgagacagagaaagagagaccagagagacaaggagagagagagaagactgcaggaggccagaggcagacccggcgagggcagaggcaacaccgccaccgagaccaccaccagacacagccagagagccgccgacggcagcgccgtgagcaccgtgaccaagaccgagagactggtgcacagcaacgacggcaccagaaccgccagaaccaccaccgtggagagcagcttcgtgagaagaagcgagaacggcagcggcagcaccatgatgcagaccaagaccttcagcagcagcagcagcagcaagaagatgggcagcatcttcgacagagaggaccaggccagccccagagccggcagcctggccgccctggagaagagacaggccgagaagaagaaggagctgatgaaggcccagagcctgcccaagaccagcgccagccaggccagaaaggccatgatcgagaagctggagaaggagggcgccgccggcagccccggcggccccagagccgccgtgcagagaagcaccagcttcggcgtgcccaacgccaacagcatcaagcagatgctgctggactggtgcagagccaagaccagaggctacgagcacgtggacatccagaacttcagcagcagctggagcgacggcatggccttctgcgccctggtgcacaacttcttccccgaggccttcgactacggccagctgagcccccagaacagaagacagaacttcgaggtggccttcagcagcgccgagacccacgccgactgcccccagctgctggacaccgaggacatggtgagactgagagagcccgactggaagatgctggtggactgcgtgcccctggtggaggtggacgacatgatgatcatgggcaagaagcccgaccccaagtgcgtgttcacctacgtgcagagcctgtacaaccacctgagaagacacgagctgagactgagaggcaagaacgtgtag

SEQ ID NO: 99244 - DNA, 1374 bp, Artificial Sequence
  Description of Artificial Sequence: Synthetic coding sequence
atggagcagaaggagggcaagctgagcgaggacggcaccaccgtgagccccgccgccgacaaccccgagatgagcggcggcggcgcccccgccgaggagaccaagggcaccgccggcaaggccatcaacgagggcccccccaccgagagcggcaagcaggagaaggcccccgccgaggacggcatgagcgccgagctgcagggcgaggccaacggcctggacgaggtgaaggtggagagccagagagaggccggcggcaaggaggacgccgaggccgagctgaagaaggaggacggcgagaaggaggagaccaccgtgggcagccaggagatgaccggcagaaaggaggagaccaagagcgagcccaaggaggccgaggagaaggagagcaccctggccagcgagaagcagaaggccgaggagaaggaggccaagcccgagagcggccagaaggccgacgccaacgacagagacaagcccgagcccaaggccaccgtggaggaggaggacgccaagaccgccagccaggaggagaccgtggtggaggacgaggccaaggccgagcccaaggagcccgacggcaaggaggaggccaagcacggcgccaaggaggaggccgacgagcccggcagccccagcgaggagcaggagcaggacgtggagaaggagcccgagggcggcgccggcgtgatccccagcagccccgaggagtggcccgagagccccaccggcgagggccacaacctgagcaccgacggcctgggccccgactgcgtggccagcggccagaccagccccagcgccagcgagagcagccccagcgacgtgccccagagcccccccgagagccccagcagcggcgagaagaaggagaaggcccccgagagaagagtgagcgcccccgccagacccagaggccccagagcccagaacagaaaggccatcgtggacaagttcggcggcgccgccagcggccccaccgccctgttcagaaacaccaaggccgccggcgccgccatcggcggcgtgaagaacatgctgctggagtggtgcagagccatgaccaagaagtacgagcacgtggacatccagaacttcagcagcagctggagcagcggcatggccttctgcgccctgatccacaagttcttccccgacgccttcgactacgccgagctggaccccgccaagagaagacacaacttcaccctggccttcagcaccgccgagaagctggccgactgcgcccagctgctggacgtggacgacatggtgagactggccgtgcccgacagcaagtgcgtgtacacctacatccaggagctgtacagaagcctggtgcagaagggcctggtgaagaccaagaagaagtag

SEQ ID NO: 99245 - DNA, 1539 bp, Artificial Sequence
  Description of Artificial Sequence: Synthetic coding sequence
atgctgcccggcgccgtgggcgagagcgactgcagcgccgaggccagagagaagatggagcagaaggagggcaagctgagcgaggacggcaccaccgtgagccccgccgccgacaaccccgagatgagcggcggcggcgcccccgccgaggagaccaagggcaccgccggcaaggccatcaacgagggcccccccaccgagagcggcaagcaggagaaggcccccgccgaggacggcatgagcgccgagctgcagggcgaggccaacggcctggacgaggtgaaggtggagagccagagagaggccggcggcaaggaggacgccgaggccgagctgaagaaggaggacggcgagaaggaggagaccaccgtgggcagccaggagatgaccggcagaaaggaggagaccaagagcgagcccaaggaggccgaggagaaggagagcaccctggccagcgagaagcagaaggccgaggagaaggaggccaagcccgagagcggccagaaggccgacgccaacgacagagacaagcccgagcccaaggccaccgtggaggaggaggacgccaagaccgccagccaggaggagaccggccagagaaaggagtgcagcaccgagcccaaggagaaggccaccgacgaggaggccaaggccgagagccagaaggccgtggtggaggacgaggccaaggccgagcccaaggagcccgacggcaaggaggaggccaagcacggcgccaaggaggaggccgacgccaaggaggaggccgaggacgccgaggaggccgagcccggcagccccagcgaggagcaggagcaggacgtggagaaggagcccgagggcggcgccggcgtgatccccagcagccccgaggagtggcccgagagccccaccggcgagggccacaacctgagcaccgacggcctgggccccgactgcgtggccagcggccagaccagccccagcgccagcgagagcagccccagcgacgtgccccagagcccccccgagagccccagcagcggcgagaagaaggagaaggcccccgagagaagagtgagcgcccccgccagacccagaggccccagagcccagaacagaaaggccatcgtggacaagttcggcggcgccgccagcggccccaccgccctgttcagaaacaccaaggccgccggcgccgccatcggcggcgtgaagaacatgctgctggagtggtgcagagccatgaccaagaagtacgagcacgtggacatccagaacttcagcagcagctggagcagcggcatggccttctgcgccctgatccacaagttcttccccgacgccttcgactacgccgagctggaccccgccaagagaagacacaacttcaccctggccttcagcaccgccgagaagctggccgactgcgcccagctgctggacgtggacgacatggtgagactggccgtgcccgacagcaagtgcgtgtacacctacatccaggagctgtacagaagcctggtgcagaagggcctggtgaagaccaagaagaagtag

SEQ ID NO: 99246 - DNA, 1485 bp, Artificial Sequence
  Description of Artificial Sequence: Synthetic coding sequence
atggagcagaaggagggcaagctgagcgaggacggcaccaccgtgagccccgccgccgacaaccccgagatgagcggcggcggcgcccccgccgaggagaccaagggcaccgccggcaaggccatcaacgagggcccccccaccgagagcggcaagcaggagaaggcccccgccgaggacggcatgagcgccgagctgcagggcgaggccaacggcctggacgaggtgaaggtggagagccagagagaggccggcggcaaggaggacgccgaggccgagctgaagaaggaggacggcgagaaggaggagaccaccgtgggcagccaggagatgaccggcagaaaggaggagaccaagagcgagcccaaggaggccgaggagaaggagagcaccctggccagcgagaagcagaaggccgaggagaaggaggccaagcccgagagcggccagaaggccgacgccaacgacagagacaagcccgagcccaaggccaccgtggaggaggaggacgccaagaccgccagccaggaggagaccggccagagaaaggagtgcagcaccgagcccaaggagaaggccaccgacgaggaggccaaggccgagagccagaaggccgtggtggaggacgaggccaaggccgagcccaaggagcccgacggcaaggaggaggccaagcacggcgccaaggaggaggccgacgccaaggaggaggccgaggacgccgaggaggccgagcccggcagccccagcgaggagcaggagcaggacgtggagaaggagcccgagggcggcgccggcgtgatccccagcagccccgaggagtggcccgagagccccaccggcgagggccacaacctgagcaccgacggcctgggccccgactgcgtggccagcggccagaccagccccagcgccagcgagagcagccccagcgacgtgccccagagcccccccgagagccccagcagcggcgagaagaaggagaaggcccccgagagaagagtgagcgcccccgccagacccagaggccccagagcccagaacagaaaggccatcgtggacaagttcggcggcgccgccagcggccccaccgccctgttcagaaacaccaaggccgccggcgccgccatcggcggcgtgaagaacatgctgctggagtggtgcagagccatgaccaagaagtacgagcacgtggacatccagaacttcagcagcagctggagcagcggcatggccttctgcgccctgatccacaagttcttccccgacgccttcgactacgccgagctggaccccgccaagagaagacacaacttcaccctggccttcagcaccgccgagaagctggccgactgcgcccagctgctggacgtggacgacatggtgagactggccgtgcccgacagcaagtgcgtgtacacctacatccaggagctgtacagaagcctggtgcagaagggcctggtgaagaccaagaagaagtag

SEQ ID NO: 99247 - DNA, 312 bp, Artificial Sequence
  Description of Artificial Sequence: Synthetic coding sequence
atgagcgaggagaagcccaaggagggcgtgaagaccgagaacgaccacatcaacctgaaggtggccggccaggacggcagcgtggtgcagttcaagatcaagagacacacccccctgagcaagctgatgaaggcctactgcgagagacagggcctgagcatgagacagatcagattcagattcgacggccagcccatcaacgagaccgacacccccgcccagctggagatggaggacgaggacaccatcgacgtgttccagcagcagaccggcggcgtgcccgagagcagcctggccggccacagcttctag

SEQ ID NO: 99248 - DNA, 426 bp, Artificial Sequence
  Description of Artificial Sequence: Synthetic coding sequence
atgagcgaggagaagcccaaggagggcgtgaagaccgagaacgaccacatcaacctgaaggtggccggccaggacggcagcgtggtgcagttcaagatcaagagacacacccccctgagcaagctgatgaaggcctactgcgagagacaggtgagacacctggcccccccccagagcctgcccgtgtgcgccctggtgctgtgcgtgcccggcatccccagagccagagccagcagaggctggacccagatgcagctgcccgagggcctgagcatgagacagatcagattcagattcgacggccagcccatcaacgagaccgacacccccgcccagctggagatggaggacgaggacaccatcgacgtgttccagcagcagaccggcggcgtgcccgagagcagcctggccggccacagcttctag

SEQ ID NO: 99249 - DNA, 288 bp, Artificial Sequence
  Description of Artificial Sequence: Synthetic coding sequence
atggccaacgagaagcccaccgaggaggtgaagaccgagaacaacaaccacatcaacctgaaggtggccggccaggacggcagcgtggtgcagttcaagatcaagagacagacccccctgagcaagctgatgaaggcctactgcgagcccagaggcctgagcgtgaagcagatcagattcagattcggcggccagcccatcagcggcaccgacaagcccgcccagctggagatggaggacgaggacaccatcgacgtgttccagcagcccaccggcggcgtgtactag

SEQ ID NO: 99250 - DNA, 411 bp, Artificial Sequence
  Description of Artificial Sequence: Synthetic coding sequence
atggccggcgccggcagcgccgccgtgagcggcgccggcacccccgtggccggccccaccggcagagacctgttcgccgagggcctgctggagttcctgagacccgccgtgcagcagctggacagccacgtgcacgccgtgagagagagccaggtggagctgagagagcagatcgacaacctggccaccgagctgtgcagaatcaacgaggaccagaaggtggccctggacctggacccctacgtgaagaagctgctgaacgccagaagaagagtggtgctggtgaacaacatcctgcagaacgcccaggagagactgagaagactgaaccacagcgtggccaaggagaccgccagaagaagagccatgctggacagcggcatctacccccccggcagccccggcaagtag

SEQ ID NO: 99251 - DNA, 2298 bp, Artificial Sequence
  Description of Artificial Sequence: Synthetic coding sequence
atggccggcttcaagagaggctacgacggcaagatcgccggcctgtacgacctggacaagaccctgggcagaggccacttcgccgtggtgaagctggccagacacgtgttcaccggcgagaaggtggccgtgaaggtgatcgacaagaccaagctggacaccctggccaccggccacctgttccaggaggtgagatgcatgaagctggtgcagcaccccaacatcgtgagactgtacgaggtgatcgacacccagaccaagctgtacctgatcctggagctgggcgacggcggcgacatgttcgactacatcatgaagcacgaggagggcctgaacgaggacctggccaagaagtacttcgcccagatcgtgcacgccatcagctactgccacaagctgcacgtggtgcacagagacctgaagcccgagaacgtggtgttcttcgagaagcagggcctggtgaagctgaccgacttcggcttcagcaacaagttccagcccggcaagaagctgaccaccagctgcggcagcctggcctacagcgcccccgagatcctgctgggcgacgagtacgacgcccccgccgtggacatctggagcctgggcgtgatcctgttcatgctggtgtgcggccagccccccttccaggaggccaacgacagcgagaccctgaccatgatcatggactgcaagtacaccgtgcccagccacgtgagcaaggagtgcaaggacctgatcaccagaatgctgcagagagaccccaagagaagagccagcctggaggagatcgagaaccacccctggctgcagggcgtggaccccagccccgccaccaagtacaacatccccctggtgagctacaagaacctgagcgaggaggagcacaacagcatcatccagagaatggtgctgggcgacatcgccgacagagacgccatcgtggaggccctggagaccaacagatacaaccacatcaccgccacctacttcctgctggccgagagaatcctgagagagaagcaggagaaggagatccagaccagaagcgccagccccagcaacatcaaggcccagttcagacagagctggcccaccaagatcgacgtgccccaggacctggaggacgacctgaccgccacccccctgagccacgccaccgtgccccagagccccgccagagccgccgacagcgtgctgaacggccacagaagcaagggcctgtgcgacagcgccaagaaggacgacctgcccgagctggccggccccgccctgagcaccgtgccccccgccagcctgaagcccaccgccagcggcagaaagtgcctgttcagagtggaggaggacgaggaggaggacgaggaggacaagaagcccatgagcctgagcacccaggtggtgctgagaagaaagcccagcgtgaccaacagactgaccagcagaaagagcgcccccgtgctgaaccagatcttcgaggagggcgagagcgacgacgagttcgacatggacgagaacctgccccccaagctgagcagactgaagatgaacatcgccagccccggcaccgtgcacaagagataccacagaagaaagagccagggcagaggcagcagctgcagcagcagcgagaccagcgacgacgacagcgagagcagaagaagactggacaaggacagcggcttcacctacagctggcacagaagagacagcagcgagggcccccccggcagcgagggcgacggcggcggccagagcaagcccagcaacgccagcggcggcgtggacaaggccagccccagcgagaacaacgccggcggcggcagccccagcagcggcagcggcggcaaccccaccaacaccagcggcaccaccagaagatgcgccggccccagcaacagcatgcagctggccagcagaagcgccggcgagctggtggagagcctgaagctgatgagcctgtgcctgggcagccagctgcacggcagcaccaagtacatcatcgacccccagaacggcctgagcttcagcagcgtgaaggtgcaggagaagagcacctggaagatgtgcatcagcagcaccggcaacgccggccaggtgcccgccgtgggcggcatcaagttcttcagcgaccacatggccgacaccaccaccgagctggagagaatcaagagcaagaacctgaagaacaacgtgctgcagctgcccctgtgcgagaagaccatcagcgtgaacatccagagaaaccccaaggagggcctgctgtgcgccagcagccccgccagctgctgccacgtgatctag

SEQ ID NO: 99252 - DNA, 2298 bp, Artificial Sequence; identical to SEQ ID NO: 99251
  Description of Artificial Sequence: Synthetic coding sequence

SEQ ID NO: 99253 - DNA, 2298 bp, Artificial Sequence; identical to SEQ ID NO: 99251
  Description of Artificial Sequence: Synthetic coding sequence

SEQ ID NO: 99254 - DNA, 9693 bp, Artificial Sequence
  Description of Artificial Sequence: Synthetic coding sequence
atgcagagcagccccagccccgcccacccccagctgcccgtgctgcagacccagatggtgagcgacggcatgaccggcagcaaccccgtgagccccgccagcagcagcagccccgccagcagcggcgccggcggcatcagcccccagcacatcgcccaggacagcagcctggacggcccccccggcccccccgacggcgccaccgtgcccctggagggcttcagcctgagccaggccgccgacctggccaacaagggccccaagtgggagaagagccacgccgagatcgccgagcaggccaagcacgaggccgagatcgagaccagaatcgccgagctgagaaaggagggcttctggagcctgaagagactgcccaaggtgcccgagccccccagacccaagggccactgggactacctgtgcgaggagatgcagtggctgagcgccgacttcgcccaggagagaagatggaagagaggcgtggccagaaaggtggtgagaatggtgatcagacaccacgaggagcagagacagaaggaggagagagccagaagagaggagcaggccaagctgagaagaatcgccagcaccatggccaaggacgtgagacagttctggagcaacgtggagaaggtggtgcagttcaagcagcagagcagactggaggagaagagaaagaaggccctggacctgcacctggacttcatcgtgggccagaccgagaagtacagcgacctgctgagccagagcctgaaccagcccctgaccagcagcaaggccggcagcagcccctgcctgggcagcagcagcgccgccagcagcccccccccccccgccagcagactggacgacgaggacggcgacttccagccccaggaggacgaggaggaggacgacgaggagaccatcgaggtggaggagcagcaggagggcaacgacgccgaggcccagagaagagagatcgagctgctgagaagagagggcgagctgcccctggaggagctgctgagaagcctgcccccccagctgctggagggccccagcagccccagccagacccccagcagccacgacagcgacaccagagacggccccgaggagggcgccgaggaggagcccccccaggtgctggagatcaagcccccccccagcgccgtgacccagagaaacaagcagccctggcaccccgacgaggacgacgaggagttcaccgccaacgaggaggaggccgaggacgaggaggacaccatcgccgccgaggagcagctggagggcgaggtggaccacgccatggagctgagcgagctggccagagagggcgagctgagcatggaggagctgctgcagcagtacgccggcgcctacgcccccggcagcggcagcagcgaggacgaggacgaggacgaggtggacgccaacagcagcgactgcgagcccgagggccccgtggaggccgaggagcccccccaggaggacagcagcagccagagcgacagcgtggaggacagaagcgaggacgaggaggacgagcacagcgaggaggaggagaccagcggcagcagcgccagcgaggagagcgagagcgaggagagcgaggacgcccagagccagagccaggccgacgaggaggaggaggacgacgacttcggcgtggagtacctgctggccagagacgaggagcagagcgaggccgacgccggcagcggcccccccacccccggccccaccaccctgggccccaagaaggagatcaccgacatcgccgccgccgccgagagcctgcagcccaagggctacaccctggccaccacccaggtgaagacccccatccccctgctgctgagaggccagctgagagagtaccagcacatcggcctggactggctggtgaccatgtacgagaagaagctgaacggcatcctggccgacgagatgggcctgggcaagaccatccagaccatcagcctgctggcccacctggcctgcgagaagggcaactggggcccccacctgatcatcgtgcccaccagcgtgatgctgaactgggagatggagctgaagagatggtgccccagcttcaagatcctgacctactacggcgcccagaaggagagaaagctgaagagacagggctggaccaagcccaacgccttccacgtgtgcatcaccagctacaagctggtgctgcaggaccaccaggccttcagaagaaagaactggagatacctgatcctggacgaggcccagaacatcaagaacttcaagagccagagatggcagagcctgctgaacttcaacagccagagaagactgctgctgaccggcacccccctgcagaacagcctgatggagctgtggagcctgatgcacttcctgatgccccacgtgttccagagccacagagagttcaaggagtggttcagcaaccccctgaccggcatgatcgagggcagccaggagtacaacgagggcctggtgaagagactgcacaaggtgctgagacccttcctgctgagaagagtgaaggtggacgtggagaagcagatgcccaagaagtacgagcacgtgatcagatgcagactgagcaagagacagagatgcctgtacgacgacttcatggcccagaccaccaccaaggagaccctggccaccggccacttcatgagcgtgatcaacatcctgatgcagctgagaaaggtgtgcaaccaccccaacctgttcgaccccagacccgtgaccagccccttcatcacccccggcatctgcttcagcaccgccagcctggtgctgagagccaccgacgtgcaccccctgcagagaatcgacatgggcagattcgacctgatcggcctggagggcagagtgagcagatacgaggccgacaccttcctgcccagacacagactgagcagaagagtgctgctggaggtggccaccgcccccgaccccccccccagacccaagcccgtgaagatgaaggtgaacagaatgctgcagcccgtgcccaagcaggagggcagaaccgtggtggtggtgaacaaccccagagcccccctgggccccgtgcccgtgagacccccccccggccccgagctgagcgcccagcccacccccggccccgtgccccaggtgctgcccgccagcctgatggtgagcgccagccccgccggcccccccctgatccccgccagcagaccccccggccccgtgctgctgccccccctgcagcccaacagcggcagcctgccccaggtgctgcccagccccctgggcgtgctgagcggcaccagcagaccccccacccccaccctgagcctgaagcccaccccccccgcccccgtgagactgagccccgcccccccccccggcagcagcagcctgctgaagcccctgaccgtgccccccggctacaccttcccccccgccgccgccaccaccaccagcaccaccaccgccaccgccaccaccaccgccgtgcccgcccccacccccgccccccagagactgatcctgagccccgacatgcaggccagactgcccagcggcgaggtggtgagcatcggccagctggccagcctggcccagagacccgtggccaacgccggcggcagcaagcccctgaccttccagatccagggcaacaagctgaccctgaccggcgcccaggtgagacagctggccgtgggccagcccagacccctgcagagaaacgtggtgcacctggtgagcgccggcggccagcaccacctgatcagccagcccgcccacgtggccctgatccaggccgtggcccccacccccggccccacccccgtgagcgtgctgcccagcagcacccccagcaccacccccgcccccaccggcctgagcctgcccctggccgccaaccaggtgccccccaccatggtgaacaacaccggcgtggtgaagatcgtggtgagacaggcccccagagacggcctgacccccgtgccccccctggcccccgcccccagaccccccagcagcggcctgcccgccgtgctgaaccccagacccaccctgacccccggcagactgcccacccccaccctgggcaccgccagagcccccatgcccacccccaccctggtgagacccctgctgaagctggtgcacagccccagccccgaggtgagcgccagcgcccccggcgccgcccccctgaccatcagcagccccctgcacgtgcccagcagcctgcccggccccgccagcagccccatgcccatccccaacagcagccccctggccagccccgtgagcagcaccgtgagcgtgcccctgagcagcagcctgcccatcagcgtgcccaccaccctgcccgcccccgccagcgcccccctgaccatccccatcagcgcccccctgaccgtgagcgccagcggccccgccctgctgaccagcgtgaccccccccctggcccccgtggtgcccgccgcccccggcccccccagcctggcccccagcggcgccagccccagcgccagcgccctgaccctgggcctggccaccgcccccagcctgagcagcagccagacccccggccaccccctgctgctggcccccaccagcagccacgtgcccggcctgaacagcaccgtggcccccgcctgcagccccgtgctggtgcccgccagcgccctggccagccccttccccagcgcccccaaccccgcccccgcccaggccagcctgctggcccccgccagcagcgccagccaggccctggccacccccctggcccccatggccgccccccagaccgccatcctggcccccagccccgccccccccctggcccccctgcccgtgctggcccccagccccggcgccgcccccgtgctggccagcagccagacccccgtgcccgtgatggcccccagcagcacccccggcaccagcctggccagcgccagccccgtgcccgcccccacccccgtgctggcccccagcagcacccagaccatgctgcccgcccccgtgcccagccccctgcccagccccgccagcacccagaccctggccctggcccccgccctggcccccaccctgggcggcagcagccccagccagaccctgagcctgggcaccggcaacccccagggccccttccccacccagaccctgagcctgacccccgccagcagcctggtgcccacccccgcccagaccctgagcctggcccccggcccccccctgggccccacccagaccctgagcctggcccccgccccccccctggcccccgccagccccgtgggccccgcccccgcccacaccctgaccctggcccccgccagcagcagcgccagcctgctggcccccgccagcgtgcagaccctgaccctgagccccgcccccgtgcccaccctgggccccgccgccgcccagaccctggccctggcccccgccagcacccagagccccgccagccaggccagcagcctggtggtgagcgccagcggcgccgcccccctgcccgtgaccatggtgagcagactgcccgtgagcaaggacgagcccgacaccctgaccctgagaagcggcccccccagcccccccagcaccgccaccagcttcggcggccccagacccagaagacagcccccccccccccccagaagccccttctacctggacagcctggaggagaagagaaagagacagagaagcgagagactggagagaatcttccagctgagcgaggcccacggcgccctggcccccgtgtacggcaccgaggtgctggacttctgcaccctgccccagcccgtggccagccccatcggccccagaagccccggccccagccaccccaccttctggacctacaccgaggccgcccacagagccgtgctgttcccccagcagagactggaccagctgagcgagatcatcgagagattcatcttcgtgatgccccccgtggaggcccccccccccagcctgcacgcctgccacccccccccctggctggcccccagacaggccgccttccaggagcagctggccagcgagctgtggcccagagccagacccctgcacagaatcgtgtgcaacatgagaacccagttccccgacctgagactgatccagtacgactgcggcaagctgcagaccctggccgtgctgctgagacagctgaaggccgagggccacagagtgctgatcttcacccagatgaccagaatgctggacgtgctggagcagttcctgacctaccacggccacctgtacctgagactggacggcagcaccagagtggagcagagacaggccctgatggagagattcaacgccgacaagagaatcttctgcttcatcctgagcaccagaagcggcggcgtgggcgtgaacctgaccggcgccgacaccgtggtgttctacgacagcgactggaaccccaccatggacgcccaggcccaggacagatgccacagaatcggccagaccagagacgtgcacatctacagactgatcagcgagagaaccgtggaggagaacatcctgaagaaggccaaccagaagagaatgctgggcgacatggccatcgagggcggcaacttcaccaccgcctacttcaagcagcagaccatcagagagctgttcgacatgcccctggaggagcccagcagcagcagcgtgcccagcgcccccgaggaggaggaggagaccgtggccagcaagcagacccacatcctggagcaggccctgtgcagagccgaggacgaggaggacatcagagccgccacccaggccaaggccgagcaggtggccgagctggccgagttcaacgagaacgacggcttccccgccggcgagggcgaggaggccggcagacccggcgccgaggacgaggagatgagcagagccgagcaggagatcgccgccctggtggagcagctgacccccatcgagagatacgccatgaagttcctggaggccagcctggaggaggtgagcagagaggagctgaagcaggccgaggagcaggtggaggccgccagaaaggacctggaccaggccaaggaggaggtgttcagactgccccaggaggaggaggagggccccggcgccggcgacgagagcagctgcggcaccggcggcggcacccacagaagaagcaagaaggccaaggcccccgagagacccggcaccagagtgagcgagagactgagaggcgccagagccgagacccagggcgccaaccacacccccgtgatcagcgcccaccagaccagaagcaccaccaccccccccagatgcagccccgccagagagagagtgcccagacccgcccccagacccagacccacccccgccagcgcccccgccgccatccccgccctggtgcccgtgcccgtgagcgcccccgtgcccatcagcgcccccaaccccatcaccatcctgcccgtgcacatcctgcccagcccccccccccccagccagatccccccctgcagcagccccgcctgcacccccccccccgcctgcacccccccccccgcccacacccccccccccgcccagacctgcctggtgacccccagcagccccctgctgctgggcccccccagcgtgcccatcagcgccagcgtgaccaacctgcccctgggcctgagacccgaggccgagctgtgcgcccaggccctggccagccccgagagcctggagctggccagcgtggccagcagcgagaccagcagcctgagcctggtgccccccaaggacctgctgcccgtggccgtggagatcctgcccgtgagcgagaagaacctgagcctgacccccagcgcccccagcctgaccctggaggccggcagcatccccaacggccaggagcaggaggcccccgacagcgccgagggcaccaccctgaccgtgctgcccgagggcgaggagctgcccctgtgcgtgagcgagagcaacggcctggagctgccccccagcgccgccagcgacgagcccctgcaggagcccctggaggccgacagaaccagcgaggagctgaccgaggccaagacccccaccagcagccccgagaagccccaggagctggtgaccgccgaggtggccgcccccagcaccagcagcagcgccaccagcagccccgagggccccagccccgccagaccccccagaagaagaaccagcgccgacgtggagatcagaggccagggcaccggcagacccggccagccccccggccccaaggtgctgagaaagctgcccggcagactggtgaccgtggtggaggagaaggagctggtgagaagaagaagacagcagagaggcgccgccagcaccctggtgcccggcgtgagcgagaccagcgccagccccggcagccccagcgtgagaagcatgagcggccccgagagcagcccccccatcggcggcccctgcgaggccgcccccagcagcagcctgcccacccccccccagcagcccttcatcgccagaagacacatcgagctgggcgtgaccggcggcggcagccccgagaacggcgacggcgccctgctggccatcaccccccccgccgtgaagagaagaagaggcagaccccccaagaagaacagaagccccgccgacgccggcagaggcgtggacgaggcccccagcagcaccctgaagggcaagaccaacggcgccgaccccgtgcccggccccgagaccctgatcgtggccgaccccgtgctggagccccagctgatccccggcccccagcccctgggcccccagcccgtgcacagacccaaccccctgctgagccccgtggagaagagaagaagaggcagaccccccaaggccagagacctgcccatccccggcaccatcagcagcgccggcgacggcaacagcgagagcagaacccagccccccccccaccccagccccctgacccccctgccccccctgctggtgtgccccaccgccaccgtggccaacaccgtgaccaccgtgaccatcagcaccagcccccccaagagaaagagaggcagaccccccaagaacccccccagccccagacccagccagctgcccgtgctggacagagacagcaccagcgtgctggagagctgcggcctgggcagaagaagacagccccagggccagggcgagagcgagggcagcagcagcgacgaggacggcagcagacccctgaccagactggccagactgagactggaggccgagggcatgagaggcagaaagagcggcggcagcatggtggtggccgtgatccaggacgacctggacctggccgacagcggccccggcggcctggagctgaccccccccgtggtgagcctgacccccaagctgagaagcaccagactgagacccggcagcctggtgccccccctggagaccgagaagctgcccagaaagagagccggcgcccccgtgggcggcagccccggcctggccaagagaggcagactgcagccccccagccccctgggccccgagggcagcgtggaggagagcgaggccgaggccagcggcgaggaggaggagggcgacggcacccccagaagaagacccggccccagaagactggtgggcaccaccaaccagggcgaccagagaatcctgagaagcagcgccccccccagcctggccggccccgccgtgagccacagaggcagaaaggccaagacctag

SEQ ID NO: 99255 - DNA, 9219 bp, Artificial Sequence
  Description of Artificial Sequence: Synthetic coding sequence
atgcagagcagccccagccccgcccacccccagctgcccgtgctgcagacccagatggtgagcgacggcatgaccggcagcaaccccgtgagccccgccagcagcagcagccccgccagcagcggcgccggcggcatcagcccccagcacatcgcccaggacagcagcctggacggcccccccggcccccccgacggcgccaccgtgcccctggagggcttcagcctgagccaggccgccgacctggccaacaagggccccaagtgggagaagagccacgccgagatcgccgagcaggccaagcacgaggccgagatcgagaccagaatcgccgagctgagaaaggagggcttctggagcctgaagagactgcccaaggtgcccgagccccccagacccaagggccactgggactacctgtgcgaggagatgcagtggctgagcgccgacttcgcccaggagagaagatggaagagaggcgtggccagaaaggtggtgagaatggtgatcagacaccacgaggagcagagacagaaggaggagagagccagaagagaggagcaggccaagctgagaagaatcgccagcaccatggccaaggacgtgagacagttctggagcaacgtggagaaggtggtgcagttcaagcagcagagcagactggaggagaagagaaagaaggccctggacctgcacctggacttcatcgtgggccagaccgagaagtacagcgacctgctgagccagagcctgaaccagcccctgaccagcagcaaggccggcagcagcccctgcctgggcagcagcagcgccgccagcagcccccccccccccgccagcagactggacgacgaggacggcgacttccagccccaggaggacgaggaggaggacgacgaggagaccatcgaggtggaggagcagcaggagggcaacgacgccgaggcccagagaagagagatcgagctgctgagaagagagggcgagctgcccctggaggagctgctgagaagcctgcccccccagctgctggagggccccagcagccccagccagacccccagcagccacgacagcgacaccagagacggccccgaggagggcgccgaggaggagcccccccaggtgctggagatcaagcccccccccagcgccgtgacccagagaaacaagcagccctggcaccccgacgaggacgacgaggagttcaccgccaacgaggaggaggccgaggacgaggaggacaccatcgccgccgaggagcagctggagggcgaggtggaccacgccatggagctgagcgagctggccagagagggcgagctgagcatggaggagctgctgcagcagtacgccggcgcctacgcccccggcagcggcagcagcgaggacgaggacgaggacgaggtggacgccaacagcagcgactgcgagcccgagggccccgtggaggccgaggagcccccccaggaggacagcagcagccagagcgacagcgtggaggacagaagcgaggacgaggaggacgagcacagcgaggaggaggagaccagcggcagcagcgccagcgaggagagcgagagcgaggagagcgaggacgcccagagccagagccaggccgacgaggaggaggaggacgacgacttcggcgtggagtacctgctggccagagacgaggagcagagcgaggccgacgccggcagcggcccccccacccccggccccaccaccctgggccccaagaaggagatcaccgacatcgccgccgccgccgagagcctgcagcccaagggctacaccctggccaccacccaggtgaagacccccatccccctgctgctgagaggccagctgagagagtaccagcacatcggcctggactggctggtgaccatgtacgagaagaagctgaacggcatcctggccgacgagatgggcctgggcaagaccatccagaccatcagcctgctggcccacctggcctgcgagaagggcaactggggcccccacctgatcatcgtgcccaccagcgtgatgctgaactgggagatggagctgaagagatggtgccccagcttcaagatcctgacctactacggcgcccagaaggagagaaagctgaagagacagggctggaccaagcccaacgccttccacgtgtgcatcaccagctacaagctggtgctgcaggaccaccaggccttcagaagaaagaactggagatacctgatcctggacgaggcccagaacatcaagaacttcaagagccagagatggcagagcctgctgaacttcaacagccagagaagactgctgctgaccggcacccccctgcagaacagcctgatggagctgtggagcctgatgcacttcctgatgccccacgtgttccagagccacagagagttcaaggagtggttcagcaaccccctgaccggcatgatcgagggcagccaggagtacaacgagggcctggtgaagagactgcacaaggtgctgagacccttcctgctgagaagagtgaaggtggacgtggagaagcagatgcccaagaagtacgagcacgtgatcagatgcagactgagcaagagacagagatgcctgtacgacgacttcatggcccagaccaccaccaaggagaccctggccaccggccacttcatgagcgtgatcaacatcctgatgcagctgagaaaggtgtgcaaccaccccaacctgttcgaccccagacccgtgaccagccccttcatcacccccggcatctgcttcagcaccgccagcctggtgctgagagccaccgacgtgcaccccctgcagagaatcgacatgggcagattcgacctgatcggcctggagggcagagtgagcagatacgaggccgacaccttcctgcccagacacagactgagcagaagagtgctgctggaggtggccaccgcccccgaccccccccccagacccaagcccgtgaagatgaaggtgaacagaatgctgcagcccgtgcccaagcaggagggcagaaccgtggtggtggtgaacaaccccagagcccccctgggccccgtgcccgtgagacccccccccggccccgagctgagcgcccagcccacccccggccccgtgccccaggtgctgcccgccagcctgatggtgagcgccagccccgccggcccccccctgatccccgccagcagaccccccggccccgtgctgctgccccccctgcagcccaacagcggcagcctgccccaggccggcgaggtggtgagcatcggccagctggccagcctggcccagagacccgtggccaacgccggcggcagcaagcccctgaccttccagatccagggcaacaagctgaccctgaccggcgcccaggtgagacagctggccgtgggccagcccagacccctgcagatgccccccaccatggtgaacaacaccggcgtggtgaagatcgtggtgagacaggcccccagagacggcctgacccccgtgccccccctggcccccgcccccagaccccccagcagcggcctgcccgccgtgctgaaccccagacccaccctgacccccggcagactgcccacccccaccctgggcaccgccagagcccccatgcccacccccaccctggtgagacccctgctgaagctggtgcacagccccagccccgaggtgagcgccagcgcccccggcgccgcccccctgaccatcagcagccccctgcacgtgcccagcagcctgcccggccccgccagcagccccatgcccatccccaacagcagccccctggccagccccgtgagcagcaccgtgagcgtgcccctgagcagcagcctgcccatcagcgtgcccaccaccctgcccgcccccgccagcgcccccctgaccatccccatcagcgcccccctgaccgtgagcgccagcggccccgccctgctgaccagcgtgaccccccccctggcccccgtggtgcccgccgcccccggcccccccagcctggcccccagcggcgccagccccagcgccagcgccctgaccctgggcctggccaccgcccccagcctgagcagcagccagacccccggccaccccctgctgctggcccccaccagcagccacgtgcccggcctgaacagcaccgtggcccccgcctgcagccccgtgctggtgcccgccagcgccctggccagccccttccccagcgcccccaaccccgcccccgcccaggccagcctgctggcccccgccagcagcgccagccaggccctggccacccccctggcccccatggccgccccccagaccgccatcctggcccccagccccgccccccccctggcccccctgcccgtgctggcccccagccccggcgccgcccccgtgctggccagcagccagacccccgtgcccgtgatggcccccagcagcacccccggcaccagcctggccagcgccagccccgtgcccgcccccacccccgtgctggcccccagcagcacccagaccatgctgcccgcccccgtgcccagccccctgcccagccccgccagcacccagaccctggccctggcccccgccctggcccccaccctgggcggcagcagccccagccagaccctgagcctgggcaccggcaacccccagggccccttccccacccagaccctgagcctgacccccgccagcagcctggtgcccacccccgcccagaccctgagcctggcccccggcccccccctgggccccacccagaccctgagcctggcccccgccccccccctggcccccgccagccccgtgggccccgcccccgcccacaccctgaccctggcccccgccagcagcagcgccagcctgctggcccccgccagcgtgcagaccctgaccctgagccccgcccccgtgcccaccctgggccccgccgccgcccagaccctggccctggcccccgccagcacccagagccccgccagccaggccagcagcctggtggtgagcgccagcggcgccgcccccctgcccgtgaccatggtgagcagactgcccgtgagcaaggacgagcccgacaccctgaccctgagaagcggcccccccagcccccccagcaccgccaccagcttcggcggccccagacccagaagacagcccccccccccccccagaagccccttctacctggacagcctggaggagaagagaaagagacagagaagcgagagactggagagaatcttccagctgagcgaggcccacggcgccctggcccccgtgtacggcaccgaggtgctggacttctgcaccctgccccagcccgtggccagccccatcggccccagaagccccggccccagccaccccaccttctggacctacaccgaggccgcccacagagccgtgctgttcccccagcagagactggaccagctgagcgagatcatcgagagattcatcttcgtgatgccccccgtggaggcccccccccccagcctgcacgcctgccacccccccccctggctggcccccagacaggccgccttccaggagcagctggccagcgagctgtggcccagagccagacccctgcacagaatcgtgtgcaacatgagaacccagttccccgacctgagactgatccagtacgactgcggcaagctgcagaccctggccgtgctgctgagacagctgaaggccgagggccacagagtgctgatcttcacccagatgaccagaatgctggacgtgctggagcagttcctgacctaccacggccacctgtacctgagactggacggcagcaccagagtggagcagagacaggccctgatggagagattcaacgccgacaagagaatcttctgcttcatcctgagcaccagaagcggcggcgtgggcgtgaacctgaccggcgccgacaccgtggtgttctacgacagcgactggaaccccaccatggacgcccaggcccaggacagatgccacagaatcggccagaccagagacgtgcacatctacagactgatcagcgagagaaccgtggaggagaacatcctgaagaaggccaaccagaagagaatgctgggcgacatggccatcgagggcggcaacttcaccaccgcctacttcaagcagcagaccatcagagagctgttcgacatgcccctggaggagcccagcagcagcagcgtgcccagcgcccccgaggaggaggaggagaccgtggccagcaagcagacccacatcctggagcaggccctgtgcagagccgaggacgaggaggacatcagagccgccacccaggccaaggccgagcaggtggccgagctggccgagttcaacgagaacgacggcttccccgccggcgagggcgaggaggccggcagacccggcgccgaggacgaggagatgagcagagccgagcaggagatcgccgccctggtggagcagctgacccccatcgagagatacgccatgaagttcctggaggccagcctggaggaggtgagcagagaggagctgaagcaggccgaggagcaggtggaggccgccagaaaggacctggaccaggccaaggaggaggtgttcagactgccccaggaggaggaggagggccccggcgccggcgacgagagcagctgcggcaccggcggcggcacccacagaagaagcaagaaggccaaggcccccgagagacccggcaccagagtgagcgagagactgagaggcgccagagccgagacccagggcgccaaccacacccccgtgatcagcgcccaccagaccagaagcaccaccaccccccccagatgcagccccgccagagagagagtgcccagacccgcccccagacccagacccacccccgccagcgcccccgccgccatccccgccctggtgcccgtgcccgtgagcgcccccgtgcccatcagcgcccccaaccccatcaccatcctgcccgtgcacatcctgcccagcccccccccccccagccagatccccccctgcagcagccccgcctgcacccccccccccgcctgcacccccccccccgcccacacccccccccccgcccagacctgcctggtgacccccagcagccccctgctgctgggcccccccagcgtgcccatcagcgccagcgtgaccaacctgcccctgggcctgagacccgaggccgagctgtgcgcccaggccctggccagccccgagagcctggagctggccagcgtggccagcagcgagaccagcagcctgagcctggtgccccccaaggacctgctgcccgtggccgtggagatcctgcccgtgagcgagaagaacctgagcctgacccccagcgcccccagcctgaccctggaggccggcagcatccccaacggccaggagcaggaggcccccgacagcgccgagggcaccaccctgaccgtgctgcccgagggcgaggagctgcccctgtgcgtgagcgagagcaacggcctggagctgccccccagcgccgccagcgacgagcccctgcaggagcccctggaggccgacagaaccagcgaggagctgaccgaggccaagacccccaccagcagccccgagaagccccaggagctggtgaccgccgaggtggccgcccccagcaccagcagcagcgccaccagcagccccgagggccccagccccgccagaccccccagaagaagaaccagcgccgacgtggagatcagaggccagggcaccggcagacccggccagccccccggccccaaggtgctgagaaagctgcccggcagactggtgaccgtggtggaggagaaggagctggtgagaagaagaagacagcagagaggcgccgccagcaccctggtgcccggcgtgagcgagaccagcgccagccccggcagccccagcgtgagaagcatgagcggccccgagagcagcccccccatcggcggcccctgcgaggccgcccccagcagcagcctgcccacccccccccagcagcccttcatcgccagaagacacatcgagctgggcgtgaccggcggcggcagccccgagaacggcgacggcgccctgctggccatcaccccccccgccgtgaagagaagaagaggcagaccccccaagaagaacagaagccccgccgacgccggcagaggcgtggacgaggcccccagcagcaccctgaagggcaagaccaacggcgccgaccccgtgcccggccccgagaccctgatcgtggccgaccccgtgctggagccccagctgatccccggcccccagcccctgggcccccagcccgtgcacagacccaaccccctgctgagccccgtggagaagagaagaagaggcagaccccccaaggccagagacctgcccatccccggcaccatcagcagcgccggcgacggcaacagcgagagcagaacccagccccccccccaccccagccccctgacccccctgccccccctgctggtgtgccccaccgccaccgtggccaacaccgtgaccaccgtgaccatcagcaccagcccccccaagagaaagagaggcagaccccccaagaacccccccagccccagacccagccagctgcccgtgctggacagagacagcaccagcgtgctggagagctgcggcctgggcagaagaagacagccccagggccagggcgagagcgagggcagcagcagcgacgaggacggcagcagacccctgaccagactggccagactgagactggaggccgagggcatgagaggcagaaagagcggcggcagcatggtggtggccgtgatccaggacgacctggacctggccgacagcggccccggcggcctggagctgaccccccccgtggtgagcctgacccccaagctgagaagcaccagactgagacccggcagcctggtgccccccctggagaccgagaagctgcccagaaagagagccggcgcccccgtgggcggcagccccggcctggccaagagaggcagactgcagccccccagccccctgggccccgagggcagcgtggaggagagcgaggccgaggccagcggcgaggaggaggagggcgacggcacccccagaagaagacccggccccagaagactggtgggcaccaccaaccagggcgaccagagaatcctgagaagcagcgccccccccagcctggccggccccgccgtgagccacagaggcagaaaggccaagacctag

SEQ ID NO: 99256 - DNA, 9507 bp, Artificial Sequence
  Description of Artificial Sequence: Synthetic coding sequence
atgcagagcagccccagccccgcccacccccagctgcccgtgctgcagacccagatggtgagcgacggcatgaccggcagcaaccccgtgagccccgccagcagcagcagccccgccagcagcggcgccggcggcatcagcccccagcacatcgcccaggacagcagcctggacggcccccccggcccccccgacggcgccaccgtgcccctggagggcttcagcctgagccaggccgccgacctggccaacaagggccccaagtgggagaagagccacgccgagatcgccgagcaggccaagcacgaggccgagatcgagaccagaatcgccgagctgagaaaggagggcttctggagcctgaagagactgcccaaggtgcccgagccccccagacccaagggccactgggactacctgtgcgaggagatgcagtggctgagcgccgacttcgcccaggagagaagatggaagagaggcgtggccagaaaggtggtgagaatggtgatcagacaccacgaggagcagagacagaaggaggagagagccagaagagaggagcaggccaagctgagaagaatcgccagcaccatggccaaggacgtgagacagttctggagcaacgtggagaaggtggtgcagttcaagcagcagagcagactggaggagaagagaaagaaggccctggacctgcacctggacttcatcgtgggccagaccgagaagtacagcgacctgctgagccagagcctgaaccagcccctgaccagcagcaaggccggcagcagcccctgcctgggcagcagcagcgccgccagcagcccccccccccccgccagcagactggacgacgaggacggcgacttccagccccaggaggacgaggaggaggacgacgaggagaccatcgaggtggaggagcagcaggagggcaacgacgccgaggcccagagaagagagatcgagctgctgagaagagagggcgagctgcccctggaggagctgctgagaagcctgcccccccagctgctggagggccccagcagccccagccagacccccagcagccacgacagcgacaccagagacggccccgaggagggcgccgaggaggagcccccccaggtgctggagatcaagcccccccccagcgccgtgacccagagaaacaagcagccctggcaccccgacgaggacgacgaggagttcaccgccaacgaggaggaggccgaggacgaggaggacaccatcgccgccgaggagcagctggagggcgaggtggaccacgccatggagctgagcgagctggccagagagggcgagctgagcatggaggagctgctgcagcagtacgccggcgcctacgcccccggcagcggcagcagcgaggacgaggacgaggacgaggtggacgccaacagcagcgactgcgagcccgagggccccgtggaggccgaggagcccccccaggaggacagcagcagccagagcgacagcgtggaggacagaagcgaggacgaggaggacgagcacagcgaggaggaggagaccagcggcagcagcgccagcgaggagagcgagagcgaggagagcgaggacgcccagagccagagccaggccgacgaggaggaggaggacgacgacttcggcgtggagtacctgctggccagagacgaggagcagagcgaggccgacgccggcagcggcccccccacccccggccccaccaccctgggccccaagaaggagatcaccgacatcgccgccgccgccgagagcctgcagcccaagggctacaccctggccaccacccaggtgaagacccccatccccctgctgctgagaggccagctgagagagtaccagcacatcggcctggactggctggtgaccatgtacgagaagaagctgaacggcatcctggccgacgagatgggcctgggcaagaccatccagaccatcagcctgctggcccacctggcctgcgagaagggcaactggggcccccacctgatcatcgtgcccaccagcgtgatgctgaactgggagatggagctgaagagatggtgccccagcttcaagatcctgacctactacggcgcccagaaggagagaaagctgaagagacagggctggaccaagcccaacgccttccacgtgtgcatcaccagctacaagctggtgctgcaggaccaccaggccttcagaagaaagaactggagatacctgatcctggacgaggcccagaacatcaagaacttcaagagccagagatggcagagcctgctgaacttcaacagccagagaagactgctgctgaccggcacccccctgcagaacagcctgatggagctgtggagcctgatgcacttcctgatgccccacgtgttccagagccacagagagttcaaggagtggttcagcaaccccctgaccggcatgatcgagggcagccaggagtacaacgagggcctggtgaagagactgcacaaggtgctgagacccttcctgctgagaagagtgaaggtggacgtggagaagcagatgcccaagaagtacgagcacgtgatcagatgcagactgagcaagagacagagatgcctgtacgacgacttcatggcccagaccaccaccaaggagaccctggccaccggccacttcatgagcgtgatcaacatcctgatgcagctgagaaaggtgtgcaaccaccccaacctgttcgaccccagacccgtgaccagccccttcatcacccccggcatctgcttcagcaccgccagcctggtgctgagagccaccgacgtgcaccccctgcagagaatcgacatgggcagattcgacctgatcggcctggagggcagagtgagcagatacgaggccgacaccttcctgcccagacacagactgagcagaagagtgctgctggaggtggccaccgcccccgaccccccccccagacccaagcccgtgaagatgaaggtgaacagaatgctgcagcccgtgcccaagcaggagggcagaaccgtggtggtggtgaacaaccccagagcccccctgggccccgtgcccgtgagacccccccccggccccgagctgagcgcccagcccacccccggccccgtgccccaggtgctgcccgccagcctgatggtgagcgccagccccgccggcccccccctgatccccgccagcagaccccccggccccgtgctgctgccccccctgcagcccaacagcggcagcctgccccaggtgctgcccagccccctgggcgtgctgagcggcaccagcagaccccccacccccaccctgagcctgaagcccaccccccccgcccccgtgagactgagccccgcccccccccccggcagcagcagcctgctgaagcccctgaccgtgccccccggctacaccttcccccccgccgccgccaccaccaccagcaccaccaccgccaccgccaccaccaccgccgtgcccgcccccacccccgccccccagagactgatcctgagccccgacatgcaggccagactgcccagcggcgaggtggtgagcatcggccagctggccagcctggcccagagacccgtggccaacgccggcggcagcaagcccctgaccttccagatccagggcaacaagctgaccctgaccggcgcccaggtgagacagctggccgtgggccagcccagacccctgcagatgccccccaccatggtgaacaacaccggcgtggtgaagatcgtggtgagacaggcccccagagacggcctgacccccgtgccccccctggcccccgcccccagaccccccagcagcggcctgcccgccgtgctgaaccccagacccaccctgacccccggcagactgcccacccccaccctgggcaccgccagagcccccatgcccacccccaccctggtgagacccctgctgaagctggtgcacagccccagccccgaggtgagcgccagcgcccccggcgccgcccccctgaccatcagcagccccctgcacgtgcccagcagcctgcccggccccgccagcagccccatgcccatccccaacagcagccccctggccagccccgtgagcagcaccgtgagcgtgcccctgagcagcagcctgcccatcagcgtgcccaccaccctgcccgcccccgccagcgcccccctgaccatccccatcagcgcccccctgaccgtgagcgccagcggccccgccctgctgaccagcgtgaccccccccctggcccccgtggtgcccgccgcccccggcccccccagcctggcccccagcggcgccagccccagcgccagcgccctgaccctgggcctggccaccgcccccagcctgagcagcagccagacccccggccaccccctgctgctggcccccaccagcagccacgtgcccggcctgaacagcaccgtggcccccgcctgcagccccgtgctggtgcccgccagcgccctggccagccccttccccagcgcccccaaccccgcccccgcccaggccagcctgctggcccccgccagcagcgccagccaggccctggccacccccctggcccccatggccgccccccagaccgccatcctggcccccagccccgccccccccctggcccccctgcccgtgctggcccccagccccggcgccgcccccgtgctggccagcagccagacccccgtgcccgtgatggcccccagcagcacccccggcaccagcctggccagcgccagccccgtgcccgcccccacccccgtgctggcccccagcagcacccagaccatgctgcccgcccccgtgcccagccccctgcccagccccgccagcacccagaccctggccctggcccccgccctggcccccaccctgggcggcagcagccccagccagaccctgagcctgggcaccggcaacccccagggccccttccccacccagaccctgagcctgacccccgccagcagcctggtgcccacccccgcccagaccctgagcctggcccccggcccccccctgggccccacccagaccctgagcctggcccccgccccccccctggcccccgccagccccgtgggccccgcccccgcccacaccctgaccctggcccccgccagcagcagcgccagcctgctggcccccgccagcgtgcagaccctgaccctgagccccgcccccgtgcccaccctgggccccgccgccgcccagaccctggccctggcccccgccagcacccagagccccgccagccaggccagcagcctggtggtgagcgccagcggcgccgcccccctgcccgtgaccatggtgagcagactgcccgtgagcaaggacgagcccgacaccctgaccctgagaagcggcccccccagcccccccagcaccgccaccagcttcggcggccccagacccagaagacagcccccccccccccccagaagccccttctacctggacagcctggaggagaagagaaagagacagagaagcgagagactggagagaatcttccagctgagcgaggcccacggcgccctggcccccgtgtacggcaccgaggtgctggacttctgcaccctgccccagcccgtggccagccccatcggccccagaagccccggccccagccaccccaccttctggacctacaccgaggccgcccacagagccgtgctgttcccccagcagagactggaccagctgagcgagatcatcgagagattcatcttcgtgatgccccccgtggaggcccccccccccagcctgcacgcctgccacccccccccctggctggcccccagacaggccgccttccaggagcagctggccagcgagctgtggcccagagccagacccctgcacagaatcgtgtgcaacatgagaacccagttccccgacctgagactgatccagtacgactgcggcaagctgcagaccctggccgtgctgctgagacagctgaaggccgagggccacagagtgctgatcttcacccagatgaccagaatgctggacgtgctggagcagttcctgacctaccacggccacctgtacctgagactggacggcagcaccagagtggagcagagacaggccctgatggagagattcaacgccgacaagagaatcttctgcttcatcctgagcaccagaagcggcggcgtgggcgtgaacctgaccggcgccgacaccgtggtgttctacgacagcgactggaaccccaccatggacgcccaggcccaggacagatgccacagaatcggccagaccagagacgtgcacatctacagactgatcagcgagagaaccgtggaggagaacatcctgaagaaggccaaccagaagagaatgctgggcgacatggccatcgagggcggcaacttcaccaccgcctacttcaagcagcagaccatcagagagctgttcgacatgcccctggaggagcccagcagcagcagcgtgcccagcgcccccgaggaggaggaggagaccgtggccagcaagcagacccacatcctggagcaggccctgtgcagagccgaggacgaggaggacatcagagccgccacccaggccaaggccgagcaggtggccgagctggccgagttcaacgagaacgacggcttccccgccggcgagggcgaggaggccggcagacccggcgccgaggacgaggagatgagcagagccgagcaggagatcgccgccctggtggagcagctgacccccatcgagagatacgccatgaagttcctggaggccagcctggaggaggtgagcagagaggagctgaagcaggccgaggagcaggtggaggccgccagaaaggacctggaccaggccaaggaggaggtgttcagactgccccaggaggaggaggagggccccggcgccggcgacgagagcagctgcggcaccggcggcggcacccacagaagaagcaagaaggccaaggcccccgagagacccggcaccagagtgagcgagagactgagaggcgccagagccgagacccagggcgccaaccacacccccgtgatcagcgcccaccagaccagaagcaccaccaccccccccagatgcagccccgccagagagagagtgcccagacccgcccccagacccagacccacccccgccagcgcccccgccgccatccccgccctggtgcccgtgcccgtgagcgcccccgtgcccatcagcgcccccaaccccatcaccatcctgcccgtgcacatcctgcccagcccccccccccccagccagatccccccctgcagcagccccgcctgcacccccccccccgcctgcacccccccccccgcccacacccccccccccgcccagacctgcctggtgacccccagcagccccctgctgctgggcccccccagcgtgcccatcagcgccagcgtgaccaacctgcccctgggcctgagacccgaggccgagctgtgcgcccaggccctggccagccccgagagcctggagctggccagcgtggccagcagcgagaccagcagcctgagcctggtgccccccaaggacctgctgcccgtggccgtggagatcctgcccgtgagcgagaagaacctgagcctgacccccagcgcccccagcctgaccctggaggccggcagcatccccaacggccaggagcaggaggcccccgacagcgccgagggcaccaccctgaccgtgctgcccgagggcgaggagctgcccctgtgcgtgagcgagagcaacggcctggagctgccccccagcgccgccagcgacgagcccctgcaggagcccctggaggccgacagaaccagcgaggagctgaccgaggccaagacccccaccagcagccccgagaagccccaggagctggtgaccgccgaggtggccgcccccagcaccagcagcagcgccaccagcagccccgagggccccagccccgccagaccccccagaagaagaaccagcgccgacgtggagatcagaggccagggcaccggcagacccggccagccccccggccccaaggtgctgagaaagctgcccggcagactggtgaccgtggtggaggagaaggagctggtgagaagaagaagacagcagagaggcgccgccagcaccctggtgcccggcgtgagcgagaccagcgccagccccggcagccccagcgtgagaagcatgagcggccccgagagcagcccccccatcggcggcccctgcgaggccgcccccagcagcagcctgcccacccccccccagcagcccttcatcgccagaagacacatcgagctgggcgtgaccggcggcggcagccccgagaacggcgacggcgccctgctggccatcaccccccccgccgtgaagagaagaagaggcagaccccccaagaagaacagaagccccgccgacgccggcagaggcgtggacgaggcccccagcagcaccctgaagggcaagaccaacggcgccgaccccgtgcccggccccgagaccctgatcgtggccgaccccgtgctggagccccagctgatccccggcccccagcccctgggcccccagcccgtgcacagacccaaccccctgctgagccccgtggagaagagaagaagaggcagaccccccaaggccagagacctgcccatccccggcaccatcagcagcgccggcgacggcaacagcgagagcagaacccagccccccccccaccccagccccctgacccccctgccccccctgctggtgtgccccaccgccaccgtggccaacaccgtgaccaccgtgaccatcagcaccagcccccccaagagaaagagaggcagaccccccaagaacccccccagccccagacccagccagctgcccgtgctggacagagacagcaccagcgtgctggagagctgcggcctgggcagaagaagacagccccagggccagggcgagagcgagggcagcagcagcgacgaggacggcagcagacccctgaccagactggccagactgagactggaggccgagggcatgagaggcagaaagagcggcggcagcatggtggtggccgtgatccaggacgacctggacctggccgacagcggccccggcggcctggagctgaccccccccgtggtgagcctgacccccaagctgagaagcaccagactgagacccggcagcctggtgccccccctggagaccgagaagctgcccagaaagagagccggcgcccccgtgggcggcagccccggcctggccaagagaggcagactgcagccccccagccccctgggccccgagggcagcgtggaggagagcgaggccgaggccagcggcgaggaggaggagggcgacggcacccccagaagaagacccggccccagaagactggtgggcaccaccaaccagggcgaccagagaatcctgagaagcagcgccccccccagcctggccggccccgccgtgagccacagaggcagaaaggccaagacctag

SEQ ID NO: 99257 - DNA, 180 bp, Artificial Sequence
  Description of Artificial Sequence: Synthetic coding sequence
atgcagagcagccccagccccgcccacccccagctgcccgtgctgcagacccagatggtgagcgacggcatgaccggcagcaaccccgtgagccccgccagcagcagcagccccgccagcagcggcgccggcggcatcagcccccagcacatcgcccaggacagcagcctggacggctag

SEQ ID NO: 99258 - DNA, 774 bp, Artificial Sequence
  Description of Artificial Sequence: Synthetic coding sequence
atgcacagaagaggcgtgggcgccggcgccatcgccaagaagaagctggccgaggccaagtacaaggagagaggcaccgtgctggccgaggaccagctggcccagatgagcaagcagctggacatgttcaagaccaacctggaggagttcgccagcaagcacaagcaggagatcagaaagaaccccgagttcagagtgcagttccaggacatgtgcgccaccatcggcgtggaccccctggccagcggcaagggcttctggagcgagatgctgggcgtgggcgacttctactacgagctgggcgtgcagatcatcgaggtgtgcctggccctgaagcacagaaacggcggcctgatcaccctggaggagctgcaccagcaggtgctgaagggcagaggcaagttcgcccaggacgtgagccaggacgacctgatcagagccatcaagaagctgaaggccctgggcaccggcttcggcatcatccccgtgggcggcacctacctgatccagagcgtgcccgccgagctgaacatggaccacaccgtggtgctgcagctggccgagaacggctacgtgaccgtgagcgagatcaaggccagcctgaagtgggagaccgagagagccagacaggtgctggagcacctgctgaaggagggcctggcctggctggacctgcaggcccccggcgaggcccactactggctgcccgccctgttcaccgacctgtacagccaggagatcaccgccgaggaggccagagaggccctgccctag

SEQ ID NO: 99259 - DNA, 777 bp, Artificial Sequence
  Description of Artificial Sequence: Synthetic coding sequence
atgcacagaagaggcgtgggcgccggcgccatcgccaagaagaagctggccgaggccaagtacaaggagagaggcaccgtgctggccgaggaccagctggcccagatgagcaagcagctggacatgttcaagaccaacctggaggagttcgccagcaagcacaagcaggagatcagaaagaaccccgagttcagagtgcagttccaggacatgtgcgccaccatcggcgtggaccccctggccagcggcaagggcttctggagcgagatgctgggcgtgggcgacttctactacgagctgggcgtgcagatcatcgaggtgtgcctggccctgaagcacagaaacggcggcctgatcaccctggaggagctgcaccagcaggtgctgaagggcagaggcaagttcgcccaggacgtgagccaggacgacctgatcagagccatcaagaagctgaaggccctgggcaccggcttcggcatcatccccgtgggcggcacctacctgatccagagcgtgcccgccgagctgaacatggaccacaccgtggtgctgcagctggccgagaagaacggctacgtgaccgtgagcgagatcaaggccagcctgaagtgggagaccgagagagccagacaggtgctggagcacctgctgaaggagggcctggcctggctggacctgcaggcccccggcgaggcccactactggctgcccgccctgttcaccgacctgtacagccaggagatcaccgccgaggaggccagagaggccctgccctag

SEQ ID NO: 99260 - DNA, 1611 bp, Artificial Sequence
  Description of Artificial Sequence: Synthetic coding sequence
atgagcagcagcctgggcaaggagaaggacagcaaggagaaggaccccaaggtgcccagcgccaaggagagagagaaggaggccaaggccagcggcggcttcggcaaggagagcaaggagaaggagcccaagaccaagggcaaggacgccaaggacggcaagaaggacagcagcgccgcccagcccggcgtggccttcagcgtggacaacaccatcaagagacccaaccccgcccccggcaccagaaagaagagcagcaacgccgaggtgatcaaggagctgaacaagtgcagagaggagaacagcatgagactggacctgagcaagagaagcatccacatcctgcccagcagcatcaaggagctgacccagctgaccgagctgtacctgtacagcaacaagctgcagagcctgcccgccgaggtgggctgcctggtgaacctgatgaccctggccctgagcgagaacagcctgaccagcctgcccgacagcctggacaacctgaagaagctgagaatgctggacctgagacacaacaagctgagagagatccccagcgtggtgtacagactggacagcctgaccaccctgtacctgagattcaacagaatcaccaccgtggagaaggacatcaagaacctgagcaagctgagcatgctgagcatcagagagaacaagatcaagcagctgcccgccgagatcggcaacctgagcagcctgagcagactgggcctgagatacaacagactgagcgccatccccagaagcctggccaagtgcagcgccctggaggagctgaacctggagaacaacaacatcagcaccctgcccgagagcctgctgagcagcctggtgaagctgaacagcctgaccctggccagaaactgcttccagctgtaccccgtgggcggccccagccagttcagcaccatctacagcctgaacatggagcacaacagaatcaacaagatccccttcggcatcttcagcagagccaaggtgctgagcaagctgaacatgaaggacaaccagctgaccagcctgcccctggacttcggcacctggaccagcatggtggagctgaacctggccaccaaccagctgaccaagatccccgaggacgtgagcggcctggtgagcctggaggtgctgatcctgagcaacaacctgctgaagaagctgccccacggcctgggcaacctgagaaagctgagagagctggacctggaggagaacaagctggagagcctgcccaacgagatcgcctacctgaaggacctgcagaagctggtgctgaccaacaaccagctgaccaccctgcccagaggcatcggccacctgaccaacctgacccacctgggcctgggcgagaacctgctgacccacctgcccgaggagatcggcaccctggagaacctggaggagctgtacctgaacgacaaccccaacctgcacagcctgcccttcgagctggccctgtgcagcaagctgagcatcatgagcatcgagaactgccccctgagccacctgcccccccagatcgtggccggcggccccagcttcatcatccagttcctgaagatgcagggcccctacagagccatggtgtag

SEQ ID NO: 99261 - DNA, 1749 bp, Artificial Sequence
  Description of Artificial Sequence: Synthetic coding sequence
atgagcagcagcctgggcaaggagaaggacagcaaggagaaggaccccaaggtgcccagcgccaaggagagagagaaggaggccaaggccagcggcggcttcggcaaggagagcaaggagaaggagcccaagaccaagggcaaggacgccaaggacggcaagaaggacagcagcgccgcccagcccggcgtggccttcagcgtggacaacaccatcaagagacccaaccccgcccccggcaccagaaagaagagcagcaacgccgaggtgatcaaggagctgaacaagtgcagagaggagaacagcatgagactggacctgagcaagagaagcatccacatcctgcccagcagcatcaaggagctgacccagctgaccgagctgtacctgtacagcaacaagctgcagagcctgcccgccgaggtgggctgcctggtgaacctgatgaccctggccctgagcgagaacagcctgaccagcctgcccgacagcctggacaacctgaagaagctgagaatgctggacctgagacacaacaagctgagagagatccccagcgtggtgtacagactggacagcctgaccaccctgtacctgagattcaacagaatcaccaccgtggagaaggacatcaagaacctgagcaagctgagcatgctgagcatcagagagaacaagatcaagcagctgcccgccgagatcggcgagctgtgcaacctgatcaccctggacgtggcccacaaccagctggagcacctgcccaaggagatcggcaactgcacccagatcaccaacctggacctgcagcacaacgagctgctggacctgcccgacaccatcggcaacctgagcagcctgagcagactgggcctgagatacaacagactgagcgccatccccagaagcctggccaagtgcagcgccctggaggagctgaacctggagaacaacaacatcagcaccctgcccgagagcctgctgagcagcctggtgaagctgaacagcctgaccctggccagaaactgcttccagctgtaccccgtgggcggccccagccagttcagcaccatctacagcctgaacatggagcacaacagaatcaacaagatccccttcggcatcttcagcagagccaaggtgctgagcaagctgaacatgaaggacaaccagctgaccagcctgcccctggacttcggcacctggaccagcatggtggagctgaacctggccaccaaccagctgaccaagatccccgaggacgtgagcggcctggtgagcctggaggtgctgatcctgagcaacaacctgctgaagaagctgccccacggcctgggcaacctgagaaagctgagagagctggacctggaggagaacaagctggagagcctgcccaacgagatcgcctacctgaaggacctgcagaagctggtgctgaccaacaaccagctgaccaccctgcccagaggcatcggccacctgaccaacctgacccacctgggcctgggcgagaacctgctgacccacctgcccgaggagatcggcaccctggagaacctggaggagctgtacctgaacgacaaccccaacctgcacagcctgcccttcgagctggccctgtgcagcaagctgagcatcatgagcatcgagaactgccccctgagccacctgcccccccagatcgtggccggcggccccagcttcatcatccagttcctgaagatgcagggcccctacagagccatggtgtag

SEQ ID NO: 99262 - DNA, 1119 bp, Artificial Sequence
  Description of Artificial Sequence: Synthetic coding sequence
ctggacaacctgaagaagctgagaatgctggacctgagacacaacaagctgagagagatccccagcgtggtgtacagactggacagcctgaccaccctgtacctgagattcaacagaatcaccaccgtggagaaggacatcaagaacctgagcaagctgagcatgctgagcatcagagagaacaagatcaagcagctgcccgccgagatcggcaacctgagcagcctgagcagactgggcctgagatacaacagactgagcgccatccccagaagcctggccaagtgcagcgccctggaggagctgaacctggagaacaacaacatcagcaccctgcccgagagcctgctgagcagcctggtgaagctgaacagcctgaccctggccagaaactgcttccagctgtaccccgtgggcggccccagccagttcagcaccatctacagcctgaacatggagcacaacagaatcaacaagatccccttcggcatcttcagcagagccaaggtgctgagcaagctgaacatgaaggacaaccagctgaccagcctgcccctggacttcggcacctggaccagcatggtggagctgaacctggccaccaaccagctgaccaagatccccgaggacgtgagcggcctggtgagcctggaggtgctgatcctgagcaacaacctgctgaagaagctgccccacggcctgggcaacctgagaaagctgagagagctggacctggaggagaacaagctggagagcctgcccaacgagatcgcctacctgaaggacctgcagaagctggtgctgaccaacaaccagctgaccaccctgcccagaggcatcggccacctgaccaacctgacccacctgggcctgggcgagaacctgctgacccacctgcccgaggagatcggcaccctggagaacctggaggagctgtacctgaacgacaaccccaacctgcacagcctgcccttcgagctggccctgtgcagcaagctgagcatcatgagcatcgagaactgccccctgagccacctgcccccccagatcgtggccggcggccccagcttcatcatccagttcctgaagatgcagggcccctacagagccatggtgtag

SEQ ID NO: 99263 - DNA, 588 bp, Artificial Sequence
  Description of Artificial Sequence: Synthetic coding sequence
atgctgagagacggcagattcgcctgcgccatctgcccccacagacccgtgctggacaccctggccatgctgaccgcccacagagccggcaagaagcacctgagcagcctgcagctgttctacggcaagaagcagcccggcaaggagagaaagcagaaccccaagcaccagaacgagctgagaagagaggagaccaaggccgaggcccccctgctgacccagaccagactgatcacccagagcgccctgcacagagccccccactacaacagctgctgcagaagaaagtacagacccgaggcccccggccccagcgtgagcctgagccccatgccccccagcgaggtgaagctgcagagcggcaagatcagcagagagcccgagcccgccgccggcccccaggccgaggagagcgccaccgtgagcgcccccgcccccatgagccccaccagaagaagagccctggaccactacctgaccctgagaagcagcggctggatccccgacggcagaggcagatgggtgaaggacgagaacgtggagttcgacagcgacgaggaggagccccccgacctgcccctggactag

SEQ ID NO: 99264 - DNA, 693 bp, Artificial Sequence
  Description of Artificial Sequence: Synthetic coding sequence
atgagcttcaagagagagggcgacgactggagccagctgaacgtgctgaagaagagaagagtgggcgacctgctggccagctacatccccgaggacgaggccctgatgctgagagacggcagattcgcctgcgccatctgcccccacagacccgtgctggacaccctggccatgctgaccgcccacagagccggcaagaagcacctgagcagcctgcagctgttctacggcaagaagcagcccggcaaggagagaaagcagaaccccaagcaccagaacgagctgagaagagaggagaccaaggccgaggcccccctgctgacccagaccagactgatcacccagagcgccctgcacagagccccccactacaacagctgctgcagaagaaagtacagacccgaggcccccggccccagcgtgagcctgagccccatgccccccagcgaggtgaagctgcagagcggcaagatcagcagagagcccgagcccgccgccggcccccaggccgaggagagcgccaccgtgagcgcccccgcccccatgagccccaccagaagaagagccctggaccactacctgaccctgagaagcagcggctggatccccgacggcagaggcagatgggtgaaggacgagaacgtggagttcgacagcgacgaggaggagccccccgacctgcccctggactag

SEQ ID NO: 99265 - DNA, 1038 bp, Artificial Sequence
  Description of Artificial Sequence: Synthetic coding sequence
atgtacaaggactgcatcgagagcaccggcgactacttcctgctgtgcgacgccgagggcccctggggcatcatcctggagagcctggccatcctgggcatcgtggtgaccatcctgctgctgctggccttcctgttcctgatgagaaagatccaggactgcagccagtggaacgtgctgcccacccagctgctgttcctgctgagcgtgctgggcctgttcggcctggccttcgccttcatcatcgagctgaaccagcagaccgcccccgtgagatacttcctgttcggcgtgctgttcgccctgtgcttcagctgcctgctggcccacgccagcaacctggtgaagctggtgagaggctgcgtgagcttcagctggaccaccatcctgtgcatcgccatcggctgcagcctgctgcagatcatcatcgccaccgagtacgtgaccctgatcatgaccagaggcatgatgttcgtgaacatgaccccctgccagctgaacgtggacttcgtggtgctgctggtgtacgtgctgttcctgatggccctgaccttcttcgtgagcaaggccaccttctgcggcccctgcgagaactggaagcagcacggcagactgatcttcatcaccgtgctgttcagcatcatcatctgggtggtgtggatcagcatgctgctgagaggcaacccccagttccagagacagccccagtgggacgaccccgtggtgtgcatcgccctggtgaccaacgcctgggtgttcctgctgctgtacatcgtgcccgagctgtgcatcctgtacagaagctgcagacaggagtgccccctgcagggcaacgcctgccccgtgaccgcctaccagcacagcttccaggtggagaaccaggagctgagcagagccagagacagcgacggcgccgaggaggacgtggccctgaccagctacggcacccccatccagccccagaccgtggaccccacccaggagtgcttcatcccccaggccaagctgagcccccagcaggacgccggcggcgtgtag

SEQ ID NO: 99266 - DNA, 2076 bp, Artificial Sequence
  Description of Artificial Sequence: Synthetic coding sequence
atggagggcaacaagctggaggagcaggacagcagccccccccagagcacccccggcctgatgaagggcaacaagagagaggagcagggcctgggccccgagcccgccgccccccagcagcccaccgccgaggaggaggccctgatcgagttccacagaagctacagagagctgttcgagttcttctgcaacaacaccaccatccacggcgccatcagactggtgtgcagccagcacaacagaatgaagaccgccttctgggccgtgctgtggctgtgcaccttcggcatgatgtactggcagttcggcctgctgttcggcgagtacttcagctaccccgtgagcctgaacatcaacctgaacagcgacaagctggtgttccccgccgtgaccatctgcaccctgaacccctacagataccccgagatcaaggaggagctggaggagctggacagaatcaccgagcagaccctgttcgacctgtacaagtacagcagcttcaccaccctggtggccggcagcagaagcagaagagacctgagaggcaccctgccccaccccctgcagagactgagagtgcccccccccccccacggcgccagaagagccagaagcgtggccagcagcctgagagacaacaacccccaggtggactggaaggactggaagatcggcttccagctgtgcaaccagaacaagagcgactgcttctaccagacctacagcagcggcgtggacgccgtgagagagtggtacagattccactacatcaacatcctgagcagactgcccgagaccctgcccagcctggaggaggacaccctgggcaacttcatcttcgcctgcagattcaaccaggtgagctgcaaccaggccaactacagccacttccaccaccccatgtacggcaactgctacaccttcaacgacaagaacaacagcaacctgtggatgagcagcatgcccggcatcaacaacggcctgagcctgatgctgagagccgagcagaacgacttcatccccctgctgagcaccgtgaccggcgccagagtgatggtgcacggccaggacgagcccgccttcatggacgacggcggcttcaacctgagacccggcgtggagaccagcatcagcatgagaaaggagaccctggacagactgggcggcgactacggcgactgcaccaagaacggcagcgacgtgcccgtggagaacctgtaccccagcaagtacacccagcaggtgtgcatccacagctgcttccaggagagcatgatcaaggagtgcggctgcgcctacatcttctaccccagaccccagaacgtggagtactgcgactacagaaagcacagcagctggggccaggtgagaagcctgacccccgtgatccccgccctgtgggaggccgaggccggcagaagcagaggctactgctactacaagctgcaggtggacttcagcagcgaccacctgggctgcttcaccaagtgcagaaagccctgcagcgtgaccagctaccagctgagcgccggctacagcagatggcccagcgtgaccagccaggagtgggtgttccagatgctgagcagacagaacaactacaccgtgaacaacaagagaaacggcgtggccaaggtgaacatcttcttcaaggagctgaactacaagaccaacagcgagagccccagcgtgaccatggtgaccctgctgagcaacctgggcagccagtggagcctgtggttcggcagcagcgtgctgagcgtggtggagatggccgagctggtgttcgacctgctggtgatcatgttcctgatgctgctgagaagattcagaagcagatactggagccccggcagaggcggcagaggcgcccaggaggtggccagcaccctggccagcagcccccccagccacttctgcccccaccccatgagcctgagcctgagccagcccggccccgcccccagccccgccctgaccgcccccccccccgcctacgccaccctgggccccagacccagccccggcggcagcgccggcgccagcagcagcacctgccccctgggcggcccctag

SEQ ID NO: 99267 - DNA, 2058 bp, Artificial Sequence
  Description of Artificial Sequence: Synthetic coding sequence
atgctgctgcacatcaaccccgcctacctgttcaagctgctgcacggcttccccccctggatcatgcccaccgacggcaacctgggcgacaagaacttccagatgggcaagcccggccacagagagggcgccaccatgcacgtgaagaagtacctgctgaagggcctgcacagactgcagaagggccccggctacacctacaaggagctgctggtgtggtactgcgacaacaccaacacccacggccccaagagaatcatctgcgagggccccaagaagaaggccatgtggttcctgctgaccctgctgttcgccgccctggtgtgctggcagtggggcatcttcatcagaacctacctgagctgggaggtgagcgtgagcctgagcgtgggcttcaagaccatggacttccccgccgtgaccatctgcaacgccagccccttcaagtacagcaagatcaagcacctgctgaaggacctggacgagctgatggaggccgtgctggagagaatcctggcccccgagctgagccacgccaacgccaccagaaacctgaacttcagcatctggaaccacacccccctggtgctgatcgacgagagaaacccccaccaccccatggtgctggacctgttcggcgacaaccacaacggcctgaccagcagcagcgccagcgagaagatctgcaacgcccacggctgcaagatggccatgagactgtgcagcctgaacagaacccagtgcaccttcagaaacttcaccagcgccacccaggccctgaccgagtggtacatcctgcaggccaccaacatcttcgcccaggtgccccagcaggagctggtggagatgagctaccccggcgagcagatgatcctggcctgcctgttcggcgccgagccctgcaactacagaaacttcaccagcatcttctacccccactacggcaactgctacatcttcaactggggcatgaccgagaaggccctgcccagcgccaaccccggcaccgagttcggcctgaagctgatcctggacatcggccaggaggactacgtgcccttcctggccagcaccgccggcgtgagactgatgctgcacgagcagagaagctaccccttcatcagagacgagggcatctacgccatgagcggcaccgagaccagcatcggcgtgctggtggacaagctgcagagaatgggcgagccctacagcccctgcaccgtgaacggcagcgaggtgcccgtgcagaacttctacagcgactacaacaccacctacagcatccaggcctgcctgagaagctgcttccaggaccacatgatcagaaactgcaactgcggccactacctgtaccccctgcccagaggcgagaagtactgcaacaacagagacttccccgactgggcccactgctacagcgacctgcagatgagcgtggcccagagagagacctgcatcggcatgtgcaaggagagctgcaacgacacccagtacaagatgaccatcagcatggccgactggcccagcgaggccagcgaggactggatcttccacgtgctgagccaggagagagaccagagcaccaacatcaccctgagcagaaagggcatcgtgaagctgaacatctacttccaggagttcaactacagaaccatcgaggagagcgccgccaacaacatcgtgtggctgctgagcaacctgggcggccagttcggcttctggatgggcggcagcgtgctgtgcctgatcgagttcggcgagatcatcatcgacttcgtgtggatcaccatcatcaagctggtggccctggccaagagcctgagacagagaagagcccaggccagctacgccggccccccccccaccgtggccgagctggtggaggcccacaccaacttcggcttccagcccgacaccgcccccagaagccccaacaccggcccctaccccagcgagcaggccctgcccatccccggcacccccccccccaactacgacagcctgagactgcagcccctggacgtgatcgagagcgacagcgagggcgacgccatctag

SEQ ID NO: 99268 - DNA, 1923 bp, Artificial Sequence
  Description of Artificial Sequence: Synthetic coding sequence
atgcacgtgaagaagtacctgctgaagggcctgcacagactgcagaagggccccggctacacctacaaggagctgctggtgtggtactgcgacaacaccaacacccacggccccaagagaatcatctgcgagggccccaagaagaaggccatgtggttcctgctgaccctgctgttcgccgccctggtgtgctggcagtggggcatcttcatcagaacctacctgagctgggaggtgagcgtgagcctgagcgtgggcttcaagaccatggacttccccgccgtgaccatctgcaacgccagccccttcaagtacagcaagatcaagcacctgctgaaggacctggacgagctgatggaggccgtgctggagagaatcctggcccccgagctgagccacgccaacgccaccagaaacctgaacttcagcatctggaaccacacccccctggtgctgatcgacgagagaaacccccaccaccccatggtgctggacctgttcggcgacaaccacaacggcctgaccagcagcagcgccagcgagaagatctgcaacgcccacggctgcaagatggccatgagactgtgcagcctgaacagaacccagtgcaccttcagaaacttcaccagcgccacccaggccctgaccgagtggtacatcctgcaggccaccaacatcttcgcccaggtgccccagcaggagctggtggagatgagctaccccggcgagcagatgatcctggcctgcctgttcggcgccgagccctgcaactacagaaacttcaccagcatcttctacccccactacggcaactgctacatcttcaactggggcatgaccgagaaggccctgcccagcgccaaccccggcaccgagttcggcctgaagctgatcctggacatcggccaggaggactacgtgcccttcctggccagcaccgccggcgtgagactgatgctgcacgagcagagaagctaccccttcatcagagacgagggcatctacgccatgagcggcaccgagaccagcatcggcgtgctggtggacaagctgcagagaatgggcgagccctacagcccctgcaccgtgaacggcagcgaggtgcccgtgcagaacttctacagcgactacaacaccacctacagcatccaggcctgcctgagaagctgcttccaggaccacatgatcagaaactgcaactgcggccactacctgtaccccctgcccagaggcgagaagtactgcaacaacagagacttccccgactgggcccactgctacagcgacctgcagatgagcgtggcccagagagagacctgcatcggcatgtgcaaggagagctgcaacgacacccagtacaagatgaccatcagcatggccgactggcccagcgaggccagcgaggactggatcttccacgtgctgagccaggagagagaccagagcaccaacatcaccctgagcagaaagggcatcgtgaagctgaacatctacttccaggagttcaactacagaaccatcgaggagagcgccgccaacaacatcgtgtggctgctgagcaacctgggcggccagttcggcttctggatgggcggcagcgtgctgtgcctgatcgagttcggcgagatcatcatcgacttcgtgtggatcaccatcatcaagctggtggccctggccaagagcctgagacagagaagagcccaggccagctacgccggccccccccccaccgtggccgagctggtggaggcccacaccaacttcggcttccagcccgacaccgcccccagaagccccaacaccggcccctaccccagcgagcaggccctgcccatccccggcacccccccccccaactacgacagcctgagactgcagcccctggacgtgatcgagagcgacagcgagggcgacgccatctag

SEQ ID NO: 99269 - DNA, 2115 bp, Artificial Sequence
  Description of Artificial Sequence: Synthetic coding sequence
atggccttcctgagcagaaccagccccgtggccgccgccagcttccagagcagacaggaggccagaggcagcatcctgctgcagagctgccagctgcccccccagtggctgagcaccgaggcctggaccggcgagtggaagcagccccacggcggcgccctgaccagcagaagccccggccccgtggccccccagagaccctgccacctgaagggctggcagcacagacccacccagcacaacgccgcctgcaagcagggccaggccgccgcccagaccccccccagacccggcccccccagcgcccccccccccccccccaaggagggccaccaggagggcctggtggagctgcccgccagcttcagagagctgctgaccttcttctgcaccaacgccaccatccacggcgccatcagactggtgtgcagcagaggcaacagactgaagaccaccagctggggcctgctgagcctgggcgccctggtggccctgtgctggcagctgggcctgctgttcgagagacactggcacagacccgtgctgatggccgtgagcgtgcacagcgagagaaagctgctgcccctggtgaccctgtgcgacggcaaccccagaagacccagccccgtgctgagacacctggagctgctggacgagttcgccagagagaacatcgacagcctgtacaacgtgaacctgagcaagggcagagccgccctgagcgccaccgtgcccagacacgagccccccttccacctggacagagagatcagactgcagagactgagccacagcggcagcagagtgagagtgggcttcagactgtgcaacagcaccggcggcgactgcttctacagaggctacaccagcggcgtggccgccgtgcaggactggtaccacttccactacgtggacatcctggccctgctgcccgccgcctgggaggacagccacggcagccaggacggccacttcgtgctgagctgcagctacgacggcctggactgccaggccagacagttcagaaccttccaccaccccacctacggcagctgctacaccgtggacggcgtgtggaccgcccagagacccggcatcacccacggcgtgggcctggtgctgagagtggagcagcagccccacctgcccctgctgagcaccctggccggcatcagagtgatggtgcacggcagaaaccacacccccttcctgggccaccacagcttcagcgtgagacccggcaccgaggccaccatcagcatcagagaggacgaggtgcacagactgggcagcccctacggccactgcaccgccggcggcgagggcgtggaggtggagctgctgcacaacaccagctacaccagacaggcctgcctggtgagctgcttccagcagctgatggtggagacctgcagctgcggctactacctgcaccccctgcccgccggcgccgagtactgcagcagcgccagacaccccgcctggggccactgcttctacagactgtaccaggacctggagacccacagactgccctgcaccagcagatgccccagaccctgcagagagagcgccttcaagctgagcaccggcaccagcagatggcccagcgccaagagcgccggctggaccctggccaccctgggcgagcagggcctgccccaccagagccacagacagagaagcagcctggccaagatcaacatcgtgtaccaggagctgaactacagaagcgtggaggaggcccccgtgtacagcgtgccccagctgctgagcgccatgggcagcctgtgcagcctgtggttcggcgccagcgtgctgagcctgctggagctgctggagctgctgctggacgccagcgccctgaccctggtgctgggcggcagaagactgagaagagcctggttcagctggcccagagccagccccgccagcggcgccagcagcatcaagcccgaggccagccagatgcccccccccgccggcggcaccagcgacgaccccgagcccagcggcccccacctgcccagagtgatgctgcccggcgtgctggccggcgtgagcgccgaggagagctgggccggcccccagcccctggagaccctggacacctag

SEQ ID NO: 99270 - DNA, 1917 bp, Artificial Sequence
  Description of Artificial Sequence: Synthetic coding sequence
atggccgagcacagaagcatggacggcagaatggaggccgccaccagaggcggcagccacctgcaggccgccgcccagaccccccccagacccggcccccccagcgcccccccccccccccccaaggagggccaccaggagggcctggtggagctgcccgccagcttcagagagctgctgaccttcttctgcaccaacgccaccatccacggcgccatcagactggtgtgcagcagaggcaacagactgaagaccaccagctggggcctgctgagcctgggcgccctggtggccctgtgctggcagctgggcctgctgttcgagagacactggcacagacccgtgctgatggccgtgagcgtgcacagcgagagaaagctgctgcccctggtgaccctgtgcgacggcaaccccagaagacccagccccgtgctgagacacctggagctgctggacgagttcgccagagagaacatcgacagcctgtacaacgtgaacctgagcaagggcagagccgccctgagcgccaccgtgcccagacacgagccccccttccacctggacagagagatcagactgcagagactgagccacagcggcagcagagtgagagtgggcttcagactgtgcaacagcaccggcggcgactgcttctacagaggctacaccagcggcgtggccgccgtgcaggactggtaccacttccactacgtggacatcctggccctgctgcccgccgcctgggaggacagccacggcagccaggacggccacttcgtgctgagctgcagctacgacggcctggactgccaggccagacagttcagaaccttccaccaccccacctacggcagctgctacaccgtggacggcgtgtggaccgcccagagacccggcatcacccacggcgtgggcctggtgctgagagtggagcagcagccccacctgcccctgctgagcaccctggccggcatcagagtgatggtgcacggcagaaaccacacccccttcctgggccaccacagcttcagcgtgagacccggcaccgaggccaccatcagcatcagagaggacgaggtgcacagactgggcagcccctacggccactgcaccgccggcggcgagggcgtggaggtggagctgctgcacaacaccagctacaccagacaggcctgcctggtgagctgcttccagcagctgatggtggagacctgcagctgcggctactacctgcaccccctgcccgccggcgccgagtactgcagcagcgccagacaccccgcctggggccactgcttctacagactgtaccaggacctggagacccacagactgccctgcaccagcagatgccccagaccctgcagagagagcgccttcaagctgagcaccggcaccagcagatggcccagcgccaagagcgccggctggaccctggccaccctgggcgagcagggcctgccccaccagagccacagacagagaagcagcctggccaagatcaacatcgtgtaccaggagctgaactacagaagcgtggaggaggcccccgtgtacagcgtgccccagctgctgagcgccatgggcagcctgtgcagcctgtggttcggcgccagcgtgctgagcctgctggagctgctggagctgctgctggacgccagcgccctgaccctggtgctgggcggcagaagactgagaagagcctggttcagctggcccagagccagccccgccagcggcgccagcagcatcaagcccgaggccagccagatgcccccccccgccggcggcaccagcgacgaccccgagcccagcggcccccacctgcccagagtgatgctgcccggcgtgctggccggcgtgagcgccgaggagagctgggccggcccccagcccctggagaccctggacacctag

SEQ ID NO: 99271 - DNA, 927 bp, Artificial Sequence
  Description of Artificial Sequence: Synthetic coding sequence
tgagccaccgccagagccgccaccgccttcaccgaggccaccagacaggcctggagactgagcagaaccggcaccaccagcaccatgtggatcagctggccctgctgccccagacacggcagaaccgccaccggcgccagaaccgccaccagcagcagccccgccgtgaccatggcctggaccgccagacccgacagcagcggccccagcaccaccccccccaccgccgccgccaccagaagcatggccagcggccagctgagcgcccccgccagccccaccgtgggcgccagcccctggcccgtgagaggccagggctgcagaagcggcggcctgacccccgccctgggcctgcccggcgtgggcctggtgctgagagtggagcagcagccccacctgcccctgctgagcaccctggccggcatcagagtgatggtgcacggcagaaaccacacccccttcctgggccaccacagcttcagcgtgagacccggcaccgaggccaccatcagcatcagagaggacgaggtgcacagactgggcagcccctacggccactgcaccgccggcggcgagggcgtggaggtggagctgctgcacaacaccagctacaccagacaggcctgcctggtgagctgcttccagcagctgatggtggagacctgcagctgcggctactacctgcaccccctgcccgccggcgccgagtactgcagcagcgccagacaccccgcctggggccactgcttctacagactgtaccaggacctggagacccacagactgccctgcaccagcagatgccccagaccctgcagagagagcgccttcaagctgagcaccggcaccagcagatggcccagcgccaagagcgccggctggaccctggccaccctgggcgagcagggcctgccccaccagagctag

SEQ ID NO: 99272 - DNA, 2010 bp, Artificial Sequence
  Description of Artificial Sequence: Synthetic coding sequence
atggccgagcacagaagcatggacggcagaatggaggccgccaccagaggcggcagccacctgcagatcgcctgggcctgcggcagccccgaggccctgccccccgagggcatggccgcccagacccacagcgcccagagatgcctgcagaccggccccggctgcagccccgacgccccccagcccggcccccccagcgcccccccccccccccccaaggagggccaccaggagggcctggtggagctgcccgccagcttcagagagctgctgaccttcttctgcaccaacgccaccatccacggcgccatcagactggtgtgcagcagaggcaacagactgaagaccaccagctggggcctgctgagcctgggcgccctggtggccctgtgctggcagctgggcctgctgttcgagagacactggcacagacccgtgctgatggccgtgagcgtgcacagcgagagaaagctgctgcccctggtgaccctgtgcgacggcaaccccagaagacccagccccgtgctgagacacctggagctgctggacgagttcgccagagagaacatcgacagcctgtacaacgtgaacctgagcaagggcagagccgccctgagcgccaccgtgcccagacacgagccccccttccacctggacagagagatcagactgcagagactgagccacagcggcagcagagtgagagtgggcttcagactgtgcaacagcaccggcggcgactgcttctacagaggctacaccagcggcgtggccgccgtgcaggactggtaccacttccactacgtggacatcctggccctgctgcccgccgcctgggaggacagccacggcagccaggacggccacttcgtgctgagctgcagctacgacggcctggactgccaggccagacagttcagaaccttccaccaccccacctacggcagctgctacaccgtggacggcgtgtggaccgcccagagacccggcatcacccacggcgtgggcctggtgctgagagtggagcagcagccccacctgcccctgctgagcaccctggccggcatcagagtgatggtgcacggcagaaaccacacccccttcctgggccaccacagcttcagcgtgagacccggcaccgaggccaccatcagcatcagagaggacgaggtgcacagactgggcagcccctacggccactgcaccgccggcggcgagggcgtggaggtggagctgctgcacaacaccagctacaccagacaggcctgcctggtgagctgcttccagcagctgatggtggagacctgcagctgcggctactacctgcaccccctgcccgccggcgccgagtactgcagcagcgccagacaccccgcctggggccactgcttctacagactgtaccaggacctggagacccacagactgccctgcaccagcagatgccccagaccctgcagagagagcgccttcaagctgagcaccggcaccagcagatggcccagcgccaagagcgccggctggaccctggccaccctgggcgagcagggcctgccccaccagagccacagacagagaagcagcctggccaagatcaacatcgtgtaccaggagctgaactacagaagcgtggaggaggcccccgtgtacagcgtgccccagctgctgagcgccatgggcagcctgtgcagcctgtggttcggcgccagcgtgctgagcctgctggagctgctggagctgctgctggacgccagcgccctgaccctggtgctgggcggcagaagactgagaagagcctggttcagctggcccagagccagccccgccagcggcgccagcagcatcaagcccgaggccagccagatgcccccccccgccggcggcaccagcgacgaccccgagcccagcggcccccacctgcccagagtgatgctgcccggcgtgctggccggcgtgagcgccgaggagagctgggccggcccccagcccctggagaccctggacacctag

SEQ ID NO: 99273 - DNA, 2409 bp, Artificial Sequence
  Description of Artificial Sequence: Synthetic coding sequence
atgagagccgtgctgagccagaagaccacccccctgcccagatacctgtggcccggccacctgagcggccccagaagactgacctggagctggtgcagcgaccacagaacccccacctgcagagagctgggcagcccccaccccaccccctgcaccggccccgccagaggctggcccagaagaggcggcggcccctgcggcttcaccagcgccggccacgtgctgtgcggctaccccctgtgcctgctgagcggccccatccagggctgcggcaccggcctgggcgacagcagcatggccttcctgagcagaaccagccccgtggccgccgccagcttccagagcagacaggaggccagaggcagcatcctgctgcagagctgccagctgcccccccagtggctgagcaccgaggcctggaccggcgagtggaagcagccccacggcggcgccctgaccagcagaagccccggccccgtggccccccagagaccctgccacctgaagggctggcagcacagacccacccagcacaacgccgcctgcaagcagggccaggccgccgcccagaccccccccagacccggcccccccagcgcccccccccccccccccaaggagggccaccaggagggcctggtggagctgcccgccagcttcagagagctgctgaccttcttctgcaccaacgccaccatccacggcgccatcagactggtgtgcagcagaggcaacagactgaagaccaccagctggggcctgctgagcctgggcgccctggtggccctgtgctggcagctgggcctgctgttcgagagacactggcacagacccgtgctgatggccgtgagcgtgcacagcgagagaaagctgctgcccctggtgaccctgtgcgacggcaaccccagaagacccagccccgtgctgagacacctggagctgctggacgagttcgccagagagaacatcgacagcctgtacaacgtgaacctgagcaagggcagagccgccctgagcgccaccgtgcccagacacgagccccccttccacctggacagagagatcagactgcagagactgagccacagcggcagcagagtgagagtgggcttcagactgtgcaacagcaccggcggcgactgcttctacagaggctacaccagcggcgtggccgccgtgcaggactggtaccacttccactacgtggacatcctggccctgctgcccgccgcctgggaggacagccacggcagccaggacggccacttcgtgctgagctgcagctacgacggcctggactgccaggccagacagttcagaaccttccaccaccccacctacggcagctgctacaccgtggacggcgtgtggaccgcccagagacccggcatcacccacggcgtgggcctggtgctgagagtggagcagcagccccacctgcccctgctgagcaccctggccggcatcagagtgatggtgcacggcagaaaccacacccccttcctgggccaccacagcttcagcgtgagacccggcaccgaggccaccatcagcatcagagaggacgaggtgcacagactgggcagcccctacggccactgcaccgccggcggcgagggcgtggaggtggagctgctgcacaacaccagctacaccagacaggcctgcctggtgagctgcttccagcagctgatggtggagacctgcagctgcggctactacctgcaccccctgcccgccggcgccgagtactgcagcagcgccagacaccccgcctggggccactgcttctacagactgtaccaggacctggagacccacagactgccctgcaccagcagatgccccagaccctgcagagagagcgccttcaagctgagcaccggcaccagcagatggcccagcgccaagagcgccggctggaccctggccaccctgggcgagcagggcctgccccaccagagccacagacagagaagcagcctggccaagatcaacatcgtgtaccaggagctgaactacagaagcgtggaggaggcccccgtgtacagcgtgccccagctgctgagcgccatgggcagcctgtgcagcctgtggttcggcgccagcgtgctgagcctgctggagctgctggagctgctgctggacgccagcgccctgaccctggtgctgggcggcagaagactgagaagagcctggttcagctggcccagagccagccccgccagcggcgccagcagcatcaagcccgaggccagccagatgcccccccccgccggcggcaccagcgacgaccccgagcccagcggcccccacctgcccagagtgatgctgcccggcgtgctggccggcgtgagcgccgaggagagctgggccggcccccagcccctggagaccctggacacctag

SEQ ID NO: 99274 - DNA, 1917 bp, Artificial Sequence; identical to SEQ ID NO: 99270
  Description of Artificial Sequence: Synthetic coding sequence

SEQ ID NO: 99275 - DNA, 1950 bp, Artificial Sequence
  Description of Artificial Sequence: Synthetic coding sequence
atggcccccggcgagaagatcaaggccaagatcaagaagaacctgcccgtgaccggcccccaggcccccaccatcaaggagctgatgagatggtactgcctgaacaccaacacccacggctgcagaagaatcgtggtgagcagaggcagactgagaagactgctgtggatcggcttcaccctgaccgccgtggccctgatcctgtggcagtgcgccctgctggtgttcagcttctacaccgtgagcgtgagcatcaaggtgcacttcagaaagctggacttccccgccgtgaccatctgcaacatcaacccctacaagtacagcaccgtgagacacctgctggccgacctggagcaggagaccagagaggccctgaagagcctgtacggcttccccgagagcagaaagagaagagaggccgagagctggaacagcgtgagcgagggcaagcagcccagattcagccacagaatccccctgctgatcttcgaccaggacgagaagggcaaggccagagacttcttcaccggcagaaagagaaaggtgggcggcagcatcatccacaaggccagcaacgtgatgcacatcgagagcaagcaggtggtgggcttccagctgtgcagcaacgacaccagcgactgcgccacctacaccttcagcagcggcatcaacgccatccaggagtggtacaagctgcactacatgaacatcatggcccaggtgcccctggagaagaagatcaacatgagctacagcgccgaggagctgctggtgacctgcttcttcgacggcgtgagctgcgacgccagaaacttcaccctgttccaccaccccatgcacggcaactgctacaccttcaacaacagagagaacgagaccatcctgagcaccagcatgggcggcagcgagtacggcctgcaggtgatcctgtacatcaacgaggaggagtacaaccccttcctggtgagcagcaccggcgccaaggtgatcatccacagacaggacgagtaccccttcgtggaggacgtgggcaccgagatcgagaccgccatggtgaccagcatcggcatgcacctgaccgagagcttcaagctgagcgagccctacagccagtgcaccgaggacggcagcgacgtgcccatcagaaacatctacaacgccgcctacagcctgcagatctgcctgcacagctgcttccagaccaagatggtggagaagtgcggctgcgcccagtacagccagcccctgccccccgccgccaactactgcaactaccagcagcaccccaactggatgtactgctactaccagctgcacagagccttcgtgcaggaggagctgggctgccagagcgtgtgcaaggaggcctgcagcttcaaggagtggaccctgaccaccagcctggcccagtggcccagcgtggtgagcgagaagtggctgctgcccgtgctgacctgggaccagggcagacaggtgaacaagaagctgaacaagaccgacctggccaagctgctgatcttctacaaggacctgaaccagagaagcatcatggagagccccgccaacagcatcgagatgctgctgagcaacttcggcggccagctgggcctgtggatgagctgcagcgtggtgtgcgtgatcgagatcatcgaggtgttcttcatcgacttcttcagcatcatcgccagaagacagtggcagaaggccaaggagtggtgggcctggaagcaggcccccccctgccccgaggcccccagaagcccccagggccaggacaaccccgccctggacatcgacgacgacctgcccaccttcaacagcgccctgcacctgccccccgccctgggcacccaggtgcccggcacccccccccccaagtacaacaccctgagactggagagagccttcagcaaccagctgaccgacacccagatgctggacgagctgtag

SEQ ID NO: 99276 - DNA, 5943 bp, Artificial Sequence
  Description of Artificial Sequence: Synthetic coding sequence
atggccgccagactgctggccccccccggccccgacagcttcaagcccttcacccccgagagcctggccaacatcgagagaagaatcgccgagagcaagctgaagaagccccccaaggccgacggcagccacagagaggacgacgaggacagcaagcccaagcccaacagcgacctggaggccggcaagagcctgcccttcatctacggcgacatcccccagggcctggtggccgtgcccctggaggacttcgacccctactacctgacccagaagaccttcgtggtgctgaacagaggcaagaccctgttcagattcagcgccacccccgccctgtacatcctgagccccttcaacctgatcagaagaatcgccatcaagatcctgatccacagcgtgttcagcatgatcatcatgtgcaccatcctgaccaactgcgtgttcatgaccttcagcaacccccccgactggagcaagaacgtggagtacaccttcaccggcatctacaccttcgagagcctggtgaagatcatcgccagaggcttctgcatcgacggcttcaccttcctgagagacccctggaactggctggacttcagcgtgatcatgatggcctacatcaccgagttcgtgaacctgggcaacgtgagcgccctgagaaccttcagagtgctgagagccctgaagaccatcagcgtgatccccggcctgaagaccatcgtgggcgccctgatccagagcgtgaagaagctgagcgacgtgatgatcctgaccgtgttctgcctgagcgtgttcgccctgatcggcctgcagctgttcatgggcaacctgagaaacaagtgcgtggtgtggcccatcaacttcaacgagagctacctggagaacggcaccaagggcttcgactgggaggagtacatcaacaacaagaccaacttctacaccgtgcccggcatgctggagcccctgctgtgcggcaacagcagcgacgccggccagtgccccgagggctaccagtgcatgaaggccggcagaaaccccaactacggctacaccagcttcgacaccttcagctgggccttcctggccctgttcagactgatgacccaggactactgggagaacctgtaccagctgaccctgagagccgccggcaagacctacatgatcttcttcgtgctggtgatcttcgtgggcagcttctacctggtgaacctgatcctggccgtggtggccatggcctacgaggagcagaaccaggccaccctggaggaggccgagcagaaggaggccgagttcaaggccatgctggagcagctgaagaagcagcaggaggaggcccaggccgccgccatggccaccagcgccggcaccgtgagcgaggacgccatcgaggaggagggcgaggagggcggcggcagccccagaagcagcagcgagatcagcaagctgagcagcaagagcgccaaggagagaagaaacagaagaaagaagagaaagcagaaggagctgagcgagggcgaggagaagggcgaccccgagaaggtgttcaagagcgagagcgaggacggcatgagaagaaaggccttcagactgcccgacaacagaatcggcagaaagttcagcatcatgaaccagagcctgctgagcatccccggcagccccttcctgagcagacacaacagcaagagcagcatcttcagcttcagaggccccggcagattcagagaccccggcagcgagaacgagttcgccgacgacgagcacagcaccgtggaggagagcgagggcagaagagacagcctgttcatccccatcagagccagagagagaagaagcagctacagcggctacagcggctacagccagggcagcagaagcagcagaatcttccccagcctgagaagaagcgtgaagagaaacagcaccgtggactgcaacggcgtggtgagcctgatcggcggccccggcagccacatcggcggcagactgctgcccgaggccaccaccgaggtggagatcaagaagaagggccccggcagcctgctggtgagcatggaccagctggccagctacggcagaaaggacagaatcaacagcatcatgagcgtggtgaccaacaccctggtggaggagctggaggagagccagagaaagtgccccccctgctggtacaagttcgccaacaccttcctgatctgggagtgccacccctactggatcaagctgaaggagatcgtgaacctgatcgtgatggaccccttcgtggacctggccatcaccatctgcatcgtgctgaacaccctgttcatggccatggagcaccaccccatgaccccccagttcgagcacgtgctggccgtgggcaacctggtgttcaccggcatcttcaccgccgagatgttcctgaagctgatcgccatggacccctactactacttccaggagggctggaacatcttcgacggcttcatcgtgagcctgagcctgatggagctgagcctggccgacgtggagggcctgagcgtgctgagaagcttcagactgctgagagtgttcaagctggccaagagctggcccaccctgaacatgctgatcaagatcatcggcaacagcgtgggcgccctgggcaacctgaccctggtgctggccatcatcgtgttcatcttcgccgtggtgggcatgcagctgttcggcaagagctacaaggagtgcgtgtgcaagatcaaccaggactgcgagctgcccagatggcacatgcacgacttcttccacagcttcctgatcgtgttcagagtgctgtgcggcgagtggatcgagaccatgtgggactgcatggaggtggccggccaggccatgtgcctgatcgtgttcatgatggtgatggtgatcggcaacctggtggtgctgaacctgttcctggccctgctgctgagcagcttcagcgccgacaacctggccgccaccgacgacgacggcgagatgaacaacctgcagatcagcgtgatcagaatcaagaagggcgtggcctggaccaagctgaaggtgcacgccttcatgcaggcccacttcaagcagagagaggccgacgaggtgaagcccctggacgagctgtacgagaagaaggccaactgcatcgccaaccacaccggcgccgacatccacagaaacggcgacttccagaagaacggcaacggcaccaccagcggcatcggcagcagcgtggagaagtacatcatcgacgaggaccacatgagcttcatcaacaaccccaacctgaccgtgagagtgcccatcgccgtgggcgagagcgacttcgagaacctgaacaccgaggacgtgagcagcgagagcgaccccgagggcagcaaggacaagctggacgacaccagcagcagcgagggcagcaccatcgacatcaagcccgaggtggaggaggtgcccgtggagcagcccgaggagtacctggaccccgacgcctgcttcaccgagggctgcgtgcagagattcaagtgctgccaggtgaacatcgaggagggcctgggcaagagctggtggatcctgagaaagacctgcttcctgatcgtggagcacaactggttcgagaccttcatcatcttcatgatcctgctgagcagcggcgccctggccttcgaggacatctacatcgagcagagaaagaccatcagaaccatcctggagtacgccgacaaggtgttcacctacatcttcatcctggagatgctgctgaagtggaccgcctacggcttcgtgaagttcttcaccaacgcctggtgctggctggacttcctgatcgtggccgtgagcctggtgagcctgatcgccaacgccctgggctacagcgagctgggcgccatcaagagcctgagaaccctgagagccctgagacccctgagagccctgagcagattcgagggcatgagagtggtggtgaacgccctggtgggcgccatccccagcatcatgaacgtgctgctggtgtgcctgatcttctggctgatcttcagcatcatgggcgtgaacctgttcgccggcaagtaccactactgcttcaacgagaccagcgagatcagattcgagatcgaggacgtgaacaacaagaccgagtgcgagaagctgatggagggcaacaacaccgagatcagatggaagaacgtgaagatcaacttcgacaacgtgggcgccggctacctggccctgctgcaggtggccaccttcaagggctggatggacatcatgtacgccgccgtggacagcagaaagcccgacgagcagcccaagtacgaggacaacatctacatgtacatctacttcgtgatcttcatcatcttcggcagcttcttcaccctgaacctgttcatcggcgtgatcatcgacaacttcaaccagcagaagaagaagttcggcggccaggacatcttcatgaccgaggagcagaagaagtactacaacgccatgaagaagctgggcagcaagaagccccagaagcccatccccagacccctgaacaagatccagggcatcgtgttcgacttcgtgacccagcaggccttcgacatcgtgatcatgatgctgatctgcctgaacatggtgaccatgatggtggagaccgacacccagagcaagcagatggagaacatcctgtactggatcaacctggtgttcgtgatcttcttcacctgcgagtgcgtgctgaagatgttcgccctgagacactactacttcaccatcggctggaacatcttcgacttcgtggtggtgatcctgagcatcgtgggcatgttcctggccgacatcatcgagaagtacttcgtgagccccaccctgttcagagtgatcagactggccagaatcggcagaatcctgagactgatcaagggcgccaagggcatcagaaccctgctgttcgccctgatgatgagcctgcccgccctgttcaacatcggcctgctgctgttcctggtgatgttcatcttcagcatcttcggcatgagcaacttcgcctacgtgaagcacgaggccggcatcgacgacatgttcaacttcgagaccttcggcaacagcatgatctgcctgttccagatcaccaccagcgccggctgggacggcctgctgctgcccatcctgaacagaccccccgactgcagcctggacaaggagcaccccggcagcggcttcaagggcgactgcggcaaccccagcgtgggcatcttcttcttcgtgagctacatcatcatcagcttcctgatcgtggtgaacatgtacatcgccatcatcctggagaacttcagcgtggccaccgaggagagcgccgaccccctgagcgaggacgacttcgagaccttctacgagatctgggagaagttcgaccccgacgccacccagttcatcgagtactgcaagctggccgacttcgccgacgccctggagcaccccctgagagtgcccaagcccaacaccatcgagctgatcgccatggacctgcccatggtgagcggcgacagaatccactgcctggacatcctgttcgccttcaccaagagagtgctgggcgacagcggcgagctggacatcctgagacagcagatggaggagagattcgtggccagcaaccccagcaaggtgagctacgagcccatcaccaccaccctgagaagaaagcaggaggaggtgagcgccgtggtgctgcagagagcctacagaggccacctggccagaagaggcttcatctgcaagaagaccaccagcaacaagctggagaacggcggcacccacagagagaagaaggagagcacccccagcaccgccagcctgcccagctacgacagcgtgaccaagcccgagaaggagaagcagcagagagccgaggagggcagaagagagagagccaagagacagaaggaggtgagagagagcaagtgctag

SEQ ID NO: 99277 - DNA, 4674 bp, Artificial Sequence
  Description of Artificial Sequence: Synthetic coding sequence
atggccgccagactgctggccccccccggccccgacagcttcaagcccttcacccccgagagcctggccaacatcgagagaagaatcgccgagagcaagctgaagaagccccccaaggccgacggcagccacagagaggacgacgaggacagcaagcccaagcccaacagcgacctggaggccggcaagagcctgcccttcatctacggcgacatcccccagggcctggtggccgtgcccctggaggacttcgacccctactacctgacccagaagaccttcgtggtgctgaacagaggcaagaccctgttcagattcagcgccacccccgccctgtacatcctgagccccttcaacctgatcagaagaatcgccatcaagatcctgatccacagcgtgttcagcatgatcatcatgtgcaccatcctgaccaactgcgtgttcatgaccttcagcaacccccccgactggagcaagaacgtggagtacaccttcaccggcatctacaccttcgagagcctggtgaagatcatcgccagaggcttctgcatcgacggcttcaccttcctgagagacccctggaactggctggacttcagcgtgatcatgatggcctacatcaccgagttcgtgaacctgggcaacgtgagcgccctgagaaccttcagagtgctgagagccctgaagaccatcagcgtgatccccggcctgaagaccatcgtgggcgccctgatccagagcgtgaagaagctgagcgacgtgatgatcctgaccgtgttctgcctgagcgtgttcgccctgatcggcctgcagctgttcatgggcaacctgagaaacaagtgcgtggtgtggcccatcaacttcaacgagagctacctggagaacggcaccaagggcttcgactgggaggagtacatcaacaacaagaccaacttctacaccgtgcccggcatgctggagcccctgctgtgcggcaacagcagcgacgccggccagtgccccgagggctaccagtgcatgaaggccggcagaaaccccaactacggctacaccagcttcgacaccttcagctgggccttcctggccctgttcagactgatgacccaggactactgggagaacctgtaccagctgaccctgagagccgccggcaagacctacatgatcttcttcgtgctggtgatcttcgtgggcagcttctacctggtgaacctgatcctggccgtggtggccatggcctacgaggagcagaaccaggccaccctggaggaggccgagcagaaggaggccgagttcaaggccatgctggagcagctgaagaagcagcaggaggaggcccaggccgccgccatggccaccagcgccggcaccgtgagcgaggacgccatcgaggaggagggcgaggagggcggcggcagccccagaagcagcagcgagatcagcaagctgagcagcaagagcgccaaggagagaagaaacagaagaaagaagagaaagcagaaggagctgagcgagggcgaggagaagggcgaccccgagaaggtgttcaagagcgagagcgaggacggcatgagaagaaaggccttcagactgcccgacaacagaatcggcagaaagttcagcatcatgaaccagagcctgctgagcatccccggcagccccttcctgagcagacacaacagcaagagcagcatcttcagcttcagaggccccggcagattcagagaccccggcagcgagaacgagttcgccgacgacgagcacagcaccgtggaggagagcgagggcagaagagacagcctgttcatccccatcagagccagagagagaagaagcagctacagcggctacagcggctacagccagggcagcagaagcagcagaatcttccccagcctgagaagaagcgtgaagagaaacagcaccgtggactgcaacggcgtggtgagcctgatcggcggccccggcagccacatcggcggcagactgctgcccgaggccaccaccgaggtggagatcaagaagaagggccccggcagcctgctggtgagcatggaccagctggccagctacggcagaaaggacagaatcaacagcatcatgagcgtggtgaccaacaccctggtggaggagctggaggagagccagagaaagtgccccccctgctggtacaagttcgccaacaccttcctgatctgggagtgccacccctactggatcaagctgaaggagatcgtgaacctgatcgtgatggaccccttcgtggacctggccatcaccatctgcatcgtgctgaacaccctgttcatggccatggagcaccaccccatgaccccccagttcgagcacgtgctggccgtgggcaacctggtgttcaccggcatcttcaccgccgagatgttcctgaagctgatcgccatggacccctactactacttccaggagggctggaacatcttcgacggcttcatcgtgagcctgagcctgatggagctgagcctggccgacgtggagggcctgagcgtgctgagaagcttcagactgctgagagtgttcaagctggccaagagctggcccaccctgaacatgctgatcaagatcatcggcaacagcgtgggcgccctgggcaacctgaccctggtgctggccatcatcgtgttcatcttcgccgtggtgggcatgcagctgttcggcaagagctacaaggagtgcgtgtgcaagatcaaccaggactgcgagctgcccagatggcacatgcacgacttcttccacagcttcctgatcgtgttcagagtgctgtgcggcgagtggatcgagaccatgtgggactgcatggaggtggccggccaggccatgtgcctgatcgtgttcatgatggtgatggtgatcggcaacctggtggtgctgaacctgttcctggccctgctgctgagcagcttcagcgccgacaacctggccgccaccgacgacgacggcgagatgaacaacctgcagatcagcgtgatcagaatcaagaagggcgtggcctggaccaagctgaaggtgcacgccttcatgcaggcccacttcaagcagagagaggccgacgaggtgaagcccctggacgagctgtacgagaagaaggccaactgcatcgccaaccacaccggcgccgacatccacagaaacggcgacttccagaagaacggcaacggcaccaccagcggcatcggcagcagcgtggagaagtacatcatcgacgaggaccacatgagcttcatcaacaaccccaacctgaccgtgagagtgcccatcgccgtgggcgagagcgacttcgagaacctgaacaccgaggacgtgagcagcgagagcgaccccgagggcagcaaggacaagctggacgacaccagcagcagcgagggcagcaccatcgacatcaagcccgaggtggaggaggtgcccgtggagcagcccgaggagtacctggaccccgacgcctgcttcaccgagggctgcgtgcagagattcaagtgctgccaggtgaacatcgaggagggcctgggcaagagctggtggatcctgagaaagacctgcttcctgatcgtggagcacaactggttcgagaccttcatcatcttcatgatcctgctgagcagcggcgccctggccttcgaggacatctacatcgagcagagaaagaccatcagaaccatcctggagtacgccgacaaggtgttcacctacatcttcatcctggagatgctgctgaagtggaccgcctacggcttcgtgaagttcttcaccaacgcctggtgctggctggacttcctgatcgtggccgtggtggtgaacgccctggtgggcgccatccccagcatcatgaacgtgctgctggtgtgcctgatcttctggctgatcttcagcatcatgggcgtgaacctgttcgccggcaagtaccactactgcttcaacgagaccagcgagatcagattcgagatcgaggacgtgaacaacaagaccgagtgcgagaagctgatggagggcaacaacaccgagatcagatggaagaacgtgaagatcaacttcgacaacgtgggcgccggctacctggccctgctgcaggtggccaccttcaagggctggatggacatcatgtacgccgccgtggacagcagaaagcccgacgagcagcccaagtacgaggacaacatctacatgtacatctacttcgtgatcttcatcatcttcggcagcttcttcaccctgaacctgttcatcggcgtgatcatcgacaacttcaaccagcagaagaagaagttcggcggccaggacatcttcatgaccgaggagcagaagaagtactacaacgccatgaagaagctgggcagcaagaagccccagaagcccatccccagacccctgaacaagatccagggcatcgtgttcgacttcgtgacccagcaggccttcgacatcgtgatcatgatgctgatctgcctgaacatggtgaccatgatggtggagaccgacacccagagcaagcagatggagaacatcctgtactggatcaacctggtgttcgtgatcttcttcacctgcgagtgcgtgctgaagatgttcgccctgagacactactacttcaccatcggctggaacatcttcgacttcgtggtggtgatcctgagcatcgtgtag

SEQ ID NO: 99278 - DNA, 3588 bp, Artificial Sequence
  Description of Artificial Sequence: Synthetic coding sequence
ttcctgagcccccagaccttcgtggtgctgaacagaggcaagaccctgttcagattcagcgccacccccgccctgtacatcctgagccccttcaacctgatcagaagaatcgccatcaagatcctgatccacagcctgttcagcatgatcatcatgtgcaccatcctgaccaactgcgtgttcatgaccttcagcaacccccccgactggagcaagaacgtggagtacaccttcaccggcatctacaccttcgagagcctggtgaagatcatcgccagaggcttctgcatcgacggcttcaccttcctgagagacccctggaactggctggacttcagcgtgatcatgatggcctacatcaccgagttcgtgaacctgggcaacgtgagcgccctgagaaccttcagagtgctgagagccctgaagaccatcagcgtgatccccggcctgaagaccatcgtgggcgccctgatccagagcgtgaagaagctgagcgacgtgatgatcctgaccgtgttctgcctgagcgtgttcgccctgatcggcctgcagctgttcatgggcaacctgagaaacaagtgcgtggtgtggcccatcaacttcaacgagagctacctggagaacggcaccaagggcttcgactgggaggagtacatcaacaacaagaccaacttctacaccgtgcccggcatgctggagcccctgctgtgcggcaacagcagcgacgccggccagtgccccgagggctaccagtgcatgaaggccggcagaaaccccaactacggctacaccagcttcgacaccttcagctgggccttcctggccctgttcagactgatgacccaggactactgggagaacctgtaccagctgaccctgagagccgccggcaagacctacatgatcttcttcgtgctggtgatcttcgtgggcagcttctacctggtgaacctgatcctggccgtggtggccatggcctacgaggagcagaaccaggccaccctggaggaggccgagcagaaggaggccgagttcaaggccatgctggagcagctgaagaagcagcaggaggaggcccaggccgccgccatggccaccagcgccggcaccgtgagcgaggacgccatcgaggaggagggcgaggagggcggcggcagccccagaagcagcagcgagatcagcaagctgagcagcaagagcgccaaggagagaagaaacagaagaaagaagagaaagcagaaggagctgagcgagggcgaggagaagggcgaccccgagaaggtgttcaagagcgagagcgaggacggcatgagaagaaaggccttcagactgcccgacaacagaatcggcagaaagttcagcatcatgaaccagagcctgctgagcatccccggcagccccttcctgagcagacacaacagcaagagcagcatcttcagcttcagaggccccggcagattcagagaccccggcagcgagaacgagttcgccgacgacgagcacagcaccgtggaggagagcgagggcagaagagacagcctgttcatccccatcagagccagagagagaagaagcagctacagcggctacagcggctacagccagggcagcagaagcagcagaatcttccccagcctgagaagaagcgtgaagagaaacagcaccgtggactgcaacggcgtggtgagcctgatcggcggccccggcagccacatcggcggcagactgctgcccgaggccaccaccgaggtggagatcaagaagaagggccccggcagcctgctggtgagcatggaccagctggccagctacggcagaaaggacagaatcaacagcatcatgagcgtggtgaccaacaccctggtggaggagctggaggagagccagagaaagtgccccccctgctggtacaagttcgccaacaccttcctgatctgggagtgccacccctactggatcaagctgaaggagatcgtgaacctgatcgtgatggaccccttcgtggacctggccatcaccatctgcatcgtgctgaacaccctgttcatggccatggagcaccaccccatgaccccccagttcgagcacgtgctggccgtgggcaacctggtgttcaccggcatcttcaccgccgagatgttcctgaagctgatcgccatggacccctactactacttccaggagggctggaacatcttcgacggcttcatcgtgagcctgagcctgatggagctgagcctggccgacgtggagggcctgagcgtgctgagaagcttcagactgctgagagtgttcaagctggccaagagctggcccaccctgaacatgctgatcaagatcatcggcaacagcgtgggcgccctgggcaacctgaccctggtgctggccatcatcgtgttcatcttcgccgtggtgggcatgcagctgttcggcaagagctacaaggagtgcgtgtgcaagatcaaccaggactgcgagctgcccagatggcacatgcacgacttcttccacagcttcctgatcgtgttcagagtgctgtgcggcgagtggatcgagaccatgtgggactgcatggaggtggccggccaggccatgtgcctgatcgtgttcatgatggtgatggtgatcggcaacctggtggtgctgaacctgttcctggccctgctgctgagcagcttcagcgccgacaacctggccgccaccgacgacgacggcgagatgaacaacctgcagatcagcgtgatcagaatcaagaagggcgtggcctggaccaagctgaaggtgcacgccttcatgcaggcccacttcaagcagagagaggccgacgaggtgaagcccctggacgagctgtacgagaagaaggccaactgcatcgccaaccacaccggcgccgacatccacagaaacggcgacttccagaagaacggcaacggcaccaccagcggcatcggcagcagcgtggagaagtacatcatcgacgaggaccacatgagcttcatcaacaaccccaacctgaccgtgagagtgcccatcgccgtgggcgagagcgacttcgagaacctgaacaccgaggacgtgagcagcgagagcgaccccgagggcagcaaggacaagctggacgacaccagcagcagcgagggcagcaccatcgacatcaagcccgaggtggaggaggtgcccgtggagcagcccgaggagtacctggaccccgacgcctgcttcaccgagggctgcgtgcagagattcaagtgctgccaggtgaacatcgaggagggcctgggcaagagctggtggatcctgagaaagacctgcttcctgatcgtggagcacaactggttcgagaccttcatcatcttcatgatcctgctgagcagcggcgccctggccttcgaggacatctacatcgagcagagaaagaccatcagaaccatcctggagtacgccgacaaggtgttcacctacatcttcatcctggagatgctgctgaagtggaccgcctacggcttcgtgaagttcttcaccaacgcctggtgctggctggacttcctgatcgtggccgtgcccctgaacctgagcggcctgatctag

SEQ ID NO: 99279 - DNA, 5820 bp, Artificial Sequence
  Description of Artificial Sequence: Synthetic coding sequence
atggccgccagactgctggccccccccggccccgacagcttcaagcccttcacccccgagagcctggccaacatcgagagaagaatcgccgagagcaagctgaagaagccccccaaggccgacggcagccacagagaggacgacgaggacagcaagcccaagcccaacagcgacctggaggccggcaagagcctgcccttcatctacggcgacatcccccagggcctggtggccgtgcccctggaggacttcgacccctactacctgacccagaagaccttcgtggtgctgaacagaggcaagaccctgttcagattcagcgccacccccgccctgtacatcctgagccccttcaacctgatcagaagaatcgccatcaagatcctgatccacagcgtgttcagcatgatcatcatgtgcaccatcctgaccaactgcgtgttcatgaccttcagcaacccccccgactggagcaagaacgtggagtacaccttcaccggcatctacaccttcgagagcctggtgaagatcatcgccagaggcttctgcatcgacggcttcaccttcctgagagacccctggaactggctggacttcagcgtgatcatgatggcctacatcaccgagttcgtgaacctgggcaacgtgagcgccctgagaaccttcagagtgctgagagccctgaagaccatcagcgtgatccccggcctgaagaccatcgtgggcgccctgatccagagcgtgaagaagctgagcgacgtgatgatcctgaccgtgttctgcctgagcgtgttcgccctgatcggcctgcagctgttcatgggcaacctgagaaacaagtgcgtggtgtggcccatcaacttcaacgagagctacctggagaacggcaccaagggcttcgactgggaggagtacatcaacaacaagaccaacttctacaccgtgcccggcatgctggagcccctgctgtgcggcaacagcagcgacgccggccagtgccccgagggctaccagtgcatgaaggccggcagaaaccccaactacggctacaccagcttcgacaccttcagctgggccttcctggccctgttcagactgatgacccaggactactgggagaacctgtaccagctgaccctgagagccgccggcaagacctacatgatcttcttcgtgctggtgatcttcgtgggcagcttctacctggtgaacctgatcctggccgtggtggccatggcctacgaggagcagaaccaggccaccctggaggaggccgagcagaaggaggccgagttcaaggccatgctggagcagctgaagaagcagcaggaggaggcccaggccgccgccatggccaccagcgccggcaccgtgagcgaggacgccatcgaggaggagggcgaggagggcggcggcagccccagaagcagcagcgagatcagcaagctgagcagcaagagcgccaaggagagaagaaacagaagaaagaagagaaagcagaaggagctgagcgagggcgaggagaagggcgaccccgagaaggtgttcaagagcgagagcgaggacggcatgagaagaaaggccttcagactgcccgacaacagaatcggcagaaagttcagcatcatgaaccagagcctgctgagcatccccggcagccccttcctgagcagacacaacagcaagagcagcatcttcagcttcagaggccccggcagattcagagaccccggcagcgagaacgagttcgccgacgacgagcacagcaccgtggaggagagcgagggcagaagagacagcctgttcatccccatcagagccagagagagaagaagcagctacagcggctacagcggctacagccagggcagcagaagcagcagaatcttccccagcctgagaagaagcgtgaagagaaacagcaccgtggactgcaacggcgtggtgagcctgatcggcggccccggcagccacatcggcggcagactgctgcccgaggccaccaccgaggtggagatcaagaagaagggccccggcagcctgctggtgagcatggaccagctggccagctacggcagaaaggacagaatcaacagcatcatgagcgtggtgaccaacaccctggtggaggagctggaggagagccagagaaagtgccccccctgctggtacaagttcgccaacaccttcctgatctgggagtgccacccctactggatcaagctgaaggagatcgtgaacctgatcgtgatggaccccttcgtggacctggccatcaccatctgcatcgtgctgaacaccctgttcatggccatggagcaccaccccatgaccccccagttcgagcacgtgctggccgtgggcaacctggtgttcaccggcatcttcaccgccgagatgttcctgaagctgatcgccatggacccctactactacttccaggagggctggaacatcttcgacggcttcatcgtgagcctgagcctgatggagctgagcctggccgacgtggagggcctgagcgtgctgagaagcttcagactgctgagagtgttcaagctggccaagagctggcccaccctgaacatgctgatcaagatcatcggcaacagcgtgggcgccctgggcaacctgaccctggtgctggccatcatcgtgttcatcttcgccgtggtgggcatgcagctgttcggcaagagctacaaggagtgcgtgtgcaagatcaaccaggactgcgagctgcccagatggcacatgcacgacttcttccacagcttcctgatcgtgttcagagtgctgtgcggcgagtggatcgagaccatgtgggactgcatggaggtggccggccaggccatgtgcctgatcgtgttcatgatggtgatggtgatcggcaacctggtggtgctgaacctgttcctggccctgctgctgagcagcttcagcgccgacaacctggccgccaccgacgacgacggcgagatgaacaacctgcagatcagcgtgatcagaatcaagaagggcgtggcctggaccaagctgaaggtgcacgccttcatgcaggcccacttcaagcagagagaggccgacgaggtgaagcccctggacgagctgtacgagaagaaggccaactgcatcgccaaccacaccggcgccgacatccacagaaacggcgacttccagaagaacggcaacggcaccaccagcggcatcggcagcagcgtggagaagtacatcatcgacgaggaccacatgagcttcatcaacaaccccaacctgaccgtgagagtgcccatcgccgtgggcgagagcgacttcgagaacctgaacaccgaggacgtgagcagcgagagcgaccccgagggcagcaaggacaagctggacgacaccagcagcagcgagggcagcaccatcgacatcaagcccgaggtggaggaggtgcccgtggagcagcccgaggagtacctggaccccgacgcctgcttcaccgagggctgcgtgcagagattcaagtgctgccaggtgaacatcgaggagggcctgggcaagagctggtggatcctgagaaagacctgcttcctgatcgtggagcacaactggttcgagaccttcatcatcttcatgatcctgctgagcagcggcgccctggccttcgaggacatctacatcgagcagagaaagaccatcagaaccatcctggagtacgccgacaaggtgttcacctacatcttcatcctggagatgctgctgaagtggaccgcctacggcttcgtgaagttcttcaccaacgcctggtgctggctggacttcctgatcgtggccgtggtggtgaacgccctggtgggcgccatccccagcatcatgaacgtgctgctggtgtgcctgatcttctggctgatcttcagcatcatgggcgtgaacctgttcgccggcaagtaccactactgcttcaacgagaccagcgagatcagattcgagatcgaggacgtgaacaacaagaccgagtgcgagaagctgatggagggcaacaacaccgagatcagatggaagaacgtgaagatcaacttcgacaacgtgggcgccggctacctggccctgctgcaggtggccaccttcaagggctggatggacatcatgtacgccgccgtggacagcagaaagcccgacgagcagcccaagtacgaggacaacatctacatgtacatctacttcgtgatcttcatcatcttcggcagcttcttcaccctgaacctgttcatcggcgtgatcatcgacaacttcaaccagcagaagaagaagttcggcggccaggacatcttcatgaccgaggagcagaagaagtactacaacgccatgaagaagctgggcagcaagaagccccagaagcccatccccagacccctgaacaagatccagggcatcgtgttcgacttcgtgacccagcaggccttcgacatcgtgatcatgatgctgatctgcctgaacatggtgaccatgatggtggagaccgacacccagagcaagcagatggagaacatcctgtactggatcaacctggtgttcgtgatcttcttcacctgcgagtgcgtgctgaagatgttcgccctgagacactactacttcaccatcggctggaacatcttcgacttcgtggtggtgatcctgagcatcgtgggcatgttcctggccgacatcatcgagaagtacttcgtgagccccaccctgttcagagtgatcagactggccagaatcggcagaatcctgagactgatcaagggcgccaagggcatcagaaccctgctgttcgccctgatgatgagcctgcccgccctgttcaacatcggcctgctgctgttcctggtgatgttcatcttcagcatcttcggcatgagcaacttcgcctacgtgaagcacgaggccggcatcgacgacatgttcaacttcgagaccttcggcaacagcatgatctgcctgttccagatcaccaccagcgccggctgggacggcctgctgctgcccatcctgaacagaccccccgactgcagcctggacaaggagcaccccggcagcggcttcaagggcgactgcggcaaccccagcgtgggcatcttcttcttcgtgagctacatcatcatcagcttcctgatcgtggtgaacatgtacatcgccatcatcctggagaacttcagcgtggccaccgaggagagcgccgaccccctgagcgaggacgacttcgagaccttctacgagatctgggagaagttcgaccccgacgccacccagttcatcgagtactgcaagctggccgacttcgccgacgccctggagcaccccctgagagtgcccaagcccaacaccatcgagctgatcgccatggacctgcccatggtgagcggcgacagaatccactgcctggacatcctgttcgccttcaccaagagagtgctgggcgacagcggcgagctggacatcctgagacagcagatggaggagagattcgtggccagcaaccccagcaaggtgagctacgagcccatcaccaccaccctgagaagaaagcaggaggaggtgagcgccgtggtgctgcagagagcctacagaggccacctggccagaagaggcttcatctgcaagaagaccaccagcaacaagctggagaacggcggcacccacagagagaagaaggagagcacccccagcaccgccagcctgcccagctacgacagcgtgaccaagcccgagaaggagaagcagcagagagccgaggagggcagaagagagagagccaagagacagaaggaggtgagagagagcaagtgctag

SEQ ID NO: 99280 - DNA, 2919 bp, Artificial Sequence
  Description of Artificial Sequence: Synthetic coding sequence
atggccgccagactgctggccccccccggccccgacagcttcaagcccttcacccccgagagcctggccaacatcgagagaagaatcgccgagagcaagctgaagaagccccccaaggccgacggcagccacagagaggacgacgaggacagcaagcccaagcccaacagcgacctggaggccggcaagagcctgcccttcatctacggcgacatcccccagggcctggtggccgtgcccctggaggacttcgacccctactacctgacccagaagaccttcgtggtgctgaacagaggcaagaccctgttcagattcagcgccacccccgccctgtacatcctgagccccttcaacctgatcagaagaatcgccatcaagatcctgatccacagcgtgttcagcatgatcatcatgtgcaccatcctgaccaactgcgtgttcatgaccttcagcaacccccccgactggagcaagaacgtggagtacaccttcaccggcatctacaccttcgagagcctggtgaagatcatcgccagaggcttctgcatcgacggcttcaccttcctgagagacccctggaactggctggacttcagcgtgatcatgatggcctacgtgaccgagttcgtggacctgggcaacgtgagcgccctgagaaccttcagagtgctgagagccctgaagaccatcagcgtgatccccggcctgaagaccatcgtgggcgccctgatccagagcgtgaagaagctgagcgacgtgatgatcctgaccgtgttctgcctgagcgtgttcgccctgatcggcctgcagctgttcatgggcaacctgagaaacaagtgcgtggtgtggcccatcaacttcaacgagagctacctggagaacggcaccaagggcttcgactgggaggagtacatcaacaacaagaccaacttctacaccgtgcccggcatgctggagcccctgctgtgcggcaacagcagcgacgccggccagtgccccgagggctaccagtgcatgaaggccggcagaaaccccaactacggctacaccagcttcgacaccttcagctgggccttcctggccctgttcagactgatgacccaggactactgggagaacctgtaccagctgaccctgagagccgccggcaagacctacatgatcttcttcgtgctggtgatcttcgtgggcagcttctacctggtgaacctgatcctggccgtggtggccatggcctacgaggagcagaaccaggccaccctggaggaggccgagcagaaggaggccgagttcaaggccatgctggagcagctgaagaagcagcaggaggaggcccaggccgccgccatggccaccagcgccggcaccgtgagcgaggacgccatcgaggaggagggcgaggagggcggcggcagccccagaagcagcagcgagatcagcaagctgagcagcaagagcgccaaggagagaagaaacagaagaaagaagagaaagcagaaggagctgagcgagggcgaggagaagggcgaccccgagaaggtgttcaagagcgagagcgaggacggcatgagaagaaaggccttcagactgcccgacaacagaatcggcagaaagttcagcatcatgaaccagagcctgctgagcatccccggcagccccttcctgagcagacacaacagcaagagcagcatcttcagcttcagaggccccggcagattcagagaccccggcagcgagaacgagttcgccgacgacgagcacagcaccgtggaggagagcgagggcagaagagacagcctgttcatccccatcagagccagagagagaagaagcagctacagcggctacagcggctacagccagggcagcagaagcagcagaatcttccccagcctgagaagaagcgtgaagagaaacagcaccgtggactgcaacggcgtggtgagcctgatcggcggccccggcagccacatcggcggcagactgctgcccgaggccaccaccgaggtggagatcaagaagaagggccccggcagcctgctggtgagcatggaccagctggccagctacggcagaaaggacagaatcaacagcatcatgagcgtggtgaccaacaccctggtggaggagctggaggagagccagagaaagtgccccccctgctggtacaagttcgccaacaccttcctgatctgggagtgccacccctactggatcaagctgaaggagatcgtgaacctgatcgtgatggaccccttcgtggacctggccatcaccatctgcatcgtgctgaacaccctgttcatggccatggagcaccaccccatgaccccccagttcgagcacgtgctggccgtgggcaacctggtgttcaccggcatcttcaccgccgagatgttcctgaagctgatcgccatggacccctactactacttccaggagggctggaacatcttcgacggcttcatcgtgagcctgagcctgatggagctgagcctggccgacgtggagggcctgagcgtgctgagaagcttcagactgctgagagtgttcaagctggccaagagctggcccaccctgaacatgctgatcaagatcatcggcaacagcgtgggcgccctgggcaacctgaccctggtgctggccatcatcgtgttcatcttcgccgtggtgggcatgcagctgttcggcaagagctacaaggagtgcgtgtgcaagatcaaccaggactgcgagctgcccagatggcacatgcacgacttcttccacagcttcctgatcgtgttcagagtgctgtgcggcgagtggatcgagaccatgtgggactgcatggaggtggccggccaggccatgtgcctgatcgtgttcatgatggtgatggtgatcggcaacctggtggtgagcaccaacctgtag

SEQ ID NO: 99281 - DNA, 6030 bp, Artificial Sequence
  Description of Artificial Sequence: Synthetic coding sequence
atggagcagaccgtgctggtgccccccggccccgacagcttcaacttcttcaccagagagagcctggccgccatcgagagaagaatcgccgaggagaaggccaagaaccccaagcccgacaagaaggacgacgacgagaacggccccaagcccaacagcgacctggaggccggcaagaacctgcccttcatctacggcgacatcccccccgagatggtgagcgagcccctggaggacctggacccctactacatcaacaagaagaccttcatcgtgctgaacaagggcaaggccatcttcagattcagcgccaccagcgccctgtacatcctgacccccttcaaccccctgagaaagatcgccatcaagatcctggtgcacagcctgttcagcatgctgatcatgtgcaccatcctgaccaactgcgtgttcatgaccatgagcaacccccccgactggaccaagaacgtggagtacaccttcaccggcatctacaccttcgagagcctgatcaagatcatcgccagaggcttctgcctggaggacttcaccttcctgagagacccctggaactggctggacttcaccgtgatcaccttcgcctacgtgaccgagttcgtggacctgggcaacgtgagcgccctgagaaccttcagagtgctgagagccctgaagaccatcagcgtgatccccggcctgaagaccatcgtgggcgccctgatccagagcgtgaagaagctgagcgacgtgatgatcctgaccgtgttctgcctgagcgtgttcgccctgatcggcctgcagctgttcatgggcaacctgagaaacaagtgcatccagtggccccccaccaacgccagcctggaggagcacagcatcgagaagaacatcaccgtgaactacaacggcaccctgatcaacgagaccgtgttcgagttcgactggaagagctacatccaggacagcagataccactacttcctggagggcttcctggacgccctgctgtgcggcaacagcagcgacgccggccagtgccccgagggctacatgtgcgtgaaggccggcagaaaccccaactacggctacaccagcttcgacaccttcagctgggccttcctgagcctgttcagactgatgacccaggacttctgggagaacctgtaccagctgaccctgagagccgccggcaagacctacatgatcttcttcgtgctggtgatcttcctgggcagcttctacctgatcaacctgatcctggccgtggtggccatggcctacgaggagcagaaccaggccaccctggaggaggccgagcagaaggaggccgagttccagcagatgatcgagcagctgaagaagcagcaggaggccgcccagcaggccgccaccgccaccgccagcgagcacagcagagagcccagcgccgccggcagactgagcgacagcagcagcgaggccagcaagctgagcagcaagagcgccaaggagagaagaaacagaagaaagaagagaaagcagaaggagcagagcggcggcgaggagaaggacgaggacgagttccagaagagcgagagcgaggacagcatcagaagaaagggcttcagattcagcatcgagggcaacagactgacctacgagaagagatacagcagcccccaccagagcctgctgagcatcagaggcagcctgttcagccccagaagaaacagcagaaccagcctgttcagcttcagaggcagagccaaggacgtgggcagcgagaacgacttcgccgacgacgagcacagcaccttcgaggacaacgagagcagaagagacagcctgttcgtgcccagaagacacggcgagagaagaaacagcaacctgagccagaccagcagaagcagcagaatgctggccgtgttccccgccaacggcaagatgcacagcaccgtggactgcaacggcgtggtgagcctggtgggcggccccagcgtgcccaccagccccgtgggccagctgctgcccgaggtgatcatcgacaagcccgccaccgacgacaacggcaccaccaccgagaccgagatgagaaagagaagaagcagcagcttccacgtgagcatggacttcctggaggaccccagccagagacagagagccatgagcatcgccagcatcctgaccaacaccgtggaggagctggaggagagcagacagaagtgccccccctgctggtacaagttcagcaacatcttcctgatctgggactgcagcccctactggctgaaggtgaagcacgtggtgaacctggtggtgatggaccccttcgtggacctggccatcaccatctgcatcgtgctgaacaccctgttcatggccatggagcactaccccatgaccgaccacttcaacaacgtgctgaccgtgggcaacctggtgttcaccggcatcttcaccgccgagatgttcctgaagatcatcgccatggacccctactactacttccaggagggctggaacatcttcgacggcttcatcgtgaccctgagcctggtggagctgggcctggccaacgtggagggcctgagcgtgctgagaagcttcagactgctgagagtgttcaagctggccaagagctggcccaccctgaacatgctgatcaagatcatcggcaacagcgtgggcgccctgggcaacctgaccctggtgctggccatcatcgtgttcatcttcgccgtggtgggcatgcagctgttcggcaagagctacaaggactgcgtgtgcaagatcgccagcgactgccagctgcccagatggcacatgaacgacttcttccacagcttcctgatcgtgttcagagtgctgtgcggcgagtggatcgagaccatgtgggactgcatggaggtggccggccaggccatgtgcctgaccgtgttcatgatggtgatggtgatcggcaacctggtggtgctgaacctgttcctggccctgctgctgagcagcttcagcgccgacaacctggccgccaccgacgacgacaacgagatgaacaacctgcagatcgccgtggacagaatgcacaagggcgtggcctacgtgaagagaaagatctacgagttcatccagcagagcttcatcagaaagcagaagatcctggacgagatcaagcccctggacgacctgaacaacaagaaggacagctgcatgagcaaccacaccgccgagatcggcaaggacctggactacctgaaggacgtgaacggcaccaccagcggcatcggcaccggcagcagcgtggagaagtacatcatcgacgagagcgactacatgagcttcatcaacaaccccagcctgaccgtgaccgtgcccatcgccgtgggcgagagcgacttcgagaacctgaacaccgaggacttcagcagcgagagcgacctggaggagagcaaggagaagctgaacgagagcagcagcagcagcgagggcagcaccgtggacatcggcgcccccgtggaggagcagcccgtggtggagcccgaggagaccctggagcccgaggcctgcttcaccgagggctgcgtgcagagattcaagtgctgccagatcaacgtggaggagggcagaggcaagcagtggtggaacctgagaagaacctgcttcagaatcgtggagcacaactggttcgagaccttcatcgtgttcatgatcctgctgagcagcggcgccctggccttcgaggacatctacatcgaccagagaaagaccatcaagaccatgctggagtacgccgacaaggtgttcacctacatcttcatcctggagatgctgctgaagtgggtggcctacggctaccagacctacttcaccaacgcctggtgctggctggacttcctgatcgtggacgtgagcctggtgagcctgaccgccaacgccctgggctacagcgagctgggcgccatcaagagcctgagaaccctgagagccctgagacccctgagagccctgagcagattcgagggcatgagagtggtggtgaacgccctgctgggcgccatccccagcatcatgaacgtgctgctggtgtgcctgatcttctggctgatcttcagcatcatgggcgtgaacctgttcgccggcaagttctaccactgcatcaacaccaccaccggcgacagattcgacatcgaggacgtgaacaaccacaccgactgcctgaagctgatcgagagaaacgagaccgccagatggaagaacgtgaaggtgaacttcgacaacgtgggcttcggctacctgagcctgctgcaggtggccaccttcaagggctggatggacatcatgtacgccgccgtggacagcagaaacgtggagctgcagcccaagtacgaggagagcctgtacatgtacctgtacttcgtgatcttcatcatcttcggcagcttcttcaccctgaacctgttcatcggcgtgatcatcgacaacttcaaccagcagaagaagaagttcggcggccaggacatcttcatgaccgaggagcagaagaagtactacaacgccatgaagaagctgggcagcaagaagccccagaagcccatccccagacccggcaacaagttccagggcatggtgttcgacttcgtgaccagacaggtgttcgacatcagcatcatgatcctgatctgcctgaacatggtgaccatgatggtggagaccgacgaccagagcgagtacgtgaccaccatcctgagcagaatcaacctggtgttcatcgtgctgttcaccggcgagtgcgtgctgaagctgatcagcctgagacactactacttcaccatcggctggaacatcttcgacttcgtggtggtgatcctgagcatcgtgggcatgttcctggccgagctgatcgagaagtacttcgtgagccccaccctgttcagagtgatcagactggccagaatcggcagaatcctgagactgatcaagggcgccaagggcatcagaaccctgctgttcgccctgatgatgagcctgcccgccctgttcaacatcggcctgctgctgttcctggtgatgttcatctacgccatcttcggcatgagcaacttcgcctacgtgaagagagaggtgggcatcgacgacatgttcaacttcgagaccttcggcaacagcatgatctgcctgttccagatcaccaccagcgccggctgggacggcctgctggcccccatcctgaacagcaagccccccgactgcgaccccaacaaggtgaaccccggcagcagcgtgaagggcgactgcggcaaccccagcgtgggcatcttcttcttcgtgagctacatcatcatcagcttcctggtggtggtgaacatgtacatcgccgtgatcctggagaacttcagcgtggccaccgaggagagcgccgagcccctgagcgaggacgacttcgagatgttctacgaggtgtgggagaagttcgaccccgacgccacccagttcatggagttcgagaagctgagccagttcgccgccgccctggagccccccctgaacctgccccagcccaacaagctgcagctgatcgccatggacctgcccatggtgagcggcgacagaatccactgcctggacatcctgttcgccttcaccaagagagtgctgggcgagagcggcgagatggacgccctgagaatccagatggaggagagattcatggccagcaaccccagcaaggtgagctaccagcccatcaccaccaccctgaagagaaagcaggaggaggtgagcgccgtgatcatccagagagcctacagaagacacctgctgaagagaaccgtgaagcaggccagcttcacctacaacaagaacaagatcaagggcggcgccaacctgctgatcaaggaggacatgatcatcgacagaatcaacgagaacagcatcaccgagaagaccgacctgaccatgagcaccgccgcctgcccccccagctacgacagagtgaccaagcccatcgtggagaagcacgagcaggagggcaaggacgagaaggccaagggcaagtag

SEQ ID NO: 99282 - DNA, 5997 bp, Artificial Sequence
  Description of Artificial Sequence: Synthetic coding sequence
atggagcagaccgtgctggtgccccccggccccgacagcttcaacttcttcaccagagagagcctggccgccatcgagagaagaatcgccgaggagaaggccaagaaccccaagcccgacaagaaggacgacgacgagaacggccccaagcccaacagcgacctggaggccggcaagaacctgcccttcatctacggcgacatcccccccgagatggtgagcgagcccctggaggacctggacccctactacatcaacaagaagaccttcatcgtgctgaacaagggcaaggccatcttcagattcagcgccaccagcgccctgtacatcctgacccccttcaaccccctgagaaagatcgccatcaagatcctggtgcacagcctgttcagcatgctgatcatgtgcaccatcctgaccaactgcgtgttcatgaccatgagcaacccccccgactggaccaagaacgtggagtacaccttcaccggcatctacaccttcgagagcctgatcaagatcatcgccagaggcttctgcctggaggacttcaccttcctgagagacccctggaactggctggacttcaccgtgatcaccttcgcctacgtgaccgagttcgtggacctgggcaacgtgagcgccctgagaaccttcagagtgctgagagccctgaagaccatcagcgtgatccccggcctgaagaccatcgtgggcgccctgatccagagcgtgaagaagctgagcgacgtgatgatcctgaccgtgttctgcctgagcgtgttcgccctgatcggcctgcagctgttcatgggcaacctgagaaacaagtgcatccagtggccccccaccaacgccagcctggaggagcacagcatcgagaagaacatcaccgtgaactacaacggcaccctgatcaacgagaccgtgttcgagttcgactggaagagctacatccaggacagcagataccactacttcctggagggcttcctggacgccctgctgtgcggcaacagcagcgacgccggccagtgccccgagggctacatgtgcgtgaaggccggcagaaaccccaactacggctacaccagcttcgacaccttcagctgggccttcctgagcctgttcagactgatgacccaggacttctgggagaacctgtaccagctgaccctgagagccgccggcaagacctacatgatcttcttcgtgctggtgatcttcctgggcagcttctacctgatcaacctgatcctggccgtggtggccatggcctacgaggagcagaaccaggccaccctggaggaggccgagcagaaggaggccgagttccagcagatgatcgagcagctgaagaagcagcaggaggccgcccagcaggccgccaccgccaccgccagcgagcacagcagagagcccagcgccgccggcagactgagcgacagcagcagcgaggccagcaagctgagcagcaagagcgccaaggagagaagaaacagaagaaagaagagaaagcagaaggagcagagcggcggcgaggagaaggacgaggacgagttccagaagagcgagagcgaggacagcatcagaagaaagggcttcagattcagcatcgagggcaacagactgacctacgagaagagatacagcagcccccaccagagcctgctgagcatcagaggcagcctgttcagccccagaagaaacagcagaaccagcctgttcagcttcagaggcagagccaaggacgtgggcagcgagaacgacttcgccgacgacgagcacagcaccttcgaggacaacgagagcagaagagacagcctgttcgtgcccagaagacacggcgagagaagaaacagcaacctgagccagaccagcagaagcagcagaatgctggccgtgttccccgccaacggcaagatgcacagcaccgtggactgcaacggcgtggtgagcctggtgggcggccccagcgtgcccaccagccccgtgggccagctgctgcccgagggcaccaccaccgagaccgagatgagaaagagaagaagcagcagcttccacgtgagcatggacttcctggaggaccccagccagagacagagagccatgagcatcgccagcatcctgaccaacaccgtggaggagctggaggagagcagacagaagtgccccccctgctggtacaagttcagcaacatcttcctgatctgggactgcagcccctactggctgaaggtgaagcacgtggtgaacctggtggtgatggaccccttcgtggacctggccatcaccatctgcatcgtgctgaacaccctgttcatggccatggagcactaccccatgaccgaccacttcaacaacgtgctgaccgtgggcaacctggtgttcaccggcatcttcaccgccgagatgttcctgaagatcatcgccatggacccctactactacttccaggagggctggaacatcttcgacggcttcatcgtgaccctgagcctggtggagctgggcctggccaacgtggagggcctgagcgtgctgagaagcttcagactgctgagagtgttcaagctggccaagagctggcccaccctgaacatgctgatcaagatcatcggcaacagcgtgggcgccctgggcaacctgaccctggtgctggccatcatcgtgttcatcttcgccgtggtgggcatgcagctgttcggcaagagctacaaggactgcgtgtgcaagatcgccagcgactgccagctgcccagatggcacatgaacgacttcttccacagcttcctgatcgtgttcagagtgctgtgcggcgagtggatcgagaccatgtgggactgcatggaggtggccggccaggccatgtgcctgaccgtgttcatgatggtgatggtgatcggcaacctggtggtgctgaacctgttcctggccctgctgctgagcagcttcagcgccgacaacctggccgccaccgacgacgacaacgagatgaacaacctgcagatcgccgtggacagaatgcacaagggcgtggcctacgtgaagagaaagatctacgagttcatccagcagagcttcatcagaaagcagaagatcctggacgagatcaagcccctggacgacctgaacaacaagaaggacagctgcatgagcaaccacaccgccgagatcggcaaggacctggactacctgaaggacgtgaacggcaccaccagcggcatcggcaccggcagcagcgtggagaagtacatcatcgacgagagcgactacatgagcttcatcaacaaccccagcctgaccgtgaccgtgcccatcgccgtgggcgagagcgacttcgagaacctgaacaccgaggacttcagcagcgagagcgacctggaggagagcaaggagaagctgaacgagagcagcagcagcagcgagggcagcaccgtggacatcggcgcccccgtggaggagcagcccgtggtggagcccgaggagaccctggagcccgaggcctgcttcaccgagggctgcgtgcagagattcaagtgctgccagatcaacgtggaggagggcagaggcaagcagtggtggaacctgagaagaacctgcttcagaatcgtggagcacaactggttcgagaccttcatcgtgttcatgatcctgctgagcagcggcgccctggccttcgaggacatctacatcgaccagagaaagaccatcaagaccatgctggagtacgccgacaaggtgttcacctacatcttcatcctggagatgctgctgaagtgggtggcctacggctaccagacctacttcaccaacgcctggtgctggctggacttcctgatcgtggacgtgagcctggtgagcctgaccgccaacgccctgggctacagcgagctgggcgccatcaagagcctgagaaccctgagagccctgagacccctgagagccctgagcagattcgagggcatgagagtggtggtgaacgccctgctgggcgccatccccagcatcatgaacgtgctgctggtgtgcctgatcttctggctgatcttcagcatcatgggcgtgaacctgttcgccggcaagttctaccactgcatcaacaccaccaccggcgacagattcgacatcgaggacgtgaacaaccacaccgactgcctgaagctgatcgagagaaacgagaccgccagatggaagaacgtgaaggtgaacttcgacaacgtgggcttcggctacctgagcctgctgcaggtggccaccttcaagggctggatggacatcatgtacgccgccgtggacagcagaaacgtggagctgcagcccaagtacgaggagagcctgtacatgtacctgtacttcgtgatcttcatcatcttcggcagcttcttcaccctgaacctgttcatcggcgtgatcatcgacaacttcaaccagcagaagaagaagttcggcggccaggacatcttcatgaccgaggagcagaagaagtactacaacgccatgaagaagctgggcagcaagaagccccagaagcccatccccagacccggcaacaagttccagggcatggtgttcgacttcgtgaccagacaggtgttcgacatcagcatcatgatcctgatctgcctgaacatggtgaccatgatggtggagaccgacgaccagagcgagtacgtgaccaccatcctgagcagaatcaacctggtgttcatcgtgctgttcaccggcgagtgcgtgctgaagctgatcagcctgagacactactacttcaccatcggctggaacatcttcgacttcgtggtggtgatcctgagcatcgtgggcatgttcctggccgagctgatcgagaagtacttcgtgagccccaccctgttcagagtgatcagactggccagaatcggcagaatcctgagactgatcaagggcgccaagggcatcagaaccctgctgttcgccctgatgatgagcctgcccgccctgttcaacatcggcctgctgctgttcctggtgatgttcatctacgccatcttcggcatgagcaacttcgcctacgtgaagagagaggtgggcatcgacgacatgttcaacttcgagaccttcggcaacagcatgatctgcctgttccagatcaccaccagcgccggctgggacggcctgctggcccccatcctgaacagcaagccccccgactgcgaccccaacaaggtgaaccccggcagcagcgtgaagggcgactgcggcaaccccagcgtgggcatcttcttcttcgtgagctacatcatcatcagcttcctggtggtggtgaacatgtacatcgccgtgatcctggagaacttcagcgtggccaccgaggagagcgccgagcccctgagcgaggacgacttcgagatgttctacgaggtgtgggagaagttcgaccccgacgccacccagttcatggagttcgagaagctgagccagttcgccgccgccctggagccccccctgaacctgccccagcccaacaagctgcagctgatcgccatggacctgcccatggtgagcggcgacagaatccactgcctggacatcctgttcgccttcaccaagagagtgctgggcgagagcggcgagatggacgccctgagaatccagatggaggagagattcatggccagcaaccccagcaaggtgagctaccagcccatcaccaccaccctgaagagaaagcaggaggaggtgagcgccgtgatcatccagagagcctacagaagacacctgctgaagagaaccgtgaagcaggccagcttcacctacaacaagaacaagatcaagggcggcgccaacctgctgatcaaggaggacatgatcatcgacagaatcaacgagaacagcatcaccgagaagaccgacctgaccatgagcaccgccgcctgcccccccagctacgacagagtgaccaagcccatcgtggagaagcacgagcaggagggcaaggacgagaaggccaagggcaagtag

SEQ ID NO: 99283 - DNA, 5946 bp, Artificial Sequence
  Description of Artificial Sequence: Synthetic coding sequence
atggagcagaccgtgctggtgccccccggccccgacagcttcaacttcttcaccagagagagcctggccgccatcgagagaagaatcgccgaggagaaggccaagaaccccaagcccgacaagaaggacgacgacgagaacggccccaagcccaacagcgacctggaggccggcaagaacctgcccttcatctacggcgacatcccccccgagatggtgagcgagcccctggaggacctggacccctactacatcaacaagaagaccttcatcgtgctgaacaagggcaaggccatcttcagattcagcgccaccagcgccctgtacatcctgacccccttcaaccccctgagaaagatcgccatcaagatcctggtgcacagcctgttcagcatgctgatcatgtgcaccatcctgaccaactgcgtgttcatgaccatgagcaacccccccgactggaccaagaacgtggagtacaccttcaccggcatctacaccttcgagagcctgatcaagatcatcgccagaggcttctgcctggaggacttcaccttcctgagagacccctggaactggctggacttcaccgtgatcaccttcgcctacgtgaccgagttcgtggacctgggcaacgtgagcgccctgagaaccttcagagtgctgagagccctgaagaccatcagcgtgatccccggcctgaagaccatcgtgggcgccctgatccagagcgtgaagaagctgagcgacgtgatgatcctgaccgtgttctgcctgagcgtgttcgccctgatcggcctgcagctgttcatgggcaacctgagaaacaagtgcatccagtggccccccaccaacgccagcctggaggagcacagcatcgagaagaacatcaccgtgaactacaacggcaccctgatcaacgagaccgtgttcgagttcgactggaagagctacatccaggacagcagataccactacttcctggagggcttcctggacgccctgctgtgcggcaacagcagcgacgccggccagtgccccgagggctacatgtgcgtgaaggccggcagaaaccccaactacggctacaccagcttcgacaccttcagctgggccttcctgagcctgttcagactgatgacccaggacttctgggagaacctgtaccagctgaccctgagagccgccggcaagacctacatgatcttcttcgtgctggtgatcttcctgggcagcttctacctgatcaacctgatcctggccgtggtggccatggcctacgaggagcagaaccaggccaccctggaggaggccgagcagaaggaggccgagttccagcagatgatcgagcagctgaagaagcagcaggaggccgcccagcaggccgccaccgccaccgccagcgagcacagcagagagcccagcgccgccggcagactgagcgacagcagcagcgaggccagcaagctgagcagcaagagcgccaaggagagaagaaacagaagaaagaagagaaagcagaaggagcagagcggcggcgaggagaaggacgaggacgagttccagaagagcgagagcgaggacagcatcagaagaaagggcttcagattcagcatcgagggcaacagactgacctacgagaagagatacagcagcccccaccagagcctgctgagcatcagaggcagcctgttcagccccagaagaaacagcagaaccagcctgttcagcttcagaggcagagccaaggacgtgggcagcgagaacgacttcgccgacgacgagcacagcaccttcgaggacaacgagagcagaagagacagcctgttcgtgcccagaagacacggcgagagaagaaacagcaacctgagccagaccagcagaagcagcagaatgctggccgtgttccccgccaacggcaagatgcacagcaccgtggactgcaacggcgtggtgagcctgggcaccaccaccgagaccgagatgagaaagagaagaagcagcagcttccacgtgagcatggacttcctggaggaccccagccagagacagagagccatgagcatcgccagcatcctgaccaacaccgtggaggagctggaggagagcagacagaagtgccccccctgctggtacaagttcagcaacatcttcctgatctgggactgcagcccctactggctgaaggtgaagcacgtggtgaacctggtggtgatggaccccttcgtggacctggccatcaccatctgcatcgtgctgaacaccctgttcatggccatggagcactaccccatgaccgaccacttcaacaacgtgctgaccgtgggcaacctggtgttcaccggcatcttcaccgccgagatgttcctgaagatcatcgccatggacccctactactacttccaggagggctggaacatcttcgacggcttcatcgtgaccctgagcctggtggagctgggcctggccaacgtggagggcctgagcgtgctgagaagcttcagactgctgagagtgttcaagctggccaagagctggcccaccctgaacatgctgatcaagatcatcggcaacagcgtgggcgccctgggcaacctgaccctggtgctggccatcatcgtgttcatcttcgccgtggtgggcatgcagctgttcggcaagagctacaaggactgcgtgtgcaagatcgccagcgactgccagctgcccagatggcacatgaacgacttcttccacagcttcctgatcgtgttcagagtgctgtgcggcgagtggatcgagaccatgtgggactgcatggaggtggccggccaggccatgtgcctgaccgtgttcatgatggtgatggtgatcggcaacctggtggtgctgaacctgttcctggccctgctgctgagcagcttcagcgccgacaacctggccgccaccgacgacgacaacgagatgaacaacctgcagatcgccgtggacagaatgcacaagggcgtggcctacgtgaagagaaagatctacgagttcatccagcagagcttcatcagaaagcagaagatcctggacgagatcaagcccctggacgacctgaacaacaagaaggacagctgcatgagcaaccacaccgccgagatcggcaaggacctggactacctgaaggacgtgaacggcaccaccagcggcatcggcaccggcagcagcgtggagaagtacatcatcgacgagagcgactacatgagcttcatcaacaaccccagcctgaccgtgaccgtgcccatcgccgtgggcgagagcgacttcgagaacctgaacaccgaggacttcagcagcgagagcgacctggaggagagcaaggagaagctgaacgagagcagcagcagcagcgagggcagcaccgtggacatcggcgcccccgtggaggagcagcccgtggtggagcccgaggagaccctggagcccgaggcctgcttcaccgagggctgcgtgcagagattcaagtgctgccagatcaacgtggaggagggcagaggcaagcagtggtggaacctgagaagaacctgcttcagaatcgtggagcacaactggttcgagaccttcatcgtgttcatgatcctgctgagcagcggcgccctggccttcgaggacatctacatcgaccagagaaagaccatcaagaccatgctggagtacgccgacaaggtgttcacctacatcttcatcctggagatgctgctgaagtgggtggcctacggctaccagacctacttcaccaacgcctggtgctggctggacttcctgatcgtggacgtgagcctggtgagcctgaccgccaacgccctgggctacagcgagctgggcgccatcaagagcctgagaaccctgagagccctgagacccctgagagccctgagcagattcgagggcatgagagtggtggtgaacgccctgctgggcgccatccccagcatcatgaacgtgctgctggtgtgcctgatcttctggctgatcttcagcatcatgggcgtgaacctgttcgccggcaagttctaccactgcatcaacaccaccaccggcgacagattcgacatcgaggacgtgaacaaccacaccgactgcctgaagctgatcgagagaaacgagaccgccagatggaagaacgtgaaggtgaacttcgacaacgtgggcttcggctacctgagcctgctgcaggtggccaccttcaagggctggatggacatcatgtacgccgccgtggacagcagaaacgtggagctgcagcccaagtacgaggagagcctgtacatgtacctgtacttcgtgatcttcatcatcttcggcagcttcttcaccctgaacctgttcatcggcgtgatcatcgacaacttcaaccagcagaagaagaagttcggcggccaggacatcttcatgaccgaggagcagaagaagtactacaacgccatgaagaagctgggcagcaagaagccccagaagcccatccccagacccggcaacaagttccagggcatggtgttcgacttcgtgaccagacaggtgttcgacatcagcatcatgatcctgatctgcctgaacatggtgaccatgatggtggagaccgacgaccagagcgagtacgtgaccaccatcctgagcagaatcaacctggtgttcatcgtgctgttcaccggcgagtgcgtgctgaagctgatcagcctgagacactactacttcaccatcggctggaacatcttcgacttcgtggtggtgatcctgagcatcgtgggcatgttcctggccgagctgatcgagaagtacttcgtgagccccaccctgttcagagtgatcagactggccagaatcggcagaatcctgagactgatcaagggcgccaagggcatcagaaccctgctgttcgccctgatgatgagcctgcccgccctgttcaacatcggcctgctgctgttcctggtgatgttcatctacgccatcttcggcatgagcaacttcgcctacgtgaagagagaggtgggcatcgacgacatgttcaacttcgagaccttcggcaacagcatgatctgcctgttccagatcaccaccagcgccggctgggacggcctgctggcccccatcctgaacagcaagccccccgactgcgaccccaacaaggtgaaccccggcagcagcgtgaagggcgactgcggcaaccccagcgtgggcatcttcttcttcgtgagctacatcatcatcagcttcctggtggtggtgaacatgtacatcgccgtgatcctggagaacttcagcgtggccaccgaggagagcgccgagcccctgagcgaggacgacttcgagatgttctacgaggtgtgggagaagttcgaccccgacgccacccagttcatggagttcgagaagctgagccagttcgccgccgccctggagccccccctgaacctgccccagcccaacaagctgcagctgatcgccatggacctgcccatggtgagcggcgacagaatccactgcctggacatcctgttcgccttcaccaagagagtgctgggcgagagcggcgagatggacgccctgagaatccagatggaggagagattcatggccagcaaccccagcaaggtgagctaccagcccatcaccaccaccctgaagagaaagcaggaggaggtgagcgccgtgatcatccagagagcctacagaagacacctgctgaagagaaccgtgaagcaggccagcttcacctacaacaagaacaagatcaagggcggcgccaacctgctgatcaaggaggacatgatcatcgacagaatcaacgagaacagcatcaccgagaagaccgacctgaccatgagcaccgccgcctgcccccccagctacgacagagtgaccaagcccatcgtggagaagcacgagcaggagggcaaggacgagaaggccaagggcaagtag

SEQ ID NO: 99284 - DNA, 6030 bp, Artificial Sequence; identical to SEQ ID NO: 99281
  Description of Artificial Sequence: Synthetic coding sequence

SEQ ID NO: 99285 - DNA, 657 bp, Artificial Sequence
  Description of Artificial Sequence: Synthetic coding sequence
atgggcagactgctggccctggtggtgggcgccgccctggtgagcagcgcctgcggcggctgcgtggaggtggacagcgagaccgaggccgtgtacggcatgaccttcaagatcctgtgcatcagctgcaagagaagaagcgagaccaacgccgagaccttcaccgagtggaccttcagacagaagggcaccgaggagttcgtgaagatcctgagatacgagaacgaggtgctgcagctggaggaggacgagagattcgagggcagagtggtgtggaacggcagcagaggcaccaaggacctgcaggacctgagcatcttcatcaccaacgtgacctacaaccacagcggcgactacgagtgccacgtgtacagactgctgttcttcgagaactacgagcacaacaccagcgtggtgaagaagatccacatcgaggtggtggacaaggccaacagagacatggccagcatcgtgagcgagatcatgatgtacgtgctgatcgtggtgctgaccatctggctggtggccgagatgatctactgctacaagaagatcgccgccgccaccgagaccgccgcccaggagaacgccagcgagtacctggccatcaccagcgagagcaaggagaactgcaccggcgtgcaggtggccgagtag

SEQ ID NO: 99286 - DNA, 807 bp, Artificial Sequence
  Description of Artificial Sequence: Synthetic coding sequence
atgggcagactgctggccctggtggtgggcgccgccctggtgagcagcgcctgcggcggctgcgtggaggtggacagcgagaccgaggccgtgtacggcatgaccttcaagatcctgtgcatcagctgcaagagaagaagcgagaccaacgccgagaccttcaccgagtggaccttcagacagaagggcaccgaggagttcgtgaagatcctgagatacgagaacgaggtgctgcagctggaggaggacgagagattcgagggcagagtggtgtggaacggcagcagaggcaccaaggacctgcaggacctgagcatcttcatcaccaacgtgacctacaaccacagcggcgactacgagtgccacgtgtacagactgctgttcttcgagaactacgagcacaacaccagcgtggtgaagaagatccacatcgaggtggtggacaagggcgagagcggcgccgcctgccccttcaccgtgacccacagaagagccagatggagagacagatggcaggccgtggacagaaccggctggctgtgcgcctggcccgccaacagaccccagcagagagccgagggcgagggcagcagccccagctgccccctgcagctgtggcccctgttcctgagcagccccagaagaggccagagcatgcccgtgccccacagaagaagcggctacagaacccagctgtgccacctgtgctgcatgaccagcggcagatgcctgctgagcctgagccagagagtggtgctgggcctgcccggcatcatcatcagatgcgtgagcagaggcgtggtgtag

SEQ ID NO: 99287 - DNA, 6018 bp, Artificial Sequence
  Description of Artificial Sequence: Synthetic coding sequence
atggcccagagcgtgctggtgccccccggccccgacagcttcagattcttcaccagagagagcctggccgccatcgagcagagaatcgccgaggagaaggccaagagacccaagcaggagagaaaggacgaggacgacgagaacggccccaagcccaacagcgacctggaggccggcaagagcctgcccttcatctacggcgacatcccccccgagatggtgagcgtgcccctggaggacctggacccctactacatcaacaagaagaccttcatcgtgctgaacaagggcaaggccatcagcagattcagcgccacccccgccctgtacatcctgacccccttcaaccccatcagaaagctggccatcaagatcctggtgcacagcctgttcaacatgctgatcatgtgcaccatcctgaccaactgcgtgttcatgaccatgagcaacccccccgactggaccaagaacgtggagtacaccttcaccggcatctacaccttcgagagcctgatcaagatcctggccagaggcttctgcctggaggacttcaccttcctgagagacccctggaactggctggacttcaccgtgatcaccttcgcctacgtgaccgagttcgtggacctgggcaacgtgagcgccctgagaaccttcagagtgctgagagccctgaagaccatcagcgtgatccccggcctgaagaccatcgtgggcgccctgatccagagcgtgaagaagctgagcgacgtgatgatcctgaccgtgttctgcctgagcgtgttcgccctgatcggcctgcagctgttcatgggcaacctgagaaacaagtgcctgcagtggccccccgacaacagcagcttcgagatcaacatcaccagcttcttcaacaacagcctggacggcaacggcaccaccttcaacagaaccgtgagcatcttcaactgggacgagtacatcgaggacaagagccacttctacttcctggagggccagaacgacgccctgctgtgcggcaacagcagcgacgccggccagtgccccgagggctacatctgcgtgaaggccggcagaaaccccaactacggctacaccagcttcgacaccttcagctgggccttcctgagcctgttcagactgatgacccaggacttctgggagaacctgtaccagctgaccctgagagccgccggcaagacctacatgatcttcttcgtgctggtgatcttcctgggcagcttctacctgatcaacctgatcctggccgtggtggccatggcctacgaggagcagaaccaggccaccctggaggaggccgagcagaaggaggccgagttccagcagatgctggagcagctgaagaagcagcaggaggaggcccaggccgccgccgccgccgccagcgccgagagcagagacttcagcggcgccggcggcatcggcgtgttcagcgagagcagcagcgtggccagcaagctgagcagcaagagcgagaaggagctgaagaacagaagaaagaagaagaagcagaaggagcagagcggcgaggaggagaagaacgacagagtgagaaagagcgagagcgaggacagcatcagaagaaagggcttcagattcagcctggagggcagcagactgacctacgagaagagattcagcagcccccaccagagcctgctgagcatcagaggcagcctgttcagccccagaagaaacagcagagccagcctgttcagcttcagaggcagagccaaggacatcggcagcgagaacgacttcgccgacgacgagcacagcaccttcgaggacaacgacagcagaagagacagcctgttcgtgccccacagacacggcgagagaagacacagcaacgtgagccaggccagcagagccagcagagtgctgcccatcctgcccatgaacggcaagatgcacagcgccgtggactgcaacggcgtggtgagcctggtgggcggccccagcaccctgaccagcgccggccagctgctgcccgagggcaccaccaccgagaccgagatcagaaagagaagaagcagcagctaccacgtgagcatggacctgctggaggaccccaccagcagacagagagccatgagcatcgccagcatcctgaccaacaccatggaggagctggaggagagcagacagaagtgccccccctgctggtacaagttcgccaacatgtgcctgatctgggactgctgcaagccctggctgaaggtgaagcacctggtgaacctggtggtgatggaccccttcgtggacctggccatcaccatctgcatcgtgctgaacaccctgttcatggccatggagcactaccccatgaccgagcagttcagcagcgtgctgagcgtgggcaacctggtgttcaccggcatcttcaccgccgagatgttcctgaagatcatcgccatggacccctactactacttccaggagggctggaacatcttcgacggcttcatcgtgagcctgagcctgatggagctgggcctggccaacgtggagggcctgagcgtgctgagaagcttcagactgctgagagtgttcaagctggccaagagctggcccaccctgaacatgctgatcaagatcatcggcaacagcgtgggcgccctgggcaacctgaccctggtgctggccatcatcgtgttcatcttcgccgtggtgggcatgcagctgttcggcaagagctacaaggagtgcgtgtgcaagatcagcaacgactgcgagctgcccagatggcacatgcacgacttcttccacagcttcctgatcgtgttcagagtgctgtgcggcgagtggatcgagaccatgtgggactgcatggaggtggccggccagaccatgtgcctgaccgtgttcatgatggtgatggtgatcggcaacctggtggtgctgaacctgttcctggccctgctgctgagcagcttcagcagcgacaacctggccgccaccgacgacgacaacgagatgaacaacctgcagatcgccgtgggcagaatgcagaagggcatcgacttcgtgaagagaaagatcagagagttcatccagaaggccttcgtgagaaagcagaaggccctggacgagatcaagcccctggaggacctgaacaacaagaaggacagctgcatcagcaaccacaccaccatcgagatcggcaaggacctgaactacctgaaggacggcaacggcaccaccagcggcatcggcagcagcgtggagaagtacgtggtggacgagagcgactacatgagcttcatcaacaaccccagcctgaccgtgaccgtgcccatcgccgtgggcgagagcgacttcgagaacctgaacaccgaggagttcagcagcgagagcgacatggaggagagcaaggagaagctgaacgccaccagcagcagcgagggcagcaccgtggacatcggcgcccccgccgagggcgagcagcccgaggtggagcccgaggagagcctggagcccgaggcctgcttcaccgaggactgcgtgagaaagttcaagtgctgccagatcagcatcgaggagggcaagggcaagctgtggtggaacctgagaaagacctgctacaagatcgtggagcacaactggttcgagaccttcatcgtgttcatgatcctgctgagcagcggcgccctggccttcgaggacatctacatcgagcagagaaagaccatcaagaccatgctggagtacgccgacaaggtgttcacctacatcttcatcctggagatgctgctgaagtgggtggcctacggcttccaggtgtacttcaccaacgcctggtgctggctggacttcctgatcgtggacgtgagcctggtgagcctgaccgccaacgccctgggctacagcgagctgggcgccatcaagagcctgagaaccctgagagccctgagacccctgagagccctgagcagattcgagggcatgagagtggtggtgaacgccctgctgggcgccatccccagcatcatgaacgtgctgctggtgtgcctgatcttctggctgatcttcagcatcatgggcgtgaacctgttcgccggcaagttctaccactgcatcaactacaccaccggcgagatgttcgacgtgagcgtggtgaacaactacagcgagtgcaaggccctgatcgagagcaaccagaccgccagatggaagaacgtgaaggtgaacttcgacaacgtgggcctgggctacctgagcctgctgcaggtggccaccttcaagggctggatggacatcatgtacgccgccgtggacagcagaaacgtggagctgcagcccaagtacgaggacaacctgtacatgtacctgtacttcgtgatcttcatcatcttcggcagcttcttcaccctgaacctgttcatcggcgtgatcatcgacaacttcaaccagcagaagaagaagttcggcggccaggacatcttcatgaccgaggagcagaagaagtactacaacgccatgaagaagctgggcagcaagaagccccagaagcccatccccagacccgccaacaagttccagggcatggtgttcgacttcgtgaccaagcaggtgttcgacatcagcatcatgatcctgatctgcctgaacatggtgaccatgatggtggagaccgacgaccagagccaggagatgaccaacatcctgtactggatcaacctggtgttcatcgtgctgttcaccggcgagtgcgtgctgaagctgatcagcctgagatactactacttcaccatcggctggaacatcttcgacttcgtggtggtgatcctgagcatcgtgggcatgttcctggccgagctgatcgagaagtacttcgtgagccccaccctgttcagagtgatcagactggccagaatcggcagaatcctgagactgatcaagggcgccaagggcatcagaaccctgctgttcgccctgatgatgagcctgcccgccctgttcaacatcggcctgctgctgttcctggtgatgttcatctacgccatcttcggcatgagcaacttcgcctacgtgaagagagaggtgggcatcgacgacatgttcaacttcgagaccttcggcaacagcatgatctgcctgttccagatcaccaccagcgccggctgggacggcctgctggcccccatcctgaacagcggcccccccgactgcgaccccgacaaggaccaccccggcagcagcgtgaagggcgactgcggcaaccccagcgtgggcatcttcttcttcgtgagctacatcatcatcagcttcctggtggtggtgaacatgtacatcgccgtgatcctggagaacttcagcgtggccaccgaggagagcgccgagcccctgagcgaggacgacttcgagatgttctacgaggtgtgggagaagttcgaccccgacgccacccagttcatcgagttcgccaagctgagcgacttcgccgacgccctggacccccccctgctgatcgccaagcccaacaaggtgcagctgatcgccatggacctgcccatggtgagcggcgacagaatccactgcctggacatcctgttcgccttcaccaagagagtgctgggcgagagcggcgagatggacgccctgagaatccagatggaggagagattcatggccagcaaccccagcaaggtgagctacgagcccatcaccaccaccctgaagagaaagcaggaggaggtgagcgccatcatcatccagagagcctacagaagatacctgctgaagcagaaggtgaagaaggtgagcagcatctacaagaaggacaagggcaaggagtgcgacggcacccccatcaaggaggacaccctgatcgacaagctgaacgagaacagcacccccgagaagaccgacatgacccccagcaccaccagcccccccagctacgacagcgtgaccaagcccgagaaggagaagttcgagaaggacaagagcgagaaggaggacaagggcaaggacatcagagagagcaagaagtag

SEQ ID NO: 99288 - DNA, 6018 bp, Artificial Sequence
  Description of Artificial Sequence: Synthetic coding sequence
atggcccagagcgtgctggtgccccccggccccgacagcttcagattcttcaccagagagagcctggccgccatcgagcagagaatcgccgaggagaaggccaagagacccaagcaggagagaaaggacgaggacgacgagaacggccccaagcccaacagcgacctggaggccggcaagagcctgcccttcatctacggcgacatcccccccgagatggtgagcgtgcccctggaggacctggacccctactacatcaacaagaagaccttcatcgtgctgaacaagggcaaggccatcagcagattcagcgccacccccgccctgtacatcctgacccccttcaaccccatcagaaagctggccatcaagatcctggtgcacagcctgttcaacatgctgatcatgtgcaccatcctgaccaactgcgtgttcatgaccatgagcaacccccccgactggaccaagaacgtggagtacaccttcaccggcatctacaccttcgagagcctgatcaagatcctggccagaggcttctgcctggaggacttcaccttcctgagagacccctggaactggctggacttcaccgtgatcaccttcgcctacgtgaccgagttcgtgaacctgggcaacgtgagcgccctgagaaccttcagagtgctgagagccctgaagaccatcagcgtgatccccggcctgaagaccatcgtgggcgccctgatccagagcgtgaagaagctgagcgacgtgatgatcctgaccgtgttctgcctgagcgtgttcgccctgatcggcctgcagctgttcatgggcaacctgagaaacaagtgcctgcagtggccccccgacaacagcagcttcgagatcaacatcaccagcttcttcaacaacagcctggacggcaacggcaccaccttcaacagaaccgtgagcatcttcaactgggacgagtacatcgaggacaagagccacttctacttcctggagggccagaacgacgccctgctgtgcggcaacagcagcgacgccggccagtgccccgagggctacatctgcgtgaaggccggcagaaaccccaactacggctacaccagcttcgacaccttcagctgggccttcctgagcctgttcagactgatgacccaggacttctgggagaacctgtaccagctgaccctgagagccgccggcaagacctacatgatcttcttcgtgctggtgatcttcctgggcagcttctacctgatcaacctgatcctggccgtggtggccatggcctacgaggagcagaaccaggccaccctggaggaggccgagcagaaggaggccgagttccagcagatgctggagcagctgaagaagcagcaggaggaggcccaggccgccgccgccgccgccagcgccgagagcagagacttcagcggcgccggcggcatcggcgtgttcagcgagagcagcagcgtggccagcaagctgagcagcaagagcgagaaggagctgaagaacagaagaaagaagaagaagcagaaggagcagagcggcgaggaggagaagaacgacagagtgagaaagagcgagagcgaggacagcatcagaagaaagggcttcagattcagcctggagggcagcagactgacctacgagaagagattcagcagcccccaccagagcctgctgagcatcagaggcagcctgttcagccccagaagaaacagcagagccagcctgttcagcttcagaggcagagccaaggacatcggcagcgagaacgacttcgccgacgacgagcacagcaccttcgaggacaacgacagcagaagagacagcctgttcgtgccccacagacacggcgagagaagacacagcaacgtgagccaggccagcagagccagcagagtgctgcccatcctgcccatgaacggcaagatgcacagcgccgtggactgcaacggcgtggtgagcctggtgggcggccccagcaccctgaccagcgccggccagctgctgcccgagggcaccaccaccgagaccgagatcagaaagagaagaagcagcagctaccacgtgagcatggacctgctggaggaccccaccagcagacagagagccatgagcatcgccagcatcctgaccaacaccatggaggagctggaggagagcagacagaagtgccccccctgctggtacaagttcgccaacatgtgcctgatctgggactgctgcaagccctggctgaaggtgaagcacctggtgaacctggtggtgatggaccccttcgtggacctggccatcaccatctgcatcgtgctgaacaccctgttcatggccatggagcactaccccatgaccgagcagttcagcagcgtgctgagcgtgggcaacctggtgttcaccggcatcttcaccgccgagatgttcctgaagatcatcgccatggacccctactactacttccaggagggctggaacatcttcgacggcttcatcgtgagcctgagcctgatggagctgggcctggccaacgtggagggcctgagcgtgctgagaagcttcagactgctgagagtgttcaagctggccaagagctggcccaccctgaacatgctgatcaagatcatcggcaacagcgtgggcgccctgggcaacctgaccctggtgctggccatcatcgtgttcatcttcgccgtggtgggcatgcagctgttcggcaagagctacaaggagtgcgtgtgcaagatcagcaacgactgcgagctgcccagatggcacatgcacgacttcttccacagcttcctgatcgtgttcagagtgctgtgcggcgagtggatcgagaccatgtgggactgcatggaggtggccggccagaccatgtgcctgaccgtgttcatgatggtgatggtgatcggcaacctggtggtgctgaacctgttcctggccctgctgctgagcagcttcagcagcgacaacctggccgccaccgacgacgacaacgagatgaacaacctgcagatcgccgtgggcagaatgcagaagggcatcgacttcgtgaagagaaagatcagagagttcatccagaaggccttcgtgagaaagcagaaggccctggacgagatcaagcccctggaggacctgaacaacaagaaggacagctgcatcagcaaccacaccaccatcgagatcggcaaggacctgaactacctgaaggacggcaacggcaccaccagcggcatcggcagcagcgtggagaagtacgtggtggacgagagcgactacatgagcttcatcaacaaccccagcctgaccgtgaccgtgcccatcgccgtgggcgagagcgacttcgagaacctgaacaccgaggagttcagcagcgagagcgacatggaggagagcaaggagaagctgaacgccaccagcagcagcgagggcagcaccgtggacatcggcgcccccgccgagggcgagcagcccgaggtggagcccgaggagagcctggagcccgaggcctgcttcaccgaggactgcgtgagaaagttcaagtgctgccagatcagcatcgaggagggcaagggcaagctgtggtggaacctgagaaagacctgctacaagatcgtggagcacaactggttcgagaccttcatcgtgttcatgatcctgctgagcagcggcgccctggccttcgaggacatctacatcgagcagagaaagaccatcaagaccatgctggagtacgccgacaaggtgttcacctacatcttcatcctggagatgctgctgaagtgggtggcctacggcttccaggtgtacttcaccaacgcctggtgctggctggacttcctgatcgtggacgtgagcctggtgagcctgaccgccaacgccctgggctacagcgagctgggcgccatcaagagcctgagaaccctgagagccctgagacccctgagagccctgagcagattcgagggcatgagagtggtggtgaacgccctgctgggcgccatccccagcatcatgaacgtgctgctggtgtgcctgatcttctggctgatcttcagcatcatgggcgtgaacctgttcgccggcaagttctaccactgcatcaactacaccaccggcgagatgttcgacgtgagcgtggtgaacaactacagcgagtgcaaggccctgatcgagagcaaccagaccgccagatggaagaacgtgaaggtgaacttcgacaacgtgggcctgggctacctgagcctgctgcaggtggccaccttcaagggctggatggacatcatgtacgccgccgtggacagcagaaacgtggagctgcagcccaagtacgaggacaacctgtacatgtacctgtacttcgtgatcttcatcatcttcggcagcttcttcaccctgaacctgttcatcggcgtgatcatcgacaacttcaaccagcagaagaagaagttcggcggccaggacatcttcatgaccgaggagcagaagaagtactacaacgccatgaagaagctgggcagcaagaagccccagaagcccatccccagacccgccaacaagttccagggcatggtgttcgacttcgtgaccaagcaggtgttcgacatcagcatcatgatcctgatctgcctgaacatggtgaccatgatggtggagaccgacgaccagagccaggagatgaccaacatcctgtactggatcaacctggtgttcatcgtgctgttcaccggcgagtgcgtgctgaagctgatcagcctgagatactactacttcaccatcggctggaacatcttcgacttcgtggtggtgatcctgagcatcgtgggcatgttcctggccgagctgatcgagaagtacttcgtgagccccaccctgttcagagtgatcagactggccagaatcggcagaatcctgagactgatcaagggcgccaagggcatcagaaccctgctgttcgccctgatgatgagcctgcccgccctgttcaacatcggcctgctgctgttcctggtgatgttcatctacgccatcttcggcatgagcaacttcgcctacgtgaagagagaggtgggcatcgacgacatgttcaacttcgagaccttcggcaacagcatgatctgcctgttccagatcaccaccagcgccggctgggacggcctgctggcccccatcctgaacagcggcccccccgactgcgaccccgacaaggaccaccccggcagcagcgtgaagggcgactgcggcaaccccagcgtgggcatcttcttcttcgtgagctacatcatcatcagcttcctggtggtggtgaacatgtacatcgccgtgatcctggagaacttcagcgtggccaccgaggagagcgccgagcccctgagcgaggacgacttcgagatgttctacgaggtgtgggagaagttcgaccccgacgccacccagttcatcgagttcgccaagctgagcgacttcgccgacgccctggacccccccctgctgatcgccaagcccaacaaggtgcagctgatcgccatggacctgcccatggtgagcggcgacagaatccactgcctggacatcctgttcgccttcaccaagagagtgctgggcgagagcggcgagatggacgccctgagaatccagatggaggagagattcatggccagcaaccccagcaaggtgagctacgagcccatcaccaccaccctgaagagaaagcaggaggaggtgagcgccatcatcatccagagagcctacagaagatacctgctgaagcagaaggtgaagaaggtgagcagcatctacaagaaggacaagggcaaggagtgcgacggcacccccatcaaggaggacaccctgatcgacaagctgaacgagaacagcacccccgagaagaccgacatgacccccagcaccaccagcccccccagctacgacagcgtgaccaagcccgagaaggagaagttcgagaaggacaagagcgagaaggaggacaagggcaaggacatcagagagagcaagaagtag

SEQ ID NO: 99289 - DNA, 6018 bp, Artificial Sequence; identical to SEQ ID NO: 99288
  Description of Artificial Sequence: Synthetic coding sequence

SEQ ID NO: 99290 - DNA, 6018 bp, Artificial Sequence; identical to SEQ ID NO: 99287
  Description of Artificial Sequence: Synthetic coding sequence

SEQ ID NO: 99291 - DNA, 1512 bp, Artificial Sequence
  Description of Artificial Sequence: Synthetic coding sequence
atggcccagagcgtgctggtgccccccggccccgacagcttcagattcttcaccagagagagcctggccgccatcgagcagagaatcgccgaggagaaggccaagagacccaagcaggagagaaaggacgaggacgacgagaacggccccaagcccaacagcgacctggaggccggcaagagcctgcccttcatctacggcgacatcccccccgagatggtgagcgtgcccctggaggacctggacccctactacatcaacaagaagaccttcatcgtgctgaacaagggcaaggccatcagcagattcagcgccacccccgccctgtacatcctgacccccttcaaccccatcagaaagctggccatcaagatcctggtgcacagcctgttcaacatgctgatcatgtgcaccatcctgaccaactgcgtgttcatgaccatgagcaacccccccgactggaccaagaacgtggagtacaccttcaccggcatctacaccttcgagagcctgatcaagatcctggccagaggcttctgcctggaggacttcaccttcctgagagacccctggaactggctggacttcaccgtgatcaccttcgcctacgtgaccgagttcgtggacctgggcaacgtgagcgccctgagaaccttcagagtgctgagagccctgaagaccatcagcgtgatccccggcctgaagaccatcgtgggcgccctgatccagagcgtgaagaagctgagcgacgtgatgatcctgaccgtgttctgcctgagcgtgttcgccctgatcggcctgcagctgttcatgggcaacctgagaaacaagtgcctgcagtggccccccgacaacagcagcttcgagatcaacatcaccagcttcttcaacaacagcctggacggcaacggcaccaccttcaacagaaccgtgagcatcttcaactgggacgagtacatcgaggacaagagccacttctacttcctggagggccagaacgacgccctgctgtgcggcaacagcagcgacgccggccagtgccccgagggctacatctgcgtgaaggccggcagaaaccccaactacggctacaccagcttcgacaccttcagctgggccttcctgagcctgttcagactgatgacccaggacttctgggagaacctgtaccagctgaccctgagagccgccggcaagacctacatgatcttcttcgtgctggtgatcttcctgggcagcttctacctgatcaacctgatcctggccgtggtggccatggcctacgaggagcagaaccaggccaccctggaggaggccgagcagaaggaggccgagttccagcagatgctggagcagctgaagaagcagcaggaggaggcccaggccgccgccgccgccgccagcgccgagagcagagacttcagcggcgccggcggcatcggcgtgttcagcgagagcagcagcgtggccagcaagctgagcagcaagagcgagaaggagctgaagaactag

SEQ ID NO: 99292 - DNA, 648 bp, Artificial Sequence
  Description of Artificial Sequence: Synthetic coding sequence
atgcacagagacgcctggctgcccagacccgccttcagcctgaccggcctgagcctgttcttcagcctggtgccccccggcagaagcatggaggtgaccgtgcccgccaccctgaacgtgctgaacggcagcgacgccagactgccctgcaccttcaacagctgctacaccgtgaaccacaagcagttcagcctgaactggacctaccaggagtgcaacaactgcagcgaggagatgttcctgcagttcagaatgaagatcatcaacctgaagctggagagattccaggacagagtggagttcagcggcaaccccagcaagtacgacgtgagcgtgatgctgagaaacgtgcagcccgaggacgagggcatctacaactgctacatcatgaacccccccgacagacacagaggccacggcaagatccacctgcaggtgctgatggaggagccccccgagagagacagcaccgtggccgtgatcgtgggcgccagcgtgggcggcttcctggccgtggtgatcctggtgctgatggtggtgaagtgcgtgagaagaaagaaggagcagaagctgagcaccgacgacctgaagaccgaggaggagggcaagaccgacggcgagggcaaccccgacgacggcgccaagtag

SEQ ID NO: 99293 - DNA, 6003 bp, Artificial Sequence
  Description of Artificial Sequence: Synthetic coding sequence
atggcccaggccctgctggtgccccccggccccgagagcttcagactgttcaccagagagagcctggccgccatcgagaagagagccgccgaggagaaggccaagaagcccaagaaggagcaggacaacgacgacgagaacaagcccaagcccaacagcgacctggaggccggcaagaacctgcccttcatctacggcgacatcccccccgagatggtgagcgagcccctggaggacctggacccctactacatcaacaagaagaccttcatcgtgatgaacaagggcaaggccatcttcagattcagcgccaccagcgccctgtacatcctgacccccctgaaccccgtgagaaagatcgccatcaagatcctggtgcacagcctgttcagcatgctgatcatgtgcaccatcctgaccaactgcgtgttcatgaccctgagcaacccccccgactggaccaagaacgtggagtacaccttcaccggcatctacaccttcgagagcctgatcaagatcctggccagaggcttctgcctggaggacttcaccttcctgagagacccctggaactggctggacttcagcgtgatcgtgatggcctacgtgaccgagttcgtggacctgggcaacgtgagcgccctgagaaccttcagagtgctgagagccctgaagaccatcagcgtgatccccggcctgaagaccatcgtgggcgccctgatccagagcgtgaagaagctgagcgacgtgatgatcctgaccgtgttctgcctgagcgtgttcgccctgatcggcctgcagctgttcatgggcaacctgagaaacaagtgcctgcagtggccccccagcgacagcgccttcgagaccaacaccaccagctacttcaacggcaccatggacagcaacggcaccttcgtgaacgtgaccatgagcaccttcaactggaaggactacatcggcgacgacagccacttctacgtgctggacggccagaaggaccccctgctgtgcggcaacggcagcgacgccggccagtgccccgagggctacatctgcgtgaaggccggcagaaaccccaactacggctacaccagcttcgacaccttcagctgggccttcctgagcctgttcagactgatgacccaggactactgggagaacctgtaccagctgaccctgagagccgccggcaagacctacatgatcttcttcgtgctggtgatcttcctgggcagcttctacctggtgaacctgatcctggccgtggtggccatggcctacgaggagcagaaccaggccaccctggaggaggccgagcagaaggaggccgagttccagcagatgctggagcagctgaagaagcagcaggaggaggcccaggccgtggccgccgccagcgccgccagcagagacttcagcggcatcggcggcctgggcgagctgctggagagcagcagcgaggccagcaagctgagcagcaagagcgccaaggagtggagaaacagaagaaagaagagaagacagagagagcacctggagggcaacaacaagggcgagagagacagcttccccaagagcgagagcgaggacagcgtgaagagaagcagcttcctgttcagcatggacggcaacagactgaccagcgacaagaagttctgcagcccccaccagagcctgctgagcatcagaggcagcctgttcagccccagaagaaacagcaagaccagcatcttcagcttcagaggcagagccaaggacgtgggcagcgagaacgacttcgccgacgacgagcacagcaccttcgaggacagcgagagcagaagagacagcctgttcgtgccccacagacacggcgagagaagaaacagcaacgtgagccaggccagcatgagcagcagaatggtgcccggcctgcccgccaacggcaagatgcacagcaccgtggactgcaacggcgtggtgagcctggtgggcggccccagcgccctgaccagccccaccggccagctgccccccgagggcaccaccaccgagaccgaggtgagaaagagaagactgagcagctaccagatcagcatggagatgctggaggacagcagcggcagacagagagccgtgagcatcgccagcatcctgaccaacaccatggaggagctggaggagagcagacagaagtgccccccctgctggtacagattcgccaacgtgttcctgatctgggactgctgcgacgcctggctgaaggtgaagcacctggtgaacctgatcgtgatggaccccttcgtggacctggccatcaccatctgcatcgtgctgaacaccctgttcatggccatggagcactaccccatgaccgagcagttcagcagcgtgctgaccgtgggcaacctggtgttcaccggcatcttcaccgccgagatggtgctgaagatcatcgccatggacccctactactacttccaggagggctggaacatcttcgacggcatcatcgtgagcctgagcctgatggagctgggcctgagcaacgtggagggcctgagcgtgctgagaagcttcagactgctgagagtgttcaagctggccaagagctggcccaccctgaacatgctgatcaagatcatcggcaacagcgtgggcgccctgggcaacctgaccctggtgctggccatcatcgtgttcatcttcgccgtggtgggcatgcagctgttcggcaagagctacaaggagtgcgtgtgcaagatcaacgacgactgcaccctgcccagatggcacatgaacgacttcttccacagcttcctgatcgtgttcagagtgctgtgcggcgagtggatcgagaccatgtgggactgcatggaggtggccggccagaccatgtgcctgatcgtgttcatgctggtgatggtgatcggcaacctggtggtgctgaacctgttcctggccctgctgctgagcagcttcagcagcgacaacctggccgccaccgacgacgacaacgagatgaacaacctgcagatcgccgtgggcagaatgcagaagggcatcgactacgtgaagaacaagatgagagagtgcttccagaaggccttcttcagaaagcccaaggtgatcgagatccacgagggcaacaagatcgacagctgcatgagcaacaacaccggcatcgagatcagcaaggagctgaactacctgagagacggcaacggcaccaccagcggcgtgggcaccggcagcagcgtggagaagtacgtgatcgacgagaacgactacatgagcttcatcaacaaccccagcctgaccgtgaccgtgcccatcgccgtgggcgagagcgacttcgagaacctgaacaccgaggagttcagcagcgagagcgagctggaggagagcaaggagaagctgaacgccaccagcagcagcgagggcagcaccgtggacgtggtgctgcccagagagggcgagcaggccgagaccgagcccgaggaggacctgaagcccgaggcctgcttcaccgagggctgcatcaagaagttccccttctgccaggtgagcaccgaggagggcaagggcaagatctggtggaacctgagaaagacctgctacagcatcgtggagcacaactggttcgagaccttcatcgtgttcatgatcctgctgagcagcggcgccctggccttcgaggacatctacatcgagcagagaaagaccatcaagaccatgctggagtacgccgacaaggtgttcacctacatcttcatcctggagatgctgctgaagtgggtggcctacggcttccagacctacttcaccaacgcctggtgctggctggacttcctgatcgtggacgtgagcctggtgagcctggtggccaacgccctgggctacagcgagctgggcgccatcaagagcctgagaaccctgagagccctgagacccctgagagccctgagcagattcgagggcatgagagtggtggtgaacgccctggtgggcgccatccccagcatcatgaacgtgctgctggtgtgcctgatcttctggctgatcttcagcatcatgggcgtgaacctgttcgccggcaagttctaccactgcgtgaacatgaccaccggcaacatgttcgacatcagcgacgtgaacaacctgagcgactgccaggccctgggcaagcaggccagatggaagaacgtgaaggtgaacttcgacaacgtgggcgccggctacctggccctgctgcaggtggccaccttcaagggctggatggacatcatgtacgccgccgtggacagcagagacgtgaagctgcagcccgtgtacgaggagaacctgtacatgtacctgtacttcgtgatcttcatcatcttcggcagcttcttcaccctgaacctgttcatcggcgtgatcatcgacaacttcaaccagcagaagaagaagttcggcggccaggacatcttcatgaccgaggagcagaagaagtactacaacgccatgaagaagctgggcagcaagaagccccagaagcccatccccagacccgccaacaagttccagggcatggtgttcgacttcgtgaccagacaggtgttcgacatcagcatcatgatcctgatctgcctgaacatggtgaccatgatggtggagaccgacgaccagggcaagtacatgaccctggtgctgagcagaatcaacctggtgttcatcgtgctgttcaccggcgagttcgtgctgaagctggtgagcctgagacactactacttcaccatcggctggaacatcttcgacttcgtggtggtgatcctgagcatcgtgggcatgttcctggccgagatgatcgagaagtacttcgtgagccccaccctgttcagagtgatcagactggccagaatcggcagaatcctgagactgatcaagggcgccaagggcatcagaaccctgctgttcgccctgatgatgagcctgcccgccctgttcaacatcggcctgctgctgttcctggtgatgttcatctacgccatcttcggcatgagcaacttcgcctacgtgaagaaggaggccggcatcgacgacatgttcaacttcgagaccttcggcaacagcatgatctgcctgttccagatcaccaccagcgccggctgggacggcctgctggcccccatcctgaacagcgccccccccgactgcgaccccgacaccatccaccccggcagcagcgtgaagggcgactgcggcaaccccagcgtgggcatcttcttcttcgtgagctacatcatcatcagcttcctggtggtggtgaacatgtacatcgccgtgatcctggagaacttcagcgtggccaccgaggagagcgccgagcccctgagcgaggacgacttcgagatgttctacgaggtgtgggagaagttcgaccccgacgccacccagttcatcgagttcagcaagctgagcgacttcgccgccgccctggacccccccctgctgatcgccaagcccaacaaggtgcagctgatcgccatggacctgcccatggtgagcggcgacagaatccactgcctggacatcctgttcgccttcaccaagagagtgctgggcgagagcggcgagatggacgccctgagaatccagatggaggacagattcatggccagcaaccccagcaaggtgagctacgagcccatcaccaccaccctgaagagaaagcaggaggaggtgagcgccgccatcatccagagaaacttcagatgctacctgctgaagcagagactgaagaacatcagcagcaactacaacaaggaggccatcaagggcagaatcgacctgcccatcaagcaggacatgatcatcgacaagctgaacggcaacagcacccccgagaagaccgacggcagcagcagcaccaccagcccccccagctacgacagcgtgaccaagcccgacaaggagaagttcgagaaggacaagcccgagaaggagagcaagggcaaggaggtgagagagaaccagaagtag

SEQ ID NO: 99294 - DNA, 6003 bp, Artificial Sequence
  Description of Artificial Sequence: Synthetic coding sequence
atggcccaggccctgctggtgccccccggccccgagagcttcagactgttcaccagagagagcctggccgccatcgagaagagagccgccgaggagaaggccaagaagcccaagaaggagcaggacaacgacgacgagaacaagcccaagcccaacagcgacctggaggccggcaagaacctgcccttcatctacggcgacatcccccccgagatggtgagcgagcccctggaggacctggacccctactacatcaacaagaagaccttcatcgtgatgaacaagggcaaggccatcttcagattcagcgccaccagcgccctgtacatcctgacccccctgaaccccgtgagaaagatcgccatcaagatcctggtgcacagcctgttcagcatgctgatcatgtgcaccatcctgaccaactgcgtgttcatgaccctgagcaacccccccgactggaccaagaacgtggagtacaccttcaccggcatctacaccttcgagagcctgatcaagatcctggccagaggcttctgcctggaggacttcaccttcctgagagacccctggaactggctggacttcagcgtgatcgtgatggcctacgtgaccgagttcgtgagcctgggcaacgtgagcgccctgagaaccttcagagtgctgagagccctgaagaccatcagcgtgatccccggcctgaagaccatcgtgggcgccctgatccagagcgtgaagaagctgagcgacgtgatgatcctgaccgtgttctgcctgagcgtgttcgccctgatcggcctgcagctgttcatgggcaacctgagaaacaagtgcctgcagtggccccccagcgacagcgccttcgagaccaacaccaccagctacttcaacggcaccatggacagcaacggcaccttcgtgaacgtgaccatgagcaccttcaactggaaggactacatcggcgacgacagccacttctacgtgctggacggccagaaggaccccctgctgtgcggcaacggcagcgacgccggccagtgccccgagggctacatctgcgtgaaggccggcagaaaccccaactacggctacaccagcttcgacaccttcagctgggccttcctgagcctgttcagactgatgacccaggactactgggagaacctgtaccagctgaccctgagagccgccggcaagacctacatgatcttcttcgtgctggtgatcttcctgggcagcttctacctggtgaacctgatcctggccgtggtggccatggcctacgaggagcagaaccaggccaccctggaggaggccgagcagaaggaggccgagttccagcagatgctggagcagctgaagaagcagcaggaggaggcccaggccgtggccgccgccagcgccgccagcagagacttcagcggcatcggcggcctgggcgagctgctggagagcagcagcgaggccagcaagctgagcagcaagagcgccaaggagtggagaaacagaagaaagaagagaagacagagagagcacctggagggcaacaacaagggcgagagagacagcttccccaagagcgagagcgaggacagcgtgaagagaagcagcttcctgttcagcatggacggcaacagactgaccagcgacaagaagttctgcagcccccaccagagcctgctgagcatcagaggcagcctgttcagccccagaagaaacagcaagaccagcatcttcagcttcagaggcagagccaaggacgtgggcagcgagaacgacttcgccgacgacgagcacagcaccttcgaggacagcgagagcagaagagacagcctgttcgtgccccacagacacggcgagagaagaaacagcaacgtgagccaggccagcatgagcagcagaatggtgcccggcctgcccgccaacggcaagatgcacagcaccgtggactgcaacggcgtggtgagcctggtgggcggccccagcgccctgaccagccccaccggccagctgccccccgagggcaccaccaccgagaccgaggtgagaaagagaagactgagcagctaccagatcagcatggagatgctggaggacagcagcggcagacagagagccgtgagcatcgccagcatcctgaccaacaccatggaggagctggaggagagcagacagaagtgccccccctgctggtacagattcgccaacgtgttcctgatctgggactgctgcgacgcctggctgaaggtgaagcacctggtgaacctgatcgtgatggaccccttcgtggacctggccatcaccatctgcatcgtgctgaacaccctgttcatggccatggagcactaccccatgaccgagcagttcagcagcgtgctgaccgtgggcaacctggtgttcaccggcatcttcaccgccgagatggtgctgaagatcatcgccatggacccctactactacttccaggagggctggaacatcttcgacggcatcatcgtgagcctgagcctgatggagctgggcctgagcaacgtggagggcctgagcgtgctgagaagcttcagactgctgagagtgttcaagctggccaagagctggcccaccctgaacatgctgatcaagatcatcggcaacagcgtgggcgccctgggcaacctgaccctggtgctggccatcatcgtgttcatcttcgccgtggtgggcatgcagctgttcggcaagagctacaaggagtgcgtgtgcaagatcaacgacgactgcaccctgcccagatggcacatgaacgacttcttccacagcttcctgatcgtgttcagagtgctgtgcggcgagtggatcgagaccatgtgggactgcatggaggtggccggccagaccatgtgcctgatcgtgttcatgctggtgatggtgatcggcaacctggtggtgctgaacctgttcctggccctgctgctgagcagcttcagcagcgacaacctggccgccaccgacgacgacaacgagatgaacaacctgcagatcgccgtgggcagaatgcagaagggcatcgactacgtgaagaacaagatgagagagtgcttccagaaggccttcttcagaaagcccaaggtgatcgagatccacgagggcaacaagatcgacagctgcatgagcaacaacaccggcatcgagatcagcaaggagctgaactacctgagagacggcaacggcaccaccagcggcgtgggcaccggcagcagcgtggagaagtacgtgatcgacgagaacgactacatgagcttcatcaacaaccccagcctgaccgtgaccgtgcccatcgccgtgggcgagagcgacttcgagaacctgaacaccgaggagttcagcagcgagagcgagctggaggagagcaaggagaagctgaacgccaccagcagcagcgagggcagcaccgtggacgtggtgctgcccagagagggcgagcaggccgagaccgagcccgaggaggacctgaagcccgaggcctgcttcaccgagggctgcatcaagaagttccccttctgccaggtgagcaccgaggagggcaagggcaagatctggtggaacctgagaaagacctgctacagcatcgtggagcacaactggttcgagaccttcatcgtgttcatgatcctgctgagcagcggcgccctggccttcgaggacatctacatcgagcagagaaagaccatcaagaccatgctggagtacgccgacaaggtgttcacctacatcttcatcctggagatgctgctgaagtgggtggcctacggcttccagacctacttcaccaacgcctggtgctggctggacttcctgatcgtggacgtgagcctggtgagcctggtggccaacgccctgggctacagcgagctgggcgccatcaagagcctgagaaccctgagagccctgagacccctgagagccctgagcagattcgagggcatgagagtggtggtgaacgccctggtgggcgccatccccagcatcatgaacgtgctgctggtgtgcctgatcttctggctgatcttcagcatcatgggcgtgaacctgttcgccggcaagttctaccactgcgtgaacatgaccaccggcaacatgttcgacatcagcgacgtgaacaacctgagcgactgccaggccctgggcaagcaggccagatggaagaacgtgaaggtgaacttcgacaacgtgggcgccggctacctggccctgctgcaggtggccaccttcaagggctggatggacatcatgtacgccgccgtggacagcagagacgtgaagctgcagcccgtgtacgaggagaacctgtacatgtacctgtacttcgtgatcttcatcatcttcggcagcttcttcaccctgaacctgttcatcggcgtgatcatcgacaacttcaaccagcagaagaagaagttcggcggccaggacatcttcatgaccgaggagcagaagaagtactacaacgccatgaagaagctgggcagcaagaagccccagaagcccatccccagacccgccaacaagttccagggcatggtgttcgacttcgtgaccagacaggtgttcgacatcagcatcatgatcctgatctgcctgaacatggtgaccatgatggtggagaccgacgaccagggcaagtacatgaccctggtgctgagcagaatcaacctggtgttcatcgtgctgttcaccggcgagttcgtgctgaagctggtgagcctgagacactactacttcaccatcggctggaacatcttcgacttcgtggtggtgatcctgagcatcgtgggcatgttcctggccgagatgatcgagaagtacttcgtgagccccaccctgttcagagtgatcagactggccagaatcggcagaatcctgagactgatcaagggcgccaagggcatcagaaccctgctgttcgccctgatgatgagcctgcccgccctgttcaacatcggcctgctgctgttcctggtgatgttcatctacgccatcttcggcatgagcaacttcgcctacgtgaagaaggaggccggcatcgacgacatgttcaacttcgagaccttcggcaacagcatgatctgcctgttccagatcaccaccagcgccggctgggacggcctgctggcccccatcctgaacagcgccccccccgactgcgaccccgacaccatccaccccggcagcagcgtgaagggcgactgcggcaaccccagcgtgggcatcttcttcttcgtgagctacatcatcatcagcttcctggtggtggtgaacatgtacatcgccgtgatcctggagaacttcagcgtggccaccgaggagagcgccgagcccctgagcgaggacgacttcgagatgttctacgaggtgtgggagaagttcgaccccgacgccacccagttcatcgagttcagcaagctgagcgacttcgccgccgccctggacccccccctgctgatcgccaagcccaacaaggtgcagctgatcgccatggacctgcccatggtgagcggcgacagaatccactgcctggacatcctgttcgccttcaccaagagagtgctgggcgagagcggcgagatggacgccctgagaatccagatggaggacagattcatggccagcaaccccagcaaggtgagctacgagcccatcaccaccaccctgaagagaaagcaggaggaggtgagcgccgccatcatccagagaaacttcagatgctacctgctgaagcagagactgaagaacatcagcagcaactacaacaaggaggccatcaagggcagaatcgacctgcccatcaagcaggacatgatcatcgacaagctgaacggcaacagcacccccgagaagaccgacggcagcagcagcaccaccagcccccccagctacgacagcgtgaccaagcccgacaaggagaagttcgagaaggacaagcccgagaaggagagcaagggcaaggaggtgagagagaaccagaagtag

SEQ ID NO: 99295 - DNA, 5856 bp, Artificial Sequence
  Description of Artificial Sequence: Synthetic coding sequence
atggcccaggccctgctggtgccccccggccccgagagcttcagactgttcaccagagagagcctggccgccatcgagaagagagccgccgaggagaaggccaagaagcccaagaaggagcaggacaacgacgacgagaacaagcccaagcccaacagcgacctggaggccggcaagaacctgcccttcatctacggcgacatcccccccgagatggtgagcgagcccctggaggacctggacccctactacatcaacaagaagaccttcatcgtgatgaacaagggcaaggccatcttcagattcagcgccaccagcgccctgtacatcctgacccccctgaaccccgtgagaaagatcgccatcaagatcctggtgcacagcctgttcagcatgctgatcatgtgcaccatcctgaccaactgcgtgttcatgaccctgagcaacccccccgactggaccaagaacgtggagtacaccttcaccggcatctacaccttcgagagcctgatcaagatcctggccagaggcttctgcctggaggacttcaccttcctgagagacccctggaactggctggacttcagcgtgatcgtgatggcctacgtgaccgagttcgtgagcctgggcaacgtgagcgccctgagaaccttcagagtgctgagagccctgaagaccatcagcgtgatccccggcctgaagaccatcgtgggcgccctgatccagagcgtgaagaagctgagcgacgtgatgatcctgaccgtgttctgcctgagcgtgttcgccctgatcggcctgcagctgttcatgggcaacctgagaaacaagtgcctgcagtggccccccagcgacagcgccttcgagaccaacaccaccagctacttcaacggcaccatggacagcaacggcaccttcgtgaacgtgaccatgagcaccttcaactggaaggactacatcggcgacgacagccacttctacgtgctggacggccagaaggaccccctgctgtgcggcaacggcagcgacgccggccagtgccccgagggctacatctgcgtgaaggccggcagaaaccccaactacggctacaccagcttcgacaccttcagctgggccttcctgagcctgttcagactgatgacccaggactactgggagaacctgtaccagctgaccctgagagccgccggcaagacctacatgatcttcttcgtgctggtgatcttcctgggcagcttctacctggtgaacctgatcctggccgtggtggccatggcctacgaggagcagaaccaggccaccctggaggaggccgagcagaaggaggccgagttccagcagatgctggagcagctgaagaagcagcaggaggaggcccaggccgtggccgccgccagcgccgccagcagagacttcagcggcatcggcggcctgggcgagctgctggagagcagcagcgaggccagcaagctgagcagcaagagcgccaaggagtggagaaacagaagaaagaagagaagacagagagagcacctggagggcaacaacaagggcgagagagacagcttccccaagagcgagagcgaggacagcgtgaagagaagcagcttcctgttcagcatggacggcaacagactgaccagcgacaagaagttctgcagcccccaccagagcctgctgagcatcagaggcagcctgttcagccccagaagaaacagcaagaccagcatcttcagcttcagaggcagagccaaggacgtgggcagcgagaacgacttcgccgacgacgagcacagcaccttcgaggacagcgagagcagaagagacagcctgttcgtgccccacagacacggcgagagaagaaacagcaacggcaccaccaccgagaccgaggtgagaaagagaagactgagcagctaccagatcagcatggagatgctggaggacagcagcggcagacagagagccgtgagcatcgccagcatcctgaccaacaccatggaggagctggaggagagcagacagaagtgccccccctgctggtacagattcgccaacgtgttcctgatctgggactgctgcgacgcctggctgaaggtgaagcacctggtgaacctgatcgtgatggaccccttcgtggacctggccatcaccatctgcatcgtgctgaacaccctgttcatggccatggagcactaccccatgaccgagcagttcagcagcgtgctgaccgtgggcaacctggtgttcaccggcatcttcaccgccgagatggtgctgaagatcatcgccatggacccctactactacttccaggagggctggaacatcttcgacggcatcatcgtgagcctgagcctgatggagctgggcctgagcaacgtggagggcctgagcgtgctgagaagcttcagactgctgagagtgttcaagctggccaagagctggcccaccctgaacatgctgatcaagatcatcggcaacagcgtgggcgccctgggcaacctgaccctggtgctggccatcatcgtgttcatcttcgccgtggtgggcatgcagctgttcggcaagagctacaaggagtgcgtgtgcaagatcaacgacgactgcaccctgcccagatggcacatgaacgacttcttccacagcttcctgatcgtgttcagagtgctgtgcggcgagtggatcgagaccatgtgggactgcatggaggtggccggccagaccatgtgcctgatcgtgttcatgctggtgatggtgatcggcaacctggtggtgctgaacctgttcctggccctgctgctgagcagcttcagcagcgacaacctggccgccaccgacgacgacaacgagatgaacaacctgcagatcgccgtgggcagaatgcagaagggcatcgactacgtgaagaacaagatgagagagtgcttccagaaggccttcttcagaaagcccaaggtgatcgagatccacgagggcaacaagatcgacagctgcatgagcaacaacaccggcatcgagatcagcaaggagctgaactacctgagagacggcaacggcaccaccagcggcgtgggcaccggcagcagcgtggagaagtacgtgatcgacgagaacgactacatgagcttcatcaacaaccccagcctgaccgtgaccgtgcccatcgccgtgggcgagagcgacttcgagaacctgaacaccgaggagttcagcagcgagagcgagctggaggagagcaaggagaagctgaacgccaccagcagcagcgagggcagcaccgtggacgtggtgctgcccagagagggcgagcaggccgagaccgagcccgaggaggacctgaagcccgaggcctgcttcaccgagggctgcatcaagaagttccccttctgccaggtgagcaccgaggagggcaagggcaagatctggtggaacctgagaaagacctgctacagcatcgtggagcacaactggttcgagaccttcatcgtgttcatgatcctgctgagcagcggcgccctggccttcgaggacatctacatcgagcagagaaagaccatcaagaccatgctggagtacgccgacaaggtgttcacctacatcttcatcctggagatgctgctgaagtgggtggcctacggcttccagacctacttcaccaacgcctggtgctggctggacttcctgatcgtggacgtgagcctggtgagcctggtggccaacgccctgggctacagcgagctgggcgccatcaagagcctgagaaccctgagagccctgagacccctgagagccctgagcagattcgagggcatgagagtggtggtgaacgccctggtgggcgccatccccagcatcatgaacgtgctgctggtgtgcctgatcttctggctgatcttcagcatcatgggcgtgaacctgttcgccggcaagttctaccactgcgtgaacatgaccaccggcaacatgttcgacatcagcgacgtgaacaacctgagcgactgccaggccctgggcaagcaggccagatggaagaacgtgaaggtgaacttcgacaacgtgggcgccggctacctggccctgctgcaggtggccaccttcaagggctggatggacatcatgtacgccgccgtggacagcagagacgtgaagctgcagcccgtgtacgaggagaacctgtacatgtacctgtacttcgtgatcttcatcatcttcggcagcttcttcaccctgaacctgttcatcggcgtgatcatcgacaacttcaaccagcagaagaagaagttcggcggccaggacatcttcatgaccgaggagcagaagaagtactacaacgccatgaagaagctgggcagcaagaagccccagaagcccatccccagacccgccaacaagttccagggcatggtgttcgacttcgtgaccagacaggtgttcgacatcagcatcatgatcctgatctgcctgaacatggtgaccatgatggtggagaccgacgaccagggcaagtacatgaccctggtgctgagcagaatcaacctggtgttcatcgtgctgttcaccggcgagttcgtgctgaagctggtgagcctgagacactactacttcaccatcggctggaacatcttcgacttcgtggtggtgatcctgagcatcgtgggcatgttcctggccgagatgatcgagaagtacttcgtgagccccaccctgttcagagtgatcagactggccagaatcggcagaatcctgagactgatcaagggcgccaagggcatcagaaccctgctgttcgccctgatgatgagcctgcccgccctgttcaacatcggcctgctgctgttcctggtgatgttcatctacgccatcttcggcatgagcaacttcgcctacgtgaagaaggaggccggcatcgacgacatgttcaacttcgagaccttcggcaacagcatgatctgcctgttccagatcaccaccagcgccggctgggacggcctgctggcccccatcctgaacagcgccccccccgactgcgaccccgacaccatccaccccggcagcagcgtgaagggcgactgcggcaaccccagcgtgggcatcttcttcttcgtgagctacatcatcatcagcttcctggtggtggtgaacatgtacatcgccgtgatcctggagaacttcagcgtggccaccgaggagagcgccgagcccctgagcgaggacgacttcgagatgttctacgaggtgtgggagaagttcgaccccgacgccacccagttcatcgagttcagcaagctgagcgacttcgccgccgccctggacccccccctgctgatcgccaagcccaacaaggtgcagctgatcgccatggacctgcccatggtgagcggcgacagaatccactgcctggacatcctgttcgccttcaccaagagagtgctgggcgagagcggcgagatggacgccctgagaatccagatggaggacagattcatggccagcaaccccagcaaggtgagctacgagcccatcaccaccaccctgaagagaaagcaggaggaggtgagcgccgccatcatccagagaaacttcagatgctacctgctgaagcagagactgaagaacatcagcagcaactacaacaaggaggccatcaagggcagaatcgacctgcccatcaagcaggacatgatcatcgacaagctgaacggcaacagcacccccgagaagaccgacggcagcagcagcaccaccagcccccccagctacgacagcgtgaccaagcccgacaaggagaagttcgagaaggacaagcccgagaaggagagcaagggcaaggaggtgagagagaaccagaagtag

SEQ ID NO: 99296 - DNA, 4095 bp, Artificial Sequence
  Description of Artificial Sequence: Synthetic coding sequence
atggcccaggccctgctggtgccccccggccccgagagcttcagactgttcaccagagagagcctggccgccatcgagaagagagccgccgaggagaaggccaagaagcccaagaaggagcaggacaacgacgacgagaacaagcccaagcccaacagcgacctggaggccggcaagaacctgcccttcatctacggcgacatcccccccgagatggtgagcgagcccctggaggacctggacccctactacatcaacaagaagaccttcatcgtgatgaacaagggcaaggccatcttcagattcagcgccaccagcgccctgtacatcctgacccccctgaaccccgtgagaaagatcgccatcaagatcctggtgcacagcctgttcagcatgctgatcatgtgcaccatcctgaccaactgcgtgttcatgaccctgagcaacccccccgactggaccaagaacgtggagtacaccttcaccggcatctacaccttcgagagcctgatcaagatcctggccagaggcttctgcctggaggacttcaccttcctgagagacccctggaactggctggacttcagcgtgatcgtgatggcctacgtgaccgagttcgtggacctgggcaacgtgagcgccctgagaaccttcagagtgctgagagccctgaagaccatcagcgtgatccccggcctgaagaccatcgtgggcgccctgatccagagcgtgaagaagctgagcgacgtgatgatcctgaccgtgttctgcctgagcgtgttcgccctgatcggcctgcagctgttcatgggcaacctgagaaacaagtgcctgcagtggccccccagcgacagcgccttcgagaccaacaccaccagctacttcaacggcaccatggacagcaacggcaccttcgtgaacgtgaccatgagcaccttcaactggaaggactacatcggcgacgacagccacttctacgtgctggacggccagaaggaccccctgctgtgcggcaacggcagcgacgccggccagtgccccgagggctacatctgcgtgaaggccggcagaaaccccaactacggctacaccagcttcgacaccttcagctgggccttcctgagcctgttcagactgatgacccaggactactgggagaacctgtaccagctgaccctgagagccgccggcaagacctacatgatcttcttcgtgctggtgatcttcctgggcagcttctacctggtgaacctgatcctggccgtggtggccatggcctacgaggagcagaaccaggccaccctggaggaggccgagcagaaggaggccgagttccagcagatgctggagcagctgaagaagcagcaggaggaggcccaggccgtggccgccgccagcgccgccagcagagacttcagcggcatcggcggcctgggcgagctgctggagagcagcagcgaggccagcaagctgagcagcaagagcgccaaggagtggagaaacagaagaaagaagagaagacagagagagcacctggagggcaacaacaagggcgagagagacagcttccccaagagcgagagcgaggacagcgtgaagagaagcagcttcctgttcagcatggacggcaacagactgaccagcgacaagaagttctgcagcccccaccagagcctgctgagcatcagaggcagcctgttcagccccagaagaaacagcaagaccagcatcttcagcttcagaggcagagccaaggacgtgggcagcgagaacgacttcgccgacgacgagcacagcaccttcgaggacagcgagagcagaagagacagcctgttcgtgccccacagacacggcgagagaagaaacagcaacggcaccaccaccgagaccgaggtgagaaagagaagactgagcagctaccagatcagcatggagatgctggaggacagcagcggcagacagagagccgtgagcatcgccagcatcctgaccaacaccatggaggagctggaggagagcagacagaagtgccccccctgctggtacagattcgccaacgtgttcctgatctgggactgctgcgacgcctggctgaaggtgaagcacctggtgaacctgatcgtgatggaccccttcgtggacctggccatcaccatctgcatcgtgctgaacaccctgttcatggccatggagcactaccccatgaccgagcagttcagcagcgtgctgaccgtgggcaacctggtgttcaccggcatcttcaccgccgagatggtgctgaagatcatcgccatggacccctactactacttccaggagggctggaacatcttcgacggcatcatcgtgagcctgagcctgatggagctgggcctgagcaacgtggagggcctgagcgtgctgagaagcttcagactgctgagagtgttcaagctggccaagagctggcccaccctgaacatgctgatcaagatcatcggcaacagcgtgggcgccctgggcaacctgaccctggtgctggccatcatcgtgttcatcttcgccgtggtgggcatgcagctgttcggcaagagctacaaggagtgcgtgtgcaagatcaacgacgactgcaccctgcccagatggcacatgaacgacttcttccacagcttcctgatcgtgttcagagtgctgtgcggcgagtggatcgagaccatgtgggactgcatggaggtggccggccagaccatgtgcctgatcgtgttcatgctggtgatggtgatcggcaacctggtggtgctgaacctgttcctggccctgctgctgagcagcttcagcagcgacaacctggccgccaccgacgacgacaacgagatgaacaacctgcagatcgccgtgggcagaatgcagaagggcatcgactacgtgaagaacaagatgagagagtgcttccagaaggccttcttcagaaagcccaaggtgatcgagatccacgagggcaacaagatcgacagctgcatgagcaacaacaccggcatcgagatcagcaaggagctgaactacctgagagacggcaacggcaccaccagcggcgtgggcaccggcagcagcgtggagaagtacgtgatcgacgagaacgactacatgagcttcatcaacaaccccagcctgaccgtgaccgtgcccatcgccgtgggcgagagcgacttcgagaacctgaacaccgaggagttcagcagcgagagcgagctggaggagagcaaggagaagctgaacgccaccagcagcagcgagggcagcaccgtggacgtggtgctgcccagagagggcgagcaggccgagaccgagcccgaggaggacctgaagcccgaggcctgcttcaccgagggctgcatcaagaagttccccttctgccaggtgagcaccgaggagggcaagggcaagatctggtggaacctgagaaagacctgctacagcatcgtggagcacaactggttcgagaccttcatcgtgttcatgatcctgctgagcagcggcgccctggccttcgaggacatctacatcgagcagagaaagaccatcaagaccatgctggagtacgccgacaaggtgttcacctacatcttcatcctggagatgctgctgaagtgggtggcctacggcttccagacctacttcaccaacgcctggtgctggctggacttcctgatcgtggacgtgagcctggtgagcctggtggccaacgccctgggctacagcgagctgggcgccatcaagagcctgagaaccctgagagccctgagacccctgagagccctgagcagattcgagggcatgagagtggtggtgaacgccctggtgggcgccatccccagcatcatgaacgtgctgctggtgtgcctgatcttctggctgatcttcagcatcatgggcgtgaacctgttcgccggcaagttctaccactgcgtgaacatgaccaccggcaacatgttcgacatcagcgacgtgaacaacctgagcgactgccaggccctgggcaagcaggccagatggaagaacgtgaaggtgaacttcgacaacgtgggcgccggctacctggccctgctgcaggtgtag

SEQ ID NO: 99297 - DNA, 603 bp, Artificial Sequence
  Description of Artificial Sequence: Synthetic coding sequence
atggcccaggccctgctggtgccccccggccccgagagcttcagactgttcaccagagagagcctggccgccatcgagaagagagccgccgaggagaaggccaagaagcccaagaaggagcaggacaacgacgacgagaacaagcccaagcccaacagcgacctggaggccggcaagaacctgcccttcatctacggcgacatcccccccgagatggtgagcgagcccctggaggacctggacccctactacatcaacaagaagaccttcatcgtgatgaacaagggcaaggccatcttcagattcagcgccaccagcgccctgtacatcctgacccccctgaaccccgtgagaaagatcgccatcaagatcctggtgcacagcctgttcagcatgctgatcatgtgcaccatcctgaccaactgcgtgttcatgaccctgagcaacccccccgactggaccaagaacgtggagtacaccttcaccggcatctacaccttcgagagcctgatcaagatcctggccagaggcttctgcctggaggacttcaccttcctgagagacccctggaactggctggacttcagcgtgatcgtgatgtag

SEQ ID NO: 99298 - DNA, 1452 bp, Artificial Sequence
  Description of Artificial Sequence: Synthetic coding sequence
atggtgttcgacttcgtgaccagacaggtgttcgacatcagcatcatgatcctgatctgcctgaacatggtgaccatgatggtggagaccgacgaccagggcaagtacatgaccctggtgctgagcagaatcaacctggtgttcatcgtgctgttcaccggcgagttcgtgctgaagctggtgagcctgagacactactacttcaccatcggctggaacatcttcgacttcgtggtggtgatcctgagcatcgtgggcatgttcctggccgagatgatcgagaagtacttcgtgagccccaccctgttcagagtgatcagactggccagaatcggcagaatcctgagactgatcaagggcgccaagggcatcagaaccctgctgttcgccctgatgatgagcctgcccgccctgttcaacatcggcctgctgctgttcctggtgatgttcatctacgccatcttcggcatgagcaacttcgcctacgtgaagaaggaggccggcatcgacgacatgttcaacttcgagaccttcggcaacagcatgatctgcctgttccagatcaccaccagcgccggctgggacggcctgctggcccccatcctgaacagcgccccccccgactgcgaccccgacaccatccaccccggcagcagcgtgaagggcgactgcggcaaccccagcgtgggcatcttcttcttcgtgagctacatcatcatcagcttcctggtggtggtgaacatgtacatcgccgtgatcctggagaacttcagcgtggccaccgaggagagcgccgagcccctgagcgaggacgacttcgagatgttctacgaggtgtgggagaagttcgaccccgacgccacccagttcatcgagttcagcaagctgagcgacttcgccgccgccctggacccccccctgctgatcgccaagcccaacaaggtgcagctgatcgccatggacctgcccatggtgagcggcgacagaatccactgcctggacatcctgttcgccttcaccaagagagtgctgggcgagagcggcgagatggacgccctgagaatccagatggaggacagattcatggccagcaaccccagcaaggtgagctacgagcccatcaccaccaccctgaagagaaagcaggaggaggtgagcgccgccatcatccagagaaacttcagatgctacctgctgaagcagagactgaagaacatcagcagcaactacaacaaggaggccatcaagggcagaatcgacctgcccatcaagcaggacatgatcatcgacaagctgaacggcaacagcacccccgagaagaccgacggcagcagcagcaccaccagcccccccagctacgacagcgtgaccaagcccgacaaggagaagttcgagaaggacaagcccgagaaggagagcaagggcaaggaggtgagagagaaccagaagtag

SEQ ID NO: 99299 - DNA, 648 bp, Artificial Sequence
  Description of Artificial Sequence: Synthetic coding sequence
atgcccgccttcaacagactgttccccctggccagcctggtgctgatctactgggtgagcgtgtgcttccccgtgtgcgtggaggtgcccagcgagaccgaggccgtgcagggcaaccccatgaagctgagatgcatcagctgcatgaagagagaggaggtggaggccaccaccgtggtggagtggttctacagacccgagggcggcaaggacttcctgatctacgagtacagaaacggccaccaggaggtggagagccccttccagggcagactgcagtggaacggcagcaaggacctgcaggacgtgagcatcaccgtgctgaacgtgaccctgaacgacagcggcctgtacacctgcaacgtgagcagagagttcgagttcgaggcccacagacccttcgtgaagaccaccagactgatccccctgagagtgaccgaggaggccggcgaggacttcaccagcgtggtgagcgagatcatgatgtacatcctgctggtgttcctgaccctgtggctgctgatcgagatgatctactgctacagaaaggtgagcaaggccgaggaggccgcccaggagaacgccagcgactacctggccatccccagcgagaacaaggagaacagcgccgtgcccgtggaggagtag

SEQ ID NO: 99300 - DNA, 648 bp, Artificial Sequence; identical to SEQ ID NO: 99299
  Description of Artificial Sequence: Synthetic coding sequence

SEQ ID NO: 99301 - DNA, 426 bp, Artificial Sequence
  Description of Artificial Sequence: Synthetic coding sequence
atgcccgccttcaacagactgttccccctggccagcctggtgctgatctactgggtgagcgtgtgcttccccgtgtgcgtggaggtgcccagcgagaccgaggccgtgcagggcaaccccatgaagctgagatgcatcagctgcatgaagagagaggaggtggaggccaccaccgtggtggagtggttctacagacccgagggcggcaaggacttcctgatctacgagtacagaaacggccaccaggaggtggagagccccttccagggcagactgcagtggaacggcagcaaggacctgcaggacgtgagcatcaccgtgctgaacgtgaccctgaacgacagcggcctgtacacctgcaacgtgagcagagagttcgagttcgaggcccacagacccttcgtgaagaccaccagactgatctag

SEQ ID NO: 99302 - DNA, 648 bp, Artificial Sequence; identical to SEQ ID NO: 99299
  Description of Artificial Sequence: Synthetic coding sequence

SEQ ID NO: 99303 - DNA, 5511 bp, Artificial Sequence
  Description of Artificial Sequence: Synthetic coding sequence
atggccagacccagcctgtgcaccctggtgcccctgggccccgagtgcctgagacccttcaccagagagagcctggccgccatcgagcagagagccgtggaggaggaggccagactgcagagaaacaagcagatggagatcgaggagcccgagagaaagcccagaagcgacctggaggccggcaagaacctgcccatgatctacggcgaccccccccccgaggtgatcggcatccccctggaggacctggacccctactacagcaacaagaagaccttcatcgtgctgaacaagggcaaggccatcttcagattcagcgccacccccgccctgtacctgctgagccccttcagcgtggtgagaagaggcgccatcaaggtgctgatccacgccctgttcagcatgttcatcatgatcaccatcctgaccaactgcgtgttcatgaccatgagcgacccccccccctggagcaagaacgtggagtacaccttcaccggcatctacaccttcgagagcctgatcaagatcctggccagaggcttctgcgtggacgacttcaccttcctgagagacccctggaactggctggacttcagcgtgatcatgatggcctacctgaccgagttcgtggacctgggcaacatcagcgccctgagaaccttcagagtgctgagagccctgaagaccatcaccgtgatccccggcctgaagaccatcgtgggcgccctgatccagagcgtgaagaagctgagcgacgtgatgatcctgaccgtgttctgcctgagcgtgttcgccctggtgggcctgcagctgttcatgggcaacctgagacagaagtgcgtgagatggcccccccccttcaacgacaccaacaccacctggtacagcaacgacacctggtacggcaacgacacctggtacggcaacgagatgtggtacggcaacgacagctggtacgccaacgacacctggaacagccacgccagctgggccaccaacgacaccttcgactgggacgcctacatcagcgacgagggcaacttctacttcctggagggcagcaacgacgccctgctgtgcggcaacagcagcgacgccggccactgccccgagggctacgagtgcatcaagaccggcagaaaccccaactacggctacaccagctacgacaccttcagctgggccttcctggccctgttcagactgatgacccaggactactgggagaacctgttccagctgaccctgagagccgccggcaagacctacatgatcttcttcgtggtgatcatcttcctgggcagcttctacctgatcaacctgatcctggccgtggtggccatggcctacgccgagcagaacgaggccaccctggccgaggacaaggagaaggaggaggagttccagcagatgctggagaagttcaagaagcaccaggaggagctggagaaggccaaggccgcccaggccctggagggcggcgaggccgacggcgaccccgcccacggcaaggactgcaacggcagcctggacaccagccagggcgagaagggcgcccccagacagagcagcagcggcgacagcggcatcagcgacgccatggaggagctggaggaggcccaccagaagtgccccccctggtggtacaagtgcgcccacaaggtgctgatctggaactgctgcgccccctggctgaagttcaagaacatcatccacctgatcgtgatggaccccttcgtggacctgggcatcaccatctgcatcgtgctgaacaccctgttcatggccatggagcactaccccatgaccgagcacttcgacaacgtgctgaccgtgggcaacctggtgttcaccggcatcttcaccgccgagatggtgctgaagctgatcgccatggacccctacgagtacttccagcagggctggaacatcttcgacagcatcatcgtgaccctgagcctggtggagctgggcctggccaacgtgcagggcctgagcgtgctgagaagcttcagactgctgagagtgttcaagctggccaagagctggcccaccctgaacatgctgatcaagatcatcggcaacagcgtgggcgccctgggcaacctgaccctggtgctggccatcatcgtgttcatcttcgccgtggtgggcatgcagctgttcggcaagagctacaaggagtgcgtgtgcaagatcgccctggactgcaacctgcccagatggcacatgcacgacttcttccacagcttcctgatcgtgttcagaatcctgtgcggcgagtggatcgagaccatgtgggactgcatggaggtggccggccaggccatgtgcctgaccgtgttcctgatggtgatggtgatcggcaacctggtggtgctgaacctgttcctggccctgctgctgagcagcttcagcgccgacagcctggccgccagcgacgaggacggcgagatgaacaacctgcagatcgccatcggcagaatcaagctgggcatcggcttcgccaaggccttcctgctgggcctgctgcacggcaagatcctgagccccaaggacatcatgctgagcctgggcgaggccgacggcgccggcgaggccggcgaggccggcgagaccgcccccgaggacgagaagaaggagccccccgaggaggacctgaagaaggacaaccacatcctgaaccacatgggcctggccgacggcccccccagcagcctggagctggaccacctgaacttcatcaacaacccctacctgaccatccaggtgcccatcgccagcgaggagagcgacctggagatgcccaccgaggaggagaccgacaccttcagcgagcccgaggacagcaagaagcccccccagcccctgtacgacggcaacagcagcgtgtgcagcaccgccgactacaagccccccgaggaggaccccgaggagcaggccgaggagaaccccgagggcgagcagcccgaggagtgcttcaccgaggcctgcgtgcagagatggccctgcctgtacgtggacatcagccagggcagaggcaagaagtggtggaccctgagaagagcctgcttcaagatcgtggagcacaactggttcgagaccttcatcgtgttcatgatcctgctgagcagcggcgccctggccttcgaggacatctacatcgagcagagaagagtgatcagaaccatcctggagtacgccgacaaggtgttcacctacatcttcatcatggagatgctgctgaagtgggtggcctacggcttcaaggtgtacttcaccaacgcctggtgctggctggacttcctgatcgtggacgtgagcatcatcagcctggtggccaactggctgggctacagcgagctgggccccatcaagagcctgagaaccctgagagccctgagacccctgagagccctgagcagattcgagggcatgagagtggtggtgaacgccctgctgggcgccatccccagcatcatgaacgtgctgctggtgtgcctgatcttctggctgatcttcagcatcatgggcgtgaacctgttcgccggcaagttctactactgcatcaacaccaccaccagcgagagattcgacatcagcgaggtgaacaacaagagcgagtgcgagagcctgatgcacaccggccaggtgagatggctgaacgtgaaggtgaactacgacaacgtgggcctgggctacctgagcctgctgcaggtggccaccttcaagggctggatggacatcatgtacgccgccgtggacagcagagagaaggaggagcagccccagtacgaggtgaacctgtacatgtacctgtacttcgtgatcttcatcatcttcggcagcttcttcaccctgaacctgttcatcggcgtgatcatcgacaacttcaaccagcagaagaagaagctgggcggcaaggacatcttcatgaccgaggagcagaagaagtactacaacgccatgaagaagctgggcagcaagaagccccagaagcccatccccagaccccagaacaagatccagggcatggtgtacgacctggtgaccaagcaggccttcgacatcaccatcatgatcctgatctgcctgaacatggtgaccatgatggtggagaccgacaaccagagccagctgaaggtggacatcctgtacaacatcaacatgatcttcatcatcatcttcaccggcgagtgcgtgctgaagatgctggccctgagacagtactacttcaccgtgggctggaacatcttcgacttcgtggtggtgatcctgagcatcgtgggcctggccctgagcgacctgatccagaagtacttcgtgagccccaccctgttcagagtgatcagactggccagaatcggcagagtgctgagactgatcagaggcgccaagggcatcagaaccctgctgttcgccctgatgatgagcctgcccgccctgttcaacatcggcctgctgctgttcctggtgatgttcatctacagcatcttcggcatgagcaacttcgcctacgtgaagaaggagagcggcatcgacgacatgttcaacttcgagaccttcggcaacagcatcatctgcctgttcgagatcaccaccagcgccggctgggacggcctgctgaaccccatcctgaacagcggcccccccgactgcgaccccaacctggagaaccccggcaccagcgtgaagggcgactgcggcaaccccagcatcggcatctgcttcttctgcagctacatcatcatcagcttcctgatcgtggtgaacatgtacatcgccatcatcctggagaacttcaacgtggccaccgaggagagcagcgagcccctgggcgaggacgacttcgagatgttctacgagacctgggagaagttcgaccccgacgccacccagttcatcgcctacagcagactgagcgacttcgtggacaccctgcaggagcccctgagaatcgccaagcccaacaagatcaagctgatcaccctggacctgcccatggtgcccggcgacaagatccactgcctggacatcctgttcgccctgaccaaggaggtgctgggcgacagcggcgagatggacgccctgaagcagaccatggaggagaagttcatggccgccaaccccagcaaggtgagctacgagcccatcaccaccaccctgaagagaaagcacgaggaggtgtgcgccatcaagatccagagagcctacagaagacacctgctgcagagaagcatgaagcaggccagctacatgtacagacacagccacgacggcagcggcgacgacgcccccgagaaggagggcctgctggccaacaccatgagcaagatgtacggccacgagaacggcaacagcagcagccccagccccgaggagaagggcgaggccggcgacgccggccccaccatgggcctgatgcccatcagccccagcgacaccgcctggccccccgcccccccccccggccagaccgtgagacccggcgtgaaggagagcctggtgtag

SEQ ID NO: 99304 - DNA, 687 bp, Artificial Sequence
  Description of Artificial Sequence: Synthetic coding sequence
atgcccggcgccggcgacggcggcaaggcccccgccagatggctgggcaccggcctgctgggcctgttcctgctgcccgtgaccctgagcctggaggtgagcgtgggcaaggccaccgacatctacgccgtgaacggcaccgagatcctgctgccctgcaccttcagcagctgcttcggcttcgaggacctgcacttcagatggacctacaacagcagcgacgccttcaagatcctgatcgagggcaccgtgaagaacgagaagagcgaccccaaggtgaccctgaaggacgacgacagaatcaccctggtgggcagcaccaaggagaagatgaacaacatcagcatcgtgctgagagacctggagttcagcgacaccggcaagtacacctgccacgtgaagaaccccaaggagaacaacctgcagcaccacgccaccatcttcctgcaggtggtggacagactggaggaggtggacaacaccgtgaccctgatcatcctggccgtggtgggcggcgtgatcggcctgctgatcctgatcctgctgatcaagaagctgatcatcttcatcctgaagaagaccagagagaagaagaaggagtgcctggtgagcagcagcggcaacgacaacaccgagaacggcctgcccggcagcaaggccgaggagaagccccccagcaaggtgtag

SEQ ID NO: 99305 - DNA, 285 bp, Artificial Sequence
  Description of Artificial Sequence: Synthetic coding sequence
atgcccggcgccggcgacggcggcaaggcccccgccagatggctgggcaccggcctgctggtggaggaggtggacaacaccgtgaccctgatcatcctggccgtggtgggcggcgtgatcggcctgctgatcctgatcctgctgatcaagaagctgatcatcttcatcctgaagaagaccagagagaagaagaaggagtgcctggtgagcagcagcggcaacgacaacaccgagaacggcctgcccggcagcaaggccgaggagaagccccccagcaaggtgtag

SEQ ID NO: 99306 - DNA, 5970 bp, Artificial Sequence
  Description of Artificial Sequence: Synthetic coding sequence
atggccatgctgcccccccccggcccccagagcttcgtgcacttcaccaagcagagcctggccctgatcgagcagagaatcgccgagagaaagagcaaggagcccaaggaggagaagaaggacgacgacgaggaggcccccaagcccagcagcgacctggaggccggcaagcagctgcccttcatctacggcgacatcccccccggcatggtgagcgagcccctggaggacctggacccctactacgccgacaagaagaccttcatcgtgctgaacaagggcaagaccatcttcagattcaacgccacccccgccctgtacatgctgagccccttcagccccctgagaagaatcagcatcaagatcctggtgcacagcaccctgttcagcatgctgatcatgtgcaccatcctgaccaactgcatcttcatgaccatgaacaacccccccgactggaccaagaacgtggagtacaccttcaccggcatctacaccttcgagagcctggtgaagatcctggccagaggcttctgcgtgggcgagttcaccttcctgagagacccctggaactggctggacttcgtggtgatcgtgttcgcctacctgaccgagttcgtgaacctgggcaacgtgagcgccctgagaaccttcagagtgctgagagccctgaagaccatcagcgtgatccccggcctgaagaccatcgtgggcgccctgatccagagcgtgaagaagctgagcgacgtgatgatcctgaccgtgttctgcctgagcgtgttcgccctgatcggcctgcagctgttcatgggcaacctgaagcacaagtgcttcagaaacagcctggagaacaacgagaccctggagagcatcatgaacaccctggagagcgaggaggacttcagaaagtacttctactacctggagggcagcaaggacgccctgctgtgcggcttcagcaccgacagcggccagtgccccgagggctacacctgcgtgaagatcggcagaaaccccgactacggctacaccagcttcgacaccttcagctgggccttcctggccctgttcagactgatgacccaggactactgggagaacctgtaccagcagaccctgagagccgccggcaagacctacatgatcttcttcgtggtggtgatcttcctgggcagcttctacctgatcaacctgatcctggccgtggtggccatggcctacgaggagcagaaccaggccaacatcgaggaggccaagcagaaggagctggagttccagcagatgctggacagactgaagaaggagcaggaggaggccgaggccatcgccgccgccgccgccgagtacaccagcatcagaagaagcagaatcatgggcctgagcgagagcagcagcgagaccagcaagctgagcagcaagagcgccaaggagagaagaaacagaagaaagaagaagaaccagaagaagctgagcagcggcgaggagaagggcgacgccgagaagctgagcaagagcgagagcgaggacagcatcagaagaaagagcttccacctgggcgtggagggccacagaagagcccacgagaagagactgagcacccccaaccagagccccctgagcatcagaggcagcctgttcagcgccagaagaagcagcagaaccagcctgttcagcttcaagggcagaggcagagacatcggcagcgagaccgagttcgccgacgacgagcacagcatcttcggcgacaacgagagcagaagaggcagcctgttcgtgccccacagaccccaggagagaagaagcagcaacatcagccaggccagcagaagcccccccatgctgcccgtgaacggcaagatgcacagcgccgtggactgcaacggcgtggtgagcctggtggacggcagaagcgccctgatgctgcccaacggccagctgctgcccgaggtgatcatcgacaaggccaccagcgacgacagcggcaccaccaaccagatccacaagaagagaagatgcagcagctacctgctgagcgaggacatgctgaacgaccccaacctgagacagagagccatgagcagagccagcatcctgaccaacaccgtggaggagctggaggagagcagacagaagtgccccccctggtggtacagattcgcccacaagttcctgatctggaactgcagcccctactggatcaagttcaagaagtgcatctacttcatcgtgatggaccccttcgtggacctggccatcaccatctgcatcgtgctgaacaccctgttcatggccatggagcaccaccccatgaccgaggagttcaagaacgtgctggccatcggcaacctggtgttcaccggcatcttcgccgccgagatggtgctgaagctgatcgccatggacccctacgagtacttccaggtgggctggaacatcttcgacagcctgatcgtgaccctgagcctggtggagctgttcctggccgacgtggagggcctgagcgtgctgagaagcttcagactgctgagagtgttcaagctggccaagagctggcccaccctgaacatgctgatcaagatcatcggcaacagcgtgggcgccctgggcaacctgaccctggtgctggccatcatcgtgttcatcttcgccgtggtgggcatgcagctgttcggcaagagctacaaggagtgcgtgtgcaagatcaacgacgactgcaccctgcccagatggcacatgaacgacttcttccacagcttcctgatcgtgttcagagtgctgtgcggcgagtggatcgagaccatgtgggactgcatggaggtggccggccaggccatgtgcctgatcgtgtacatgatggtgatggtgatcggcaacctggtggtgctgaacctgttcctggccctgctgctgagcagcttcagcagcgacaacctgaccgccatcgaggaggaccccgacgccaacaacctgcagatcgccgtgaccagaatcaagaagggcatcaactacgtgaagcagaccctgagagagttcatcctgaaggccttcagcaagaagcccaagatcagcagagagatcagacaggccgaggacctgaacaccaagaaggagaactacatcagcaaccacaccctggccgagatgagcaagggccacaacttcctgaaggagaaggacaagatcagcggcttcggcagcagcgtggacaagcacctgatggaggacagcgacggccagagcttcatccacaaccccagcctgaccgtgaccgtgcccatcgcccccggcgagagcgacctggagaacatgaacgccgaggagctgagcagcgacagcgacagcgagtacagcaaggtgagactgaacagaagcagcagcagcgagtgcagcaccgtggacaaccccctgcccggcgagggcgaggaggccgaggccgagcccatgaacagcgacgagcccgaggcctgcttcaccgacggctgcgtgtggagattcagctgctgccaggtgaacatcgagagcggcaagggcaagatctggtggaacatcagaaagacctgctacaagatcgtggagcacagctggttcgagagcttcatcgtgctgatgatcctgctgagcagcggcgccctggccttcgaggacatctacatcgagagaaagaagaccatcaagatcatcctggagtacgccgacaagatcttcacctacatcttcatcctggagatgctgctgaagtggatcgcctacggctacaagacctacttcaccaacgcctggtgctggctggacttcctgatcgtggacgtgagcctggtgaccctggtggccaacaccctgggctacagcgacctgggccccatcaagagcctgagaaccctgagagccctgagacccctgagagccctgagcagattcgagggcatgagagtggtggtgaacgccctgatcggcgccatccccagcatcatgaacgtgctgctggtgtgcctgatcttctggctgatcttcagcatcatgggcgtgaacctgttcgccggcaagttctacgagtgcatcaacaccaccgacggcagcagattccccgccagccaggtgcccaacagaagcgagtgcttcgccctgatgaacgtgagccagaacgtgagatggaagaacctgaaggtgaacttcgacaacgtgggcctgggctacctgagcctgctgcaggtggccaccttcaagggctggaccatcatcatgtacgccgccgtggacagcgtgaacgtggacaagcagcccaagtacgagtacagcctgtacatgtacatctacttcgtggtgttcatcatcttcggcagcttcttcaccctgaacctgttcatcggcgtgatcatcgacaacttcaaccagcagaagaagaagctgggcggccaggacatcttcatgaccgaggagcagaagaagtactacaacgccatgaagaagctgggcagcaagaagccccagaagcccatccccagacccggcaacaagatccagggctgcatcttcgacctggtgaccaaccaggccttcgacatcagcatcatggtgctgatctgcctgaacatggtgaccatgatggtggagaaggagggccagagccagcacatgaccgaggtgctgtactggatcaacgtggtgttcatcatcctgttcaccggcgagtgcgtgctgaagctgatcagcctgagacactactacttcaccgtgggctggaacatcttcgacttcgtggtggtgatcatcagcatcgtgggcatgttcctggccgacctgatcgagacctacttcgtgagccccaccctgttcagagtgatcagactggccagaatcggcagaatcctgagactggtgaagggcgccaagggcatcagaaccctgctgttcgccctgatgatgagcctgcccgccctgttcaacatcggcctgctgctgttcctggtgatgttcatctacgccatcttcggcatgagcaacttcgcctacgtgaagaaggaggacggcatcaacgacatgttcaacttcgagaccttcggcaacagcatgatctgcctgttccagatcaccaccagcgccggctgggacggcctgctggcccccatcctgaacagcaagccccccgactgcgaccccaagaaggtgcaccccggcagcagcgtggagggcgactgcggcaaccccagcgtgggcatcttctacttcgtgagctacatcatcatcagcttcctggtggtggtgaacatgtacatcgccgtgatcctggagaacttcagcgtggccaccgaggagagcaccgagcccctgagcgaggacgacttcgagatgttctacgaggtgtgggagaagttcgaccccgacgccacccagttcatcgagttcagcaagctgagcgacttcgccgccgccctggacccccccctgctgatcgccaagcccaacaaggtgcagctgatcgccatggacctgcccatggtgagcggcgacagaatccactgcctggacatcctgttcgccttcaccaagagagtgctgggcgagagcggcgagatggacagcctgagaagccagatggaggagagattcatgagcgccaaccccagcaaggtgagctacgagcccatcaccaccaccctgaagagaaagcaggaggacgtgagcgccaccgtgatccagagagcctacagaagatacagactgagacagaacgtgaagaacatcagcagcatctacatcaaggacggcgacagagacgacgacctgctgaacaagaaggacatggccttcgacaacgtgaacgagaacagcagccccgagaagaccgacgccaccagcagcaccaccagcccccccagctacgacagcgtgaccaagcccgacaaggagaagtacgagcaggacagaaccgagaaggaggacaagggcaaggacagcaaggagagcaagaagtag

SEQ ID NO: 99307 - DNA, 5970 bp, Artificial Sequence
  Description of Artificial Sequence: Synthetic coding sequence
atggccatgctgcccccccccggcccccagagcttcgtgcacttcaccaagcagagcctggccctgatcgagcagagaatcgccgagagaaagagcaaggagcccaaggaggagaagaaggacgacgacgaggaggcccccaagcccagcagcgacctggaggccggcaagcagctgcccttcatctacggcgacatcccccccggcatggtgagcgagcccctggaggacctggacccctactacgccgacaagaagaccttcatcgtgctgaacaagggcaagaccatcttcagattcaacgccacccccgccctgtacatgctgagccccttcagccccctgagaagaatcagcatcaagatcctggtgcacagcaccctgttcagcatgctgatcatgtgcaccatcctgaccaactgcatcttcatgaccatgaacaacccccccgactggaccaagaacgtggagtacaccttcaccggcatctacaccttcgagagcctggtgaagatcctggccagaggcttctgcgtgggcgagttcaccttcctgagagacccctggaactggctggacttcgtggtgatcgtgttcgcctacgtgaccgagttcgtggacctgggcaacgtgagcgccctgagaaccttcagagtgctgagagccctgaagaccatcagcgtgatccccggcctgaagaccatcgtgggcgccctgatccagagcgtgaagaagctgagcgacgtgatgatcctgaccgtgttctgcctgagcgtgttcgccctgatcggcctgcagctgttcatgggcaacctgaagcacaagtgcttcagaaacagcctggagaacaacgagaccctggagagcatcatgaacaccctggagagcgaggaggacttcagaaagtacttctactacctggagggcagcaaggacgccctgctgtgcggcttcagcaccgacagcggccagtgccccgagggctacacctgcgtgaagatcggcagaaaccccgactacggctacaccagcttcgacaccttcagctgggccttcctggccctgttcagactgatgacccaggactactgggagaacctgtaccagcagaccctgagagccgccggcaagacctacatgatcttcttcgtggtggtgatcttcctgggcagcttctacctgatcaacctgatcctggccgtggtggccatggcctacgaggagcagaaccaggccaacatcgaggaggccaagcagaaggagctggagttccagcagatgctggacagactgaagaaggagcaggaggaggccgaggccatcgccgccgccgccgccgagtacaccagcatcagaagaagcagaatcatgggcctgagcgagagcagcagcgagaccagcaagctgagcagcaagagcgccaaggagagaagaaacagaagaaagaagaagaaccagaagaagctgagcagcggcgaggagaagggcgacgccgagaagctgagcaagagcgagagcgaggacagcatcagaagaaagagcttccacctgggcgtggagggccacagaagagcccacgagaagagactgagcacccccaaccagagccccctgagcatcagaggcagcctgttcagcgccagaagaagcagcagaaccagcctgttcagcttcaagggcagaggcagagacatcggcagcgagaccgagttcgccgacgacgagcacagcatcttcggcgacaacgagagcagaagaggcagcctgttcgtgccccacagaccccaggagagaagaagcagcaacatcagccaggccagcagaagcccccccatgctgcccgtgaacggcaagatgcacagcgccgtggactgcaacggcgtggtgagcctggtggacggcagaagcgccctgatgctgcccaacggccagctgctgcccgaggtgatcatcgacaaggccaccagcgacgacagcggcaccaccaaccagatccacaagaagagaagatgcagcagctacctgctgagcgaggacatgctgaacgaccccaacctgagacagagagccatgagcagagccagcatcctgaccaacaccgtggaggagctggaggagagcagacagaagtgccccccctggtggtacagattcgcccacaagttcctgatctggaactgcagcccctactggatcaagttcaagaagtgcatctacttcatcgtgatggaccccttcgtggacctggccatcaccatctgcatcgtgctgaacaccctgttcatggccatggagcaccaccccatgaccgaggagttcaagaacgtgctggccatcggcaacctggtgttcaccggcatcttcgccgccgagatggtgctgaagctgatcgccatggacccctacgagtacttccaggtgggctggaacatcttcgacagcctgatcgtgaccctgagcctggtggagctgttcctggccgacgtggagggcctgagcgtgctgagaagcttcagactgctgagagtgttcaagctggccaagagctggcccaccctgaacatgctgatcaagatcatcggcaacagcgtgggcgccctgggcaacctgaccctggtgctggccatcatcgtgttcatcttcgccgtggtgggcatgcagctgttcggcaagagctacaaggagtgcgtgtgcaagatcaacgacgactgcaccctgcccagatggcacatgaacgacttcttccacagcttcctgatcgtgttcagagtgctgtgcggcgagtggatcgagaccatgtgggactgcatggaggtggccggccaggccatgtgcctgatcgtgtacatgatggtgatggtgatcggcaacctggtggtgctgaacctgttcctggccctgctgctgagcagcttcagcagcgacaacctgaccgccatcgaggaggaccccgacgccaacaacctgcagatcgccgtgaccagaatcaagaagggcatcaactacgtgaagcagaccctgagagagttcatcctgaaggccttcagcaagaagcccaagatcagcagagagatcagacaggccgaggacctgaacaccaagaaggagaactacatcagcaaccacaccctggccgagatgagcaagggccacaacttcctgaaggagaaggacaagatcagcggcttcggcagcagcgtggacaagcacctgatggaggacagcgacggccagagcttcatccacaaccccagcctgaccgtgaccgtgcccatcgcccccggcgagagcgacctggagaacatgaacgccgaggagctgagcagcgacagcgacagcgagtacagcaaggtgagactgaacagaagcagcagcagcgagtgcagcaccgtggacaaccccctgcccggcgagggcgaggaggccgaggccgagcccatgaacagcgacgagcccgaggcctgcttcaccgacggctgcgtgtggagattcagctgctgccaggtgaacatcgagagcggcaagggcaagatctggtggaacatcagaaagacctgctacaagatcgtggagcacagctggttcgagagcttcatcgtgctgatgatcctgctgagcagcggcgccctggccttcgaggacatctacatcgagagaaagaagaccatcaagatcatcctggagtacgccgacaagatcttcacctacatcttcatcctggagatgctgctgaagtggatcgcctacggctacaagacctacttcaccaacgcctggtgctggctggacttcctgatcgtggacgtgagcctggtgaccctggtggccaacaccctgggctacagcgacctgggccccatcaagagcctgagaaccctgagagccctgagacccctgagagccctgagcagattcgagggcatgagagtggtggtgaacgccctgatcggcgccatccccagcatcatgaacgtgctgctggtgtgcctgatcttctggctgatcttcagcatcatgggcgtgaacctgttcgccggcaagttctacgagtgcatcaacaccaccgacggcagcagattccccgccagccaggtgcccaacagaagcgagtgcttcgccctgatgaacgtgagccagaacgtgagatggaagaacctgaaggtgaacttcgacaacgtgggcctgggctacctgagcctgctgcaggtggccaccttcaagggctggaccatcatcatgtacgccgccgtggacagcgtgaacgtggacaagcagcccaagtacgagtacagcctgtacatgtacatctacttcgtggtgttcatcatcttcggcagcttcttcaccctgaacctgttcatcggcgtgatcatcgacaacttcaaccagcagaagaagaagctgggcggccaggacatcttcatgaccgaggagcagaagaagtactacaacgccatgaagaagctgggcagcaagaagccccagaagcccatccccagacccggcaacaagatccagggctgcatcttcgacctggtgaccaaccaggccttcgacatcagcatcatggtgctgatctgcctgaacatggtgaccatgatggtggagaaggagggccagagccagcacatgaccgaggtgctgtactggatcaacgtggtgttcatcatcctgttcaccggcgagtgcgtgctgaagctgatcagcctgagacactactacttcaccgtgggctggaacatcttcgacttcgtggtggtgatcatcagcatcgtgggcatgttcctggccgacctgatcgagacctacttcgtgagccccaccctgttcagagtgatcagactggccagaatcggcagaatcctgagactggtgaagggcgccaagggcatcagaaccctgctgttcgccctgatgatgagcctgcccgccctgttcaacatcggcctgctgctgttcctggtgatgttcatctacgccatcttcggcatgagcaacttcgcctacgtgaagaaggaggacggcatcaacgacatgttcaacttcgagaccttcggcaacagcatgatctgcctgttccagatcaccaccagcgccggctgggacggcctgctggcccccatcctgaacagcaagccccccgactgcgaccccaagaaggtgcaccccggcagcagcgtggagggcgactgcggcaaccccagcgtgggcatcttctacttcgtgagctacatcatcatcagcttcctggtggtggtgaacatgtacatcgccgtgatcctggagaacttcagcgtggccaccgaggagagcaccgagcccctgagcgaggacgacttcgagatgttctacgaggtgtgggagaagttcgaccccgacgccacccagttcatcgagttcagcaagctgagcgacttcgccgccgccctggacccccccctgctgatcgccaagcccaacaaggtgcagctgatcgccatggacctgcccatggtgagcggcgacagaatccactgcctggacatcctgttcgccttcaccaagagagtgctgggcgagagcggcgagatggacagcctgagaagccagatggaggagagattcatgagcgccaaccccagcaaggtgagctacgagcccatcaccaccaccctgaagagaaagcaggaggacgtgagcgccaccgtgatccagagagcctacagaagatacagactgagacagaacgtgaagaacatcagcagcatctacatcaaggacggcgacagagacgacgacctgctgaacaagaaggacatggccttcgacaacgtgaacgagaacagcagccccgagaagaccgacgccaccagcagcaccaccagcccccccagctacgacagcgtgaccaagcccgacaaggagaagtacgagcaggacagaaccgagaaggaggacaagggcaaggacagcaaggagagcaagaagtag

SEQ ID NO: 99308 - DNA, 5967 bp, Artificial Sequence
  Description of Artificial Sequence: Synthetic coding sequence
atggccatgctgcccccccccggcccccagagcttcgtgcacttcaccaagcagagcctggccctgatcgagcagagaatcgccgagagaaagagcaaggagcccaaggaggagaagaaggacgacgacgaggaggcccccaagcccagcagcgacctggaggccggcaagcagctgcccttcatctacggcgacatcccccccggcatggtgagcgagcccctggaggacctggacccctactacgccgacaagaagaccttcatcgtgctgaacaagggcaagaccatcttcagattcaacgccacccccgccctgtacatgctgagccccttcagccccctgagaagaatcagcatcaagatcctggtgcacagcctgttcagcatgctgatcatgtgcaccatcctgaccaactgcatcttcatgaccatgaacaacccccccgactggaccaagaacgtggagtacaccttcaccggcatctacaccttcgagagcctggtgaagatcctggccagaggcttctgcgtgggcgagttcaccttcctgagagacccctggaactggctggacttcgtggtgatcgtgttcgcctacctgaccgagttcgtgaacctgggcaacgtgagcgccctgagaaccttcagagtgctgagagccctgaagaccatcagcgtgatccccggcctgaagaccatcgtgggcgccctgatccagagcgtgaagaagctgagcgacgtgatgatcctgaccgtgttctgcctgagcgtgttcgccctgatcggcctgcagctgttcatgggcaacctgaagcacaagtgcttcagaaacagcctggagaacaacgagaccctggagagcatcatgaacaccctggagagcgaggaggacttcagaaagtacttctactacctggagggcagcaaggacgccctgctgtgcggcttcagcaccgacagcggccagtgccccgagggctacacctgcgtgaagatcggcagaaaccccgactacggctacaccagcttcgacaccttcagctgggccttcctggccctgttcagactgatgacccaggactactgggagaacctgtaccagcagaccctgagagccgccggcaagacctacatgatcttcttcgtggtggtgatcttcctgggcagcttctacctgatcaacctgatcctggccgtggtggccatggcctacgaggagcagaaccaggccaacatcgaggaggccaagcagaaggagctggagttccagcagatgctggacagactgaagaaggagcaggaggaggccgaggccatcgccgccgccgccgccgagtacaccagcatcagaagaagcagaatcatgggcctgagcgagagcagcagcgagaccagcaagctgagcagcaagagcgccaaggagagaagaaacagaagaaagaagaagaaccagaagaagctgagcagcggcgaggagaagggcgacgccgagaagctgagcaagagcgagagcgaggacagcatcagaagaaagagcttccacctgggcgtggagggccacagaagagcccacgagaagagactgagcacccccaaccagagccccctgagcatcagaggcagcctgttcagcgccagaagaagcagcagaaccagcctgttcagcttcaagggcagaggcagagacatcggcagcgagaccgagttcgccgacgacgagcacagcatcttcggcgacaacgagagcagaagaggcagcctgttcgtgccccacagaccccaggagagaagaagcagcaacatcagccaggccagcagaagcccccccatgctgcccgtgaacggcaagatgcacagcgccgtggactgcaacggcgtggtgagcctggtggacggcagaagcgccctgatgctgcccaacggccagctgctgcccgaggtgatcatcgacaaggccaccagcgacgacagcggcaccaccaaccagatccacaagaagagaagatgcagcagctacctgctgagcgaggacatgctgaacgaccccaacctgagacagagagccatgagcagagccagcatcctgaccaacaccgtggaggagctggaggagagcagacagaagtgccccccctggtggtacagattcgcccacaagttcctgatctggaactgcagcccctactggatcaagttcaagaagtgcatctacttcatcgtgatggaccccttcgtggacctggccatcaccatctgcatcgtgctgaacaccctgttcatggccatggagcaccaccccatgaccgaggagttcaagaacgtgctggccatcggcaacctggtgttcaccggcatcttcgccgccgagatggtgctgaagctgatcgccatggacccctacgagtacttccaggtgggctggaacatcttcgacagcctgatcgtgaccctgagcctggtggagctgttcctggccgacgtggagggcctgagcgtgctgagaagcttcagactgctgagagtgttcaagctggccaagagctggcccaccctgaacatgctgatcaagatcatcggcaacagcgtgggcgccctgggcaacctgaccctggtgctggccatcatcgtgttcatcttcgccgtggtgggcatgcagctgttcggcaagagctacaaggagtgcgtgtgcaagatcaacgacgactgcaccctgcccagatggcacatgaacgacttcttccacagcttcctgatcgtgttcagagtgctgtgcggcgagtggatcgagaccatgtgggactgcatggaggtggccggccaggccatgtgcctgatcgtgtacatgatggtgatggtgatcggcaacctggtggtgctgaacctgttcctggccctgctgctgagcagcttcagcagcgacaacctgaccgccatcgaggaggaccccgacgccaacaacctgcagatcgccgtgaccagaatcaagaagggcatcaactacgtgaagcagaccctgagagagttcatcctgaaggccttcagcaagaagcccaagatcagcagagagatcagacaggccgaggacctgaacaccaagaaggagaactacatcagcaaccacaccctggccgagatgagcaagggccacaacttcctgaaggagaaggacaagatcagcggcttcggcagcagcgtggacaagcacctgatggaggacagcgacggccagagcttcatccacaaccccagcctgaccgtgaccgtgcccatcgcccccggcgagagcgacctggagaacatgaacgccgaggagctgagcagcgacagcgacagcgagtacagcaaggtgagactgaacagaagcagcagcagcgagtgcagcaccgtggacaaccccctgcccggcgagggcgaggaggccgaggccgagcccatgaacagcgacgagcccgaggcctgcttcaccgacggctgcgtgtggagattcagctgctgccaggtgaacatcgagagcggcaagggcaagatctggtggaacatcagaaagacctgctacaagatcgtggagcacagctggttcgagagcttcatcgtgctgatgatcctgctgagcagcggcgccctggccttcgaggacatctacatcgagagaaagaagaccatcaagatcatcctggagtacgccgacaagatcttcacctacatcttcatcctggagatgctgctgaagtggatcgcctacggctacaagacctacttcaccaacgcctggtgctggctggacttcctgatcgtggacgtgagcctggtgaccctggtggccaacaccctgggctacagcgacctgggccccatcaagagcctgagaaccctgagagccctgagacccctgagagccctgagcagattcgagggcatgagagtggtggtgaacgccctgatcggcgccatccccagcatcatgaacgtgctgctggtgtgcctgatcttctggctgatcttcagcatcatgggcgtgaacctgttcgccggcaagttctacgagtgcatcaacaccaccgacggcagcagattccccgccagccaggtgcccaacagaagcgagtgcttcgccctgatgaacgtgagccagaacgtgagatggaagaacctgaaggtgaacttcgacaacgtgggcctgggctacctgagcctgctgcaggtggccaccttcaagggctggaccatcatcatgtacgccgccgtggacagcgtgaacgtggacaagcagcccaagtacgagtacagcctgtacatgtacatctacttcgtggtgttcatcatcttcggcagcttcttcaccctgaacctgttcatcggcgtgatcatcgacaacttcaaccagcagaagaagaagctgggcggccaggacatcttcatgaccgaggagcagaagaagtactacaacgccatgaagaagctgggcagcaagaagccccagaagcccatccccagacccggcaacaagatccagggctgcatcttcgacctggtgaccaaccaggccttcgacatcagcatcatggtgctgatctgcctgaacatggtgaccatgatggtggagaaggagggccagagccagcacatgaccgaggtgctgtactggatcaacgtggtgttcatcatcctgttcaccggcgagtgcgtgctgaagctgatcagcctgagacactactacttcaccgtgggctggaacatcttcgacttcgtggtggtgatcatcagcatcgtgggcatgttcctggccgacctgatcgagacctacttcgtgagccccaccctgttcagagtgatcagactggccagaatcggcagaatcctgagactggtgaagggcgccaagggcatcagaaccctgctgttcgccctgatgatgagcctgcccgccctgttcaacatcggcctgctgctgttcctggtgatgttcatctacgccatcttcggcatgagcaacttcgcctacgtgaagaaggaggacggcatcaacgacatgttcaacttcgagaccttcggcaacagcatgatctgcctgttccagatcaccaccagcgccggctgggacggcctgctggcccccatcctgaacagcaagccccccgactgcgaccccaagaaggtgcaccccggcagcagcgtggagggcgactgcggcaaccccagcgtgggcatcttctacttcgtgagctacatcatcatcagcttcctggtggtggtgaacatgtacatcgccgtgatcctggagaacttcagcgtggccaccgaggagagcaccgagcccctgagcgaggacgacttcgagatgttctacgaggtgtgggagaagttcgaccccgacgccacccagttcatcgagttcagcaagctgagcgacttcgccgccgccctggacccccccctgctgatcgccaagcccaacaaggtgcagctgatcgccatggacctgcccatggtgagcggcgacagaatccactgcctggacatcctgttcgccttcaccaagagagtgctgggcgagagcggcgagatggacagcctgagaagccagatggaggagagattcatgagcgccaaccccagcaaggtgagctacgagcccatcaccaccaccctgaagagaaagcaggaggacgtgagcgccaccgtgatccagagagcctacagaagatacagactgagacagaacgtgaagaacatcagcagcatctacatcaaggacggcgacagagacgacgacctgctgaacaagaaggacatggccttcgacaacgtgaacgagaacagcagccccgagaagaccgacgccaccagcagcaccaccagcccccccagctacgacagcgtgaccaagcccgacaaggagaagtacgagcaggacagaaccgagaaggaggacaagggcaaggacagcaaggagagcaagaagtag

SEQ ID NO: 99309 - DNA, 5934 bp, Artificial Sequence
  Description of Artificial Sequence: Synthetic coding sequence
atggccatgctgcccccccccggcccccagagcttcgtgcacttcaccaagcagagcctggccctgatcgagcagagaatcgccgagagaaagagcaaggagcccaaggaggagaagaaggacgacgacgaggaggcccccaagcccagcagcgacctggaggccggcaagcagctgcccttcatctacggcgacatcccccccggcatggtgagcgagcccctggaggacctggacccctactacgccgacaagaagaccttcatcgtgctgaacaagggcaagaccatcttcagattcaacgccacccccgccctgtacatgctgagccccttcagccccctgagaagaatcagcatcaagatcctggtgcacagcctgttcagcatgctgatcatgtgcaccatcctgaccaactgcatcttcatgaccatgaacaacccccccgactggaccaagaacgtggagtacaccttcaccggcatctacaccttcgagagcctggtgaagatcctggccagaggcttctgcgtgggcgagttcaccttcctgagagacccctggaactggctggacttcgtggtgatcgtgttcgcctacctgaccgagttcgtgaacctgggcaacgtgagcgccctgagaaccttcagagtgctgagagccctgaagaccatcagcgtgatccccggcctgaagaccatcgtgggcgccctgatccagagcgtgaagaagctgagcgacgtgatgatcctgaccgtgttctgcctgagcgtgttcgccctgatcggcctgcagctgttcatgggcaacctgaagcacaagtgcttcagaaacagcctggagaacaacgagaccctggagagcatcatgaacaccctggagagcgaggaggacttcagaaagtacttctactacctggagggcagcaaggacgccctgctgtgcggcttcagcaccgacagcggccagtgccccgagggctacacctgcgtgaagatcggcagaaaccccgactacggctacaccagcttcgacaccttcagctgggccttcctggccctgttcagactgatgacccaggactactgggagaacctgtaccagcagaccctgagagccgccggcaagacctacatgatcttcttcgtggtggtgatcttcctgggcagcttctacctgatcaacctgatcctggccgtggtggccatggcctacgaggagcagaaccaggccaacatcgaggaggccaagcagaaggagctggagttccagcagatgctggacagactgaagaaggagcaggaggaggccgaggccatcgccgccgccgccgccgagtacaccagcatcagaagaagcagaatcatgggcctgagcgagagcagcagcgagaccagcaagctgagcagcaagagcgccaaggagagaagaaacagaagaaagaagaagaaccagaagaagctgagcagcggcgaggagaagggcgacgccgagaagctgagcaagagcgagagcgaggacagcatcagaagaaagagcttccacctgggcgtggagggccacagaagagcccacgagaagagactgagcacccccaaccagagccccctgagcatcagaggcagcctgttcagcgccagaagaagcagcagaaccagcctgttcagcttcaagggcagaggcagagacatcggcagcgagaccgagttcgccgacgacgagcacagcatcttcggcgacaacgagagcagaagaggcagcctgttcgtgccccacagaccccaggagagaagaagcagcaacatcagccaggccagcagaagcccccccatgctgcccgtgaacggcaagatgcacagcgccgtggactgcaacggcgtggtgagcctggtggacggcagaagcgccctgatgctgcccaacggccagctgctgcccgagggcaccaccaaccagatccacaagaagagaagatgcagcagctacctgctgagcgaggacatgctgaacgaccccaacctgagacagagagccatgagcagagccagcatcctgaccaacaccgtggaggagctggaggagagcagacagaagtgccccccctggtggtacagattcgcccacaagttcctgatctggaactgcagcccctactggatcaagttcaagaagtgcatctacttcatcgtgatggaccccttcgtggacctggccatcaccatctgcatcgtgctgaacaccctgttcatggccatggagcaccaccccatgaccgaggagttcaagaacgtgctggccatcggcaacctggtgttcaccggcatcttcgccgccgagatggtgctgaagctgatcgccatggacccctacgagtacttccaggtgggctggaacatcttcgacagcctgatcgtgaccctgagcctggtggagctgttcctggccgacgtggagggcctgagcgtgctgagaagcttcagactgctgagagtgttcaagctggccaagagctggcccaccctgaacatgctgatcaagatcatcggcaacagcgtgggcgccctgggcaacctgaccctggtgctggccatcatcgtgttcatcttcgccgtggtgggcatgcagctgttcggcaagagctacaaggagtgcgtgtgcaagatcaacgacgactgcaccctgcccagatggcacatgaacgacttcttccacagcttcctgatcgtgttcagagtgctgtgcggcgagtggatcgagaccatgtgggactgcatggaggtggccggccaggccatgtgcctgatcgtgtacatgatggtgatggtgatcggcaacctggtggtgctgaacctgttcctggccctgctgctgagcagcttcagcagcgacaacctgaccgccatcgaggaggaccccgacgccaacaacctgcagatcgccgtgaccagaatcaagaagggcatcaactacgtgaagcagaccctgagagagttcatcctgaaggccttcagcaagaagcccaagatcagcagagagatcagacaggccgaggacctgaacaccaagaaggagaactacatcagcaaccacaccctggccgagatgagcaagggccacaacttcctgaaggagaaggacaagatcagcggcttcggcagcagcgtggacaagcacctgatggaggacagcgacggccagagcttcatccacaaccccagcctgaccgtgaccgtgcccatcgcccccggcgagagcgacctggagaacatgaacgccgaggagctgagcagcgacagcgacagcgagtacagcaaggtgagactgaacagaagcagcagcagcgagtgcagcaccgtggacaaccccctgcccggcgagggcgaggaggccgaggccgagcccatgaacagcgacgagcccgaggcctgcttcaccgacggctgcgtgtggagattcagctgctgccaggtgaacatcgagagcggcaagggcaagatctggtggaacatcagaaagacctgctacaagatcgtggagcacagctggttcgagagcttcatcgtgctgatgatcctgctgagcagcggcgccctggccttcgaggacatctacatcgagagaaagaagaccatcaagatcatcctggagtacgccgacaagatcttcacctacatcttcatcctggagatgctgctgaagtggatcgcctacggctacaagacctacttcaccaacgcctggtgctggctggacttcctgatcgtggacgtgagcctggtgaccctggtggccaacaccctgggctacagcgacctgggccccatcaagagcctgagaaccctgagagccctgagacccctgagagccctgagcagattcgagggcatgagagtggtggtgaacgccctgatcggcgccatccccagcatcatgaacgtgctgctggtgtgcctgatcttctggctgatcttcagcatcatgggcgtgaacctgttcgccggcaagttctacgagtgcatcaacaccaccgacggcagcagattccccgccagccaggtgcccaacagaagcgagtgcttcgccctgatgaacgtgagccagaacgtgagatggaagaacctgaaggtgaacttcgacaacgtgggcctgggctacctgagcctgctgcaggtggccaccttcaagggctggaccatcatcatgtacgccgccgtggacagcgtgaacgtggacaagcagcccaagtacgagtacagcctgtacatgtacatctacttcgtggtgttcatcatcttcggcagcttcttcaccctgaacctgttcatcggcgtgatcatcgacaacttcaaccagcagaagaagaagctgggcggccaggacatcttcatgaccgaggagcagaagaagtactacaacgccatgaagaagctgggcagcaagaagccccagaagcccatccccagacccggcaacaagatccagggctgcatcttcgacctggtgaccaaccaggccttcgacatcagcatcatggtgctgatctgcctgaacatggtgaccatgatggtggagaaggagggccagagccagcacatgaccgaggtgctgtactggatcaacgtggtgttcatcatcctgttcaccggcgagtgcgtgctgaagctgatcagcctgagacactactacttcaccgtgggctggaacatcttcgacttcgtggtggtgatcatcagcatcgtgggcatgttcctggccgacctgatcgagacctacttcgtgagccccaccctgttcagagtgatcagactggccagaatcggcagaatcctgagactggtgaagggcgccaagggcatcagaaccctgctgttcgccctgatgatgagcctgcccgccctgttcaacatcggcctgctgctgttcctggtgatgttcatctacgccatcttcggcatgagcaacttcgcctacgtgaagaaggaggacggcatcaacgacatgttcaacttcgagaccttcggcaacagcatgatctgcctgttccagatcaccaccagcgccggctgggacggcctgctggcccccatcctgaacagcaagccccccgactgcgaccccaagaaggtgcaccccggcagcagcgtggagggcgactgcggcaaccccagcgtgggcatcttctacttcgtgagctacatcatcatcagcttcctggtggtggtgaacatgtacatcgccgtgatcctggagaacttcagcgtggccaccgaggagagcaccgagcccctgagcgaggacgacttcgagatgttctacgaggtgtgggagaagttcgaccccgacgccacccagttcatcgagttcagcaagctgagcgacttcgccgccgccctggacccccccctgctgatcgccaagcccaacaaggtgcagctgatcgccatggacctgcccatggtgagcggcgacagaatccactgcctggacatcctgttcgccttcaccaagagagtgctgggcgagagcggcgagatggacagcctgagaagccagatggaggagagattcatgagcgccaaccccagcaaggtgagctacgagcccatcaccaccaccctgaagagaaagcaggaggacgtgagcgccaccgtgatccagagagcctacagaagatacagactgagacagaacgtgaagaacatcagcagcatctacatcaaggacggcgacagagacgacgacctgctgaacaagaaggacatggccttcgacaacgtgaacgagaacagcagccccgagaagaccgacgccaccagcagcaccaccagcccccccagctacgacagcgtgaccaagcccgacaaggagaagtacgagcaggacagaaccgagaaggaggacaagggcaaggacagcaaggagagcaagaagtag

SEQ ID NO: 99310 - DNA, 1620 bp, Artificial Sequence
  Description of Artificial Sequence: Synthetic coding sequence
atcctgaccaactgcatcttcatgaccatgaacaacccccccgactggaccaagaacgtggagtacaccttcaccggcatctacaccttcgagagcctggtgaagatcctggccagaggcttctgcgtgggcgagttcaccttcctgagagacccctggaactggctggacttcgtggtgatcgtgttcgcctacgtgaccgagttcgtggacctgggcaacgtgagcgccctgagaaccttcagagtgctgagagccctgaagaccatcagcgtgatccccggcctgaagaccatcgtgggcgccctgatccagagcgtgaagaagctgagcgacgtgatgatcctgaccgtgttctgcctgagcgtgttcgccctgatcggcctgcagctgttcatgggcaacctgaagcacaagtgcttcagaaacagcctggagaacaacgagaccctggagagcatcatgaacaccctggagagcgaggaggacttcagaaagtacttctactacctggagggcagcaaggacgccctgctgtgcggcttcagcaccgacagcggccagtgccccgagggctacacctgcgtgaagatcggcagaaaccccgactacggctacaccagcttcgacaccttcagctgggccttcctggccctgttcagactgatgacccaggactactgggagaacctgtaccagcagaccctgagagccgccggcaagacctacatgatcttcttcgtggtggtgatcttcctgggcagcttctacctgatcaacctgatcctggccgtggtggccatggcctacgaggagcagaaccaggccaacatcgaggaggccaagcagaaggagctggagttccagcagatgctggacagactgaagaaggagcaggaggaggccgaggccatcgccgccgccgccgccgagtacaccagcatcagaagaagcagaatcatgggcctgagcgagagcagcagcgagaccagcaagctgagcagcaagagcgccaaggagagaagaaacagaagaaagaagaagaaccagaagaagctgagcagcggcgaggagaagggcgacgccgagaagctgagcaagagcgagagcgaggacagcatcagaagaaagagcttccacctgggcgtggagggccacagaagagcccacgagaagagactgagcacccccaaccagagccccctgagcatcagaggcagcctgttcagcgccagaagaagcagcagaaccagcctgttcagcttcaagggcagaggcagagacatcggcagcgagaccgagttcgccgacgacgagcacagcatcttcggcgacaacgagagcagaagaggcagcctgttcgtgccccacagaccccaggagagaagaagcagcaacatcagccaggccagcagaagcccccccatgctgcccgtgaacggcaagatgcacagcgccgtggactgcaacggcgtggtgagcctggtggacggcagaagcgccctgatgctgcccaacggccagctgctgcccgaggtgatcatcgacaaggccaccagcgacgacagcggcaccaccaaccagatccacaagaagagaagatgcagcagctacctgtag

SEQ ID NO: 99311 - DNA, 198 bp, Artificial Sequence
  Description of Artificial Sequence: Synthetic coding sequence
atggccaacttcctgctgcccagaggcaccagcagcttcagaagattcaccagagagagcctggccgccatcgagaagagaatggccgagaagcaggccagaggcagcaccaccctgcaggagagcagagagggcctgcccgaggaggaggcccccagaccccagctggacctgcaggccagcaagaagctgccctag

SEQ ID NO: 99312 - DNA, 6051 bp, Artificial Sequence
  Description of Artificial Sequence: Synthetic coding sequence
atggccaacttcctgctgcccagaggcaccagcagcttcagaagattcaccagagagagcctggccgccatcgagaagagaatggccgagaagcaggccagaggcagcaccaccctgcaggagagcagagagggcctgcccgaggaggaggcccccagaccccagctggacctgcaggccagcaagaagctgcccgacctgtacggcaaccccccccaggagctgatcggcgagcccctggaggacctggaccccttctacagcacccagaagaccttcatcgtgctgaacaagggcaagaccatcttcagattcagcgccaccaacgccctgtacgtgctgagccccttccaccccatcagaagagccgccgtgaagatcctggtgcacagcctgttcaacatgctgatcatgtgcaccatcctgaccaactgcgtgttcatggcccagcacgacccccccccctggaccaagtacgtggagtacaccttcaccgccatctacaccttcgagagcctggtgaagatcctggccagaggcttctgcctgcacgccttcaccttcctgagagacccctggaactggctggacttcagcgtgatcatcatggcctacaccaccgagttcgtggacctgggcaacgtgagcgccctgagaaccttcagagtgctgagagccctgaagaccatcagcgtgatcagcggcctgaagaccatcgtgggcgccctgatccagagcgtgaagaagctggccgacgtgatggtgctgaccgtgttctgcctgagcgtgttcgccctgatcggcctgcagctgttcatgggcaacctgagacacaagtgcgtgagaaacttcaccgccctgaacggcaccaacggcagcgtggaggccgacggcctggtgtgggagagcctggacctgtacctgagcgaccccgagaactacctgctgaagaacggcaccagcgacgtgctgctgtgcggcaacagcagcgacgccggcacctgccccgagggctacagatgcctgaaggccggcgagaaccccgaccacggctacaccagcttcgacagcttcgcctgggccttcctggccctgttcagactgatgacccaggactgctgggagagactgtaccagcagaccctgagaagcgccggcaagatctacatgatcttcttcatgctggtgatcttcctgggcagcttctacctggtgaacctgatcctggccgtggtggccatggcctacgaggagcagaaccaggccaccatcgccgagaccgaggagaaggagaagagattccaggaggccatggagatgctgaagaaggagcacgaggccctgaccatcagaggcgtggacaccgtgagcagaagcagcctggagatgagccccctggcccccgtgaacagccacgagagaagaagcaagagaagaaagagaatgagcagcggcaccgaggagtgcggcgaggacagactgcccaagagcgacagcgaggacggccccagagccatgaaccacctgagcctgaccagaggcctgagcagaaccagcatgaagcccagaagcagcagaggcagcatcttcaccttcagaagaagagacctgggcagcgaggccgacttcgccgacgacgagaacagcaccgccggcgagagcgagagccaccacaccagcctgctggtgccctggcccctgagaagaaccagcgcccagggccagcccagccccggcaccagcgcccccggccacgccctgcacggcaagaagaacagcaccgtggactgcaacggcgtggtgagcctgctgggcgccggcgaccccgaggccaccagccccggcagccacctgctgagacccgtgatgctggagcacccccccgacaccaccacccccagcgaggagcccggcggcccccagatgctgaccagccaggccccctgcgtggacggcttcgaggagcccggcgccagacagagagccctgagcgccgtgagcgtgctgaccagcgccctggaggagctggaggagagcagacacaagtgccccccctgctggaacagactggcccagagatacctgatctgggagtgctgccccctgtggatgagcatcaagcagggcgtgaagctggtggtgatggaccccttcaccgacctgaccatcaccatgtgcatcgtgctgaacaccctgttcatggccctggagcactacaacatgaccagcgagttcgaggagatgctgcaggtgggcaacctggtgttcaccggcatcttcaccgccgagatgaccttcaagatcatcgccctggacccctactactacttccagcagggctggaacatcttcgacagcatcatcgtgatcctgagcctgatggagctgggcctgagcagaatgagcaacctgagcgtgctgagaagcttcagactgctgagagtgttcaagctggccaagagctggcccaccctgaacaccctgatcaagatcatcggcaacagcgtgggcgccctgggcaacctgaccctggtgctggccatcatcgtgttcatcttcgccgtggtgggcatgcagctgttcggcaagaactacagcgagctgagagacagcgacagcggcctgctgcccagatggcacatgatggacttcttccacgccttcctgatcatcttcagaatcctgtgcggcgagtggatcgagaccatgtgggactgcatggaggtgagcggccagagcctgtgcctgctggtgttcctgctggtgatggtgatcggcaacctggtggtgctgaacctgttcctggccctgctgctgagcagcttcagcgccgacaacctgaccgcccccgacgaggacagagagatgaacaacctgcagctggccctggccagaatccagagaggcctgagattcgtgaagagaaccacctgggacttctgctgcggcctgctgagacagagaccccagaagcccgccgccctggccgcccagggccagctgcccagctgcatcgccaccccctacagcccccccccccccgagaccgagaaggtgccccccaccagaaaggagaccagattcgaggagggcgagcagcccggccagggcacccccggcgaccccgagcccgtgtgcgtgcccatcgccgtggccgagagcgacaccgacgaccaggaggaggacgaggagaacagcctgggcaccgaggaggagagcagcaagcagcaggagagccagcccgtgagcggcggccccgaggccccccccgacagcagaacctggagccaggtgagcgccaccgccagcagcgaggccgaggccagcgccagccaggccgactggagacagcagtggaaggccgagccccaggcccccggctgcggcgagacccccgaggacagctgcagcgagggcagcaccgccgacatgaccaacaccgccgagctgctggagcagatccccgacctgggccaggacgtgaaggaccccgaggactgcttcaccgagggctgcgtgagaagatgcccctgctgcgccgtggacaccacccaggcccccggcaaggtgtggtggagactgagaaagacctgctaccacatcgtggagcacagctggttcgagaccttcatcatcttcatgatcctgctgagcagcggcgccctggccttcgaggacatctacctggaggagagaaagaccatcaaggtgctgctggagtacgccgacaagatgttcacctacgtgttcgtgctggagatgctgctgaagtgggtggcctacggcttcaagaagtacttcaccaacgcctggtgctggctggacttcctgatcgtggacgtgagcctggtgagcctggtggccaacaccctgggcttcgccgagatgggccccatcaagagcctgagaaccctgagagccctgagacccctgagagccctgagcagattcgagggcatgagagtggtggtgaacgccctggtgggcgccatccccagcatcatgaacgtgctgctggtgtgcctgatcttctggctgatcttcagcatcatgggcgtgaacctgttcgccggcaagttcggcagatgcatcaaccagaccgagggcgacctgcccctgaactacaccatcgtgaacaacaagagccagtgcgagagcctgaacctgaccggcgagctgtactggaccaaggtgaaggtgaacttcgacaacgtgggcgccggctacctggccctgctgcaggtggccaccttcaagggctggatggacatcatgtacgccgccgtggacagcagaggctacgaggagcagccccagtgggagtacaacctgtacatgtacatctacttcgtgatcttcatcatcttcggcagcttcttcaccctgaacctgttcatcggcgtgatcatcgacaacttcaaccagcagaagaagaagctgggcggccaggacatcttcatgaccgaggagcagaagaagtactacaacgccatgaagaagctgggcagcaagaagccccagaagcccatccccagacccctgaacaagtaccagggcttcatcttcgacatcgtgaccaagcaggccttcgacgtgaccatcatgttcctgatctgcctgaacatggtgaccatgatggtggagaccgacgaccagagccccgagaagatcaacatcctggccaagatcaacctgctgttcgtggccatcttcaccggcgagtgcatcgtgaagctggccgccctgagacactactacttcaccaacagctggaacatcttcgacttcgtggtggtgatcctgagcatcgtgggcaccgtgctgagcgacatcatccagaagtacttcttcagccccaccctgttcagagtgatcagactggccagaatcggcagaatcctgagactgatcagaggcgccaagggcatcagaaccctgctgttcgccctgatgatgagcctgcccgccctgttcaacatcggcctgctgctgttcctggtgatgttcatctacagcatcttcggcatggccaacttcgcctacgtgaagtgggaggccggcatcgacgacatgttcaacttccagaccttcgccaacagcatgctgtgcctgttccagatcaccaccagcgccggctgggacggcctgctgagccccatcctgaacaccggccccccctactgcgaccccaccctgcccaacagcaacggcagcagaggcgactgcggcagccccgccgtgggcatcctgttcttcaccacctacatcatcatcagcttcctgatcgtggtgaacatgtacatcgccatcatcctggagaacttcagcgtggccaccgaggagagcaccgagcccctgagcgaggacgacttcgacatgttctacgagatctgggagaagttcgaccccgaggccacccagttcatcgagtacagcgtgctgagcgacttcgccgacgccctgagcgagcccctgagaatcgccaagcccaaccagatcagcctgatcaacatggacctgcccatggtgagcggcgacagaatccactgcatggacatcctgttcgccttcaccaagagagtgctgggcgagagcggcgagatggacgccctgaagatccagatggaggagaagttcatggccgccaaccccagcaagatcagctacgagcccatcaccaccaccctgagaagaaagcacgaggaggtgagcgccatggtgatccagagagccttcagaagacacctgctgcagagaagcctgaagcacgccagcttcctgttcagacagcaggccggcagcggcctgagcgaggaggacgcccccgagagagagggcctgatcgcctacgtgatgagcgagaacttcagcagacccctgggcccccccagcagcagcagcatcagcagcaccagcttcccccccagctacgacagcgtgaccagagccaccagcgacaacctgcaggtgagaggcagcgactacagccacagcgaggacctggccgacttcccccccagccccgacagagacagagagagcatcgtgtag

SEQ ID NO: 99313 - DNA, 342 bp, Artificial Sequence
  Description of Artificial Sequence: Synthetic coding sequence
atggcccagcacgacccccccccctggaccaagtacgtggagtacgtgagcgagaacatcaagctgggcaacctgagcgccctgagaaccttcagagtgctgagagccctgaagaccatcagcgtgatccccggcctgaagaccatcgtgggcgccctgatccagagcgtgaagaagctggccgacgtgatggtgctgaccgtgttctgcctgagcgtgttcgccctgatcggcctgcagctgttcatgggcaacctgagacacaagtgcgtgagaaacttcaccgccctgaacggcaccaacggcagcgtggaggccgacggcctggtgtgggagagctag

SEQ ID NO: 99314 - DNA, 6051 bp, Artificial Sequence
  Description of Artificial Sequence: Synthetic coding sequence
atggccaacttcctgctgcccagaggcaccagcagcttcagaagattcaccagagagagcctggccgccatcgagaagagaatggccgagaagcaggccagaggcagcaccaccctgcaggagagcagagagggcctgcccgaggaggaggcccccagaccccagctggacctgcaggccagcaagaagctgcccgacctgtacggcaaccccccccaggagctgatcggcgagcccctggaggacctggaccccttctacagcacccagaagaccttcatcgtgctgaacaagggcaagaccatcttcagattcagcgccaccaacgccctgtacgtgctgagccccttccaccccatcagaagagccgccgtgaagatcctggtgcacagcctgttcaacatgctgatcatgtgcaccatcctgaccaactgcgtgttcatggcccagcacgacccccccccctggaccaagtacgtggagtacaccttcaccgccatctacaccttcgagagcctggtgaagatcctggccagaggcttctgcctgcacgccttcaccttcctgagagacccctggaactggctggacttcagcgtgatcatcatggcctacgtgagcgagaacatcaagctgggcaacctgagcgccctgagaaccttcagagtgctgagagccctgaagaccatcagcgtgatccccggcctgaagaccatcgtgggcgccctgatccagagcgtgaagaagctggccgacgtgatggtgctgaccgtgttctgcctgagcgtgttcgccctgatcggcctgcagctgttcatgggcaacctgagacacaagtgcgtgagaaacttcaccgccctgaacggcaccaacggcagcgtggaggccgacggcctggtgtgggagagcctggacctgtacctgagcgaccccgagaactacctgctgaagaacggcaccagcgacgtgctgctgtgcggcaacagcagcgacgccggcacctgccccgagggctacagatgcctgaaggccggcgagaaccccgaccacggctacaccagcttcgacagcttcgcctgggccttcctggccctgttcagactgatgacccaggactgctgggagagactgtaccagcagaccctgagaagcgccggcaagatctacatgatcttcttcatgctggtgatcttcctgggcagcttctacctggtgaacctgatcctggccgtggtggccatggcctacgaggagcagaaccaggccaccatcgccgagaccgaggagaaggagaagagattccaggaggccatggagatgctgaagaaggagcacgaggccctgaccatcagaggcgtggacaccgtgagcagaagcagcctggagatgagccccctggcccccgtgaacagccacgagagaagaagcaagagaagaaagagaatgagcagcggcaccgaggagtgcggcgaggacagactgcccaagagcgacagcgaggacggccccagagccatgaaccacctgagcctgaccagaggcctgagcagaaccagcatgaagcccagaagcagcagaggcagcatcttcaccttcagaagaagagacctgggcagcgaggccgacttcgccgacgacgagaacagcaccgccggcgagagcgagagccaccacaccagcctgctggtgccctggcccctgagaagaaccagcgcccagggccagcccagccccggcaccagcgcccccggccacgccctgcacggcaagaagaacagcaccgtggactgcaacggcgtggtgagcctgctgggcgccggcgaccccgaggccaccagccccggcagccacctgctgagacccgtgatgctggagcacccccccgacaccaccacccccagcgaggagcccggcggcccccagatgctgaccagccaggccccctgcgtggacggcttcgaggagcccggcgccagacagagagccctgagcgccgtgagcgtgctgaccagcgccctggaggagctggaggagagcagacacaagtgccccccctgctggaacagactggcccagagatacctgatctgggagtgctgccccctgtggatgagcatcaagcagggcgtgaagctggtggtgatggaccccttcaccgacctgaccatcaccatgtgcatcgtgctgaacaccctgttcatggccctggagcactacaacatgaccagcgagttcgaggagatgctgcaggtgggcaacctggtgttcaccggcatcttcaccgccgagatgaccttcaagatcatcgccctggacccctactactacttccagcagggctggaacatcttcgacagcatcatcgtgatcctgagcctgatggagctgggcctgagcagaatgagcaacctgagcgtgctgagaagcttcagactgctgagagtgttcaagctggccaagagctggcccaccctgaacaccctgatcaagatcatcggcaacagcgtgggcgccctgggcaacctgaccctggtgctggccatcatcgtgttcatcttcgccgtggtgggcatgcagctgttcggcaagaactacagcgagctgagagacagcgacagcggcctgctgcccagatggcacatgatggacttcttccacgccttcctgatcatcttcagaatcctgtgcggcgagtggatcgagaccatgtgggactgcatggaggtgagcggccagagcctgtgcctgctggtgttcctgctggtgatggtgatcggcaacctggtggtgctgaacctgttcctggccctgctgctgagcagcttcagcgccgacaacctgaccgcccccgacgaggacagagagatgaacaacctgcagctggccctggccagaatccagagaggcctgagattcgtgaagagaaccacctgggacttctgctgcggcctgctgagacagagaccccagaagcccgccgccctggccgcccagggccagctgcccagctgcatcgccaccccctacagcccccccccccccgagaccgagaaggtgccccccaccagaaaggagaccagattcgaggagggcgagcagcccggccagggcacccccggcgaccccgagcccgtgtgcgtgcccatcgccgtggccgagagcgacaccgacgaccaggaggaggacgaggagaacagcctgggcaccgaggaggagagcagcaagcagcaggagagccagcccgtgagcggcggccccgaggccccccccgacagcagaacctggagccaggtgagcgccaccgccagcagcgaggccgaggccagcgccagccaggccgactggagacagcagtggaaggccgagccccaggcccccggctgcggcgagacccccgaggacagctgcagcgagggcagcaccgccgacatgaccaacaccgccgagctgctggagcagatccccgacctgggccaggacgtgaaggaccccgaggactgcttcaccgagggctgcgtgagaagatgcccctgctgcgccgtggacaccacccaggcccccggcaaggtgtggtggagactgagaaagacctgctaccacatcgtggagcacagctggttcgagaccttcatcatcttcatgatcctgctgagcagcggcgccctggccttcgaggacatctacctggaggagagaaagaccatcaaggtgctgctggagtacgccgacaagatgttcacctacgtgttcgtgctggagatgctgctgaagtgggtggcctacggcttcaagaagtacttcaccaacgcctggtgctggctggacttcctgatcgtggacgtgagcctggtgagcctggtggccaacaccctgggcttcgccgagatgggccccatcaagagcctgagaaccctgagagccctgagacccctgagagccctgagcagattcgagggcatgagagtggtggtgaacgccctggtgggcgccatccccagcatcatgaacgtgctgctggtgtgcctgatcttctggctgatcttcagcatcatgggcgtgaacctgttcgccggcaagttcggcagatgcatcaaccagaccgagggcgacctgcccctgaactacaccatcgtgaacaacaagagccagtgcgagagcctgaacctgaccggcgagctgtactggaccaaggtgaaggtgaacttcgacaacgtgggcgccggctacctggccctgctgcaggtggccaccttcaagggctggatggacatcatgtacgccgccgtggacagcagaggctacgaggagcagccccagtgggagtacaacctgtacatgtacatctacttcgtgatcttcatcatcttcggcagcttcttcaccctgaacctgttcatcggcgtgatcatcgacaacttcaaccagcagaagaagaagctgggcggccaggacatcttcatgaccgaggagcagaagaagtactacaacgccatgaagaagctgggcagcaagaagccccagaagcccatccccagacccctgaacaagtaccagggcttcatcttcgacatcgtgaccaagcaggccttcgacgtgaccatcatgttcctgatctgcctgaacatggtgaccatgatggtggagaccgacgaccagagccccgagaagatcaacatcctggccaagatcaacctgctgttcgtggccatcttcaccggcgagtgcatcgtgaagctggccgccctgagacactactacttcaccaacagctggaacatcttcgacttcgtggtggtgatcctgagcatcgtgggcaccgtgctgagcgacatcatccagaagtacttcttcagccccaccctgttcagagtgatcagactggccagaatcggcagaatcctgagactgatcagaggcgccaagggcatcagaaccctgctgttcgccctgatgatgagcctgcccgccctgttcaacatcggcctgctgctgttcctggtgatgttcatctacagcatcttcggcatggccaacttcgcctacgtgaagtgggaggccggcatcgacgacatgttcaacttccagaccttcgccaacagcatgctgtgcctgttccagatcaccaccagcgccggctgggacggcctgctgagccccatcctgaacaccggccccccctactgcgaccccaccctgcccaacagcaacggcagcagaggcgactgcggcagccccgccgtgggcatcctgttcttcaccacctacatcatcatcagcttcctgatcgtggtgaacatgtacatcgccatcatcctggagaacttcagcgtggccaccgaggagagcaccgagcccctgagcgaggacgacttcgacatgttctacgagatctgggagaagttcgaccccgaggccacccagttcatcgagtacagcgtgctgagcgacttcgccgacgccctgagcgagcccctgagaatcgccaagcccaaccagatcagcctgatcaacatggacctgcccatggtgagcggcgacagaatccactgcatggacatcctgttcgccttcaccaagagagtgctgggcgagagcggcgagatggacgccctgaagatccagatggaggagaagttcatggccgccaaccccagcaagatcagctacgagcccatcaccaccaccctgagaagaaagcacgaggaggtgagcgccatggtgatccagagagccttcagaagacacctgctgcagagaagcctgaagcacgccagcttcctgttcagacagcaggccggcagcggcctgagcgaggaggacgcccccgagagagagggcctgatcgcctacgtgatgagcgagaacttcagcagacccctgggcccccccagcagcagcagcatcagcagcaccagcttcccccccagctacgacagcgtgaccagagccaccagcgacaacctgcaggtgagaggcagcgactacagccacagcgaggacctggccgacttcccccccagccccgacagagacagagagagcatcgtgtag

SEQ ID NO: 99315 - DNA, 5997 bp, Artificial Sequence
  Description of Artificial Sequence: Synthetic coding sequence
atggccaacttcctgctgcccagaggcaccagcagcttcagaagattcaccagagagagcctggccgccatcgagaagagaatggccgagaagcaggccagaggcagcaccaccctgcaggagagcagagagggcctgcccgaggaggaggcccccagaccccagctggacctgcaggccagcaagaagctgcccgacctgtacggcaaccccccccaggagctgatcggcgagcccctggaggacctggaccccttctacagcacccagaagaccttcatcgtgctgaacaagggcaagaccatcttcagattcagcgccaccaacgccctgtacgtgctgagccccttccaccccatcagaagagccgccgtgaagatcctggtgcacagcctgttcaacatgctgatcatgtgcaccatcctgaccaactgcgtgttcatggcccagcacgacccccccccctggaccaagtacgtggagtacaccttcaccgccatctacaccttcgagagcctggtgaagatcctggccagaggcttctgcctgcacgccttcaccttcctgagagacccctggaactggctggacttcagcgtgatcatcatggcctacgtgagcgagaacatcaagctgggcaacctgagcgccctgagaaccttcagagtgctgagagccctgaagaccatcagcgtgatccccggcctgaagaccatcgtgggcgccctgatccagagcgtgaagaagctggccgacgtgatggtgctgaccgtgttctgcctgagcgtgttcgccctgatcggcctgcagctgttcatgggcaacctgagacacaagtgcgtgagaaacttcaccgccctgaacggcaccaacggcagcgtggaggccgacggcctggtgtgggagagcctggacctgtacctgagcgaccccgagaactacctgctgaagaacggcaccagcgacgtgctgctgtgcggcaacagcagcgacgccggcacctgccccgagggctacagatgcctgaaggccggcgagaaccccgaccacggctacaccagcttcgacagcttcgcctgggccttcctggccctgttcagactgatgacccaggactgctgggagagactgtaccagcagaccctgagaagcgccggcaagatctacatgatcttcttcatgctggtgatcttcctgggcagcttctacctggtgaacctgatcctggccgtggtggccatggcctacgaggagcagaaccaggccaccatcgccgagaccgaggagaaggagaagagattccaggaggccatggagatgctgaagaaggagcacgaggccctgaccatcagaggcgtggacaccgtgagcagaagcagcctggagatgagccccctggcccccgtgaacagccacgagagaagaagcaagagaagaaagagaatgagcagcggcaccgaggagtgcggcgaggacagactgcccaagagcgacagcgaggacggccccagagccatgaaccacctgagcctgaccagaggcctgagcagaaccagcatgaagcccagaagcagcagaggcagcatcttcaccttcagaagaagagacctgggcagcgaggccgacttcgccgacgacgagaacagcaccgccggcgagagcgagagccaccacaccagcctgctggtgccctggcccctgagaagaaccagcgcccagggccagcccagccccggcaccagcgcccccggccacgccctgcacggcaagaagaacagcaccgtggactgcaacggcgtggtgagcctgctgggcgccggcgaccccgaggccaccagccccggcagccacctgctgagacccgtgatgctggagcacccccccgacaccaccacccccagcgaggagcccggcggcccccagatgctgaccagccaggccccctgcgtggacggcttcgaggagcccggcgccagacagagagccctgagcgccgtgagcgtgctgaccagcgccctggaggagctggaggagagcagacacaagtgccccccctgctggaacagactggcccagagatacctgatctgggagtgctgccccctgtggatgagcatcaagcagggcgtgaagctggtggtgatggaccccttcaccgacctgaccatcaccatgtgcatcgtgctgaacaccctgttcatggccctggagcactacaacatgaccagcgagttcgaggagatgctgcaggtgggcaacctggtgttcaccggcatcttcaccgccgagatgaccttcaagatcatcgccctggacccctactactacttccagcagggctggaacatcttcgacagcatcatcgtgatcctgagcctgatggagctgggcctgagcagaatgagcaacctgagcgtgctgagaagcttcagactgctgagagtgttcaagctggccaagagctggcccaccctgaacaccctgatcaagatcatcggcaacagcgtgggcgccctgggcaacctgaccctggtgctggccatcatcgtgttcatcttcgccgtggtgggcatgcagctgttcggcaagaactacagcgagctgagagacagcgacagcggcctgctgcccagatggcacatgatggacttcttccacgccttcctgatcatcttcagaatcctgtgcggcgagtggatcgagaccatgtgggactgcatggaggtgagcggccagagcctgtgcctgctggtgttcctgctggtgatggtgatcggcaacctggtggtgctgaacctgttcctggccctgctgctgagcagcttcagcgccgacaacctgaccgcccccgacgaggacagagagatgaacaacctgcagctggccctggccagaatccagagaggcctgagattcgtgaagagaaccacctgggacttctgctgcggcctgctgagacagagaccccagaagcccgccgccctggccgcccagggccagctgcccagctgcatcgccaccccctacagcccccccccccccgagaccgagaaggtgccccccaccagaaaggagaccagattcgaggagggcgagcagcccggccagggcacccccggcgaccccgagcccgtgtgcgtgcccatcgccgtggccgagagcgacaccgacgaccaggaggaggacgaggagaacagcctgggcaccgaggaggagagcagcaagcagcaggagagccagcccgtgagcggcggccccgaggccccccccgacagcagaacctggagccaggtgagcgccaccgccagcagcgaggccgaggccagcgccagccaggccgactggagacagcagtggaaggccgagccccaggcccccggctgcggcgagacccccgaggacagctgcagcgagggcagcaccgccgacatgaccaacaccgccgagctgctggagcagatccccgacctgggccaggacgtgaaggaccccgaggactgcttcaccgagggctgcgtgagaagatgcccctgctgcgccgtggacaccacccaggcccccggcaaggtgtggtggagactgagaaagacctgctaccacatcgtggagcacagctggttcgagaccttcatcatcttcatgatcctgctgagcagcggcgccctggccttcgaggacatctacctggaggagagaaagaccatcaaggtgctgctggagtacgccgacaagatgttcacctacgtgttcgtgctggagatgctgctgaagtgggtggcctacggcttcaagaagtacttcaccaacgcctggtgctggctggacttcctgatcgtggacgtgagcctggtgagcctggtggccaacaccctgggcttcgccgagatgggccccatcaagagcctgagaaccctgagagccctgagacccctgagagccctgagcagattcgagggcatgagagtggtggtgaacgccctggtgggcgccatccccagcatcatgaacgtgctgctggtgtgcctgatcttctggctgatcttcagcatcatgggcgtgaacctgttcgccggcaagttcggcagatgcatcaaccagaccgagggcgacctgcccctgaactacaccatcgtgaacaacaagagccagtgcgagagcctgaacctgaccggcgagctgtactggaccaaggtgaaggtgaacttcgacaacgtgggcgccggctacctggccctgctgcaggtgtacgaggagcagccccagtgggagtacaacctgtacatgtacatctacttcgtgatcttcatcatcttcggcagcttcttcaccctgaacctgttcatcggcgtgatcatcgacaacttcaaccagcagaagaagaagctgggcggccaggacatcttcatgaccgaggagcagaagaagtactacaacgccatgaagaagctgggcagcaagaagccccagaagcccatccccagacccctgaacaagtaccagggcttcatcttcgacatcgtgaccaagcaggccttcgacgtgaccatcatgttcctgatctgcctgaacatggtgaccatgatggtggagaccgacgaccagagccccgagaagatcaacatcctggccaagatcaacctgctgttcgtggccatcttcaccggcgagtgcatcgtgaagctggccgccctgagacactactacttcaccaacagctggaacatcttcgacttcgtggtggtgatcctgagcatcgtgggcaccgtgctgagcgacatcatccagaagtacttcttcagccccaccctgttcagagtgatcagactggccagaatcggcagaatcctgagactgatcagaggcgccaagggcatcagaaccctgctgttcgccctgatgatgagcctgcccgccctgttcaacatcggcctgctgctgttcctggtgatgttcatctacagcatcttcggcatggccaacttcgcctacgtgaagtgggaggccggcatcgacgacatgttcaacttccagaccttcgccaacagcatgctgtgcctgttccagatcaccaccagcgccggctgggacggcctgctgagccccatcctgaacaccggccccccctactgcgaccccaccctgcccaacagcaacggcagcagaggcgactgcggcagccccgccgtgggcatcctgttcttcaccacctacatcatcatcagcttcctgatcgtggtgaacatgtacatcgccatcatcctggagaacttcagcgtggccaccgaggagagcaccgagcccctgagcgaggacgacttcgacatgttctacgagatctgggagaagttcgaccccgaggccacccagttcatcgagtacagcgtgctgagcgacttcgccgacgccctgagcgagcccctgagaatcgccaagcccaaccagatcagcctgatcaacatggacctgcccatggtgagcggcgacagaatccactgcatggacatcctgttcgccttcaccaagagagtgctgggcgagagcggcgagatggacgccctgaagatccagatggaggagaagttcatggccgccaaccccagcaagatcagctacgagcccatcaccaccaccctgagaagaaagcacgaggaggtgagcgccatggtgatccagagagccttcagaagacacctgctgcagagaagcctgaagcacgccagcttcctgttcagacagcaggccggcagcggcctgagcgaggaggacgcccccgagagagagggcctgatcgcctacgtgatgagcgagaacttcagcagacccctgggcccccccagcagcagcagcatcagcagcaccagcttcccccccagctacgacagcgtgaccagagccaccagcgacaacctgcaggtgagaggcagcgactacagccacagcgaggacctggccgacttcccccccagccccgacagagacagagagagcatcgtgtag

SEQ ID NO: 99316 - DNA, 6048 bp, Artificial Sequence
  Description of Artificial Sequence: Synthetic coding sequence
atggccaacttcctgctgcccagaggcaccagcagcttcagaagattcaccagagagagcctggccgccatcgagaagagaatggccgagaagcaggccagaggcagcaccaccctgcaggagagcagagagggcctgcccgaggaggaggcccccagaccccagctggacctgcaggccagcaagaagctgcccgacctgtacggcaaccccccccaggagctgatcggcgagcccctggaggacctggaccccttctacagcacccagaagaccttcatcgtgctgaacaagggcaagaccatcttcagattcagcgccaccaacgccctgtacgtgctgagccccttccaccccatcagaagagccgccgtgaagatcctggtgcacagcctgttcaacatgctgatcatgtgcaccatcctgaccaactgcgtgttcatggcccagcacgacccccccccctggaccaagtacgtggagtacaccttcaccgccatctacaccttcgagagcctggtgaagatcctggccagaggcttctgcctgcacgccttcaccttcctgagagacccctggaactggctggacttcagcgtgatcatcatggcctacaccaccgagttcgtggacctgggcaacgtgagcgccctgagaaccttcagagtgctgagagccctgaagaccatcagcgtgatcagcggcctgaagaccatcgtgggcgccctgatccagagcgtgaagaagctggccgacgtgatggtgctgaccgtgttctgcctgagcgtgttcgccctgatcggcctgcagctgttcatgggcaacctgagacacaagtgcgtgagaaacttcaccgccctgaacggcaccaacggcagcgtggaggccgacggcctggtgtgggagagcctggacctgtacctgagcgaccccgagaactacctgctgaagaacggcaccagcgacgtgctgctgtgcggcaacagcagcgacgccggcacctgccccgagggctacagatgcctgaaggccggcgagaaccccgaccacggctacaccagcttcgacagcttcgcctgggccttcctggccctgttcagactgatgacccaggactgctgggagagactgtaccagcagaccctgagaagcgccggcaagatctacatgatcttcttcatgctggtgatcttcctgggcagcttctacctggtgaacctgatcctggccgtggtggccatggcctacgaggagcagaaccaggccaccatcgccgagaccgaggagaaggagaagagattccaggaggccatggagatgctgaagaaggagcacgaggccctgaccatcagaggcgtggacaccgtgagcagaagcagcctggagatgagccccctggcccccgtgaacagccacgagagaagaagcaagagaagaaagagaatgagcagcggcaccgaggagtgcggcgaggacagactgcccaagagcgacagcgaggacggccccagagccatgaaccacctgagcctgaccagaggcctgagcagaaccagcatgaagcccagaagcagcagaggcagcatcttcaccttcagaagaagagacctgggcagcgaggccgacttcgccgacgacgagaacagcaccgccggcgagagcgagagccaccacaccagcctgctggtgccctggcccctgagaagaaccagcgcccagggccagcccagccccggcaccagcgcccccggccacgccctgcacggcaagaagaacagcaccgtggactgcaacggcgtggtgagcctgctgggcgccggcgaccccgaggccaccagccccggcagccacctgctgagacccgtgatgctggagcacccccccgacaccaccacccccagcgaggagcccggcggcccccagatgctgaccagccaggccccctgcgtggacggcttcgaggagcccggcgccagacagagagccctgagcgccgtgagcgtgctgaccagcgccctggaggagctggaggagagcagacacaagtgccccccctgctggaacagactggcccagagatacctgatctgggagtgctgccccctgtggatgagcatcaagcagggcgtgaagctggtggtgatggaccccttcaccgacctgaccatcaccatgtgcatcgtgctgaacaccctgttcatggccctggagcactacaacatgaccagcgagttcgaggagatgctgcaggtgggcaacctggtgttcaccggcatcttcaccgccgagatgaccttcaagatcatcgccctggacccctactactacttccagcagggctggaacatcttcgacagcatcatcgtgatcctgagcctgatggagctgggcctgagcagaatgagcaacctgagcgtgctgagaagcttcagactgctgagagtgttcaagctggccaagagctggcccaccctgaacaccctgatcaagatcatcggcaacagcgtgggcgccctgggcaacctgaccctggtgctggccatcatcgtgttcatcttcgccgtggtgggcatgcagctgttcggcaagaactacagcgagctgagagacagcgacagcggcctgctgcccagatggcacatgatggacttcttccacgccttcctgatcatcttcagaatcctgtgcggcgagtggatcgagaccatgtgggactgcatggaggtgagcggccagagcctgtgcctgctggtgttcctgctggtgatggtgatcggcaacctggtggtgctgaacctgttcctggccctgctgctgagcagcttcagcgccgacaacctgaccgcccccgacgaggacagagagatgaacaacctgcagctggccctggccagaatccagagaggcctgagattcgtgaagagaaccacctgggacttctgctgcggcctgctgagacagagaccccagaagcccgccgccctggccgcccagggccagctgcccagctgcatcgccaccccctacagcccccccccccccgagaccgagaaggtgccccccaccagaaaggagaccagattcgaggagggcgagcagcccggccagggcacccccggcgaccccgagcccgtgtgcgtgcccatcgccgtggccgagagcgacaccgacgaccaggaggaggacgaggagaacagcctgggcaccgaggaggagagcagcaagcaggagagccagcccgtgagcggcggccccgaggccccccccgacagcagaacctggagccaggtgagcgccaccgccagcagcgaggccgaggccagcgccagccaggccgactggagacagcagtggaaggccgagccccaggcccccggctgcggcgagacccccgaggacagctgcagcgagggcagcaccgccgacatgaccaacaccgccgagctgctggagcagatccccgacctgggccaggacgtgaaggaccccgaggactgcttcaccgagggctgcgtgagaagatgcccctgctgcgccgtggacaccacccaggcccccggcaaggtgtggtggagactgagaaagacctgctaccacatcgtggagcacagctggttcgagaccttcatcatcttcatgatcctgctgagcagcggcgccctggccttcgaggacatctacctggaggagagaaagaccatcaaggtgctgctggagtacgccgacaagatgttcacctacgtgttcgtgctggagatgctgctgaagtgggtggcctacggcttcaagaagtacttcaccaacgcctggtgctggctggacttcctgatcgtggacgtgagcctggtgagcctggtggccaacaccctgggcttcgccgagatgggccccatcaagagcctgagaaccctgagagccctgagacccctgagagccctgagcagattcgagggcatgagagtggtggtgaacgccctggtgggcgccatccccagcatcatgaacgtgctgctggtgtgcctgatcttctggctgatcttcagcatcatgggcgtgaacctgttcgccggcaagttcggcagatgcatcaaccagaccgagggcgacctgcccctgaactacaccatcgtgaacaacaagagccagtgcgagagcctgaacctgaccggcgagctgtactggaccaaggtgaaggtgaacttcgacaacgtgggcgccggctacctggccctgctgcaggtggccaccttcaagggctggatggacatcatgtacgccgccgtggacagcagaggctacgaggagcagccccagtgggagtacaacctgtacatgtacatctacttcgtgatcttcatcatcttcggcagcttcttcaccctgaacctgttcatcggcgtgatcatcgacaacttcaaccagcagaagaagaagctgggcggccaggacatcttcatgaccgaggagcagaagaagtactacaacgccatgaagaagctgggcagcaagaagccccagaagcccatccccagacccctgaacaagtaccagggcttcatcttcgacatcgtgaccaagcaggccttcgacgtgaccatcatgttcctgatctgcctgaacatggtgaccatgatggtggagaccgacgaccagagccccgagaagatcaacatcctggccaagatcaacctgctgttcgtggccatcttcaccggcgagtgcatcgtgaagctggccgccctgagacactactacttcaccaacagctggaacatcttcgacttcgtggtggtgatcctgagcatcgtgggcaccgtgctgagcgacatcatccagaagtacttcttcagccccaccctgttcagagtgatcagactggccagaatcggcagaatcctgagactgatcagaggcgccaagggcatcagaaccctgctgttcgccctgatgatgagcctgcccgccctgttcaacatcggcctgctgctgttcctggtgatgttcatctacagcatcttcggcatggccaacttcgcctacgtgaagtgggaggccggcatcgacgacatgttcaacttccagaccttcgccaacagcatgctgtgcctgttccagatcaccaccagcgccggctgggacggcctgctgagccccatcctgaacaccggccccccctactgcgaccccaccctgcccaacagcaacggcagcagaggcgactgcggcagccccgccgtgggcatcctgttcttcaccacctacatcatcatcagcttcctgatcgtggtgaacatgtacatcgccatcatcctggagaacttcagcgtggccaccgaggagagcaccgagcccctgagcgaggacgacttcgacatgttctacgagatctgggagaagttcgaccccgaggccacccagttcatcgagtacagcgtgctgagcgacttcgccgacgccctgagcgagcccctgagaatcgccaagcccaaccagatcagcctgatcaacatggacctgcccatggtgagcggcgacagaatccactgcatggacatcctgttcgccttcaccaagagagtgctgggcgagagcggcgagatggacgccctgaagatccagatggaggagaagttcatggccgccaaccccagcaagatcagctacgagcccatcaccaccaccctgagaagaaagcacgaggaggtgagcgccatggtgatccagagagccttcagaagacacctgctgcagagaagcctgaagcacgccagcttcctgttcagacagcaggccggcagcggcctgagcgaggaggacgcccccgagagagagggcctgatcgcctacgtgatgagcgagaacttcagcagacccctgggcccccccagcagcagcagcatcagcagcaccagcttcccccccagctacgacagcgtgaccagagccaccagcgacaacctgcaggtgagaggcagcgactacagccacagcgaggacctggccgacttcccccccagccccgacagagacagagagagcatcgtgtag

SEQ ID NO: 99317 - DNA, 5997 bp, Artificial Sequence; identical to SEQ ID NO: 99315
  Description of Artificial Sequence: Synthetic coding sequence

SEQ ID NO: 99318 - DNA, 6048 bp, Artificial Sequence; identical to SEQ ID NO: 99316
  Description of Artificial Sequence: Synthetic coding sequence

SEQ ID NO: 99319 - DNA, 5889 bp, Artificial Sequence
  Description of Artificial Sequence: Synthetic coding sequence
atggccaacttcctgctgcccagaggcaccagcagcttcagaagattcaccagagagagcctggccgccatcgagaagagaatggccgagaagcaggccagaggcagcaccaccctgcaggagagcagagagggcctgcccgaggaggaggcccccagaccccagctggacctgcaggccagcaagaagctgcccgacctgtacggcaaccccccccaggagctgatcggcgagcccctggaggacctggaccccttctacagcacccagaagaccttcatcgtgctgaacaagggcaagaccatcttcagattcagcgccaccaacgccctgtacgtgctgagccccttccaccccatcagaagagccgccgtgaagatcctggtgcacagcctgttcaacatgctgatcatgtgcaccatcctgaccaactgcgtgttcatggcccagcacgacccccccccctggaccaagtacgtggagtacaccttcaccgccatctacaccttcgagagcctggtgaagatcctggccagaggcttctgcctgcacgccttcaccttcctgagagacccctggaactggctggacttcagcgtgatcatcatggcctacaccaccgagttcgtggacctgggcaacgtgagcgccctgagaaccttcagagtgctgagagccctgaagaccatcagcgtgatcagcggcctgaagaccatcgtgggcgccctgatccagagcgtgaagaagctggccgacgtgatggtgctgaccgtgttctgcctgagcgtgttcgccctgatcggcctgcagctgttcatgggcaacctgagacacaagtgcgtgagaaacttcaccgccctgaacggcaccaacggcagcgtggaggccgacggcctggtgtgggagagcctggacctgtacctgagcgaccccgagaactacctgctgaagaacggcaccagcgacgtgctgctgtgcggcaacagcagcgacgccggcacctgccccgagggctacagatgcctgaaggccggcgagaaccccgaccacggctacaccagcttcgacagcttcgcctgggccttcctggccctgttcagactgatgacccaggactgctgggagagactgtaccagcagaccctgagaagcgccggcaagatctacatgatcttcttcatgctggtgatcttcctgggcagcttctacctggtgaacctgatcctggccgtggtggccatggcctacgaggagcagaaccaggccaccatcgccgagaccgaggagaaggagaagagattccaggaggccatggagatgctgaagaaggagcacgaggccctgaccatcagaggcgtggacaccgtgagcagaagcagcctggagatgagccccctggcccccgtgaacagccacgagagaagaagcaagagaagaaagagaatgagcagcggcaccgaggagtgcggcgaggacagactgcccaagagcgacagcgaggacggccccagagccatgaaccacctgagcctgaccagaggcctgagcagaaccagcatgaagcccagaagcagcagaggcagcatcttcaccttcagaagaagagacctgggcagcgaggccgacttcgccgacgacgagaacagcaccgccggcgagagcgagagccaccacaccagcctgctggtgccctggcccctgagaagaaccagcgcccagggccagcccagccccggcaccagcgcccccggccacgccctgcacggcaagaagaacagcaccgtggactgcaacggcgtggtgagcctgctgggcgccggcgaccccgaggccaccagccccggcagccacctgctgagacccgtgatgctggagcacccccccgacaccaccacccccagcgaggagcccggcggcccccagatgctgaccagccaggccccctgcgtggacggcttcgaggagcccggcgccagacagagagccctgagcgccgtgagcgtgctgaccagcgccctggaggagctggaggagagcagacacaagtgccccccctgctggaacagactggcccagagatacctgatctgggagtgctgccccctgtggatgagcatcaagcagggcgtgaagctggtggtgatggaccccttcaccgacctgaccatcaccatgtgcatcgtgctgaacaccctgttcatggccctggagcactacaacatgaccagcgagttcgaggagatgctgcaggtgggcaacctggtgttcaccggcatcttcaccgccgagatgaccttcaagatcatcgccctggacccctactactacttccagcagggctggaacatcttcgacagcatcatcgtgatcctgagcctgatggagctgggcctgagcagaatgagcaacctgagcgtgctgagaagcttcagactgctgagagtgttcaagctggccaagagctggcccaccctgaacaccctgatcaagatcatcggcaacagcgtgggcgccctgggcaacctgaccctggtgctggccatcatcgtgttcatcttcgccgtggtgggcatgcagctgttcggcaagaactacagcgagctgagagacagcgacagcggcctgctgcccagatggcacatgatggacttcttccacgccttcctgatcatcttcagaatcctgtgcggcgagtggatcgagaccatgtgggactgcatggaggtgagcggccagagcctgtgcctgctggtgttcctgctggtgatggtgatcggcaacctggtggtgctgaacctgttcctggccctgctgctgagcagcttcagcgccgacaacctgaccgcccccgacgaggacagagagatgaacaacctgcagctggccctggccagaatccagagaggcctgagattcgtgaagagaaccacctgggacttctgctgcggcctgctgagacagagaccccagaagcccgccgccctggccgcccagggccagctgcccagctgcatcgccaccccctacagcccccccccccccgagaccgagaaggtgccccccaccagaaaggagaccagattcgaggagggcgagcagcccggccagggcacccccggcgaccccgagcccgtgtgcgtgcccatcgccgtggccgagagcgacaccgacgaccaggaggaggacgaggagaacagcctgggcaccgaggaggagagcagcaagcagacccccgaggacagctgcagcgagggcagcaccgccgacatgaccaacaccgccgagctgctggagcagatccccgacctgggccaggacgtgaaggaccccgaggactgcttcaccgagggctgcgtgagaagatgcccctgctgcgccgtggacaccacccaggcccccggcaaggtgtggtggagactgagaaagacctgctaccacatcgtggagcacagctggttcgagaccttcatcatcttcatgatcctgctgagcagcggcgccctggccttcgaggacatctacctggaggagagaaagaccatcaaggtgctgctggagtacgccgacaagatgttcacctacgtgttcgtgctggagatgctgctgaagtgggtggcctacggcttcaagaagtacttcaccaacgcctggtgctggctggacttcctgatcgtggacgtgagcctggtgagcctggtggccaacaccctgggcttcgccgagatgggccccatcaagagcctgagaaccctgagagccctgagacccctgagagccctgagcagattcgagggcatgagagtggtggtgaacgccctggtgggcgccatccccagcatcatgaacgtgctgctggtgtgcctgatcttctggctgatcttcagcatcatgggcgtgaacctgttcgccggcaagttcggcagatgcatcaaccagaccgagggcgacctgcccctgaactacaccatcgtgaacaacaagagccagtgcgagagcctgaacctgaccggcgagctgtactggaccaaggtgaaggtgaacttcgacaacgtgggcgccggctacctggccctgctgcaggtggccaccttcaagggctggatggacatcatgtacgccgccgtggacagcagaggctacgaggagcagccccagtgggagtacaacctgtacatgtacatctacttcgtgatcttcatcatcttcggcagcttcttcaccctgaacctgttcatcggcgtgatcatcgacaacttcaaccagcagaagaagaagctgggcggccaggacatcttcatgaccgaggagcagaagaagtactacaacgccatgaagaagctgggcagcaagaagccccagaagcccatccccagacccctgaacaagtaccagggcttcatcttcgacatcgtgaccaagcaggccttcgacgtgaccatcatgttcctgatctgcctgaacatggtgaccatgatggtggagaccgacgaccagagccccgagaagatcaacatcctggccaagatcaacctgctgttcgtggccatcttcaccggcgagtgcatcgtgaagctggccgccctgagacactactacttcaccaacagctggaacatcttcgacttcgtggtggtgatcctgagcatcgtgggcaccgtgctgagcgacatcatccagaagtacttcttcagccccaccctgttcagagtgatcagactggccagaatcggcagaatcctgagactgatcagaggcgccaagggcatcagaaccctgctgttcgccctgatgatgagcctgcccgccctgttcaacatcggcctgctgctgttcctggtgatgttcatctacagcatcttcggcatggccaacttcgcctacgtgaagtgggaggccggcatcgacgacatgttcaacttccagaccttcgccaacagcatgctgtgcctgttccagatcaccaccagcgccggctgggacggcctgctgagccccatcctgaacaccggccccccctactgcgaccccaccctgcccaacagcaacggcagcagaggcgactgcggcagccccgccgtgggcatcctgttcttcaccacctacatcatcatcagcttcctgatcgtggtgaacatgtacatcgccatcatcctggagaacttcagcgtggccaccgaggagagcaccgagcccctgagcgaggacgacttcgacatgttctacgagatctgggagaagttcgaccccgaggccacccagttcatcgagtacagcgtgctgagcgacttcgccgacgccctgagcgagcccctgagaatcgccaagcccaaccagatcagcctgatcaacatggacctgcccatggtgagcggcgacagaatccactgcatggacatcctgttcgccttcaccaagagagtgctgggcgagagcggcgagatggacgccctgaagatccagatggaggagaagttcatggccgccaaccccagcaagatcagctacgagcccatcaccaccaccctgagaagaaagcacgaggaggtgagcgccatggtgatccagagagccttcagaagacacctgctgcagagaagcctgaagcacgccagcttcctgttcagacagcaggccggcagcggcctgagcgaggaggacgcccccgagagagagggcctgatcgcctacgtgatgagcgagaacttcagcagacccctgggcccccccagcagcagcagcatcagcagcaccagcttcccccccagctacgacagcgtgaccagagccaccagcgacaacctgcaggtgagaggcagcgactacagccacagcgaggacctggccgacttcccccccagccccgacagagacagagagagcatcgtgtag

SEQ ID NO: 99320 - DNA, 5889 bp, Artificial Sequence
  Description of Artificial Sequence: Synthetic coding sequence
atggccaacttcctgctgcccagaggcaccagcagcttcagaagattcaccagagagagcctggccgccatcgagaagagaatggccgagaagcaggccagaggcagcaccaccctgcaggagagcagagagggcctgcccgaggaggaggcccccagaccccagctggacctgcaggccagcaagaagctgcccgacctgtacggcaaccccccccaggagctgatcggcgagcccctggaggacctggaccccttctacagcacccagaagaccttcatcgtgctgaacaagggcaagaccatcttcagattcagcgccaccaacgccctgtacgtgctgagccccttccaccccatcagaagagccgccgtgaagatcctggtgcacagcctgttcaacatgctgatcatgtgcaccatcctgaccaactgcgtgttcatggcccagcacgacccccccccctggaccaagtacgtggagtacaccttcaccgccatctacaccttcgagagcctggtgaagatcctggccagaggcttctgcctgcacgccttcaccttcctgagagacccctggaactggctggacttcagcgtgatcatcatggcctacgtgagcgagaacatcaagctgggcaacctgagcgccctgagaaccttcagagtgctgagagccctgaagaccatcagcgtgatccccggcctgaagaccatcgtgggcgccctgatccagagcgtgaagaagctggccgacgtgatggtgctgaccgtgttctgcctgagcgtgttcgccctgatcggcctgcagctgttcatgggcaacctgagacacaagtgcgtgagaaacttcaccgccctgaacggcaccaacggcagcgtggaggccgacggcctggtgtgggagagcctggacctgtacctgagcgaccccgagaactacctgctgaagaacggcaccagcgacgtgctgctgtgcggcaacagcagcgacgccggcacctgccccgagggctacagatgcctgaaggccggcgagaaccccgaccacggctacaccagcttcgacagcttcgcctgggccttcctggccctgttcagactgatgacccaggactgctgggagagactgtaccagcagaccctgagaagcgccggcaagatctacatgatcttcttcatgctggtgatcttcctgggcagcttctacctggtgaacctgatcctggccgtggtggccatggcctacgaggagcagaaccaggccaccatcgccgagaccgaggagaaggagaagagattccaggaggccatggagatgctgaagaaggagcacgaggccctgaccatcagaggcgtggacaccgtgagcagaagcagcctggagatgagccccctggcccccgtgaacagccacgagagaagaagcaagagaagaaagagaatgagcagcggcaccgaggagtgcggcgaggacagactgcccaagagcgacagcgaggacggccccagagccatgaaccacctgagcctgaccagaggcctgagcagaaccagcatgaagcccagaagcagcagaggcagcatcttcaccttcagaagaagagacctgggcagcgaggccgacttcgccgacgacgagaacagcaccgccggcgagagcgagagccaccacaccagcctgctggtgccctggcccctgagaagaaccagcgcccagggccagcccagccccggcaccagcgcccccggccacgccctgcacggcaagaagaacagcaccgtggactgcaacggcgtggtgagcctgctgggcgccggcgaccccgaggccaccagccccggcagccacctgctgagacccgtgatgctggagcacccccccgacaccaccacccccagcgaggagcccggcggcccccagatgctgaccagccaggccccctgcgtggacggcttcgaggagcccggcgccagacagagagccctgagcgccgtgagcgtgctgaccagcgccctggaggagctggaggagagcagacacaagtgccccccctgctggaacagactggcccagagatacctgatctgggagtgctgccccctgtggatgagcatcaagcagggcgtgaagctggtggtgatggaccccttcaccgacctgaccatcaccatgtgcatcgtgctgaacaccctgttcatggccctggagcactacaacatgaccagcgagttcgaggagatgctgcaggtgggcaacctggtgttcaccggcatcttcaccgccgagatgaccttcaagatcatcgccctggacccctactactacttccagcagggctggaacatcttcgacagcatcatcgtgatcctgagcctgatggagctgggcctgagcagaatgagcaacctgagcgtgctgagaagcttcagactgctgagagtgttcaagctggccaagagctggcccaccctgaacaccctgatcaagatcatcggcaacagcgtgggcgccctgggcaacctgaccctggtgctggccatcatcgtgttcatcttcgccgtggtgggcatgcagctgttcggcaagaactacagcgagctgagagacagcgacagcggcctgctgcccagatggcacatgatggacttcttccacgccttcctgatcatcttcagaatcctgtgcggcgagtggatcgagaccatgtgggactgcatggaggtgagcggccagagcctgtgcctgctggtgttcctgctggtgatggtgatcggcaacctggtggtgctgaacctgttcctggccctgctgctgagcagcttcagcgccgacaacctgaccgcccccgacgaggacagagagatgaacaacctgcagctggccctggccagaatccagagaggcctgagattcgtgaagagaaccacctgggacttctgctgcggcctgctgagacagagaccccagaagcccgccgccctggccgcccagggccagctgcccagctgcatcgccaccccctacagcccccccccccccgagaccgagaaggtgccccccaccagaaaggagaccagattcgaggagggcgagcagcccggccagggcacccccggcgaccccgagcccgtgtgcgtgcccatcgccgtggccgagagcgacaccgacgaccaggaggaggacgaggagaacagcctgggcaccgaggaggagagcagcaagcagacccccgaggacagctgcagcgagggcagcaccgccgacatgaccaacaccgccgagctgctggagcagatccccgacctgggccaggacgtgaaggaccccgaggactgcttcaccgagggctgcgtgagaagatgcccctgctgcgccgtggacaccacccaggcccccggcaaggtgtggtggagactgagaaagacctgctaccacatcgtggagcacagctggttcgagaccttcatcatcttcatgatcctgctgagcagcggcgccctggccttcgaggacatctacctggaggagagaaagaccatcaaggtgctgctggagtacgccgacaagatgttcacctacgtgttcgtgctggagatgctgctgaagtgggtggcctacggcttcaagaagtacttcaccaacgcctggtgctggctggacttcctgatcgtggacgtgagcctggtgagcctggtggccaacaccctgggcttcgccgagatgggccccatcaagagcctgagaaccctgagagccctgagacccctgagagccctgagcagattcgagggcatgagagtggtggtgaacgccctggtgggcgccatccccagcatcatgaacgtgctgctggtgtgcctgatcttctggctgatcttcagcatcatgggcgtgaacctgttcgccggcaagttcggcagatgcatcaaccagaccgagggcgacctgcccctgaactacaccatcgtgaacaacaagagccagtgcgagagcctgaacctgaccggcgagctgtactggaccaaggtgaaggtgaacttcgacaacgtgggcgccggctacctggccctgctgcaggtggccaccttcaagggctggatggacatcatgtacgccgccgtggacagcagaggctacgaggagcagccccagtgggagtacaacctgtacatgtacatctacttcgtgatcttcatcatcttcggcagcttcttcaccctgaacctgttcatcggcgtgatcatcgacaacttcaaccagcagaagaagaagctgggcggccaggacatcttcatgaccgaggagcagaagaagtactacaacgccatgaagaagctgggcagcaagaagccccagaagcccatccccagacccctgaacaagtaccagggcttcatcttcgacatcgtgaccaagcaggccttcgacgtgaccatcatgttcctgatctgcctgaacatggtgaccatgatggtggagaccgacgaccagagccccgagaagatcaacatcctggccaagatcaacctgctgttcgtggccatcttcaccggcgagtgcatcgtgaagctggccgccctgagacactactacttcaccaacagctggaacatcttcgacttcgtggtggtgatcctgagcatcgtgggcaccgtgctgagcgacatcatccagaagtacttcttcagccccaccctgttcagagtgatcagactggccagaatcggcagaatcctgagactgatcagaggcgccaagggcatcagaaccctgctgttcgccctgatgatgagcctgcccgccctgttcaacatcggcctgctgctgttcctggtgatgttcatctacagcatcttcggcatggccaacttcgcctacgtgaagtgggaggccggcatcgacgacatgttcaacttccagaccttcgccaacagcatgctgtgcctgttccagatcaccaccagcgccggctgggacggcctgctgagccccatcctgaacaccggccccccctactgcgaccccaccctgcccaacagcaacggcagcagaggcgactgcggcagccccgccgtgggcatcctgttcttcaccacctacatcatcatcagcttcctgatcgtggtgaacatgtacatcgccatcatcctggagaacttcagcgtggccaccgaggagagcaccgagcccctgagcgaggacgacttcgacatgttctacgagatctgggagaagttcgaccccgaggccacccagttcatcgagtacagcgtgctgagcgacttcgccgacgccctgagcgagcccctgagaatcgccaagcccaaccagatcagcctgatcaacatggacctgcccatggtgagcggcgacagaatccactgcatggacatcctgttcgccttcaccaagagagtgctgggcgagagcggcgagatggacgccctgaagatccagatggaggagaagttcatggccgccaaccccagcaagatcagctacgagcccatcaccaccaccctgagaagaaagcacgaggaggtgagcgccatggtgatccagagagccttcagaagacacctgctgcagagaagcctgaagcacgccagcttcctgttcagacagcaggccggcagcggcctgagcgaggaggacgcccccgagagagagggcctgatcgcctacgtgatgagcgagaacttcagcagacccctgggcccccccagcagcagcagcatcagcagcaccagcttcccccccagctacgacagcgtgaccagagccaccagcgacaacctgcaggtgagaggcagcgactacagccacagcgaggacctggccgacttcccccccagccccgacagagacagagagagcatcgtgtag

SEQ ID NO: 99321 - DNA, 5889 bp, Artificial Sequence; identical to SEQ ID NO: 99320
  Description of Artificial Sequence: Synthetic coding sequence

SEQ ID NO: 99322 - DNA, 5952 bp, Artificial Sequence
  Description of Artificial Sequence: Synthetic coding sequence
atggccaacttcctgctgcccagaggcaccagcagcttcagaagattcaccagagagagcctggccgccatcgagaagagaatggccgagaagcaggccagaggcagcaccaccctgcaggagagcagagagggcctgcccgaggaggaggcccccagaccccagctggacctgcaggccagcaagaagctgcccgacctgtacggcaaccccccccaggagctgatcggcgagcccctggaggacctggaccccttctacagcacccagaagaccttcatcgtgctgaacaagggcaagaccatcttcagattcagcgccaccaacgccctgtacgtgctgagccccttccaccccatcagaagagccgccgtgaagatcctggtgcacagcctgttcaacatgctgatcatgtgcaccatcctgaccaactgcgtgttcatggcccagcacgacccccccccctggaccaagtacgtggagtacaccttcaccgccatctacaccttcgagagcctggtgaagatcctggccagaggcttctgcctgcacgccttcaccttcctgagagacccctggaactggctggacttcagcgtgatcatcatggcctacgtgagcgagaacatcaagctgggcaacctgagcgccctgagaaccttcagagtgctgagagccctgaagaccatcagcgtgatccccggcctgaagaccatcgtgggcgccctgatccagagcgtgaagaagctggccgacgtgatggtgctgaccgtgttctgcctgagcgtgttcgccctgatcggcctgcagctgttcatgggcaacctgagacacaagtgcgtgagaaacttcaccgccctgaacggcaccaacggcagcgtggaggccgacggcctggtgtgggagagcctggacctgtacctgagcgaccccgagaactacctgctgaagaacggcaccagcgacgtgctgctgtgcggcaacagcagcgacgccggcacctgccccgagggctacagatgcctgaaggccggcgagaaccccgaccacggctacaccagcttcgacagcttcgcctgggccttcctggccctgttcagactgatgacccaggactgctgggagagactgtaccagcagaccctgagaagcgccggcaagatctacatgatcttcttcatgctggtgatcttcctgggcagcttctacctggtgaacctgatcctggccgtggtggccatggcctacgaggagcagaaccaggccaccatcgccgagaccgaggagaaggagaagagattccaggaggccatggagatgctgaagaaggagcacgaggccctgaccatcagaggcgtggacaccgtgagcagaagcagcctggagatgagccccctggcccccgtgaacagccacgagagaagaagcaagagaagaaagagaatgagcagcggcaccgaggagtgcggcgaggacagactgcccaagagcgacagcgaggacggccccagagccatgaaccacctgagcctgaccagaggcctgagcagaaccagcatgaagcccagaagcagcagaggcagcatcttcaccttcagaagaagagacctgggcagcgaggccgacttcgccgacgacgagaacagcaccgccggcgagagcgagagccaccacaccagcctgctggtgccctggcccctgagaagaaccagcgcccagggccagcccagccccggcaccagcgcccccggccacgccctgcacggcaagaagaacagcaccgtggactgcaacggcgtggtgagcctgctgggcgccggcgaccccgaggccaccagccccggcagccacctgctgagacccgtgatgctggagcacccccccgacaccaccacccccagcgaggagcccggcggcccccagatgctgaccagccaggccccctgcgtggacggcttcgaggagcccggcgccagacagagagccctgagcgccgtgagcgtgctgaccagcgccctggaggagctggaggagagcagacacaagtgccccccctgctggaacagactggcccagagatacctgatctgggagtgctgccccctgtggatgagcatcaagcagggcgtgaagctggtggtgatggaccccttcaccgacctgaccatcaccatgtgcatcgtgctgaacaccctgttcatggccctggagcactacaacatgaccagcgagttcgaggagatgctgcaggtgggcaacctggtgttcaccggcatcttcaccgccgagatgaccttcaagatcatcgccctggacccctactactacttccagcagggctggaacatcttcgacagcatcatcgtgatcctgagcctgatggagctgggcctgagcagaatgagcaacctgagcgtgctgagaagcttcagactgctgagagtgttcaagctggccaagagctggcccaccctgaacaccctgatcaagatcatcggcaacagcgtgggcgccctgggcaacctgaccctggtgctggccatcatcgtgttcatcttcgccgtggtgggcatgcagctgttcggcaagaactacagcgagctgagagacagcgacagcggcctgctgcccagatggcacatgatggacttcttccacgccttcctgatcatcttcagaatcctgtgcggcgagtggatcgagaccatgtgggactgcatggaggtgagcggccagagcctgtgcctgctggtgttcctgctggtgatggtgatcggcaacctggtggtgctgaacctgttcctggccctgctgctgagcagcttcagcgccgacaacctgaccgcccccgacgaggacagagagatgaacaacctgcagctggccctggccagaatccagagaggcctgagattcgtgaagagaaccacctgggacttctgctgcggcctgctgagacagagaccccagaagcccgccgccctggccgcccagggccagctgcccagctgcatcgccaccccctacagcccccccccccccgagaccgagaaggtgccccccaccagaaaggagaccagattcgaggagggcgagcagcccggccagggcacccccggcgaccccgagcccgtgtgcgtgcccatcgccgtggccgagagcgacaccgacgaccaggaggaggacgaggagaacagcctgggcaccgaggaggagagcagcaagcaggagagccagcccgtgagcggcggccccgaggccccccccgacagcagaacctggagccaggtgagcgccaccgccagcagcgaggccgaggccagcgccagccaggccgactggagacagcagtggaaggccgagccccaggcccccggctgcggcgagacccccgaggacagctgcagcgagggcagcaccgccgacatgaccaacaccgccgagctgctggagcagatccccgacctgggccaggacgtgaaggaccccgaggactgcttcaccgagggctgcgtgagaagatgcccctgctgcgccgtggacaccacccaggcccccggcaaggtgtggtggagactgagaaagacctgctaccacatcgtggagcacagctggttcgagaccttcatcatcttcatgatcctgctgagcagcggcgccctggccttcgaggacatctacctggaggagagaaagaccatcaaggtgctgctggagtacgccgacaagatgttcacctacgtgttcgtgctggagatgctgctgaagtgggtggcctacggcttcaagaagtacttcaccaacgcctggtgctggctggacttcctgatcgtggacgtgagcctggtgagcctggtggccaacaccctgggcttcgccgagatgggccccatcaagagcctgagaaccctgagagccctgagacccctgagagccctgagcagattcgagggcatgagagtggtggtgaacgccctggtgggcgccatccccagcatcatgaacgtgctgctggtgtgcctgatcttctggctgatcttcagcatcatgggcgtgaacctgttcgccggcaagttcggcagatgcatcaaccagaccgagggcgacctgcccctgaactacaccatcgtgaacaacaagagccagtgcgagagcctgaacctgaccggcgagctgtactggaccaaggtgaaggtgaacttcgacaacgtgggcgccggctacctggccctgctgcaggtggccaccttcaagggctggatggacatcatgtacgccgccgtggacagcagaggctacgaggagcagccccagtgggagtacaacctgtacatgtacatctacttcgtgatcttcatcatcttcggcagcttcttcaccctgaacctgttcatcggcgtgatcatcgacaacttcaaccagcagaagaagaagctgggcggccaggacatcttcatgaccgaggagcagaagaagtactacaacgccatgaagaagctgggcagcaagaagccccagaagcccatccccagacccctgaacaagtaccagggcttcatcttcgacatcgtgaccaagcaggccttcgacgtgaccatcatgttcctgatctgcctgaacatggtgaccatgatggtggagaccgacgaccagagccccgagaagatcaacatcctggccaagatcaacctgctgttcgtggccatcttcaccggcaccgtgctgagcgacatcatccagaagtacttcttcagccccaccctgttcagagtgatcagactggccagaatcggcagaatcctgagactgatcagaggcgccaagggcatcagaaccctgctgttcgccctgatgatgagcctgcccgccctgttcaacatcggcctgctgctgttcctggtgatgttcatctacagcatcttcggcatggccaacttcgcctacgtgaagtgggaggccggcatcgacgacatgttcaacttccagaccttcgccaacagcatgctgtgcctgttccagatcaccaccagcgccggctgggacggcctgctgagccccatcctgaacaccggccccccctactgcgaccccaccctgcccaacagcaacggcagcagaggcgactgcggcagccccgccgtgggcatcctgttcttcaccacctacatcatcatcagcttcctgatcgtggtgaacatgtacatcgccatcatcctggagaacttcagcgtggccaccgaggagagcaccgagcccctgagcgaggacgacttcgacatgttctacgagatctgggagaagttcgaccccgaggccacccagttcatcgagtacagcgtgctgagcgacttcgccgacgccctgagcgagcccctgagaatcgccaagcccaaccagatcagcctgatcaacatggacctgcccatggtgagcggcgacagaatccactgcatggacatcctgttcgccttcaccaagagagtgctgggcgagagcggcgagatggacgccctgaagatccagatggaggagaagttcatggccgccaaccccagcaagatcagctacgagcccatcaccaccaccctgagaagaaagcacgaggaggtgagcgccatggtgatccagagagccttcagaagacacctgctgcagagaagcctgaagcacgccagcttcctgttcagacagcaggccggcagcggcctgagcgaggaggacgcccccgagagagagggcctgatcgcctacgtgatgagcgagaacttcagcagacccctgggcccccccagcagcagcagcatcagcagcaccagcttcccccccagctacgacagcgtgaccagagccaccagcgacaacctgcaggtgagaggcagcgactacagccacagcgaggacctggccgacttcccccccagccccgacagagacagagagagcatcgtgtag

SEQ ID NO: 99323 - DNA, 5049 bp, Artificial Sequence
  Description of Artificial Sequence: Synthetic coding sequence
atgctggccagccccgagcccaagggcctggtgcccttcaccaaggagagcttcgagctgatcaagcagcacatcgccaagacccacaacgaggaccacgaggaggaggacctgaagcccacccccgacctggaggtgggcaagaagctgcccttcatctacggcaacctgagccagggcatggtgagcgagcccctggaggacgtggacccctactactacaagaagaagaacaccttcatcgtgctgaacaagaacagaaccatcttcagattcaacgccgccagcatcctgtgcaccctgagccccttcaactgcatcagaagaaccaccatcaaggtgctggtgcaccccttcttccagctgttcatcctgatcagcgtgctgatcgactgcgtgttcatgagcctgaccaacctgcccaagtggagacccgtgctggagaacaccctgctgggcatctacaccttcgagatcctggtgaagctgttcgccagaggcgtgtgggccggcagcttcagcttcctgggcgacccctggaactggctggacttcagcgtgaccgtgttcgaggtgatcatcagatacagccccctggacttcatccccaccctgcagaccgccagaaccctgagaatcctgaagatcatccccctgaaccagggcctgaagagcctggtgggcgtgctgatccactgcctgaagcagctgatcggcgtgatcatcctgaccctgttcttcctgagcatcttcagcctgatcggcatgggcctgttcatgggcaacctgaagcacaagtgcttcagatggccccaggagaacgagaacgagaccctgcacaacagaaccggcaacccctactacatcagagagaccgagaacttctactacctggagggcgagagatacgccctgctgtgcggcaacagaaccgacgccggccagtgccccgagggctacgtgtgcgtgaaggccggcatcaaccccgaccagggcttcaccaacttcgacagcttcggctgggccctgttcgccctgttcagactgatggcccaggactaccccgaggtgctgtaccaccagatcctgtacgccagcggcaaggtgtacatgatcttcttcgtggtggtgagcttcctgttcagcttctacatggccagcctgttcctgggcatcctggccatggcctacgaggaggagaagcagagagtgggcgagatcagcaagaagatcgagcccaagttccagcagaccggcaaggagctgcaggagggcaacgagaccgacgaggccaagaccatccagatcgagatgaagaagagaagccccatcagcaccgacaccagcctggacgtgctggaggacgccaccctgagacacaaggaggagctggagaagagcaagaagatctgccccctgtactggtacaagttcgccaagaccttcctgatctggaactgcagcccctgctggctgaagctgaaggagttcgtgcacagaatcatcatggcccccttcaccgacctgttcctgatcatctgcatcatcctgaacgtgtgcttcctgaccctggagcactaccccatgagcaagcagaccaacaccctgctgaacatcggcaacctggtgttcatcggcatcttcaccgccgagatgatcttcaagatcatcgccatgcacccctacggctacttccaggtgggctggaacatcttcgacagcatgatcgtgttccacggcctgatcgagctgtgcctggccaacgtggccggcatggccctgctgagactgttcagaatgctgagaatcttcaagctgggcaagtactggcccaccttccagatcctgatgtggagcctgagcaacagctgggtggccctgaaggacctggtgctgctgctgttcaccttcatcttcttcagcgccgccttcggcatgaagctgttcggcaagaactacgaggagttcgtgtgccacatcgacaaggactgccagctgcccagatggcacatgcacgacttcttccacagcttcctgaacgtgttcagaatcctgtgcggcgagtgggtggagaccctgtgggactgcatggaggtggccggccagagctggtgcatccccttctacctgatggtgatcctgatcggcaacctgctggtgctgtacctgttcctggccctggtgagcagcttcagcagctgcaaggacgtgaccgccgaggagaacaacgaggccaagaacctgcagctggccgtggccagaatcaagaagggcatcaactacgtgctgctgaagatcctgtgcaagacccagaacgtgcccaaggacaccatggaccacgtgaacgaggtgtacgtgaaggaggacatcagcgaccacaccctgagcgagctgagcaacacccaggacttcctgaaggacaaggagaagagcagcggcaccgagaagaacgccaccgagaacgagagccagagcctgatccccagccccagcgtgagcgagaccgtgcccatcgccagcggcgagagcgacatcgagaacctggacaacaaggagatccagagcaagagcggcgacggcggcagcaaggagaagatcaagcagagcagcagcagcgagtgcagcaccgtggacatcgccatcagcgaggaggaggagatgttctacggcggcgagagaagcaagcacctgaagaacggctgcagaagaggcagcagcctgggccagatcagcggcgccagcaagaagggcaagatctggcagaacatcagaaagacctgctgcaagatcgtggagaacaactggttcaagtgcttcatcggcctggtgaccctgctgagcaccggcaccctggccttcgaggacatctacatggaccagagaaagaccatcaagatcctgctggagtacgccgacatgatcttcacctacatcttcatcctggagatgctgctgaagtggatggcctacggcttcaaggcctacttcagcaacggctggtacagactggacttcgtggtggtgatcgtgttctgcctgagcctgatcggcaagaccagagaggagctgaagcccctgatcagcatgaagttcctgagacccctgagagtgctgagccagttcgagagaatgaaggtggtggtgagagccctgatcaagaccaccctgcccaccctgaacgtgttcctggtgtgcctgatgatctggctgatcttcagcatcatgggcgtggacctgttcgccggcagattctacgagtgcatcgaccccaccagcggcgagagattccccagcagcgaggtgatgaacaagagcagatgcgagagcctgctgttcaacgagagcatgctgtgggagaacgccaagatgaacttcgacaacgtgggcaacggcttcctgagcctgctgcaggtggccaccttcaacggctggatcaccatcatgaacagcgccatcgacagcgtggccgtgaacatccagccccacttcgaggtgaacatctacatgtactgctacttcatcaacttcatcatcttcggcgtgttcctgcccctgagcatgctgatcaccgtgatcatcgacaacttcaacaagcacaagatcaagctgggcggcagcaacatcttcatcaccgtgaagcagagaaagcagtacagaagactgaagaagctgatgtacgaggacagccagagacccgtgcccagacccctgaacaagctgcagggcttcatcttcgacgtggtgaccagccaggccttcaacgtgatcgtgatggtgctgatctgcttccaggccatcgccatgatgatcgacaccgacgtgcagagcctgcagatgagcatcgccctgtactggatcaacagcatcttcgtgatgctgtacaccatggagtgcatcctgaagctgatcgccttcagatgcttctacttcaccatcgcctggaacatcttcgacttcatggtggtgatcttcagcatcaccggcctgtgcctgcccatgaccgtgggcagctacctggtgccccccagcctggtgcagctgatcctgctgagcagaatcatccacatgctgagactgggcaagggccccaaggtgttccacaacctgatgctgcccctgatgctgagcctgcccgccctgctgaacatcatcctgctgatcttcctggtgatgttcatctacgccgtgttcggcatgtacaacttcgcctacgtgaagaaggaggccggcatcaacgacgtgagcaacttcgagaccttcggcaacagcatgctgtgcctgttccaggtggccatcttcgccggctgggacggcatgctggacgccatcttcaacagcaagtggagcgactgcgaccccgacaagatcaaccccggcacccaggtgagaggcgactgcggcaaccccagcgtgggcatcttctacttcgtgagctacatcctgatcagctggctgatcatcgtgaacatgtacatcgtggtggtgatggagttcctgaacatcgccagcaagaagaagaacaagaccctgagcgaggacgacttcagaaagttcttccaggtgtggaagagattcgaccccgacagaacccagtacatcgacagcagcaagctgagcgacttcgccgccgccctggacccccccctgttcatggccaagcccaacaagggccagctgatcgccctggacctgcccatggccgtgggcgacagaatccactgcctggacatcctgctggccttcaccaagagagtgatgggccaggacgtgagaatggagaaggtggtgagcgagatcgagagcggcttcctgctggccaaccccttcaagatcacctgcgagcccatcaccaccaccctgaagagaaagcaggaggccgtgagcgccaccatcatccagagagcctacaagaactacagactgagaagaaacgacaagaacaccagcgacatccacatgatcgacggcgacagagacgtgcacgccaccaaggagggcgcctacttcgacaaggccaaggagaagagccccatccagagccagatctag

SEQ ID NO: 99324 - DNA, 5049 bp, Artificial Sequence; identical to SEQ ID NO: 99323
  Description of Artificial Sequence: Synthetic coding sequence

SEQ ID NO: 99325 - DNA, 2592 bp, Artificial Sequence
  Description of Artificial Sequence: Synthetic coding sequence
atgctggccagccccgagcccaagggcctggtgcccttcaccaaggagagcttcgagctgatcaagcagcacatcgccaagacccacaacgaggaccacgaggaggaggacctgaagcccacccccgacctggaggtgggcaagaagctgcccttcatctacggcaacctgagccagggcatggtgagcgagcccctggaggacgtggacccctactactacaagaagaagaacaccttcatcgtgctgaacaagaacagaaccatcttcagattcaacgccgccagcatcctgtgcaccctgagccccttcaactgcatcagaagaaccaccatcaaggtgctggtgcaccccttcttccagctgttcatcctgatcagcgtgctgatcgactgcgtgttcatgagcctgaccaacctgcccaagtggagacccgtgctggagaacaccctgctgggcatctacaccttcgagatcctggtgaagctgttcgccagaggcgtgtgggccggcagcttcagcttcctgggcgacccctggaactggctggacttcagcgtgaccgtgttcgaggtgatcatcagatacagccccctggacttcatccccaccctgcagaccgccagaaccctgagaatcctgaagatcatccccctgaaccagggcctgaagagcctggtgggcgtgctgatccactgcctgaagcagctgatcggcgtgatcatcctgaccctgttcttcctgagcatcttcagcctgatcggcatgggcctgttcatgggcaacctgaagcacaagtgcttcagatggccccaggagaacgagaacgagaccctgcacaacagaaccggcaacccctactacatcagagagaccgagaacttctactacctggagggcgagagatacgccctgctgtgcggcaacagaaccgacgccggccagtgccccgagggctacgtgtgcgtgaaggccggcatcaaccccgaccagggcttcaccaacttcgacagcttcggctgggccctgttcgccctgttcagactgatggcccaggactaccccgaggtgctgtaccaccagatcctgtacgccagcggcaaggtgtacatgatcttcttcgtggtggtgagcttcctgttcagcttctacatggccagcctgttcctgggcatcctggccatggcctacgaggaggagaagcagagagtgggcgagatcagcaagaagatcgagcccaagttccagcagaccggcaaggagctgcaggagggcaacgagaccgacgaggccaagaccatccagatcgagatgaagaagagaagccccatcagcaccgacaccagcctggacgtgctggaggacgccaccctgagacacaaggaggagctggagaagagcaagaagatctgccccctgtactggtacaagttcgccaagaccttcctgatctggaactgcagcccctgctggctgaagctgaaggagttcgtgcacagaatcatcatggcccccttcaccgacctgttcctgatcatctgcatcatcctgaacgtgtgcttcctgaccctggagcactaccccatgagcaagcagaccaacaccctgctgaacatcggcaacctggtgttcatcggcatcttcaccgccgagatgatcttcaagatcatcgccatgcacccctacggctacttccaggtgggctggaacatcttcgacagcatgatcgtgttccacggcctgatcgagctgtgcctggccaacgtggccggcatggccctgctgagactgttcagaatgctgagaatcttcaagctgggcaagtactggcccaccttccagatcctgatgtggagcctgagcaacagctgggtggccctgaaggacctggtgctgctgctgttcaccttcatcttcttcagcgccgccttcggcatgaagctgttcggcaagaactacgaggagttcgtgtgccacatcgacaaggactgccagctgcccagatggcacatgcacgacttcttccacagcttcctgaacgtgttcagaatcctgtgcggcgagtgggtggagaccctgtgggactgcatggaggtggccggccagagctggtgcatccccttctacctgatggtgatcctgatcggcaacctgctggtgctgtacctgttcctggccctggtgagcagcttcagcagctgcaaggacgtgaccgccgaggagaacaacgaggccaagaacctgcagctggccgtggccagaatcaagaagggcatcaactacgtgctgctgaagatcctgtgcaagacccagaacgtgcccaaggacaccatggaccacgtgaacgaggtgtacgtgaaggaggacatcagcgaccacaccctgagcgagctgagcaacacccaggacttcctgaaggacaaggagaagagcagcggcaccgagaagaacgccaccgagaacgagagccagagcctgatccccagccccagcgtgagcgagaccgtgcccatcgccagcggcgagagcgacatcgagaacctggacaacaaggagatccagagcaagagcggcgacggcggcagcaagtag

SEQ ID NO: 99326 - DNA, 1209 bp, Artificial Sequence
  Description of Artificial Sequence: Synthetic coding sequence
atgctggccagccccgagcccaagggcctggtgcccttcaccaaggagagcttcgagctgatcaagcagcacatcgccaagacccacaacgaggaccacgaggaggaggacctgaagcccacccccgacctggaggtgggcaagaagctgcccttcatctacggcaacctgagccagggcatggtgagcgagcccctggaggacgtggacccctactactacaagaagaagaacaccttcatcgtgctgaacaagaacagaaccatcttcagattcaacgccgccagcatcctgtgcaccctgagccccttcaactgcatcagaagaaccaccatcaaggtgctggtgcaccccttcttccagctgttcatcctgatcagcgtgctgatcgactgcgtgttcatgagcctgaccaacctgcccaagtggagacccgtgctggagaacaccctgctgggcatctacaccttcgagatcctggtgaagctgttcgccagaggcgtgtgggccggcagcttcagcttcctgggcgacccctggaactggctggacttcagcgtgaccgtgttcgaggtgatcatcagatacagccccctggacttcatccccaccctgcagaccgccagaaccctgagaatcctgaagatcatccccctgaaccagggcctgaagagcctggtgggcgtgctgatccactgcctgaagcagctgatcggcgtgatcatcctgaccctgttcttcctgagcatcttcagcctgatcggcatgggcctgttcatgggcaacctgaagcacaagtgcttcagatggccccaggagaacgagaacgagaccctgcacaacagaaccggcaacccctactacatcagagagaccgagaacttctactacctggagggcgagagatacgccctgctgtgcggcaacagaaccgacgccggccagtgccccgagggctacgtgtgcgtgaaggccggcatcaaccccgaccagggcttcaccaacttcgacagcttcggctgggccctgttcgccctgttcagactgatggcccaggactaccccgaggtgctgtaccaccagatcctgtacgccagcggcaaggtgtacatgatcttcttcgtggtggtgagcttcctgttcagcttctacatggccagcctgttcctgggcatcctggccatggcctacgaggaggagaagcagtag

SEQ ID NO: 99327 - DNA, 5871 bp, Artificial Sequence
  Description of Artificial Sequence: Synthetic coding sequence
atggagttccccatcggcagcctggagaccaacaacttcagaagattcacccccgagagcctggtggagatcgagaagcagatcgccgccaagcagggcaccaagaaggccagagagaagcacagagagcagaaggaccaggaggagaagcccagaccccagctggacctgaaggcctgcaaccagctgcccaagttctacggcgagctgcccgccgagctgatcggcgagcccctggaggacctggaccccttctacagcacccacagaaccttcatggtgctgaacaagggcagaaccatcagcagattcagcgccaccagagccctgtggctgttcagccccttcaacctgatcagaagaaccgccatcaaggtgagcgtgcacagctggttcagcctgttcatcaccgtgaccatcctggtgaactgcgtgtgcatgaccagaaccgacctgcccgagaagatcgagtacgtgttcaccgtgatctacaccttcgaggccctgatcaagatcctggccagaggcttctgcctgaacgagttcacctacctgagagacccctggaactggctggacttcagcgtgatcaccctggcctacgtgggcaccgccatcgacctgagaggcatcagcggcctgagaaccttcagagtgctgagagccctgaagaccgtgagcgtgatccccggcctgaaggtgatcgtgggcgccctgatccacagcgtgaagaagctggccgacgtgaccatcctgaccatcttctgcctgagcgtgttcgccctggtgggcctgcagctgttcaagggcaacctgaagaacaagtgcgtgaagaacgacatggccgtgaacgagaccaccaactacagcagccacagaaagcccgacatctacatcaacaagagaggcaccagcgaccccctgctgtgcggcaacggcagcgacagcggccactgccccgacggctacatctgcctgaagaccagcgacaaccccgacttcaactacaccagcttcgacagcttcgcctgggccttcctgagcctgttcagactgatgacccaggacagctgggagagactgtaccagcagaccctgagaaccagcggcaagatctacatgatcttcttcgtgctggtgatcttcctgggcagcttctacctggtgaacctgatcctggccgtggtgaccatggcctacgaggagcagaaccaggccaccaccgacgagatcgaggccaaggagaagaagttccaggaggccctggagatgctgagaaaggagcaggaggtgctggccgccctgggcatcgacaccaccagcctgcacagccacaacggcagccccctgaccagcaagaacgccagcgagagaagacacagaatcaagcccagagtgagcgagggcagcaccgaggacaacaagagccccagaagcgacccctacaaccagagaagaatgagcttcctgggcctggccagcggcaagagaagagccagccacggcagcgtgttccacttcagaagccccggcagagacatcagcctgcccgagggcgtgaccgacgacggcgtgttccccggcgaccacgagagccacagaggcagcctgctgctgggcggcggcgccggccagcagggccccctgcccagaagccccctgccccagcccagcaaccccgacagcagacacggcgaggacgagcaccagcccccccccaccagcgagctggcccccggcgccgtggacgtgagcgccttcgacgccggccagaagaagaccttcctgagcgccgagtacctggacgagcccttcagagcccagagagccatgagcgtggtgagcatcatcaccagcgtgctggaggagctggaggagagcgagcagaagtgccccccctgcctgaccagcctgagccagaagtacctgatctgggactgctgccccatgtgggtgaagctgaagaccatcctgttcggcctggtgaccgaccccttcgccgagctgaccatcaccctgtgcatcgtggtgaacaccatcttcatggccatggagcaccacggcatgagccccaccttcgaggccatgctgcagatcggcaacatcgtgttcaccatcttcttcaccgccgagatggtgttcaagatcatcgccttcgacccctactactacttccagaagaagtggaacatcttcgactgcatcatcgtgaccgtgagcctgctggagctgggcgtggccaagaagggcagcctgagcgtgctgagaagcttcagactgctgagagtgttcaagctggccaagagctggcccaccctgaacaccctgatcaagatcatcggcaacagcgtgggcgccctgggcaacctgaccatcatcctggccatcatcgtgttcgtgttcgccctggtgggcaagcagctgctgggcgagaactacagaaacaacagaaagaacatcagcgccccccacgaggactggcccagatggcacatgcacgacttcttccacagcttcctgatcgtgttcagaatcctgtgcggcgagtggatcgagaacatgtgggcctgcatggaggtgggccagaagagcatctgcctgatcctgttcctgaccgtgatggtgctgggcaacctggtggtgctgaacctgttcatcgccctgctgctgaacagcttcagcgccgacaacctgaccgcccccgaggacgacggcgaggtgaacaacctgcaggtggccctggccagaatccaggtgttcggccacagaaccaagcaggccctgtgcagcttcttcagcagaagctgccccttcccccagcccaaggccgagcccgagctggtggtgaagctgcccctgagcagcagcaaggccgagaaccacatcgccgccaacaccgccagaggcagcagcggcggcctgcaggcccccagaggccccagagacgagcacagcgacttcatcgccaaccccaccgtgtgggtgagcgtgcccatcgccgagggcgagagcgacctggacgacctggaggacgacggcggcgaggacgcccagagcttccagcaggaggtgatccccaagggccagcaggagcagctgcagcaggtggagagatgcggcgaccacctgacccccagaagccccggcaccggcaccagcagcgaggacctggcccccagcctgggcgagacctggaaggacgagagcgtgccccaggtgcccgccgagggcgtggacgacaccagcagcagcgagggcagcaccgtggactgcctggaccccgaggagatcctgagaaagatccccgagctggccgacgacctggaggagcccgacgactgcttcaccgagggctgcatcagacactgcccctgctgcaagctggacaccaccaagagcccctgggacgtgggctggcaggtgagaaagacctgctacagaatcgtggagcacagctggttcgagagcttcatcatcttcatgatcctgctgagcagcggcagcctggccttcgaggactactacctggaccagaagcccaccgtgaaggccctgctggagtacaccgacagagtgttcaccttcatcttcgtgttcgagatgctgctgaagtgggtggcctacggcttcaagaagtacttcaccaacgcctggtgctggctggacttcctgatcgtgaacatcagcctgatcagcctgaccgccaagatcctggagtacagcgaggtggcccccatcaaggccctgagaaccctgagagccctgagacccctgagagccctgagcagattcgagggcatgagagtggtggtggacgccctggtgggcgccatccccagcatcatgaacgtgctgctggtgtgcctgatcttctggctgatcttcagcatcatgggcgtgaacctgttcgccggcaagttctggagatgcatcaactacaccgacggcgagttcagcctggtgcccctgagcatcgtgaacaacaagagcgactgcaagatccagaacagcaccggcagcttcttctgggtgaacgtgaaggtgaacttcgacaacgtggccatgggctacctggccctgctgcaggtggccaccttcaagggctggatggacatcatgtacgccgccgtggacagcagagaggtgaacatgcagcccaagtgggaggacaacgtgtacatgtacctgtacttcgtgatcttcatcatcttcggcggcttcttcaccctgaacctgttcgtgggcgtgatcatcgacaacttcaaccagcagaagaagaagctgggcggccaggacatcttcatgaccgaggagcagaagaagtactacaacgccatgaagaagctgggcagcaagaagccccagaagcccatccccagacccctgaacaagttccagggcttcgtgttcgacatcgtgaccagacaggccttcgacatcaccatcatggtgctgatctgcctgaacatgatcaccatgatggtggagaccgacgaccagagcgaggagaagaccaagatcctgggcaagatcaaccagttcttcgtggccgtgttcaccggcgagtgcgtgatgaagatgttcgccctgagacagtactacttcaccaacggctggaacgtgttcgacttcatcgtggtggtgctgagcatcgccagcctgatcttcagcgccatcctgaagagcctgcagagctacttcagccccaccctgttcagagtgatcagactggccagaatcggcagaatcctgagactgatcagagccgccaagggcatcagaaccctgctgttcgccctgatgatgagcctgcccgccctgttcaacatcggcctgctgctgttcctggtgatgttcatctacagcatcttcggcatgagcagcttcccccacgtgagatgggaggccggcatcgacgacatgttcaacttccagaccttcgccaacagcatgctgtgcctgttccagatcaccaccagcgccggctgggacggcctgctgagccccatcctgaacaccggccccccctactgcgaccccaacctgcccaacagcaacggcaccagaggcgactgcggcagccccgccgtgggcatcatcttcttcaccacctacatcatcatcagcttcctgatcatggtgaacatgtacatcgccgtgatcctggagaacttcaacgtggccaccgaggagagcaccgagcccctgagcgaggacgacttcgacatgttctacgagacctgggagaagttcgaccccgaggccacccagttcatcaccttcagcgccctgagcgacttcgccgacaccctgagcggccccctgagaatccccaagcccaacagaaacatcctgatccagatggacctgcccctggtgcccggcgacaagatccactgcctggacatcctgttcgccttcaccaagaacgtgctgggcgagagcggcgagctggacagcctgaaggccaacatggaggagaagttcatggccaccaacctgagcaagagcagctacgagcccatcgccaccaccctgagatggaagcaggaggacatcagcgccaccgtgatccagaaggcctacagaagctacgtgctgcacagaagcatggccctgagcaacaccccctgcgtgcccagagccgaggaggaggccgccagcctgcccgacgagggcttcgtggccttcaccgccaacgagaactgcgtgctgcccgacaagagcgagaccgccagcgccaccagcttcccccccagctacgagagcgtgaccagaggcctgagcgacagagtgaacatgagaaccagcagcagcatccagaacgaggacgaggccaccagcatggagctgatcgcccccggcccctag

SEQ ID NO: 99328 - DNA, 5376 bp, Artificial Sequence
  Description of Artificial Sequence: Synthetic coding sequence
atggacgacagatgctaccccgtgatcttccccgacgagagaaacttcagacccttcaccagcgacagcctggccgccatcgagaagagaatcgccatccagaaggagaagaagaagagcaaggaccagaccggcgaggtgccccagcccagaccccagctggacctgaaggccagcagaaagctgcccaagctgtacggcgacatccccagagagctgatcggcaagcccctggaggacctggaccccttctacagaaaccacaagaccttcatggtgctgaacagaaagagaaccatctacagattcagcgccaagcacgccctgttcatcttcggccccttcaacagcatcagaagcctggccatcagagtgagcgtgcacagcctgttcagcatgttcatcatcggcaccgtgatcatcaactgcgtgttcatggccaccggccccgccaagaacagcaacagcaacaacaccgacatcgccgagtgcgtgttcaccggcatctacatcttcgaggccctgatcaagatcctggccagaggcttcatcctggacgagttcagcttcctgagagacccctggaactggctggacagcatcgtgatcggcatcgccatcgtgagctacatccccggcatcaccatcaagctgctgcccctgagaaccttcagagtgttcagagccctgaaggccatcagcgtggtgagcagactgaaggtgatcgtgggcgccctgctgagaagcgtgaagaagctggtgaacgtgatcatcctgaccttcttctgcctgagcatcttcgccctggtgggccagcagctgttcatgggcagcctgaacctgaagtgcatcagcagagactgcaagaacatcagcaaccccgaggcctacgaccactgcttcgagaagaaggagaacagccccgagttcaagatgtgcggcatctggatgggcaacagcgcctgcagcatccagtacgagtgcaagcacaccaagatcaaccccgactacaactacaccaacttcgacaacttcggctggagcttcctggccatgttcagactgatgacccaggacagctgggagaagctgtaccagcagaccctgagaaccaccggcctgtacagcgtgttcttcttcatcgtggtgatcttcctgggcagcttctacctgatcaacctgaccctggccgtggtgaccatggcctacgaggagcagaacaagaacgtggccgccgagatcgaggccaaggagaagatgttccaggaggcccagcagctgctgaaggaggagaaggaggccctggtggccatgggcatcgacagaagcagcctgaccagcctggagaccagctacttcacccccaagaagagaaagctgttcggcaacaagaagagaaagagcttcttcctgagagagagcggcaaggaccagccccccggcagcgacagcgacgaggactgccagaagaagccccagctgctggagcagaccaagagactgagccagaacctgagcctggaccacttcgacgagcacggcgaccccctgcagagacagagagccctgagcgccgtgagcatcctgaccatcaccatgaaggagcaggagaagagccaggagccctgcctgccctgcggcgagaacctggccagcaagtacctggtgtggaactgctgcccccagtggctgtgcgtgaagaaggtgctgagaaccgtgatgaccgaccccttcaccgagctggccatcaccatctgcatcatcatcaacaccgtgttcctggccatggagcaccacaagatggaggccagcttcgagaagatgctgaacatcggcaacctggtgttcaccagcatcttcatcgccgagatgtgcctgaagatcatcgccctggacccctaccactacttcagaagaggctggaacatcttcgacagcatcgtggccctgctgagcttcgccgacgtgatgaactgcgtgctgcagaagagaagctggcccttcctgagaagcttcagagtgctgagagtgttcaagctggccaagagctggcccaccctgaacaccctgatcaagatcatcggcaacagcgtgggcgccctgggcagcctgaccgtggtgctggtgatcgtgatcttcatcttcagcgtggtgggcatgcagctgttcggcagaagcttcaacagccagaagagccccaagctgtgcaaccccaccggccccaccgtgagctgcctgagacactggcacatgggcgacttctggcacagcttcctggtggtgttcagaatcctgtgcggcgagtggatcgagaacatgtgggagtgcatgcaggaggccaacgccagcagcagcctgtgcgtgatcgtgttcatcctgatcaccgtgatcggcaagctggtggtgctgaacctgttcatcgccctgctgctgaacagcttcagcaacgaggagagaaacggcaacctggagggcgaggccagaaagaccaaggtgcagctggccctggacagattcagaagagccttctgcttcgtgagacacaccctggagcacttctgccacaagtggtgcagaaagcagaacctgccccagcagaaggaggtggccggcggctgcgccgcccagagcaaggacatcatccccctggtgatggagatgaagagaggcagcgagacccaggaggagctgggcatcctgaccagcgtgcccaagaccctgggcgtgagacacgactggacctggctggcccccctggccgaggaggaggacgacgtggagttcagcggcgaggacaacgcccagagaatcacccagcccgagcccgagcagcaggcctacgagctgcaccaggagaacaagaagcccaccagccagagagtgcagagcgtggagatcgacatgttcagcgaggacgagccccacctgaccatccaggaccccagaaagaagagcgacgtgaccagcatcctgagcgagtgcagcaccatcgacctgcaggacggcttcggctggctgcccgagatggtgcccaagaagcagcccgagagatgcctgcccaagggcttcggctgctgcttcccctgctgcagcgtggacaagagaaagcccccctgggtgatctggtggaacctgagaaagacctgctaccagatcgtgaagcacagctggttcgagagcttcatcatcttcgtgatcctgctgagcagcggcgccctgatcttcgaggacgtgcacctggagaaccagcccaagatccaggagctgctgaactgcaccgacatcatcttcacccacatcttcatcctggagatggtgctgaagtgggtggccttcggcttcggcaagtacttcaccagcgcctggtgctgcctggacttcatcatcgtgatcgtgagcgtgaccaccctgatcaacctgatggagctgaagagcttcagaaccctgagagccctgagacccctgagagccctgagccagttcgagggcatgaaggtggtggtgaacgccctgatcggcgccatccccgccatcctgaacgtgctgctggtgtgcctgatcttctggctggtgttctgcatcctgggcgtgtacttcttcagcggcaagttcggcaagtgcatcaacggcaccgacagcgtgatcaactacaccatcatcaccaacaagagccagtgcgagagcggcaacttcagctggatcaaccagaaggtgaacttcgacaacgtgggcaacgcctacctggccctgctgcaggtggccaccttcaagggctggatggacatcatctacgccgccgtggacagcaccgagaaggagcagcagcccgagttcgagagcaacagcctgggctacatctacttcgtggtgttcatcatcttcggcagcttcttcaccctgaacctgttcatcggcgtgatcatcgacaacttcaaccagcagcagaagaagctgggcggccaggacatcttcatgaccgaggagcagaagaagtactacaacgccatgaagaagctgggcagcaagaagccccagaagcccatccccagacccctgaacaagtgccagggcctggtgttcgacatcgtgaccagccagatcttcgacatcatcatcatcagcctgatcatcctgaacatgatcagcatgatggccgagagctacaaccagcccaaggccatgaagagcatcctggaccacctgaactgggtgttcgtggtgatcttcaccctggagtgcctgatcaagatcttcgccctgagacagtactacttcaccaacggctggaacctgttcgactgcgtggtggtgctgctgagcatcgtgagcaccatgatcagcaccctggagaaccaggagcacatccccttcccccccaccctgttcagaatcgtgagactggccagaatcggcagaatcctgagactggtgagagccgccagaggcatcagaaccctgctgttcgccctgatgatgagcctgcccagcctgttcaacatcggcctgctgctgttcctgatcatgttcatctacgccatcctgggcatgaactggttcagcaaggtgaaccccgagagcggcatcgacgacatcttcaacttcaagaccttcgccagcagcatgctgtgcctgttccagatcagcaccagcgccggctgggacagcctgctgagccccatgctgagaagcaaggagagctgcaacagcagcagcgagaactgccacctgcccggcatcgccaccagctacttcgtgagctacatcatcatcagcttcctgatcgtggtgaacatgtacatcgccgtgatcctggagaacttcaacaccgccaccgaggagagcgaggaccccctgggcgaggacgacttcgacatcttctacgaggtgtgggagaagttcgaccccgaggccacccagttcatcaagtacagcgccctgagcgacttcgccgacgccctgcccgagcccctgagagtggccaagcccaacaagtaccagttcctggtgatggacctgcccatggtgagcgaggacagactgcactgcatggacatcctgttcgccttcaccgccagagtgctgggcggcagcgacggcctggacagcatgaaggccatgatggaggagaagttcatggaggccaaccccctgaagaagctgtacgagcccatcgtgaccaccaccaagagaaaggaggaggagagaggcgccgccatcatccagaaggccttcagaaagtacatgatgaaggtgaccaagggcgaccagggcgaccagaacgacctggagaacggcccccacagccccctgcagaccctgtgcaacggcgacctgagcagcttcggcgtggccaagggcaaggtgcactgcgactag

SEQ ID NO: 99329 - DNA, 4335 bp, Artificial Sequence
  Description of Artificial Sequence: Synthetic coding sequence
atggacgacagatgctaccccgtgatcttccccgacgagagaaacttcagacccttcaccagcgacagcctggccgccatcgagaagagaatcgccatccagaaggagaagaagaagagcaaggaccagaccggcgaggtgccccagcccagaccccagctggacctgaaggccagcagaaagctgcccaagctgtacggcgacatccccagagagctgatcggcaagcccctggaggacctggaccccttctacagaaaccacaagaccttcatggtgctgaacagaaagagaaccatctacagattcagcgccaagcacgccctgttcatcttcggccccttcaacagcatcagaagcctggccatcagagtgagcgtgcacagcctgttcagcatgttcatcatcggcaccgtgatcatcaactgcgtgttcatggccaccggccccgccaagaacagcaacagcaacaacaccgacatcgccgagtgcgtgttcaccggcatctacatcttcgaggccctgatcaagatcctggccagaggcttcatcctggacgagttcagcttcctgagagacccctggaactggctggacagcatcgtgatcggcatcgccatcgtgagctacatccccggcatcaccatcaagctgctgcccctgagaaccttcagagtgttcagagccctgaaggccatcagcgtggtgagcagactgaaggtgatcgtgggcgccctgctgagaagcgtgaagaagctggtgaacgtgatcatcctgaccttcttctgcctgagcatcttcgccctggtgggccagcagctgttcatgggcagcctgaacctgaagtgcatcagcagagactgcaagaacatcagcaaccccgaggcctacgaccactgcttcgagaagaaggagaacagccccgagttcaagatgtgcggcatctggatgggcaacagcgcctgcagcatccagtacgagtgcaagcacaccaagatcaaccccgactacaactacaccaacttcgacaacttcggctggagcttcctggccatgttcagactgatgacccaggacagctgggagaagctgtaccagcagaccctgagaaccaccggcctgtacagcgtgttcttcttcatcgtggtgatcttcctgggcagcttctacctgatcaacctgaccctggccgtggtgaccatggcctacgaggagcagaacaagaacgtggccgccgagatcgaggccaaggagaagatgttccaggaggcccagcagctgctgaaggaggagaaggaggccctggtggccatgggcatcgacagaagcagcctgaccagcctggagaccagctacttcacccccaagaagagaaagctgttcggcaacaagaagagaaagagcttcttcctgagagagagcggcaaggaccagccccccggcagcgacagcgacgaggactgccagaagaagccccagctgctggagcagaccaagagactgagccagaacctgagcctggaccacttcgacgagcacggcgaccccctgcagagacagagagccctgagcgccgtgagcatcctgaccatcaccatgaaggagcaggagaagagccaggagccctgcctgccctgcggcgagaacctggccagcaagtacctggtgtggaactgctgcccccagtggctgtgcgtgaagaaggtgctgagaaccgtgatgaccgaccccttcaccgagctggccatcaccatctgcatcatcatcaacaccgtgttcctggccatggagcaccacaagatggaggccagcttcgagaagatgctgaacatcggcaacctggtgttcaccagcatcttcatcgccgagatgtgcctgaagatcatcgccctggacccctaccactacttcagaagaggctggaacatcttcgacagcatcgtggccctgctgagcttcgccgacgtgatgaactgcgtgctgcagaagagaagctggcccttcctgagaagcttcagagtgctgagagtgttcaagctggccaagagctggcccaccctgaacaccctgatcaagatcatcggcaacagcgtgggcgccctgggcagcctgaccgtggtgctggtgatcgtgatcttcatcttcagcgtggtgggcatgcagctgttcggcagaagcttcaacagccagaagagccccaagctgtgcaaccccaccggccccaccgtgagctgcctgagacactggcacatgggcgacttctggcacagcttcctggtggtgttcagaatcctgtgcggcgagtggatcgagaacatgtgggagtgcatgcaggaggccaacgccagcagcagcctgtgcgtgatcgtgttcatcctgatcaccgtgatcggcaagctggtggtgctgaacctgttcatcgccctgctgctgaacagcttcagcaacgaggagagaaacggcaacctggagggcgaggccagaaagaccaaggtgcagctggccctggacagattcagaagagccttctgcttcgtgagacacaccctggagcacttctgccacaagtggtgcagaaagcagaacctgccccagcagaaggaggtggccggcggctgcgccgcccagagcaaggacatcatccccctggtgatggagatgaagagaggcagcgagacccaggaggagctgggcatcctgaccagcgtgcccaagaccctgggcgtgagacacgactggacctggctggcccccctggccgaggaggaggacgacgtggagttcagcggcgaggacaacgcccagagaatcacccagcccgagcccgagcagcaggcctacgagctgcaccaggagaacaagaagcccaccagccagagagtgcagagcgtggagatcgacatgttcagcgaggacgagccccacctgaccatccaggaccccagaaagaagagcgacgtgaccagcatcctgagcgagtgcagcaccatcgacctgcaggacggcttcggctggctgcccgagatggtgcccaagaagcagcccgagagatgcctgcccaagggcttcggctgctgcttcccctgctgcagcgtggacaagagaaagcccccctgggtgatctggtggaacctgagaaagacctgctaccagatcgtgaagcacagctggttcgagagcttcatcatcttcgtgatcctgctgagcagcggcgccctgatcttcgaggacgtgcacctggagaaccagcccaagatccaggagctgctgaactgcaccgacatcatcttcacccacatcttcatcctggagatggtgctgaagtgggtggccttcggcttcggcaagtacttcaccagcgcctggtgctgcctggacttcatcatcgtgatcgtgagcgtgaccaccctgatcaacctgatggagctgaagagcttcagaaccctgagagccctgagacccctgagagccctgagccagttcgagggcatgaaggtggtggtgaacgccctgatcggcgccatccccgccatcctgaacgtgctgctggtgtgcctgatcttctggctggtgttctgcatcctgggcgtgtacttcttcagcggcaagttcggcaagtgcatcaacggcaccgacagcgtgatcaactacaccatcatcaccaacaagagccagtgcgagagcggcaacttcagctggatcaaccagaaggtgaacttcgacaacgtgggcaacgcctacctggccctgctgcaggtggccaccttcaagggctggatggacatcatctacgccgccgtggacagcaccgagaaggagcagcagcccgagttcgagagcaacagcctgggctacatctacttcgtggtgttcatcatcttcggcagcttcttcaccctgaacctgttcatcggcgtgatcatcgacaacttcaaccagcagcagaagaagctgggcggccaggacatcttcatgaccgaggagcagaagaagtactacaacgccatgaagaagctgggcagcaagaagccccagaagcccatccccagacccctgaacaagtgccagggcctggtgttcgacatcgtgaccagccagatcttcgacatcatcatcatcagcctgatcatcctgaacatgatcagcatgatggccgagagctacaaccagcccaaggccatgaagagcatcctggaccacctgaactgggtgttcgtggtgatcttcaccctggagtgcctgatcaagatcttcgccctgagacagtactacttcaccaacggctggaacctgttcgactgcgtggtggtgctgctgagcatcgtgagcaagtag

SEQ ID NO: 99330 - DNA, 5376 bp, Artificial Sequence; identical to SEQ ID NO: 99328
  Description of Artificial Sequence: Synthetic coding sequence

SEQ ID NO: 99331 - DNA, 5217 bp, Artificial Sequence
  Description of Artificial Sequence: Synthetic coding sequence
atgctgaagagaaagcagagcagcagagtggaggcccagcccgtgaccgacttcggccccgacgagagcctgagcgacaacgccgacatcctgtggatcaacaagccctgggtgcacagcctgctgagaatctgcgccatcatcagcgtgatcagcgtgtgcatgaacacccccatgaccttcgagcactacccccccctgcagtacgtgaccttcaccctggacaccctgctgatgttcctgtacaccgccgagatgatcgccaagatgcacatcagaggcatcgtgaagggcgacagcagctacgtgaaggacagatggtgcgtgttcgacggcttcatggtgttctgcctgtgggtgagcctggtgctgcaggtgttcgagatcgccgacatcgtggaccagatgagcccctggggcatgctgagaatccccagacccctgatcatgatcagagccttcagaatctacttcagattcgagctgcccagaaccagaatcaccaacatcctgaagagaagcggcgagcagatctggagcgtgagcatcttcctgctgttcttcctgctgctgtacggcatcctgggcgtgcagatgttcggcaccttcacctaccactgcgtggtgaacgacaccaagcccggcaacgtgacctggaacagcctggccatccccgacacccactgcagccccgagctggaggagggctaccagtgcccccccggcttcaagtgcatggacctggaggacctgggcctgagcagacaggagctgggctacagcggcttcaacgagatcggcaccagcatcttcaccgtgtacgaggccgccagccaggagggctgggtgttcctgatgtacagagccatcgacagcttccccagatggagaagctacttctacttcatcaccctgatcttcttcctggcctggctggtgaagaacgtgttcatcgccgtgatcatcgagaccttcgccgagatcagagtgcagttccagcagatgtggggcagcagaagcagcaccaccagcaccgccaccacccagatgttccacgaggacgccgccggcggctggcagctggtggccgtggacgtgaacaagccccagggcagagcccccgcctgcctgcagaagatgatgagaagcagcgtgttccacatgttcatcctgagcatggtgaccgtggacgtgatcgtggccgccagcaactactacaagggcgagaacttcagaagacagtacgacgagttctacctggccgaggtggccttcaccgtgctgttcgacctggaggccctgctgaagatctggtgcctgggcttcaccggctacatcagcagcagcctgcacaagttcgagctgctgctggtgatcggcaccaccctgcacgtgtaccccgacctgtaccacagccagttcacctacttccaggtgctgagagtggtgagactgatcaagatcagccccgccctggaggacttcgtgtacaagatcttcggccccggcaagaagctgggcagcctggtggtgttcaccgccagcctgctgatcgtgatgagcgccatcagcctgcagatgttctgcttcgtggaggagctggacagattcaccaccttccccagagccttcatgagcatgttccagatcctgacccaggagggctgggtggacgtgatggaccagaccctgaacgccgtgggccacatgtgggcccccgtggtggccatctacttcatcctgtaccacctgttcgccaccctgatcctgctgagcctgttcgtggccgtgatcctggacaacctggagctggacgaggacctgaagaagctgaagcagctgaagcagagcgaggccaacgccgacaccaaggagaagctgcccctgagactgagaatcttcgagaagttccccaacagaccccagatggtgaagatcagcaagctgcccagcgacttcaccgtgcccaagatcagagagagcttcatgaagcagttcatcgacagacagcagcaggacacctgctgcctgctgagaagcctgcccaccaccagcagcagcagctgcgaccacagcaagagaagcgccatcgaggacaacaagtacatcgaccagaagctgagaaagagcgtgttcagcatcagagccagaaacctgctggagaaggagaccgccgtgaccaagatcctgagagcctgcaccagacagagaatgctgagcggcagcttcgagggccagcccgccaaggagagaagcatcctgagcgtgcagcaccacatcagacaggagagaagaagcctgagacacggcagcaacagccagagaatcagcagaggcaagagcctggagaccctgacccaggaccacagcaacaccgtgagatacagaaacgcccagagagaggacagcgagatcaagatgatccaggagaagaaggagcaggccgagatgaagagaaaggtgcaggaggaggagctgagagagaaccacccctacttcgacaagcccctgttcatcgtgggcagagagcacagattcagaaacttctgcagagtggtggtgagagccagattcaacgccagcaagaccgaccccgtgaccggcgccgtgaagaacaccaagtaccaccagctgtacgacctgctgggcctggtgacctacctggactgggtgatgatcatcgtgaccatctgcagctgcatcagcatgatgttcgagagccccttcagaagagtgatgcacgcccccaccctgcagatcgccgagtacgtgttcgtgatcttcatgagcatcgagctgaacctgaagatcatggccgacggcctgttcttcacccccaccgccgtgatcagagacttcggcggcgtgatggacatcttcatctacctggtgagcctgatcttcctgtgctggatgccccagaacgtgcccgccgagagcggcgcccagctgctgatggtgctgagatgcctgagacccctgagaatcttcaagctggtgccccagatgagaaaggtggtgagagagctgttcagcggcttcaaggagatcttcctggtgagcatcctgctgctgaccctgatgctggtgttcgccagcttcggcgtgcagctgttcgccggcaagctggccaagtgcaacgaccccaacatcatcagaagagaggactgcaacggcatcttcagaatcaacgtgagcgtgagcaagaacctgaacctgaagctgagacccggcgagaagaagcccggcttctgggtgcccagagtgtgggccaaccccagaaacttcaacttcgacaacgtgggcaacgccatgctggccctgttcgaggtgctgagcctgaagggctgggtggaggtgagagacgtgatcatccacagagtgggccccatccacggcatctacatccacgtgttcgtgttcctgggctgcatgatcggcctgaccctgttcgtgggcgtggtgatcgccaacttcaacgagaacaagggcaccgccctgctgaccgtggaccagagaagatgggaggacctgaagagcagactgaagatcgcccagcccctgcacctgccccccagacccgacaacgacggcttcagagccaagatgtacgacatcacccagcaccccttcttcaagagaaccatcgccctgctggtgctggcccagagcgtgctgctgagcgtgaagtgggacgtggaggaccccgtgaccgtgcccctggccaccatgagcgtggtgttcaccttcatcttcgtgctggaggtgaccatgaagatcatcgccatgagccccgccggcttctggcagagcagaagaaacagatacgacctgctggtgaccagcctgggcgtggtgtgggtggtgctgcacttcgccctgctgaacgcctacacctacatgatgggcgcctgcgtgatcgtgttcagattcttcagcatctgcggcaagcacgtgaccctgaagatgctgctgctgaccgtggtggtgagcatgtacaagagcttcttcatcatcgtgggcatgttcctgctgctgctgtgctacgccttcgccggcgtggtgctgttcggcaccgtgaagtacggcgagaacatcaacagacacgccaacttcagcagcgccggcaaggccatcaccgtgctgttcagaatcgtgaccggcgaggactggaacaagatcatgcacgactgcatggtgcagccccccttctgcacccccgacgagttcacctactgggccaccgactgcggcaactacgccggcgccctgatgtacttctgcagcttctacgtgatcatcgcctacatcatgctgaacctgctggtggccatcatcgtggagaacttcagcctgttctacagcaccgaggaggaccagctgctgagctacaacgacctgagacacttccagatcatctggaacatggtggacgacaagagagagggcgtgatccccaccttcagagtgaagttcctgctgagactgctgagaggcagactggaggtggacctggacaaggacaagctgctgttcaagcacatgtgctacgagatggagagactgcacaacggcggcgacgtgaccttccacgacgtgctgagcatgctgagctacagaagcgtggacatcagaaagagcctgcagctggaggagctgctggccagagagcagctggagtacaccatcgaggaggaggtggccaagcagaccatcagaatgtggctgaagaagtgcctgaagagaatcagagccaagcagcagcagagctgcagcatcatccacagcctgagagagagccagcagcaggagctgagcagattcctgaacccccccagcatcgagaccacccagcccagcgaggacaccaacgccaacagccaggacaacagcatgcagcccgagaccagcagccagcagcagctgctgagccccaccctgagcgacagaggcggcagcagacaggacgccgccgacgccggcaagccccagagaaagttcggccagtggagactgcccagcgcccccaagcccatcagccacagcgtgagcagcgtgaacctgagattcggcggcagaaccaccatgaagagcgtggtgtgcaagatgaaccccatgaccgacgccgccagctgcggcagcgaggtgaagaagtggtggaccagacagctgaccgtggagagcgacgagagcggcgacgacctgctggacatctag

SEQ ID NO: 99332 - DNA, 2007 bp, Artificial Sequence
  Description of Artificial Sequence: Synthetic coding sequence
atgctgaagagaaagcagagcagcagagtggaggcccagcccgtgaccgacttcggccccgacgagagcctgagcgacaacgccgacatcctgtggatcaacaagccctgggtgcacagcctgctgagaatctgcgccatcatcagcgtgatcagcgtgtgcatgaacacccccatgaccttcgagcactacccccccctgcagtacgtgaccttcaccctggacaccctgctgatgttcctgtacaccgccgagatgatcgccaagatgcacatcagaggcatcgtgaagggcgacagcagctacgtgaaggacagatggtgcgtgttcgacggcttcatggtgttctgcctgtgggtgagcctggtgctgcaggtgttcgagatcgccgacatcgtggaccagatgagcccctggggcatgctgagaatccccagacccctgatcatgatcagagccttcagaatctacttcagattcgagctgcccagaaccagaatcaccaacatcctgaagagaagcggcgagcagatctggagcgtgagcatcttcctgctgttcttcctgctgctgtacggcatcctgggcgtgcagatgttcggcaccttcacctaccactgcgtggtgaacgacaccaagcccggcaacgtgacctggaacagcctggccatccccgacacccactgcagccccgagctggaggagggctaccagtgcccccccggcttcaagtgcatggacctggaggacctgggcctgagcagacaggagctgggctacagcggcttcaacgagatcggcaccagcatcttcaccgtgtacgaggccgccagccaggagggctgggtgttcctgatgtacagagccatcgacagcttccccagatggagaagctacttctacttcatcaccctgatcttcttcctggcctggctggtgaagaacgtgttcatcgccgtgatcatcgagaccttcgccgagatcagagtgcagttccagcagatgtggggcagcagaagcagcaccaccagcaccgccaccacccagatgttccacgaggacgccgccggcggctggcagctggtggccgtggacgtgaacaagccccagggcagagcccccgcctgcctgcagaagatgatgagaagcagcgtgttccacatgttcatcctgagcatggtgaccgtggacgtgatcgtggccgccagcaactactacaagggcgagaacttcagaagacagtacgacgagttctacctggccgaggtggccttcaccgtgctgttcgacctggaggccctgctgaagatctggtgcctgggcttcaccggctacatcagcagcagcctgcacaagttcgagctgctgctggtgatcggcaccaccctgcacgtgtaccccgacctgtaccacagccagttcacctacttccaggtgctgagagtggtgagactgatcaagatcagccccgccctggaggacttcgtgtacaagatcttcggccccggcaagaagctgggcagcctggtggtgttcaccgccagcctgctgatcgtgatgagcgccatcagcctgcagatgttctgcttcgtggaggagctggacagattcaccaccttccccagagccttcatgagcatgttccagatcctgacccaggagggctgggtggacgtgatggaccagaccctgaacgccgtgggccacatgtgggcccccgtggtggccatctacttcatcctgtaccacctgttcgccaccctgccccccagcctgatcagagacctgtgcggcacccaggacgcctgccccagctgcctgcccctgcagccccccaaccccctgcccggcagccagaccctggccagactgacccaccaggccctgaccaccccccccggcatgagaagcagccagctgttcagcaagatcagcctgctgctgggcatctgcgtggcctgggagagcatcctgggcagcctgagcctgagccacaacctgagatag

SEQ ID NO: 99333 - DNA, 657 bp, Artificial Sequence
  Description of Artificial Sequence: Synthetic coding sequence
atgctgaagagaaagcagagcagcagagtggaggcccagcccgtgaccgacttcggccccgacgagagcctgagcgacaacgccgacatcctgtggatcaacaagccctgggtgcacagcctgctgagaatctgcgccatcatcagcgtgatcagcgtgtgcatgaacacccccatgaccttcgagcactacccccccctgcagtacgtgaccttcaccctggacaccctgctgatgttcctgtacaccgccgagatgatcgccaagatgcacatcagaggcatcgtgaagggcgacagcagctacgtgaaggacagatggtgcgtgttcgacggcttcatggtgttctgcctgtgggtgagcctggtgctgcaggtgttcgagatcgccgacatcgtggaccagatgagcccctggggcatgctgagaatccccagacccctgatcatgatcagagccttcagaatctacttcagattcgagctgcccagaaccagaatcaccaacatcctgaagagaagcggcgagcagatctggagcgtgagcatcttcctgctgttcttcctgctgctgtacggcatcctgggcgtgcagatgttcggcaccttcacctaccactgcgtggtgaacgacaccaagcccggcctgagcctgtag

SEQ ID NO: 99334 - DNA, 657 bp, Artificial Sequence
  Description of Artificial Sequence: Synthetic coding sequence
atgctgaagagaaagcagagcagcagagtggaggcccagcccgtgaccgacttcggccccgacgagagcctgagcgacaacgccgacatcctgtggatcaacaagccctgggtgcacagcctgctgagaatctgcgccatcatcagcgtgatcagcgtgtgcatgaacacccccatgaccttcgagcactacccccccctgcagtacgtgaccttcaccctggacaccctgctgatgttcctgtacaccgccgagatgatcgccaagatgcacatcagaggcatcgtgaagggcgacagcagctacgtgaaggacagatggtgcgtgttcgacggcttcatggtgttctgcctgtgggtgagcctggtgctgcaggtgttcgagatcgccgacatcgtggaccagatgagcccctggggcatgctgagaatccccagacccctgatcatgatcagagccttcagaatctacttcagattcgagctgcccagaaccagaatcaccaacatcctgaagagaagcggcgagcagatctggagcgtgagcatcttcctgctgttcttcctgctgctgtacggcatcctgggcgtgcagatgttcggcaccttcacctaccactgcgtggtgaacgacaccaagcccggcctgagcatctag

SEQ ID NO: 99335 - DNA, 1725 bp, Artificial Sequence
  Description of Artificial Sequence: Synthetic coding sequence
atggccagcaccgagggcgccaacaacatgcccaagcaggtggaggtgagaatgcacgacagccacctgggcagcgaggagcccaagcacagacacctgggcctgagactgtgcgacaagctgggcaagaacctgctgctgaccctgaccgtgttcggcgtgatcctgggcgccgtgtgcggcggcctgctgagactggccagccccatccaccccgacgtggtgatgctgatcgccttccccggcgacatcctgatgagaatgctgaagatgctgatcctgcccctgatcatcagcagcctgatcaccggcctgagcggcctggacgccaaggccagcggcagactgggcaccagagccatggtgtactacatgagcaccaccatcatcgccgccgtgctgggcgtgatcctggtgctggccatccaccccggcaaccccaagctgaagaagcagctgggccccggcaagaagaacgacgaggtgagcagcctggacgccttcctggacctgatcagaaacctgttccccgagaacctggtgcaggcctgcttccagcagatccagaccgtgaccaagaaggtgctggtggcccccccccccgacgaggaggccaacgccaccagcgccgtggtgagcctgctgaacgagaccgtgaccgaggtgcccgaggagaccaagatggtgatcaagaagggcctggagttcaaggacggcatgaacgtgctgggcctgatcggcttcttcatcgccttcggcatcgccatgggcaagatgggcgaccaggccaagctgatggtggacttcttcaacatcctgaacgagatcgtgatgaagctggtgatcatgatcatgtggtacagccccctgggcatcgcctgcctgatctgcggcaagatcatcgccatcaaggacctggaggtggtggccagacagctgggcatgtacatggtgaccgtgatcatcggcctgatcatccacggcggcatcttcctgcccctgatctacttcgtggtgaccagaaagaaccccttcagcttcttcgccggcatcttccaggcctggatcaccgccctgggcaccgccagcagcgccggcaccctgcccgtgaccttcagatgcctggaggagaacctgggcatcgacaagagagtgaccagattcgtgctgcccgtgggcgccaccatcaacatggacggcaccgccctgtacgaggccgtggccgccatcttcatcgcccagatgaacggcgtggtgctggacggcggccagatcgtgaccgtgagcctgaccgccaccctggccagcgtgggcgccgccagcatccccagcgccggcctggtgaccatgctgctgatcctgaccgccgtgggcctgcccaccgaggacatcagcctgctggtggccgtggactggctgctggacagaatgagaaccagcgtgaacgtggtgggcgacagcttcggcgccggcatcgtgtaccacctgagcaagagcgagctggacaccatcgacagccagcacagagtgcacgaggacatcgagatgaccaagacccagagcatctacgacgacatgaagaaccacagagagagcaacagcaaccagtgcgtgtacgccgcccacaacagcgtgatcgtggacgagtgcaaggtgaccctggccgccaacggcaagagcgccgactgcagcgtggaggaggagccctggaagagagagaagtag

SEQ ID NO: 99336 - DNA, 1698 bp, Artificial Sequence
  Description of Artificial Sequence: Synthetic coding sequence
atgcccaagcaggtggaggtgagaatgcacgacagccacctgggcagcgaggagcccaagcacagacacctgggcctgagactgtgcgacaagctgggcaagaacctgctgctgaccctgaccgtgttcggcgtgatcctgggcgccgtgtgcggcggcctgctgagactggccagccccatccaccccgacgtggtgatgctgatcgccttccccggcgacatcctgatgagaatgctgaagatgctgatcctgcccctgatcatcagcagcctgatcaccggcctgagcggcctggacgccaaggccagcggcagactgggcaccagagccatggtgtactacatgagcaccaccatcatcgccgccgtgctgggcgtgatcctggtgctggccatccaccccggcaaccccaagctgaagaagcagctgggccccggcaagaagaacgacgaggtgagcagcctggacgccttcctggacctgatcagaaacctgttccccgagaacctggtgcaggcctgcttccagcagatccagaccgtgaccaagaaggtgctggtggcccccccccccgacgaggaggccaacgccaccagcgccgtggtgagcctgctgaacgagaccgtgaccgaggtgcccgaggagaccaagatggtgatcaagaagggcctggagttcaaggacggcatgaacgtgctgggcctgatcggcttcttcatcgccttcggcatcgccatgggcaagatgggcgaccaggccaagctgatggtggacttcttcaacatcctgaacgagatcgtgatgaagctggtgatcatgatcatgtggtacagccccctgggcatcgcctgcctgatctgcggcaagatcatcgccatcaaggacctggaggtggtggccagacagctgggcatgtacatggtgaccgtgatcatcggcctgatcatccacggcggcatcttcctgcccctgatctacttcgtggtgaccagaaagaaccccttcagcttcttcgccggcatcttccaggcctggatcaccgccctgggcaccgccagcagcgccggcaccctgcccgtgaccttcagatgcctggaggagaacctgggcatcgacaagagagtgaccagattcgtgctgcccgtgggcgccaccatcaacatggacggcaccgccctgtacgaggccgtggccgccatcttcatcgcccagatgaacggcgtggtgctggacggcggccagatcgtgaccgtgagcctgaccgccaccctggccagcgtgggcgccgccagcatccccagcgccggcctggtgaccatgctgctgatcctgaccgccgtgggcctgcccaccgaggacatcagcctgctggtggccgtggactggctgctggacagaatgagaaccagcgtgaacgtggtgggcgacagcttcggcgccggcatcgtgtaccacctgagcaagagcgagctggacaccatcgacagccagcacagagtgcacgaggacatcgagatgaccaagacccagagcatctacgacgacatgaagaaccacagagagagcaacagcaaccagtgcgtgtacgccgcccacaacagcgtgatcgtggacgagtgcaaggtgaccctggccgccaacggcaagagcgccgactgcagcgtggaggaggagccctggaagagagagaagtag

SEQ ID NO: 99337 - DNA, 1698 bp, Artificial Sequence; identical to SEQ ID NO: 99336
  Description of Artificial Sequence: Synthetic coding sequence

SEQ ID NO: 99338 - DNA, 1629 bp, Artificial Sequence
  Description of Artificial Sequence: Synthetic coding sequence
atgaccaagagcaacggcgaggagcccaagatgggcggcagaatggagagattccagcagggcgtgagaaagagaaccctgctggccaagaagaaggtgcagaacatcaccaaggaggacgtgaagagctacctgttcagaaacgccttcgtgctgctgaccgtgaccgccgtgatcgtgggcaccatcctgggcttcaccctgagaccctacagaatgagctacagagaggtgaagtacttcagcttccccggcgagctgctgatgagaatgctgcagatgctggtgctgcccctgatcatcagcagcctggtgaccggcatggccgccctggacagcaaggccagcggcaagatgggcatgagagccgtggtgtactacatgaccaccaccatcatcgccgtggtgatcggcatcatcatcgtgatcatcatccaccccggcaagggcaccaaggagaacatgcacagagagggcaagatcgtgagagtgaccgccgccgacgccttcctggacctgatcagaaacatgttcccccccaacctggtggaggcctgcttcaagcagttcaagaccaactacgagaagagaagcttcaaggtgcccatccaggccaacgagaccctggtgggcgccgtgatcaacaacgtgagcgaggccatggagaccctgaccagaatcaccgaggagctggtgcccgtgcccggcagcgtgaacggcgtgaacgccctgggcctggtggtgttcagcatgtgcttcggcttcgtgatcggcaacatgaaggagcagggccaggccctgagagagttcttcgacagcctgaacgaggccatcatgagactggtggccgtgatcatgtggtacgcccccgtgggcatcctgttcctgatcgccggcaagatcgtggagatggaggacatgggcgtgatcggcggccagctggccatgtacaccgtgaccgtgatcgtgggcctgctgatccacgccgtgatcgtgctgcccctgctgtacttcctggtgaccagaaagaacccctgggtgttcatcggcggcctgctgcaggccctgatcaccgccctgggcaccagcagcagcagcgccaccctgcccatcaccttcaagtgcctggaggagaacaacggcgtggacaagagagtgaccagattcgtgctgcccgtgggcgccaccatcaacatggacggcaccgccctgtacgaggccctggccgccatcttcatcgcccaggtgaacaacttcgagctgaacttcggccagatcatcaccatcagcatcaccgccaccgccgccagcatcggcgccgccggcatcccccaggccggcctggtgaccatggtgatcgtgctgaccagcgtgggcctgcccaccgacgacatcaccctgatcatcgccgtggactggttcctggacagactgagaaccaccaccaacgtgctgggcgacagcctgggcgccggcatcgtggagcacctgagcagacacgagctgaagaacagagacgtggagatgggcaacagcgtgatcgaggagaacgagatgaagaagccctaccagctgatcgcccaggacaacgagaccgagaagcccatcgacagcgagaccaagatgtag

SEQ ID NO: 99339 - DNA, 1494 bp, Artificial Sequence
  Description of Artificial Sequence: Synthetic coding sequence
atgaccaagagcaacggcgaggagcccaagatgggcggcagaatggagagattccagcagggcgtgagaaagagaaccctgctggccaagaagaaggtgcagaacatcaccaaggaggacgtgaagagctacctgttcagaaacgccttcgtgctgctgaccgtgaccgccgtgatcgtgggcaccatcctgggcttcaccctgagaccctacagaatgagctacagagaggtgaagtacttcagcttccccggcgagctgctgatgagaatgctgcagatgctggtgctgcccctgatcatcagcagcctggtgaccggcatggccgccctggacagcaaggccagcggcaagatgggcatgagagccgtggtgtactacatgaccaccaccatcatcgccgtggtgatcggcatcatcatcgtgatcatcatccaccccggcaagggcaccaaggagaacatgcacagagagggcaagatcgtgagagtgaccgccgccgacgccttcctggacctgatcagaaacatgttcccccccaacctggtggaggcctgcttcaagcagttcaagaccaactacgagaagagaagcttcaaggtgcccatccaggccaacgagaccctggtgggcgccgtgatcaacaacgtgagcgaggccatggagaccctgaccagaatcaccgaggagctggtgcccgtgcccggcagcgtgaacggcgtgaacgccctgggcctggtggtgttcagcatgtgcttcggcttcgtgatcggcaacatgaaggagcagggccaggccctgagagagttcttcgacagcctgaacgaggccatcatgagactggtggccgtgatcatgtggtacgcccccgtgggcatcctgttcctgatcgccggcaagatcgtggagatggaggacatgggcgtgatcggcggccagctggccatgtacaccgtgaccgtgatcgtgggcctgctgatccacgccgtgatcgtgctgcccctgctgtacttcctggtgaccagaaagaacccctgggtgttcatcggcggcctgctgcaggccctgatcaccgccctgggcaccagcagcagcagcgccaccctgcccatcaccttcaagtgcctggaggagaacaacggcgtggacaagagagtgaccagattcgtgctgcccgtgggcgccaccatcaacatggacggcaccgccctgtacgaggccctggccgccatcttcatcgcccaggtgaacaacttcgagctgaacttcggccagatcatcaccatcagagacagactgagaaccaccaccaacgtgctgggcgacagcctgggcgccggcatcgtggagcacctgagcagacacgagctgaagaacagagacgtggagatgggcaacagcgtgatcgaggagaacgagatgaagaagccctaccagctgatcgcccaggacaacgagaccgagaagcccatcgacagcgagaccaagatgtag

SEQ ID NO: 99340 - DNA, 348 bp, Artificial Sequence
  Description of Artificial Sequence: Synthetic coding sequence
atgaccaagagcaacggcgaggagcccaagatgggcggcagaatggagagattccagcagggcgtgagaaagagaaccctgctggccaagaagaaggtgcagaacatcaccaaggaggacgtgaagagctacctgttcagaaacgccttcgtgctgctgaccgtgaccgccgtgatcgtggacgagaagaccgaggcccagatcctgaccacccagctgatgaacaccgagtgggacagcaacccccccttcagactgcaggtgctgatccaccacaccgtgctgggcgccatcacccccatcctggccctgctgcagcagttcgccgagggcctgcccgaggtgtag

SEQ ID NO: 99341 - DNA, 1473 bp, Artificial Sequence
  Description of Artificial Sequence: Synthetic coding sequence
atgaccaagagcaacggcgaggagcccaagatgggcggcagaatggagagattccagcagggcgtgagaaagagaaccctgctggccaagaagaaggtgcagaacatcaccaaggaggacgtgaagagctacctgttcagaaacgccttcgtgctgctgaccggcatggccgccctggacagcaaggccagcggcaagatgggcatgagagccgtggtgtactacatgaccaccaccatcatcgccgtggtgatcggcatcatcatcgtgatcatcatccaccccggcaagggcaccaaggagaacatgcacagagagggcaagatcgtgagagtgaccgccgccgacgccttcctggacctgatcagaaacatgttcccccccaacctggtggaggcctgcttcaagcagttcaagaccaactacgagaagagaagcttcaaggtgcccatccaggccaacgagaccctggtgggcgccgtgatcaacaacgtgagcgaggccatggagaccctgaccagaatcaccgaggagctggtgcccgtgcccggcagcgtgaacggcgtgaacgccctgggcctggtggtgttcagcatgtgcttcggcttcgtgatcggcaacatgaaggagcagggccaggccctgagagagttcttcgacagcctgaacgaggccatcatgagactggtggccgtgatcatgtggtacgcccccgtgggcatcctgttcctgatcgccggcaagatcgtggagatggaggacatgggcgtgatcggcggccagctggccatgtacaccgtgaccgtgatcgtgggcctgctgatccacgccgtgatcgtgctgcccctgctgtacttcctggtgaccagaaagaacccctgggtgttcatcggcggcctgctgcaggccctgatcaccgccctgggcaccagcagcagcagcgccaccctgcccatcaccttcaagtgcctggaggagaacaacggcgtggacaagagagtgaccagattcgtgctgcccgtgggcgccaccatcaacatggacggcaccgccctgtacgaggccctggccgccatcttcatcgcccaggtgaacaacttcgagctgaacttcggccagatcatcaccatcagcatcaccgccaccgccgccagcatcggcgccgccggcatcccccaggccggcctggtgaccatggtgatcgtgctgaccagcgtgggcctgcccaccgacgacatcaccctgatcatcgccgtggactggttcctggacagactgagaaccaccaccaacgtgctgggcgacagcctgggcgccggcatcgtggagcacctgagcagacacgagctgaagaacagagacgtggagatgggcaacagcgtgatcgaggagaacgagatgaagaagccctaccagctgatcgcccaggacaacgagaccgagaagcccatcgacagcgagaccaagatgtag

SEQ ID NO: 99342 - DNA, 324 bp, Artificial Sequence
  Description of Artificial Sequence: Synthetic coding sequence
atgaccaagagcaacggcgaggagcccaagatgggcggcagaatggagagattccagcagggcgtgagaaagagaaccctgctggccaagaagaaggtgcagaacatcaccaaggaggacgtgaagagctacctgttcagaaacgccttcgtgctgctgaccgtgaccgccgtgatcgtgggcaccatcctgggcttcaccctgagaccctacagaatgagctacagagaggtgaagtacttcagcttccccggcgagctgctgatgagaatgctgcagatgctggtgctgcccctgatcatcagcagcctggtgaccggctag

SEQ ID NO: 99343 - DNA, 324 bp, Artificial Sequence; identical to SEQ ID NO: 99342
  Description of Artificial Sequence: Synthetic coding sequence

SEQ ID NO: 99344 - DNA, 306 bp, Artificial Sequence
  Description of Artificial Sequence: Synthetic coding sequence
atgaccaagagcaacggcgaggagcccaagatgggcggcagaatggagagattccagcagggcgtgagaaagagaaccctgctggccaagaagaaggtgcagaacatcaccaaggaggacgtgaagagctacctgttcagaaacgccttcgtgctgctgaccgtgaccgccgtgatcgtgggcaccatcctgggcttcaccctgagaccctacagaatgagctacagagaggtgaagtacttcagcttccccggcgagctgctgatgagaatgctgcagatgctggtgctgcccctgatcatctag

SEQ ID NO: 99345 - DNA, 987 bp, Artificial Sequence
  Description of Artificial Sequence: Synthetic coding sequence
atgaccggcgtgttcgacagcctggtggccgacatgcacagcacccagatcgccgccagcagcacctaccaccagcaccagcagccccccagcggcggcggcgccggccccggcggcaacagcagcagcagcagcagcctgcacaagccccaggagagccccaccctgcccgtgagcaccgccaccgacagcagctactacaccaaccagcagcaccccgccggcggcggcggcggcggcggcagcccctacgcccacatgggcagctaccagtaccaggccagcggcctgaacaacgtgccctacagcgccaagagcagctacgacctgggctacaccgccgcctacaccagctacgccccctacggcaccagcagcagccccgccaacaacgagcccgagaaggaggacctggagcccgagatcagaatcgtgaacggcaagcccaagaaggtgagaaagcccagaaccatctacagcagcttccagctggccgccctgcagagaagattccagaagacccagtacctggccctgcccgagagagccgagctggccgccagcctgggcctgacccagacccaggtgaagatctggttccagaacagaagaagcaagttcaagaagatgtggaagagcggcgagatccccagcgagcagcaccccggcgccagcgccagccccccctgcgccagcccccccgtgagcgcccccgccagctgggacttcggcgtgccccagagaatggccggcggcggcggccccggcagcggcggcagcggcgccggcagcagcggcagcagccccagcagcgccgccagcgccttcctgggcaactacccctggtaccaccagaccagcggcagcgccagccacctgcaggccaccgcccccctgctgcaccccacccagaccccccagccccaccaccaccaccaccaccacggcggcggcggcgcccccgtgagcgccggcaccatcttctag

SEQ ID NO: 99346 - DNA, 1359 bp, Artificial Sequence
  Description of Artificial Sequence: Synthetic coding sequence
atgctgctgagaatgctgagaatgatcatcctgcccctggtggtgtgcagcctggtgagcggcgccgccagcctggacgccagctgcctgggcagactgggcggcatcgccgtggcctacttcggcctgaccaccctgagcgccagcgccctggccgtggccctggccttcatcatcaagcccggcagcggcgcccagaccctgcagagcagcgacctgggcctggaggacagcggccccccccccgtgcccaaggagaccgtggacagcttcctggacctggccagaaacctgttccccagcaacctggtggtggccgccttcagaacctacgccaccgactacaaggtggtgacccagaacagcagcagcggcaacgtgacccacgagaagatccccatcggcaccgagatcgagggcatgaacatcctgggcctggtgctgttcgccctggtgctgggcgtggccctgaagaagctgggcagcgagggcgaggacctgatcagattcttcaacagcctgaacgaggccaccatggtgctggtgagctggatcatgtggtacgtgcccgtgggcatcatgttcctggtgggcagcaagatcgtggagatgaaggacatcatcgtgctggtgaccagcctgggcaagtacatcttcgccagcatcctgggccacgtgatccacggcggcatcgtgctgcccctgatctacttcgtgttcaccagaaagaaccccttcagattcctgctgggcctgctggcccccttcgccaccgccttcgccacctgcagcagcagcgccaccctgcccagcatgatgaagtgcatcgaggagaacaacggcgtggacaagagaatcagcagattcatcctgcccatcggcgccaccgtgaacatggacggcgccgccatcttccagtgcgtggccgccgtgttcatcgcccagctgaacaacgtggagctgaacgccggccagatcttcaccatcctggtgaccgccaccgccagcagcgtgggcgccgccggcgtgcccgccggcggcgtgctgaccatcgccatcatcctggaggccatcggcctgcccacccacgacctgcccctgatcctggccgtggactggatcgtggacagaaccaccaccgtggtgaacgtggagggcgacgccctgggcgccggcatcctgcaccacctgaaccagaaggccaccaagaagggcgagcaggagctggccgaggtgaaggtggaggccatccccaactgcaagagcgaggaggagaccagccccctggtgacccaccagaaccccgccggccccgtggccagcgcccccgagctggagagcaaggagagcgtgctgtag

SEQ ID NO: 99347 - DNA, 705 bp, Artificial Sequence
  Description of Artificial Sequence: Synthetic coding sequence
atgaacatcctgggcctggtgctgttcgccctggtgctgggcgtggccctgaagaagctgggcagcgagggcgaggacctgatcagattcttcaacagcctgaacgaggccaccatggtgctggtgagctggatcatgtgcagcgccaccctgcccagcatgatgaagtgcatcgaggagaacaacggcgtggacaagagaatcagcagattcatcctgcccatcggcgccaccgtgaacatggacggcgccgccatcttccagtgcgtggccgccgtgttcatcgcccagctgaacaacgtggagctgaacgccggccagatcttcaccatcctggtgaccgccaccgccagcagcgtgggcgccgccggcgtgcccgccggcggcgtgctgaccatcgccatcatcctggaggccatcggcctgcccacccacgacctgcccctgatcctggccgtggactggatcgtggacagaaccaccaccgtggtgaacgtggagggcgacgccctgggcgccggcatcctgcaccacctgaaccagaaggccaccaagaagggcgagcaggagctggccgaggtgaaggtggaggccatccccaactgcaagagcgaggaggagaccagccccctggtgacccaccagaaccccgccggccccgtggccagcgcccccgagctggagagcaaggagagcgtgctgtag

SEQ ID NO: 99348 - DNA, 1575 bp, Artificial Sequence
  Description of Artificial Sequence: Synthetic coding sequence
atgggcaagcccgccagaaagggctgcgagtggaagagattcctgaagaacaactgggtgctgctgagcaccgtggccgccgtggtgctgggcatcaccaccggcgtgctggtgagagagcacagcaacctgagcaccctggagaagttctacttcgccttccccggcgagatcctgatgagaatgctgaagctgatcatcctgcccctgatcatcagcagcatgatcaccggcgtggccgccctggacagcaacgtgagcggcaagatcggcctgagagccgtggtgtactacttctgcaccaccctgatcgccgtgatcctgggcatcgtgctggtggtgagcatcaagcccggcgtgacccagaaggtgggcgagatcgccagaaccggcagcacccccgaggtgagcaccgtggacgccatgctggacctgatcagaaacatgttccccgagaacctggtgcaggcctgcttccagcagtacaagaccaagagagaggaggtgaagccccccagcgaccccgagatgaacatgaccgaggagagcttcaccgccgtgatgaccaccgccatcagcaagaacaagaccaaggagtacaagatcgtgggcatgtacagcgacggcatcaacgtgctgggcctgatcgtgttctgcctggtgttcggcctggtgatcggcaagatgggcgagaagggccagatcctggtggacttcttcaacgccctgagcgacgccaccatgaagatcgtgcagatcatcatgtgctacatgcccctgggcatcctgttcctgatcgccggcaagatcatcgaggtggaggactgggagatcttcagaaagctgggcctgtacatggccaccgtgctgaccggcctggccatccacagcatcgtgatcctgcccctgatctacttcatcgtggtgagaaagaaccccttcagattcgccatgggcatggcccaggccctgctgaccgccctgatgatcagcagcagcagcgccaccctgcccgtgaccttcagatgcgccgaggagaacaaccaggtggacaagagaatcaccagattcgtgctgcccgtgggcgccaccatcaacatggacggcaccgccctgtacgaggccgtggccgccgtgttcatcgcccagctgaacgacctggacctgggcatcggccagatcatcaccatcagcatcaccgccaccagcgccagcatcggcgccgccggcgtgccccaggccggcctggtgaccatggtgatcgtgctgagcgccgtgggcctgcccgccgaggacgtgaccctgatcatcgccgtggactggctgctggacagattcagaaccatggtgaacgtgctgggcgacgccttcggcaccggcatcgtggagaagctgagcaagaaggagctggagcagatggacgtgagcagcgaggtgaacatcgtgaaccccttcgccctggagagcaccatcctggacaacgaggacagcgacaccaagaagagctacgtgaacggcggcttcgccgtggacaagagcgacaccatcagcttcacccagaccagccagttctag

SEQ ID NO: 99349 - DNA, 729 bp, Artificial Sequence
  Description of Artificial Sequence: Synthetic coding sequence
tgattcttcaacgccctgagcgacgccaccatgaagatcgtgcagatcatcatgtgctacatgcccctgggcatcctgttcctgatcgccggcaagatcatcgaggtggaggactgggagatcttcagaaagctgggcctgtacatggccaccgtgctgaccggcctggccatccacagcatcgtgatcctgcccctgatctacttcatcgtggtgagaaagaaccccttcagattcgccatgggcatggcccaggccctgctgaccgccctgatgatcagcagcagcagcgccaccctgcccgtgaccttcagatgcgccgaggagaacaaccaggtggacaagagaatcaccagattcgtgctgcccgtgggcgccaccatcaacatggacggcaccgccctgtacgaggccgtggccgccgtgttcatcgcccagctgaacgacctggacctgggcatcggccagatcatcaccatcagagacagattcagaaccatggtgaacgtgctgggcgacgccttcggcaccggcatcgtggagaagctgagcaagaaggagctggagcagatggacgtgagcagcgaggtgaacatcgtgaaccccttcgccctggagagcaccatcctggacaacgaggacagcgacaccaagaagagctacgtgaacggcggcttcgccgtggacaagagcgacaccatcagcttcacccagaccagccagttctag

SEQ ID NO: 99350 - DNA, 1647 bp, Artificial Sequence
  Description of Artificial Sequence: Synthetic coding sequence
gagacccccgtgctgcccatcatggtggccgacccccccagagacagcaagggcctggccgccgccgagcccaccgccaacggcggcctggccctggccagcatcgaggaccagggcgccgccgccggcggctactgcggcagcagagaccaggtgagaagatgcctgagagccaacctgctggtgctgctgaccgtggtggccgtggtggccggcgtggccctgggcctgggcgtgagcggcgccggcggcgccctggccctgggccccgagagactgagcgccttcgtgttccccggcgagctgctgctgagactgctgagaatgatcatcctgcccctggtggtgtgcagcctgatcggcggcgccgccagcctggaccccggcgccctgggcagactgggcgcctgggccctgctgttcttcctggtgaccaccctgctggccagcgccctgggcgtgggcctggccctggccctgcagcccggcgccgccagcgccgccatcaacgccagcgtgggcgccgccggcagcgccgagaacgcccccagcaaggaggtgctggacagcttcctggacctggccagaaacatcttccccagcaacctggtgagcgccgccttcagaagctacagcaccacctacgaggagagaaacatcaccggcaccagagtgaaggtgcccgtgggccaggaggtggagggcatgaacatcctgggcctggtggtgttcgccatcgtgttcggcgtggccctgagaaagctgggccccgagggcgagctgctgatcagattcttcaacagcttcaacgaggccaccatggtgctggtgagctggatcatgtggtacgcccccgtgggcatcatgttcctggtggccggcaagatcgtggagatggaggacgtgggcctgctgttcgccagactgggcaagtacatcctgtgctgcctgctgggccacgccatccacggcctgctggtgctgcccctgatctacttcctgttcaccagaaagaacccctacagattcctgtggggcatcgtgacccccctggccaccgccttcggcaccagcagcagcagcgccaccctgcccctgatgatgaagtgcgtggaggagaacaacggcgtggccaagcacatcagcagattcatcctgcccatcggcgccaccgtgaacatggacggcgccgccctgttccagtgcgtggccgccgtgttcatcgcccagctgagccagcagagcctggacttcgtgaagatcatcaccatcctggtgaccgccaccgccagcagcgtgggcgccgccggcatccccgccggcggcgtgctgaccctggccatcatcctggaggccgtgaacctgcccgtggaccacatcagcctgatcctggccgtggactggctggtggacagaagctgcaccgtgctgaacgtggagggcgacgccctgggcgccggcctgctgcagaactacgtggacagaaccgagagcagaagcaccgagcccgagctgatccaggtgaagagcgagctgcccctggaccccctgcccgtgcccaccgaggagggcaaccccctgctgaagcactacagaggccccgccggcgacgccaccgtggccagcgagaaggagagcgtgatgtag

SEQ ID NO: 99351 - DNA, 942 bp, Artificial Sequence
  Description of Artificial Sequence: Synthetic coding sequence
atgaacatcctgggcctggtggtgttcgccatcgtgttcggcgtggccctgagaaagctgggccccgagggcgagctgctgatcagattcttcaacagcttcaacgaggccaccatggtgctggtgagctggatcatgtggtacgcccccgtgggcatcatgttcctggtggccggcaagatcgtggagatggaggacgtgggcctgctgttcgccagactgggcaagtacatcctgtgctgcctgctgggccacgccatccacggcctgctggtgctgcccctgatctacttcctgttcaccagaaagaacccctacagattcctgtggggcatcgtgacccccctggccaccgccttcggcaccagcagcagcagcgccaccctgcccctgatgatgaagtgcgtggaggagaacaacggcgtggccaagcacatcagcagattcatcctgcccatcggcgccaccgtgaacatggacggcgccgccctgttccagtgcgtggccgccgtgttcatcgcccagctgagccagcagagcctggacttcgtgaagatcatcaccatcctggtgaccgccaccgccagcagcgtgggcgccgccggcatccccgccggcggcgtgctgaccctggccatcatcctggaggccgtgaacctgcccgtggaccacatcagcctgatcctggccgtggactggctggtggacagaagctgcaccgtgctgaacgtggagggcgacgccctgggcgccggcctgctgcagaactacgtggacagaaccgagagcagaagcaccgagcccgagctgatccaggtgaagagcgagctgcccctggaccccctgcccgtgcccaccgaggagggcaaccccctgctgaagcactacagaggccccgccggcgacgccaccgtggccagcgagaaggagagcgtgatgtag

SEQ ID NO: 99352 - DNA, 1020 bp, Artificial Sequence
  Description of Artificial Sequence: Synthetic coding sequence
atgtacagcaccacctacgaggagagaaacatcaccggcaccagagtgaaggtgcccgtgggccaggaggtggagggcatgaacatcctgggcctggtggtgttcgccatcgtgttcggcgtggccctgagaaagctgggccccgagggcgagctgctgatcagattcttcaacagcttcaacgaggccaccatggtgctggtgagctggatcatgtggtacgcccccgtgggcatcatgttcctggtggccggcaagatcgtggagatggaggacgtgggcctgctgttcgccagactgggcaagtacatcctgtgctgcctgctgggccacgccatccacggcctgctggtgctgcccctgatctacttcctgttcaccagaaagaacccctacagattcctgtggggcatcgtgacccccctggccaccgccttcggcaccagcagcagcagcgccaccctgcccctgatgatgaagtgcgtggaggagaacaacggcgtggccaagcacatcagcagattcatcctgcccatcggcgccaccgtgaacatggacggcgccgccctgttccagtgcgtggccgccgtgttcatcgcccagctgagccagcagagcctggacttcgtgaagatcatcaccatcctggtgaccgccaccgccagcagcgtgggcgccgccggcatccccgccggcggcgtgctgaccctggccatcatcctggaggccgtgaacctgcccgtggaccacatcagcctgatcctggccgtggactggctggtggacagaagctgcaccgtgctgaacgtggagggcgacgccctgggcgccggcctgctgcagaactacgtggacagaaccgagagcagaagcaccgagcccgagctgatccaggtgaagagcgagctgcccctggaccccctgcccgtgcccaccgaggagggcaaccccctgctgaagcactacagaggccccgccggcgacgccaccgtggccagcgagaaggagagcgtgatgtag

SEQ ID NO: 99353 - DNA, 1626 bp, Artificial Sequence
  Description of Artificial Sequence: Synthetic coding sequence
atggtggccgacccccccagagacagcaagggcctggccgccgccgagcccaccgccaacggcggcctggccctggccagcatcgaggaccagggcgccgccgccggcggctactgcggcagcagagaccaggtgagaagatgcctgagagccaacctgctggtgctgctgaccgtggtggccgtggtggccggcgtggccctgggcctgggcgtgagcggcgccggcggcgccctggccctgggccccgagagactgagcgccttcgtgttccccggcgagctgctgctgagactgctgagaatgatcatcctgcccctggtggtgtgcagcctgatcggcggcgccgccagcctggaccccggcgccctgggcagactgggcgcctgggccctgctgttcttcctggtgaccaccctgctggccagcgccctgggcgtgggcctggccctggccctgcagcccggcgccgccagcgccgccatcaacgccagcgtgggcgccgccggcagcgccgagaacgcccccagcaaggaggtgctggacagcttcctggacctggccagaaacatcttccccagcaacctggtgagcgccgccttcagaagctacagcaccacctacgaggagagaaacatcaccggcaccagagtgaaggtgcccgtgggccaggaggtggagggcatgaacatcctgggcctggtggtgttcgccatcgtgttcggcgtggccctgagaaagctgggccccgagggcgagctgctgatcagattcttcaacagcttcaacgaggccaccatggtgctggtgagctggatcatgtggtacgcccccgtgggcatcatgttcctggtggccggcaagatcgtggagatggaggacgtgggcctgctgttcgccagactgggcaagtacatcctgtgctgcctgctgggccacgccatccacggcctgctggtgctgcccctgatctacttcctgttcaccagaaagaacccctacagattcctgtggggcatcgtgacccccctggccaccgccttcggcaccagcagcagcagcgccaccctgcccctgatgatgaagtgcgtggaggagaacaacggcgtggccaagcacatcagcagattcatcctgcccatcggcgccaccgtgaacatggacggcgccgccctgttccagtgcgtggccgccgtgttcatcgcccagctgagccagcagagcctggacttcgtgaagatcatcaccatcctggtgaccgccaccgccagcagcgtgggcgccgccggcatccccgccggcggcgtgctgaccctggccatcatcctggaggccgtgaacctgcccgtggaccacatcagcctgatcctggccgtggactggctggtggacagaagctgcaccgtgctgaacgtggagggcgacgccctgggcgccggcctgctgcagaactacgtggacagaaccgagagcagaagcaccgagcccgagctgatccaggtgaagagcgagctgcccctggaccccctgcccgtgcccaccgaggagggcaaccccctgctgaagcactacagaggccccgccggcgacgccaccgtggccagcgagaaggagagcgtgatgtag

SEQ ID NO: 99354 - DNA, 1308 bp, Artificial Sequence
  Description of Artificial Sequence: Synthetic coding sequence
atggccgagagcagcagcgagagcgaccacttcagatgcagagacagactgagcccctgggccgccagaagcacccacagaggcaccagaagcctgcccaccgtggaggtgaccgagaaggtgaacaccatcaccagcaccctgcaggacaccagcagaaacctgagacaggtggaccagatgctgggcagatacagagagtacagcaacggccaggccggcgccatcgagcacctgaaggagagcctggagcagagcatcgaccagctgagaagccagagactgctgagaaacagcggcggcagaagcatcagcgtgaccagcctgagcgccagcgacctggacggcggcaccggcagcgagctgcaccacttcccccccaccagccccctgaaggactacggcgacccccagggcatcaagagaatgagaagcagaaccggcgtgagattcgtgcaggagaccgacgacatgacccagctgcacggcttccaccagagcctgagagacctgagcagcgagcagatcagactgggcgacgacttcaacagagagctgagcagaagaagcagaagcgacgccgagaccaagagagccctggaggagctgaccgagaagctgaacgaggcccagaagcaggaggtggtgagcgacagagtggagagaagactgcaggagctggagagagagatgagaaccgagagagagctggtggagagaagacaggaccagctgggcctgatgagcctgcagctgcaggaggccctgaagaagcaggaggccaaggccgacgagcacgagggcgccatcaagaacaagctgagacagaccgagaccgagaagaaccagctggagcaggagctggagctgagcagaagactgctgaaccagagcgagggcagcagagagaccctgctgcaccaggtggaggagctgagaacccagctgaccaaggccgagggcgacagaaagggcctgcagcaccaggtgagccagatcagcaagcagcagagcaactaccaggacgagcagggcgaggactggagattcagaagaggcgtggagagagagaagcaggacctggagaagcagatgagcgacctgagagtgcagctgaacttcagcgccatggccagcgagctggaggaggtgaagagatgcatggagagaaaggacaaggagaaggcccacctggccagccaggtggagcacatcaacagaaagtgcctgctgaacctggtgcaggacctggactgcaaggacaacgagatcctgacctacagcctgcagagccccctgcacgtgtag

SEQ ID NO: 99355 - DNA, 1047 bp, Artificial Sequence
  Description of Artificial Sequence: Synthetic coding sequence
atgaacgaccccaacagctgcgtggacaacgccaccgtgtgcagcggcgccagctgcgtggtgcccgagagcaacttcaacaacatcctgagcgtggtgctgagcaccgtgctgaccatcctgctggccctggtgatgttcagcatgggctgcaacgtggagatcaagaagttcctgggccacatcaagagaccctggggcatctgcgtgggcttcctgtgccagttcggcatcatgcccctgaccggcttcatcctgagcgtggccttcgacatcctgcccctgcaggccgtggtggtgctgatcatcggctgctgccccggcggcaccgccagcaacatcctggcctactgggtggacggcgacatggacctgagcgtgagcatgaccacctgcagcaccctgctggccctgggcatgatgcccctgtgcctgctgatctacaccaagatgtgggtggacagcggcagcatcgtgatcccctacgacaacatcggcaccagcctggtgagcctggtggtgcccgtgagcatcggcatgttcgtgaaccacaagtggccccagaaggccaagatcatcctgaagatcggcagcatcgccggcgccatcctgatcgtgctgatcgccgtggtgggcggcatcctgtaccagagcgcctggatcatcgcccccaagctgtggatcatcggcaccatcttccccgtggccggctacagcctgggcttcctgctggccagaatcgccggcctgccctggtacagatgcagaaccgtggccttcgagaccggcatgcagaacacccagctgtgcagcaccatcgtgcagctgagcttcacccccgaggagctgaacgtggtgttcaccttccccctgatctacagcatcttccagctggccttcgccgccatcttcctgggcttctacgtggcctacaagaagtgccacggcaagaacaaggccgagatccccgagagcaaggagaacggcaccgagcccgagagcagcttctacaaggccaacggcggcttccagcccgacgagaagtag

SEQ ID NO: 99356 - DNA, 1434 bp, Artificial Sequence
  Description of Artificial Sequence: Synthetic coding sequence
atggtgctgatgcaggacaagggcagcagccagcagtggcccggcctgggcggcgagggcggcggcaccggccccctgagcatgctgagagccgccctgctgctgatcagcctgccctggggcgcccagggcaccgccagcaccagcctgagcaccgccggcggccacaccgtgccccccaccggcggcagatacctgagcatcggcgacggcagcgtgatggagttcgagttccccgaggacagcgagggcatcatcgtgatcagcagccagtaccccggccaggccaacagaaccgcccccggccccatgctgagagtgaccagcctggacaccgaggtgctgaccatcaagaacgtgagcgccatcacctggggcggcggcggcggcttcgtggtgagcatccacagcggcctggccggcctggcccccctgcacatccagctggtggacgcccacgaggccccccccaccctgatcgaggagagaagagacttctgcatcaaggtgagccccgccgaggacacccccgccaccctgagcgccgacctggcccacttcagcgagaaccccatcctgtacctgctgctgcccctgatcttcgtgaacaagtgcagcttcggctgcaaggtggagctggaggtgctgaagggcctgatgcagagcccccagcccatgctgctgggcctgctgggccagttcctggtgatgcccctgtacgccttcctgatggccaaggtgttcatgctgcccaaggccctggccctgggcctgatcatcacctgcagcagccccggcggcggcggcagctacctgttcagcctgctgctgggcggcgacgtgaccctggccatcagcatgaccttcctgagcaccgtggccgccaccggcttcctgcccctgagcagcgccatctacagcagactgctgagcatccacgagaccctgcacgtgcccatcagcaagatcctgggcaccctgctgttcatcgccatccccatcgccgtgggcgtgctgatcaagagcaagctgcccaagttcagccagctgctgctgcaggtggtgaagcccttcagcttcgtgctgctgctgggcggcctgttcctggcctacagaatgggcgtgttcatcctggccggcatcagactgcccatcgtgctggtgggcatcaccgtgcccctggtgggcctgctggtgggctactgcctggccacctgcctgaagctgcccgtggcccagagaagaaccgtgagcatcgaggtgggcgtgcagaacagcctgctggccctggccatgctgcagctgagcctgagaagactgcaggccgactacgccagccaggcccccttcatcgtggccctgagcggcaccagcgagatgctggccctggtgatcggccacttcatctacagcagcctgttccccgtgccctag

SEQ ID NO: 99357 - DNA, 1347 bp, Artificial Sequence
  Description of Artificial Sequence: Synthetic coding sequence
atggtgctgatgcaggacaagggcagcagccagcagtggcccggcctgggcggcgagggcggcggcaccggccccctgagcatgctgagagccgccctgctgctgatcagcctgccctggggcgcccagggcaccgccagcaccagcctgagcaccgccggcggccacaccgtgccccccaccggcggcagatacctgagcatcggcgacggcagcgtgatggagttcgagttccccgaggacagcgagggcatcatcgtgatcagcagccagtaccccggccaggccaacagaaccgcccccggccccatgctgagagtgaccagcctggacaccgaggtgctgaccatcaagaacctggtggacgcccacgaggccccccccaccctgatcgaggagagaagagacttctgcatcaaggtgagccccgccgaggacacccccgccaccctgagcgccgacctggcccacttcagcgagaaccccatcctgtacctgctgctgcccctgatcttcgtgaacaagtgcagcttcggctgcaaggtggagctggaggtgctgaagggcctgatgcagagcccccagcccatgctgctgggcctgctgggccagttcctggtgatgcccctgtacgccttcctgatggccaaggtgttcatgctgcccaaggccctggccctgggcctgatcatcacctgcagcagccccggcggcggcggcagctacctgttcagcctgctgctgggcggcgacgtgaccctggccatcagcatgaccttcctgagcaccgtggccgccaccggcttcctgcccctgagcagcgccatctacagcagactgctgagcatccacgagaccctgcacgtgcccatcagcaagatcctgggcaccctgctgttcatcgccatccccatcgccgtgggcgtgctgatcaagagcaagctgcccaagttcagccagctgctgctgcaggtggtgaagcccttcagcttcgtgctgctgctgggcggcctgttcctggcctacagaatgggcgtgttcatcctggccggcatcagactgcccatcgtgctggtgggcatcaccgtgcccctggtgggcctgctggtgggctactgcctggccacctgcctgaagctgcccgtggcccagagaagaaccgtgagcatcgaggtgggcgtgcagaacagcctgctggccctggccatgctgcagctgagcctgagaagactgcaggccgactacgccagccaggcccccttcatcgtggccctgagcggcaccagcgagatgctggccctggtgatcggccacttcatctacagcagcctgttccccgtgccctag

SEQ ID NO: 99358 - DNA, 1599 bp, Artificial Sequence
  Description of Artificial Sequence: Synthetic coding sequence
atggccggccccagaccccccggcgacagccccgccatcaaggaggacagcaccggcctgggccccacccacgagcccttcagcggccagcccaacagcaccagcggcgacgtgctgctgagcagaagaggccccggccacgccatcagaccccccggcagagccatggtgctgatgcaggacaagggcagcagccagcagtggcccggcctgggcggcgagggcggcggcaccggccccctgagcatgctgagagccgccctgctgctgatcagcctgccctggggcgcccagggcaccgccagcaccagcctgagcaccgccggcggccacaccgtgccccccaccggcggcagatacctgagcatcggcgacggcagcgtgatggagttcgagttccccgaggacagcgagggcatcatcgtgatcagcagccagtaccccggccaggccaacagaaccgcccccggccccatgctgagagtgaccagcctggacaccgaggtgctgaccatcaagaacgtgagcgccatcacctggggcggcggcggcggcttcgtggtgagcatccacagcggcctggccggcctggcccccctgcacatccagctggtggacgcccacgaggccccccccaccctgatcgaggagagaagagacttctgcatcaaggtgagccccgccgaggacacccccgccaccctgagcgccgacctggcccacttcagcgagaaccccatcctgtacctgctgctgcccctgatcttcgtgaacaagtgcagcttcggctgcaaggtggagctggaggtgctgaagggcctgatgcagagcccccagcccatgctgctgggcctgctgggccagttcctggtgatgcccctgtacgccttcctgatggccaaggtgttcatgctgcccaaggccctggccctgggcctgatcatcacctgcagcagccccggcggcggcggcagctacctgttcagcctgctgctgggcggcgacgtgaccctggccatcagcatgaccttcctgagcaccgtggccgccaccggcttcctgcccctgagcagcgccatctacagcagactgctgagcatccacgagaccctgcacgtgcccatcagcaagatcctgggcaccctgctgttcatcgccatccccatcgccgtgggcgtgctgatcaagagcaagctgcccaagttcagccagctgctgctgcaggtggtgaagcccttcagcttcgtgctgctgctgggcggcctgttcctggcctacagaatgggcgtgttcatcctggccggcatcagactgcccatcgtgctggtgggcatcaccgtgcccctggtgggcctgctggtgggctactgcctggccacctgcctgaagctgcccgtggcccagagaagaaccgtgagcatcgaggtgggcgtgcagaacagcctgctggccctggccatgctgcagctgagcctgagaagactgcaggccgactacgccagccaggcccccttcatcgtggccctgagcggcaccagcgagatgctggccctggtgatcggccacttcatctacagcagcctgttccccgtgccctag

SEQ ID NO: 99359 - DNA, 1434 bp, Artificial Sequence; identical to SEQ ID NO: 99356
  Description of Artificial Sequence: Synthetic coding sequence

SEQ ID NO: 99360 - DNA, 657 bp, Artificial Sequence
  Description of Artificial Sequence: Synthetic coding sequence
atggtgctgatgcaggacaagggcagcagccagcagtggcccggcctgggcggcgagggcggcggcaccggccccctgagcatgctgagagccgccctgctgctgatcagcctgccctggggcgcccagggcaccgccagcaccagcctgagcaccgccggcggccacaccgtgccccccaccggcggcagatacctgagcatcggcgacggcagcgtgatggagttcgagttccccgaggacagcgagggcatcatcgtgatcagcagccagtaccccggccaggccaacagaaccgcccccggccccatgctgagagtgaccagcctggacaccgaggtgctgaccatcaagaacgtgagcgccatcacctggggcggcggcggcggcttcgtggtgagcatccacagcggcctggccggcctggcccccctgcacatccagctggtggacgcccacgaggccccccccaccctgatcgaggagagaagagacttctgcatcaaggtgagccccgccgaggacacccccgccaccctgagcgccgacctggcccacttcagcgagaaccccatcctgtacctgctgctgcccctgatcttcgtgaacaagtgcagcttcggctgcaaggtggagctggaggtgctgaagggctag

SEQ ID NO: 99361 - DNA, 1314 bp, Artificial Sequence
  Description of Artificial Sequence: Synthetic coding sequence
atggacggcaacgacaacgtgaccctgctgttcgcccccctgctgagagacaactacaccctggcccccaacgccagcagcctgggccccggcaccgacctggccctggcccccgccagcagcgccggccccggccccggcctgagcctgggccccggccccagcttcggcttcagccccggccccacccccacccccgagcccaccaccagcggcctggccggcggcgccgccagccacggccccagccccttccccagaccctgggccccccacgccctgcccttctgggacacccccctgaaccacggcctgaacgtgttcgtgggcgccgccctgtgcatcaccatgctgggcctgggctgcaccgtggacgtgaaccacttcggcgcccacgtgagaagacccgtgggcgccctgctggccgccctgtgccagttcggcctgctgcccctgctggccttcctgctggccctggccttcaagctggacgaggtggccgccgtggccgtgctgctgtgcggctgctgccccggcggcaacctgagcaacctgatgagcctgctggtggacggcgacatgaacctgagcatcatcatgaccatcagcagcaccctgctggccctggtgctgatgcccctgtgcctgtggatctacagctgggcctggatcaacacccccatcgtgcagctgctgcccctgggcaccgtgaccctgaccctgtgcagcaccctgatccccatcggcctgggcgtgttcatcagatacaagtacagcagagtggccgactacatcgtgaaggtgagcctgtggagcctgctggtgaccctggtggtgctgttcatcatgaccggcaccatgctgggccccgagctgctggccagcatccccgccgccgtgtacgtgatcgccatcttcatgcccctggccggctacgccagcggctacggcctggccaccctgttccacctgccccccaactgcaagagaaccgtgtgcctggagaccggcagccagaacgtgcagctgtgcaccgccatcctgaagctggccttccccccccagttcatcggcagcatgtacatgttccccctgctgtacgccctgttccagagcgccgaggccggcatcttcgtgctgatctacaagatgtacggcagcgagatgctgcacaagagagaccccctggacgaggacgaggacaccgacatcagctacaagaagctgaaggaggaggagatggccgacaccagctacggcaccgtgaaggccgagaacatcatcatgatggagaccgcccagaccagcctgtag

SEQ ID NO: 99362 - DNA, 1134 bp, Artificial Sequence
  Description of Artificial Sequence: Synthetic coding sequence
atgagagccaactgcagcagcagcagcgcctgccccgccaacagcagcgaggaggagctgcccgtgggcctggaggtgcacggcaacctggagctggtgttcaccgtggtgagcaccgtgatgatgggcctgctgatgttcagcctgggctgcagcgtggagatcagaaagctgtggagccacatcagaagaccctggggcatcgccgtgggcctgctgtgccagttcggcctgatgcccttcaccgcctacctgctggccatcagcttcagcctgaagcccgtgcaggccatcgccgtgctgatcatgggctgctgccccggcggcaccatcagcaacatcttcaccttctgggtggacggcgacatggacctgagcatcagcatgaccacctgcagcaccgtggccgccctgggcatgatgcccctgtgcatctacctgtacacctggagctggagcctgcagcagaacctgaccatcccctaccagaacatcggcatcaccctggtgtgcctgaccatccccgtggccttcggcgtgtacgtgaactacagatggcccaagcagagcaagatcatcctgaagatcggcgccgtggtgggcggcgtgctgctgctggtggtggccgtggccggcgtggtgctggccaagggcagctggaacagcgacatcaccctgctgaccatcagcttcatcttccccctgatcggccacgtgaccggcttcctgctggccctgttcacccaccagagctggcagagatgcagaaccatcagcctggagaccggcgcccagaacatccagatgtgcatcaccatgctgcagctgagcttcaccgccgagcacctggtgcagatgctgagcttccccctggcctacggcctgttccagctgatcgacggcttcctgatcgtggccgcctaccagacctacaagagaagactgaagaacaagcacggcaagaagaacagcggctgcaccgaggtgtgccacaccagaaagagcaccagcagcagagagaccaacgccttcctggaggtgaacgaggagggcgccatcacccccggcccccccggccccatggactgccacagagccctggagcccgtgggccacatcaccagctgcgagtag

SEQ ID NO: 99363 - DNA, 2184 bp, Artificial Sequence; identical to SEQ ID NO: 90366
  Description of Artificial Sequence: Synthetic coding sequence

SEQ ID NO: 99364 - DNA, 492 bp, Artificial Sequence
  Description of Artificial Sequence: Synthetic coding sequence
atgaccggcgacaagggcccccagagactgagcggcagcagctacggcagcatcagcagccccaccagccccaccagccccggcccccagcaggccccccccagagagacctacctgagcgagaagatccccatccccgacaccaagcccggcaccttcagcctgagaaagctgtgggccttcaccggccccggcttcctgatgagcatcgccttcctggaccccggcaacatcgagagcgacctgcaggccggcgccgtggccggcttcaagctgctgtgggtgctgctgtgggccaccgtgctgggcctgctgtgccagagactggccgccagactgggcgtggtgaccggcaaggacctgggcgaggtgtgccacctgtactaccccaagagcgagagcagaagcgtggcccagagcggcgtgcagtggtgcgacgtgagcagcctgcagcccctgccccccagatgccccgcccccagcagcggctag

SEQ ID NO: 99365 - DNA, 1299 bp, Artificial Sequence
  Description of Artificial Sequence: Synthetic coding sequence
atggtgagatgccagctgaccgccaccagcaccagccaggtgcccagaaccgtgctgtggctgaccatcgagctggccatcgtgggcagcgacatgcaggaggtgatcggcaccgccatcgccttcaacctgctgagcgccggcagaatccccctgtggggcggcgtgctgatcaccatcgtggacaccttcttcttcctgttcctggacaactacggcctgagaaagctggaggccttcttcggcctgctgatcaccatcatggccctgaccttcggctacgagtacgtggtggccagacccgagcagggcgccctgctgagaggcctgttcctgcccagctgccccggctgcggccaccccgagctgctgcaggccgtgggcatcgtgggcgccatcatcatgccccacaacatctacctgcacagcgccctggtgaagagcagagagatcgacagagccagaagagccgacatcagagaggccaacatgtacttcctgatcgaggccaccatcgccctgagcgtgagcttcatcatcaacctgttcgtgatggccgtgttcggccaggccttctaccagaagaccaaccaggccgccttcaacatctgcgccaacagcagcctgcacgactacgccaagatcttccccatgaacaacgccaccgtggccgtggacatctaccagggcggcgtgatcctgggctgcctgttcggccccgccgccctgtacatctgggccatcggcctgctggccgccggccagagcagcaccatgaccggcacctacgccggccagttcgtgatggagggcttcctgagactgagatggagcagattcgccagagtgctgctgaccagaagctgcgccatcctgcccaccgtgctggtggccgtgttcagagacctgagagacctgagcggcctgaacgacctgctgaacgtgctgcagagcctgctgctgcccttcgccgtgctgcccatcctgaccttcaccagcatgcccaccctgatgcaggagttcgccaacggcctgctgaacaaggtggtgaccagcagcatcatggtgctggtgtgcgccatcaacctgtacttcgtggtgagctacctgcccagcctgccccaccccgcctacttcggcctggccgccctgctggccgccgcctacctgggcctgagcacctacctggtgtggacctgctgcctggcccacggcgccaccttcctggcccacagcagccaccaccacttcctgtacggcctgctggaggaggaccagaagggcgagaccagcggctag

SEQ ID NO: 99366 - DNA, 3351 bp, Artificial Sequence
  Description of Artificial Sequence: Synthetic coding sequence
atgctgaacaacctgaccgactgcgaggacggcgacggcggcgccaaccccggcgacggcaaccccaaggagagcagccccttcatcaacagcaccgacaccgagaagggcaaggagtacgacggcaagaacatggccctgttcgaggaggagatggacaccagccccatggtgagcagcctgctgagcggcctggccaactacaccaacctgccccagggcagcagagagcacgaggaggccgagaacaacgagggcggcaagaagaagcccgtgcaggcccccagaatgggcaccttcatgggcgtgtacctgccctgcctgcagaacatcttcggcgtgatcctgttcctgagactgacctgggtggtgggcatcgccggcatcatggagagcttctgcatggtgttcatctgctgcagctgcaccatgctgaccgccatcagcatgagcgccatcgccaccaacggcgtggtgcccgccggcggcagctactacatgatcagcagaagcctgggccccgagttcggcggcgccgtgggcctgtgcttctacctgggcaccaccttcgccggcgccatgtacatcctgggcaccatcgagatcctgctggcctacctgttccccgccatggccatcttcaaggccgaggacgccagcggcgaggccgccgccatgctgaacaacatgagagtgtacggcacctgcgtgctgacctgcatggccaccgtggtgttcgtgggcgtgaagtacgtgaacaagttcgccctggtgttcctgggctgcgtgatcctgagcatcctggccatctacgccggcgtgatcaagagcgccttcgacccccccaacttccccatctgcctgctgggcaacagaaccctgagcagacacggcttcgacgtgtgcgccaagctggcctgggagggcaacgagaccgtgaccaccagactgtggggcctgttctgcagcagcagattcctgaacgccacctgcgacgagtacttcaccagaaacaacgtgaccgagatccagggcatccccggcgccgccagcggcctgatcaaggagaacctgtggagcagctacctgaccaagggcgtgatcgtggagagaagcggcatgaccagcgtgggcctggccgacggcacccccatcgacatggaccacccctacgtgttcagcgacatgaccagctacttcaccctgctggtgggcatctacttccccagcgtgaccggcatcatggccggcagcaacagaagcggcgacctgagagacgcccagaagagcatccccaccggcaccatcctggccatcgccaccaccagcgccgtgtacatcagcagcgtggtgctgttcggcgcctgcatcgagggcgtggtgctgagagacaagttcggcgaggccgtgaacggcaacctggtggtgggcaccctggcctggcccagcccctgggtgatcgtgatcggcagcttcttcagcacctgcggcgccggcctgcagagcctgaccggcgcccccagactgctgcaggccatcagcagagacggcatcgtgcccttcctgcaggtgttcggccacggcaaggccaacggcgagcccacctgggccctgctgctgaccgcctgcatctgcgagatcggcatcctgatcgccagcctggacgaggtggcccccatcctgagcatgttcttcctgatgtgctacatgttcgtgaacctggcctgcgccgtgcagaccctgctgagaacccccaactggagacccagattcagatactaccactggaccctgagcttcctgggcatgagcctgtgcctggccctgatgttcatctgcagctggtactacgccctggtggccatgctgatcgccggcctgatctacaagtacatcgagtacagaggcgccgagaaggagtggggcgacggcatcagaggcctgagcctgagcgccgccagatacgccctgctgagactggaggagggccccccccacaccaagaactggagaccccagctgctggtgctggtgagagtggaccaggaccagaacgtggtgcacccccagctgctgagcctgaccagccagctgaaggccggcaagggcctgaccatcgtgggcagcgtgctggagggcaccttcctggagaaccacccccaggcccagagagccgaggagagcatcagaagactgatggaggccgagaaggtgaagggcttctgccaggtggtgatcagcagcaacctgagagacggcgtgagccacctgatccagagcggcggcctgggcggcctgcagcacaacaccgtgctggtgggctggcccagaaactggagacagaaggaggaccaccagacctggagaaacttcatcgagctggtgagagagaccaccgccggccacctggccctgctggtgaccaagaacgtgagcatgttccccggcaaccccgagagattcagcgagggcagcatcgacgtgtggtggatcgtgcacgacggcggcatgctgatgctgctgcccttcctgctgagacaccacaaggtgtggagaaagtgcaagatgagaatcttcaccgtggcccagatggacgacaacagcatccagatgaagaaggacctgaccaccttcctgtaccacctgagaatcaccgccgaggtggaggtggtggagatgcacgagagcgacatcagcgcctacacctacgagaagaccctggtgatggagcagagaagccagatcctgaagcagatgcacctgaccaagaacgagagagagagagagatccagagcatcaccgacgagagcagaggcagcatcagaagaaagaaccccgccaacaccagactgagactgaacgtgcccgaggagaccgccggcgacagcgaggagaagcccgaggaggaggtgcagctgatccacgaccagagcgcccccagctgccccagcagcagccccagccccggcgaggagcccgagggcgagggcgagaccgaccccgagaaggtgcacctgacctggaccaaggacaagagcgtggccgagaagaacaagggccccagccccgtgagcagcgagggcatcaaggacttcttcagcatgaagcccgagtgggagaacctgaaccagagcaacgtgagaagaatgcacaccgccgtgagactgaacgaggtgatcgtgaagaagagcagagacgccaagctggtgctgctgaacatgcccggcccccccagaaacagaaacggcgacgagaactacatggagttcctggaggtgctgaccgagcacctggacagagtgatgctggtgagaggcggcggcagagaggtgatcaccatctacagctag

SEQ ID NO: 99367 - DNA, 858 bp, Artificial Sequence
  Description of Artificial Sequence: Synthetic coding sequence
atgctgaacaacctgaccgactgcgaggacggcgacggcggcgccaaccccggcgacggcaaccccaaggagagcagccccttcatcaacagcaccgacaccgagaagggcaaggagtacgacggcaagaacatggccctgttcgaggaggagatggacaccagccccatggtgagcagcctgctgagcggcctggccaactacaccaacctgccccagggcagcagagagcacgaggaggccgagaacaacgagggcggcaagaagaagcccgtgcaggcccccagaatgggcaccttcatgggcgtgtacctgccctgcctgcagaacatcttcggcgtgatcctgttcctgagactgacctgggtggtgggcatcgccggcatcatggagagcttctgcatggtgttcatctgctgcagctgcaccatgctgaccgccatcagcatgagcgccatcgccaccaacggcgtggtgcccgccggcggcagctactacatgatcagcagaagcctgggccccgagttcggcggcgccgtgggcctgtgcttctacctgggcaccaccttcgccggcgccatgtacatcctgggcaccatcgagatcctgctggcctacctgttccccgccatggccatcttcaaggccgaggacgccagcggcgaggccgccgccatgctgaacaacatgagagtgtacggcacctgcgtgctgacctgcatggccaccgtggtgttcgtgggcgtgaagtacgtgaacaagttcgccctggtgttcctgggctgcgtgatcctgagcatcctggccatctacgccggcgtgatcaagagcgccttcgacccccccaacttcccctag

SEQ ID NO: 99368 - DNA, 3420 bp, Artificial Sequence
  Description of Artificial Sequence: Synthetic coding sequence
atgagcagaagattcaccgtgaccagcctgccccccgccggccccgccagaagccccgaccccgagagcagaagacacagcgtggccgaccccagacacctgcccggcgaggacgtgaagggcgacggcaaccccaaggagagcagccccttcatcaacagcaccgacaccgagaagggcaaggagtacgacggcaagaacatggccctgttcgaggaggagatggacaccagccccatggtgagcagcctgctgagcggcctggccaactacaccaacctgccccagggcagcagagagcacgaggaggccgagaacaacgagggcggcaagaagaagcccgtgcaggcccccagaatgggcaccttcatgggcgtgtacctgccctgcctgcagaacatcttcggcgtgatcctgttcctgagactgacctgggtggtgggcatcgccggcatcatggagagcttctgcatggtgttcatctgctgcagctgcaccatgctgaccgccatcagcatgagcgccatcgccaccaacggcgtggtgcccgccggcggcagctactacatgatcagcagaagcctgggccccgagttcggcggcgccgtgggcctgtgcttctacctgggcaccaccttcgccggcgccatgtacatcctgggcaccatcgagatcctgctggcctacctgttccccgccatggccatcttcaaggccgaggacgccagcggcgaggccgccgccatgctgaacaacatgagagtgtacggcacctgcgtgctgacctgcatggccaccgtggtgttcgtgggcgtgaagtacgtgaacaagttcgccctggtgttcctgggctgcgtgatcctgagcatcctggccatctacgccggcgtgatcaagagcgccttcgacccccccaacttccccatctgcctgctgggcaacagaaccctgagcagacacggcttcgacgtgtgcgccaagctggcctgggagggcaacgagaccgtgaccaccagactgtggggcctgttctgcagcagcagattcctgaacgccacctgcgacgagtacttcaccagaaacaacgtgaccgagatccagggcatccccggcgccgccagcggcctgatcaaggagaacctgtggagcagctacctgaccaagggcgtgatcgtggagagaagcggcatgaccagcgtgggcctggccgacggcacccccatcgacatggaccacccctacgtgttcagcgacatgaccagctacttcaccctgctggtgggcatctacttccccagcgtgaccggcatcatggccggcagcaacagaagcggcgacctgagagacgcccagaagagcatccccaccggcaccatcctggccatcgccaccaccagcgccgtgtacatcagcagcgtggtgctgttcggcgcctgcatcgagggcgtggtgctgagagacaagttcggcgaggccgtgaacggcaacctggtggtgggcaccctggcctggcccagcccctgggtgatcgtgatcggcagcttcttcagcacctgcggcgccggcctgcagagcctgaccggcgcccccagactgctgcaggccatcagcagagacggcatcgtgcccttcctgcaggtgttcggccacggcaaggccaacggcgagcccacctgggccctgctgctgaccgcctgcatctgcgagatcggcatcctgatcgccagcctggacgaggtggcccccatcctgagcatgttcttcctgatgtgctacatgttcgtgaacctggcctgcgccgtgcagaccctgctgagaacccccaactggagacccagattcagatactaccactggaccctgagcttcctgggcatgagcctgtgcctggccctgatgttcatctgcagctggtactacgccctggtggccatgctgatcgccggcctgatctacaagtacatcgagtacagaggcgccgagaaggagtggggcgacggcatcagaggcctgagcctgagcgccgccagatacgccctgctgagactggaggagggccccccccacaccaagaactggagaccccagctgctggtgctggtgagagtggaccaggaccagaacgtggtgcacccccagctgctgagcctgaccagccagctgaaggccggcaagggcctgaccatcgtgggcagcgtgctggagggcaccttcctggagaaccacccccaggcccagagagccgaggagagcatcagaagactgatggaggccgagaaggtgaagggcttctgccaggtggtgatcagcagcaacctgagagacggcgtgagccacctgatccagagcggcggcctgggcggcctgcagcacaacaccgtgctggtgggctggcccagaaactggagacagaaggaggaccaccagacctggagaaacttcatcgagctggtgagagagaccaccgccggccacctggccctgctggtgaccaagaacgtgagcatgttccccggcaaccccgagagattcagcgagggcagcatcgacgtgtggtggatcgtgcacgacggcggcatgctgatgctgctgcccttcctgctgagacaccacaaggtgtggagaaagtgcaagatgagaatcttcaccgtggcccagatggacgacaacagcatccagatgaagaaggacctgaccaccttcctgtaccacctgagaatcaccgccgaggtggaggtggtggagatgcacgagagcgacatcagcgcctacacctacgagaagaccctggtgatggagcagagaagccagatcctgaagcagatgcacctgaccaagaacgagagagagagagagatccagagcatcaccgacgagagcagaggcagcatcagaagaaagaaccccgccaacaccagactgagactgaacgtgcccgaggagaccgccggcgacagcgaggagaagcccgaggaggaggtgcagctgatccacgaccagagcgcccccagctgccccagcagcagccccagccccggcgaggagcccgagggcgagggcgagaccgaccccgagaaggtgcacctgacctggaccaaggacaagagcgtggccgagaagaacaagggccccagccccgtgagcagcgagggcatcaaggacttcttcagcatgaagcccgagtgggagaacctgaaccagagcaacgtgagaagaatgcacaccgccgtgagactgaacgaggtgatcgtgaagaagagcagagacgccaagctggtgctgctgaacatgcccggcccccccagaaacagaaacggcgacgagaactacatggagttcctggaggtgctgaccgagcacctggacagagtgatgctggtgagaggcggcggcagagaggtgatcaccatctacagctag

SEQ ID NO: 99369 - DNA, 561 bp, Artificial Sequence
  Description of Artificial Sequence: Synthetic coding sequence
atgctgaacaacctgaccgactgcgaggacggcgacggcggcgccaaccccggcgacggcaaccccaaggagagcagccccttcatcaacagcaccgacaccgagaagggcaaggagtacgacggcaagaacatggccctgttcgaggaggagatggacaccagccccatggtgagcagcctgctgagcggcctggccaactacaccaacctgccccagggcagcagagagcacgaggaggccgagaacaacgagggcggcaagaagaagcccgtgcaggcccccagaatgggcaccttcatgggcgtgtacctgccctgcctgcagaacatcttcggcgtgatcctgttcctgagactgacctgggtggtgggcatcgccggcatcatggagagcttctgcatggtgttcatctgctgcagctgcaccatgctgaccgccatcagcatgagcgccatcgccaccaacggcgtggtgcccgccggcggcagctactacatgatcagcagaagcctggccatggccagacccatggagagcagacccggcccctgcagctag

SEQ ID NO: 99370 - DNA, 3258 bp, Artificial Sequence
  Description of Artificial Sequence: Synthetic coding sequence
atgccccacttcaccgtggtgcccgtggacggccccagaagaggcgactacgacaacctggagggcctgagctgggtggactacggcgagagagccgagctggacgacagcgacggccacggcaaccacagagagagcagccccttcctgagccccctggaggccagcagaggcatcgactactacgacagaaacctggccctgttcgaggaggagctggacatcagacccaaggtgagcagcctgctgggcaagctggtgagctacaccaacctgacccagggcgccaaggagcacgaggaggccgagagcggcgagggcaccagaagaagagccgccgaggcccccagcatgggcaccctgatgggcgtgtacctgccctgcctgcagaacatcttcggcgtgatcctgttcctgagactgacctggatggtgggcaccgccggcgtgctgcaggccctgctgatcgtgctgatctgctgctgctgcaccctgctgaccgccatcagcatgagcgccatcgccaccaacggcgtggtgcccgccggcggcagctacttcatgatcagcagaagcctgggccccgagttcggcggcgccgtgggcctgtgcttctacctgggcaccaccttcgccgccgccatgtacatcctgggcgccatcgagatcctgctgacctacatcgccccccccgccgccatcttctaccccagcggcgcccacgacaccagcaacgccaccctgaacaacatgagagtgtacggcaccatcttcctgaccttcatgaccctggtggtgttcgtgggcgtgaagtacgtgaacaagttcgccagcctgttcctggcctgcgtgatcatcagcatcctgagcatctacgccggcggcatcaagagcatcttcgacccccccgtgttccccgtgtgcatgctgggcaacagaaccctgagcagagaccagttcgacatctgcgccaagaccgccgtggtggacaacgagaccgtggccacccagctgtggagcttcttctgccacagccccaacctgaccaccgacagctgcgacccctacttcatgctgaacaacgtgaccgagatccccggcatccccggcgccgccgccggcgtgctgcaggagaacctgtggagcgcctacctggagaagggcgacatcgtggagaagcacggcctgcccagcgccgacgcccccagcctgaaggagagcctgcccctgtacgtggtggccgacatcgccaccagcttcaccgtgctggtgggcatcttcttccccagcgtgaccggcatcatggccggcagcaacagaagcggcgacctgagagacgcccagaagagcatccccgtgggcaccatcctggccatcatcaccaccagcctggtgtacttcagcagcgtggtgctgttcggcgcctgcatcgagggcgtggtgctgagagacaagtacggcgacggcgtgagcagaaacctggtggtgggcaccctggcctggcccagcccctgggtgatcgtgatcggcagcttcttcagcacctgcggcgccggcctgcagagcctgaccggcgcccccagactgctgcaggccatcgccaaggacaacatcatccccttcctgagagtgttcggccacggcaaggtgaacggcgagcccacctgggccctgctgctgaccgccctgatcgccgagctgggcatcctgatcgccagcctggacatggtggcccccatcctgagcatgttcttcctgatgtgctacctgttcgtgaacctggcctgcgccgtgcagaccctgctgagaacccccaactggagacccagattcaagtactaccactgggccctgagcttcctgggcatgagcctgtgcctggccctgatgttcgtgagcagctggtactacgccctggtggccatgctgatcgccggcatgatctacaagtacatcgagtaccagggcgccgagaaggagtggggcgacggcatcagaggcctgagcctgagcgccgccagatacgccctgctgagactggaggagggccccccccacaccaagaactggagaccccagctgctggtgctgctgaagctggacgaggacctgcacgtgaagtaccccagactgctgaccttcgccagccagctgaaggccggcaagggcctgaccatcgtgggcagcgtgatccagggcagcttcctggagagctacggcgaggcccaggccgccgagcagaccatcaagaacatgatggagatcgagaaggtgaagggcttctgccaggtggtggtggccagcaaggtgagagagggcctggcccacctgatccagagctgcggcctgggcggcatgagacacaacagcgtggtgctgggctggccctacggctggagacagagcgaggaccccagagcctggaagaccttcatcgacaccgtgagatgcaccaccgccgcccacctggccctgctggtgcccaagaacatcgccttctaccccagcaaccacgagagatacctggagggccacatcgacgtgtggtggatcgtgcacgacggcggcatgctgatgctgctgcccttcctgctgagacagcacaaggtgtggagaaagtgcagaatgagaatcttcaccgtggcccagatggacgacaacagcatccagatgaagaaggacctggccgtgttcctgtaccacctgagactggaggccgaggtggaggtggtggagatgcacaacagcgacatcagcgcctacacctacgagagaaccctgatgatggagcagagaagccagatgctgagacagatgagactgaccaagaccgagagagagagagaggcccagctggtgaaggacagacacagcgccctgagactggagagcctgtacagcgacgaggaggacgagagcgccgtgggcgccgacaagatccagatgacctggaccagagacaagtacatgaccgagacctgggaccccagccacgcccccgacaacttcagagagctggtgcacatcaagcccgaccagagcaacgtgagaagaatgcacaccgccgtgaagctgaacgaggtgatcgtgaccagaagccacgacgccagactggtgctgctgaacatgcccggcccccccagaaacagcgagggcgacgagaactacatggagttcctggaggtgctgaccgagggcctggagagagtgctgctggtgagaggcggcggcagagaggtgatcaccatctacagctag

SEQ ID NO: 99371 - DNA, 2343 bp, Artificial Sequence
  Description of Artificial Sequence: Synthetic coding sequence
atgccccacttcaccgtggtgcccgtggacggccccagaagaggcgactacgacaacctggagggcctgagctgggtggactacggcgagagagccgagctggacgacagcgacggccacggcaaccacagagagagcagccccttcctgagccccctggaggccagcagaggcatcgactactacgacagaaacctggccctgttcgaggaggagctggacatcagacccaaggtgagcagcctgctgggcaagctggtgagctacaccaacctgacccagggcgccaaggagcacgaggaggccgagagcggcgagggcaccagaagaagagccgccgaggcccccagcatgggcaccctgatgggcgtgtacctgccctgcctgcagaacatcttcggcgtgatcctgttcctgagactgacctggatggtgggcaccgccggcgtgctgcaggccctgctgatcgtgctgatctgctgctgctgcaccctgctgaccgccatcagcatgagcgccatcgccaccaacggcgtggtgcccgccggcggcagctacttcatgatcagcagaagcctgggccccgagttcggcggcgccgtgggcctgtgcttctacctgggcaccaccttcgccgccgccatgtacatcctgggcgccatcgagatcctgctgacctacatcgccccccccgccgccatcttctaccccagcggcgcccacgacaccagcaacgccaccctgaacaacatgagagtgtacggcaccatcttcctgaccttcatgaccctggtggtgttcgtgggcgtgaagtacgtgaacaagttcgccagcctgttcctggcctgcgtgatcatcagcatcctgagcatctacgccggcggcatcaagagcatcttcgacccccccgtgttccccgtgtgcatgctgggcaacagaaccctgagcagagaccagttcgacatctgcgccaagaccgccgtggtggacaacgagaccgtggccacccagctgtggagcttcttctgccacagccccaacctgaccaccgacagctgcgacccctacttcatgctgaacaacgtgaccgagatccccggcatccccggcgccgccgccggcgtgctgcaggagaacctgtggagcgcctacctggagaagggcgacatcgtggagaagcacggcctgcccagcgccgacgcccccagcctgaaggagagcctgcccctgtacgtggtggccgacatcgccaccagcttcaccgtgctggtgggcatcttcttccccagcgtgaccggcatcatggccggcagcaacagaagcggcgacctgagagacgcccagaagagcatccccgtgggcaccatcctggccatcatcaccaccagcctggtgtacttcagcagcgtggtgctgttcggcgcctgcatcgagggcgtggtgctgagagacaagtacggcgacggcgtgagcagaaacctggtggtgggcaccctggcctggcccagcccctgggtgatcgtgatcggcagcttcttcagcacctgcggcgccggcctgcagagcctgaccggcgcccccagactgctgcaggccatcgccaaggacaacatcatccccttcctgagagtgttcggccacggcaaggtgaacggcgagcccacctgggccctgctgctgaccgccctgatcgccgagctgggcatcctgatcgccagcctggacatggtggcccccatcctgagcatgttcttcctgatgtgctacctgttcgtgaacctggcctgcgccgtgcagaccctgctgagaacccccaactggagacccagattcaagtactaccactgggccctgagcttcctgggcatgagcctgtgcctggccctgatgttcgtgagcagctggtactacgccctggtggccatgctgatcgccggcatgatctacaagtacatcgagtaccagggcgccgagaaggagtggggcgacggcatcagaggcctgagcctgagcgccgccagatacgccctgctgagactggaggagggccccccccacaccaagaactggagaccccagctgctggtgctgctgaagctggacgaggacctgcacgtgaagtaccccagactgctgaccttcgccagccagctgaaggccggcaagggcctgaccatcgtgggcagcgtgatccagggcagcttcctggagagctacggcgaggcccaggccgccgagcagaccccctgcgccgccctgagactgcccacctggccctgcagctgccccagaaccagccccagcacccccgccaccaccagcgccacctggagagccacctag

SEQ ID NO: 99372 - DNA, 3264 bp, Artificial Sequence
  Description of Artificial Sequence: Synthetic coding sequence
atgagagccggcggcgcctgcagacccggcgccgccggcaccgccgccggcaccgccgccggcggctgggacggcggctgcggcggcgccgagcccgccagatgcctgaccagcccctggtgccagtggaccggcagaggcgccgccaccatgaccaccagcagaggcagcgtgggctggaccaccggcagcgcccccagctggatgaccagaaccgaggagctggacatcagacccaaggtgagcagcctgctgggcaagctggtgagctacaccaacctgacccagggcgccaaggagcacgaggaggccgagagcggcgagggcaccagaagaagagccgccgaggcccccagcatgggcaccctgatgggcgtgtacctgccctgcctgcagaacatcttcggcgtgatcctgttcctgagactgacctggatggtgggcaccgccggcgtgctgcaggccctgctgatcgtgctgatctgctgctgctgcaccctgctgaccgccatcagcatgagcgccatcgccaccaacggcgtggtgcccgccggcggcagctacttcatgatcagcagaagcctgggccccgagttcggcggcgccgtgggcctgtgcttctacctgggcaccaccttcgccgccgccatgtacatcctgggcgccatcgagatcctgctgacctacatcgccccccccgccgccatcttctaccccagcggcgcccacgacaccagcaacgccaccctgaacaacatgagagtgtacggcaccatcttcctgaccttcatgaccctggtggtgttcgtgggcgtgaagtacgtgaacaagttcgccagcctgttcctggcctgcgtgatcatcagcatcctgagcatctacgccggcggcatcaagagcatcttcgacccccccgtgttccccgtgtgcatgctgggcaacagaaccctgagcagagaccagttcgacatctgcgccaagaccgccgtggtggacaacgagaccgtggccacccagctgtggagcttcttctgccacagccccaacctgaccaccgacagctgcgacccctacttcatgctgaacaacgtgaccgagatccccggcatccccggcgccgccgccggcgtgctgcaggagaacctgtggagcgcctacctggagaagggcgacatcgtggagaagcacggcctgcccagcgccgacgcccccagcctgaaggagagcctgcccctgtacgtggtggccgacatcgccaccagcttcaccgtgctggtgggcatcttcttccccagcgtgaccggcatcatggccggcagcaacagaagcggcgacctgagagacgcccagaagagcatccccgtgggcaccatcctggccatcatcaccaccagcctggtgtacttcagcagcgtggtgctgttcggcgcctgcatcgagggcgtggtgctgagagacaagtacggcgacggcgtgagcagaaacctggtggtgggcaccctggcctggcccagcccctgggtgatcgtgatcggcagcttcttcagcacctgcggcgccggcctgcagagcctgaccggcgcccccagactgctgcaggccatcgccaaggacaacatcatccccttcctgagagtgttcggccacggcaaggtgaacggcgagcccacctgggccctgctgctgaccgccctgatcgccgagctgggcatcctgatcgccagcctggacatggtggcccccatcctgagcatgttcttcctgatgtgctacctgttcgtgaacctggcctgcgccgtgcagaccctgctgagaacccccaactggagacccagattcaagtactaccactgggccctgagcttcctgggcatgagcctgtgcctggccctgatgttcgtgagcagctggtactacgccctggtggccatgctgatcgccggcatgatctacaagtacatcgagtaccagggcgccgagaaggagtggggcgacggcatcagaggcctgagcctgagcgccgccagatacgccctgctgagactggaggagggccccccccacaccaagaactggagaccccagctgctggtgctgctgaagctggacgaggacctgcacgtgaagtaccccagactgctgaccttcgccagccagctgaaggccggcaagggcctgaccatcgtgggcagcgtgatccagggcagcttcctggagagctacggcgaggcccaggccgccgagcagaccatcaagaacatgatggagatcgagaaggtgaagggcttctgccaggtggtggtggccagcaaggtgagagagggcctggcccacctgatccagagctgcggcctgggcggcatgagacacaacagcgtggtgctgggctggccctacggctggagacagagcgaggaccccagagcctggaagaccttcatcgacaccgtgagatgcaccaccgccgcccacctggccctgctggtgcccaagaacatcgccttctaccccagcaaccacgagagatacctggagggccacatcgacgtgtggtggatcgtgcacgacggcggcatgctgatgctgctgcccttcctgctgagacagcacaaggtgtggagaaagtgcagaatgagaatcttcaccgtggcccagatggacgacaacagcatccagatgaagaaggacctggccgtgttcctgtaccacctgagactggaggccgaggtggaggtggtggagatgcacaacagcgacatcagcgcctacacctacgagagaaccctgatgatggagcagagaagccagatgctgagacagatgagactgaccaagaccgagagagagagagaggcccagctggtgaaggacagacacagcgccctgagactggagagcctgtacagcgacgaggaggacgagagcgccgtgggcgccgacaagatccagatgacctggaccagagacaagtacatgaccgagacctgggaccccagccacgcccccgacaacttcagagagctggtgcacatcaagcccgaccagagcaacgtgagaagaatgcacaccgccgtgaagctgaacgaggtgatcgtgaccagaagccacgacgccagactggtgctgctgaacatgcccggcccccccagaaacagcgagggcgacgagaactacatggagttcctggaggtgctgaccgagggcctggagagagtgctgctggtgagaggcggcggcagagaggtgatcaccatctacagctag

SEQ ID NO: 99373 - DNA, 3240 bp, Artificial Sequence
  Description of Artificial Sequence: Synthetic coding sequence
atggccgccgagggcgccgtgtgcggcttcgtgtacctggagggcaccgcctgggccgtgcccgaggacaccgagcccctggccagctgcaccctgggccacggcaaccacagagagagcagccccttcctgagccccctggaggccagcagaggcatcgactactacgacagaaacctggccctgttcgaggaggagctggacatcagacccaaggtgagcagcctgctgggcaagctggtgagctacaccaacctgacccagggcgccaaggagcacgaggaggccgagagcggcgagggcaccagaagaagagccgccgaggcccccagcatgggcaccctgatgggcgtgtacctgccctgcctgcagaacatcttcggcgtgatcctgttcctgagactgacctggatggtgggcaccgccggcgtgctgcaggccctgctgatcgtgctgatctgctgctgctgcaccctgctgaccgccatcagcatgagcgccatcgccaccaacggcgtggtgcccgccggcggcagctacttcatgatcagcagaagcctgggccccgagttcggcggcgccgtgggcctgtgcttctacctgggcaccaccttcgccgccgccatgtacatcctgggcgccatcgagatcctgctgacctacatcgccccccccgccgccatcttctaccccagcggcgcccacgacaccagcaacgccaccctgaacaacatgagagtgtacggcaccatcttcctgaccttcatgaccctggtggtgttcgtgggcgtgaagtacgtgaacaagttcgccagcctgttcctggcctgcgtgatcatcagcatcctgagcatctacgccggcggcatcaagagcatcttcgacccccccgtgttccccgtgtgcatgctgggcaacagaaccctgagcagagaccagttcgacatctgcgccaagaccgccgtggtggacaacgagaccgtggccacccagctgtggagcttcttctgccacagccccaacctgaccaccgacagctgcgacccctacttcatgctgaacaacgtgaccgagatccccggcatccccggcgccgccgccggcgtgctgcaggagaacctgtggagcgcctacctggagaagggcgacatcgtggagaagcacggcctgcccagcgccgacgcccccagcctgaaggagagcctgcccctgtacgtggtggccgacatcgccaccagcttcaccgtgctggtgggcatcttcttccccagcgtgaccggcatcatggccggcagcaacagaagcggcgacctgagagacgcccagaagagcatccccgtgggcaccatcctggccatcatcaccaccagcctggtgtacttcagcagcgtggtgctgttcggcgcctgcatcgagggcgtggtgctgagagacaagtacggcgacggcgtgagcagaaacctggtggtgggcaccctggcctggcccagcccctgggtgatcgtgatcggcagcttcttcagcacctgcggcgccggcctgcagagcctgaccggcgcccccagactgctgcaggccatcgccaaggacaacatcatccccttcctgagagtgttcggccacggcaaggtgaacggcgagcccacctgggccctgctgctgaccgccctgatcgccgagctgggcatcctgatcgccagcctggacatggtggcccccatcctgagcatgttcttcctgatgtgctacctgttcgtgaacctggcctgcgccgtgcagaccctgctgagaacccccaactggagacccagattcaagtactaccactgggccctgagcttcctgggcatgagcctgtgcctggccctgatgttcgtgagcagctggtactacgccctggtggccatgctgatcgccggcatgatctacaagtacatcgagtaccagggcgccgagaaggagtggggcgacggcatcagaggcctgagcctgagcgccgccagatacgccctgctgagactggaggagggccccccccacaccaagaactggagaccccagctgctggtgctgctgaagctggacgaggacctgcacgtgaagtaccccagactgctgaccttcgccagccagctgaaggccggcaagggcctgaccatcgtgggcagcgtgatccagggcagcttcctggagagctacggcgaggcccaggccgccgagcagaccatcaagaacatgatggagatcgagaaggtgaagggcttctgccaggtggtggtggccagcaaggtgagagagggcctggcccacctgatccagagctgcggcctgggcggcatgagacacaacagcgtggtgctgggctggccctacggctggagacagagcgaggaccccagagcctggaagaccttcatcgacaccgtgagatgcaccaccgccgcccacctggccctgctggtgcccaagaacatcgccttctaccccagcaaccacgagagatacctggagggccacatcgacgtgtggtggatcgtgcacgacggcggcatgctgatgctgctgcccttcctgctgagacagcacaaggtgtggagaaagtgcagaatgagaatcttcaccgtggcccagatggacgacaacagcatccagatgaagaaggacctggccgtgttcctgtaccacctgagactggaggccgaggtggaggtggtggagatgcacaacagcgacatcagcgcctacacctacgagagaaccctgatgatggagcagagaagccagatgctgagacagatgagactgaccaagaccgagagagagagagaggcccagctggtgaaggacagacacagcgccctgagactggagagcctgtacagcgacgaggaggacgagagcgccgtgggcgccgacaagatccagatgacctggaccagagacaagtacatgaccgagacctgggaccccagccacgcccccgacaacttcagagagctggtgcacatcaagcccgaccagagcaacgtgagaagaatgcacaccgccgtgaagctgaacgaggtgatcgtgaccagaagccacgacgccagactggtgctgctgaacatgcccggcccccccagaaacagcgagggcgacgagaactacatggagttcctggaggtgctgaccgagggcctggagagagtgctgctggtgagaggcggcggcagagaggtgatcaccatctacagctag

SEQ ID NO: 99374 - DNA, 3165 bp, Artificial Sequence
  Description of Artificial Sequence: Synthetic coding sequence
atgggcgacaccctgagccccggccacggcaaccacagagagagcagccccttcctgagccccctggaggccagcagaggcatcgactactacgacagaaacctggccctgttcgaggaggagctggacatcagacccaaggtgagcagcctgctgggcaagctggtgagctacaccaacctgacccagggcgccaaggagcacgaggaggccgagagcggcgagggcaccagaagaagagccgccgaggcccccagcatgggcaccctgatgggcgtgtacctgccctgcctgcagaacatcttcggcgtgatcctgttcctgagactgacctggatggtgggcaccgccggcgtgctgcaggccctgctgatcgtgctgatctgctgctgctgcaccctgctgaccgccatcagcatgagcgccatcgccaccaacggcgtggtgcccgccggcggcagctacttcatgatcagcagaagcctgggccccgagttcggcggcgccgtgggcctgtgcttctacctgggcaccaccttcgccgccgccatgtacatcctgggcgccatcgagatcctgctgacctacatcgccccccccgccgccatcttctaccccagcggcgcccacgacaccagcaacgccaccctgaacaacatgagagtgtacggcaccatcttcctgaccttcatgaccctggtggtgttcgtgggcgtgaagtacgtgaacaagttcgccagcctgttcctggcctgcgtgatcatcagcatcctgagcatctacgccggcggcatcaagagcatcttcgacccccccgtgttccccgtgtgcatgctgggcaacagaaccctgagcagagaccagttcgacatctgcgccaagaccgccgtggtggacaacgagaccgtggccacccagctgtggagcttcttctgccacagccccaacctgaccaccgacagctgcgacccctacttcatgctgaacaacgtgaccgagatccccggcatccccggcgccgccgccggcgtgctgcaggagaacctgtggagcgcctacctggagaagggcgacatcgtggagaagcacggcctgcccagcgccgacgcccccagcctgaaggagagcctgcccctgtacgtggtggccgacatcgccaccagcttcaccgtgctggtgggcatcttcttccccagcgtgaccggcatcatggccggcagcaacagaagcggcgacctgagagacgcccagaagagcatccccgtgggcaccatcctggccatcatcaccaccagcctggtgtacttcagcagcgtggtgctgttcggcgcctgcatcgagggcgtggtgctgagagacaagtacggcgacggcgtgagcagaaacctggtggtgggcaccctggcctggcccagcccctgggtgatcgtgatcggcagcttcttcagcacctgcggcgccggcctgcagagcctgaccggcgcccccagactgctgcaggccatcgccaaggacaacatcatccccttcctgagagtgttcggccacggcaaggtgaacggcgagcccacctgggccctgctgctgaccgccctgatcgccgagctgggcatcctgatcgccagcctggacatggtggcccccatcctgagcatgttcttcctgatgtgctacctgttcgtgaacctggcctgcgccgtgcagaccctgctgagaacccccaactggagacccagattcaagtactaccactgggccctgagcttcctgggcatgagcctgtgcctggccctgatgttcgtgagcagctggtactacgccctggtggccatgctgatcgccggcatgatctacaagtacatcgagtaccagggcgccgagaaggagtggggcgacggcatcagaggcctgagcctgagcgccgccagatacgccctgctgagactggaggagggccccccccacaccaagaactggagaccccagctgctggtgctgctgaagctggacgaggacctgcacgtgaagtaccccagactgctgaccttcgccagccagctgaaggccggcaagggcctgaccatcgtgggcagcgtgatccagggcagcttcctggagagctacggcgaggcccaggccgccgagcagaccatcaagaacatgatggagatcgagaaggtgaagggcttctgccaggtggtggtggccagcaaggtgagagagggcctggcccacctgatccagagctgcggcctgggcggcatgagacacaacagcgtggtgctgggctggccctacggctggagacagagcgaggaccccagagcctggaagaccttcatcgacaccgtgagatgcaccaccgccgcccacctggccctgctggtgcccaagaacatcgccttctaccccagcaaccacgagagatacctggagggccacatcgacgtgtggtggatcgtgcacgacggcggcatgctgatgctgctgcccttcctgctgagacagcacaaggtgtggagaaagtgcagaatgagaatcttcaccgtggcccagatggacgacaacagcatccagatgaagaaggacctggccgtgttcctgtaccacctgagactggaggccgaggtggaggtggtggagatgcacaacagcgacatcagcgcctacacctacgagagaaccctgatgatggagcagagaagccagatgctgagacagatgagactgaccaagaccgagagagagagagaggcccagctggtgaaggacagacacagcgccctgagactggagagcctgtacagcgacgaggaggacgagagcgccgtgggcgccgacaagatccagatgacctggaccagagacaagtacatgaccgagacctgggaccccagccacgcccccgacaacttcagagagctggtgcacatcaagcccgaccagagcaacgtgagaagaatgcacaccgccgtgaagctgaacgaggtgatcgtgaccagaagccacgacgccagactggtgctgctgaacatgcccggcccccccagaaacagcgagggcgacgagaactacatggagttcctggaggtgctgaccgagggcctggagagagtgctgctggtgagaggcggcggcagagaggtgatcaccatctacagctag

SEQ ID NO: 99375 - DNA, 3300 bp, Artificial Sequence
  Description of Artificial Sequence: Synthetic coding sequence
atgccccacttcaccgtgaccaaggtggaggaccccgaggagggcgccgccgccagcatcagccaggagcccagcctggccgacatcaaggccagaatccaggacagcgacgagcccgacctgagccagaacagcatcaccggcgagcacagccagctgctggacgacggccacaagaaggccagaaacgcctacctgaacaacagcaactacgaggagggcgacgagtacttcgacaagaacctggccctgttcgaggaggagatggacaccagacccaaggtgagcagcctgctgaacagaatggccaactacaccaacctgacccagggcgccaaggagcacgaggaggccgagaacatcaccgagggcaagaagaagcccaccaagaccccccagatgggcaccttcatgggcgtgtacctgccctgcctgcagaacatcttcggcgtgatcctgttcctgagactgacctgggtggtgggcaccgccggcgtgctgcaggccttcgccatcgtgctgatctgctgctgctgcaccatgctgaccgccatcagcatgagcgccatcgccaccaacggcgtggtgcccgccggcggcagctacttcatgatcagcagagccctgggccccgagttcggcggcgccgtgggcctgtgcttctacctgggcaccaccttcgccgccgccatgtacatcctgggcgccatcgagatcttcctggtgtacatcgtgcccagagccgccatcttccacagcgacgacgccctgaaggagagcgccgccatgctgaacaacatgagagtgtacggcaccgccttcctggtgctgatggtgctggtggtgttcatcggcgtgagatacgtgaacaagttcgccagcctgttcctggcctgcgtgatcgtgagcatcctggccatctacgccggcgccatcaagagcagcttcgcccccccccacttccccgtgtgcatgctgggcaacagaaccctgagcagcagacacatcgacgtgtgcagcaagaccaaggagatcaacaacatgaccgtgcccagcaagctgtggggcttcttctgcaacagcagccagttcttcaacgccacctgcgacgagtacttcgtgcacaacaacgtgaccagcatccagggcatccccggcctggccagcggcatcatcaccgagaacctgtggagcaactacctgcccaagggcgagatcatcgagaagcccagcgccaagagcagcgacgtgctgggcagcctgaaccacgagtacgtgctggtggacatcaccaccagcttcaccctgctggtgggcatcttcttccccagcgtgaccggcatcatggccggcagcaacagaagcggcgacctgaaggacgcccagaagagcatccccatcggcaccatcctggccatcctgaccaccagcttcgtgtacctgagcaacgtggtgctgttcggcgcctgcatcgagggcgtggtgctgagagacaagttcggcgacgccgtgaagggcaacctggtggtgggcaccctgagctggcccagcccctgggtgatcgtgatcggcagcttcttcagcacctgcggcgccggcctgcagagcctgaccggcgcccccagactgctgcaggccatcgccaaggacaacatcatccccttcctgagagtgttcggccacagcaaggccaacggcgagcccacctgggccctgctgctgaccgccgccatcgccgagctgggcatcctgatcgccagcctggacctggtggcccccatcctgagcatgttcttcctgatgtgctacctgttcgtgaacctggcctgcgccctgcagaccctgctgagaacccccaactggagacccagattcagatactaccactgggccctgagcttcatgggcatgagcatctgcctggccctgatgttcatcagcagctggtactacgccatcgtggccatggtgatcgccggcatgatctacaagtacatcgagtaccagggcgccgagaaggagtggggcgacggcatcagaggcctgagcctgagcgccgccagattcgccctgctgagactggaggagggccccccccacaccaagaactggagaccccagctgctggtgctgctgaagctggacgaggacctgcacgtgaagcaccccagactgctgaccttcgccagccagctgaaggccggcaagggcctgaccatcgtgggcagcgtgatcgtgggcaacttcctggagaactacggcgaggccctggccgccgagcagaccatcaagcacctgatggaggccgagaaggtgaagggcttctgccagctggtggtggccgccaagctgagagagggcatcagccacctgatccagagctgcggcctgggcggcatgaagcacaacaccgtggtgatgggctggcccaacggctggagacagagcgaggacgccagagcctggaagaccttcatcggcaccgtgagagtgaccaccgccgcccacctggccctgctggtggccaagaacatcagcttcttccccagcaacgtggagcagttcagcgagggcaacatcgacgtgtggtggatcgtgcacgacggcggcatgctgatgctgctgcccttcctgctgaagcagcacaaggtgtggagaaagtgcagcatcagaatcttcaccgtggcccagctggaggacaacagcatccagatgaagaaggacctggccaccttcctgtaccacctgagaatcgaggccgaggtggaggtggtggagatgcacgacagcgacatcagcgcctacacctacgagagaaccctgatgatggagcagagaagccagatgctgagacacatgagactgagcaagaccgagagagacagagaggcccagctggtgaaggacagaaacagcatgctgagactgaccagcatcggcagcgacgaggacgaggagaccgagacctaccaggagaaggtgcacatgacctggaccaaggacaagtacatggccagcagaggccagaaggccaagagcatggagggcttccaggacctgctgaacatgagacccgaccagagcaacgtgagaagaatgcacaccgccgtgaagctgaacgaggtgatcgtgaacaagagccacgaggccaagctggtgctgctgaacatgcccggcccccccagaaaccccgagggcgacgagaactacatggagttcctggaggtgctgaccgagggcctggagagagtgctgctggtgagaggcggcggcagcgaggtgatcaccatctacagctag

SEQ ID NO: 99376 - DNA, 3453 bp, Artificial Sequence
  Description of Artificial Sequence: Synthetic coding sequence
atgcacccccccgagaccaccaccaagatggccagcgtgagattcatggtgacccccaccaagatcgacgacatccccggcctgagcgacaccagccccgacctgagcagcagaagcagcagcagagtgagattcagcagcagagagagcgtgcccgagaccagcagaagcgagcccatgagcgagatgagcggcgccaccaccagcctggccaccgtggccctggacccccccagcgacagaaccagccacccccaggacgtgatcgaggacctgagccagaacagcatcaccggcgagcacagccagctgctggacgacggccacaagaaggccagaaacgcctacctgaacaacagcaactacgaggagggcgacgagtacttcgacaagaacctggccctgttcgaggaggagatggacaccagacccaaggtgagcagcctgctgaacagaatggccaactacaccaacctgacccagggcgccaaggagcacgaggaggccgagaacatcaccgagggcaagaagaagcccaccaagaccccccagatgggcaccttcatgggcgtgtacctgccctgcctgcagaacatcttcggcgtgatcctgttcctgagactgacctgggtggtgggcaccgccggcgtgctgcaggccttcgccatcgtgctgatctgctgctgctgcaccatgctgaccgccatcagcatgagcgccatcgccaccaacggcgtggtgcccgccggcggcagctacttcatgatcagcagagccctgggccccgagttcggcggcgccgtgggcctgtgcttctacctgggcaccaccttcgccgccgccatgtacatcctgggcgccatcgagatcttcctggtgtacatcgtgcccagagccgccatcttccacagcgacgacgccctgaaggagagcgccgccatgctgaacaacatgagagtgtacggcaccgccttcctggtgctgatggtgctggtggtgttcatcggcgtgagatacgtgaacaagttcgccagcctgttcctggcctgcgtgatcgtgagcatcctggccatctacgccggcgccatcaagagcagcttcgcccccccccacttccccgtgtgcatgctgggcaacagaaccctgagcagcagacacatcgacgtgtgcagcaagaccaaggagatcaacaacatgaccgtgcccagcaagctgtggggcttcttctgcaacagcagccagttcttcaacgccacctgcgacgagtacttcgtgcacaacaacgtgaccagcatccagggcatccccggcctggccagcggcatcatcaccgagaacctgtggagcaactacctgcccaagggcgagatcatcgagaagcccagcgccaagagcagcgacgtgctgggcagcctgaaccacgagtacgtgctggtggacatcaccaccagcttcaccctgctggtgggcatcttcttccccagcgtgaccggcatcatggccggcagcaacagaagcggcgacctgaaggacgcccagaagagcatccccatcggcaccatcctggccatcctgaccaccagcttcgtgtacctgagcaacgtggtgctgttcggcgcctgcatcgagggcgtggtgctgagagacaagttcggcgacgccgtgaagggcaacctggtggtgggcaccctgagctggcccagcccctgggtgatcgtgatcggcagcttcttcagcacctgcggcgccggcctgcagagcctgaccggcgcccccagactgctgcaggccatcgccaaggacaacatcatccccttcctgagagtgttcggccacagcaaggccaacggcgagcccacctgggccctgctgctgaccgccgccatcgccgagctgggcatcctgatcgccagcctggacctggtggcccccatcctgagcatgttcttcctgatgtgctacctgttcgtgaacctggcctgcgccctgcagaccctgctgagaacccccaactggagacccagattcagatactaccactgggccctgagcttcatgggcatgagcatctgcctggccctgatgttcatcagcagctggtactacgccatcgtggccatggtgatcgccggcatgatctacaagtacatcgagtaccagggcgccgagaaggagtggggcgacggcatcagaggcctgagcctgagcgccgccagattcgccctgctgagactggaggagggccccccccacaccaagaactggagaccccagctgctggtgctgctgaagctggacgaggacctgcacgtgaagcaccccagactgctgaccttcgccagccagctgaaggccggcaagggcctgaccatcgtgggcagcgtgatcgtgggcaacttcctggagaactacggcgaggccctggccgccgagcagaccatcaagcacctgatggaggccgagaaggtgaagggcttctgccagctggtggtggccgccaagctgagagagggcatcagccacctgatccagagctgcggcctgggcggcatgaagcacaacaccgtggtgatgggctggcccaacggctggagacagagcgaggacgccagagcctggaagaccttcatcggcaccgtgagagtgaccaccgccgcccacctggccctgctggtggccaagaacatcagcttcttccccagcaacgtggagcagttcagcgagggcaacatcgacgtgtggtggatcgtgcacgacggcggcatgctgatgctgctgcccttcctgctgaagcagcacaaggtgtggagaaagtgcagcatcagaatcttcaccgtggcccagctggaggacaacagcatccagatgaagaaggacctggccaccttcctgtaccacctgagaatcgaggccgaggtggaggtggtggagatgcacgacagcgacatcagcgcctacacctacgagagaaccctgatgatggagcagagaagccagatgctgagacacatgagactgagcaagaccgagagagacagagaggcccagctggtgaaggacagaaacagcatgctgagactgaccagcatcggcagcgacgaggacgaggagaccgagacctaccaggagaaggtgcacatgacctggaccaaggacaagtacatggccagcagaggccagaaggccaagagcatggagggcttccaggacctgctgaacatgagacccgaccagagcaacgtgagaagaatgcacaccgccgtgaagctgaacgaggtgatcgtgaacaagagccacgaggccaagctggtgctgctgaacatgcccggcccccccagaaaccccgagggcgacgagaactacatggagttcctggaggtgctgaccgagggcctggagagagtgctgctggtgagaggcggcggcagcgaggtgatcaccatctacagctag

SEQ ID NO: 99377 - DNA, 3276 bp, Artificial Sequence
  Description of Artificial Sequence: Synthetic coding sequence
atgagcgagatgagcggcgccaccaccagcctggccaccgtggccctggacccccccagcgacagaaccagccacccccaggacgtgatcgaggacctgagccagaacagcatcaccggcgagcacagccagctgctggacgacggccacaagaaggccagaaacgcctacctgaacaacagcaactacgaggagggcgacgagtacttcgacaagaacctggccctgttcgaggaggagatggacaccagacccaaggtgagcagcctgctgaacagaatggccaactacaccaacctgacccagggcgccaaggagcacgaggaggccgagaacatcaccgagggcaagaagaagcccaccaagaccccccagatgggcaccttcatgggcgtgtacctgccctgcctgcagaacatcttcggcgtgatcctgttcctgagactgacctgggtggtgggcaccgccggcgtgctgcaggccttcgccatcgtgctgatctgctgctgctgcaccatgctgaccgccatcagcatgagcgccatcgccaccaacggcgtggtgcccgccggcggcagctacttcatgatcagcagagccctgggccccgagttcggcggcgccgtgggcctgtgcttctacctgggcaccaccttcgccgccgccatgtacatcctgggcgccatcgagatcttcctggtgtacatcgtgcccagagccgccatcttccacagcgacgacgccctgaaggagagcgccgccatgctgaacaacatgagagtgtacggcaccgccttcctggtgctgatggtgctggtggtgttcatcggcgtgagatacgtgaacaagttcgccagcctgttcctggcctgcgtgatcgtgagcatcctggccatctacgccggcgccatcaagagcagcttcgcccccccccacttccccgtgtgcatgctgggcaacagaaccctgagcagcagacacatcgacgtgtgcagcaagaccaaggagatcaacaacatgaccgtgcccagcaagctgtggggcttcttctgcaacagcagccagttcttcaacgccacctgcgacgagtacttcgtgcacaacaacgtgaccagcatccagggcatccccggcctggccagcggcatcatcaccgagaacctgtggagcaactacctgcccaagggcgagatcatcgagaagcccagcgccaagagcagcgacgtgctgggcagcctgaaccacgagtacgtgctggtggacatcaccaccagcttcaccctgctggtgggcatcttcttccccagcgtgaccggcatcatggccggcagcaacagaagcggcgacctgaaggacgcccagaagagcatccccatcggcaccatcctggccatcctgaccaccagcttcgtgtacctgagcaacgtggtgctgttcggcgcctgcatcgagggcgtggtgctgagagacaagttcggcgacgccgtgaagggcaacctggtggtgggcaccctgagctggcccagcccctgggtgatcgtgatcggcagcttcttcagcacctgcggcgccggcctgcagagcctgaccggcgcccccagactgctgcaggccatcgccaaggacaacatcatccccttcctgagagtgttcggccacagcaaggccaacggcgagcccacctgggccctgctgctgaccgccgccatcgccgagctgggcatcctgatcgccagcctggacctggtggcccccatcctgagcatgttcttcctgatgtgctacctgttcgtgaacctggcctgcgccctgcagaccctgctgagaacccccaactggagacccagattcagatactaccactgggccctgagcttcatgggcatgagcatctgcctggccctgatgttcatcagcagctggtactacgccatcgtggccatggtgatcgccggcatgatctacaagtacatcgagtaccagggcgccgagaaggagtggggcgacggcatcagaggcctgagcctgagcgccgccagattcgccctgctgagactggaggagggccccccccacaccaagaactggagaccccagctgctggtgctgctgaagctggacgaggacctgcacgtgaagcaccccagactgctgaccttcgccagccagctgaaggccggcaagggcctgaccatcgtgggcagcgtgatcgtgggcaacttcctggagaactacggcgaggccctggccgccgagcagaccatcaagcacctgatggaggccgagaaggtgaagggcttctgccagctggtggtggccgccaagctgagagagggcatcagccacctgatccagagctgcggcctgggcggcatgaagcacaacaccgtggtgatgggctggcccaacggctggagacagagcgaggacgccagagcctggaagaccttcatcggcaccgtgagagtgaccaccgccgcccacctggccctgctggtggccaagaacatcagcttcttccccagcaacgtggagcagttcagcgagggcaacatcgacgtgtggtggatcgtgcacgacggcggcatgctgatgctgctgcccttcctgctgaagcagcacaaggtgtggagaaagtgcagcatcagaatcttcaccgtggcccagctggaggacaacagcatccagatgaagaaggacctggccaccttcctgtaccacctgagaatcgaggccgaggtggaggtggtggagatgcacgacagcgacatcagcgcctacacctacgagagaaccctgatgatggagcagagaagccagatgctgagacacatgagactgagcaagaccgagagagacagagaggcccagctggtgaaggacagaaacagcatgctgagactgaccagcatcggcagcgacgaggacgaggagaccgagacctaccaggagaaggtgcacatgacctggaccaaggacaagtacatggccagcagaggccagaaggccaagagcatggagggcttccaggacctgctgaacatgagacccgaccagagcaacgtgagaagaatgcacaccgccgtgaagctgaacgaggtgatcgtgaacaagagccacgaggccaagctggtgctgctgaacatgcccggcccccccagaaaccccgagggcgacgagaactacatggagttcctggaggtgctgaccgagggcctggagagagtgctgctggtgagaggcggcggcagcgaggtgatcaccatctacagctag

SEQ ID NO: 99378 - DNA, 3408 bp, Artificial Sequence
  Description of Artificial Sequence: Synthetic coding sequence
atgcacccccccgagaccaccaccaagatggccagcgtgagattcatggtgacccccaccaagatcgacgacatccccggcctgagcgacaccagccccgacctgagcagcagaagcagcagcagagtgagattcagcagcagagagagcgtgcccgagaccagcagaagcgagcccatgagcgagatgagcggcgccaccaccagcctggccaccgtggccctggacccccccagcgacagaaccagccacccccaggacgtgatcgaggacgacggccacaagaaggccagaaacgcctacctgaacaacagcaactacgaggagggcgacgagtacttcgacaagaacctggccctgttcgaggaggagatggacaccagacccaaggtgagcagcctgctgaacagaatggccaactacaccaacctgacccagggcgccaaggagcacgaggaggccgagaacatcaccgagggcaagaagaagcccaccaagaccccccagatgggcaccttcatgggcgtgtacctgccctgcctgcagaacatcttcggcgtgatcctgttcctgagactgacctgggtggtgggcaccgccggcgtgctgcaggccttcgccatcgtgctgatctgctgctgctgcaccatgctgaccgccatcagcatgagcgccatcgccaccaacggcgtggtgcccgccggcggcagctacttcatgatcagcagagccctgggccccgagttcggcggcgccgtgggcctgtgcttctacctgggcaccaccttcgccgccgccatgtacatcctgggcgccatcgagatcttcctggtgtacatcgtgcccagagccgccatcttccacagcgacgacgccctgaaggagagcgccgccatgctgaacaacatgagagtgtacggcaccgccttcctggtgctgatggtgctggtggtgttcatcggcgtgagatacgtgaacaagttcgccagcctgttcctggcctgcgtgatcgtgagcatcctggccatctacgccggcgccatcaagagcagcttcgcccccccccacttccccgtgtgcatgctgggcaacagaaccctgagcagcagacacatcgacgtgtgcagcaagaccaaggagatcaacaacatgaccgtgcccagcaagctgtggggcttcttctgcaacagcagccagttcttcaacgccacctgcgacgagtacttcgtgcacaacaacgtgaccagcatccagggcatccccggcctggccagcggcatcatcaccgagaacctgtggagcaactacctgcccaagggcgagatcatcgagaagcccagcgccaagagcagcgacgtgctgggcagcctgaaccacgagtacgtgctggtggacatcaccaccagcttcaccctgctggtgggcatcttcttccccagcgtgaccggcatcatggccggcagcaacagaagcggcgacctgaaggacgcccagaagagcatccccatcggcaccatcctggccatcctgaccaccagcttcgtgtacctgagcaacgtggtgctgttcggcgcctgcatcgagggcgtggtgctgagagacaagttcggcgacgccgtgaagggcaacctggtggtgggcaccctgagctggcccagcccctgggtgatcgtgatcggcagcttcttcagcacctgcggcgccggcctgcagagcctgaccggcgcccccagactgctgcaggccatcgccaaggacaacatcatccccttcctgagagtgttcggccacagcaaggccaacggcgagcccacctgggccctgctgctgaccgccgccatcgccgagctgggcatcctgatcgccagcctggacctggtggcccccatcctgagcatgttcttcctgatgtgctacctgttcgtgaacctggcctgcgccctgcagaccctgctgagaacccccaactggagacccagattcagatactaccactgggccctgagcttcatgggcatgagcatctgcctggccctgatgttcatcagcagctggtactacgccatcgtggccatggtgatcgccggcatgatctacaagtacatcgagtaccagggcgccgagaaggagtggggcgacggcatcagaggcctgagcctgagcgccgccagattcgccctgctgagactggaggagggccccccccacaccaagaactggagaccccagctgctggtgctgctgaagctggacgaggacctgcacgtgaagcaccccagactgctgaccttcgccagccagctgaaggccggcaagggcctgaccatcgtgggcagcgtgatcgtgggcaacttcctggagaactacggcgaggccctggccgccgagcagaccatcaagcacctgatggaggccgagaaggtgaagggcttctgccagctggtggtggccgccaagctgagagagggcatcagccacctgatccagagctgcggcctgggcggcatgaagcacaacaccgtggtgatgggctggcccaacggctggagacagagcgaggacgccagagcctggaagaccttcatcggcaccgtgagagtgaccaccgccgcccacctggccctgctggtggccaagaacatcagcttcttccccagcaacgtggagcagttcagcgagggcaacatcgacgtgtggtggatcgtgcacgacggcggcatgctgatgctgctgcccttcctgctgaagcagcacaaggtgtggagaaagtgcagcatcagaatcttcaccgtggcccagctggaggacaacagcatccagatgaagaaggacctggccaccttcctgtaccacctgagaatcgaggccgaggtggaggtggtggagatgcacgacagcgacatcagcgcctacacctacgagagaaccctgatgatggagcagagaagccagatgctgagacacatgagactgagcaagaccgagagagacagagaggcccagctggtgaaggacagaaacagcatgctgagactgaccagcatcggcagcgacgaggacgaggagaccgagacctaccaggagaaggtgcacatgacctggaccaaggacaagtacatggccagcagaggccagaaggccaagagcatggagggcttccaggacctgctgaacatgagacccgaccagagcaacgtgagaagaatgcacaccgccgtgaagctgaacgaggtgatcgtgaacaagagccacgaggccaagctggtgctgctgaacatgcccggcccccccagaaaccccgagggcgacgagaactacatggagttcctggaggtgctgaccgagggcctggagagagtgctgctggtgagaggcggcggcagcgaggtgatcaccatctacagctag

SEQ ID NO: 99379 - DNA, 2889 bp, Artificial Sequence
  Description of Artificial Sequence: Synthetic coding sequence
atggacaccagacccaaggtgagcagcctgctgaacagaatggccaactacaccaacctgacccagggcgccaaggagcacgaggaggccgagaacatcaccgagggcaagaagaagcccaccaagaccatgctgaccgccatcagcatgagcgccatcgccaccaacggcgtggtgcccgccggcggcagctacttcatgatcagcagagccctgggccccgagttcggcggcgccgtgggcctgtgcttctacctgggcaccaccttcgccgccgccatgtacatcctgggcgccatcgagatcttcctggtgtacatcgtgcccagagccgccatcttccacagcgacgacgccctgaaggagagcgccgccatgctgaacaacatgagagtgtacggcaccgccttcctggtgctgatggtgctggtggtgttcatcggcgtgagatacgtgaacaagttcgccagcctgttcctggcctgcgtgatcgtgagcatcctggccatctacgccggcgccatcaagagcagcttcgcccccccccacttccccgtgtgcatgctgggcaacagaaccctgagcagcagacacatcgacgtgtgcagcaagaccaaggagatcaacaacatgaccgtgcccagcaagctgtggggcttcttctgcaacagcagccagttcttcaacgccacctgcgacgagtacttcgtgcacaacaacgtgaccagcatccagggcatccccggcctggccagcggcatcatcaccgagaacctgtggagcaactacctgcccaagggcgagatcatcgagaagcccagcgccaagagcagcgacgtgctgggcagcctgaaccacgagtacgtgctggtggacatcaccaccagcttcaccctgctggtgggcatcttcttccccagcgtgaccggcatcatggccggcagcaacagaagcggcgacctgaaggacgcccagaagagcatccccatcggcaccatcctggccatcctgaccaccagcttcgtgtacctgagcaacgtggtgctgttcggcgcctgcatcgagggcgtggtgctgagagacaagttcggcgacgccgtgaagggcaacctggtggtgggcaccctgagctggcccagcccctgggtgatcgtgatcggcagcttcttcagcacctgcggcgccggcctgcagagcctgaccggcgcccccagactgctgcaggccatcgccaaggacaacatcatccccttcctgagagtgttcggccacagcaaggccaacggcgagcccacctgggccctgctgctgaccgccgccatcgccgagctgggcatcctgatcgccagcctggacctggtggcccccatcctgagcatgttcttcctgatgtgctacctgttcgtgaacctggcctgcgccctgcagaccctgctgagaacccccaactggagacccagattcagatactaccactgggccctgagcttcatgggcatgagcatctgcctggccctgatgttcatcagcagctggtactacgccatcgtggccatggtgatcgccggcatgatctacaagtacatcgagtaccagggcgccgagaaggagtggggcgacggcatcagaggcctgagcctgagcgccgccagattcgccctgctgagactggaggagggccccccccacaccaagaactggagaccccagctgctggtgctgctgaagctggacgaggacctgcacgtgaagcaccccagactgctgaccttcgccagccagctgaaggccggcaagggcctgaccatcgtgggcagcgtgatcgtgggcaacttcctggagaactacggcgaggccctggccgccgagcagaccatcaagcacctgatggaggccgagaaggtgaagggcttctgccagctggtggtggccgccaagctgagagagggcatcagccacctgatccagagctgcggcctgggcggcatgaagcacaacaccgtggtgatgggctggcccaacggctggagacagagcgaggacgccagagcctggaagaccttcatcggcaccgtgagagtgaccaccgccgcccacctggccctgctggtggccaagaacatcagcttcttccccagcaacgtggagcagttcagcgagggcaacatcgacgtgtggtggatcgtgcacgacggcggcatgctgatgctgctgcccttcctgctgaagcagcacaaggtgtggagaaagtgcagcatcagaatcttcaccgtggcccagctggaggacaacagcatccagatgaagaaggacctggccaccttcctgtaccacctgagaatcgaggccgaggtggaggtggtggagatgcacgacagcgacatcagcgcctacacctacgagagaaccctgatgatggagcagagaagccagatgctgagacacatgagactgagcaagaccgagagagacagagaggcccagctggtgaaggacagaaacagcatgctgagactgaccagcatcggcagcgacgaggacgaggagaccgagacctaccaggagaaggtgcacatgacctggaccaaggacaagtacatggccagcagaggccagaaggccaagagcatggagggcttccaggacctgctgaacatgagacccgaccagagcaacgtgagaagaatgcacaccgccgtgaagctgaacgaggtgatcgtgaacaagagccacgaggccaagctggtgctgctgaacatgcccggcccccccagaaaccccgagggcgacgagaactacatggagttcctggaggtgctgaccgagggcctggagagagtgctgctggtgagaggcggcggcagcgaggtgatcaccatctacagctag

SEQ ID NO: 99380 - DNA, 3276 bp, Artificial Sequence; identical to SEQ ID NO: 99377
  Description of Artificial Sequence: Synthetic coding sequence

SEQ ID NO: 99381 - DNA, 3426 bp, Artificial Sequence
  Description of Artificial Sequence: Synthetic coding sequence
atggccagcgtgagattcatggtgacccccaccaagatcgacgacatccccggcctgagcgacaccagccccgacctgagcagcagaagcagcagcagagtgagattcagcagcagagagagcgtgcccgagaccagcagaagcgagcccatgagcgagatgagcggcgccaccaccagcctggccaccgtggccctggacccccccagcgacagaaccagccacccccaggacgtgatcgaggacctgagccagaacagcatcaccggcgagcacagccagctgctggacgacggccacaagaaggccagaaacgcctacctgaacaacagcaactacgaggagggcgacgagtacttcgacaagaacctggccctgttcgaggaggagatggacaccagacccaaggtgagcagcctgctgaacagaatggccaactacaccaacctgacccagggcgccaaggagcacgaggaggccgagaacatcaccgagggcaagaagaagcccaccaagaccccccagatgggcaccttcatgggcgtgtacctgccctgcctgcagaacatcttcggcgtgatcctgttcctgagactgacctgggtggtgggcaccgccggcgtgctgcaggccttcgccatcgtgctgatctgctgctgctgcaccatgctgaccgccatcagcatgagcgccatcgccaccaacggcgtggtgcccgccggcggcagctacttcatgatcagcagagccctgggccccgagttcggcggcgccgtgggcctgtgcttctacctgggcaccaccttcgccgccgccatgtacatcctgggcgccatcgagatcttcctggtgtacatcgtgcccagagccgccatcttccacagcgacgacgccctgaaggagagcgccgccatgctgaacaacatgagagtgtacggcaccgccttcctggtgctgatggtgctggtggtgttcatcggcgtgagatacgtgaacaagttcgccagcctgttcctggcctgcgtgatcgtgagcatcctggccatctacgccggcgccatcaagagcagcttcgcccccccccacttccccgtgtgcatgctgggcaacagaaccctgagcagcagacacatcgacgtgtgcagcaagaccaaggagatcaacaacatgaccgtgcccagcaagctgtggggcttcttctgcaacagcagccagttcttcaacgccacctgcgacgagtacttcgtgcacaacaacgtgaccagcatccagggcatccccggcctggccagcggcatcatcaccgagaacctgtggagcaactacctgcccaagggcgagatcatcgagaagcccagcgccaagagcagcgacgtgctgggcagcctgaaccacgagtacgtgctggtggacatcaccaccagcttcaccctgctggtgggcatcttcttccccagcgtgaccggcatcatggccggcagcaacagaagcggcgacctgaaggacgcccagaagagcatccccatcggcaccatcctggccatcctgaccaccagcttcgtgtacctgagcaacgtggtgctgttcggcgcctgcatcgagggcgtggtgctgagagacaagttcggcgacgccgtgaagggcaacctggtggtgggcaccctgagctggcccagcccctgggtgatcgtgatcggcagcttcttcagcacctgcggcgccggcctgcagagcctgaccggcgcccccagactgctgcaggccatcgccaaggacaacatcatccccttcctgagagtgttcggccacagcaaggccaacggcgagcccacctgggccctgctgctgaccgccgccatcgccgagctgggcatcctgatcgccagcctggacctggtggcccccatcctgagcatgttcttcctgatgtgctacctgttcgtgaacctggcctgcgccctgcagaccctgctgagaacccccaactggagacccagattcagatactaccactgggccctgagcttcatgggcatgagcatctgcctggccctgatgttcatcagcagctggtactacgccatcgtggccatggtgatcgccggcatgatctacaagtacatcgagtaccagggcgccgagaaggagtggggcgacggcatcagaggcctgagcctgagcgccgccagattcgccctgctgagactggaggagggccccccccacaccaagaactggagaccccagctgctggtgctgctgaagctggacgaggacctgcacgtgaagcaccccagactgctgaccttcgccagccagctgaaggccggcaagggcctgaccatcgtgggcagcgtgatcgtgggcaacttcctggagaactacggcgaggccctggccgccgagcagaccatcaagcacctgatggaggccgagaaggtgaagggcttctgccagctggtggtggccgccaagctgagagagggcatcagccacctgatccagagctgcggcctgggcggcatgaagcacaacaccgtggtgatgggctggcccaacggctggagacagagcgaggacgccagagcctggaagaccttcatcggcaccgtgagagtgaccaccgccgcccacctggccctgctggtggccaagaacatcagcttcttccccagcaacgtggagcagttcagcgagggcaacatcgacgtgtggtggatcgtgcacgacggcggcatgctgatgctgctgcccttcctgctgaagcagcacaaggtgtggagaaagtgcagcatcagaatcttcaccgtggcccagctggaggacaacagcatccagatgaagaaggacctggccaccttcctgtaccacctgagaatcgaggccgaggtggaggtggtggagatgcacgacagcgacatcagcgcctacacctacgagagaaccctgatgatggagcagagaagccagatgctgagacacatgagactgagcaagaccgagagagacagagaggcccagctggtgaaggacagaaacagcatgctgagactgaccagcatcggcagcgacgaggacgaggagaccgagacctaccaggagaaggtgcacatgacctggaccaaggacaagtacatggccagcagaggccagaaggccaagagcatggagggcttccaggacctgctgaacatgagacccgaccagagcaacgtgagaagaatgcacaccgccgtgaagctgaacgaggtgatcgtgaacaagagccacgaggccaagctggtgctgctgaacatgcccggcccccccagaaaccccgagggcgacgagaactacatggagttcctggaggtgctgaccgagggcctggagagagtgctgctggtgagaggcggcggcagcgaggtgatcaccatctacagctag

SEQ ID NO: 99382 - DNA, 3453 bp, Artificial Sequence; identical to SEQ ID NO: 99376
  Description of Artificial Sequence: Synthetic coding sequence

SEQ ID NO: 99383 - DNA, 186 bp, Artificial Sequence
  Description of Artificial Sequence: Synthetic coding sequence
atgagcgagatgagcggcgccaccaccagcctggccaccgtggccctggacccccccagcgacagaaccagccacccccaggacgtgatcgaggacctgagccagaacagcatcaccggcgagcacagccagctgctggacgacggccacaagaaggccagaaacgcctacctgaacaacagctag

SEQ ID NO: 99384 - DNA, 2889 bp, Artificial Sequence; identical to SEQ ID NO: 99379
  Description of Artificial Sequence: Synthetic coding sequence

SEQ ID NO: 99385 - DNA, 3453 bp, Artificial Sequence; identical to SEQ ID NO: 99376
  Description of Artificial Sequence: Synthetic coding sequence

SEQ ID NO: 99386 - DNA, 459 bp, Artificial Sequence
  Description of Artificial Sequence: Synthetic coding sequence
atggccagcgtgagattcatggtgacccccaccaagatcgacgacatccccggcctgagcgacaccagccccgacctgagcagcagaagcagcagcagagtgagattcagcagcagagagagcgtgcccgagaccagcagaagcgagcccatgagcgagatgagcggcgccaccaccagcctggccaccgtggccctggacccccccagcgacagaaccagccacccccaggacgtgatcgaggacctgagccagaacagcatcaccggcgagcacagccagctgctggacgacggccacaagaaggccagaaacgcctacctgaacaacagcaactacgaggagggcgacgagtacttcgacaagaacctggccctgttcgaggaggagatggacaccagacccaaggtgagcagcctgctgaacagaatggccaactacaccaacctgacccagtag

SEQ ID NO: 99387 - DNA, 3252 bp, Artificial Sequence
  Description of Artificial Sequence: Synthetic coding sequence
atgcccaccaacttcaccgtggtgcccgtggaggcccacgccgacggcggcggcgacgagaccgccgagagaaccgaggcccccggcacccccgagggccccgagcccgagagacccagccccggcgacggcaaccccagagagaacagccccttcctgaacaacgtggaggtggagcaggagagcttcttcgagggcaagaacatggccctgttcgaggaggagatggacagcaaccccatggtgagcagcctgctgaacaagctggccaactacaccaacctgagccagggcgtggtggagcacgaggaggacgaggagagcagaagaagagaggccaaggcccccagaatgggcaccttcatcggcgtgtacctgccctgcctgcagaacatcctgggcgtgatcctgttcctgagactgacctggatcgtgggcgtggccggcgtgctggagagcttcctgatcgtggccatgtgctgcacctgcaccatgctgaccgccatcagcatgagcgccatcgccaccaacggcgtggtgcccgccggcggcagctactacatgatcagcagaagcctgggccccgagttcggcggcgccgtgggcctgtgcttctacctgggcaccaccttcgccggcgccatgtacatcctgggcaccatcgagatcttcctgacctacatcagccccggcgccgccatcttccaggccgaggccgccggcggcgaggccgccgccatgctgcacaacatgagagtgtacggcacctgcaccctggtgctgatggccctggtggtgttcgtgggcgtgaagtacgtgaacaagctggccctggtgttcctggcctgcgtggtgctgagcatcctggccatctacgccggcgtgatcaagagcgccttcgacccccccgacatccccgtgtgcctgctgggcaacagaaccctgagcagaagaagcttcgacgcctgcgtgaaggcctacggcatccacaacaacagcgccaccagcgccctgtggggcctgttctgcaacggcagccagcccagcgccgcctgcgacgagtacttcatccagaacaacgtgaccgagatccagggcatccccggcgccgccagcggcgtgttcctggagaacctgtggagcacctacgcccacgccggcgccttcgtggagaagaagggcgtgcccagcgtgcccgtggccgaggagagcagagccagcgccctgccctacgtgctgaccgacatcgccgccagcttcaccctgctggtgggcatctacttccccagcgtgaccggcatcatggccggcagcaacagaagcggcgacctgaaggacgcccagaagagcatccccaccggcaccatcctggccatcgtgaccaccagcttcatctacctgagctgcatcgtgctgttcggcgcctgcatcgagggcgtggtgctgagagacaagttcggcgaggccctgcagggcaacctggtgatcggcatgctggcctggcccagcccctgggtgatcgtgatcggcagcttcttcagcacctgcggcgccggcctgcagagcctgaccggcgcccccagactgctgcaggccatcgccagagacggcatcgtgcccttcctgcaggtgttcggccacggcaaggccaacggcgagcccacctgggccctgctgctgaccgtgctgatctgcgagaccggcatcctgatcgccagcctggacagcgtggcccccatcctgagcatgttcttcctgatgtgctacctgttcgtgaacctggcctgcgccgtgcagaccctgctgagaacccccaactggagacccagattcaagttctaccactggaccctgagcttcctgggcatgagcctgtgcctggccctgatgttcatctgcagctggtactacgccctgagcgccatgctgatcgccggctgcatctacaagtacatcgagtacagaggcgccgagaaggagtggggcgacggcatcagaggcctgagcctgaacgccgccagatacgccctgctgagagtggagcacggccccccccacaccaagaactggagaccccaggtgctggtgatgctgaacctggacgccgagcaggccgtgaagcaccccagactgctgagcttcaccagccagctgaaggccggcaagggcctgaccatcgtgggcagcgtgctggagggcacctacctggacaagcacatggaggcccagagagccgaggagaacatcagaagcctgatgagcaccgagaagaccaagggcttctgccagctggtggtgagcagcagcctgagagacggcatgagccacctgatccagagcgccggcctgggcggcctgaagcacaacaccgtgctgatggcctggcccgccagctggaagcaggaggacaaccccttcagctggaagaacttcgtggacaccgtgagagacaccaccgccgcccaccaggccctgctggtggccaagaacgtggacagcttcccccagaaccaggagagattcggcggcggccacatcgacgtgtggtggatcgtgcacgacggcggcatgctgatgctgctgcccttcctgctgagacagcacaaggtgtggagaaagtgcagaatgagaatcttcaccgtggcccaggtggacgacaacagcatccagatgaagaaggacctgcagatgttcctgtaccacctgagaatcagcgccgaggtggaggtggtggagatggtggagaacgacatcagcgccttcacctacgagagaaccctgatgatggagcagagaagccagatgctgaagcagatgcagctgagcaagaacgagcaggagagagaggcccagctgatccacgacagaaacaccgccagccacaccgccgccgccgccagaacccaggccccccccacccccgacaaggtgcagatgacctggaccagagagaagctgatcgccgagaagtacagaagcagagacaccagcctgagcggcttcaaggacctgttcagcatgaagcccgaccagagcaacgtgagaagaatgcacaccgccgtgaagctgaacggcgtggtgctgaacaagagccaggacgcccagctggtgctgctgaacatgcccggcccccccaagaacagacagggcgacgagaactacatggagttcctggaggtgctgaccgagggcctgaacagagtgctgctggtgagaggcggcggcagagaggtgatcaccatctacagctag

SEQ ID NO: 99388 - DNA, 801 bp, Artificial Sequence
  Description of Artificial Sequence: Synthetic coding sequence
atgcccaccaacttcaccgtggtgcccgtggaggcccacgccgacggcggcggcgacgagaccgccgagagaaccgaggcccccggcacccccgagggccccgagcccgagagacccagccccggcgacggcaaccccagagagaacagccccttcctgaacaacgtggaggtggagcaggagagcttcttcgagggcaagaacatggccctgttcgaggaggagatggacagcaaccccatggtgagcagcctgctgaacaagctggccaactacaccaacctgagccagggcgtggtggagcacgaggaggacgaggagagcagaagaagagaggccaaggcccccagaatgggcaccttcatcggcgtgtacctgccctgcctgcagaacatcctgggcgtgatcctgttcctgagactgacctggatcgtgggcgtggccggcgtgctggagagcttcctgatcgtggccatgtgctgcacctgcaccatgctgaccgccatcagcatgagcgccatcgccaccaacggcgtggtgcccgccggcggcagctactacatgatcagcagaagcctgggccccgagttcggcggcgccgtgggcctgtgcttctacctgggcaccaccttcgccggcgccatgtacatcctgggcaccatcgagatcttcctgaccggcaccgaggacggcgtgggcagcctgggcctgggcctggcccagggcaacagaagacagacccacctgagccccagcgacgccgcccaggccgcccacggcgccagctacggcagcttctag

SEQ ID NO: 99389 - DNA, 3066 bp, Artificial Sequence
  Description of Artificial Sequence: Synthetic coding sequence
atggccgagctgcccaccaccgagacccccggcgacgccaccctgtgcagcggcagattcaccatcagcaccctgctgagcagcgacgagcccagcccccccgccgcctacgacagcagccaccccagccacctgacccacagcagcaccttctgcatgagaaccttcggctacaacaccatcgacgtggtgcccacctacgagcactacgccaacagcacccagcccggcgagcccagaaaggtgagacccaccctggccgacctgcacagcttcctgaagcaggagggcagacacctgcacgccctggccttcgacagcagacccagccacgagatgaccgacggcctggtggagggcgaggccggcaccagcagcgagaagaaccccgaggagcccgtgagattcggctgggtgaagggcgtgatgatcagatgcatgctgaacatctggggcgtgatcctgtacctgagactgccctggatcaccgcccaggccggcatcgtgctgacctggatcatcatcctgctgagcgtgaccgtgaccagcatcaccggcctgagcatcagcgccatcagcaccaacggcaaggtgaagagcggcggcacctacttcctgatcagcagaagcctgggccccgagctgggcggcagcatcggcctgatcttcgccttcgccaacgccgtgggcgtggccatgcacaccgtgggcttcgccgagaccgtgagagacctgctgcaggagtacggcgcccccatcgtggaccccatcaacgacatcagaatcatcgccgtggtgagcgtgaccgtgctgctggccatcagcctggccggcatggagtgggagagcaaggcccaggtgctgttcttcctggtgatcatggtgagcttcgccaactacctggtgggcaccctgatcccccccagcgaggacaaggccagcaagggcttcttcagctacagagccgacatcttcgtgcagaacctggtgcccgactggagaggccccgacggcaccttcttcggcatgttcagcatcttcttccccagcgccaccggcatcctggccggcgccaacatcagcggcgacctgaaggaccccgccatcgccatccccaagggcaccctgatggccatcttctggaccaccatcagctacctggccatcagcgccaccatcggcagctgcgtggtgagagacgccagcggcgtgctgaacgacaccgtgacccccggctggggcgcctgcgagggcctggcctgcagctacggctggaacttcaccgagtgcacccagcagcacagctgccactacggcctgatcaactactaccagaccatgagcatggtgagcggcttcgcccccctgatcaccgccggcatcttcggcgccaccctgagcagcgccctggcctgcctggtgagcgccgccaaggtgttccagtgcctgtgcgaggaccagctgtaccccctgatcggcttcttcggcaagggctacggcaagaacaaggagcccgtgagaggctacctgctggcctacgccatcgccgtggccttcatcatcatcgccgagctgaacaccatcgcccccatcatcagcaacttcttcctgtgcagctacgccctgatcaacttcagctgcttccacgccagcatcaccaacagccccggctggagacccagcttccagtactacaacaagtgggccgccctgttcggcgccatcatcagcgtggtgatcatgttcctgctgacctggtgggccgccctgatcgccatcggcgtggtgctgttcctgctgctgtacgtgatctacaagaagcccgaggtgaactggggcagcagcgtgcaggccggcagctacaacctggccctgagctacagcgtgggcctgaacgaggtggaggaccacatcaagaactacagaccccagtgcctggtgctgaccggcccccccaacttcagacccgccctggtggacttcgtgggcaccttcaccagaaacctgagcctgatgatctgcggccacgtgctgatcggcccccacaagcagagaatgcccgagctgcagctgatcgccaacggccacaccaagtggctgaacaagagaaagatcaaggccttctacagcgacgtgatcgccgaggacctgagaagaggcgtgcagatcctgatgcaggccgccggcctgggcagaatgaagcccaacatcctggtggtgggcttcaagaagaactggcagagcgcccaccccgccaccgtggaggactacatcggcatcctgcacgacgccttcgacttcaactacggcgtgtgcgtgatgagaatgagagagggcctgaacgtgagcaagatgatgcaggcccacatcaaccccgtgttcgaccccgccgaggacggcaaggaggccagcgccagagtggaccccaaggccctggtgaaggaggagcaggccaccaccatcttccagagcgagcagggcaagaagaccatcgacatctactggctgttcgacgacggcggcctgaccctgctgatcccctacctgctgggcagaaagagaagatggagcaagtgcaagatcagagtgttcgtgggcggccagatcaacagaatggaccaggagagaaaggccatcatcagcctgctgagcaagttcagactgggcttccacgaggtgcacatcctgcccgacatcaaccagaaccccagagccgagcacaccaagagattcgaggacatgatcgcccccttcagactgaacgacggcttcaaggacgaggccaccgtgaacgagatgagaagagactgcccctggaagatcagcgacgaggagatcaccaagaacagagtgaagagcctgagacaggtgagactgaacgagatcgtgctggactacagcagagacgccgccctgatcgtgatcaccctgcccatcggcagaaagggcaagtgccccagcagcctgtacatggcctggctggagaccctgagccaggacctgagaccccccgtgatcctgatcagaggcaaccaggagaacgtgctgaccttctactgccagtag

SEQ ID NO: 99390 - DNA, 3090 bp, Artificial Sequence
  Description of Artificial Sequence: Synthetic coding sequence
atggccgagctgcccaccaccgagacccccggcgacgccaccctgtgcagcggcagattcaccatcagcaccctgctgagcagcgacgagcccagcccccccgccgcctacgacagcagccaccccagccacctgacccacagcagcaccttctgcatgagaaccttcggctacaacaccatcgacgtggtgcccacctacgagcactacgccaacagcacccagcccggcgagcccagaaaggtgagacccaccctggccgacctgcacagcttcctgaaggagggcagacacctgcacgccctggccttcgacagcagacccagccacgagatgaccgacggcctggtggagggcgaggccggcaccagcagcgagaagaaccccgaggagcccgtgagattcggctgggtgaagggcgtgatgatcagatgcatgctgaacatctggggcgtgatcctgtacctgagactgccctggatcaccgcccaggccggcatcgtgctgacctggatcatcatcctgctgagcgtgaccgtgaccagcatcaccggcctgagcatcagcgccatcagcaccaacggcaaggtgaagagcggcggcacctacttcctgatcagcagaagcctgggccccgagctgggcggcagcatcggcctgatcttcgccttcgccaacgccgtgggcgtggccatgcacaccgtgggcttcgccgagaccgtgagagacctgctgcaggagtacggcgcccccatcgtggaccccatcaacgacatcagaatcatcgccgtggtgagcgtgaccgtgctgctggccatcagcctggccggcatggagtgggagagcaaggcccaggtgctgttcttcctggtgatcatggtgagcttcgccaactacctggtgggcaccctgatcccccccagcgaggacaaggccagcaagggcttcttcagctacagagccgacatcttcgtgcagaacctggtgcccgactggagaggccccgacggcaccttcttcggcatgttcagcatcttcttccccagcgccaccggcatcctggccggcgccaacatcagcggcgacctgaaggaccccgccatcgccatccccaagggcaccctgatggccatcttctggaccaccatcagctacctggccatcagcgccaccatcggcagctgcgtggtgagagacgccagcggcgtgctgaacgacaccgtgacccccggctggggcgcctgcgagggcctggcctgcagctacggctggaacttcaccgagtgcacccagcagcacagctgccactacggcctgatcaactactaccagaccatgagcatggtgagcggcttcgcccccctgatcaccgccggcatcttcggcgccaccctgagcagcgccctggcctgcctggtgagcgccgccaaggtgttccagtgcctgtgcgaggaccagctgtaccccctgatcggcttcttcggcaagggctacggcaagaacaaggagcccgtgagaggctacctgctggcctacgccatcgccgtggccttcatcatcatcgccgagctgaacaccatcgcccccatcatcagcaacttcttcctgtgcagctacgccctgatcaacttcagctgcttccacgccagcatcaccaacagccccggctggagacccagcttccagtactacaacaagtgggccgccctgttcggcgccatcatcagcgtggtgatcatgttcctgctgacctggtgggccgccctgatcgccatcggcgtggtgctgttcctgctgctgtacgtgatctacaagaagcccgaggtgaactggggcagcagcgtgcaggccggcagctacaacctggccctgagctacagcgtgggcctgaacgaggtggaggaccacatcaagaactacagaccccagtgcctggtgctgaccggcccccccaacttcagacccgccctggtggacttcgtgggcaccttcaccagaaacctgagcctgatgatctgcggccacgtgctgatcggcccccacaagcagagaatgcccgagctgcagctgatcgccaacggccacaccaagtggctgaacaagagaaagatcaaggccttctacagcgacgtgatcgccgaggacctgagaagaggcgtgcagatcctgatgcaggccgccggcctgggcagaatgaagcccaacatcctggtggtgggcttcaagaagaactggcagagcgcccaccccgccaccgtggaggactacatcggcatcctgcacgacgccttcgacttcaactacggcgtgtgcgtgatgagaatgagagagggcctgaacgtgagcaagatgatgcaggcccacatcaaccccgtgttcgaccccgccgaggacggcaaggaggccagcgccagaggcgccagacccagcgtgagcggcgccctggaccccaaggccctggtgaaggaggagcaggccaccaccatcttccagagcgagcagggcaagaagaccatcgacatctactggctgttcgacgacggcggcctgaccctgctgatcccctacctgctgggcagaaagagaagatggagcaagtgcaagatcagagtgttcgtgggcggccagatcaacagaatggaccaggagagaaaggccatcatcagcctgctgagcaagttcagactgggcttccacgaggtgcacatcctgcccgacatcaaccagaaccccagagccgagcacaccaagagattcgaggacatgatcgcccccttcagactgaacgacggcttcaaggacgaggccaccgtgaacgagatgagaagagactgcccctggaagatcagcgacgaggagatcaccaagaacagagtgaagagcctgagacaggtgagactgaacgagatcgtgctggactacagcagagacgccgccctgatcgtgatcaccctgcccatcggcagaaagggcaagtgccccagcagcctgtacatggcctggctggagaccctgagccaggacctgagaccccccgtgatcctgatcagaggcaaccaggagaacgtgctgaccttctactgccagtag

SEQ ID NO: 99391 - DNA, 3093 bp, Artificial Sequence
  Description of Artificial Sequence: Synthetic coding sequence
atggccgagctgcccaccaccgagacccccggcgacgccaccctgtgcagcggcagattcaccatcagcaccctgctgagcagcgacgagcccagcccccccgccgcctacgacagcagccaccccagccacctgacccacagcagcaccttctgcatgagaaccttcggctacaacaccatcgacgtggtgcccacctacgagcactacgccaacagcacccagcccggcgagcccagaaaggtgagacccaccctggccgacctgcacagcttcctgaagcaggagggcagacacctgcacgccctggccttcgacagcagacccagccacgagatgaccgacggcctggtggagggcgaggccggcaccagcagcgagaagaaccccgaggagcccgtgagattcggctgggtgaagggcgtgatgatcagatgcatgctgaacatctggggcgtgatcctgtacctgagactgccctggatcaccgcccaggccggcatcgtgctgacctggatcatcatcctgctgagcgtgaccgtgaccagcatcaccggcctgagcatcagcgccatcagcaccaacggcaaggtgaagagcggcggcacctacttcctgatcagcagaagcctgggccccgagctgggcggcagcatcggcctgatcttcgccttcgccaacgccgtgggcgtggccatgcacaccgtgggcttcgccgagaccgtgagagacctgctgcaggagtacggcgcccccatcgtggaccccatcaacgacatcagaatcatcgccgtggtgagcgtgaccgtgctgctggccatcagcctggccggcatggagtgggagagcaaggcccaggtgctgttcttcctggtgatcatggtgagcttcgccaactacctggtgggcaccctgatcccccccagcgaggacaaggccagcaagggcttcttcagctacagagccgacatcttcgtgcagaacctggtgcccgactggagaggccccgacggcaccttcttcggcatgttcagcatcttcttccccagcgccaccggcatcctggccggcgccaacatcagcggcgacctgaaggaccccgccatcgccatccccaagggcaccctgatggccatcttctggaccaccatcagctacctggccatcagcgccaccatcggcagctgcgtggtgagagacgccagcggcgtgctgaacgacaccgtgacccccggctggggcgcctgcgagggcctggcctgcagctacggctggaacttcaccgagtgcacccagcagcacagctgccactacggcctgatcaactactaccagaccatgagcatggtgagcggcttcgcccccctgatcaccgccggcatcttcggcgccaccctgagcagcgccctggcctgcctggtgagcgccgccaaggtgttccagtgcctgtgcgaggaccagctgtaccccctgatcggcttcttcggcaagggctacggcaagaacaaggagcccgtgagaggctacctgctggcctacgccatcgccgtggccttcatcatcatcgccgagctgaacaccatcgcccccatcatcagcaacttcttcctgtgcagctacgccctgatcaacttcagctgcttccacgccagcatcaccaacagccccggctggagacccagcttccagtactacaacaagtgggccgccctgttcggcgccatcatcagcgtggtgatcatgttcctgctgacctggtgggccgccctgatcgccatcggcgtggtgctgttcctgctgctgtacgtgatctacaagaagcccgaggtgaactggggcagcagcgtgcaggccggcagctacaacctggccctgagctacagcgtgggcctgaacgaggtggaggaccacatcaagaactacagaccccagtgcctggtgctgaccggcccccccaacttcagacccgccctggtggacttcgtgggcaccttcaccagaaacctgagcctgatgatctgcggccacgtgctgatcggcccccacaagcagagaatgcccgagctgcagctgatcgccaacggccacaccaagtggctgaacaagagaaagatcaaggccttctacagcgacgtgatcgccgaggacctgagaagaggcgtgcagatcctgatgcaggccgccggcctgggcagaatgaagcccaacatcctggtggtgggcttcaagaagaactggcagagcgcccaccccgccaccgtggaggactacatcggcatcctgcacgacgccttcgacttcaactacggcgtgtgcgtgatgagaatgagagagggcctgaacgtgagcaagatgatgcaggcccacatcaaccccgtgttcgaccccgccgaggacggcaaggaggccagcgccagaggcgccagacccagcgtgagcggcgccctggaccccaaggccctggtgaaggaggagcaggccaccaccatcttccagagcgagcagggcaagaagaccatcgacatctactggctgttcgacgacggcggcctgaccctgctgatcccctacctgctgggcagaaagagaagatggagcaagtgcaagatcagagtgttcgtgggcggccagatcaacagaatggaccaggagagaaaggccatcatcagcctgctgagcaagttcagactgggcttccacgaggtgcacatcctgcccgacatcaaccagaaccccagagccgagcacaccaagagattcgaggacatgatcgcccccttcagactgaacgacggcttcaaggacgaggccaccgtgaacgagatgagaagagactgcccctggaagatcagcgacgaggagatcaccaagaacagagtgaagagcctgagacaggtgagactgaacgagatcgtgctggactacagcagagacgccgccctgatcgtgatcaccctgcccatcggcagaaagggcaagtgccccagcagcctgtacatggcctggctggagaccctgagccaggacctgagaccccccgtgatcctgatcagaggcaaccaggagaacgtgctgaccttctactgccagtag

SEQ ID NO: 99392 - DNA, 3090 bp, Artificial Sequence; identical to SEQ ID NO: 99390
  Description of Artificial Sequence: Synthetic coding sequence

SEQ ID NO: 99393 - DNA, 1293 bp, Artificial Sequence
  Description of Artificial Sequence: Synthetic coding sequence
atgagcctgaacaacagcagcaacgtgttcctggacagcgtgcccagcaacaccaacagattccaggtgagcgtgatcaacgagaaccacgagagcagcgccgccgccgacgacaacaccgaccccccccactacgaggagaccagcttcggcgacgaggcccagaagagactgagaatcagcttcagacccggcaaccaggagtgctacgacaacttcctgcagagcggcgagaccgccaagaccgacgccagcttccacgcctacgacagccacaccaacacctactacctgcagaccttcggccacaacaccatggacgccgtgcccaagatcgagtactacagaaacaccggcagcatcagcggccccaaggtgaacagacccagcctgctggagatccacgagcagctggccaagaacgtggccgtgacccccagcagcgccgacagagtggccaacggcgacggcatccccggcgacgagcaggccgagaacaaggaggacgaccaggccggcgtggtgaagttcggctgggtgaagggcgtgctggtgagatgcatgctgaacatctggggcgtgatgctgttcatcagactgagctggatcgtgggcgaggccggcatcggcctgggcgtgctgatcatcctgctgagcaccatggtgaccagcatcaccggcctgagcaccagcgccatcgccaccaacggcttcgtgagaggcggcggcgcctactacctgatcagcagaagcctgggccccgagttcggcggcagcatcggcctgatcttcgccttcgccaacgccgtggccgtggccatgtacgtggtgggcttcgccgagaccgtggtggacctgctgaaggagagcgacagcatgatggtggaccccaccaacgacatcagaatcatcggcagcatcaccgtggtgatcctgctgggcatcagcgtggccggcatggagtgggaggccaaggcccaggtgatcctgctggtgatcctgctgatcgccatcgccaacttcttcatcggcaccgtgatccccagcaacaacgagaagaagagcagaggcttcttcaactaccaggccagcatcttcgccgagaacttcggccccagattcaccaagggcgagggcttcttcagcgtgttcgccatcttcttccccgccgccaccggcatcctggccggcgccaacatcagcggcgacctggaggccctgagaaagcagggcgccagccccctgccccagggcgcccagagcagaagaagaagacagaccagcctgatctag

SEQ ID NO: 99394 - DNA, 3300 bp, Artificial Sequence
  Description of Artificial Sequence: Synthetic coding sequence
atgagcctgaacaacagcagcaacgtgttcctggacagcgtgcccagcaacaccaacagattccaggtgagcgtgatcaacgagaaccacgagagcagcgccgccgccgacgacaacaccgaccccccccactacgaggagaccagcttcggcgacgaggcccagaagagactgagaatcagcttcagacccggcaaccaggagtgctacgacaacttcctgcagagcggcgagaccgccaagaccgacgccagcttccacgcctacgacagccacaccaacacctactacctgcagaccttcggccacaacaccatggacgccgtgcccaagatcgagtactacagaaacaccggcagcatcagcggccccaaggtgaacagacccagcctgctggagatccacgagcagctggccaagaacgtggccgtgacccccagcagcgccgacagagtggccaacggcgacggcatccccggcgacgagcaggccgagaacaaggaggacgaccaggccggcgtggtgaagttcggctgggtgaagggcgtgctggtgagatgcatgctgaacatctggggcgtgatgctgttcatcagactgagctggatcgtgggcgaggccggcatcggcctgggcgtgctgatcatcctgctgagcaccatggtgaccagcatcaccggcctgagcaccagcgccatcgccaccaacggcttcgtgagaggcggcggcgcctactacctgatcagcagaagcctgggccccgagttcggcggcagcatcggcctgatcttcgccttcgccaacgccgtggccgtggccatgtacgtggtgggcttcgccgagaccgtggtggacctgctgaaggagagcgacagcatgatggtggaccccaccaacgacatcagaatcatcggcagcatcaccgtggtgatcctgctgggcatcagcgtggccggcatggagtgggaggccaaggcccaggtgatcctgctggtgatcctgctgatcgccatcgccaacttcttcatcggcaccgtgatccccagcaacaacgagaagaagagcagaggcttcttcaactaccaggccagcatcttcgccgagaacttcggccccagattcaccaagggcgagggcttcttcagcgtgttcgccatcttcttccccgccgccaccggcatcctggccggcgccaacatcagcggcgacctggaggacccccaggacgccatccccagaggcaccatgctggccatcttcatcaccaccgtggcctacctgggcgtggccatctgcgtgggcgcctgcgtggtgagagacgccaccggcaacatgaacgacaccatcatcagcggcatgaactgcaacggcagcgccgcctgcggcctgggctacgacttcagcagatgcagacacgagccctgccagtacggcctgatgaacaacttccaggtgatgagcatggtgagcggcttcggccccctgatcaccgccggcatcttcagcgccaccctgagcagcgccctggccagcctggtgagcgcccccaaggtgttccaggccctgtgcaaggacaacatctacaaggccctgcagttcttcgccaagggctacggcaagaacaacgagcccctgagaggctacatcctgaccttcctgatcgccatggccttcatcctgatcgccgagctgaacaccatcgcccccatcatcagcaacttcttcctggccagctacgccctgatcaacttcagctgcttccacgccagctacgccaagagccccggctggagacccgcctacggcatctacaacatgtgggtgagcctgttcggcgccgtgctgtgctgcgccgtgatgttcgtgatcaactggtgggccgccgtgatcacctacgtgatcgagttcttcctgtacgtgtacgtgacctgcaagaagcccgacgtgaactggggcagcagcacccaggccctgagctacgtgagcgccctggacaacgccctggagctgaccaccgtggaggaccacgtgaagaacttcagaccccagtgcatcgtgctgaccggcggccccatgaccagacccgccctgctggacatcacccacgccttcaccaagaacagcggcctgtgcatctgctgcgaggtgttcgtgggccccagaaagctgtgcgtgaaggagatgaacagcggcatggccaagaagcaggcctggctgatcaagaacaagatcaaggccttctacgccgccgtggccgccgactgcttcagagacggcgtgagaagcctgctgcaggccagcggcctgggcagaatgaagcccaacaccctggtgatcggctacaagaagaactggagaaaggcccccctgaccgagatcgagaactacgtgggcatcatccacgacgccttcgacttcgagatcggcgtggtgatcgtgagaatcagccagggcttcgacatcagccaggtgctgcaggtgcaggaggagctggagagactggagcaggagagactggccctggaggccaccatcaaggacaacgagtgcgaggaggagagcggcggcatcagaggcctgttcaagaaggccggcaagctgaacatcaccaagaccacccccaagaaggacggcagcatcaacaccagccagagcatgcacgtgggcgagttcaaccagaagctggtggaggccagcacccagttcaagaagaagcaggagaagggcaccatcgacgtgtggtggctgttcgacgacggcggcctgaccctgctgatcccctacatcctgaccctgagaaagaagtggaaggactgcaagctgagaatctacgtgggcggcaagatcaacagaatcgaggaggagaagatcgtgatggccagcctgctgagcaagttcagaatcaagttcgccgacatccacatcatcggcgacatcaacatcagacccaacaaggagagctggaaggtgttcgaggagatgatcgagccctacagactgcacgagagctgcaaggacctgaccaccgccgagaagctgaagagagagaccccctggaagatcaccgacgccgagctggaggccgtgaaggagaagagctacagacaggtgagactgaacgagctgctgcaggagcacagcagagccgccaacctgatcgtgctgagcctgcccgtggccagaaagggcagcatcagcgacctgctgtacatggcctggctggagatcctgaccaagaacctgccccccgtgctgctggtgagaggcaaccacaagaacgtgctgaccttctacagctag

SEQ ID NO: 99395 - DNA, 3300 bp, Artificial Sequence
  Description of Artificial Sequence: Synthetic coding sequence
atgagcctgaacaacagcagcaacgtgttcctggacagcgtgcccagcaacaccaacagattccaggtgagcgtgatcaacgagaaccacgagagcagcgccgccgccgacgacaacaccgaccccccccactacgaggagaccagcttcggcgacgaggcccagaagagactgagaatcagcttcagacccggcaaccaggagtgctacgacaacttcctgcagagcggcgagaccgccaagaccgacgccagcttccacgcctacgacagccacaccaacacctactacctgcagaccttcggccacaacaccatggacgccgtgcccaagatcgagtactacagaaacaccggcagcatcagcggccccaaggtgaacagacccagcctgctggagatccacgagcagctggccaagaacgtggccgtgacccccagcagcgccgacagagtggccaacggcgacggcatccccggcgacgagcaggccgagaacaaggaggacgaccaggccggcgtggtgaagttcggctgggtgaagggcgtgctggtgagatgcatgctgaacatctggggcgtgatgctgttcatcagactgagctggatcgtgggcgaggccggcatcggcctgggcgtgatcatcatcggcctgagcgtggtggtgaccaccctgaccggcatcagcatgagcgccatctgcaccaacggcgtggtgagaggcggcggcgcctactacctgatcagcagaagcctgggccccgagttcggcggcagcatcggcctgatcttcgccttcgccaacgccgtggccgtggccatgtacgtggtgggcttcgccgagaccgtggtggacctgctgaaggagagcgacagcatgatggtggaccccaccaacgacatcagaatcatcggcagcatcaccgtggtgatcctgctgggcatcagcgtggccggcatggagtgggaggccaaggcccaggtgatcctgctggtgatcctgctgatcgccatcgccaacttcttcatcggcaccgtgatccccagcaacaacgagaagaagagcagaggcttcttcaactaccaggccagcatcttcgccgagaacttcggccccagattcaccaagggcgagggcttcttcagcgtgttcgccatcttcttccccgccgccaccggcatcctggccggcgccaacatcagcggcgacctggaggacccccaggacgccatccccagaggcaccatgctggccatcttcatcaccaccgtggcctacctgggcgtggccatctgcgtgggcgcctgcgtggtgagagacgccaccggcaacatgaacgacaccatcatcagcggcatgaactgcaacggcagcgccgcctgcggcctgggctacgacttcagcagatgcagacacgagccctgccagtacggcctgatgaacaacttccaggtgatgagcatggtgagcggcttcggccccctgatcaccgccggcatcttcagcgccaccctgagcagcgccctggccagcctggtgagcgcccccaaggtgttccaggccctgtgcaaggacaacatctacaaggccctgcagttcttcgccaagggctacggcaagaacaacgagcccctgagaggctacatcctgaccttcctgatcgccatggccttcatcctgatcgccgagctgaacaccatcgcccccatcatcagcaacttcttcctggccagctacgccctgatcaacttcagctgcttccacgccagctacgccaagagccccggctggagacccgcctacggcatctacaacatgtgggtgagcctgttcggcgccgtgctgtgctgcgccgtgatgttcgtgatcaactggtgggccgccgtgatcacctacgtgatcgagttcttcctgtacgtgtacgtgacctgcaagaagcccgacgtgaactggggcagcagcacccaggccctgagctacgtgagcgccctggacaacgccctggagctgaccaccgtggaggaccacgtgaagaacttcagaccccagtgcatcgtgctgaccggcggccccatgaccagacccgccctgctggacatcacccacgccttcaccaagaacagcggcctgtgcatctgctgcgaggtgttcgtgggccccagaaagctgtgcgtgaaggagatgaacagcggcatggccaagaagcaggcctggctgatcaagaacaagatcaaggccttctacgccgccgtggccgccgactgcttcagagacggcgtgagaagcctgctgcaggccagcggcctgggcagaatgaagcccaacaccctggtgatcggctacaagaagaactggagaaaggcccccctgaccgagatcgagaactacgtgggcatcatccacgacgccttcgacttcgagatcggcgtggtgatcgtgagaatcagccagggcttcgacatcagccaggtgctgcaggtgcaggaggagctggagagactggagcaggagagactggccctggaggccaccatcaaggacaacgagtgcgaggaggagagcggcggcatcagaggcctgttcaagaaggccggcaagctgaacatcaccaagaccacccccaagaaggacggcagcatcaacaccagccagagcatgcacgtgggcgagttcaaccagaagctggtggaggccagcacccagttcaagaagaagcaggagaagggcaccatcgacgtgtggtggctgttcgacgacggcggcctgaccctgctgatcccctacatcctgaccctgagaaagaagtggaaggactgcaagctgagaatctacgtgggcggcaagatcaacagaatcgaggaggagaagatcgtgatggccagcctgctgagcaagttcagaatcaagttcgccgacatccacatcatcggcgacatcaacatcagacccaacaaggagagctggaaggtgttcgaggagatgatcgagccctacagactgcacgagagctgcaaggacctgaccaccgccgagaagctgaagagagagaccccctggaagatcaccgacgccgagctggaggccgtgaaggagaagagctacagacaggtgagactgaacgagctgctgcaggagcacagcagagccgccaacctgatcgtgctgagcctgcccgtggccagaaagggcagcatcagcgacctgctgtacatggcctggctggagatcctgaccaagaacctgccccccgtgctgctggtgagaggcaaccacaagaacgtgctgaccttctacagctag

SEQ ID NO: 99396 - DNA, 1782 bp, Artificial Sequence
  Description of Artificial Sequence: Synthetic coding sequence
atgctgaacatctggggcgtgatgctgttcatcagactgagctggatcgtgggcgaggccggcatcggcctgggcgtgctgatcatcctgctgagcaccatggtgaccagcatcaccggcctgagcaccagcgccatcgccaccaacggcttcgtgagaggcggcggcgcctactacctgatcagcagaagcctgggccccgagttcggcggcagcatcggcctgatcttcgccttcgccaacgccgtggccgtggccatgtacgtggtgggcttcgccgagaccgtggtggacctgctgaaggagagcgacagcatgatggtggaccccaccaacgacatcagaatcatcggcagcatcaccgtggtgatcctgctgggcatcagcgtggccggcatggagtgggaggccaaggcccaggtgatcctgctggtgatcctgctgatcgccatcgccaacttcttcatcggcaccgtgatccccagcaacaacgagaagaagagcagaggcttcttcaactaccaggccagcatcttcgccgagaacttcggccccagattcaccaagggcgagggcttcttcagcgtgttcgccatcttcttccccgccgccaccggcatcctggccggcgccaacatcagcggcgacctggaggacccccaggacgccatccccagaggcaccatgctggccatcttcatcaccaccgtggcctacctgggcgtggccatctgcgtgggcgcctgcgtggtgagagacgccaccggcaacatgaacgacaccatcatcagcggcatgaactgcaacggcagcgccgcctgcggcctgggctacgacttcagcagatgcagacacgagccctgccagtacggcctgatgaacaacttccaggtgatgagcatggtgagcggcttcggccccctgatcaccgccggcatcttcagcgccaccctgagcagcgccctggccagcctggtgagcgcccccaaggtgttccaggccctgtgcaaggacaacatctacaaggccctgcagttcttcgccaagggctacggcaagaacaacgagcccctgagaggctacatcctgaccttcctgatcgccatggccttcatcctgatcgccgagctgaacaccatcgcccccatcatcagcaacttcttcctggccagctacgccctgatcaacttcagctgcttccacgccagctacgccaagagccccggctggagacccgcctacggcatctacaacatgtgggtgagcctgttcggcgccgtgctgtgctgcgccgtgatgttcgtgatcaactggtgggccgccgtgatcacctacgtgatcgagttcttcctgtacgtgtacgtgacctgcaagaagcccgacgtgaactggggcagcagcacccaggccctgagctacgtgagcgccctggacaacgccctggagctgaccaccgtggaggaccacgtgaagaacttcagaccccagtgcatcgtgctgaccggcggccccatgaccagacccgccctgctggacatcacccacgccttcaccaagaacagcggcctgtgcatctgctgcgaggtgttcgtgggccccagaaagctgtgcgtgaaggagatgaacagcggcatggccaagaccggcctggcctacaaggagcagaaccagggcttcctgtgctgcagcggcggcagactgttccagggctggtgccccaagagcagcagcggcctgagactgagaaagaacgagaccaagcacagcggcgactggatctag

SEQ ID NO: 99397 - DNA, 540 bp, Artificial Sequence
  Description of Artificial Sequence: Synthetic coding sequence
atgagaaccatgagagccgtgcagctgcagatgaccatcctgacccaccacatcatgaagaagcccctgctgggcatgaagctgagaaaggacagcgagagcgccctgggcctgggcatcagaagcgccatgaccatcagcagcaagcaggccctgagctacgtgagcgccctggacaacgccctggagctgaccaccgtggaggaccacgtgaagaacttcagaccccagtgcatcgtgctgaccggcggccccatgaccagacccgccctgctggacatcacccacgccttcaccaagaacagcggcctgtgcatctgctgcgaggtgttcgtgggccccagaaagctgtgcgtgaaggagatgaacagcggcatggccaagaagcaggcctggctgatcaagaacaagatcaaggccttctacgccgccgtggccgccgactgcttcagagacggcgtgagaagcctgctgcaggccagcggcctgggcagaatgaagcccaacaccctggtgatcggctacaagaagaactggtag

SEQ ID NO: 99398 - DNA, 3300 bp, Artificial Sequence; identical to SEQ ID NO: 99394
  Description of Artificial Sequence: Synthetic coding sequence

SEQ ID NO: 99399 - DNA, 1947 bp, Artificial Sequence
  Description of Artificial Sequence: Synthetic coding sequence
atgctgaacatctggggcgtgatgctgttcatcagactgagctggatcgtgggcgaggccggcatcggcctgggcgtgctgatcatcctgctgagcaccatggtgaccagcatcaccggcctgagcaccagcgccatcgccaccaacggcttcgtgagaggcggcggcgcctactacctgatcagcagaagcctgggccccgagttcggcggcagcatcggcctgatcttcgccttcgccaacgccgtggccgtggccatgtacgtggtgggcttcgccgagaccgtggtggacctgctgaaggagagcgacagcatgatggtggaccccaccaacgacatcagaatcatcggcagcatcaccgtggtgatcctgctgggcatcagcgtggccggcatggagtgggaggccaaggcccaggtgatcctgctggtgatcctgctgatcgccatcgccaacttcttcatcggcaccgtgatccccagcaacaacgagaagaagagcagaggcttcttcaactaccaggccagcatcttcgccgagaacttcggccccagattcaccaagggcgagggcttcttcagcgtgttcgccatcttcttccccgccgccaccggcatcctggccggcgccaacatcagcggcgacctggaggacccccaggacgccatccccagaggcaccatgctggccatcttcatcaccaccgtggcctacctgggcgtggccatctgcgtgggcgcctgcgtggtgagagacgccaccggcaacatgaacgacaccatcatcagcggcatgaactgcaacggcagcgccgcctgcggcctgggctacgacttcagcagatgcagacacgagccctgccagtacggcctgatgaacaacttccaggtgatgagcatggtgagcggcttcggccccctgatcaccgccggcatcttcagcgccaccctgagcagcgccctggccagcctggtgagcgcccccaaggtgttccaggccctgtgcaaggacaacatctacaaggccctgcagttcttcgccaagggctacggcaagaacaacgagcccctgagaggctacatcctgaccttcctgatcgccatggccttcatcctgatcgccgagctgaacaccatcgcccccatcatcagcaacttcttcctggccagctacgccctgatcaacttcagctgcttccacgccagctacgccaagagccccggctggagacccgcctacggcatctacaacatgtgggtgagcctgttcggcgccgtgctgtgctgcgccgtgatgttcgtgatcaactggtgggccgccgtgatcacctacgtgatcgagttcttcctgtacgtgtacgtgacctgcaagaagcccgacgtgaactggggcagcagcacccaggccctgagctacgtgagcgccctggacaacgccctggagctgaccaccgtggaggaccacgtgaagaacttcagaccccagtgcatcgtgctgaccggcggccccatgaccagacccgccctgctggacatcacccacgccttcaccaagaacagcggcctgtgcatctgctgcgaggtgttcgtgggccccagaaagctgtgcgtgaaggagatgaacagcggcatggccaagaagcaggcctggctgatcaagaacaagatcaaggccttctacgccgccgtggccgccgactgcttcagagacggcgtgagaagcctgctgcaggccagcggcctgggcagaatgaagcccaacaccctggtgatcggctacaagaagaactggagaaaggcccccctgaccgagatcgagaactacgtgggcatcatccacgacgccttcgacttcgagatcggcgtggtgatcgtgagaatcagccagggcttcgacatcagccaggtgctgcaggtgcaggaggagctggagagactggagtag

SEQ ID NO: 99400 - DNA, 3639 bp, Artificial Sequence
  Description of Artificial Sequence: Synthetic coding sequence
atggagcccagacccaccgcccccagcagcggcgcccccggcctggccggcgtgggcgagacccccagcgccgccgccctggccgccgccagagtggagctgcccggcaccgccgtgcccagcgtgcccgaggacgccgcccccgccagcagagacggcggcggcgtgagagacgagggccccgccgccgccggcgacggcctgggcagacccctgggccccacccccagccagagcagattccaggtggacctggtgagcgagaacgccggcagagccgccgccgccgccgccgccgccgccgccgccgccgccgccgccggcgccggcgccggcgccaagcagacccccgccgacggcgaggccagcggcgagagcgagcccgccaagggcagcgaggaggccaagggcagattcagagtgaacttcgtggaccccgccgccagcagcagcgccgaggacagcctgagcgacgccgccggcgtgggcgtggacggccccaacgtgagcttccagaacggcggcgacaccgtgctgagcgagggcagcagcctgcacagcggcggcggcggcggcagcggccaccaccagcactactactacgacacccacaccaacacctactacctgagaaccttcggccacaacaccatggacgccgtgcccagaatcgaccactacagacacaccgccgcccagctgggcgagaagctgctgagacccagcctggccgagctgcacgacgagctggagaaggagcccttcgaggacggcttcgccaacggcgaggagagcacccccaccagagacgccgtggtgacctacaccgccgagagcaagggcgtggtgaagttcggctggatcaagggcgtgctggtgagatgcatgctgaacatctggggcgtgatgctgttcatcagactgagctggatcgtgggccaggccggcatcggcctgagcgtgctggtgatcatgatggccaccgtggtgaccaccatcaccggcctgagcaccagcgccatcgccaccaacggcttcgtgagaggcggcggcgcctactacctgatcagcagaagcctgggccccgagttcggcggcgccatcggcctgatcttcgccttcgccaacgccgtggccgtggccatgtacgtggtgggcttcgccgagaccgtggtggagctgctgaaggagcacagcatcctgatgatcgacgagatcaacgacatcagaatcatcggcgccatcaccgtggtgatcctgctgggcatcagcgtggccggcatggagtgggaggccaaggcccagatcgtgctgctggtgatcctgctgctggccatcggcgacttcgtgatcggcaccttcatccccctggagagcaagaagcccaagggcttcttcggctacaagagcgagatcttcaacgagaacttcggccccgacttcagagaggaggagaccttcttcagcgtgttcgccatcttcttccccgccgccaccggcatcctggccggcgccaacatcagcggcgacctggccgacccccagagcgccatccccaagggcaccctgctggccatcctgatcaccaccctggtgtacgtgggcatcgccgtgagcgtgggcagctgcgtggtgagagacgccaccggcaacgtgaacgacaccatcgtgaccgagctgaccaactgcaccagcgccgcctgcaagctgaacttcgacttcagcagctgcgagagcagcccctgcagctacggcctgatgaacaacttccaggtgatgagcatggtgagcggcttcacccccctgatcagcgccggcatcttcagcgccaccctgagcagcgccctggccagcctggtgagcgcccccaagatcttccaggccctgtgcaaggacaacatctaccccgccttccagatgttcgccaagggctacggcaagaacaacgagcccctgagaggctacatcctgaccttcctgatcgccctgggcttcatcctgatcgccgagctgaacgtgatcgcccccatcatcagcaacttcttcctggccagctacgccctgatcaacttcagcgtgttccacgccagcctggccaagagccccggctggagacccgccttcaagtactacaacatgtggatcagcctgctgggcgccatcctgtgctgcatcgtgatgttcgtgatcaactggtgggccgccctgctgacctacgtgatcgtgctgggcctgtacatctacgtgacctacaagaagcccgacgtgaactggggcagcagcacccaggccctgacctacctgaacgccctgcagcacagcatcagactgagcggcgtggaggaccacgtgaagaacttcagaccccagtgcctggtgatgaccggcgcccccaacagcagacccgccctgctgcacctggtgcacgacttcaccaagaacgtgggcctgatgatctgcggccacgtgcacatgggccccagaagacaggccatgaaggagatgagcatcgaccaggccaagtaccagagatggctgatcaagaacaagatgaaggccttctacgcccccgtgcacgccgacgacctgagagagggcgcccagtacctgatgcaggccgccggcctgggcagaatgaagcccaacaccctggtgctgggcttcaagaaggactggctgcaggccgacatgagagacgtggacatgtacatcaacctgttccacgacgccttcgacatccagtacggcgtggtggtgatcagactgaaggagggcctggacatcagccacctgcagggccaggaggagctgctgagcagccaggagaagagccccggcaccaaggacgtggtggtgagcgtggagtacagcaagaagagcgacctggacaccagcaagcccctgagcgagaagcccatcacccacaaggtggaggaggaggacggcaagaccgccacccagcccctgctgaagaaggagagcaagggccccatcgtgcccctgaacgtggccgaccagaagctgctggaggccagcacccagttccagaagaagcagggcaagaacaccatcgacgtgtggtggctgttcgacgacggcggcctgaccctgctgatcccctacctgctgaccaccaagaagaagtggaaggactgcaagatcagagtgttcatcggcggcaagatcaacagaatcgaccacgacagaagagccatggccaccctgctgagcaagttcagaatcgacttcagcgacatcatggtgctgggcgacatcaacaccaagcccaagaaggagaacatcatcgccttcgaggagatcatcgagccctacagactgcacgaggacgacaaggagcaggacatcgccgacaagatgaaggaggacgagccctggagaatcaccgacaacgagctggagctgtacaagaccaagacctacagacagatcagactgaacgagctgctgaaggagcacagcagcaccgccaacatcatcgtgatgagcctgcccgtggccagaaagggcgccgtgagcagcgccctgtacatggcctggctggaggccctgagcaaggacctgccccccatcctgctggtgagaggcaaccaccagagcgtgctgaccttctacagctag

SEQ ID NO: 99401 - DNA, 3591 bp, Artificial Sequence
  Description of Artificial Sequence: Synthetic coding sequence
atggagcccagacccaccgcccccagcagcggcgcccccggcctggccggcgtgggcgagacccccagcgccgccgccctggccgccgccagagtggagctgcccggcaccgccgtgcccagcgtgcccgaggacgccgcccccgccagcagagacggcggcggcgtgagagacgagggccccgccgccgccggcgacggcctgggcagacccctgggccccacccccagccagagcagattccaggtggacctggtgagcgagaacgccggcagagccgccgccgccgccgccgccgccgccgccgccgccgccgccgccggcgccggcgccggcgccaagcagacccccgccgacggcgaggccagcggcgagagcgagcccgccaagggcagcgaggaggccaagggcagattcagagtgaacttcgtggaccccgccgccagcagcagcgccgaggacagcctgagcgacgccgccggcgtgggcgtggacggccccaacgtgagcttccagaacggcggcgacaccgtgctgagcgagggcagcagcctgcacagcggcggcggcggcggcagcggccaccaccagcactactactacgacacccacaccaacacctactacctgagaaccttcggccacaacaccatggacgccgtgcccagaatcgaccactacagacacaccgccgcccagctgggcgagaagctgctgagacccagcctggccgagctgcacgacgagctggagaaggagcccttcgaggacggcttcgccaacggcgaggagagcacccccaccagagacgccgtggtgacctacaccgccgagagcaagggcgtggtgaagttcggctggatcaagggcgtgctggtgagatgcatgctgaacatctggggcgtgatgctgttcatcagactgagctggatcgtgggccaggccggcatcggcctgagcgtgctggtgatcatgatggccaccgtggtgaccaccatcaccggcctgagcaccagcgccatcgccaccaacggcttcgtgagaggcggcggcgcctactacctgatcagcagaagcctgggccccgagttcggcggcgccatcggcctgatcttcgccttcgccaacgccgtggccgtggccatgtacgtggtgggcttcgccgagaccgtggtggagctgctgaaggagcacagcatcctgatgatcgacgagatcaacgacatcagaatcatcggcgccatcaccgtggtgatcctgctgggcatcagcgtggccggcatggagtgggaggccaaggcccagatcgtgctgctggtgatcctgctgctggccatcggcgacttcgtgatcggcaccttcatccccctggagagcaagaagcccaagggcttcttcggctacaagagcgagatcttcaacgagaacttcggccccgacttcagagaggaggagaccttcttcagcgtgttcgccatcttcttccccgccgccaccggcatcctggccggcgccaacatcagcggcgacctggccgacccccagagcgccatccccaagggcaccctgctggccatcctgatcaccaccctggtgtacgtgggcatcgccgtgagcgtgggcagctgcgtggtgagagacgccaccggcaacgtgaacgacaccatcgtgaccgagctgaccaactgcaccagcgccgcctgcaagctgaacttcgacttcagcagctgcgagagcagcccctgcagctacggcctgatgaacaacttccaggtgatgagcatggtgagcggcttcacccccctgatcagcgccggcatcttcagcgccaccctgagcagcgccctggccagcctggtgagcgcccccaagatcttccaggccctgtgcaaggacaacatctaccccgccttccagatgttcgccaagggctacggcaagaacaacgagcccctgagaggctacatcctgaccttcctgatcgccctgggcttcatcctgatcgccgagctgaacgtgatcgcccccatcatcagcaacttcttcctggccagctacgccctgatcaacttcagcgtgttccacgccagcctggccaagagccccggctggagacccgccttcaagtactacaacatgtggatcagcctgctgggcgccatcctgtgctgcatcgtgatgttcgtgatcaactggtgggccgccctgctgacctacgtgatcgtgctgggcctgtacatctacgtgacctacaagaagcccgacgtgaactggggcagcagcacccaggccctgacctacctgaacgccctgcagcacagcatcagactgagcggcgtggaggaccacgtgaagaacttcagaccccagtgcctggtgatgaccggcgcccccaacagcagacccgccctgctgcacctggtgcacgacttcaccaagaacgtgggcctgatgatctgcggccacgtgcacatgggccccagaagacaggccatgaaggagatgagcatcgaccaggccaagtaccagagatggctgatcaagaacaagatgaaggccttctacgcccccgtgcacgccgacgacctgagagagggcgcccagtacctgatgcaggccgccggcctgggcagaatgaagcccaacaccctggtgctgggcttcaagaaggactggctgcaggccgacatgagagacgtggacatgtacatcaacctgttccacgacgccttcgacatccagtacggcgtggtggtgatcagactgaaggagggcctggacatcagccacctgcagggccaggaggagctgctgagcagccaggagaagagccccggcaccaaggacgtggtggtgagcgtggagtacagcaagaagagcgacctggacaccagcaagcccctgagcgagaagcccatcacccacaaggagagcaagggccccatcgtgcccctgaacgtggccgaccagaagctgctggaggccagcacccagttccagaagaagcagggcaagaacaccatcgacgtgtggtggctgttcgacgacggcggcctgaccctgctgatcccctacctgctgaccaccaagaagaagtggaaggactgcaagatcagagtgttcatcggcggcaagatcaacagaatcgaccacgacagaagagccatggccaccctgctgagcaagttcagaatcgacttcagcgacatcatggtgctgggcgacatcaacaccaagcccaagaaggagaacatcatcgccttcgaggagatcatcgagccctacagactgcacgaggacgacaaggagcaggacatcgccgacaagatgaaggaggacgagccctggagaatcaccgacaacgagctggagctgtacaagaccaagacctacagacagatcagactgaacgagctgctgaaggagcacagcagcaccgccaacatcatcgtgatgagcctgcccgtggccagaaagggcgccgtgagcagcgccctgtacatggcctggctggaggccctgagcaaggacctgccccccatcctgctggtgagaggcaaccaccagagcgtgctgaccttctacagctag

SEQ ID NO: 99402 - DNA, 1788 bp, Artificial Sequence
  Description of Artificial Sequence: Synthetic coding sequence
atgaagttcttcagctacatcctggtgtacagaagattcctgttcgtggtgttcaccgtgctggtgctgctgcccctgcccatcgtgctgcacaccaaggaggccgagtgcgcctacaccctgttcgtggtggccaccttctggctgaccgaggccctgcccctgagcgtgaccgccctgctgcccagcctgatgctgcccatgttcggcatcatgcccagcaagaaggtggccagcgcctacttcaaggacttccacctgctgctgatcggcgtgatctgcctggccaccagcatcgagaagtggaacctgcacaagagaatcgccctgaagatggtgatgatggtgggcgtgaaccccgcctggctgaccctgggcttcatgagcagcaccgccttcctgagcatgtggctgagcaacaccagcaccgccgccatggtgatgcccatcgccgaggccgtggtgcagcagatcatcaacgccgaggccgaggtggaggccacccagatgacctacttcaacggcagcaccaaccacggcctggagatcgacgagagcgtgaacggccacgagatcaacgagagaaaggagaagaccaagcccgtgcccggctacaacaacgacaccggcaagatcagcagcaaggtggagctggagaagaacagcggcatgagaaccaagtacagaaccaagaagggccacgtgaccagaaagctgacctgcctgtgcatcgcctacagcagcaccatcggcggcctgaccaccatcaccggcaccagcaccaacctgatcttcgccgagtacttcaacaccagataccccgactgcagatgcctgaacttcggcagctggttcaccttcagcttccccgccgccctgatcatcctgctgctgagctggatctggctgcagtggctgttcctgggcttcaacttcaaggagatgttcaagtgcggcaagaccaagaccgtgcagcagaaggcctgcgccgaggtgatcaagcaggagtaccagaagctgggccccatcagataccaggagatcgtgaccctggtgctgttcatcatcatggccctgctgtggttcagcagagaccccggcttcgtgcccggctggagcgccctgttcagcgagtaccccggcttcgccaccgacagcaccgtggccctgctgatcggcctgctgttcttcctgatccccgccaagaccctgaccaagaccacccccaccggcgagatcgtggccttcgactacagccccctgatcacctggaaggagttccagagcttcatgccctgggacatcgccatcctggtgggcggcggcttcgccctggccgacggctgcgaggagagcggcctgagcaagtggatcggcaacaagctgagccccctgggcagcctgcccgcctggctgatcatcctgatcagcagcctgatggtgaccagcctgaccgaggtggccagcaaccccgccaccatcaccctgttcctgcccatcctgagccccctggccgaggccatccacgtgaaccccctgtacatcctgatccccagcaccctgtgcaccagcttcgccttcctgctgcccgtggccaacccccccaacgccatcgtgttcagctacggccacctgaaggtgatcgacatggtgaaggccggcctgggcgtgaacatcgtgggcgtggccgtggtgatgctgggcatctgcacctggatcgtgcccatgttcgacctgtacacctaccccagctgggcccccgccatgagcaacgagaccatgccctag

SEQ ID NO: 99403 - DNA, 486 bp, Artificial Sequence
  Description of Artificial Sequence: Synthetic coding sequence
atgctgcccatgttcggcatcatgcccagcaagaaggtggccagcgcctacttcaaggacttccacctgctgctgatcggcgtgatctgcctggccaccagcatcgagaagtggaacctgcacaagagaatcgccctgaagatggtgatgatggtgggcgtgaaccccgcctggctgaccctgggcttcatgagcagcaccgccttcctgagcatgtggctgagcaacaccagcaccgccgccatggtgatgcccatcgccgaggccgtggtgcagcagatcatcaacgccgaggccgaggtggaggccacccagatgacctacttcaacggcagcaccaaccacggcctggagatcgacgagagcgtgaacggccacgagatcaacgagagaaaggagaagaccaagcccgtgcccggctacaacaacgacaccggcaagatcagcagcaaggtggagctggagaagtacctgcaggtgagatag

SEQ ID NO: 99404 - DNA, 1881 bp, Artificial Sequence
  Description of Artificial Sequence: Synthetic coding sequence
atgggcctgctgcagggcctgctgagagtgagaaagctgctgctggtggtgtgcgtgcccctgctgctgctgcccctgcccgtgctgcaccccagcagcgaggccagctgcgcctacgtgctgatcgtgaccgccgtgtactgggtgagcgaggccgtgcccctgggcgccgccgccctggtgcccgccttcctgtaccccttcttcggcgtgctgagaagcaacgaggtggccgccgagtacttcaagaacaccaccctgctgctggtgggcgtgatctgcgtggccgccgccgtggagaagtggaacctgcacaagagaatcgccctgagaatggtgctgatggccggcgccaagcccggcatgctgctgctgtgcttcatgtgctgcaccaccctgctgagcatgtggctgagcaacaccagcaccaccgccatggtgatgcccatcgtggaggccgtgctgcaggagctggtgagcgccgaggacgagcagctggtggccggcaacagcaacaccgaggaggccgagcccatcagcctggacgtgaagaacagccagcccagcctggagctgatcttcgtgaacgaggagagcaacgccgacctgaccaccctgatgcacaacgagaacctgaacggcgtgcccagcatcaccaaccccatcaagaccgccaaccagcaccagggcaagaagcagcaccccagccaggagaagccccaggtgctgacccccagccccagaaagcagaagctgaacagaaagtacagaagccaccacgaccagatgatctgcaagtgcctgagcctgagcatcagctacagcgccaccatcggcggcctgaccaccatcatcggcaccagcaccagcctgatcttcctggagcacttcaacaaccagtaccccgccgccgaggtggtgaacttcggcacctggttcctgttcagcttccccatcagcctgatcatgctggtggtgagctggttctggatgcactggctgttcctgggctgcaacttcaaggagacctgcagcctgagcaagaagaagaagaccaagagagagcagctgagcgagaagagaatccaggaggagtacgagaagctgggcgacatcagctaccccgagatggtgaccggcttcttcttcatcctgatgaccgtgctgtggttcaccagagagcccggcttcgtgcccggctgggacagcttcttcgagaagaagggctacagaaccgacgccaccgtgagcgtgttcctgggcttcctgctgttcctgatccccgccaagaagccctgcttcggcaagaagaacgacggcgagaaccaggagcacagcctgggcaccgagcccatcatcacctggaaggacttccagaagaccatgccctgggagatcgtgatcctggtgggcggcggctacgccctggccagcggcagcaagagcagcggcctgagcacctggatcggcaaccagatgctgagcctgagcagcctgcccccctgggccgtgaccctgctggcctgcatcctggtgagcatcgtgaccgagttcgtgagcaaccccgccaccatcaccatcttcctgcccatcctgtgcagcctgagcgagaccctgcacatcaaccccctgtacaccctgatccccgtgaccatgtgcatcagcttcgccgtgatgctgcccgtgggcaacccccccaacgccatcgtgttcagctacggccactgccagatcaaggacatggtgaaggccggcctgggcgtgaacgtgatcggcctggtgatcgtgatggtggccatcaacacctggggcgtgagcctgttccacctggacacctaccccgcctgggccagagtgagcaacatcaccgaccaggcctag

SEQ ID NO: 99405 - DNA, 1569 bp, Artificial Sequence
  Description of Artificial Sequence: Synthetic coding sequence
atggccagcgccctgagctacgtgagcaagttcaagagcttcgtgatcctgttcgtgacccccctgctgctgctgcccctggtgatcctgatgcccgccaagttcgtgagatgcgcctacgtgatcatcctgatggccatctactggtgcaccgaggtgatccccctggccgtgaccagcctgatgcccgtgctgctgttccccctgttccagatcctggacagcagacaggtgtgcgtgcagtacatgaaggacaccaacatgctgttcctgggcggcctgatcgtggccgtggccgtggagagatggaacctgcacaagagaatcgccctgagaaccctgctgtgggtgggcgccaagcccgccagactgatgctgggcttcatgggcgtgaccgccctgctgagcatgtggatcagcaacaccgccaccaccgccatgatggtgcccatcgtggaggccatcctgcagcagatggaggccaccagcgccgccaccgaggccggcctggagctggtggacaagggcaaggccaaggagctgcccggcagccaggtgatcttcgagggccccaccctgggccagcaggaggaccaggagagaaagagactgtgcaaggccatgaccctgtgcatctgctacgccgccagcatcggcggcaccgccaccctgaccggcaccggccccaacgtggtgctgctgggccagatgaacgagctgttccccgacagcaaggacctggtgaacttcgccagctggttcgccttcgccttccccaacatgctggtgatgctgctgttcgcctggctgtggctgcagttcgtgtacatgagattcaacttcaagaagagctggggctgcggcctggagagcaagaagaacgagaaggccgccctgaaggtgctgcaggaggagtacagaaagctgggccccctgagcttcgccgagatcaacgtgctgatctgcttcttcctgctggtgatcctgtggttcagcagagaccccggcttcatgcccggctggctgaccgtggcctgggtggagggcgagaccaagtacgtgagcgacgccaccgtggccatcttcgtggccaccctgctgttcatcgtgcccagccagaagcccaagttcaacttcagaagccagaccgaggaggagagaaagacccccttctaccccccccccctgctggactggaaggtgacccaggagaaggtgccctggggcatcgtgctgctgctgggcggcggcttcgccctggccaagggcagcgaggccagcggcctgagcgtgtggatgggcaagcagatggagcccctgcacgccgtgccccccgccgccatcaccctgatcctgagcctgctggtggccgtgttcaccgagtgcaccagcaacgtggccaccaccaccctgttcctgcccatcttcgccagcatggtgaagaccggcgtgatcatgaacatcatcggcgtgttctgcgtgttcctggccgtgaacacctggggcagagccatcttcgacctggaccacttccccgactgggccaacgtgacccacatcgagacctag

SEQ ID NO: 99406 - DNA, 1707 bp, Artificial Sequence
  Description of Artificial Sequence: Synthetic coding sequence
atggccagcgccctgagctacgtgagcaagttcaagagcttcgtgatcctgttcgtgacccccctgctgctgctgcccctggtgatcctgatgcccgccaagttcgtgagatgcgcctacgtgatcatcctgatggccatctactggtgcaccgaggtgatccccctggccgtgaccagcctgatgcccgtgctgctgttccccctgttccagatcctggacagcagacaggtgtgcgtgcagtacatgaaggacaccaacatgctgttcctgggcggcctgatcgtggccgtggccgtggagagatggaacctgcacaagagaatcgccctgagaaccctgctgtgggtgggcgccaagcccgccagactgatgctgggcttcatgggcgtgaccgccctgctgagcatgtggatcagcaacaccgccaccaccgccatgatggtgcccatcgtggaggccatcctgcagcagatggaggccaccagcgccgccaccgaggccggcctggagctggtggacaagggcaaggccaaggagctgcccggcagccaggtgatcttcgagggccccaccctgggccagcaggaggaccaggagagaaagagactgtgcaaggccatgaccctgtgcatctgctacgccgccagcatcggcggcaccgccaccctgaccggcaccggccccaacgtggtgctgctgggccagatgaacgagctgttccccgacagcaaggacctggtgaacttcgccagctggttcgccttcgccttccccaacatgctggtgatgctgctgttcgcctggctgtggctgcagttcgtgtacatgagattcaacttcaagaagagctggggctgcggcctggagagcaagaagaacgagaaggccgccctgaaggtgctgcaggaggagtacagaaagctgggccccctgagcttcgccgagatcaacgtgctgatctgcttcttcctgctggtgatcctgtggttcagcagagaccccggcttcatgcccggctggctgaccgtggcctgggtggagggcgagaccaagtacgtgagcgacgccaccgtggccatcttcgtggccaccctgctgttcatcgtgcccagccagaagcccaagttcaacttcagaagccagaccgaggaggagagaaagacccccttctaccccccccccctgctggactggaaggtgacccaggagaaggtgccctggggcatcgtgctgctgctgggcggcggcttcgccctggccaagggcagcgaggccagcggcctgagcgtgtggatgggcaagcagatggagcccctgcacgccgtgccccccgccgccatcaccctgatcctgagcctgctggtggccgtgttcaccgagtgcaccagcaacgtggccaccaccaccctgttcctgcccatcttcgccagcatgagcagaagcatcggcctgaaccccctgtacatcatgctgccctgcaccctgagcgccagcttcgccttcatgctgcccgtggccaccccccccaacgccatcgtgttcacctacggccacctgaaggtggccgacatggtgaagaccggcgtgatcatgaacatcatcggcgtgttctgcgtgttcctggccgtgaacacctggggcagagccatcttcgacctggaccacttccccgactgggccaacgtgacccacatcgagacctag

SEQ ID NO: 99407 - DNA, 1578 bp, Artificial Sequence
  Description of Artificial Sequence: Synthetic coding sequence
atggccagcgccctgagctacgtgagcaagttcaagagcttcgtgatcctgttcgtgacccccctgctgctgctgcccctggtgatcctgatgcccgccaaggtgtgcgtgcagtacatgaaggacaccaacatgctgttcctgggcggcctgatcgtggccgtggccgtggagagatggaacctgcacaagagaatcgccctgagaaccctgctgtgggtgggcgccaagcccgccagactgatgctgggcttcatgggcgtgaccgccctgctgagcatgtggatcagcaacaccgccaccaccgccatgatggtgcccatcgtggaggccatcctgcagcagatggaggccaccagcgccgccaccgaggccggcctggagctggtggacaagggcaaggccaaggagctgcccggcagccaggtgatcttcgagggccccaccctgggccagcaggaggaccaggagagaaagagactgtgcaaggccatgaccctgtgcatctgctacgccgccagcatcggcggcaccgccaccctgaccggcaccggccccaacgtggtgctgctgggccagatgaacgagctgttccccgacagcaaggacctggtgaacttcgccagctggttcgccttcgccttccccaacatgctggtgatgctgctgttcgcctggctgtggctgcagttcgtgtacatgagattcaacttcaagaagagctggggctgcggcctggagagcaagaagaacgagaaggccgccctgaaggtgctgcaggaggagtacagaaagctgggccccctgagcttcgccgagatcaacgtgctgatctgcttcttcctgctggtgatcctgtggttcagcagagaccccggcttcatgcccggctggctgaccgtggcctgggtggagggcgagaccaagtacgtgagcgacgccaccgtggccatcttcgtggccaccctgctgttcatcgtgcccagccagaagcccaagttcaacttcagaagccagaccgaggaggagagaaagacccccttctaccccccccccctgctggactggaaggtgacccaggagaaggtgccctggggcatcgtgctgctgctgggcggcggcttcgccctggccaagggcagcgaggccagcggcctgagcgtgtggatgggcaagcagatggagcccctgcacgccgtgccccccgccgccatcaccctgatcctgagcctgctggtggccgtgttcaccgagtgcaccagcaacgtggccaccaccaccctgttcctgcccatcttcgccagcatgagcagaagcatcggcctgaaccccctgtacatcatgctgccctgcaccctgagcgccagcttcgccttcatgctgcccgtggccaccccccccaacgccatcgtgttcacctacggccacctgaaggtggccgacatggtgaagaccggcgtgatcatgaacatcatcggcgtgttctgcgtgttcctggccgtgaacacctggggcagagccatcttcgacctggaccacttccccgactgggccaacgtgacccacatcgagacctag

SEQ ID NO: 99408 - DNA, 1569 bp, Artificial Sequence; identical to SEQ ID NO: 99405
  Description of Artificial Sequence: Synthetic coding sequence

SEQ ID NO: 99409 - DNA, 1779 bp, Artificial Sequence
  Description of Artificial Sequence: Synthetic coding sequence
atggccacctgctggcaggccctgtgggcctacagaagctacctgatcgtgttcttcgtgcccatcctgctgctgcccctgcccatcctggtgcccagcaaggaggcctactgcgcctacgccatcatcctgatggccctgttctggtgcaccgaggccctgcccctggccgtgaccgccctgttccccctgatcctgttccccatgatgggcatcgtggacgccagcgaggtggccgtggagtacctgaaggacagcaacctgctgttcttcggcggcctgctggtggccatcgccgtggagcactggaacctgcacaagagaatcgccctgagagtgctgctgatcgtgggcgtgagacccgcccccctgatcctgggcttcatgctggtgaccgccttcctgagcatgtggatcagcaacaccgccaccagcgccatgatggtgcccatcgcccacgccgtgctggaccagctgcacagcagccaggccagcagcaacgtggaggagggcagcaacaaccccaccttcgagctgcaggagcccagcccccagaaggaggtgaccaagctggacaacggccaggccctgcccgtgaccagcgccagcagcgagggcagagcccacctgagccagaagcacctgcacctgacccagtgcatgagcctgtgcgtgtgctacagcgccagcatcggcggcatcgccaccctgaccggcaccgcccccaacctggtgctgcagggccagatcaacagcctgttcccccagaacggcaacgtggtgaacttcgccagctggttcagcttcgccttccccaccatggtgatcctgctgctgctggcctggctgtggctgcagatcctgttcctgggcttcaacttcagaaagaacttcggcatcggcgagaagatgcaggagcagcagcaggccgcctactgcgtgatccagaccgagcacagactgctgggccccatgaccttcgccgagaaggccatcagcatcctgttcgtgatcctggtgctgctgtggttcaccagagagcccggcttcttcctgggctggggcaacctggccttccccaacgccaagggcgagagcatggtgagcgacggcaccgtggccatcttcatcggcatcatcatgttcatcatccccagcaagttccccggcctgacccaggaccccgagaaccccggcaagctgaaggcccccctgggcctgctggactggaagaccgtgaaccagaagatgccctggaacatcgtgctgctgctgggcggcggctacgccctggccaagggcagcgagagaagcggcctgagcgagtggctgggcaacaagctgacccccctgcagagcgtgcccgcccccgccatcgccatcatcctgagcctgctggtggccaccttcaccgagtgcaccagcaacgtggccaccaccaccatcttcctgcccatcctggccagcatggcccaggccatctgcctgcaccccctgtacgtgatgctgccctgcaccctggccaccagcctggccttcatgctgcccgtggccaccccccccaacgccatcgtgttcagcttcggcgacctgaaggtgctggacatggccagagccggcttcctgctgaacatcatcggcgtgctgatcatcgccctggccatcaacagctggggcatccccctgttcagcctgcacagcttccccagctgggcccagagcaacaccaccgcccagtgcctgcccagcctggccaacaccaccacccccagcccctag

SEQ ID NO: 99410 - DNA, 1926 bp, Artificial Sequence
  Description of Artificial Sequence: Synthetic coding sequence
atggccacctgctggcaggccctgtgggcctacagaagctacctgatcgtgttcttcgtgcccatcctgctgctgcccctgcccatcctggtgcccagcaaggaggcctactgcgcctacgccatcatcctgatggccctgttctggtgcaccgaggccctgcccctggccgtgaccgccctgttccccctgatcctgttccccatgatgggcatcgtggacgccagcgagatcatccagagacccttccccagcagcttcgagagccccggcgagtgccagagcgtgggcatgagcgtgaccgccagccacaacctgggcggcaccgtgggcgacagcagagtgttcccccccctgagccacgtgagcacctgccaggtggccgtggagtacctgaaggacagcaacctgctgttcttcggcggcctgctggtggccatcgccgtggagcactggaacctgcacaagagaatcgccctgagagtgctgctgatcgtgggcgtgagacccgcccccctgatcctgggcttcatgctggtgaccgccttcctgagcatgtggatcagcaacaccgccaccagcgccatgatggtgcccatcgcccacgccgtgctggaccagctgcacagcagccaggccagcagcaacgtggaggagggcagcaacaaccccaccttcgagctgcaggagcccagcccccagaaggaggtgaccaagctggacaacggccaggccctgcccgtgaccagcgccagcagcgagggcagagcccacctgagccagaagcacctgcacctgacccagtgcatgagcctgtgcgtgtgctacagcgccagcatcggcggcatcgccaccctgaccggcaccgcccccaacctggtgctgcagggccagatcaacagcctgttcccccagaacggcaacgtggtgaacttcgccagctggttcagcttcgccttccccaccatggtgatcctgctgctgctggcctggctgtggctgcagatcctgttcctgggcttcaacttcagaaagaacttcggcatcggcgagaagatgcaggagcagcagcaggccgcctactgcgtgatccagaccgagcacagactgctgggccccatgaccttcgccgagaaggccatcagcatcctgttcgtgatcctggtgctgctgtggttcaccagagagcccggcttcttcctgggctggggcaacctggccttccccaacgccaagggcgagagcatggtgagcgacggcaccgtggccatcttcatcggcatcatcatgttcatcatccccagcaagttccccggcctgacccaggaccccgagaaccccggcaagctgaaggcccccctgggcctgctggactggaagaccgtgaaccagaagatgccctggaacatcgtgctgctgctgggcggcggctacgccctggccaagggcagcgagagaagcggcctgagcgagtggctgggcaacaagctgacccccctgcagagcgtgcccgcccccgccatcgccatcatcctgagcctgctggtggccaccttcaccgagtgcaccagcaacgtggccaccaccaccatcttcctgcccatcctggccagcatggcccaggccatctgcctgcaccccctgtacgtgatgctgccctgcaccctggccaccagcctggccttcatgctgcccgtggccaccccccccaacgccatcgtgttcagcttcggcgacctgaaggtgctggacatggccagagccggcttcctgctgaacatcatcggcgtgctgatcatcgccctggccatcaacagctggggcatccccctgttcagcctgcacagcttccccagctgggcccagagcaacaccaccgcccagtgcctgcccagcctggccaacaccaccacccccagcccctag

SEQ ID NO: 99411 - DNA, 1566 bp, Artificial Sequence
  Description of Artificial Sequence: Synthetic coding sequence
atgcccgtgtgcggcaacgtggccgtggagtacctgaaggacagcaacctgctgttcttcggcggcctgctggtggccatcgccgtggagcactggaacctgcacaagagaatcgccctgagagtgctgctgatcgtgggcgtgagacccgcccccctgatcctgggcttcatgctggtgaccgccttcctgagcatgtggatcagcaacaccgccaccagcgccatgatggtgcccatcgcccacgccgtgctggaccagctgcacagcagccaggccagcagcaacgtggaggagggcagcaacaaccccaccttcgagctgcaggagcccagcccccagaaggaggtgaccaagctggacaacggccaggccctgcccgtgaccagcgccagcagcgagggcagagcccacctgagccagaagcacctgcacctgacccagtgcatgagcctgtgcgtgtgctacagcgccagcatcggcggcatcgccaccctgaccggcaccgcccccaacctggtgctgcagggccagatcaacagcctgttcccccagaacggcaacgtggtgaacttcgccagctggttcagcttcgccttccccaccatggtgatcctgctgctgctggcctggctgtggctgcagatcctgttcctgggcttcaacttcagaaagaacttcggcatcggcgagaagatgcaggagcagcagcaggccgcctactgcgtgatccagaccgagcacagactgctgggccccatgaccttcgccgagaaggccatcagcatcctgttcgtgatcctggtgctgctgtggttcaccagagagcccggcttcttcctgggctggggcaacctggccttccccaacgccaagggcgagagcatggtgagcgacggcaccgtggccatcttcatcggcatcatcatgttcatcatccccagcaagttccccggcctgacccaggaccccgagaaccccggcaagctgaaggcccccctgggcctgctggactggaagaccgtgaaccagaagatgccctggaacatcgtgctgctgctgggcggcggctacgccctggccaagggcagcgagagaagcggcctgagcgagtggctgggcaacaagctgacccccctgcagagcgtgcccgcccccgccatcgccatcatcctgagcctgctggtggccaccttcaccgagtgcaccagcaacgtggccaccaccaccatcttcctgcccatcctggccagcatggcccaggccatctgcctgcaccccctgtacgtgatgctgccctgcaccctggccaccagcctggccttcatgctgcccgtggccaccccccccaacgccatcgtgttcagcttcggcgacctgaaggtgctggacatggccagagccggcttcctgctgaacatcatcggcgtgctgatcatcgccctggccatcaacagctggggcatccccctgttcagcctgcacagcttccccagctgggcccagagcaacaccaccgcccagtgcctgcccagcctggccaacaccaccacccccagcccctag

SEQ ID NO: 99412 - DNA, 1035 bp, Artificial Sequence
  Description of Artificial Sequence: Synthetic coding sequence
atggccctgttctggtgcaccgaggccctgcccctggccgtgaccgccctgttccccctgatcctgttccccatgatgggcatcgtggacgccagcgaggtggccgtggagtacctgaaggacagcaacctgctgttcttcggcggcctgctggtggccatcgccgtggagcactggaacctgcacaagagaatcgccctgagagtgctgctgatcgtgggcgtgagacccgcccccctgatcctgggcttcatgctggtgaccgccttcctgagcatgtggatcagcaacaccgccaccagcgccatgatggtgcccatcgcccacgccgtgctggaccagctgcacagcagccaggccagcagcaacgtggaggagggcagcaacaaccccaccttcgagctgcaggagcccagcccccagaaggaggtgaccaagctggacaacggccaggccctgcccgtgaccagcgccagcagcgagggcagagcccacctgagccagaagcacctgcacctgacccagtgcatgagcctgtgcgtgtgctacagcgccagcatcggcggcatcgccaccctgaccggcaccgcccccaacctggtgctgcagggccagatcaacagcctgttcccccagaacggcaacgtggtgaacttcgccagctggttcagcttcgccttccccaccatggtgatcctgctgctgctggcctggctgtggctgcagatcctgttcctgggcttcaacttcagaaagaacttcggcatcggcgagaagatgcaggagcagcagcaggccgcctactgcgtgatccagaccgagcacagactgctgggccccatgaccttcgccgagaaggccatcagcatcctgttcgtgatcctggtgctgctgtggttcaccagagagcccggcttcttctggctgggccagttcggcttcagccagtgccagggcggcgaggtgagagtggccggcgtgggcagaagaacccacctgggcctgacctgcagcggcagaagagagggctactag

SEQ ID NO: 99413 - DNA, 1650 bp, Artificial Sequence
  Description of Artificial Sequence: Synthetic coding sequence
atggccacctgctggcaggccctgtgggcctacagaagctacctgatcgtgttcttcgtgcccatcctgctgctgcccctgcccatcctggtgcccagcaaggtggccgtggagtacctgaaggacagcaacctgctgttcttcggcggcctgctggtggccatcgccgtggagcactggaacctgcacaagagaatcgccctgagagtgctgctgatcgtgggcgtgagacccgcccccctgatcctgggcttcatgctggtgaccgccttcctgagcatgtggatcagcaacaccgccaccagcgccatgatggtgcccatcgcccacgccgtgctggaccagctgcacagcagccaggccagcagcaacgtggaggagggcagcaacaaccccaccttcgagctgcaggagcccagcccccagaaggaggtgaccaagctggacaacggccaggccctgcccgtgaccagcgccagcagcgagggcagagcccacctgagccagaagcacctgcacctgacccagtgcatgagcctgtgcgtgtgctacagcgccagcatcggcggcatcgccaccctgaccggcaccgcccccaacctggtgctgcagggccagatcaacagcctgttcccccagaacggcaacgtggtgaacttcgccagctggttcagcttcgccttccccaccatggtgatcctgctgctgctggcctggctgtggctgcagatcctgttcctgggcttcaacttcagaaagaacttcggcatcggcgagaagatgcaggagcagcagcaggccgcctactgcgtgatccagaccgagcacagactgctgggccccatgaccttcgccgagaaggccatcagcatcctgttcgtgatcctggtgctgctgtggttcaccagagagcccggcttcttcctgggctggggcaacctggccttccccaacgccaagggcgagagcatggtgagcgacggcaccgtggccatcttcatcggcatcatcatgttcatcatccccagcaagttccccggcctgacccaggaccccgagaaccccggcaagctgaaggcccccctgggcctgctggactggaagaccgtgaaccagaagatgccctggaacatcgtgctgctgctgggcggcggctacgccctggccaagggcagcgagagaagcggcctgagcgagtggctgggcaacaagctgacccccctgcagagcgtgcccgcccccgccatcgccatcatcctgagcctgctggtggccaccttcaccgagtgcaccagcaacgtggccaccaccaccatcttcctgcccatcctggccagcatggcccaggccatctgcctgcaccccctgtacgtgatgctgccctgcaccctggccaccagcctggccttcatgctgcccgtggccaccccccccaacgccatcgtgttcagcttcggcgacctgaaggtgctggacatggccagagccggcttcctgctgaacatcatcggcgtgctgatcatcgccctggccatcaacagctggggcatccccctgttcagcctgcacagcttccccagctgggcccagagcaacaccaccgcccagtgcctgcccagcctggccaacaccaccacccccagcccctag

SEQ ID NO: 99414 - DNA, 1809 bp, Artificial Sequence
  Description of Artificial Sequence: Synthetic coding sequence
atggccgccctggccgccgccgccaagaaggtgtggagcgccagaagactgctggtgctgctgttcacccccctggccctgctgcccgtggtgttcgccctgccccccaaggagggcagatgcctgttcgtgatcctgctgatggccgtgtactggtgcaccgaggccctgcccctgagcgtgaccgccctgctgcccatcgtgctgttccccttcatgggcatcctgcccagcaacaaggtgtgcccccagtacttcctggacaccaacttcctgttcctgagcggcctgatcatggccagcgccatcgaggagtggaacctgcacagaagaatcgccctgaagatcctgatgctggtgggcgtgcagcccgccagactgatcctgggcatgatggtgaccaccagcttcctgagcatgtggctgagcaacaccgccagcaccgccatgatgctgcccatcgccaacgccatcctgaagagcctgttcggccagaaggaggtgagaaaggaccccagccaggagagcgaggagaacaccgccgccgtgagaagaaacggcctgcacaccgtgcccaccgagatgcagttcctggccagcaccgaggccaaggaccaccccggcgagaccgaggtgcccctggacctgcccgccgacagcagaaaggaggacgagtacagaagaaacatctggaagggcttcctgatcagcatcccctacagcgccagcatcggcggcaccgccaccctgaccggcaccgcccccaacctgatcctgctgggccagctgaagagcttcttcccccagtgcgacgtggtgaacttcggcagctggttcatcttcgccttccccctgatgctgctgttcctgctggccggctggctgtggatcagcttcctgtacggcggcctgagcttcagaggctggagaaagaacaagagcgagatcagaaccaacgccgaggacagagccagagccgtgatcagagaggagtaccagaacctgggccccatcaagttcgccgagcaggccgtgttcatcctgttctgcatgttcgccatcctgctgttcaccagagaccccaagttcatccccggctgggccagcctgttcaaccccggcttcctgagcgacgccgtgaccggcgtggccatcgtgaccatcctgttcttcttccccagccagagacccagcctgaagtggtggttcgacttcaaggcccccaacaccgagaccgagcccctgctgacctggaagaaggcccaggagaccgtgccctggaacatcatcctgctgctgggcggcggcttcgccatggccaagggctgcgaggagagcggcctgagcgtgtggatcggcggccagctgcaccccctggagaacgtgccccccgccctggccgtgctgctgatcaccgtggtgatcgccttcttcaccgagttcgccagcaacaccgccaccatcatcatcttcctgcccgtgctggccgagctggccatcagactgagagtgcaccccctgtacctgatgatccccggcaccgtgggctgcagcttcgccttcatgctgcccgtgagcaccccccccaacagcatcgccttcgccagcggccacctgctggtgaaggacatggtgagaaccggcctgctgatgaacctgatgggcgtgctgctgctgagcctggccatgaacacctgggcccagaccatcttccagctgggcaccttccccgactgggccgacatgtacagcgtgaacgtgaccgccctgccccccaccctggccaacgacaccttcagaaccctgtag

SEQ ID NO: 99415 - DNA, 1668 bp, Artificial Sequence
  Description of Artificial Sequence: Synthetic coding sequence
atggccgtgtactggtgcaccgaggccctgcccctgagcgtgaccgccctgctgcccatcgtgctgttccccttcatgggcatcctgcccagcaacaaggtgtgcccccagtacttcctggacaccaacttcctgttcctgagcggcctgatcatggccagcgccatcgaggagtggaacctgcacagaagaatcgccctgaagatcctgatgctggtgggcgtgcagcccgccagactgatcctgggcatgatggtgaccaccagcttcctgagcatgtggctgagcaacaccgccagcaccgccatgatgctgcccatcgccaacgccatcctgaagagcctgttcggccagaaggaggtgagaaaggaccccagccaggagagcgaggagaacaccgccgccgtgagaagaaacggcctgcacaccgtgcccaccgagatgcagttcctggccagcaccgaggccaaggaccaccccggcgagaccgaggtgcccctggacctgcccgccgacagcagaaaggaggacgagtacagaagaaacatctggaagggcttcctgatcagcatcccctacagcgccagcatcggcggcaccgccaccctgaccggcaccgcccccaacctgatcctgctgggccagctgaagagcttcttcccccagtgcgacgtggtgaacttcggcagctggttcatcttcgccttccccctgatgctgctgttcctgctggccggctggctgtggatcagcttcctgtacggcggcctgagcttcagaggctggagaaagaacaagagcgagatcagaaccaacgccgaggacagagccagagccgtgatcagagaggagtaccagaacctgggccccatcaagttcgccgagcaggccgtgttcatcctgttctgcatgttcgccatcctgctgttcaccagagaccccaagttcatccccggctgggccagcctgttcaaccccggcttcctgagcgacgccgtgaccggcgtggccatcgtgaccatcctgttcttcttccccagccagagacccagcctgaagtggtggttcgacttcaaggcccccaacaccgagaccgagcccctgctgacctggaagaaggcccaggagaccgtgccctggaacatcatcctgctgctgggcggcggcttcgccatggccaagggctgcgaggagagcggcctgagcgtgtggatcggcggccagctgcaccccctggagaacgtgccccccgccctggccgtgctgctgatcaccgtggtgatcgccttcttcaccgagttcgccagcaacaccgccaccatcatcatcttcctgcccgtgctggccgagctggccatcagactgagagtgcaccccctgtacctgatgatccccggcaccgtgggctgcagcttcgccttcatgctgcccgtgagcaccccccccaacagcatcgccttcgccagcggccacctgctggtgaaggacatggtgagaaccggcctgctgatgaacctgatgggcgtgctgctgctgagcctggccatgaacacctgggcccagaccatcttccagctgggcaccttccccgactgggccgacatgtacagcgtgaacgtgaccgccctgccccccaccctggccaacgacaccttcagaaccctgtag

SEQ ID NO: 99416 - DNA, 699 bp, Artificial Sequence
  Description of Artificial Sequence: Synthetic coding sequence
atggccgccctggccgccgccgccaagaaggtgtggagcgccagaagactgctggtgctgctgttcacccccctggccctgctgcccgtggtgttcgccctgccccccaaggagggcagatgcctgttcgtgatcctgctgatggccgtgtactggtgcaccgaggccctgcccctgagcgtgaccgccctgctgcccatcgtgctgttccccttcatgggcatcctgcccagcaacaaggtgtgcccccagtacttcctggacaccaacttcctgttcctgagcggcctgatcatggccagcgccatcgaggagtggaacctgcacagaagaatcgccctgaagatcctgatgctggtgggcgtgcagcccgccagactgatcctgggcatgatggtgaccaccagcttcctgagcatgtggctgagcaacaccgccagcaccgccatgatgctgcccatcgccaacgccatcctgaagagcctgttcggccagaaggaggtgagaaaggaccccagccaggagagcgaggagaacaccggcatcgagcccaacaccttcctgagcgaggagagactgaagctgcaggcccccctggtgatcagactgggccagatcaccgagagcggccagtggaacatgagcggcaacgacgtgtgcaacttcagagtgctgagcttcctgcccggcggcatgtag

SEQ ID NO: 99417 - DNA, 1017 bp, Artificial Sequence
  Description of Artificial Sequence: Synthetic coding sequence
atggccgccctggccgccgccgccaagaaggtgtggagcgccagaagactgctggtgctgctgttcacccccctggccctgctgcccgtggtgttcgccctgccccccaaggagggcagatgcctgttcgtgatcctgctgatggccgtgtactggtgcaccgaggccctgcccctgagcgtgaccgccctgctgcccatcgtgctgttccccttcatgggcatcctgcccagcaacaaggtgtgcccccagtacttcctggacaccaacttcctgttcctgagcggcctgatcatggccagcgccatcgaggagtggaacctgcacagaagaatcgccctgaagatcctgatgctggtgggcgtgcagcccgccagactgatcctgggcatgatggtgaccaccagcttcctgagcatgtggctgagcaacaccgccagcaccgccatgatgctgcccatcgccaacgccatcctgaagagcctgttcggccagaaggaggtgagaaaggaccccagccaggagagcgaggagaacaccgccaagaccaccctgggcagacagagattccactggatctgcagactgacccccggcagaagaatgaacatcgtgggcaccagcggcagagccagcagcagccccagccccacccagcccgtgctgggcgcccagccccacagcagagcccagcccctgaccagcagctgcctggccagcagcagaggctggctgtggatcagcttcctgtacggcggcctgagcttcagaggctggagaaagaacaagagcgagatcagaaccaacgccgaggacagagccagagccgtgatcagagaggagtaccagaacctgggccccatcaagttcgccgagcaggccgtgttcatcctgttctgcatgttcgccatcctgctgttcaccagagaccccaagttcatccccggctgggccagcctgttcaaccccggctgcaagatgggcatcatcagcatcagcaccatccagaagatgtag

SEQ ID NO: 99418 - DNA, 1563 bp, Artificial Sequence
  Description of Artificial Sequence: Synthetic coding sequence
atggccgtgtactggtgcaccgaggccctgcccctgagcgtgaccgccctgctgcccatcgtgctgttccccttcatgggcatcctgcccagcaacaaggtgtgcccccagtacttcctggacaccaacttcctgttcctgagcggcctgatcatggccagcgccatcgaggagtggaacctgcacagaagaatcgccctgaagatcctgatgctggtgggcgtgcagcccgccagactgatcctgggcatgatggtgaccaccagcttcctgagcatgtggctgagcaacaccgccagcaccgccatgatgctgcccatcgccaacgccatcctgaagagcctgttcggccagaaggaggtgagaaaggaccccagccaggagagcgaggagaacaccgccgccgtgagaagaaacggcctgcacaccgtgcccaccgagatgcagttcctggccagcaccgaggccaaggaccaccccggcgagaccgaggtgcccctggacctgcccgccgacagcagaaaggaggacgagtacagaagaaacatctggaagggcttcctgatcagcatcccctacagcgccagcatcggcggcaccgccaccctgaccggcaccgcccccaacctgatcctgctgggccagctgaagagcttcttcccccagtgcgacgtggtgaacttcggcagctggttcatcttcgccttccccctgatgctgctgttcctgctggccggctggctgtggatcagcttcctgtacggcggcctgagcttcagaggctggagaaagaacaagagcgagatcagaaccaacgccgaggacagagccagagccgtgatcagagaggagtaccagaacctgggccccatcaagttcctgagcgacgccgtgaccggcgtggccatcgtgaccatcctgttcttcttccccagccagagacccagcctgaagtggtggttcgacttcaaggcccccaacaccgagaccgagcccctgctgacctggaagaaggcccaggagaccgtgccctggaacatcatcctgctgctgggcggcggcttcgccatggccaagggctgcgaggagagcggcctgagcgtgtggatcggcggccagctgcaccccctggagaacgtgccccccgccctggccgtgctgctgatcaccgtggtgatcgccttcttcaccgagttcgccagcaacaccgccaccatcatcatcttcctgcccgtgctggccgagctggccatcagactgagagtgcaccccctgtacctgatgatccccggcaccgtgggctgcagcttcgccttcatgctgcccgtgagcaccccccccaacagcatcgccttcgccagcggccacctgctggtgaaggacatggtgagaaccggcctgctgatgaacctgatgggcgtgctgctgctgagcctggccatgaacacctgggcccagaccatcttccagctgggcaccttccccgactgggccgacatgtacagcgtgaacgtgaccgccctgccccccaccctggccaacgacaccttcagaaccctgtag

SEQ ID NO: 99419 - DNA, 1659 bp, Artificial Sequence
  Description of Artificial Sequence: Synthetic coding sequence
atggccgccctggccgccgccgccaagaaggtgtggagcgccagaagactgctggtgctgctgttcacccccctggccctgctgcccgtggtgttcgccctgccccccaaggagggcagatgcctgttcgtgatcctgctgatggccgtgtactggtgcaccgaggccctgcccctgagcgtgaccgccctgctgcccatcgtgctgttccccttcatgggcatcctgcccagcaacaaggtgtgcccccagtacttcctggacaccaacttcctgttcctgagcggcctgatcatggccagcgccatcgaggagtggaacctgcacagaagaatcgccctgaagatcctgatgctggtgggcgtgcagcccgccagactgatcctgggcatgatggtgaccaccagcttcctgagcatgtggctgagcaacaccgccagcaccgccatgatgctgcccatcgccaacgccatcctgaagagcctgttcggccagaaggaggtgagaaaggaccccagccaggagagcgaggagaacaccgccaagaccaccctgggcagacagagattccactggatctgcagactgacccccggcagaagaatgaacatcgtgggcaccagcggcagagccagcagcagccccagccccacccagcccgtgctgggcgcccagccccacagcagagcccagcccctgaccagcagctgcctggccagcagcagaggctggctgtggatcagcttcctgtacggcggcctgagcttcagaggctggagaaagaacaagagcgagatcagaaccaacgccgaggacagagccagagccgtgatcagagaggagtaccagaacctgggccccatcaagttcgccgagcaggccgtgttcatcctgttctgcatgttcgccatcctgctgttcaccagagaccccaagttcatccccggctgggccagcctgttcaaccccggcttcctgagcgacgccgtgaccggcgtggccatcgtgaccatcctgttcttcttccccagccagagacccagcctgaagtggtggttcgacttcaaggcccccaacaccgagaccgagcccctgctgacctggaagaaggcccaggagaccgtgccctggaacatcatcctgctgctgggcggcggcttcgccatggccaagggctgcgaggagagcggcctgagcgtgtggatcggcggccagctgcaccccctggagaacgtgccccccgccctggccgtgctgctgatcaccgtggtgatcgccttcttcaccgagttcgccagcaacaccgccaccatcatcatcttcctgcccgtgctggccgagctggccatcagactgagagtgcaccccctgtacctgatgatccccggcaccgtgggctgcagcttcgccttcatgctgcccgtgagcaccccccccaacagcatcgccttcgccagcggccacctgctggtgaaggacatggtgagaaccggcctgctgatgaacctgatgggcgtgctgctgctgagcctggccatgaacacctgggcccagaccatcttccagctgggcaccttccccgactgggccgacatgtacagcgtgaacgtgaccgccctgccccccaccctggccaacgacaccttcagaaccctgtag

SEQ ID NO: 99420 - DNA, 558 bp, Artificial Sequence
  Description of Artificial Sequence: Synthetic coding sequence
atggccgtgtactggtgcaccgaggccctgcccctgagcgtgaccgccctgctgcccatcgtgctgttccccttcatgggcatcctgcccagcaacaaggtgtgcccccagtacttcctggacaccaacttcctgttcctgagcggcctgatcatggccagcgccatcgaggagtggaacctgcacagaagaatcgccctgaagatcctgatgctggtgggcgtgcagcccgccagactgatcctgggcatgatggtgaccaccagcttcctgagcatgtggctgagcaacaccgccagcaccgccatgatgctgcccatcgccaacgccatcctgaagagcctgttcggccagaaggaggtgagaaaggaccccagccaggagagcgaggagaacaccggcatcgagcccaacaccttcctgagcgaggagagactgaagctgcaggcccccctggtgatcagactgggccagatcaccgagagcggccagtggaacatgagcggcaacgacgtgtgcaacttcagagtgctgagcttcctgcccggcggcatgtag

SEQ ID NO: 99421 - DNA, 564 bp, Artificial Sequence
  Description of Artificial Sequence: Synthetic coding sequence
atgctgagccccgcctggctgctgagccccagctgcagcagcagcagacccaagggccccctgagcagcggcggcctgaccagcaaggagagcggcctgagcgtgtggatcggcggccagctgcaccccctggagaacgtgccccccgccctggccgtgctgctgatcaccgtggtgatcgccttcttcaccgagttcgccagcaacaccgccaccatcatcatcttcctgcccgtgctggccgagctggccatcagactgagagtgcaccccctgtacctgatgatccccggcaccgtgggctgcagcttcgccttcatgctgcccgtgagcaccccccccaacagcatcgccttcgccagcggccacctgctggtgaaggacatggtgagaaccggcctgctgatgaacctgatgggcgtgctgctgctgagcctggccatgaacacctgggcccagaccatcttccagctgggcaccttccccgactgggccgacatgtacagcgtgaacgtgaccgccctgccccccaccctggccaacgacaccttcagaaccctgtag

SEQ ID NO: 99422 - DNA, 1230 bp, Artificial Sequence
  Description of Artificial Sequence: Synthetic coding sequence
atggccgtgtactggtgcaccgaggccctgcccctgagcgtgaccgccctgctgcccatcgtgctgttccccttcatgggcatcctgcccagcaacaaggtgtgcccccagtacttcctggacaccaacttcctgttcctgagcggcctgatcatggccagcgccatcgaggagtggaacctgcacagaagaatcgccctgaagatcctgatgctggtgggcgtgcagcccgccagactgatcctgggcatgatggtgaccaccagcttcctgagcatgtggctgagcaacaccgccagcaccgccatgatgctgcccatcgccaacgccatcctgaagagcctgttcggccagaaggaggtgagaaaggaccccagccaggagagcgaggagaacaccgccgccgtgagaagaaacggcctgcacaccgtgcccaccgagatgcagttcctggccagcaccgaggccaaggaccaccccggcgagaccgaggtgcccctggacctgcccgccgacagcagaaaggaggacgagtacagaagaaacatctggaagggcttcctgatcagcatcccctacagcgccagcatcggcggcaccgccaccctgaccggcaccgcccccaacctgatcctgctgggccagctgaagagcttcttcccccagtgcgacgtggtgaacttcggcagctggttcatcttcgccttccccctgatgctgctgttcctgctggccggctggctgtggatcagcttcctgtacggcggcctgagcttcagaggctggagaaagaacaagagcgagatcagaaccaacgccgaggacagagccagagccgtgatcagagaggagtaccagaacctgggccccatcaagttcgccgagcaggccgtgttcatcctgttctgcatgttcgccatcctgctgttcaccagagaccccaagttcatccccggctgggccagcctgttcaaccccggcttcctgagcgacgccgtgaccggcgtggccatcgtgaccatcctgttcttcttccccagccagagacccagcctgaagtggtggttcgacttcaaggcccccaacaccgagaccgagcccctgctgacctggaagaaggcccaggagaccgtgccctggaacatcatcctgctgctgggcggcggcttcgccatggccaagggctgcgaggagagcggcctgagcgtgtggatcggcggccagctgtag

SEQ ID NO: 99423 - DNA, 1668 bp, Artificial Sequence; identical to SEQ ID NO: 99415
  Description of Artificial Sequence: Synthetic coding sequence

SEQ ID NO: 99424 - DNA, 2763 bp, Artificial Sequence
  Description of Artificial Sequence: Synthetic coding sequence
atgagcgacccccacagcagccccctgctgcccgagcccctgagcagcagatacaagctgtacgaggccgagttcaccagccccagctggcccagcaccagccccgacacccaccccgccctgcccctgctggagatgcccgaggagaaggacctgagaagcagcaacgaggacagccacatcgtgaagatcgagaagctgaacgagagaagcaagagaaaggacgacggcgtggcccacagagacagcgccggccagagatgcatctgcctgagcaaggccgtgggctacctgaccggcgacatgaaggagtacagaatctggctgaaggacaagcacctggccctgcagttcatcgactgggtgctgagaggcaccgcccaggtgatgttcatcaacaaccccctgagcggcctgatcatcttcatcggcctgctgatccagaacccctggtggaccatcaccggcggcctgggcaccgtggtgagcaccctgaccgccctggccctgggccaggacagaagcgccatcgccagcggcctgcacggctacaacggcatgctggtgggcctgctgatggccgtgttcagcgagaagctggactactactggtggctgctgttccccgtgaccttcaccgccatgagctgccccgtgctgagcagcgccctgaacagcatcttcagcaagtgggacctgcccgtgttcaccctgcccttcaacatcgccgtgaccctgtacctggccgccaccggccactacaacctgttcttccccaccaccctggtggagcccgtgagcagcgtgcccaacatcacctggaccgagatggagatgcccctgctgctgcaggccatccccgtgggcgtgggccaggtgtacggctgcgacaacccctggaccggcggcgtgttcctggtggccctgttcatcagcagccccctgatctgcctgcacgccgccatcggcagcatcgtgggcctgctggccgccctgagcgtggccacccccttcgagaccatctacaccggcctgtggagctacaactgcgtgctgagctgcatcgccatcggcggcatgttctacgccctgacctggcagacccacctgctggccctgatctgcgccctgttctgcgcctacatggaggccgccatcagcaacatcatgagcgtggtgggcgtgccccccggcacctgggccttctgcctggccaccatcatcttcctgctgctgaccaccaacaaccccgccatcttcagactgcccctgagcaaggtgacctaccccgaggccaacagaatctactacctgaccgtgaagagcggcgaggaggagaaggcccccagcggcggcggcggcgagcacccccccaccgccggccccaaggtggaggagggcagcgaggccgtgctgagcaagcacagaagcgtgttccacatcgagtggagcagcatcagaagaagaagcaaggtgttcggcaagggcgagcaccaggagagacagaacaaggaccccttcccctacagatacagaaagcccaccgtggagctgctggacctggacaccatggaggagagcagcgagatcaaggtggagaccaacatcagcaagaccagctggatcagaagcagcatggccgccagcggcaagagagtgagcaaggccctgagctacatcaccggcgagatgaaggagtgcggcgagggcctgaaggacaagagccccgtgttccagttcttcgactgggtgctgagaggcaccagccaggtgatgttcgtgaacaaccccctgagcggcatcctgatcatcctgggcctgttcatccagaacccctggtgggccatcagcggctgcctgggcaccatcatgagcaccctgaccgccctgatcctgagccaggacaagagcgccatcgccgccggcttccacggctacaacggcgtgctggtgggcctgctgatggccgtgttcagcgacaagggcgactactactggtggctgctgctgcccgtgatcatcatgagcatgagctgccccatcctgagcagcgccctgggcaccatcttcagcaagtgggacctgcccgtgttcaccctgcccttcaacatcaccgtgaccctgtacctggccgccaccggccactacaacctgttcttccccaccaccctgctgcagcccgccagcgccatgcccaacatcacctggagcgaggtgcaggtgcccctgctgctgagagccatccccgtgggcatcggccaggtgtacggctgcgacaacccctggaccggcggcatcttcctgatcgccctgttcatcagcagccccctgatctgcctgcacgccgccatcggcagcaccatgggcatgctggccgccctgaccatcgccacccccttcgacagcatctacttcggcctgtgcggcttcaacagcaccctggcctgcatcgccatcggcggcatgttctacgtgatcacctggcagacccacctgctggccatcgcctgcgccctgttcgccgcctacctgggcgccgccctggccaacatgctgagcgtgttcggcctgcccccctgcacctggcccttctgcctgagcgccctgaccttcctgctgctgaccaccaacaaccccgccatctacaagctgcccctgagcaaggtgacctaccccgaggccaacagaatctactacctgagccaggagagaaacagaagagccagcatcatcaccaagtaccaggcctacgacgtgagctag

SEQ ID NO: 99425 - DNA, 1170 bp, Artificial Sequence
  Description of Artificial Sequence: Synthetic coding sequence
atggaggacagccccaccatggtgagagtggacagccccaccatggtgagaggcgagaaccaggtgagcccctgccagggcagaagatgcttccccaaggccctgggctacgtgaccggcgacatgaaggagctggccaaccagctgaaggacaagcccgtggtgctgcagttcatcgactggatcctgagaggcatcagccaggtggtgttcgtgaacaaccccgtgagcggcatcctgatcctggtgggcctgctggtgcagaacccctggtgggccctgaccggctggctgggcaccgtggtgagcaccctgatggccctgctgctgagccaggacagaagcctgatcgccagcggcctgtacggctacaacgccaccctggtgggcgtgctgatggccgtgttcagcgacaagggcgactacttctggtggctgctgctgcccgtgtgcgccatgagcatgacctgccccatcttcagcagcgccctgaacagcatgctgagcaagtgggacctgcccgtgttcaccctgcccttcaacatggccctgagcatgtacctgagcgccaccggccactacaaccccttcttccccgccaagctggtgatccccatcaccaccgcccccaacatcagctggagcgacctgagcgccctggagctgctgaagagcatccccgtgggcgtgggccagatctacggctgcgacaacccctggaccggcggcatcttcctgggcgccatcctgctgagcagccccctgatgtgcctgcacgccgccatcggcagcctgctgggcatcgccgccggcctgagcctgagcgcccccttcgaggacatctacttcggcctgtggggcttcaacagcagcctggcctgcatcgccatgggcggcatgttcatggccctgacctggcagacccacctgctggccctgggctgcgccctgttcaccgcctacctgggcgtgggcatggccaacttcatggccgaggtgggcctgcccgcctgcacctggcccttctgcctggccaccctgctgttcctgatcatgaccaccaagaacagcaacatctacaagatgcccctgagcaaggtgacctaccccgaggagaacagaatcttctacctgcaggccaagaagagaatggtggagagccccctgtag

SEQ ID NO: 99426 - DNA, 855 bp, Artificial Sequence
  Description of Artificial Sequence: Synthetic coding sequence
atggccctgctgctgagccaggacagaagcctgatcgccagcggcctgtacggctacaacgccaccctggtgggcgtgctgatggccgtgttcagcgacaagggcgactacttctggtggctgctgctgcccgtgtgcgccatgagcatgacctgccccatcttcagcagcgccctgaacagcatgctgagcaagtgggacctgcccgtgttcaccctgcccttcaacatggccctgagcatgtacctgagcgccaccggccactacaaccccttcttccccgccaagctggtgatccccatcaccaccgcccccaacatcagctggagcgacctgagcgccctggagctgctgaagagcatccccgtgggcgtgggccagatctacggctgcgacaacccctggaccggcggcatcttcctgggcgccatcctgctgagcagccccctgatgtgcctgcacgccgccatcggcagcctgctgggcatcgccgccggcctgagcctgagcgcccccttcgaggacatctacttcggcctgtggggcttcaacagcagcctggcctgcatcgccatgggcggcatgttcatggccctgacctggcagacccacctgctggccctgggctgcgccctgttcaccgcctacctgggcgtgggcatggccaacttcatggccgaggtgggcctgcccgcctgcacctggcccttctgcctggccaccctgctgttcctgatcatgaccaccaagaacagcaacatctacaagatgcccctgagcaaggtgacctaccccgaggagaacagaatcttctacctgcaggccaagaagagaatggtggagagccccctgtag

SEQ ID NO: 99427 - DNA, 1338 bp, Artificial Sequence
  Description of Artificial Sequence: Synthetic coding sequence
atgaacggcagaagcctgatcggcggcgccggcgacgccagacacggccccgtgtggaaggaccccttcggcaccaaggccggcgacgccgccagaagaggcatcgccagactgagcctggccctggccgacggcagccaggagcaggagcccgaggaggagatcgccatggaggacagccccaccatggtgagagtggacagccccaccatggtgagaggcgagaaccaggtgagcccctgccagggcagaagatgcttccccaaggccctgggctacgtgaccggcgacatgaaggagctggccaaccagctgaaggacaagcccgtggtgctgcagttcatcgactggatcctgagaggcatcagccaggtggtgttcgtgaacaaccccgtgagcggcatcctgatcctggtgggcctgctggtgcagaacccctggtgggccctgaccggctggctgggcaccgtggtgagcaccctgatggccctgctgctgagccaggacagaagcctgatcgccagcggcctgtacggctacaacgccaccctggtgggcgtgctgatggccgtgttcagcgacaagggcgactacttctggtggctgctgctgcccgtgtgcgccatgagcatgacctgccccatcttcagcagcgccctgaacagcatgctgagcaagtgggacctgcccgtgttcaccctgcccttcaacatggccctgagcatgtacctgagcgccaccggccactacaaccccttcttccccgccaagctggtgatccccatcaccaccgcccccaacatcagctggagcgacctgagcgccctggagctgctgaagagcatccccgtgggcgtgggccagatctacggctgcgacaacccctggaccggcggcatcttcctgggcgccatcctgctgagcagccccctgatgtgcctgcacgccgccatcggcagcctgctgggcatcgccgccggcctgagcctgagcgcccccttcgaggacatctacttcggcctgtggggcttcaacagcagcctggcctgcatcgccatgggcggcatgttcatggccctgacctggcagacccacctgctggccctgggctgcgccctgttcaccgcctacctgggcgtgggcatggccaacttcatggccgaggtgggcctgcccgcctgcacctggcccttctgcctggccaccctgctgttcctgatcatgaccaccaagaacagcaacatctacaagatgcccctgagcaaggtgacctaccccgaggagaacagaatcttctacctgcaggccaagaagagaatggtggagagccccctgtag

SEQ ID NO: 99428 - DNA, 1338 bp, Artificial Sequence; identical to SEQ ID NO: 99427
  Description of Artificial Sequence: Synthetic coding sequence

SEQ ID NO: 99429 - DNA, 645 bp, Artificial Sequence
  Description of Artificial Sequence: Synthetic coding sequence
atgaacggcagaagcctgatcggcggcgccggcgacgccagacacggccccgtgtggaaggaccccttcggcaccaaggccggcgacgccgccagaagaggcatcgccagactgagcctggccctggccgacggcagccaggagcaggagcccgaggaggagatcgccatggaggacagccccaccatggtgagagtggacagccccaccatggtgagaggcgagaaccaggtgagcccctgccagggcagaagatgcttccccaaggccctgggctacgtgaccggcgacatgaaggagctggccaaccagctgaaggacaagcccgtggtgctgcagttcatcgactggatcctgagaggcatcagccaggtggtgttcgtgaacaaccccgtgagcggcatcctgatcctggtgggcctgctggtgcagaacccctggtgggccctgaccggctggctgggcaccgtggtgagcaccctgatggccctgctgctgagccaggacagaagcctgatcgccagcggcctgtacggctacaacgccaccctggtgggcgtgctgatggccgtgttcagcgacaagggcgactacttctggtggctgctgctgcccgtgtgcgccatgagcatgacctgctgctag

SEQ ID NO: 99430 - DNA, 846 bp, Artificial Sequence
  Description of Artificial Sequence: Synthetic coding sequence
atgggcagaagaaacagaagcctgatcgccagcggcctgtacggctacaacgccaccctggtgggcgtgctgatggccgtgttcagcgacaagggcgactacttctggtggctgctgctgcccgtgtgcgccatgagcatgacctgccccatcttcagcagcgccctgaacagcatgctgagcaagtgggacctgcccgtgttcaccctgcccttcaacatggccctgagcatgtacctgagcgccaccggccactacaaccccttcttccccgccaagctggtgatccccatcaccaccgcccccaacatcagctggagcgacctgagcgccctggagctgctgaagagcatccccgtgggcgtgggccagatctacggctgcgacaacccctggaccggcggcatcttcctgggcgccatcctgctgagcagccccctgatgtgcctgcacgccgccatcggcagcctgctgggcatcgccgccggcctgagcctgagcgcccccttcgaggacatctacttcggcctgtggggcttcaacagcagcctggcctgcatcgccatgggcggcatgttcatggccctgacctggcagacccacctgctggccctgggctgcgccctgttcaccgcctacctgggcgtgggcatggccaacttcatggccgaggtgggcctgcccgcctgcacctggcccttctgcctggccaccctgctgttcctgatcatgaccaccaagaacagcaacatctacaagatgcccctgagcaaggtgacctaccccgaggagaacagaatcttctacctgcaggccaagaagagaatggtggagagccccctgtag

SEQ ID NO: 99431 - DNA, 774 bp, Artificial Sequence
  Description of Artificial Sequence: Synthetic coding sequence
atggccgtgttcagcgacaagggcgactacttctggtggctgctgctgcccgtgtgcgccatgagcatgacctgccccatcttcagcagcgccctgaacagcatgctgagcaagtgggacctgcccgtgttcaccctgcccttcaacatggccctgagcatgtacctgagcgccaccggccactacaaccccttcttccccgccaagctggtgatccccatcaccaccgcccccaacatcagctggagcgacctgagcgccctggagctgctgaagagcatccccgtgggcgtgggccagatctacggctgcgacaacccctggaccggcggcatcttcctgggcgccatcctgctgagcagccccctgatgtgcctgcacgccgccatcggcagcctgctgggcatcgccgccggcctgagcctgagcgcccccttcgaggacatctacttcggcctgtggggcttcaacagcagcctggcctgcatcgccatgggcggcatgttcatggccctgacctggcagacccacctgctggccctgggctgcgccctgttcaccgcctacctgggcgtgggcatggccaacttcatggccgaggtgggcctgcccgcctgcacctggcccttctgcctggccaccctgctgttcctgatcatgaccaccaagaacagcaacatctacaagatgcccctgagcaaggtgacctaccccgaggagaacagaatcttctacctgcaggccaagaagagaatggtggagagccccctgtag

SEQ ID NO: 99432 - DNA, 2763 bp, Artificial Sequence; identical to SEQ ID NO: 99424
  Description of Artificial Sequence: Synthetic coding sequence

SEQ ID NO: 99433 - DNA, 708 bp, Artificial Sequence
  Description of Artificial Sequence: Synthetic coding sequence
atgagcgacccccacagcagccccctgctgcccgagcccctgagcagcagatacaagctgtacgaggccgagttcaccagccccagctggcccagcaccagccccgacacccaccccgccctgcccctgctggagatgcccgaggagaaggacctgagaagcagcaacgaggacagccacatcgtgaagatcgagaagctgaacgagagaagcaagagaaaggacgacggcgtggcccacagagacagcgccggccagagatgcatctgcctgagcaaggccgtgggctacctgaccggcgacatgaaggagtacagaatctggctgaaggacaagcacctggccctgcagttcatcgactgggtgctgagaggcaccgcccaggtgatgttcatcaacaaccccctgagcggcctgatcatcttcatcggcctgctgatccagaacccctggtggaccatcaccggcggcctgggcaccgtggtgagcaccctgaccgccctggccctgggccaggacagaagcgccatcgccagcggcctgcacggctacaacggcatgctggtgggcctgctgatggccgtgttcagcgagaagctggactactactggtggctgctgttccccgtgaccttcaccgccatgagctggatggagaccgacttcaactggagcaagagcggctgctggaagcacctgctgcagtag

SEQ ID NO: 99434 - DNA, 627 bp, Artificial Sequence
  Description of Artificial Sequence: Synthetic coding sequence
atggaccagtggggcgtgtacttcaaccccgtgctggtgagcttctgccagagcttcttcggctaccccctgagcatcttcttcatcgtggtgaacgagttctgcgagagattcagctactacggcatgagagccatcctgatcctgtacttcaccaacttcatcagctgggacgacaacctgagcaccgccatctaccacaccttcgtggccctgtgctacctgacccccatcctgggcgccctgatcgccgacagctggctgggcaagttcaagaccatcgtgagcctgagcatcgtgtacaccatcggccaggccgtgaccagcgtgagcagcatcaacgacctgaccgaccacaaccacgacggcacccccgacagcctgcccgtgcacgtggtgctgagcctgatcggcctggccctgatcgccctgggcaccggcggcatcaagccctgcgtgagcgccttcggcggcgaccagttcgaggagggccaggagaagcagagaaacagattcttcagcatcttctacctggccatcaacgccggcagcctgctgagcaccatcatcacccccatgctgagaggcaagagatacctgaagggcaccagcgtgggcctgttctag

SEQ ID NO: 99435 - DNA, 849 bp, Artificial Sequence
  Description of Artificial Sequence: Synthetic coding sequence
atgagagccatcctgatcctgtacttcaccaacttcatcagctgggacgacaacctgagcaccgccatctaccacaccttcgtggccctgtgctacctgacccccatcctgggcgccctgatcgccgacagctggctgggcaagttcaagaccatcgtgagcctgagcatcgtgtacaccatcggccaggccgtgaccagcgtgagcagcatcaacgacctgaccgaccacaaccacgacggcacccccgacagcctgcccgtgcacgtggtgctgagcctgatcggcctggccctgatcgccctgggcaccggcggcatcaagccctgcgtgagcgccttcggcggcgaccagttcgaggagggccaggagaagcagagaaacagattcttcagcatcttctacctggccatcaacgccggcagcctgctgagcaccatcatcacccccatgctgagaggcaagagatacctgaagggcaccagcgtgggcctgttcctggtgagacccagcccctgcctgctgagattcgtgctgttcttccccagcgccctgttcagcagctgccagctgcacgccggcatgcacgtgggcatctggagcaagtgcttcctgccctgcgagttccacctgctgttcgtgctgttcaagagcctgatccccgtgaccaccggcgagagcaagcccagcctggcctgggccagcatcttcctgaactgctacagctgcaaggtgatgctggtggtgagaggcaagagacaggagagatgcctgggcagccaggccggcggcagaagctgccacttcagcctgcaggccctgctgcccagcgacatcagcgtgacctag

SEQ ID NO: 99436 - DNA, 2127 bp, Artificial Sequence
  Description of Artificial Sequence: Synthetic coding sequence
atgggcatgagcaagagccacagcttcttcggctaccccctgagcatcttcttcatcgtggtgaacgagttctgcgagagattcagctactacggcatgagagccatcctgatcctgtacttcaccaacttcatcagctgggacgacaacctgagcaccgccatctaccacaccttcgtggccctgtgctacctgacccccatcctgggcgccctgatcgccgacagctggctgggcaagttcaagaccatcgtgagcctgagcatcgtgtacaccatcggccaggccgtgaccagcgtgagcagcatcaacgacctgaccgaccacaaccacgacggcacccccgacagcctgcccgtgcacgtggtgctgagcctgatcggcctggccctgatcgccctgggcaccggcggcatcaagccctgcgtgagcgccttcggcggcgaccagttcgaggagggccaggagaagcagagaaacagattcttcagcatcttctacctggccatcaacgccggcagcctgctgagcaccatcatcacccccatgctgagagtgcagcagtgcggcatccacagcaagcaggcctgctaccccctggccttcggcgtgcccgccgccctgatggccgtggccctgatcgtgttcgtgctgggcagcggcatgtacaagaagttcaagccccagggcaacatcatgggcaaggtggccaagtgcatcggcttcgccatcaagaacagattcagacacagaagcaaggccttccccaagagagagcactggctggactgggccaaggagaagtacgacgagagactgatcagccagatcaagatggtgaccagagtgatgttcctgtacatccccctgcccatgttctgggccctgttcgaccagcagggcagcagatggaccctgcaggccaccaccatgagcggcaagatcggcgccctggagatccagcccgaccagatgcagaccgtgaacgccatcctgatcgtgatcatggtgcccatcttcgacgccgtgctgtaccccctgatcgccaagtgcggcttcaacttcaccagcctgaagaagatggccgtgggcatggtgctggccagcatggccttcgtggtggccgccatcgtgcaggtggagatcgacaagaccctgcccgtgttccccaagggcaacgaggtgcagatcaaggtgctgaacatcggcaacaacaccatgaacatcagcctgcccggcgagatggtgaccctgggccccatgagccagaccaacgccttcatgaccttcgacgtgaacaagctgaccagaatcaacatcagcagccccggcagccccgtgaccgccgtgaccgacgacttcaagcagggccagagacacaccctgctggtgtgggcccccaaccactaccaggtggtgaaggacggcctgaaccagaagcccgagaagggcgagaacggcatcagattcgtgaacaccttcaacgagctgatcaccatcaccatgagcggcaaggtgtacgccaacatcagcagctacaacgccagcacctaccagttcttccccagcggcatcaagggcttcaccatcagcagcaccgagatccccccccagtgccagcccaacttcaacaccttctacctggagttcggcagcgcctacacctacatcgtgcagagaaagaacgacagctgccccgaggtgaaggtgttcgaggacatcagcgccaacaccgtgaacatggccctgcagatcccccagtacttcctgctgacctgcggcgaggtggtgttcagcgtgaccggcctggagttcagctacagccaggcccccagcaacatgaagagcgtgctgcaggccggctggctgctgaccgtggccgtgggcaacatcatcgtgctgatcgtggccggcgccggccagttcagcaagcagtgggccgagtacatcctgttcgccgccctgctgctggtggtgtgcgtgatcttcgccatcatggccagattctacacctacatcaaccccgccgagatcgaggcccagttcgacgaggacgagaagaagaacagactggagaagagcaacccctacttcatgagcggcgccaacagccagaagcagatgtag

SEQ ID NO: 99437 - DNA, 1503 bp, Artificial Sequence
  Description of Artificial Sequence: Synthetic coding sequence
atgccccccgccgtgggcggccccgtgggctacaccccccccgacggcggctggggctgggccgtggtgatcggcgccttcatcagcatcggcttcagctacgccttccccaagagcatcaccgtgttcttcaaggagatcgagggcatcttccacgccaccaccagcgaggtgagctggatcagcagcatcatgctggccgtgatgtacggcggcggccccatcagcagcatcctggtgaacaagtacggcagcagaatcgtgatgatcgtgggcggctgcctgagcggctgcggcctgatcgccgccagcttctgcaacaccgtgcagcagctgtacgtgtgcatcggcgtgatcggcggcctgggcctggccttcaacctgaaccccgccctgaccatgatcggcaagtacttctacaagagaagacccctggccaacggcctggccatggccggcagccccgtgttcctgtgcaccctggcccccctgaaccaggtgttcttcggcatcttcggctggagaggcagcttcctgatcctgggcggcctgctgctgaactgctgcgtggccggcgccctgatgagacccatcggccccaagcccaccaaggccggcaaggacaagagcaaggccagcctggagaaggccggcaagagcggcgtgaagaaggacctgcacgacgccaacaccgacctgatcggcagacaccccaagcaggagaagagaagcgtgttccagaccatcaaccagttcctggacctgaccctgttcacccacagaggcttcctgctgtacctgagcggcaacgtgatcatgttcttcggcctgttcgcccccctggtgttcctgagcagctacggcaagagccagcactacagcagcgagaagagcgccttcctgctgagcatcctggccttcgtggacatggtggccagacccagcatgggcctggtggccaacaccaagcccatcagacccagaatccagtacttcttcgccgccagcgtggtggccaacggcgtgtgccacatgctggcccccctgagcaccacctacgtgggcttctgcgtgtacgccggcttcttcggcttcgccttcggctggctgagcagcgtgctgttcgagaccctgatggacctggtgggcccccagagattcagcagcgccgtgggcctggtgaccatcgtggagtgctgccccgtgctgctgggcccccccctgctgggcagactgaacgacatgtacggcgactacaagtacacctactgggcctgcggcgtggtgctgatcatcagcggcatctacctgttcatcggcatgggcatcaactacagactgctggccaaggagcagaaggccaacgagcagaagaaggagagcaaggaggaggagaccagcatcgacgtggccggcaagcccaacgaggtgaccaaggccgccgagagccccgaccagaaggacaccgacggcggccccaaggaggaggagagccccgtgtag

SEQ ID NO: 99438 - DNA, 648 bp, Artificial Sequence
  Description of Artificial Sequence: Synthetic coding sequence
atgccccccgccgtgggcggccccgtgggctacaccccccccgacggcggctggggctgggccgtggtgatcggcgccttcatcagcatcggcttcagctacgccttccccaagagcatcaccgtgttcttcaaggagatcgagggcatcttccacgccaccaccagcgaggtgagctggatcagcagcatcatgctggccgtgatgtacggcggcggccccatcagcagcatcctggtgaacaagtacggcagcagaatcgtgatgatcgtgggcggctgcctgagcggctgcggcctgatcgccgccagcttctgcaacaccgtgcagcagctgtacgtgtgcatcggcgtgatcggcggcctgggcctggccttcaacctgaaccccgccctgaccatgatcggcaagtacttctacaagagaagacccctggccaacggcctggccatggccggcagccccgtgttcctgtgcaccctggcccccctgaaccaggtgttcttcggcatcttcggctggagaggcagcttcctgatcctgggcggcctgctgctgaactgctgcgtggccggcgccctgatgagacccatcggccccaagcccaccaaggccggcaaggacaagagcaaggccagcctggagtag

SEQ ID NO: 99439 - DNA, 1293 bp, Artificial Sequence
  Description of Artificial Sequence: Synthetic coding sequence
atgccccccgccgtgggcggccccgtgggctacaccccccccgacggcggctggggctgggccgtggtgatcggcgccttcatcagcatcggcttcagctacgccttccccaagagcatcaccgtgttcttcaaggagatcgagggcatcttccacgccaccaccagcgaggtgagctggatcagcagcatcatgctggccgtgatgtacggcggcggccccatcagcagcatcctggtgaacaagtacggcagcagaatcgtgatgatcgtgggcggctgcctgagcggctgcggcctgatcgccgccagcttctgcaacaccgtgcagcagctgtacgtgtgcatcggcgtgatcggcggcctgggcctggccttcaacctgaaccccgccctgaccatgatcggcaagtacttctacaagagaagacccctggccaacggcctggccatggccggcagccccgtgttcctgtgcaccctggcccccctgaaccaggtgttcttcggcatcttcggctggagaggcagcttcctgatcctgggcggcctgctgctgaactgctgcgtggccggcgccctgatgagacccatcggccccaagcccaccaaggccggcaaggacaagagcaaggccagcctggagaaggccggcaagagcggcgtgaagaaggacctgcacgacgccaacaccgacctgatcggcagacaccccaagcaggagaagagaagcgtgttccagaccatcaaccagttcctggacctgaccctgttcacccacagaggcttcctgctgtacctgagcggcaacgtgatcatgttcttcggcctgttcgcccccctggtgttcctgagcagctacggcaagagccagcactacagcagcgagaagagcgccttcctgctgagcatcctggccttcgtggacatggtggccagacccagcatgggcctggtggccaacaccaagcccatcagacccagaatccagtacttcttcgccgccagcgtggtggccaacggcgtgtgccacatgctggcccccctgagcaccacctacgtgggcttctgcgtgtacgccggcttcttcggcttcgccttcggctggctgagcagcgtgctgttcgagaccctgatggacctggtgggcccccagagattcagcagcgccgtgggcctggtgaccatcgtggagtgctgccccgtgctgctgggcccccccctgctgggcatcgtgtacctgcccaccaacgtgggcctgctgcagaacaagcacgtgagatgggagtgctag

SEQ ID NO: 99440 - DNA, 891 bp, Artificial Sequence
  Description of Artificial Sequence: Synthetic coding sequence
atgccccccgccgtgggcggccccgtgggctacaccccccccgacggcggctggggctgggccgtggtgatcggcgccttcatcagcatcggcttcagctacgccttccccaagagcatcaccgtgttcttcaaggagatcgagggcatcttccacgccaccaccagcgaggtgagctggatcagcagcatcatgctggccgtgatgtacggcggcggccccatcagcagcatcctggtgaacaagtacggcagcagaatcgtgatgatcgtgggcggctgcctgagcggctgcggcctgatcgccgccagcttctgcaacaccgtgcagcagctgtacgtgtgcatcggcgtgatcggcggcctgggcctggccttcaacctgaaccccgccctgaccatgatcggcaagtacttctacaagagaagacccctggccaacggcctggccatggccggcagccccgtgttcctgtgcaccctggcccccctgaaccaggtgttcttcggcatcttcggctggagaggcagcttcctgatcctgggcggcctgctgctgaactgctgcgtggccggcgccctgatgagacccatcggccccaagcccaccaaggccggcaaggacaagagcaaggccagcctggagaaggccggcaagagcggcgtgaagaaggacctgcacgacgccaacaccgacctgatcggcagacaccccaagcaggagaagagaagcgtgttccagaccatcaaccagttcctggacctgaccctgttcacccacagaggcttcctgctgtacctgagcggcaacgtgatcatgttcttcggcctgttcgcccccctggtgttcctgagcagctacggcaagagccagcactacagcagcgagtag

SEQ ID NO: 99441 - DNA, 1371 bp, Artificial Sequence
  Description of Artificial Sequence: Synthetic coding sequence
atgccccccgccgtgggcggccccgtgggctacaccccccccgacggcggctggggctgggccgtggtgatcggcgccttcatcagcatcggcttcagctacgccttccccaagagcatcaccgtgttcttcaaggagatcgagggcatcttccacgccaccaccagcgaggtgagctggatcagcagcatcatgctggccgtgatgtacggcggcggccccatcagcagcatcctggtgaacaagtacggcagcagaatcgtgatgatcgtgggcggctgcctgagcggctgcggcctgatcgccgccagcttctgcaacaccgtgcagcagctgtacgtgtgcatcggcgtgatcggcggcctgggcctggccttcaacctgaaccccgccctgaccatgatcggcaagtacttctacaagagaagacccctggccaacggcctggccatggccggcagccccgtgttcctgtgcaccctggcccccctgaaccaggtgttcttcggcatcttcggctggagaggcagcttcctgatcctgggcggcctgctgctgaactgctgcgtggccggcgccctgatgagacccatcggccccaagcccaccaaggccggcaaggacaagagcaaggccagcctggagaaggccggcaagagcggcgtgaagaaggacctgcacgacgccaacaccgacctgatcggcagacaccccaagcaggagaagagaagcgtgttccagaccatcaaccagttcctggacctgaccctgttcacccacagaggcttcctgctgtacctgagcggcaacgtgatcatgttcttcggcctgttcgcccccctggtgttcctgagcagctacggcaagagccagcactacagcagcgagaagagcgccttcctgctgagcatcctggccttcgtggacatggtggccagacccagcatgggcctggtggccaacaccaagcccatcagacccagaatccagtacttcttcgccgccagcgtggtggccaacggcgtgtgccacatgctggcccccctgagcaccacctacgtgggcttctgcgtgtacgccggcttcttcggcttcgccttcggctggctgagcagcgtgctgttcgagaccctgatggacctggtgggcccccagagattcagcagcgccgtgggcctggtgaccatcgtggagtgctgccccgtgctgctgggcccccccctgctgggcagactgaacgacatgtacggcgactacaagtacacctactgggcctgcggcgtggtgctgatcatcagcggcatctacctgttcatcggcatgggcatcaactacagactgctggccaaggagcagaaggccaacgagtag

SEQ ID NO: 99442 - DNA, 1503 bp, Artificial Sequence; identical to SEQ ID NO: 99437
  Description of Artificial Sequence: Synthetic coding sequence

SEQ ID NO: 99443 - DNA, 606 bp, Artificial Sequence
  Description of Artificial Sequence: Synthetic coding sequence
atgaagcacgtgaacgagagattccaggacgagaagaacaaggaggtggtgctgatgtgcatcggcgtgaccagcggcgtgggcagactgctgttcggcagaatcgccgactacgtgcccggcgtgaagaaggtgtacctgcaggtgctgagcttcttcttcatcggcctgatgagcatgatgatccccctgtgcagcatcttcggcgccctgatcgccgtgtgcctgatcatgggcctgttcgacggctgcttcatcagcatcatggcccccatcgccttcgagctggtgggcgcccaggacgtgagccaggccatcggcttcctgctgggcttcatgagcatccccatgaccgtgggcccccccatcgccggcctgctgagagacaagctgggcagctacgacgtggccttctacctggccggcgtgccccccctgatcggcggcgccgtgctgtgcttcatcccctggatccacagcaagaagcagagagagatcagcaagaccaccggcaaggagaagatggagaagatgctggagaaccagaacagcctgctgagcagcagcagcggcatgttcaagaaggagagcgacagcatcatctag

SEQ ID NO: 99444 - DNA, 1548 bp, Artificial Sequence
  Description of Artificial Sequence: Synthetic coding sequence
atggtgctgagccaggaggagcccgacagcgccagaggcaccagcgaggcccagcccctgggccccgcccccaccggcgccgcccccccccccggccccggccccagcgacagccccgaggccgccgtggagaaggtggaggtggagctggccggccccgccaccgccgagccccacgagccccccgagccccccgagggcggctggggctggctggtgatgctggccgccatgtggtgcaacggcagcgtgttcggcatccagaacgcctgcggcgtgctgttcgtgagcatgctggagaccttcggcagcaaggacgacgacaagatggtgttcaagaccgcctgggtgggcagcctgagcatgggcatgatcttcttctgctgccccatcgtgagcgtgttcaccgacctgttcggctgcagaaagaccgccgtggtgggcgccgccgtgggcttcgtgggcctgatgagcagcagcttcgtgagcagcatcgagcccctgtacctgacctacggcatcatcttcgcctgcggctgcagcttcgcctaccagcccagcctggtgatcctgggccactacttcaagaagagactgggcctggtgaacggcatcgtgaccgccggcagcagcgtgttcaccatcctgctgcccctgctgctgagagtgctgatcgacagcgtgggcctgttctacaccctgagagtgctgtgcatcttcatgttcgtgctgttcctggccggcttcacctacagacccctggccaccagcaccaaggacaaggagagcggcggcagcggcagcagcctgttcagcagaaagaagttcagcccccccaagaagatcttcaacttcgccatcttcaaggtgaccgcctacgccgtgtgggccgtgggcatccccctggccctgttcggctacttcgtgccctacgtgcacctgatgaagcacgtgaacgagagattccaggacgagaagaacaaggaggtggtgctgatgtgcatcggcgtgaccagcggcgtgggcagactgctgttcggcagaatcgccgactacgtgcccggcgtgaagaaggtgtacctgcaggtgctgagcttcttcttcatcggcctgatgagcatgatgatccccctgtgcagcatcttcggcgccctgatcgccgtgtgcctgatcatgggcctgttcgacggctgcttcatcagcatcatggcccccatcgccttcgagctggtgggcgcccaggacgtgagccaggccatcggcttcctgctgggcttcatgagcatccccatgaccgtgggcccccccatcgccggcctgctgagagacaagctgggcagctacgacgtggccttctacctggccggcgtgccccccctgatcggcggcgccgtgctgtgcttcatcccctggatccacagcaagaagcagagagagatcagcaagaccaccggcaaggagaagatggagaagatgctggagaaccagaacagcctgctgagcagcagcagcggcatgttcaagaaggagagcgacagcatcatctag

SEQ ID NO: 99445 - DNA, 651 bp, Artificial Sequence
  Description of Artificial Sequence: Synthetic coding sequence
atggtgttcaagaccgcctgggtgggcagcctgagcatgggcatgatcttcttctgctgccccatcgtgagcgtgttcaccgacctgttcggctgcagaaagaccgccgtggtgggcgccgccgtgggcttcgtgggcctgatgagcagcagcttcgtgagcagcatcgagcccctgtacctgacctacggcatcatcttcgcctgcggctgcagcttcgcctaccagcccagcctggtgatcctgggccactacttcaagaagagactgggcctggtgaacggcatcgtgaccgccggcagcagcgtgttcaccatcctgctgcccctgctgctgagagtgctgatcgacagcgtgggcctgttctacaccctgagagtgctgtgcatcttcatgttcgtgctgttcctggccggcttcacctacagacccctggccaccagcaccaaggacaaggagagcggcggcagcggcagcagcctgttcagcagaaagaagttcagcccccccaagaagatcttcaacttcgccatcttcaaggtgaccgcctacgccgtgtgggccgtgggcatccccctggccctgttcggctacttcgtgccctacgtgcacctggccaagttcagcttcgtgatcctgaagtacgagtag

SEQ ID NO: 99446 - DNA, 636 bp, Artificial Sequence
  Description of Artificial Sequence: Synthetic coding sequence
tgatgggtgggcagcctgagcatgggcatgatcttcttctgctgccccatcgtgagcgtgttcaccgacctgttcggctgcagaaagaccgccgtggtgggcgccgccgtgggcttcgtgggcctgatgagcagcagcttcgtgagcagcatcgagcccctgtacctgacctacggcatcatcttcgcctgcggctgcagcttcgcctaccagcccagcctggtgatcctgggccactacttcaagaagagactgggcctggtgaacggcatcgtgaccgccggcagcagcgtgttcaccatcctgctgcccctgctgctgagagtgctgatcgacagcgtgggcctgttctacaccctgagagtgctgtgcatcttcatgttcgtgctgttcctggccggcttcacctacagacccctggccaccagcaccaaggacaaggagagcggcggcagcggcagcagcctgttcagcagaaagaagttcagcccccccaagaagatcttcaacttcgccatcttcaaggtgaccgcctacgccgtgtgggccgtgggcatccccctggccctgttcggctacttcgtgccctacgtgcacctggccaagttcagcttcgtgatcctgaagtacgagtag

SEQ ID NO: 99447 - DNA, 621 bp, Artificial Sequence
  Description of Artificial Sequence: Synthetic coding sequence
tgatgggtgggcagcctgagcatgggcatgatcttcttctgctgccccatcgtgagcgtgttcaccgacctgttcggctgcagaaagaccgccgtggtgggcgccgccgtgggcttcgtgggcctgatgagcagcagcttcgtgagcagcatcgagcccctgtacctgacctacggcatcatcttcgcctgcggctgcagcttcgcctaccagcccagcctggtgatcctgggccactacttcaagaagagactgggcctggtgaacggcatcgtgaccgccggcagcagcgtgttcaccatcctgctgcccctgctgctgagagtgctgatcgacagcgtgggcctgttctacaccctgagagtgctgtgcatcttcatgttcgtgctgttcctggccggcttcacctacagacccctggccaccagcaccaaggacaaggagagcggcggcagcggcagcagcctgttcagcagaaagaagttcagcccccccaagaagatcttcaacttcgccatcttcaaggtgaccgcctacgccgtgtgggccgtgggcatccccctggccctgttcggctacttcgtgccctacgtgcacctggtgagcatgctgctgcactag

SEQ ID NO: 99448 - DNA, 981 bp, Artificial Sequence
  Description of Artificial Sequence: Synthetic coding sequence
atggtgctgagccaggaggagcccgacagcgccagaggcaccagcgaggcccagcccctgggccccgcccccaccggcgccgcccccccccccggccccggccccagcgacagccccgaggccgccgtggagaaggtggaggtggagctggccggccccgccaccgccgagccccacgagccccccgagccccccgagggcggctggggctggctggtgatgctggccgccatgtggtgcaacggcagcgtgttcggcatccagaacgcctgcggcgtgctgttcgtgagcatgctggagaccttcggcagcaaggacgacgacaagatggtgttcaagaccgcctgggtgggcagcctgagcatgggcatgatcttcttctgctgccccatcgtgagcgtgttcaccgacctgttcggctgcagaaagaccgccgtggtgggcgccgccgtgggcttcgtgggcctgatgagcagcagcttcgtgagcagcatcgagcccctgtacctgacctacggcatcatcttcgcctgcggctgcagcttcgcctaccagcccagcctggtgatcctgggccactacttcaagaagagactgggcctggtgaacggcatcgtgaccgccggcagcagcgtgttcaccatcctgctgcccctgctgctgagagtgctgatcgacagcgtgggcctgttctacaccctgagagtgctgtgcatcttcatgttcgtgctgttcctggccggcttcacctacagacccctggccaccagcaccaaggacaaggagagcggcggcagcggcagcagcctgttcagcagaaagaagttcagcccccccaagaacttccagttctgccacctgcagggcgacagcctgtgcagcgtgggcagctggaacaccacctgcaccttctggatcctgtgcgccctgtgcagcctgggcgagtacgcccccagcctgatcatgaacatcaccatctag

SEQ ID NO: 99449 - DNA, 1461 bp, Artificial Sequence
  Description of Artificial Sequence: Synthetic coding sequence
atggccaaggtgaacagagccagaagcaccagcccccccgacggcggctggggctggatgatcgtggccggctgcttcctggtgaccatctgcaccagagccgtgaccagatgcatcagcatcttcttcgtggagttccagacctacttcacccaggactacgcccagaccgcctggatccacagcatcgtggactgcgtgaccatgctgtgcgcccccctgggcagcgtggtgagcaaccacctgagctgccaggtgggcatcatgctgggcggcctgctggccagcaccggcctgatcctgagcagcttcgccaccagcctgaagcacctgtacctgaccctgggcgtgctgaccggcctgggcttcgccctgtgctacagccccgccatcgccatggtgggcaagtacttcagcagaagaaaggccctggcctacggcatcgccatgagcggcagcggcatcggcaccttcatcctggcccccgtggtgcagctgctgatcgagcagttcagctggagaggcgccctgctgatcctgggcggcttcgtgctgaacctgtgcgtgtgcggcgccctgatgagacccatcaccctgaaggaggaccacaccacccccgagcagaaccacgtgtgcagaacccagaaggaggacatcaagagagtgagcccctacagcagcctgaccaaggagtgggcccagacctgcctgtgctgctgcctgcagcaggagtacagcttcctgctgatgagcgacttcgtggtgctggccgtgagcgtgctgttcatggcctacggctgcagccccctgttcgtgtacctggtgccctacgccctgagcgtgggcgtgagccaccagcaggccgccttcctgatgagcatcctgggcgtgatcgacatcatcggcaacatcaccttcggctggctgaccgacagaagatgcctgaagaactaccagtacgtgtgctacctgttcgccgtgggcatggacggcctgtgctacctgtgcctgcccatgctgcagagcctgcccctgctggtgcccttcagctgcaccttcggctacttcgacggcgcctacgtgaccctgatccccgtggtgaccaccgagatcgtgggcaccaccagcctgagcagcgccctgggcgtggtgtacttcctgcacgccgtgccctacctggtgagcccccccatcgccggcagactggtggacaccaccggcagctacaccgccgccttcctgctgtgcggcttcagcatgatcttcagcagcgtgctgctgggcttcgccagactgatcaagagaatgagaaagacccagctgcagttcatcgccaaggagagcgaccccaagctgcagctgtggaccaacggcagcgtggcctacagcgtggccagagagctggaccagaagcacggcgagcccgtggccaccgccgtgcccggctacagcctgacctag

SEQ ID NO: 99450 - DNA, 1551 bp, Artificial Sequence
  Description of Artificial Sequence: Synthetic coding sequence
atgcccagcggcagccactggaccgccaacagcagcaagatcatcacctggctgctggagcagcccggcaaggaggagaagagaaagaccatggccaaggtgaacagagccagaagcaccagcccccccgacggcggctggggctggatgatcgtggccggctgcttcctggtgaccatctgcaccagagccgtgaccagatgcatcagcatcttcttcgtggagttccagacctacttcacccaggactacgcccagaccgcctggatccacagcatcgtggactgcgtgaccatgctgtgcgcccccctgggcagcgtggtgagcaaccacctgagctgccaggtgggcatcatgctgggcggcctgctggccagcaccggcctgatcctgagcagcttcgccaccagcctgaagcacctgtacctgaccctgggcgtgctgaccggcctgggcttcgccctgtgctacagccccgccatcgccatggtgggcaagtacttcagcagaagaaaggccctggcctacggcatcgccatgagcggcagcggcatcggcaccttcatcctggcccccgtggtgcagctgctgatcgagcagttcagctggagaggcgccctgctgatcctgggcggcttcgtgctgaacctgtgcgtgtgcggcgccctgatgagacccatcaccctgaaggaggaccacaccacccccgagcagaaccacgtgtgcagaacccagaaggaggacatcaagagagtgagcccctacagcagcctgaccaaggagtgggcccagacctgcctgtgctgctgcctgcagcaggagtacagcttcctgctgatgagcgacttcgtggtgctggccgtgagcgtgctgttcatggcctacggctgcagccccctgttcgtgtacctggtgccctacgccctgagcgtgggcgtgagccaccagcaggccgccttcctgatgagcatcctgggcgtgatcgacatcatcggcaacatcaccttcggctggctgaccgacagaagatgcctgaagaactaccagtacgtgtgctacctgttcgccgtgggcatggacggcctgtgctacctgtgcctgcccatgctgcagagcctgcccctgctggtgcccttcagctgcaccttcggctacttcgacggcgcctacgtgaccctgatccccgtggtgaccaccgagatcgtgggcaccaccagcctgagcagcgccctgggcgtggtgtacttcctgcacgccgtgccctacctggtgagcccccccatcgccggcagactggtggacaccaccggcagctacaccgccgccttcctgctgtgcggcttcagcatgatcttcagcagcgtgctgctgggcttcgccagactgatcaagagaatgagaaagacccagctgcagttcatcgccaaggagagcgaccccaagctgcagctgtggaccaacggcagcgtggcctacagcgtggccagagagctggaccagaagcacggcgagcccgtggccaccgccgtgcccggctacagcctgacctag

SEQ ID NO: 99451 - DNA, 78 bp, Artificial Sequence
  Description of Artificial Sequence: Synthetic coding sequence
atgcccagcggcagccactggaccgccaacagcagcaagatcatcacctggctgctggagcagcccggcaaggagtag

SEQ ID NO: 99452 - DNA, 453 bp, Artificial Sequence
  Description of Artificial Sequence: Synthetic coding sequence
atgagacccatcaccctgaaggaggaccacaccacccccgagcagaaccacgtgtgcagaacccagaaggaggacatcaagagagtgagcccctacagcagcctgaccaaggagtgggcccagacctgcctgtgctgctgcctgcagcaggagtacagcttcctgctgatgagcgacttcgtggtgctggccgtgagcgtgctgttcatggcctacggctgcagccccctgttcgtgtacctggtgccctacgccctgagcgtgggcgtgagccaccagcaggccgccttcctgatgagcatcctgggcgtgatcgacatcatcggcaacatcaccttcggctggctgaccgacagaagattctgcatcaagaccttcggcatcttcagaaagagcgtgagaaagatgtacatcctgagaagcaccatcctgcacttctacaccgagttctag

SEQ ID NO: 99453 - DNA, 1842 bp, Artificial Sequence
  Description of Artificial Sequence: Synthetic coding sequence
atgggcagaggcggcggcggcctggacgtgggcggcggcggcgagggcagcagagacagactgagcagagacggcctggccagctggggcgccgagcccggcggcggcggcagcggcagcggcagcagcagcccccccagcagcagcagctgcagcagcagaaacaagtaccagccccagagcggcagcagcggccccagcagccacagcccccccgccgccatggccctgcagagccaggccagcgaggaggccaagggcccctggcaggaggccgaccaggagcagcaggagcccgtgggcagccccgagcccgagagcgagcccgagcccgagcccgagcccgagcccgtgcccgtgcccccccccgagccccagcccgagccccagcccctgcccgaccccgcccccctgcccgagctggagttcgagagcgagagagtgcacgagcccgagcccacccccaccgtggagaccagaggcaccgccagaggcttccagccccccgagggcggcttcggctgggtggtggtgttcgccgccacctggtgcaacggcagcatcttcggcatccacaacagcgtgggcatcctgtacagcatgctgctggaggaggagaaggagaagaacagacaggtggagttccaggccgcctgggtgggcgccctggccatgggcatgatcttcttctgcagccccatcgtgagcatcttcaccgacagactgggctgcagaatcaccgccaccgccggcgccgccgtggccttcatcggcctgcacaccagcagcttcaccagcagcctgagcctgagatacttcacctacggcatcctgttcggctgcggctgcagcttcgccttccagcccagcctggtgatcctgggccactacttccagagaagactgggcctggccaacggcgtggtgagcgccggcagcagcatcttcagcatgagcttccccttcctgatcagaatgctgggcgacaagatcaagctggcccagaccttccaggtgctgagcaccttcatgttcgtgctgatgctgctgagcctgacctacagacccctgctgcccagcagccaggacacccccagcaagagaggcgtgagaaccctgcaccagagattcctggcccagctgagaaagtacttcaacatgagagtgttcagacagagaacctacagaatctgggccttcggcatcgccgccgccgccctgggctacttcgtgccctacgtgcacctgatgaagtacgtggaggaggagttcagcgagatcaaggagacctgggtgctgctggtgtgcatcggcgccaccagcggcctgggcagactggtgagcggccacatcagcgacagcatccccggcctgaagaagatctacctgcaggtgctgagcttcctgctgctgggcctgatgagcatgatgatccccctgtgcagagacttcggcggcctgatcgtggtgtgcctgttcctgggcctgtgcgacggcttcttcatcaccatcatggcccccatcgccttcgagctggtgggccccatgcaggccagccaggccatcggctacctgctgggcatgatggccctgcccatgatcgccggcccccccatcgccggcctgctgagaaactgcttcggcgactaccacgtggccttctacttcgccggcgtgccccccatcatcggcgccgtgatcctgttcttcgtgcccctgatgcaccagagaatgttcaagaaggagcagagagacagcagcaaggacaagatgctggcccccgaccccgaccccaacggcgagctgctgcccggcagccccaaccccgaggagcccatctag

SEQ ID NO: 99454 - DNA, 1437 bp, Artificial Sequence
  Description of Artificial Sequence: Synthetic coding sequence
atgccccccatgcccagcgccccccccgtgcaccccccccccgacggcggctggggctggatcgtggtgggcgccgccttcatcagcatcggcttcagctacgccttccccaaggccgtgaccgtgttcttcaaggagatccagcagatcttccacaccacctacagcgagatcgcctggatcagcagcatcatgctggccgtgatgtacgccggcggccccgtgagcagcgtgctggtgaacaagtacggcagcagacccgtggtgatcgccggcggcctgctgtgctgcctgggcatggtgctggccagcttcagcagcagcgtggtgcagctgtacctgaccatgggcttcatcaccggcctgggcctggccttcaacctgcagcccgccctgaccatcatcggcaagtacttctacagaaagagacccatggccaacggcctggccatggccggcagccccgtgttcctgagcagcctggcccccttcaaccagtacctgttcaacaccttcggctggaagggcagcttcctgatcctgggcagcctgctgctgaacgcctgcgtggccggcagcctgatgagacccctgggccccaaccagaccaccagcaagagcaagaacaagaccggcaagaccgaggacgacagcagccccaagaagatcaagaccaagaagagcacctgggagaaggtgaacaagtacctggacttcagcctgttcaagcacagaggcttcctgatctacctgagcggcaacgtgatcatgttcctgggcttcttcgcccccatcatcttcctggccccctacgccaaggaccagggcatcgacgagtacagcgccgccttcctgctgagcgtgatggccttcgtggacatgttcgccagacccagcgtgggcctgatcgccaacagcaagtacatcagacccagaatccagtacttcttcagcttcgccatcatgttcaacggcgtgtgccacctgctgtgccccctggcccaggactacaccagcctggtgctgtacgccgtgttcttcggcctgggcttcggcagcgtgagcagcgtgctgttcgagaccctgatggacctggtgggcgcccccagattcagcagcgccgtgggcctggtgaccatcgtggagtgcggccccgtgctgctgggcccccccctggccggcaagctggtggacctgaccggcgagtacaagtacatgtacatgagctgcggcgccatcgtggtggccgccagcgtgtggctgctgatcggcaacgccatcaactacagactgctggccaaggagagaaaggaggagaacgccagacagaagaccagagagagcgagcccctgagcaagagcaagcacagcgaggacgtgaacgtgaaggtgagcaacgcccagagcgtgaccagcgagagagagaccaacatctag

SEQ ID NO: 99455 - DNA, 1140 bp, Artificial Sequence
  Description of Artificial Sequence: Synthetic coding sequence
atggtgctggccagcttcagcagcagcgtggtgcagctgtacctgaccatgggcttcatcaccggcctgggcctggccttcaacctgcagcccgccctgaccatcatcggcaagtacttctacagaaagagacccatggccaacggcctggccatggccggcagccccgtgttcctgagcagcctggcccccttcaaccagtacctgttcaacaccttcggctggaagggcagcttcctgatcctgggcagcctgctgctgaacgcctgcgtggccggcagcctgatgagacccctgggccccaaccagaccaccagcaagagcaagaacaagaccggcaagaccgaggacgacagcagccccaagaagatcaagaccaagaagagcacctgggagaaggtgaacaagtacctggacttcagcctgttcaagcacagaggcttcctgatctacctgagcggcaacgtgatcatgttcctgggcttcttcgcccccatcatcttcctggccccctacgccaaggaccagggcatcgacgagtacagcgccgccttcctgctgagcgtgatggccttcgtggacatgttcgccagacccagcgtgggcctgatcgccaacagcaagtacatcagacccagaatccagtacttcttcagcttcgccatcatgttcaacggcgtgtgccacctgctgtgccccctggcccaggactacaccagcctggtgctgtacgccgtgttcttcggcctgggcttcggcagcgtgagcagcgtgctgttcgagaccctgatggacctggtgggcgcccccagattcagcagcgccgtgggcctggtgaccatcgtggagtgcggccccgtgctgctgggcccccccctggccggcaagctggtggacctgaccggcgagtacaagtacatgtacatgagctgcggcgccatcgtggtggccgccagcgtgtggctgctgatcggcaacgccatcaactacagactgctggccaaggagagaaaggaggagaacgccagacagaagaccagagagagcgagcccctgagcaagagcaagcacagcgaggacgtgaacgtgaaggtgagcaacgcccagagcgtgaccagcgagagagagaccaacatctag

SEQ ID NO: 99456 - DNA, 1437 bp, Artificial Sequence; identical to SEQ ID NO: 99454
  Description of Artificial Sequence: Synthetic coding sequence

SEQ ID NO: 99457 - DNA, 1437 bp, Artificial Sequence; identical to SEQ ID NO: 99454
  Description of Artificial Sequence: Synthetic coding sequence

SEQ ID NO: 99458 - DNA, 1437 bp, Artificial Sequence; identical to SEQ ID NO: 99454
  Description of Artificial Sequence: Synthetic coding sequence

SEQ ID NO: 99459 - DNA, 1530 bp, Artificial Sequence
  Description of Artificial Sequence: Synthetic coding sequence
atggagctgaagaagagccccgacggcggctggggctgggtgatcgtgttcgtgagcttcctgacccagttcctgtgctacggcagccccctggccgtgggcgtgctgtacatcgagtggctggacgccttcggcgagggcaagggcaagaccgcctgggtgggcagcctggccagcggcgtgggcctgctggccagccccgtgtgcagcctgtgcgtgagcagcttcggcgccagacccgtgaccatcttcagcggcttcatggtggccggcggcctgatgctgagcagcttcgcccccaacatctacttcctgttcttcagctacggcatcgtggtgggcctgggctgcggcctgctgtacaccgccaccgtgaccatcacctgccagtacttcgacgacagaagaggcctggccctgggcctgatcagcaccggcagcagcgtgggcctgttcatctacgccgccctgcagagaatgctggtggagttctacggcctggacggctgcctgctgatcgtgggcgccctggccctgaacatcctggcctgcggcagcctgatgagacccctgcagagcagcgactgccccctgcccaagaagatcgcccccgaggacctgcccgacaagtacagcatctacaacgagaagggcaagaacctggaggagaacatcaacatcctggacaagagctacagcagcgaggagaagtgcagaatcaccctggccaacggcgactggaagcaggacagcctgctgcacaagaaccccaccgtgacccacaccaaggagcccgagacctacaagaagaaggtggccgagcagacctacttctgcaagcagctggccaagagaaagtggcagctgtacaagaactactgcggcgagaccgtggccctgttcaagaacaaggtgttcagcgccctgttcatcgccatcctgctgttcgacatcggcggcttcccccccagcctgctgatggaggacgtggccagaagcagcaacgtgaaggaggaggagttcatcatgcccctgatcagcatcatcggcatcatgaccgccgtgggcaagctgctgctgggcatcctggccgacttcaagtggatcaacaccctgtacctgtacgtggccaccctgatcatcatgggcctggccctgtgcgccatccccttcgccaagagctacgtgaccctggccctgctgagcggcatcctgggcttcctgaccggcaactggagcatcttcccctacgtgaccaccaagaccgtgggcatcgagaagctggcccacgcctacggcatcctgatgttcttcgccggcctgggcaacagcctgggcccccccatcgtgggctggttctacgactggacccagacctacgacatcgccttctacttcagcggcttctgcgtgctgctgggcggcttcatcctgctgctggccgccctgcccagctgggacacctgcaacaagcagctgcccaagcccgcccccaccaccttcctgtacaaggtggccagcaacgtgtag

SEQ ID NO: 99460 - DNA, 1530 bp, Artificial Sequence; identical to SEQ ID NO: 99459
  Description of Artificial Sequence: Synthetic coding sequence

SEQ ID NO: 99461 - DNA, 198 bp, Artificial Sequence
  Description of Artificial Sequence: Synthetic coding sequence
atggagctgaagaagagccccgacggcggctggggctgggtgatcgtgttcgtgagcttcctgacccagttcctgtgctacggcagccccctggccgtgggcgtgctgtacatcgagtggctggacgccttcggcgagggcaagggcaagaccgcctgggtgggcagcctggccagcggcgtgggcctgctggcctag

SEQ ID NO: 99462 - DNA, 1488 bp, Artificial Sequence
  Description of Artificial Sequence: Synthetic coding sequence
atgagaagccccgtgagagacctggccagaaacgacggcgaggagagcaccgacagaacccccctgctgcccggcgcccccagagccgaggccgcccccgtgtgctgcagcgccagatacaacctggccatcctggccttcttcggcttcttcatcgtgtacgccctgagagtgaacctgagcgtggccctggtggacatggtggacagcaacaccaccctggaggacaacagaaccagcaaggcctgccccgagcacagcgcccccatcaaggtgcaccacaaccagaccggcaagaagtaccagtgggacgccgagacccagggctggatcctgggcagcttcttctacggctacatcatcacccagatccccggcggctacgtggccagcaagatcggcggcaagatgctgctgggcttcggcatcctgggcaccgccgtgctgaccctgttcacccccatcgccgccgacctgggcgtgggccccctgatcgtgctgagagccctggagggcctgggcgagggcgtgaccttccccgccatgcacgccatgtggagcagctgggccccccccctggagagaagcaagctgctgagcatcagctacgccggcgcccagctgggcaccgtgatcagcctgcccctgagcggcatcatctgctactacatgaactggacctacgtgttctacttcttcggcaccatcggcatcttctggttcctgctgtggatctggctggtgagcgacaccccccagaagcacaagagaatcagccactacgagaaggagtacatcctgagcagcctgagaaaccagctgagcagccagaagagcgtgccctgggtgcccatcctgaagagcctgcccctgtgggccatcgtggtggcccacttcagctacaactggaccttctacaccctgctgaccctgctgcccacctacatgaaggagatcctgagattcaacgtgcaggagaacggcttcctgagcagcctgccctacctgggcagctggctgtgcatgatcctgagcggccaggccgccgacaacctgagagccaagtggaacttcagcaccctgtgcgtgagaagaatcttcagcctgatcggcatgatcggccccgccgtgttcctggtggccgccggcttcatcggctgcgactacagcctggccgtggccttcctgaccatcagcaccaccctgggcggcttctgcagcagcggcttcagcatcaaccacctggacatcgcccccagctacgccggcatcctgctgggcatcaccaacaccttcgccaccatccccggcatggtgggccccgtgatcgccaagagcctgacccccgacaacaccgtgggcgagtggcagaccgtgttctacatcgccgccgccatcaacgtgttcggcgccatcttcttcaccctgttcgccaagggcgaggtgcagaactgggccctgaacgaccaccacggccacagacactag

SEQ ID NO: 99463 - DNA, 546 bp, Artificial Sequence
  Description of Artificial Sequence: Synthetic coding sequence
atgagaagccccgtgagagacctggccagaaacgacggcgaggagagcaccgacagaacccccctgctgcccggcgcccccagagccgaggccgcccccgtgtgctgcagcgccagatacaacctggccatcctggccttcttcggcttcttcatcgtgtacgccctgagagtgaacctgagcgtggccctggtggacatggtggacagcaacaccaccctggaggacaacagaaccagcaaggcctgccccgagcacagcgcccccatcaaggtgcaccacaaccagaccggcaagaagtaccagtgggacgccgagacccagggctggatcctgggcagcttcttctacggctacatcatcacccagatccccggcggctacgtggccagcaagatcggcggcaagatgctgctgggcttcggcatcctgggcaccgccgtgctgaccctgttcacccccatcgccgccgacctgggcgtgggccccctgatcgtgctgagagccctggagggcctgggcgaggagcacagcctgggccagtag

SEQ ID NO: 99464 - DNA, 1404 bp, Artificial Sequence
  Description of Artificial Sequence: Synthetic coding sequence
atgcagatggacaacagactgccccccaagaaggtgcccggcttctgcagcttcagatacggcctgagcttcctggtgcactgctgcaacgtgatcatcaccgcccagagagcctgcctgaacctgaccatggtggtgatggtgaacagcaccgacccccacggcctgcccaacaccagcaccaagaagctgctggacaacatcaagaaccccatgtacaactggagccccgacatccagggcatcatcctgagcagcaccagctacggcgtgatcatcatccaggtgcccgtgggctacttcagcggcatctacagcaccaagaagatgatcggcttcgccctgtgcctgagcagcgtgctgagcctgctgatcccccccgccgccggcatcggcgtggcctgggtggtggtgtgcagagccgtgcagggcgccgcccagggcatcgtggccaccgcccagttcgagatctacgtgaagtgggccccccccctggagagaggcagactgaccagcatgagcaccagcggcttcctgctgggccccttcatcgtgctgctggtgaccggcgtgatctgcgagagcctgggctggcccatggtgttctacatcttcggcgcctgcggctgcgccgtgtgcctgctgtggttcgtgctgttctacgacgaccccaaggaccacccctgcatcagcatcagcgagaaggagtacatcaccagcagcctggtgcagcaggtgagcagcagcagacagagcctgcccatcaaggccatcctgaagagcctgcccgtgtgggccatcagcaccggcagcttcaccttcttctggagccacaacatcatgaccctgtacacccccatgttcatcaacagcatgctgcacgtgaacatcaaggagaacggcttcctgagcagcctgccctacctgttcgcctggatctgcggcaacctggccggccagctgagcgacttcttcctgaccagaaacatcctgagcgtgatcgccgtgagaaagctgttcaccgccgccggcttcctgctgcccgccatcttcggcgtgtgcctgccctacctgagcagcaccttctacagcatcgtgatcttcctgatcctggccggcgccaccggcagcttctgcctgggcggcgtgttcatcaacggcctggacatcgcccccagatacttcggcttcatcaaggcctgcagcaccctgaccggcatgatcggcggcctgatcgccagcaccctgaccggcctgatcctgaagcaggaccccgagagcgcctggttcaagaccttcatcctgatggccgccatcaacgtgaccggcctgatcttctacctgatcgtggccaccgccgagatccaggactgggccaaggagaagcagcacaccagactgtag

SEQ ID NO: 99465 - DNA, 630 bp, Artificial Sequence
  Description of Artificial Sequence: Synthetic coding sequence
atgcagatggacaacagactgccccccaagaaggtgcccggcttctgcagcttcagatacggcctgagcttcctggtgcactgctgcaacgtgatcatcaccgcccagagagcctgcctgaacctgaccatggtggtgatggtgaacagcaccgacccccacggcctgcccaacaccagcaccaagaagctgctggacaacatcaagaaccccatgtacaactggagccccgacatccagggcatcatcctgagcagcaccagctacggcgtgatcatcatccaggtgcccgtgggctacttcagcggcatctacagcaccaagaagatgatcggcttcgccctgtgcctgagcagcgtgctgagcctgctgatcccccccgccgccggcatcggcgtggcctgggtggtggtgtgcagagccgtgcagggcgccgcccagggcatcgtggccaccgcccagttcgagatctacgtgaagtgggccccccccctggagagaggcagactgaccagcatgagcaccagcggcttcctgctgggccccttcatcgtgctgctggtgaccggcgtgatctgcgagagcctgggctggcccatggtgttctacatcttcggccagttcaagtag

SEQ ID NO: 99466 - DNA, 1242 bp, Artificial Sequence
  Description of Artificial Sequence: Synthetic coding sequence
atgcagatggacaacagactgccccccaagaaggtgcccggcttctgcagcttcagatacggcctgagcttcctggtgcactgctgcaacgtgatcatcaccgcccagagagcctgcctgaacctgaccatggtggtgatggtgaacagcaccgacccccacggcctgcccaacaccagcaccaagaagctgctggacaacatcaagaaccccatgtacaactggagccccgacatccagggcatcatcctgagcagcaccagctacggcgtgatcatcatccaggtgcccgtgggctacttcagcggcatctacagcaccaagaagatgatcggcttcgccctgtgcctgagcagcgtgctgagcctgctgatcccccccgccgccggcatcggcgtggcctgggtggtggtgtgcagagccgtgcagggcgccgcccagggcatcgtggccaccgcccagttcgagatctacgtgaagtgggccccccccctggagagaggcagactgaccagcatgagcaccagcggcttcctgctgggccccttcatcgtgctgctggtgaccggcgtgatctgcgagagcctgggctggcccatggtgttctacatcttcggcgcctgcggctgcgccgtgtgcctgctgtggttcgtgctgttctacgacgaccccaaggaccacccctgcatcagcatcagcgagaaggagtacatcaccagcagcctggtgcagcagaacggcttcctgagcagcctgccctacctgttcgcctggatctgcggcaacctggccggccagctgagcgacttcttcctgaccagaaacatcctgagcgtgatcgccgtgagaaagctgttcaccgccgccggcttcctgctgcccgccatcttcggcgtgtgcctgccctacctgagcagcaccttctacagcatcgtgatcttcctgatcctggccggcgccaccggcagcttctgcctgggcggcgtgttcatcaacggcctggacatcgcccccagatacttcggcttcatcaaggcctgcagcaccctgaccggcatgatcggcggcctgatcgccagcaccctgaccggcctgatcctgaagcaggaccccgagagcgcctggttcaagaccttcatcctgatggccgccatcaacgtgaccggcctgatcttctacctgatcgtggccaccgccgagatccaggactgggccaaggagaagcagcacaccagactgtag

SEQ ID NO: 99467 - DNA, 1242 bp, Artificial Sequence; identical to SEQ ID NO: 99466
  Description of Artificial Sequence: Synthetic coding sequence

SEQ ID NO: 99468 - DNA, 1404 bp, Artificial Sequence; identical to SEQ ID NO: 99464
  Description of Artificial Sequence: Synthetic coding sequence

SEQ ID NO: 99469 - DNA, 1320 bp, Artificial Sequence
  Description of Artificial Sequence: Synthetic coding sequence
atggacggcaagcccgccaccagaaagggccccgacttctgcagcctgagatacggcctggccctgatcatgcacttcagcaacttcaccatgatcacccagagagtgagcctgagcatcgccatcatcgccatggtgaacaccacccagcagcagggcctgagcaacgccagcaccgagggccccgtggccgacgccttcaacaacagcagcatcagcatcaaggagttcgacaccaaggccagcgtgtaccagtggagccccgagacccagggcatcatcttcagcagcatcaactacggcatcatcctgaccctgatccccagcggctacctggccggcatcttcggcgccaagaagatgctgggcgccggcctgctgatcagcagcctgctgaccctgttcacccccctggccgccgacttcggcgtgatcctggtgatcatggtgagaaccgtgcagggcatggcccagggcatggcctggaccggccagttcaccatctgggccaagtgggccccccccctggagagaagcaagctgaccaccatcgccggcagcggcagcgccttcggcagcttcatcatcctgtgcgtgggcggcctgatcagccaggccctgagctggcccttcatcttctacatcttcggcagcaccggctgcgtgtgctgcctgctgtggttcaccgtgatctacgacgaccccatgcaccacccctgcatcagcgtgagagagaaggagcacatcctgagcagcctggcccagcagcccagcagccccggcagagccgtgcccatcaaggccatggtgacctgcctgcccctgtgggccatcttcctgggcttcttcagccacttctggctgtgcaccatcatcctgacctacctgcccacctacatcagcaccctgctgcacgtgaacatcagagacagcggcgtgctgagcagcctgcccttcatcgccgccgccagctgcaccatcctgggcggccagctggccgacttcctgctgagcagaaacctgctgagactgatcaccgtgagaaagctgttcagcagcctgggcctgctgctgcccagcatctgcgccgtggccctgcccttcgtggccagcagctacgtgatcaccatcatcctgctgatcctgatccccggcaccagcaacctgtgcgacagcggcttcatcatcaacaccctggacatcgcccccagatacgccagcttcctgatgggcatcagcagaggcttcggcctgatcgccggcatcatcagcagcaccgccaccggcttcctgatcagccaggtgggccccgtgtactag

SEQ ID NO: 99470 - DNA, 1311 bp, Artificial Sequence
  Description of Artificial Sequence: Synthetic coding sequence
atggacggcaagcccgccaccagaaagggccccgacttctgcagcctgagatacggcctggccctgatcatgcacttcagcaacttcaccatgatcacccagagagtgagcctgagcatcgccatcatcgccatggtgaacaccacccagcagcagggcctgagcaacgccagcaccgagggccccgtggccgacgccttcaacaacagcagcatcagcatcaaggagttcgacaccaaggccagcgtgtaccagtggagccccgagacccagggcatcatcttcagcagcatcaactacggcatcatcctgaccctgatccccagcggctacctggccggcatcttcggcgccaagaagatgctgggcgccggcctgctgatcagcagcctgctgaccctgttcacccccctggccgccgacttcggcgtgatcctggtgatcatggtgagaaccgtgcagggcatggcccagggcatggcctggaccggccagttcaccatctgggccaagtgggccccccccctggagagaagcaagctgaccaccatcgccggcagcggcagcgccttcggcagcttcatcatcctgtgcgtgggcggcctgatcagccaggccctgagctggcccttcatcttctacatcttcggcagcaccggctgcgtgtgctgcctgctgtggttcaccgtgatctacgacgaccccatgcaccacccctgcatcagcgtgagagagaaggagcacatcctgagcagcctggcccagcagcccagcagccccggcagagccgtgcccatcaaggccatggtgacctgcctgcccctgtgggccatcttcctgggcttcttcagccacttctggctgtgcaccatcatcctgacctacctgcccacctacatcagcaccctgctgcacgtgaacatcagagacagcggcgtgctgagcagcctgcccttcatcgccgccgccagctgcaccatcctgggcggccagctggccgacttcctgctgagcagaaacctgctgagactgatcaccgtgagaaagctgttcagcagcctggacatgcaggtgagcagctgggagagccagggcgacctgggcagcagccaggagagcagcctgcccctgcccctggacagcagcagcgtgagaatcctgagcctggtgggcggcatgagcttcagctgcctgctgcagagcacctgcctggcctggagcttcaccagcagactggacaagcagaacttcaagaccggccccaagagaggccccctgcccgccagcgaggacatcaagctgcagacctag

SEQ ID NO: 99471 - DNA, 1437 bp, Artificial Sequence
  Description of Artificial Sequence: Synthetic coding sequence
atggacggcaagcccgccaccagaaagggccccgacttctgcagcctgagatacggcctggccctgatcatgcacttcagcaacttcaccatgatcacccagagagtgagcctgagcatcgccatcatcgccatggtgaacaccacccagcagcagggcctgagcaacgccagcaccgagggccccgtggccgacgccttcaacaacagcagcatcagcatcaaggagttcgacaccaaggccagcgtgtaccagtggagccccgagacccagggcatcatcttcagcagcatcaactacggcatcatcctgaccctgatccccagcggctacctggccggcatcttcggcgccaagaagatgctgggcgccggcctgctgatcagcagcctgctgaccctgttcacccccctggccgccgacttcggcgtgatcctggtgatcatggtgagaaccgtgcagggcatggcccagggcatggcctggaccggccagttcaccatctgggccaagtgggccccccccctggagagaagcaagctgaccaccatcgccggcagcggcagcgccttcggcagcttcatcatcctgtgcgtgggcggcctgatcagccaggccctgagctggcccttcatcttctacatcttcggcagcaccggctgcgtgtgctgcctgctgtggttcaccgtgatctacgacgaccccatgcaccacccctgcatcagcgtgagagagaaggagcacatcctgagcagcctggcccagcagcccagcagccccggcagagccgtgcccatcaaggccatggtgacctgcctgcccctgtgggccatcttcctgggcttcttcagccacttctggctgtgcaccatcatcctgacctacctgcccacctacatcagcaccctgctgcacgtgaacatcagagacagcggcgtgctgagcagcctgcccttcatcgccgccgccagctgcaccatcctgggcggccagctggccgacttcctgctgagcagaaacctgctgagactgatcaccgtgagaaagctgttcagcagcctgggcctgctgctgcccagcatctgcgccgtggccctgcccttcgtggccagcagctacgtgatcaccatcatcctgctgatcctgatccccggcaccagcaacctgtgcgacagcggcttcatcatcaacaccctggacatcgcccccagatacgccagcttcctgatgggcatcagcagaggcttcggcctgatcgccggcatcatcagcagcaccgccaccggcttcctgatcagccaggacttcgagagcggctggagaaacgtgttcttcctgagcgccgccgtgaacatgttcggcctggtgttctacctgaccttcggccaggccgagctgcaggactgggccaaggagagaaccctgaccagactgtag

SEQ ID NO: 99472 - DNA, 1263 bp, Artificial Sequence
  Description of Artificial Sequence: Synthetic coding sequence
atggccaccaagaccgagctgagccccaccgccagagagagcaagaacgcccaggacatgcaggtggacgagaccctgatccccagaaaggtgcccagcctgtgcagcgccagatacggcatcgccctggtgctgcacttctgcaacttcaccaccatcgcccagaacgtgatcatgaacatcaccatggtggccatggtgaacagcaccagcccccagagccagctgaacgacagcagcgaggtgctgcccgtggacagcttcggcggcctgagcaaggcccccaagagcctgcccgccaagagcagcatcctgggcggccagttcgccatctgggagaagtggggccccccccaggagagaagcagactgtgcagcatcgccctgagcggcatgctgctgggctgcttcaccgccatcctgatcggcggcttcatcagcgagaccctgggctggcccttcgtgttctacatcttcggcggcgtgggctgcgtgtgctgcctgctgtggttcgtggtgatctacgacgaccccgtgagctacccctggatcagcaccagcgagaaggagtacatcatcagcagcctgaagcagcaggtgggcagcagcaagcagcccctgcccatcaaggccatgctgagaagcctgcccatctggagcatctgcctgggctgcttcagccaccagtggctggtgagcaccatggtggtgtacatccccacctacatcagcagcgtgtaccacgtgaacatcagagacaacggcctgctgagcgccctgcccttcatcgtggcctgggtgatcggcatggtgggcggctacctggccgacttcctgctgaccaagaagttcagactgatcaccgtgagaaagatcgccaccatcctgggcagcctgcccagcagcgccctgatcgtgagcctgccctacctgaacagcggctacatcaccgccaccgccctgctgaccctgagctgcggcctgagcaccctgtgccagagcggcatctacatcaacgtgctggacatcgcccccagatacagcagcttcctgatgggcgccagcagaggcttcagcagcatcgcccccgtgatcgtgcccaccgtgagcggcttcctgctgagccaggaccccgagttcggctggagaaacgtgttcttcctgctgttcgccgtgaacctgctgggcctgctgttctacctgatcttcggcgaggccgacgtgcaggagtgggccaaggagagaaagctgaccagactgtag

SEQ ID NO: 99473 - DNA, 1263 bp, Artificial Sequence; identical to SEQ ID NO: 99472
  Description of Artificial Sequence: Synthetic coding sequence

SEQ ID NO: 99474 - DNA, 1497 bp, Artificial Sequence
  Description of Artificial Sequence: Synthetic coding sequence
atggccaccaagaccgagctgagccccaccgccagagagagcaagaacgcccaggacatgcaggtggacgagaccctgatccccagaaaggtgcccagcctgtgcagcgccagatacggcatcgccctggtgctgcacttctgcaacttcaccaccatcgcccagaacgtgatcatgaacatcaccatggtggccatggtgaacagcaccagcccccagagccagctgaacgacagcagcgaggtgctgcccgtggacagcttcggcggcctgagcaaggcccccaagagcctgcccgccaaggcccccgtgtacgactggagcccccagatccagggcatcatcttcggcgccgtgggctacggcggcatcctgaccatggcccccagcggctacctggccggcagagtgggcaccaagagagtggtgggcatcagcctgttcgccaccagcttcctgaccctgtgcatccccctggccaccgacttcggcatcgtgctgctgatcgtgaccagaatcgtgcagggcctgagccagagcagcatcctgggcggccagttcgccatctgggagaagtggggccccccccaggagagaagcagactgtgcagcatcgccctgagcggcatgctgctgggctgcttcaccgccatcctgatcggcggcttcatcagcgagaccctgggctggcccttcgtgttctacatcttcggcggcgtgggctgcgtgtgctgcctgctgtggttcgtggtgatctacgacgaccccgtgagctacccctggatcagcaccagcgagaaggagtacatcatcagcagcctgaagcagcaggtgggcagcagcaagcagcccctgcccatcaaggccatgctgagaagcctgcccatctggagcatctgcctgggctgcttcagccaccagtggctggtgagcaccatggtggtgtacatccccacctacatcagcagcgtgtaccacgtgaacatcagagacaacggcctgctgagcgccctgcccttcatcgtggcctgggtgatcggcatggtgggcggctacctggccgacttcctgctgaccaagaagttcagactgatcaccgtgagaaagatcgccaccatcctgggcagcctgcccagcagcgccctgatcgtgagcctgccctacctgaacagcggctacatcaccgccaccgccctgctgaccctgagctgcggcctgagcaccctgtgccagagcggcatctacatcaacgtgctggacatcgcccccagatacagcagcttcctgatgggcgccagcagaggcttcagcagcatcgcccccgtgatcgtgcccaccgtgagcggcttcctgctgagccaggaccccgagttcggctggagaaacgtgttcttcctgctgttcgccgtgaacctgctgggcctgctgttctacctgatcttcggcgaggccgacgtgcaggagtgggccaaggagagaaagctgaccagactgtag

SEQ ID NO: 99475 - DNA, 300 bp, Artificial Sequence
  Description of Artificial Sequence: Synthetic coding sequence
tgaaccctgagctgcggcctgagcaccctgtgccagagcggcatctacatcaacgtgctggacatcgcccccagatacagcagcttcctgatgggcgccagcagaggcttcagcagcatcgcccccgtgatcgtgcccaccgtgagcggcttcctgctgagccaggaccccgagttcggctggagaaacgtgttcttcctgctgttcgccgtgaacctgctgggcctgctgttctacctgatcttcggcgaggccgacgtgcaggagtgggccaaggagagaaagctgaccagactgtag

SEQ ID NO: 99476 - DNA, 156 bp, Artificial Sequence
  Description of Artificial Sequence: Synthetic coding sequence
agcggcttcctgctgagccaggaccccgagttcggctggagaaacgtgttcttcctgctgttcgccgtgaacctgctgggcctgctgttctacctgatcttcggcgaggccgacgtgcaggagtgggccaaggagagaaagctgaccagactgtag

SEQ ID NO: 99477 - DNA, 1494 bp, Artificial Sequence
  Description of Artificial Sequence: Synthetic coding sequence
atgagcaccggccccgacgtgaaggccaccgtgggcgacatcagcagcgacggcaacctgaacgtggcccaggaggagtgcagcagaaagggcttctgcagcgtgagacacggcctggccctgatcctgcagctgtgcaacttcagcatctacacccagcagatgaacctgagcatcgccatccccgccatggtgaacaacaccgccccccccagccagcccaacgccagcaccgagagacccagcaccgacagccagggctactggaacgagaccctgaaggagttcaaggccatggcccccgcctacgactggagccccgagatccagggcatcatcctgagcagcctgaactacggcagcttcctggcccccatccccagcggctacgtggccggcatcttcggcgccaagtacgtggtgggcgccggcctgttcatcagcagcttcctgaccctgttcatccccctggccgccaacgccggcgtggccctgctgatcgtgctgagaatcgtgcagggcatcgcccaggtgatggtgctgaccggccagtacagcatctgggtgaagtgggccccccccctggagagaagccagctgaccaccatcgccggcagcggcagcatgctgggcagcttcatcgtgctgctggccggcggcctgctgtgccagaccatcggctggccctacgtgttctacatcttcggcggcatcggctgcgcctgctgccccctgtggttccccctgatctacgacgaccccgtgaaccaccccttcatcagcgccggcgagaagagatacatcgtgtgcagcctggcccagcaggactgcagccccggctggagcctgcccatcagagccatgatcaagagcctgcccctgtgggccatcctggtgagctacttctgcgagtactggctgttctacaccatcatggcctacacccccacctacatcagcagcgtgctgcaggccaacctgagagacagcggcatcctgagcgccctgcccttcgtggtgggctgcatctgcatcatcctgggcggcctgctggccgacttcctgctgagcagaaagatcctgagactgatcaccatcagaaagctgttcaccgccatcggcgtgctgttccccagcgtgatcctggtgagcctgccctgggtgagaagcagccacagcatgaccatgaccttcctggtgctgagcagcgccatcagcagcttctgcgagagcggcgccctggtgaacttcctggacatcgcccccagatacaccggcttcctgaagggcctgctgcaggtgttcgcccacatcgccggcgccatcagccccaccgccgccggcttcttcatcagccaggacagcgagttcggctggagaaacgtgttcctgctgagcgccgccgtgaacatcagcggcctggtgttctacctgatcttcggcagagccgacgtgcaggactgggccaaggagcagaccttcacccacctgtag

SEQ ID NO: 99478 - DNA, 666 bp, Artificial Sequence
  Description of Artificial Sequence: Synthetic coding sequence
atgaacctgagcatcgccatccccgccatggtgaacaacaccgccccccccagccagcccaacgccagcaccgagagacccagcaccgacagccagggctactggaacgagaccctgaaggagttcaaggccatggactgcagccccggctggagcctgcccatcagagccatgatcaagagcctgcccctgtgggccatcctggtgagctacttctgcgagtactggctgttctacaccatcatggcctacacccccacctacatcagcagcgtgctgcaggccaacctgagagacagcggcatcctgagcgccctgcccttcgtggtgggctgcatctgcatcatcctgggcggcctgctggccgacttcctgctgagcagaaagatcctgagactgatcaccatcagaaagctgttcaccgccatcggcaagggcgagaccggccacagaggcgagagaggcaagctgagagccgccttcagcctgctgtgcgtgtgcccccccacccccggcgtgctgttccccagcgtgatcctggtgagcctgccctgggtgagaagcagccacagcatgaccatgaccttcctggtgctgagcagcgccatcagcagcttctgcgagagcggcgccctggtgaacttcctggacatcgcccccagatag

SEQ ID NO: 99479 - DNA, 804 bp, Artificial Sequence
  Description of Artificial Sequence: Synthetic coding sequence
atgagcaccggccccgacgtgaaggccaccgtgggcgacatcagcagcgacggcaacctgaacgtggcccaggaggagtgcagcagaaagggcttctgcagcgtgagacacggcctggccctgatcctgcagctgtgcaacttcagcatctacacccagcagatgaacctgagcatcgccatccccgccatggtgaacaacaccgccccccccagccagcccaacgccagcaccgagagacccagcaccgacagccagggctactggaacgagaccctgaaggagttcaaggccatgagcggcatcctgagcgccctgcccttcgtggtgggctgcatctgcatcatcctgggcggcctgctggccgacttcctgctgagcagaaagatcctgagactgatcaccatcagaaagctgttcaccgccatcggcgtgctgttccccagcgtgatcctggtgagcctgccctgggtgagaagcagccacagcatgaccatgaccttcctggtgctgagcagcgccatcagcagcttctgcgagagcggcgccctggtgaacttcctggacatcgcccccagatacaccggcttcctgaagggcctgctgcaggtgttcgcccacatcgccggcgccatcagccccaccgccgccggcttcttcatcagccaggacagcgagttcggctggagaaacgtgttcctgctgagcgccgccgtgaacatcagcggcctggtgttctacctgatcttcggcagagccgacgtgcaggactgggccaaggagcagaccttcacccacctgtag

SEQ ID NO: 99480 - DNA, 1749 bp, Artificial Sequence
  Description of Artificial Sequence: Synthetic coding sequence
atggagagcgtgaagcagagaatcctggcccccggcaaggagggcctgaagaacttcgccggcaagagcctgggccagatctacagagtgctggagaagaagcaggacaccggcgagaccatcgagctgaccgaggacggcaagcccctggaggtgcccgagagaaaggcccccctgtgcgactgcacctgcttcggcctgcccagaagatacatcatcgccatcatgagcggcctgggcttctgcatcagcttcggcatcagatgcaacctgggcgtggccatcgtggacatggtgaacaacagcaccatccacagaggcggcaaggtgatcaaggagaaggccaagttcaactgggaccccgagaccgtgggcatgatccacggcagcttcttctggggctacatcatcacccagatccccggcggctacatcgccagcagactggccgccaacagagtgttcggcgccgccatcctgctgaccagcaccctgaacatgctgatccccagcgccgccagagtgcactacggctgcgtgatcttcgtgagaatcctgcagggcctggtggagggcgtgacctaccccgcctgccacggcatctggagcaagtgggccccccccctggagagaagcagactggccaccaccagcttctgcggcagctacgccggcgccgtgatcgccatgcccctggccggcatcctggtgcagtacaccggctggagcagcgtgttctacgtgtacggcagcttcggcatggtgtggtacatgttctggctgctggtgagctacgagagccccgccaagcaccccaccatcaccgacgaggagagaagatacatcgaggagagcatcggcgagagcgccaacctgctgggcgccatggagaagttcaagaccccctggagaaagttcttcaccagcatgcccgtgtacgccatcatcgtggccaacttctgcagaagctggaccttctacctgctgctgatcagccagcccgcctacttcgaggaggtgttcggcttcgagatcagcaaggtgggcatgctgagcgccgtgccccacctggtgatgaccatcatcgtgcccatcggcggccagatcgccgacttcctgagaagcaagcagatcctgagcaccaccaccgtgagaaagatcatgaactgcggcggcttcggcatggaggccaccctgctgctggtggtgggctacagccacaccagaggcgtggccatcagcttcctggtgctggccgtgggcttcagcggcttcgccatcagcggcttcaacgtgaaccacctggacatcgcccccagatacgccagcatcctgatgggcatcagcaacggcgtgggcaccctgagcggcatggtgtgccccatcatcgtgggcgccatgaccaagaacaagagcagagaggagtggcagtacgtgttcctgatcgccgccctggtgcactacggcggcgtgatcttctacgccatcttcgccagcggcgagaagcagccctgggccgaccccgaggagaccagcgaggagaagtgcggcttcatccacgaggacgagctggacgaggagaccggcgacatcacccagaactacatcaactacggcaccaccaagagctacggcgccaccacccaggccaacggcggctggcccagcggctgggagaagaaggaggagttcgtgcagggcgaggtgcaggacagccacagctacaaggacagagtggactacagctag

SEQ ID NO: 99481 - DNA, 1413 bp, Artificial Sequence
  Description of Artificial Sequence: Synthetic coding sequence
atgaaggccaagttcaactgggaccccgagaccgtgggcatgatccacggcagcttcttctggggctacatcatcacccagatccccggcggctacatcgccagcagactggccgccaacagagtgttcggcgccgccatcctgctgaccagcaccctgaacatgctgatccccagcgccgccagagtgcactacggctgcgtgatcttcgtgagaatcctgcagggcctggtggagggcgtgacctaccccgcctgccacggcatctggagcaagtgggccccccccctggagagaagcagactggccaccaccagcttctgcggcagctacgccggcgccgtgatcgccatgcccctggccggcatcctggtgcagtacaccggctggagcagcgtgttctacgtgtacggcagcttcggcatggtgtggtacatgttctggctgctggtgagctacgagagccccgccaagcaccccaccatcaccgacgaggagagaagatacatcgaggagagcatcggcgagagcgccaacctgctgggcgccatggagaagttcaagaccccctggagaaagttcttcaccagcatgcccgtgtacgccatcatcgtggccaacttctgcagaagctggaccttctacctgctgctgatcagccagcccgcctacttcgaggaggtgttcggcttcgagatcagcaaggtgggcatgctgagcgccgtgccccacctggtgatgaccatcatcgtgcccatcggcggccagatcgccgacttcctgagaagcaagcagatcctgagcaccaccaccgtgagaaagatcatgaactgcggcggcttcggcatggaggccaccctgctgctggtggtgggctacagccacaccagaggcgtggccatcagcttcctggtgctggccgtgggcttcagcggcttcgccatcagcggcttcaacgtgaaccacctggacatcgcccccagatacgccagcatcctgatgggcatcagcaacggcgtgggcaccctgagcggcatggtgtgccccatcatcgtgggcgccatgaccaagaacaagagcagagaggagtggcagtacgtgttcctgatcgccgccctggtgcactacggcggcgtgatcttctacgccatcttcgccagcggcgagaagcagccctgggccgaccccgaggagaccagcgaggagaagtgcggcttcatccacgaggacgagctggacgaggagaccggcgacatcacccagaactacatcaactacggcaccaccaagagctacggcgccaccacccaggccaacggcggctggcccagcggctgggagaagaaggaggagttcgtgcagggcgaggtgcaggacagccacagctacaaggacagagtggactacagctag

SEQ ID NO: 99482 - DNA, 5223 bp, Artificial Sequence
  Description of Artificial Sequence: Synthetic coding sequence
atgggcgagaagctggagctgagactgaagagccccgtgggcgccgagcccgccgtgtacccctggcccctgcccgtgtacgacaagcaccacgacgccgcccacgagatcatcgagaccatcagatgggtgtgcgaggagatccccgacctgaagctggccatggagaactacgtgctgatcgactacgacaccaagagcttcgagagcatgcagagactgtgcgacaagtacaacagagccatcgacagcatccaccagctgtggaagggcaccacccagcccatgaagctgaacaccagacccagcaccggcctgctgagacacatcctgcagcaggtgtacaaccacagcgtgaccgaccccgagaagctgaacaactacgagcccttcagccccgaggtgtacggcgagaccagcttcgacctggtggcccagatgatcgacgagatcaagatgaccgacgacgacctgttcgtggacctgggcagcggcgtgggccaggtggtgctgcaggtggccgccgccaccaactgcaagcaccactacggcgtggagaaggccgacatccccgccaagtacgccgagaccatggacagagagttcagaaagtggatgaagtggtacggcaagaagcacgccgagtacaccctggagagaggcgacttcctgagcgaggagtggagagagagaatcgccaacaccagcgtgatcttcgtgaacaacttcgccttcggccccgaggtggaccaccagctgaaggagagattcgccaacatgaaggagggcggcagaatcgtgagcagcaagcccttcgcccccctgaacttcagaatcaacagcagaaacctgagcgacatcggcaccatcatgagagtggtggagctgagccccctgaagggcagcgtgagctggaccggcaagcccgtgagctactacctgcacaccatcgacagaaccatcctggagaactacttcagcagcctgaagaaccccaagctgagagaggagcaggaggccgccagaagaagacagcagagagagagcaagagcaacgccgccacccccaccaagggccccgagggcaaggtggccggccccgccgacgcccccatggacagcggcgccgaggaggagaaggccggcgccgccaccgtgaagaagcccagccccagcaaggccagaaagaagaagctgaacaagaagggcagaaagatggccggcagaaagagaggcagacccaagaagatgaacaccgccaaccccgagagaaagcccaagaagaaccagaccgccctggacgccctgcacgcccagaccgtgagccagaccgccgccagcagcccccaggacgcctacagaagcccccacagccccttctaccagctgccccccagcgtgcagagacacagccccaaccccctgctggtggcccccaccccccccgccctgcagaagctgctggagagcttcaagatccagtacctgcagttcctggcctacaccaagaccccccagtacaaggccagcctgcaggagctgctgggccaggagaaggagaagaacgcccagctgctgggcgccgcccagcagctgctgagccactgccaggcccagaaggaggagatcagaagactgttccagcagaagctggacgagctgggcgtgaaggccctgacctacaacgacctgatccaggcccagaaggagatcagcgcccacaaccagcagctgagagagcagagcgagcagctggagcaggacaacagagccctgagaggccagagcctgcagctgctgaaggccagatgcgaggagctgcagctggactgggccaccctgagcctggagaagctgctgaaggagaagcaggccctgaagagccagatcagcgagaagcagagacactgcctggagctgcagatcagcatcgtggagctggagaagagccagagacagcaggagctgctgcagctgaagagctgcgtgccccccgacgacgccctgagcctgcacctgagaggcaagggcgccctgggcagagagctggagcccgacgccagcagactgcacctggagctggactgcaccaagttcagcctgccccacctgagcagcatgagccccgagctgagcatgaacggccaggccgccggctacgagctgtgcggcgtgctgagcagacccagcagcaagcagaacaccccccagtacctggccagccccctggaccaggaggtggtgccctgcacccccagccacgtgggcagacccagactggagaagctgagcggcctggccgcccccgactacaccagactgagccccgccaagatcgtgctgagaagacacctgagccaggaccacaccgtgcccggcagacccgccgccagcgagctgcacagcagagccgagcacaccaaggagaacggcctgccctaccagagccccagcgtgcccggcagcatgaagctgagcccccaggaccccagacccctgagccccggcgccctgcagctggccggcgagaagagcagcgagaagggcctgagagagagagcctacggcagcagcggcgagctgatcaccagcctgcccatcagcatccccctgagcaccgtgcagcccaacaagctgcccgtgagcatccccctggccagcgtggtgctgcccagcagagccgagagagccagaagcacccccagccccgtgctgcagcccagagaccccagcagcaccctggagaagcagatcggcgccaacgcccacggcgccggcagcagaagcctggccctggcccccgccggcttcagctacgccggcagcgtggccatcagcggcgccctggccggcagccccgccagcctgacccccggcgccgagcccgccaccctggacgagagcagcagcagcggcagcctgttcgccaccgtgggcagcagaagcagcaccccccagcaccccctgctgctggcccagcccagaaacagcctgcccgccagccccgcccaccagctgagcagcagccccagactgggcggcgccgcccagggccccctgcccgaggccagcaagggcgacctgcccagcgacagcggcttcagcgaccccgagagcgaggccaagagaagaatcgtgttcaccatcaccaccggcgccggcagcgccaagcagagccccagcagcaagcacagccccctgaccgccagcgccagaggcgactgcgtgcccagccacggccaggacagcagaagaagaggcagaagaaagagagccagcgccggcacccccagcctgagcgccggcgtgagccccaagagaagagccctgcccagcgtggccggcctgttcacccagcccagcggcagccccctgaacctgaacagcatggtgagcaacatcaaccagcccctggagatcaccgccatcagcagccccgagaccagcctgaagagcagccccgtgccctaccaggaccacgaccagccccccgtgctgaagaaggagagacccctgagccagaccaacggcgcccactacagccccctgaccagcgacgaggagcccggcagcgaggacgagcccagcagcgccagaatcgagagaaagatcgccaccatcagcctggagagcaagagcccccccaagaccctggagaacggcggcggcctggccggcagaaagcccgcccccgccggcgagcccgtgaacagcagcaagtggaagagcaccttcagccccatcagcgacatcggcctggccaagagcgccgacagccccctgcaggccagcagcgccctgagccagaacagcctgttcaccttcagacccgccctggaggagcccagcgccgacgccaagctggccgcccaccccagaaagggcttccccggcagcctgagcggcgccgacggcctgagccccggcaccaaccccgccaacggctgcaccttcggcggcggcctggccgccgacctgagcctgcacagcttcagcgacggcgccagcctgccccacaagggccccgaggccgccggcctgagcagccccctgagcttccccagccagagaggcaaggagggcagcgacgccaaccccttcctgagcaagagacagctggacggcctggccggcctgaagggcgagggcagcagaggcaaggaggccggcgagggcggcctgcccctgtgcggccccaccgacaagacccccctgctgagcggcaaggccgccaaggccagagacagagaggtggacctgaagaacggccacaacctgttcatcagcgccgccgccgtgccccccggcagcctgctgagcggccccggcctggcccccgccgccagcagcgccggcggcgccgccagcagcgcccagacccacagaagcttcctgggccccttcccccccggcccccagttcgccctgggccccatgagcctgcaggccaacctgggcagcgtggccggcagcagcgtgctgcagagcctgttcagcagcgtgcccgccgccgccggcctggtgcacgtgagcagcgccgccaccagactgaccaacagccacgccatgggcagcttcagcggcgtggccggcggcaccgtgggcgccggcggcgtgttcaaccacgccgtgcccagcgccagcgcccaccccttcggcgccagagtgggcagaggcgccgcctgcggcagcgccaccctgggccccagccccctgcaggccgccgccagcgccagcgccagcagcttccaggcccccgccagcgtggagaccagacccccccccccccccccccccccccccccccccctgcccccccccgcccacctgggcagaagccccgccggcccccccgtgctgcacgccccccccccccccaacgccgccctgccccccccccccaccctgctggccagcaaccccgagcccgccctgctgcagagcctggccagcctgccccccaaccaggccttcctgccccccaccagcgccgccagcctgccccccgccaacgccagcctgagcatcaagctgaccagcctgccccacaagggcgccagacccagcttcaccgtgcaccaccagcccctgcccagactggccctggcccaggccgcccccggcatcccccaggccagcgccaccggccccagcgccgtgtgggtgagcctgggcatgccccccccctacgccgcccacctgagcggcgtgaagcccagatag

SEQ ID NO: 99483 - DNA, 1647 bp, Artificial Sequence
  Description of Artificial Sequence: Synthetic coding sequence
atgggcagccagctggccctggccggcctgctggagaagagacaggagggcgccgagaccctggagctgagcgccgacggcagacccgtgaccacccagaccagagacccccccgtggtggactgcacctgcttcggcctgcccagaagatacatcatcgccatcatgagcggcctgggcttctgcatcagcttcggcatcagatgcaacctgggcgtggccatcgtgagcatggtgaacaacagcaccacccacagaggcggccacgtggtggtgcagaaggcccagttcagctgggaccccgagaccgtgggcctgatccacggcagcttcttctggggctacatcgtgacccagatccccggcggcttcatctgccagaagttcgccgccaacagagtgttcggcttcgccatcgtggccaccagcaccctgaacatgctgatccccagcgccgccagagtgcactacggctgcgtgatcttcgtgagaatcctgcagggcctggtggagggcgtgacctaccccgcctgccacggcatctggagcaagtgggccccccccctggagagaagcagactggccaccaccgccttctgcggcagctacgccggcgccgtggtggccatgcccctggccggcgtgctggtgcagtacagcggctggagcagcgtgttctacgtgtacggcagcttcggcatcttctggtacctgttctggctgctggtgagctacgagagccccgccctgcaccccagcatcagcgaggaggagagaaagtacatcgaggacgccatcggcgagagcgccaagctgatgaaccccctgaccaagttcagcaccccctggagaagattcttcaccagcatgcccgtgtacgccatcatcgtggccaacttctgcagaagctggaccttctacctgctgctgatcagccagcccgcctacttcgaggaggtgttcggcttcgagatcagcaaggtgggcctggtgagcgccctgccccacctggtgatgaccatcatcgtgcccatcggcggccagatcgccgacttcctgagaagcagaagaatcatgagcaccaccaacgtgagaaagctgatgaactgcggcggcttcggcatggaggccaccctgctgctggtggtgggctacagccacagcaagggcgtggccatcagcttcctggtgctggccgtgggcttcagcggcttcgccatcagcggcttcaacgtgaaccacctggacatcgcccccagatacgccagcatcctgatgggcatcagcaacggcgtgggcaccctgagcggcatggtgtgccccatcatcgtgggcgccatgaccaagcacaagaccagagaggagtggcagtacgtgttcctgatcgccagcctggtgcactacggcggcgtgatcttctacggcgtgttcgccagcggcgagaagcagccctgggccgagcccgaggagatgagcgaggagaagtgcggcttcgtgggccacgaccagctggccggcagcgacgacagcgagatggaggacgaggccgagccccccggcgccccccccgcccccccccccagctacggcgccacccacagcaccttccagccccccagaccccccccccccgtgagagactactag

SEQ ID NO: 99484 - DNA, 1770 bp, Artificial Sequence
  Description of Artificial Sequence: Synthetic coding sequence
atgcccttcaaggccttcgacaccttcaaggagaagatcctgaagcccggcaaggagggcgtgaagaacgccgtgggcgacagcctgggcatcctgcagagaaagatcgacggcaccaccgaggaggaggacaacatcgagctgaacgaggagggcagacccgtgcagaccagcagacccagcccccccctgtgcgactgccactgctgcggcctgcccaagagatacatcatcgccatcatgagcggcctgggcttctgcatcagcttcggcatcagatgcaacctgggcgtggccatcgtggagatggtgaacaacagcaccgtgtacgtggacggcaagcccgagatccagaccgcccagttcaactgggaccccgagaccgtgggcctgatccacggcagcttcttctggggctacatcatgacccagatccccggcggcttcatcagcaacaagttcgccgccaacagagtgttcggcgccgccatcttcctgaccagcaccctgaacatgttcatccccagcgccgccagagtgcactacggctgcgtgatgtgcgtgagaatcctgcagggcctggtggagggcgtgacctaccccgcctgccacggcatgtggagcaagtgggccccccccctggagagaagcagactggccaccaccagcttctgcggcagctacgccggcgccgtggtggccatgcccctggccggcgtgctggtgcagtacatcggctggagcagcgtgttctacatctacggcatgttcggcatcatctggtacatgttctggctgctgcaggcctacgagtgccccgccgcccaccccaccatcagcaacgaggagaagacctacatcgagaccagcatcggcgagggcgccaacgtggtgagcctgagcaagttcagcaccccctggaagagattcttcaccagcctgcccgtgtacgccatcatcgtggccaacttctgcagaagctggaccttctacctgctgctgatcagccagcccgcctacttcgaggaggtgttcggcttcgccatcagcaaggtgggcctgctgagcgccgtgccccacatggtgatgaccatcgtggtgcccatcggcggccagctggccgactacctgagaagcagacagatcctgaccaccaccgccgtgagaaagatcatgaactgcggcggcttcggcatggaggccaccctgctgctggtggtgggcttcagccacaccaagggcgtggccatcagcttcctggtgctggccgtgggcttcagcggcttcgccatcagcggcttcaacgtgaaccacctggacatcgcccccagatacgccagcatcctgatgggcatcagcaacggcgtgggcaccctgagcggcatggtgtgccccctgatcgtgggcgccatgaccagacacaagaccagagaggagtggcagaacgtgttcctgatcgccgccctggtgcactacagcggcgtgatcttctacggcgtgttcgccagcggcgagaagcaggagtgggccgaccccgagaacctgagcgaggagaagtgcggcatcatcgaccaggacgagctggccgaggagatcgagctgaaccacgagagcttcgccagccccaagaagaagatgagctacggcgccaccagccagaactgcgaggtgcagaagaaggagtggaagggccagagaggcgccaccctggacgaggaggagctgaccagctaccagaacgaggagagaaacttcagcaccatcagctag

SEQ ID NO: 99485 - DNA, 1620 bp, Artificial Sequence
  Description of Artificial Sequence: Synthetic coding sequence
atgcccttcaaggccttcgacaccttcaaggagaagatcctgaagcccggcaaggagggcgtgaagaacgccgtgggcgacagcctgggcatcctgcagagaaagatcgacggcaccaccgaggaggaggacaacatcgagctgaacgaggagggcagacccgtgcagaccagcagacccagcccccccctgtgcgactgccactgctgcggcctgcccaagagatacatcatcgccatcatgagcggcctgggcttctgcatcagcttcggcatcagatgcaacctgggcgtggccatcgtggagatggtgaacaacagcaccgtgtacgtggacggcaagcccgagatccagaccgcccagttcaactgggaccccgagaccgtgggcctgatccacggcagcttcttctggggctacatcatgacccagatccccggcggcttcatcagcaacaagttcgccgccaacagagtgttcggcgccgccatcttcctgaccagcaccctgaacatgttcatccccagcgccgccagagtgcactacggctgcgtgatgtgcgtgagaatcctgcagggcctggtggagggcgtgacctaccccgcctgccacggcatgtggagcaagtgggccccccccctggagagaagcagactggccaccaccagcttctgcggcagctacgccggcgccgtggtggccatgcccctggccggcgtgctggtgcagtacatcggctggagcagcgtgttctacatctacggcatgttcggcatcatctggtacatgttctggctgctgcaggcctacgagtgccccgccgcccaccccaccatcagcaacgaggagaagacctacatcgagaccagcatcggcgagggcgccaacgtggtgagcctgagcgtgggcctgctgagcgccgtgccccacatggtgatgaccatcgtggtgcccatcggcggccagctggccgactacctgagaagcagacagatcctgaccaccaccgccgtgagaaagatcatgaactgcggcggcttcggcatggaggccaccctgctgctggtggtgggcttcagccacaccaagggcgtggccatcagcttcctggtgctggccgtgggcttcagcggcttcgccatcagcggcttcaacgtgaaccacctggacatcgcccccagatacgccagcatcctgatgggcatcagcaacggcgtgggcaccctgagcggcatggtgtgccccctgatcgtgggcgccatgaccagacacaagaccagagaggagtggcagaacgtgttcctgatcgccgccctggtgcactacagcggcgtgatcttctacggcgtgttcgccagcggcgagaagcaggagtgggccgaccccgagaacctgagcgaggagaagtgcggcatcatcgaccaggacgagctggccgaggagatcgagctgaaccacgagagcttcgccagccccaagaagaagatgagctacggcgccaccagccagaactgcgaggtgcagaagaaggagtggaagggccagagaggcgccaccctggacgaggaggagctgaccagctaccagaacgaggagagaaacttcagcaccatcagctag

SEQ ID NO: 99486 - DNA, 1293 bp, Artificial Sequence
  Description of Artificial Sequence: Synthetic coding sequence
atgaccctgaccagcagaagacaggacagccaggaggccagacccgagtgccaggcctggaccggcaccctgctgctgggcacctgcctgctgtactgcgccagaagcagcatgcccatctgcaccgtgagcatgagccaggacttcggctggaacaagaaggaggccggcatcgtgctgagcagcttcttctggggctactgcctgacccaggtggtgggcggccacctgggcgacagaatcggcggcgagaaggtgatcctgctgagcgccagcgcctggggcagcatcaccgccgtgacccccctgctggcccacctgagcagcgcccacctggccttcatgaccttcagcagaatcctgatgggcctgctgcagggcgtgtacttccccgccctgaccagcctgctgagccagaaggtgagagagagcgagagagccttcacctacagcatcgtgggcgccggcagccagttcggcaccctgctgaccggcgccgtgggcagcctgctgctggagtggtacggctggcagagcatcttctacttcagcggcggcctgaccctgctgtgggtgtggtacgtgtacagatacctgctgagcgagaaggacctgatcctggccctgggcgtgctggcccagagcagacccgtgagcagacacaacagagtgccctggagaagactgttcagaaagcccgccgtgtgggccgccgtggtgagccagctgagcgccgcctgcagcttcttcatcctgctgagctggctgcccaccttcttcgaggagaccttccccgacgccaagggctggatcttcaacgtggtgccctggctggtggccatccccgccagcctgttcagcggcttcctgagcgaccacctgatcaaccagggctacagagccatcaccgtgagaaagctgatgcagggcatgggcctgggcctgagcagcgtgttcgccctgtgcctgggccacaccagcagcttctgcgagagcgtggtgttcgccagcgccagcatcggcctgcagaccttcaaccacagcggcatcagcgtgaacatccaggacctggcccccagctgcgccggcttcctgttcggcgtggccaacaccgccggcgccctggccggcgtggtgggcgtgtgcctgggcggctacctgatggagaccaccggcagctggacctgcctgttcaacctggtggccatcatcagcaacctgggcctgtgcaccttcctggtgttcggccaggcccagagagtggacctgagcagcacccacgaggacctgtag

SEQ ID NO: 99487 - DNA, 1311 bp, Artificial Sequence
  Description of Artificial Sequence: Synthetic coding sequence
atgcagcccccccccgacgaggccagaagagacatggccggcgacacccagtggagcagacccgagtgccaggcctggaccggcaccctgctgctgggcacctgcctgctgtactgcgccagaagcagcatgcccatctgcaccgtgagcatgagccaggacttcggctggaacaagaaggaggccggcatcgtgctgagcagcttcttctggggctactgcctgacccaggtggtgggcggccacctgggcgacagaatcggcggcgagaaggtgatcctgctgagcgccagcgcctggggcagcatcaccgccgtgacccccctgctggcccacctgagcagcgcccacctggccttcatgaccttcagcagaatcctgatgggcctgctgcagggcgtgtacttccccgccctgaccagcctgctgagccagaaggtgagagagagcgagagagccttcacctacagcatcgtgggcgccggcagccagttcggcaccctgctgaccggcgccgtgggcagcctgctgctggagtggtacggctggcagagcatcttctacttcagcggcggcctgaccctgctgtgggtgtggtacgtgtacagatacctgctgagcgagaaggacctgatcctggccctgggcgtgctggcccagagcagacccgtgagcagacacaacagagtgccctggagaagactgttcagaaagcccgccgtgtgggccgccgtggtgagccagctgagcgccgcctgcagcttcttcatcctgctgagctggctgcccaccttcttcgaggagaccttccccgacgccaagggctggatcttcaacgtggtgccctggctggtggccatccccgccagcctgttcagcggcttcctgagcgaccacctgatcaaccagggctacagagccatcaccgtgagaaagctgatgcagggcatgggcctgggcctgagcagcgtgttcgccctgtgcctgggccacaccagcagcttctgcgagagcgtggtgttcgccagcgccagcatcggcctgcagaccttcaaccacagcggcatcagcgtgaacatccaggacctggcccccagctgcgccggcttcctgttcggcgtggccaacaccgccggcgccctggccggcgtggtgggcgtgtgcctgggcggctacctgatggagaccaccggcagctggacctgcctgttcaacctggtggccatcatcagcaacctgggcctgtgcaccttcctggtgttcggccaggcccagagagtggacctgagcagcacccacgaggacctgtag

SEQ ID NO: 99488 - DNA, 459 bp, Artificial Sequence
  Description of Artificial Sequence: Synthetic coding sequence
atgttccccagacccggcgccctgagctggaccgtgagaagacacacccccagacaggtggagcccccctgcgtgtgcatgaccctgaccagcagaagacaggacagccaggaggccagacccgagtgccaggcctggaccggcaccctgctgctgggcacctgcctgctgtactgcgccagaagcagcatgcccatctgcaccgtgagcatgagccaggacttcggctggaacaagaaggaggccggcatcgtgctgagcagcttcttctggggctactgcctgacccaggtggtgggcggccacctgggcgacagaatcggcggcgagaaggtgatcctgctgagcgccagcgcctggggcagcatcaccgccgtgacccccctgctggcccacctgagcagcgcccacctggccttcatgaccttcagcagaatcctgatgggcctgctgcagtag

SEQ ID NO: 99489 - DNA, 1599 bp, Artificial Sequence
  Description of Artificial Sequence: Synthetic coding sequence
atggagagcgccgagcccgccggccaggccagagccgccgccaccaagctgagcgaggccgtgggcgccgccctgcaggagcccagaagacagagaagactggtgctggtgatcgtgtgcgtggccctgctgctggacaacatgctgtacatggtgatcgtgcccatcgtgcccgactacatcgcccacatgagaggcggcggcgagggccccaccagaacccccgaggtgtgggagcccaccctgcccctgcccacccccgccaacgccagcgcctacaccgccaacaccagcgccagccccaccgccgcctggcccgccggcagcgccctgagacccagataccccaccgagagcgaggacgtgaagatcggcgtgctgttcgccagcaaggccatcctgcagctgctggtgaaccccctgagcggccccttcatcgacagaatgagctacgacgtgcccctgctgatcggcctgggcgtgatgttcgccagcaccgtgctgttcgccttcgccgaggactacgccaccctgttcgccgccagaagcctgcagggcctgggcagcgccttcgccgacaccagcggcatcgccatgatcgccgacaagtaccccgaggagcccgagagaagcagagccctgggcgtggccctggccttcatcagcttcggcagcctggtggccccccccttcggcggcatcctgtacgagttcgccggcaagagagtgcccttcctggtgctggccgccgtgagcctgttcgacgccctgctgctgctggccgtggccaagcccttcagcgccgccgccagagccagagccaacctgcccgtgggcacccccatccacagactgatgctggacccctacatcgccgtggtggccggcgccctgaccacctgcaacatccccctggccttcctggagcccaccatcgccacctggatgaagcacaccatggccgccagcgagtgggagatgggcatggcctggctgcccgccttcgtgccccacgtgctgggcgtgtacctgaccgtgagactggccgccagatacccccacctgcagtggctgtacggcgccctgggcctggccgtgatcggcgccagcagctgcatcgtgcccgcctgcagaagcttcgcccccctggtggtgagcctgtgcggcctgtgcttcggcatcgccctggtggacaccgccctgctgcccaccctggccttcctggtggacgtgagacacgtgagcgtgtacggcagcgtgtacgccatcgccgacatcagctacagcgtggcctacgccctgggccccatcgtggccggccacatcgtgcacagcctgggcttcgagcagctgagcctgggcatgggcctggccaacctgctgtacgcccccgtgctgctgctgctgagaaacgtgggcctgctgaccagaagcagaagcgagagagacgtgctgctggacgagcccccccagggcctgtacgacgccgtgagactgagagagagacccgtgagcggccaggacggcgagcccagaagcccccccggccccttcgacgcctgcgaggacgactacaactactactacaccagaagctag

SEQ ID NO: 99490 - DNA, 1482 bp, Artificial Sequence
  Description of Artificial Sequence: Synthetic coding sequence
atgctgagaaccatcctggacgccccccagagactgctgaaggagggcagagccagcagacagctggtgctggtggtggtgttcgtggccctgctgctggacaacatgctgttcaccgtggtggtgcccatcgtgcccaccttcctgtacgacatggagttcaaggaggtgaacagcagcctgcacctgggccacgccggcagcagcccccacgccctggccagccccgccttcagcaccatcttcagcttcttcaacaacaacaccgtggccgtggaggagagcgtgcccagcggcatcgcctggatgaacgacaccgccagcaccatccccccccccgccaccgaggccatcagcgcccacaagaacaactgcctgcagggcaccggcttcctggaggaggagatcaccagagtgggcgtgctgttcgccagcaaggccgtgatgcagctgctggtgaaccccttcgtgggccccctgaccaacagaatcggctaccacatccccatgttcgccggcttcgtgatcatgttcctgagcaccgtgatgttcgccttcagcggcacctacaccctgctgttcgtggccagaaccctgcagggcatcggcagcagcttcagcagcgtggccggcctgggcatgctggccagcgtgtacaccgacgaccacgagagaggcagagccatgggcaccgccctgggcggcctggccctgggcctgctggtgggcgcccccttcggcagcgtgatgtacgagttcgtgggcaagagcgcccccttcctgatcctggccttcctggccctgctggacggcgccctgcagctgtgcatcctgcagcccagcaaggtgagccccgagagcgccaagggcacccccctgttcatgctgctgaaggacccctacatcctggtggccgccggcctggccttcctgcccgccagcgtgagctacctgatcggcaccaacctgttcggcgtgctggccaacaagatgggcagatggctgtgcagcctgatcggcatgctggtggtgggcaccagcctgctgtgcgtgcccctggcccacaacatcttcggcctgatcggccccaacgccggcctgggcctggccatcggcatggtggacagcagcatgatgcccatcatgggccacctggtggacctgagacacaccagcgtgtacggcagcgtgtacgccatcgccgacgtggccttctgcatgggcttcgccatcggccccagcaccggcggcgccatcgtgaaggccatcggcttcccctggctgatggtgatcaccggcgtgatcaacatcgtgtacgcccccctgtgctactacctgagaagcccccccgccaaggaggagaagctggccatcctgagccaggactgccccatggagaccagaatgtacgccacccagaagcccaccaaggagttccccctgggcgaggacagcgacgaggagcccgaccacgaggagtag

SEQ ID NO: 99491 - DNA, 1578 bp, Artificial Sequence
  Description of Artificial Sequence: Synthetic coding sequence
atgctgagaaccatcctggacgccccccagagactgctgaaggagggcagagccagcagacagctggtgctggtggtggtgttcgtggccctgctgctggacaacatgctgttcaccgtggtggtgcccatcgtgcccaccttcctgtacgacatggagttcaaggaggtgaacagcagcctgcacctgggccacgccggcagcagcccccacgccctggccagccccgccttcagcaccatcttcagcttcttcaacaacaacaccgtggccgtggaggagagcgtgcccagcggcatcgcctggatgaacgacaccgccagcaccatccccccccccgccaccgaggccatcagcgcccacaagaacaactgcctgcagggcaccggcttcctggaggaggagatcaccagagtgggcgtgctgttcgccagcaaggccgtgatgcagctgctggtgaaccccttcgtgggccccctgaccaacagaatcggctaccacatccccatgttcgccggcttcgtgatcatgttcctgagcaccgtgatgttcgccttcagcggcacctacaccctgctgttcgtggccagaaccctgcagggcatcggcagcagcttcagcagcgtggccggcctgggcatgctggccagcgtgtacaccgacgaccacgagagaggcagagccatgggcaccgccctgggcggcctggccctgggcctgctggtgggcgcccccttcggcagcgtgatgtacgagttcgtgggcaagagcgcccccttcctgatcctggccttcctggccctgctggacggcgccctgcagctgtgcatcctgcagcccagcaaggtgagccccgagagcgccaagggcacccccctgttcatgctgctgaaggacccctacatcctggtggccgccggcagcatctgcttcgccaacatgggcgtggccatcctggagcccaccctgcccatctggatgatgcagaccatgtgcagccccaagtggcagctgggcctggccttcctgcccgccagcgtgagctacctgatcggcaccaacctgttcggcgtgctggccaacaagatgggcagatggctgtgcagcctgatcggcatgctggtggtgggcaccagcctgctgtgcgtgcccctggcccacaacatcttcggcctgatcggccccaacgccggcctgggcctggccatcggcatggtggacagcagcatgatgcccatcatgggccacctggtggacctgagacacaccagcgtgtacggcagcgtgtacgccatcgccgacgtggccttctgcatgggcttcgccatcggccccagcaccggcggcgccatcgtgaaggccatcggcttcccctggctgatggtgatcaccggcgtgatcaacatcgtgtacgcccccctgtgctactacctgagaagcccccccgccaaggaggagaagctggccatcctgagccaggactgccccatggagaccagaatgtacgccacccagaagcccaccaaggagttccccctgggcgaggacagcgacgaggagcccgaccacgaggagtag

SEQ ID NO: 99492 - DNA, 1419 bp, Artificial Sequence
  Description of Artificial Sequence: Synthetic coding sequence
atgctgagaaccatcctggacgccccccagagactgctgaaggagggcagagccagcagacagctggtgctggtggtggtgttcgtggccctgctgctggacaacatgctgttcaccgtggtggtgcccatcgtgcccaccttcctgtacgacatggagttcaaggaggtgaacagcagcctgcacctgggccacgccggcagcagcccccacgccctggccagccccgccttcagcaccatcttcagcttcttcaacaacaacaccgtggccgtggaggagagcgtgcccagcggcatcgcctggatgaacgacaccgccagcaccatccccccccccgccaccgaggccatcagcgcccacaagaacaactgcctgcagggcaccggcttcctggaggaggagatcaccagagtgggcgtgctgttcgccagcaaggccgtgatgcagctgctggtgaaccccttcgtgggccccctgaccaacagaatcggctaccacatccccatgttcgccggcttcgtgatcatgttcctgagcaccgtgatgttcgccttcagcggcacctacaccctgctgttcgtggccagaaccctgcagggcatcggcagcagcttcagcagcgtggccggcctgggcatgctggccagcgtgtacaccgacgaccacgagagaggcagagccatgggcaccgccctgggcggcctggccctgggcctgctggtgggcgcccccttcggcagcgtgatgtacgagttcgtgggcaagagcgcccccttcctgatcctggccttcctggccctgctggacggcgccctgcagctgtgcatcctgcagcccagcaaggtgagccccgagagcgccaagggcacccccctgttcatgctgctgaaggacccctacatcctggtggccgccggcagcatctgcttcgccaacatgggcgtggccatcctggagcccaccctgcccatctggatgatgcagaccatgtgcagccccaagtggcagctgggcctggccttcctgcccgccagcgtgagctacctgatcggcaccaacctgttcggcgtgctggccaacaagatgggcagatggctgtgcagcctgatcggcatgctggtggtgggcaccagcctgctgtgcgtgcccctggcccacaacatcttcggcctgatcggccccaacgccggcctgggcctggccatcggcatggtggacagcagcatgatgcccatcatgggccacctggtggacctgagacacaccagcgtgtacggcagcgtgtacgccatcgccgacgtggccttctgcatgggcttcgccatcggctacagcgagagcggcctgccccacggcgaccccgacgtgtgcaaccccgaggcccacgagggcatcagcagcggcggcggccagtag

SEQ ID NO: 99493 - DNA, 1578 bp, Artificial Sequence; identical to SEQ ID NO: 99491
  Description of Artificial Sequence: Synthetic coding sequence

SEQ ID NO: 99494 - DNA, 1158 bp, Artificial Sequence
  Description of Artificial Sequence: Synthetic coding sequence
atgctgagaaccatcctggacgccccccagagactgctgaaggagggcagagccagcagacagctggtgctggtggtggtgttcgtggccctgctgctggacaacatgctgttcaccgtggtggtgcccatcgtgcccaccttcctgtacgacatggagttcaaggaggtgaacagcagcctgcacctgggccacgccggcagcagcccccacgccctggccagccccgccttcagcaccatcttcagcttcttcaacaacaacaccgtggccgtggaggagagcgtgcccagcggcatcgcctggatgaacgacaccgccagcaccatccccccccccgccaccgaggccatcagcgcccacaagaacaactgcctgcagggcaccggcttcctggaggaggagatcaccagagtgggcgtgctgttcgccagcaaggccgtgatgcagctgctggtgaaccccttcgtgggccccctgaccaacagaatcggctaccacatccccatgttcgccggcttcgtgatcatgttcctgagcaccgtgatgttcgccttcagcggcacctacaccctgctgttcgtggccagaaccctgcagggcatcggcagcagcttcagcagcgtggccggcctgggcatgctggccagcgtgtacaccgacgaccacgagagaggcagagccatgggcaccgccctgggcggcctggccctgggcctgctggtgggcgcccccttcggcagcgtgatgtacgagttcgtgggcaagagcgcccccttcctgatcctggccttcctggccctgctggacggcgccctgcagctgtgcatcctgcagcccagcaaggtgagccccgagagcgccaagggcacccccctgttcatgctgctgaaggacccctacatcctggtggccgccggcagcatctgcttcgccaacatgggcgtggccatcctggagcccaccctgcccatctggatgatgcagaccatgtgcagccccaagtggcagctgggcctggccttcctgcccgccagcgtgagctacctgatcggcaccaacctgttcggcgtgctggccaacaagatgggcagatggctgtgcagcctgatcggcatgctggtggtgggcaccagcctgctgtgcctgcccagctag

SEQ ID NO: 99495 - DNA, 1482 bp, Artificial Sequence; identical to SEQ ID NO: 99490
  Description of Artificial Sequence: Synthetic coding sequence

SEQ ID NO: 99496 - DNA, 1545 bp, Artificial Sequence
  Description of Artificial Sequence: Synthetic coding sequence
atggccctgagcgagctggccctggtgagatggctgcaggagagcagaagaagcagaaagctgatcctgttcatcgtgttcctggccctgctgctggacaacatgctgctgaccgtggtggtgcccatcatccccagctacctgtacagcatcaagcacgagaagaacgccaccgagatccagaccgccagacccgtgcacaccgccagcatcagcgacagcttccagagcatcttcagctactacgacaacagcaccatggtgaccggcaacgccaccagagacctgaccctgcaccagaccgccacccagcacatggtgaccaacgccagcgccgtgcccagcgactgccccagcgaggacaaggacctgctgaacgagaacgtgcaggtgggcctgctgttcgccagcaaggccaccgtgcagctgatcaccaaccccttcatcggcctgctgaccaacagaatcggctaccccatccccatcttcgccggcttctgcatcatgttcgtgagcaccatcatgttcgccttcagcagcagctacgccttcctgctgatcgccagaagcctgcagggcatcggcagcagctgcagcagcgtggccggcatgggcatgctggccagcgtgtacaccgacgacgaggagagaggcaacgtgatgggcatcgccctgggcggcctggccatgggcgtgctggtgggcccccccttcggcagcgtgctgtacgagttcgtgggcaagaccgcccccttcctggtgctggccgccctggtgctgctggacggcgccatccagctgttcgtgctgcagcccagcagagtgcagcccgagagccagaagggcacccccctgaccaccctgctgaaggacccctacatcctgatcgccgccggcagcatctgcttcgccaacatgggcatcgccatgctggagcccgccctgcccatctggatgatggagaccatgtgcagcagaaagtggcagctgggcgtggccttcctgcccgccagcatcagctacctgatcggcaccaacatcttcggcatcctggcccacaagatgggcagatggctgtgcgccctgctgggcatgatcatcgtgggcgtgagcatcctgtgcatccccttcgccaagaacatctacggcctgatcgcccccaacttcggcgtgggcttcgccatcggcatggtggacagcagcatgatgcccatcatgggctacctggtggacctgagacacgtgagcgtgtacggcagcgtgtacgccatcgccgacgtggccttctgcatgggctacgccatcggccccagcgccggcggcgccatcgccaaggccatcggcttcccctggctgatgaccatcatcggcatcatcgacatcctgttcgcccccctgtgcttcttcctgagaagcccccccgccaaggaggagaagatggccatcctgatggaccacaactgccccatcaagaccaagatgtacacccagaacaacatccagagctaccccatcggcgaggacgaggagagcgagagcgactag

SEQ ID NO: 99497 - DNA, 1494 bp, Artificial Sequence
  Description of Artificial Sequence: Synthetic coding sequence
atggacgtgcccggccccgtgagcagaagagccgccgccgccgccgccaccgtgctgctgagaaccgccagagtgagaagagagtgctggttcctgcccaccgccctgctgtgcgcctacggcttcttcgccagcctgagacccagcgagcccttcctgaccccctacctgctgggccccgacaagaacctgaccgagagagaggtgttcaacgagatctaccccgtgtggacctacagctacctggtgctgctgttccccgtgttcctggccaccgactacctgagatacaagcccgtggtgctgctgcagggcctgagcctgatcgtgacctggttcatgctgctgtacgcccagggcctgctggccatccagttcctggagttcttctacggcatcgccaccgccaccgagatcgcctactacagctacatctacagcgtggtggacctgggcatgtaccagaaggtgaccagctactgcagaagcgccaccctggtgggcttcaccgtgggcagcgtgctgggccagatcctggtgagcgtggccggctggagcctgttcagcctgaacgtgatcagcctgacctgcgtgagcgtggccttcgccgtggcctggttcctgcccatgccccagaagagcctgttcttccaccacatccccagcacctgccagagagtgaacggcatcaaggtgcagaacggcggcatcgtgaccgacacccccgccagcaaccacctgcccggctgggaggacatcgagagcaagatccccctgaacatggaggagccccccgtggaggagcccgagcccaagcccgacagactgctggtgctgaaggtgctgtggaacgacttcctgatgtgctacagcagcagacccctgctgtgctggagcgtgtggtgggccctgagcacctgcggctacttccaggtggtgaactacacccagggcctgtgggagaaggtgatgcccagcagatacgccgccatctacaacggcggcgtggaggccgtgagcaccctgctgggcgccgtggccgtgttcgccgtgggctacatcaagatcagctggagcacctggggcgagatgaccctgagcctgttcagcctgctgatcgccgccgccgtgtacatcatggacaccgtgggcaacatctgggtgtgctacgccagctacgtggtgttcagaatcatctacatgctgctgatcaccatcgccaccttccagatcgccgccaacctgagcatggagagatacgccctggtgttcggcgtgaacaccttcatcgccctggccctgcagaccctgctgaccctgatcgtggtggacgccagcggcctgggcctggagatcaccacccagttcctgatctacgccagctacttcgccctgatcgccgtggtgttcctggccagcggcgccgtgagcgtgatgaagaagtgcagaaagctggaggacccccagagcagcagccaggtgaccaccagctag

SEQ ID NO: 99498 - DNA, 1380 bp, Artificial Sequence
  Description of Artificial Sequence: Synthetic coding sequence
atggacgtgcccggccccgtgagcagaagagccgccgccgccgccgccaccgtgctgctgagaaccgccagagtgagaagagagtgctggttcctgcccaccgccctgctgtgcgcctacggcttcttcgccagcctgagacccagcgagcccttcctgaccccctacctgctgggccccgacaagaacctgaccgagagagaggtgttcaacgagatctaccccgtgtggacctacagctacctggtgctgctgttccccgtgttcctggccaccgactacctgagatacaagcccgtggtgctgctgcagggcctgagcctgatcgtgacctggttcatgctgctgtacgcccagggcctgctggccatccagttcctggagttcttctacggcatcgccaccgccaccgagatcgcctactacagctacatctacagcgtggtggacctgggcatgtaccagaaggtgaccagctactgcagaagcgccaccctggtgggcttcaccgtgggcagcgtgctgggccagatcctggtgagcgtggccggctggagcctgttcagcctgaacgtgatcagcctgacctgcgtgagcgtggccttcgccgtggcctggttcctgcccatgccccagaagagcctgttcttccaccacatccccagcacctgccagagagtgaacggcatcaaggagcccaagcccgacagactgctggtgctgaaggtgctgtggaacgacttcctgatgtgctacagcagcagacccctgctgtgctggagcgtgtggtgggccctgagcacctgcggctacttccaggtggtgaactacacccagggcctgtgggagaaggtgatgcccagcagatacgccgccatctacaacggcggcgtggaggccgtgagcaccctgctgggcgccgtggccgtgttcgccgtgggctacatcaagatcagctggagcacctggggcgagatgaccctgagcctgttcagcctgctgatcgccgccgccgtgtacatcatggacaccgtgggcaacatctgggtgtgctacgccagctacgtggtgttcagaatcatctacatgctgctgatcaccatcgccaccttccagatcgccgccaacctgagcatggagagatacgccctggtgttcggcgtgaacaccttcatcgccctggccctgcagaccctgctgaccctgatcgtggtggacgccagcggcctgggcctggagatcaccacccagttcctgatctacgccagctacttcgccctgatcgccgtggtgttcctggccagcggcgccgtgagcgtgatgaagaagtgcagaaagctggaggacccccagagcagcagccaggtgaccaccagctag

SEQ ID NO: 99499 - DNA, 891 bp, Artificial Sequence
  Description of Artificial Sequence: Synthetic coding sequence
atggacgtgcccggccccgtgagcagaagagccgccgccgccgccgccaccgtgctgctgagaaccgccagagtgagaagagagtgctggttcctgcccaccgccctgctgtgcgcctacggcttcttcgccagcctgagacccagcgagcccttcctgaccccctacctgctgggccccgacaagaacctgaccgagagagaggagcccaagcccgacagactgctggtgctgaaggtgctgtggaacgacttcctgatgtgctacagcagcagacccctgctgtgctggagcgtgtggtgggccctgagcacctgcggctacttccaggtggtgaactacacccagggcctgtgggagaaggtgatgcccagcagatacgccgccatctacaacggcggcgtggaggccgtgagcaccctgctgggcgccgtggccgtgttcgccgtgggctacatcaagatcagctggagcacctggggcgagatgaccctgagcctgttcagcctgctgatcgccgccgccgtgtacatcatggacaccgtgggcaacatctgggtgtgctacgccagctacgtggtgttcagaatcatctacatgctgctgatcaccatcgccaccttccagatcgccgccaacctgagcatggagagatacgccctggtgttcggcgtgaacaccttcatcgccctggccctgcagaccctgctgaccctgatcgtggtggacgccagcggcctgggcctggagatcaccacccagttcctgatctacgccagctacttcgccctgatcgccgtggtgttcctggccagcggcgccgtgagcgtgatgaagaagtgcagaaagctggaggacccccagagcagcagccaggtgaccaccagctag

SEQ ID NO: 99500 - DNA, 1491 bp, Artificial Sequence
  Description of Artificial Sequence: Synthetic coding sequence
atggactgctacagaaccagcctgagcagcagctggatctaccccaccgtgatcctgtgcctgttcggcttcttcagcatgatgagacccagcgagcccttcctgatcccctacctgagcggccccgacaagaacctgaccagcgccgagatcaccaacgagatcttccccgtgtggacctacagctacctggtgctgctgctgcccgtgttcgtgctgaccgactacgtgagatacaagcccgtgatcatcctgcagggcatcagcttcatcatcacctggctgctgctgctgttcggccagggcgtgaagaccatgcaggtggtggagttcttctacggcatggtgaccgccgccgaggtggcctactacgcctacatctacagcgtggtgagccccgagcactaccagagagtgagcggctactgcagaagcgtgaccctggccgcctacaccgccggcagcgtgctggcccagctgctggtgagcctggccaacatgagctacttctacctgaacgtgatcagcctggccagcgtgagcgtggccttcctgttcagcctgttcctgcccatgcccaagaagagcatgttcttccacgccaagcccagcagagagatcaagaagagcagcagcgtgaaccccgtgctggaggagacccacgagggcgaggcccccggctgcgaggagcagaagcccaccagcgagatcctgagcaccagcggcaagctgaacaagggccagctgaacagcctgaagcccagcaacgtgaccgtggacgtgttcgtgcagtggttccaggacctgaaggagtgctacagcagcaagagactgttctactggagcctgtggtgggccttcgccaccgccggcttcaaccaggtgctgaactacgtgcagatcctgtgggactacaaggcccccagccaggacagcagcatctacaacggcgccgtggaggccatcgccaccttcggcggcgccgtggccgccttcgccgtgggctacgtgaaggtgaactgggacctgctgggcgagctggccctggtggtgttcagcgtggtgaacgccggcagcctgttcctgatgcactacaccgccaacatctgggcctgctacgccggctacctgatcttcaagagcagctacatgctgctgatcaccatcgccgtgttccagatcgccgtgaacctgaacgtggagagatacgccctggtgttcggcatcaacaccttcatcgccctggtgatccagaccatcatgaccgtgatcgtggtggaccagagaggcctgaacctgcccgtgagcatccagttcctggtgtacggcagctacttcgccgtgatcgccggcatcttcctgatgagaagcatgtacatcacctacagcaccaagagccagaaggacgtgcagagccccgcccccagcgagaaccccgacgtgagccaccccgaggaggagagcaacatcatcatgagcaccaagctgtag

SEQ ID NO: 99501 - DNA, 165 bp, Artificial Sequence
  Description of Artificial Sequence: Synthetic coding sequence
atggactgctacagaaccagcctgagcagcagctggatctaccccaccgtgatcctgtgcctgttcggcttcttcagcatgatgagacccagcgagcccttcctgatcccctacctgagcggccccgacaagaacctgaccagcgccgagatcaccaacgagtag

SEQ ID NO: 99502 - DNA, 195 bp, Artificial Sequence
  Description of Artificial Sequence: Synthetic coding sequence
atggactgctacagaaccagcctgagcagcagctggatctaccccaccgtgatcctgtgcctgttcggcttcttcagcatgatgagacccagcgagcccttcctgatcccctacctgagcggccccgacaagaacctgaccagcgccgagatcaccaacgagatcttccccgtgtggacctacagctacctgtag

SEQ ID NO: 99503 - DNA, 1491 bp, Artificial Sequence; identical to SEQ ID NO: 99500
  Description of Artificial Sequence: Synthetic coding sequence

SEQ ID NO: 99504 - DNA, 399 bp, Artificial Sequence
  Description of Artificial Sequence: Synthetic coding sequence
atggactgctacagaaccagcctgagcagcagctggatctaccccaccgtgatcctgtgcctgttcggcttcttcagcatgatgagacccagcgagcccttcctgatcccctacctgagcggccccgacaagaacctgaccagcgccgagatcaccaacgagatcttccccgtgtggacctacagctacctggtgctgctgctgcccgtgttcgtgctgaccgactacgtgagatacaagcccgtgatcatcctgcagggcatcagcttcatcatcacctggctgctgctgctgttcggccagggcgtgaagaccatgcaggtggtggagttcttctacggcatggtgaccgccgccgaggtggcctactacgcctacatctacagcgtggtgagctag

SEQ ID NO: 99505 - DNA, 1479 bp, Artificial Sequence
  Description of Artificial Sequence: Synthetic coding sequence
atgaaccccctgggcagcgccagcagagccaccgtggaccagctgaccgacctgcccagcaaggagcagctgagctgcgtggtgttcgccctgtggccccccgccttcagcagcaacctgagcgaccccggcgtgaagatcaccaacgagatcttccccgtgtggacctacagctacctggtgctgctgctgcccgtgttcgtgctgaccgactacgtgagatacaagcccgtgatcatcctgcagggcatcagcttcatcatcacctggctgctgctgctgttcggccagggcgtgaagaccatgcaggtggtggagttcttctacggcatggtgaccgccgccgaggtggcctactacgcctacatctacagcgtggtgagccccgagcactaccagagagtgagcggctactgcagaagcgtgaccctggccgcctacaccgccggcagcgtgctggcccagctgctggtgagcctggccaacatgagctacttctacctgaacgtgatcagcctggccagcgtgagcgtggccttcctgttcagcctgttcctgcccatgcccaagaagagcatgttcttccacgccaagcccagcagagagatcaagaagagcagcagcgtgaaccccgtgctggaggagacccacgagggcgaggcccccggctgcgaggagcagaagcccaccagcgagatcctgagcaccagcggcaagctgaacaagggccagctgaacagcctgaagcccagcaacgtgaccgtggacgtgttcgtgcagtggttccaggacctgaaggagtgctacagcagcaagagactgttctactggagcctgtggtgggccttcgccaccgccggcttcaaccaggtgctgaactacgtgcagatcctgtgggactacaaggcccccagccaggacagcagcatctacaacggcgccgtggaggccatcgccaccttcggcggcgccgtggccgccttcgccgtgggctacgtgaaggtgaactgggacctgctgggcgagctggccctggtggtgttcagcgtggtgaacgccggcagcctgttcctgatgcactacaccgccaacatctgggcctgctacgccggctacctgatcttcaagagcagctacatgctgctgatcaccatcgccgtgttccagatcgccgtgaacctgaacgtggagagatacgccctggtgttcggcatcaacaccttcatcgccctggtgatccagaccatcatgaccgtgatcgtggtggaccagagaggcctgaacctgcccgtgagcatccagttcctggtgtacggcagctacttcgccgtgatcgccggcatcttcctgatgagaagcatgtacatcacctacagcaccaagagccagaaggacgtgcagagccccgcccccagcgagaaccccgacgtgagccaccccgaggaggagagcaacatcatcatgagcaccaagctgtag

SEQ ID NO: 99506 - DNA, 1626 bp, Artificial Sequence
  Description of Artificial Sequence: Synthetic coding sequence
atgggccacagcccccccgtgctgcccctgtgcgccagcgtgagcctgctgggcggcctgaccttcggctacgagctggccgtgatcagcggcgccctgctgcccctgcagctggacttcggcctgagctgcctggagcaggagttcctggtgggcagcctgctgctgggcgccctgctggccagcctggtgggcggcttcctgatcgactgctacggcagaaagcaggccatcctgggcagcaacctggtgctgctggccggcagcctgaccctgggcctggccggcagcctggcctggctggtgctgggcagagccgtggtgggcttcgccatcagcctgagcagcatggcctgctgcatctacgtgagcgagctggtgggccccagacagagaggcgtgctggtgagcctgtacgaggccggcatcaccgtgggcatcctgctgagctacgccctgaactacgccctggccggcaccccctggggctggagacacatgttcggctgggccaccgcccccgccgtgctgcagagcctgagcctgctgttcctgcccgccggcaccgacgagaccgccacccacaaggacctgatccccctgcagggcggcgaggcccccaagctgggccccggcagacccagatacagcttcctggacctgttcagagccagagacaacatgagaggcagaaccaccgtgggcctgggcctggtgctgttccagcagctgaccggccagcccaacgtgctgtgctacgccagcaccatcttcagcagcgtgggcttccacggcggcagcagcgccgtgctggccagcgtgggcctgggcgccgtgaaggtggccgccaccctgaccgccatgggcctggtggacagagccggcagaagagccctgctgctggccggctgcgccctgatggccctgagcgtgagcggcatcggcctggtgagcttcgccgtgcccatggacagcggccccagctgcctggccgtgcccaacgccaccggccagaccggcctgcccggcgacagcggcctgctgcaggacagcagcctgccccccatccccagaaccaacgaggaccagagagagcccatcctgagcaccgccaagaagaccaagccccaccccagaagcggcgaccccagcgccccccccagactggccctgagcagcgccctgcccggcccccccctgcccgccagaggccacgccctgctgagatggaccgccctgctgtgcctgatggtgttcgtgagcgccttcagcttcggcttcggccccgtgacctggctggtgctgagcgagatctaccccgtggagatcagaggcagagccttcgccttctgcaacagcttcaactgggccgccaacctgttcatcagcctgagcttcctggacctgatcggcaccatcggcctgagctggaccttcctgctgtacggcctgaccgccgtgctgggcctgggcttcatctacctgttcgtgcccgagaccaagggccagagcctggccgagatcgaccagcagttccagaagagaagattcaccctgagcttcggccacagacagaacagcaccggcatcccctacagcagaatcgagatcagcgccgccagctag

SEQ ID NO: 99507 - DNA, 1947 bp, Artificial Sequence
  Description of Artificial Sequence: Synthetic coding sequence
atgagcagaaaggccagcgagaacgtggagtacaccctgagaagcctgagcagcctgatgggcgagagaagaagaaagcagcccgagcccgacgccgccagcgccgccggcgagtgcagcctgctggccgccgccgagagcagcaccagcctgcagagcgccggcgccggcggcggcggcgtgggcgacctggagagagccgccagaagacagttccagcaggacgagacccccgccttcgtgtacgtggtggccgtgttcagcgccctgggcggcttcctgttcggctacgacaccggcgtggtgagcggcgccatgctgctgctgaagagacagctgagcctggacgccctgtggcaggagctgctggtgagcagcaccgtgggcgccgccgccgtgagcgccctggccggcggcgccctgaacggcgtgttcggcagaagagccgccatcctgctggccagcgccctgttcaccgccggcagcgccgtgctggccgccgccaacaacaaggagaccctgctggccggcagactggtggtgggcctgggcatcggcatcgccagcatgaccgtgcccgtgtacatcgccgaggtgagcccccccaacctgagaggcagactggtgaccatcaacaccctgttcatcaccggcggccagttcttcgccagcgtggtggacggcgccttcagctacctgcagaaggacggctggagatacatgctgggcctggccgccgtgcccgccgtgatccagttcttcggcttcctgttcctgcccgagagccccagatggctgatccagaagggccagacccagaaggccagaagaatcctgagccagatgagaggcaaccagaccatcgacgaggagtacgacagcatcaagaacaacatcgaggaggaggagaaggaggtgggcagcgccggccccgtgatctgcagaatgctgagctacccccccaccagaagagccctgatcgtgggctgcggcctgcagatgttccagcagctgagcggcatcaacaccatcatgtactacagcgccaccatcctgcagatgagcggcgtggaggacgacagactggccatctggctggccagcgtgaccgccttcaccaacttcatcttcaccctggtgggcgtgtggctggtggagaaggtgggcagaagaaagctgaccttcggcagcctggccggcaccaccgtggccctgatcatcctggccctgggcttcgtgctgagcgcccaggtgagccccagaatcaccttcaagcccatcgcccccagcggccagaacgccacctgcaccagatacagctactgcaacgagtgcatgctggaccccgactgcggcttctgctacaagatgaacaagagcaccgtgatcgacagcagctgcgtgcccgtgaacaaggccagcaccaacgaggccgcctggggcagatgcgagaacgagaccaagttcaagaccgaggacatcttctgggcctacaacttctgccccaccccctacagctggaccgccctgctgggcctgatcctgtacctggtgttcttcgcccccggcatgggccccatgccctggaccgtgaacagcgagatctaccccctgtgggccagaagcaccggcaacgcctgcagcagcggcatcaactggatcttcaacgtgctggtgagcctgaccttcctgcacaccgccgagtacctgacctactacggcgccttcttcctgtacgccggcttcgccgccgtgggcctgctgttcatctacggctgcctgcccgagaccaagggcaagaagctggaggagatcgagagcctgttcgacaacagactgtgcacctgcggcaccagcgacagcgacgagggcagatacatcgagtacatcagagtgaagggcagcaactaccacctgagcgacaacgacgccagcgacgtggagtag

SEQ ID NO: 99508 - DNA, 1074 bp, Artificial Sequence
  Description of Artificial Sequence: Synthetic coding sequence
atgagcagaaaggccagcgagaacgtggagtacaccctgagaagcctgagcagcctgatgggcgagagaagaagaaagcagcccgagcccgacgccgccagcgccgccggcgagtgcagcctgctggccgccgccgagagcagcaccagcctgcagagcgccggcgccggcggcggcggcgtgggcgacctggagagagccgccagaagacagttccagcaggacgagacccccgccttcgtgtacgtggtggccgtgttcagcgccctgggcggcttcctgttcggctacgacaccggcgtggtgagcggcgccatgctgctgctgaagagacagctgagcctggacgccctgtggcaggagctgctggtgagcagcaccgtgggcgccgccgccgtgagcgccctggccggcggcgccctgaacggcgtgttcggcagaagagccgccatcctgctggccagcgccctgttcaccgccggcagcgccgtgctggccgccgccaacaacaaggagaccctgctggccggcagactggtggtgggcctgggcatcggcatcgccagcatgaccgtgcccgtgtacatcgccgaggtgagcccccccaacctgagaggcagactggtgaccatcaacaccctgttcatcaccggcggccagttcttcgccagcgtggtggacggcgccttcagctacctgcagaaggacggctggagatacatgctgggcctggccgccgtgcccgccgtgatccagttcttcggcttcctgttcctgcccgagagccccagatggctgatccagaagggccagacccagaaggccagaagaatcctgagccagatgagaggcaaccagaccatcgacgaggagtacgacagcatcaagaacaacatcgaggaggaggagaaggaggtgggcagcgccggccccgtgatctgcagaatgctgagctacccccccaccagaagagccctgatcgtgggctgcggcctgcagatgttccagcagctgagcggcatcaacaccatcatgtacgtgttcctgagcggcttcctgctgaagagactgtag

SEQ ID NO: 99509 - DNA, 1494 bp, Artificial Sequence
  Description of Artificial Sequence: Synthetic coding sequence
atggacaacagacagaacgtgacccccgccctgatcttcgccatcaccgtggccaccatcggcagcttccagttcggctacaacaccggcgtgatcaacgcccccgagaccatcatcaaggagttcatcaacaagaccctgaccgacaaggccaacgccccccccagcgaggtgctgctgaccaacctgtggagcctgagcgtggccatcttcagcgtgggcggcatgatcggcagcttcagcgtgggcctgttcgtgaacagattcggcagaagaaacagcatgctgatcgtgaacctgctggccgccaccggcggctgcctgatgggcctgtgcaagatcgccgagagcgtggagatgctgatcctgggcagactggtgatcggcctgttctgcggcctgtgcaccggcttcgtgcccatgtacatcggcgagatcagccccaccgccctgagaggcgccttcggcaccctgaaccagctgggcatcgtgatcggcatcctggtggcccagatcttcggcctggagctgatcctgggcagcgaggagctgtggcccgtgctgctgggcttcaccatcctgcccgccatcctgcagagcgccgccctgccctgctgccccgagagccccagattcctgctgatcaacagaaagaaggaggagaacgccaccagaatcctgcagagactgtggggcacccaggacgtgagccaggacatccaggagatgaaggacgagagcgccagaatgagccaggagaagcaggtgaccgtgctggagctgttcagagtgagcagctacagacagcccatcatcatcagcatcgtgctgcagctgagccagcagctgagcggcatcaacgccgtgttctactacagcaccggcatcttcaaggacgccggcgtgcagcagcccatctacgccaccatcagcgccggcgtggtgaacaccatcttcaccctgctgagcctgttcctggtggagagagccggcagaagaaccctgcacatgatcggcctgggcggcatggccttctgcagcaccctgatgaccgtgagcctgctgctgaagaaccactacaacggcatgagcttcgtgtgcatcggcgccatcctggtgttcgtggcctgcttcgagatcggccccggccccatcccctggttcatcgtggccgagctgttcagccagggccccagacccgccgccatggccgtggccggctgcagcaactggaccagcaacttcctggtgggcctgctgttccccagcgccgcctactacctgggcgcctacgtgttcatcatcttcaccggcttcctgatcaccttcctggccttcaccttcttcaaggtgcccgagaccagaggcagaaccttcgaggacatcaccagagccttcgagggccaggcccacggcgccgacagaagcggcaaggacggcgtgatgggcatgaacagcatcgagcccgccaaggagaccaccaccaacgtgtag

SEQ ID NO: 99510 - DNA, 1563 bp, Artificial Sequence
  Description of Artificial Sequence: Synthetic coding sequence
atggagttccacaacggcggccacgtgagcggcatcggcggcttcctggtgagcctgaccagcagaatgaagccccacaccctggccgtgacccccgccctgatcttcgccatcaccgtggccaccatcggcagcttccagttcggctacaacaccggcgtgatcaacgcccccgagaccatcatcaaggagttcatcaacaagaccctgaccgacaaggccaacgccccccccagcgaggtgctgctgaccaacctgtggagcctgagcgtggccatcttcagcgtgggcggcatgatcggcagcttcagcgtgggcctgttcgtgaacagattcggcagaagaaacagcatgctgatcgtgaacctgctggccgccaccggcggctgcctgatgggcctgtgcaagatcgccgagagcgtggagatgctgatcctgggcagactggtgatcggcctgttctgcggcctgtgcaccggcttcgtgcccatgtacatcggcgagatcagccccaccgccctgagaggcgccttcggcaccctgaaccagctgggcatcgtgatcggcatcctggtggcccagatcttcggcctggagctgatcctgggcagcgaggagctgtggcccgtgctgctgggcttcaccatcctgcccgccatcctgcagagcgccgccctgccctgctgccccgagagccccagattcctgctgatcaacagaaagaaggaggagaacgccaccagaatcctgcagagactgtggggcacccaggacgtgagccaggacatccaggagatgaaggacgagagcgccagaatgagccaggagaagcaggtgaccgtgctggagctgttcagagtgagcagctacagacagcccatcatcatcagcatcgtgctgcagctgagccagcagctgagcggcatcaacgccgtgttctactacagcaccggcatcttcaaggacgccggcgtgcagcagcccatctacgccaccatcagcgccggcgtggtgaacaccatcttcaccctgctgagcctgttcctggtggagagagccggcagaagaaccctgcacatgatcggcctgggcggcatggccttctgcagcaccctgatgaccgtgagcctgctgctgaagaaccactacaacggcatgagcttcgtgtgcatcggcgccatcctggtgttcgtggcctgcttcgagatcggccccggccccatcccctggttcatcgtggccgagctgttcagccagggccccagacccgccgccatggccgtggccggctgcagcaactggaccagcaacttcctggtgggcctgctgttccccagcgccgcctactacctgggcgcctacgtgttcatcatcttcaccggcttcctgatcaccttcctggccttcaccttcttcaaggtgcccgagaccagaggcagaaccttcgaggacatcaccagagccttcgagggccaggcccacggcgccgacagaagcggcaaggacggcgtgatgggcatgaacagcatcgagcccgccaaggagaccaccaccaacgtgtag

SEQ ID NO: 99511 - DNA, 1494 bp, Artificial Sequence; identical to SEQ ID NO: 99509
  Description of Artificial Sequence: Synthetic coding sequence

SEQ ID NO: 99512 - DNA, 363 bp, Artificial Sequence
  Description of Artificial Sequence: Synthetic coding sequence
atggagttccacaacggcggccacgtgagcggcatcggcggcttcctggtgagcctgaccagcagaatgaagccccacaccctggccgtgacccccgccctgatcttcgccatcaccgtggccaccatcggcagcttccagttcggctacaacaccggcgtgatcaacgcccccgagaccatcatcaaggagttcatcaacaagaccctgaccgacaaggccaacgccccccccagcgaggtgctgctgaccaacctgtggagcctgagcgtggccatcttcagcgtgggcggcatgatcggcagcttcagcgtgggcctgttcgtgaacagattcggcagaagaaacagcatgctgatctag

SEQ ID NO: 99513 - DNA, 1236 bp, Artificial Sequence
  Description of Artificial Sequence: Synthetic coding sequence
atgctgctgagaagaagaaacagcatgctgatcgtgaacctgctggccgccaccggcggctgcctgatgggcctgtgcaagatcgccgagagcgtggagatgctgatcctgggcagactggtgatcggcctgttctgcggcctgtgcaccggcttcgtgcccatgtacatcggcgagatcagccccaccgccctgagaggcgccttcggcaccctgaaccagctgggcatcgtgatcggcatcctggtggcccagatcttcggcctggagctgatcctgggcagcgaggagctgtggcccgtgctgctgggcttcaccatcctgcccgccatcctgcagagcgccgccctgccctgctgccccgagagccccagattcctgctgatcaacagaaagaaggaggagaacgccaccagaatcctgcagagactgtggggcacccaggacgtgagccaggacatccaggagatgaaggacgagagcgccagaatgagccaggagaagcaggtgaccgtgctggagctgttcagagtgagcagctacagacagcccatcatcatcagcatcgtgctgcagctgagccagcagctgagcggcatcaacgccgtgttctactacagcaccggcatcttcaaggacgccggcgtgcagcagcccatctacgccaccatcagcgccggcgtggtgaacaccatcttcaccctgctgagcctgttcctggtggagagagccggcagaagaaccctgcacatgatcggcctgggcggcatggccttctgcagcaccctgatgaccgtgagcctgctgctgaagaaccactacaacggcatgagcttcgtgtgcatcggcgccatcctggtgttcgtggcctgcttcgagatcggccccggccccatcccctggttcatcgtggccgagctgttcagccagggccccagacccgccgccatggccgtggccggctgcagcaactggaccagcaacttcctggtgggcctgctgttccccagcgccgcctactacctgggcgcctacgtgttcatcatcttcaccggcttcctgatcaccttcctggccttcaccttcttcaaggtgcccgagaccagaggcagaaccttcgaggacatcaccagagccttcgagggccaggcccacggcgccgacagaagcggcaaggacggcgtgatgggcatgaacagcatcgagcccgccaaggagaccaccaccaacgtgtag

SEQ ID NO: 99514 - DNA, 426 bp, Artificial Sequence
  Description of Artificial Sequence: Synthetic coding sequence
atggacaacagacagaacgtgacccccgccctgatcttcgccatcaccgtggccaccatcggcagcttccagttcggctacaacaccggcgtgatcaacgcccccgagaccatcatcaaggagttcatcaacaagaccctgaccgacaaggccaacgccccccccagcgaggtgctgctgaccaacctgtggagcctgagcgtggccatcttcagcgtgggcggcatgatcggcagcttcagcgtgggcctgttcgtgaacagattcggcagaagaaacagcatgctgatcgtgaacctgctggccgccaccggcggctgcctgatgggcctgtgcaagatcgccgagagcgtggagatgctgatcctgggcagactggtgatcggcctgttctgcggcctgtgcaccggcttcgtgcccatgtag

SEQ ID NO: 99515 - DNA, 144 bp, Artificial Sequence
  Description of Artificial Sequence: Synthetic coding sequence
atggacaacagacagaacgtgacccccgccctgatcttcgccatcaccgtggccaccatcggcagcttccagttcggctacaacaccggcgtgatcaacgcccccgagaccatcatcaaggagttcatcaacaagaccctgtag

SEQ ID NO: 99516 - DNA, 69 bp, Artificial Sequence
  Description of Artificial Sequence: Synthetic coding sequence
atggacaacagacagaacgtgacccccgccctgatcttcgccatcaccgtggccaccatcggcagctag

SEQ ID NO: 99517 - DNA, 426 bp, Artificial Sequence
  Description of Artificial Sequence: Synthetic coding sequence
atggagttccacaacggcggccacgtgagcggcatcggcggcttcctggtgagcctgaccagcagaatgaagccccacaccctggccgtgacccccgccctgatcttcgccatcaccgtggccaccatcggcagcttccagttcggctacaacaccggcgtgatcaacgcccccgagaccatcatcaaggagttcatcaacaagaccctgaccgacaaggccaacgccccccccagcgaggtgctgctgaccaacctgtggagcctgagcgtggccatcttcagcgtgggcggcatgatcggcagcttcagcgtgggcctgttcgtgaacagattcggcagaagaaacagcatgctgatcgtgaacctgctggccgccaccggcggctgcctgatgggcctgtgcaagatcgccgagagcgtgtag

SEQ ID NO: 99518 - DNA, 1608 bp, Artificial Sequence
  Description of Artificial Sequence: Synthetic coding sequence
atgcagagactgcagctgctgagagtggaggtgctgctgggcgtgaagcagggcgacgagatgagacacttcttcttcagcagccagaccagcaccctggagaagagccagaacggcggcgtgggcgaggaggtgacccccgccctgatcttcgccatcaccgtggccaccatcggcagcttccagttcggctacaacaccggcgtgatcaacgcccccgagaccatcatcaaggagttcatcaacaagaccctgaccgacaaggccaacgccccccccagcgaggtgctgctgaccaacctgtggagcctgagcgtggccatcttcagcgtgggcggcatgatcggcagcttcagcgtgggcctgttcgtgaacagattcggcagaagaaacagcatgctgatcgtgaacctgctggccgccaccggcggctgcctgatgggcctgtgcaagatcgccgagagcgtggagatgctgatcctgggcagactggtgatcggcctgttctgcggcctgtgcaccggcttcgtgcccatgtacatcggcgagatcagccccaccgccctgagaggcgccttcggcaccctgaaccagctgggcatcgtgatcggcatcctggtggcccagatcttcggcctggagctgatcctgggcagcgaggagctgtggcccgtgctgctgggcttcaccatcctgcccgccatcctgcagagcgccgccctgccctgctgccccgagagccccagattcctgctgatcaacagaaagaaggaggagaacgccaccagaatcctgcagagactgtggggcacccaggacgtgagccaggacatccaggagatgaaggacgagagcgccagaatgagccaggagaagcaggtgaccgtgctggagctgttcagagtgagcagctacagacagcccatcatcatcagcatcgtgctgcagctgagccagcagctgagcggcatcaacgccgtgttctactacagcaccggcatcttcaaggacgccggcgtgcagcagcccatctacgccaccatcagcgccggcgtggtgaacaccatcttcaccctgctgagcctgttcctggtggagagagccggcagaagaaccctgcacatgatcggcctgggcggcatggccttctgcagcaccctgatgaccgtgagcctgctgctgaagaaccactacaacggcatgagcttcgtgtgcatcggcgccatcctggtgttcgtggcctgcttcgagatcggccccggccccatcccctggttcatcgtggccgagctgttcagccagggccccagacccgccgccatggccgtggccggctgcagcaactggaccagcaacttcctggtgggcctgctgttccccagcgccgcctactacctgggcgcctacgtgttcatcatcttcaccggcttcctgatcaccttcctggccttcaccttcttcaaggtgcccgagaccagaggcagaaccttcgaggacatcaccagagccttcgagggccaggcccacggcgccgacagaagcggcaaggacggcgtgatgggcatgaacagcatcgagcccgccaaggagaccaccaccaacgtgtag

SEQ ID NO: 99519 - DNA, 486 bp, Artificial Sequence
  Description of Artificial Sequence: Synthetic coding sequence
atgatcggcctgggcggcatggccttctgcagcaccctgatgaccgtgagcctgctgctgaagaaccactacaacggcatgagcttcgtgtgcatcggcgccatcctggtgttcgtggcctgcttcgagatcggccccggccccatcccctggttcatcgtggccgagctgttcagccagggccccagacccgccgccatggccgtggccggctgcagcaactggaccagcaacttcctggtgggcctgctgttccccagcgccgcctactacctgggcgcctacgtgttcatcatcttcaccggcttcctgatcaccttcctggccttcaccttcttcaaggtgcccgagaccagaggcagaaccttcgaggacatcaccagagccttcgagggccaggcccacggcgccgacagaagcggcaaggacggcgtgatgggcatgaacagcatcgagcccgccaaggagaccaccaccaacgtgtag

SEQ ID NO: 99520 - DNA, 1236 bp, Artificial Sequence; identical to SEQ ID NO: 99513
  Description of Artificial Sequence: Synthetic coding sequence

SEQ ID NO: 99521 - DNA, 459 bp, Artificial Sequence
  Description of Artificial Sequence: Synthetic coding sequence
atggacaacagacagaacgtgacccccgccctgatcttcgccatcaccgtggccaccatcggcagcttccagttcggctacaacaccggcgtgatcaacgcccccgagaccatcatcaaggagttcatcaacaagaccctgaccgacaaggccaacgccccccccagcgaggtgctgctgaccaacctgtggagcctgagcgtggccatcttcagcgtgggcggcatgatcggcagcttcagcgtgggcctgttcgtgaacagattcggcagaagaaacagcatgctgatcgtgaacctgctggccgccaccggcggctgcctgatgggcctgtgcaagatcgccgagagcgtggagatgctgatcctgggcagactggtgatcggcctgttctgcggcctgtgcaccggcttcgtgcccatgtacatcggcgagatcagccccaccgccctgagatag

SEQ ID NO: 99522 - DNA, 255 bp, Artificial Sequence
  Description of Artificial Sequence: Synthetic coding sequence
atggacaacagacagaacgtgacccccgccctgatcttcgccatcaccgtggccaccatcggcagcttccagttcggctacaacaccggcgtgatcaacgcccccgagaccatcatcaaggagttcatcaacaagaccctgaccgacaaggccaacgccccccccagcgaggtgctgctgaccaacctgtggagcctgagcgtggccatcttcagcgtgggcggcatgatcggcagcttcagcgtgggcctgtag

SEQ ID NO: 99523 - DNA, 1563 bp, Artificial Sequence; identical to SEQ ID NO: 99510
  Description of Artificial Sequence: Synthetic coding sequence

SEQ ID NO: 99524 - DNA, 510 bp, Artificial Sequence
  Description of Artificial Sequence: Synthetic coding sequence
atggacaacagacagaacgtgacccccgccctgatcttcgccatcaccgtggccaccatcggcagcttccagttcggctacaacaccggcgtgatcaacgcccccgagaccatcatcaaggagttcatcaacaagaccctgaccgacaaggccaacgccccccccagcgaggtgctgctgaccaacctgtggagcctgagcgtggccatcttcagcgtgggcggcatgatcggcagcttcagcgtgggcctgttcgtgaacagattcggcagaagaaacagcatgctgatcgtgaacctgctggccgccaccggcggctgcctgatgggcctgtgcaagatcgccgagagcgtggagatgctgatcctgggcagactggtgatcggcctgttctgcggcctgtgcaccggcttcgtgcccatgtacatcggcgagatcagccccaccgccctgagaggcgccttcggcaccctgaaccagctgggcatcgtgatcggcatcctggtgtag

SEQ ID NO: 99525 - DNA, 1491 bp, Artificial Sequence
  Description of Artificial Sequence: Synthetic coding sequence
atgggcacccagaaggtgacccccgccctgatcttcgccatcaccgtggccaccatcggcagcttccagttcggctacaacaccggcgtgatcaacgcccccgagaagatcatcaaggagttcatcaacaagaccctgaccgacaagggcaacgccccccccagcgaggtgctgctgaccagcctgtggagcctgagcgtggccatcttcagcgtgggcggcatgatcggcagcttcagcgtgggcctgttcgtgaacagattcggcagaagaaacagcatgctgatcgtgaacctgctggccgtgaccggcggctgcttcatgggcctgtgcaaggtggccaagagcgtggagatgctgatcctgggcagactggtgatcggcctgttctgcggcctgtgcaccggcttcgtgcccatgtacatcggcgagatcagccccaccgccctgagaggcgccttcggcaccctgaaccagctgggcatcgtggtgggcatcctggtggcccagatcttcggcctggagttcatcctgggcagcgaggagctgtggcccctgctgctgggcttcaccatcctgcccgccatcctgcagagcgccgccctgcccttctgccccgagagccccagattcctgctgatcaacagaaaggaggaggagaacgccaagcagatcctgcagagactgtggggcacccaggacgtgagccaggacatccaggagatgaaggacgagagcgccagaatgagccaggagaagcaggtgaccgtgctggagctgttcagagtgagcagctacagacagcccatcatcatcagcatcgtgctgcagctgagccagcagctgagcggcatcaacgccgtgttctactacagcaccggcatcttcaaggacgccggcgtgcaggagcccatctacgccaccatcggcgccggcgtggtgaacaccatcttcaccgtggtgagcctgttcctggtggagagagccggcagaagaaccctgcacatgatcggcctgggcggcatggccttctgcagcaccctgatgaccgtgagcctgctgctgaaggacaactacaacggcatgagcttcgtgtgcatcggcgccatcctggtgttcgtggccttcttcgagatcggccccggccccatcccctggttcatcgtggccgagctgttcagccagggccccagacccgccgccatggccgtggccggctgcagcaactggaccagcaacttcctggtgggcctgctgttccccagcgccgcccactacctgggcgcctacgtgttcatcatcttcaccggcttcctgatcaccttcctggccttcaccttcttcaaggtgcccgagaccagaggcagaaccttcgaggacatcaccagagccttcgagggccaggcccacggcgccgacagaagcggcaaggacggcgtgatggagatgaacagcatcgagcccgccaaggagaccaccaccaacgtgtag

SEQ ID NO: 99526 - DNA, 1269 bp, Artificial Sequence
  Description of Artificial Sequence: Synthetic coding sequence
atgatcggcagcttcagcgtgggcctgttcgtgaacagattcggcagaagaaacagcatgctgatcgtgaacctgctggccgtgaccggcggctgcttcatgggcctgtgcaaggtggccaagagcgtggagatgctgatcctgggcagactggtgatcggcctgttctgcggcctgtgcaccggcttcgtgcccatgtacatcggcgagatcagccccaccgccctgagaggcgccttcggcaccctgaaccagctgggcatcgtggtgggcatcctggtggcccagatcttcggcctggagttcatcctgggcagcgaggagctgtggcccctgctgctgggcttcaccatcctgcccgccatcctgcagagcgccgccctgcccttctgccccgagagccccagattcctgctgatcaacagaaaggaggaggagaacgccaagcagatcctgcagagactgtggggcacccaggacgtgagccaggacatccaggagatgaaggacgagagcgccagaatgagccaggagaagcaggtgaccgtgctggagctgttcagagtgagcagctacagacagcccatcatcatcagcatcgtgctgcagctgagccagcagctgagcggcatcaacgccgtgttctactacagcaccggcatcttcaaggacgccggcgtgcaggagcccatctacgccaccatcggcgccggcgtggtgaacaccatcttcaccgtggtgagcctgttcctggtggagagagccggcagaagaaccctgcacatgatcggcctgggcggcatggccttctgcagcaccctgatgaccgtgagcctgctgctgaaggacaactacaacggcatgagcttcgtgtgcatcggcgccatcctggtgttcgtggccttcttcgagatcggccccggccccatcccctggttcatcgtggccgagctgttcagccagggccccagacccgccgccatggccgtggccggctgcagcaactggaccagcaacttcctggtgggcctgctgttccccagcgccgcccactacctgggcgcctacgtgttcatcatcttcaccggcttcctgatcaccttcctggccttcaccttcttcaaggtgcccgagaccagaggcagaaccttcgaggacatcaccagagccttcgagggccaggcccacggcgccgacagaagcggcaaggacggcgtgatggagatgaacagcatcgagcccgccaaggagaccaccaccaacgtgtag

SEQ ID NO: 99527 - DNA, 1530 bp, Artificial Sequence
  Description of Artificial Sequence: Synthetic coding sequence
atgcccagcggcttccagcagatcggcagcgaggacggcgagcccccccagcagagagtgaccggcaccctggtgctggccgtgttcagcgccgtgctgggcagcctgcagttcggctacaacatcggcgtgatcaacgccccccagaaggtgatcgagcagagctacaacgagacctggctgggcagacagggccccgagggccccagcagcatcccccccggcaccctgaccaccctgtgggccctgagcgtggccatcttcagcgtgggcggcatgatcagcagcttcctgatcggcatcatcagccagtggctgggcagaaagagagccatgctggtgaacaacgtgctggccgtgctgggcggcagcctgatgggcctggccaacgccgccgccagctacgagatgctgatcctgggcagattcctgatcggcgcctacagcggcctgaccagcggcctggtgcccatgtacgtgggcgagatcgcccccacccacctgagaggcgccctgggcaccctgaaccagctggccatcgtgatcggcatcctgatcgcccaggtgctgggcctggagagcctgctgggcaccgccagcctgtggcccctgctgctgggcctgaccgtgctgcccgccctgctgcagctggtgctgctgcccttctgccccgagagccccagatacctgtacatcatccagaacctggagggccccgccagaaagagcctgaagagactgaccggctgggccgacgtgagcggcgtgctggccgagctgaaggacgagaagagaaagctggagagagagagacccctgagcctgctgcagctgctgggcagcagaacccacagacagcccctgatcatcgccgtggtgctgcagctgagccagcagctgagcggcatcaacgccgtgttctactacagcaccagcatcttcgagaccgccggcgtgggccagcccgcctacgccaccatcggcgccggcgtggtgaacaccgtgttcaccctggtgagcgtgctgctggtggagagagccggcagaagaaccctgcacctgctgggcctggccggcatgtgcggctgcgccatcctgatgaccgtggccctgctgctgctggagagagtgcccgccatgagctacgtgagcatcgtggccatcttcggcttcgtggccttcttcgagatcggccccggccccatcccctggttcatcgtggccgagctgttcagccagggccccagacccgccgccatggccgtggccggcttcagcaactggaccagcaacttcatcatcggcatgggcttccagtacgtggccgaggccatgggcccctacgtgttcctgctgttcgccgtgctgctgctgggcttcttcatcttcaccttcctgagagtgcccgagaccagaggcagaaccttcgaccagatcagcgccgccttccacagaacccccagcctgctggagcaggaggtgaagcccagcaccgagctggagtacctgggccccgacgagaacgactag

SEQ ID NO: 99528 - DNA, 1356 bp, Artificial Sequence
  Description of Artificial Sequence: Synthetic coding sequence
atggacggcgagcccccccagcagagagtgaccggcaccctggtgctggccgtgttcagcgccgtgctgggcagcctgcagttcggctacaacatcggcgtgatcaacgccccccagaaggtgatcgagcagagctacaacgagacctggctgggcagacagggccccgagggccccagcagcatcccccccggcaccctgaccaccctgtgggccctgagcgtggccatcttcagcgtgggcggcatgatcagcagcttcctgatcggcatcatcagccagtggctgggcagaaagagagccatgctggtgaacaacgtgctggccgtgctgggcggcagcctgatgggcctggccaacgccgccgccagctacgagatgctgatcctgggcagattcctgatcggcgcctacagcggcctgaccagcggcctggtgcccatgtacgtgggcgagatcgcccccacccacctgagaggcgccctgggcaccctgaaccagctggccatcgtgatcggcatcctgatcgcccaggtgctgggcctggagagcctgctgggcaccgccagcctgtggcccctgctgctgggcctgaccgtgctgcccgccctgctgcagctggtgctgctgcccttctgccccgagagccccagatacctgtacatcatccagaacctggagggccccgccagaaagagcctgaagagactgaccggctgggccgacgtgagcggcgtgctggccgagctgaaggacgagaagagaaagctggagagagagagacccctgagcctgctgcagctgctgggcagcagaacccacagacagcccctgatcatcgccgtggtgctgcagctgagccagcagctgagcggcatcaacgccgtgttctactacagcaccagcatcttcgagaccgccggcgtgggccagcccgcctacgccaccatcggcgccggcgtggtgaacaccgtgttcaccctggtgagcgtgctgctggtggagagagccggcagaagaaccctgcacctgctgggcctggccggcatgtgcggctgcgccatcctgatgaccgtggccctgctgctgctggagagagtgcccgccatgagctacgtgagcatcgtggccatcttcggcttcgtggccttcttcgagatcggccccggccccatcccctggttcatcgtggccgagctgttcagccagggccccagacccgccgccatggccgtggccggcttcagcaactggaccagcaacttcatcatcggcatgggcttccagtacgtggccgtgggcccccccgcccccgccagccacaccgtgggccagagatgggccagccacagctag

SEQ ID NO: 99529 - DNA, 1338 bp, Artificial Sequence
  Description of Artificial Sequence: Synthetic coding sequence
atgcaggagcccctgctgggcgccgagggccccgactacgacaccttccccgagaagcccccccccagccccggcgacagagccagagtgggcaccctgcagaacaagagagtgttcctggccaccttcgccgccgtgctgggcaacttcagcttcggctacgccctggtgtacaccagccccgtgatccccgccctggagagaagcctggaccccgacctgcacctgaccaagagccaggccagctggttcggcagcgtgttcaccctgggcgccgccgccggcggcctgagcgccatgatcctgaacgacctgctgggcagaaagctgagcatcatgttcagcgccgtgcccagcgccgccggctacgccctgatggccggcgcccacggcctgtggatgctgctgctgggcagaaccctgaccggcttcgccggcggcctgaccgccgcctgcatccccgtgtacgtgagcgagatcgccccccccggcgtgagaggcgccctgggcgccaccccccagctgatggccgtgttcggcagcctgagcctgtacgccctgggcctgctgctgccctggagatggctggccgtggccggcgaggcccccgtgctgatcatgatcctgctgctgagcttcatgcccaacagccccagattcctgctgagcagaggcagagacgaggaggccctgagagccctggcctggctgagaggcaccgacgtggacgtgcactgggagttcgagcagatccaggacaacgtgagaagacagagcagcagagtgagctgggccgaggccagagccccccacgtgtgcagacccatcaccgtggccctgctgatgagactgctgcagcagctgaccggcatcacccccatcctggtgtacctgcagagcatcttcgacagcaccgccgtgctgctgccccccaaggacgacgccgccatcgtgggcgccgtgagactgctgagcgtgctgatcgccgccctgaccatggacctggccggcagaaaggtgctgctgttcgtgagcggctacgccgtgggctggggccccatcacctggctgctgatgagcgaggtgctgcccctgagagccagaggcgtggccagcggcctgtgcgtgctggccagctggctgaccgccttcgtgctgaccaagagcttcctgcccgtggtgagcaccttcggcctgcaggtgcccttcttcttcttcgccgccatctgcctggtgagcctggtgttcaccggctgctgcgtgcccgagaccaagggcagaagcctggagcagatcgagagcttcttcagaaccggcagaagaagcttcctgagatag

SEQ ID NO: 99530 - DNA, 1524 bp, Artificial Sequence
  Description of Artificial Sequence: Synthetic coding sequence
atgcaggagcccctgctgggcgccgagggccccgactacgacaccttccccgagaagcccccccccagccccggcgacagagccagagtgggcaccctgcagaacaagagagtgttcctggccaccttcgccgccgtgctgggcaacttcagcttcggctacgccctggtgtacaccagccccgtgatccccgccctggagagaagcctggaccccgacctgcacctgaccaagagccaggccagctggttcggcagcgtgttcaccctgggcgccgccgccggcggcctgagcgccatgatcctgaacgacctgctgggcagaaagctgagcatcatgttcagcgccgtgcccagcgccgccggctacgccctgatggccggcgcccacggcctgtggatgctgctgctgggcagaaccctgaccggcttcgccggcggcctgaccgccgcctgcatccccgtgtacgtgagcgagatcgccccccccggcgtgagaggcgccctgggcgccaccccccagctgatggccgtgttcggcagcctgagcctgtacgccctgggcctgctgctgccctggagatggctggccgtggccggcgaggcccccgtgctgatcatgatcctgctgctgagcttcatgcccaacagccccagattcctgctgagcagaggcagagacgaggaggccctgagagccctggcctggctgagaggcaccgacgtggacgtgcactgggagttcgagcagatccaggacaacgtgagaagacagagcagcagagtgagctgggccgaggccagagccccccacgtgtgcagacccatcaccgtggccctgctgatgagactgctgcagcagctgaccggcatcacccccatcctggtgtacctgcagagcatcttcgacagcaccgccgtgctgctgccccccaaggacgacgccgccatcgtgggcgccgtgagactgctgagcgtgctgatcgccgccctgaccatggacctggccggcagaaaggtgctgctgttcgtgagcgccgccatcatgttcgccgccaacctgaccctgggcctgtacatccacttcggccccagacccctgagccccaacagcaccgccggcctggagagcgagagctggggcgacctggcccagcccctggccgcccccgccggctacctgaccctggtgcccctgctggccaccatgctgttcatcatgggctacgccgtgggctggggccccatcacctggctgctgatgagcgaggtgctgcccctgagagccagaggcgtggccagcggcctgtgcgtgctggccagctggctgaccgccttcgtgctgaccaagagcttcctgcccgtggtgagcaccttcggcctgcaggtgcccttcttcttcttcgccgccatctgcctggtgagcctggtgttcaccggctgctgcgtgcccgagaccaagggcagaagcctggagcagatcgagagcttcttcagaaccggcagaagaagcttcctgagatag

SEQ ID NO: 99531 - DNA, 441 bp, Artificial Sequence
  Description of Artificial Sequence: Synthetic coding sequence
atgatcctgaacgacctgctgggcagaaagctgagcatcatgttcagcgccgtgcccagcgccgccggctacgccctgatggccggcgcccacggcctgtggatgctgctgctgggcagaaccctgaccggcttcgccggcggcctgaccgccgcctgcatccccggcctgaccctgcccagcagacccggcctgggcaccagcatcttcagcaagacctggtgcggcggctgcgtgctgcaggtgtacgtgagcgagatcgccccccccggcgtgagaggcgccctgggcgccaccccccagctgatggccgtgttcggcagcctgagcctgtacgccctgggcaaggacgaggaggccctgagagccctggcctggctgagaggcaccgacgtggacgtgcactgggagttcgagcagatccaggacaacgtgagatag

SEQ ID NO: 99532 - DNA, 660 bp, Artificial Sequence
  Description of Artificial Sequence: Synthetic coding sequence
atgcaggagcccctgctgggcgccgagggccccgactacgacaccttccccgagaagcccccccccagccccggcgacagagccagagtgggcaccctgcagaacaagagagtgttcctggccaccttcgccgccgtgctgggcaacttcagcttcggctacgccctggtgtacaccagccccgtgatccccgccctggagagaagcctggaccccgacctgcacctgaccaagagccaggccagctggttcggcagcgtgttcaccctgggcgccgccgccggcggcctgagcgccatgatcctgaacgacctgctgggcagaaagctgagcatcatgttcagcgccgtgcccagcgccgccggctacgccctgatggccggcgcccacggcctgtggatgctgctgctgggcagaaccctgaccggcttcgccggcggcctgaccgccgcctgcatccccgtgtacgtgagcgagatcgccccccccggcgtgagaggcgccctgggcgccaccccccagctgatggccgtgttcggcagcctgagcctgtacgccctgggcaccaagagaccctgcggcagatggcccggctgcgtgggcagaaccagcatgagcaccggcagcagcagcagaagcagaaccaccagcggcgactag

SEQ ID NO: 99533 - DNA, 1539 bp, Artificial Sequence
  Description of Artificial Sequence: Synthetic coding sequence
atggagaacaaggaggccggcacccccccccccatccccagcagagagggcagactgcagcccaccctgctgctggccaccctgagcgccgccttcggcagcgccttccagtacggctacaacctgagcgtggtgaacaccccccacaaggtgttcaagagcttctacaacgagacctacttcgagagacacgccaccttcatggacggcaagctgatgctgctgctgtggagctgcaccgtgagcatgttccccctgggcggcctgctgggcagcctgctggtgggcctgctggtggacagctgcggcagaaagggcaccctgctgatcaacaacatcttcgccatcatccccgccatcctgatgggcgtgagcaaggtggccaaggccttcgagctgatcgtgttcagcagagtggtgctgggcgtgtgcgccggcatcagctacagcgccctgcccatgtacctgggcgagctggcccccaagaacctgagaggcatggtgggcaccatgaccgaggtgttcgtgatcgtgggcgtgttcctggcccagatcttcagcctgcaggccatcctgggcaaccccgccggctggcccgtgctgctggccctgaccggcgtgcccgccctgctgcagctgctgaccctgcccttcttccccgagagccccagatacagcctgatccagaagggcgacgaggccaccgccagacaggccctgagaagactgagaggccacaccgacatggaggccgagctggaggacatgagagccgaggccagagccgagagagccgagggccacctgagcgtgctgcacctgtgcgccctgagaagcctgagatggcagctgctgagcatcatcgtgctgatggccggccagcagctgagcggcatcaacgccatcaactactacgccgacaccatctacaccagcgccggcgtggaggccgcccacagccagtacgtgaccgtgggcagcggcgtggtgaacatcgtgatgaccatcaccagcgccgtgctggtggagagactgggcagaagacacctgctgctggccggctacggcatctgcggcagcgcctgcctggtgctgaccgtggtgctgctgttccagaacagagtgcccgagctgagctacctgggcatcatctgcgtgttcgcctacatcgccggccacagcatcggccccagccccgtgcccagcgtggtgagaaccgagatcttcctgcagagcagcagaagagccgccttcatggtggacggcgccgtgcactggctgaccaacttcatcatcggcttcctgttccccagcatccaggaggccatcggcgcctacagcttcatcatcttcgccggcatctgcctgctgaccgccatctacatctacgtggtgatccccgagaccaagggcaagaccttcgtggagatcaacagaatcttcgccaagagaaacagagtgaagctgcccgaggagaaggaggagaccatcgacgccggcccccccaccgccagccccgccaaggagaccagcttctag

SEQ ID NO: 99534 - DNA, 804 bp, Artificial Sequence
  Description of Artificial Sequence: Synthetic coding sequence
atgacctgcagcctgggcaaggtgtacatcagcgagatcgcctaccccgccgtgagaggcctgctgggcagctgcgtgcagctgatggtggtggtgggcatcctgctggcctacctggccggctgggtgctggagtggagatggctggccgtgctgggctgcgtgccccccagcctgatgctgctgctgatgtgcttcatgcccgagacccccagattcctgctgacccagcacagaagacaggaggccatggccgccctgagattcctgtggggcagcgagcagggctgggaggacccccccatcggcgccgagcagagcttccacctggccctgctgagacagcccggcatctacaagcccttcatcatcggcgtgagcctgatggccttccagcagctgagcggcgtgaacgccgtgatgttctacgccgagaccatcttcgaggaggccaagttcaaggacagcagcctggccagcgtggtggtgggcgtgatccaggtgctgttcaccgccgtggccgccctgatcatggacagagccggcagaagactgctgctggtgctgagcggcgtggtgatggtgttcagcaccagcgccttcggcgcctacttcaagctgacccagggcggccccggcaacagcagccacgtggccatcagcgcccccgtgagcgcccagcccgtggacgccagcgtgggcctggcctggctggccgtgggcagcatgtgcctgttcatcgccggcttcgccgtgggctggggccccatcccctggctgctgatgagcgagatcttcccctag

SEQ ID NO: 99535 - DNA, 645 bp, Artificial Sequence
  Description of Artificial Sequence: Synthetic coding sequence
atggccttccagcagctgagcggcgtgaacgccgtgatgttctacgccgagaccatcttcgaggaggccaagttcaaggacagcagcctggccagcgtggtggtgggcgtgatccaggtgctgttcaccgccgtggccgccctgatcatggacagagccggcagaagactgctgctggtgctgagcggcgtggtgatggtgttcagcaccagcgccttcggcgcctacttcaagctgacccagggcggccccggcaacagcagccacgtggccatcagcgcccccgtgagcgcccagcccgtggacgccagcgtgggcctggcctggctggccgtgggcagcatgtgcctgttcatcgccggcttcgccgtgggctggggccccatcccctggctgctgatgagcgagatcttccccctgcacgtgaagggcgtggccaccggcatctgcgtgctgaccaactggctgatggccttcctggtgaccaaggagttcagcagcctgatggaggtgctgagaccctacggcgccttctggctggccagcgccttctgcatcttcagcgtgctgttcaccctgttctgcgtgcccgagaccaagggcaagaccctggagcagatcaccgcccacttcgagggcagatag

SEQ ID NO: 99536 - DNA, 1236 bp, Artificial Sequence
  Description of Artificial Sequence: Synthetic coding sequence
atgacccccgaggaccccgaggagacccagcccctgctgggcccccccggcggcagcgcccccagaggcagaagagtgttcctggccgccttcgccgccgccctgggccccctgagcttcggcttcgccctgggctacagcagccccgccatccccagcctgcagagagccgccccccccgcccccagactggacgacgccgccgccagctggttcggcgccgtggtgaccctgggcgccgccgccggcggcgtgctgggcggctggctggtggacagagccggcagaaagctgagcctgctgctgtgcagcgtgcccttcgtggccggcttcgccgtgatcaccgccgcccaggacgtgtggatgctgctgggcggcagactgctgaccggcctggcctgcggcgtggccagcctggtggcccccgtgtacatcagcgagatcgcctaccccgccgtgagaggcctgctgggcagctgcgtgcagctgatggtggtggtgggcatcctgctggcctacctggccggctgggtgctggagtggagatggctggccgtgctgggctgcgtgccccccagcctgatgctgctgctgatgtgcttcatgcccgagacccccagattcctgctgacccagcacagaagacaggaggccatggccgccctgagattcctgtggggcagcgagcagggctgggaggacccccccatcggcgccgagcagagcttccacctggccctgctgagacagcccggcatctacaagcccttcatcatcggcgtgagcctgatggccttccagcagctgagcggcgtgaacgccgtgatgttctacgccgagaccatcttcgaggaggccaagttcaaggacagcagcctggccagcgtggtggtgggcgtgatccaggtgctgttcaccgccgtggccgccctgatcatggacagagccggcagaagactgctgctggtgctgagcggcgtggtgatggtgttcagcaccagcgccttcggcgcctacttcaagctgacccagggcggccccggcaacagcagccacgtggccatcagcgcccccgtgagcgcccagcccgtggacgccagcgtgggcctggcctggctggccgtgggcagcatgtgcctgttcatcgccggcggcccccaggccctgtggagcctgctggcctgcctgagattcctgcacctgcagtgccccttccacttcgtgctgtgcccctag

SEQ ID NO: 99537 - DNA, 1434 bp, Artificial Sequence
  Description of Artificial Sequence: Synthetic coding sequence
atgacccccgaggaccccgaggagacccagcccctgctgggcccccccggcggcagcgcccccagaggcagaagagtgttcctggccgccttcgccgccgccctgggccccctgagcttcggcttcgccctgggctacagcagccccgccatccccagcctgcagagagccgccccccccgcccccagactggacgacgccgccgccagctggttcggcgccgtggtgaccctgggcgccgccgccggcggcgtgctgggcggctggctggtggacagagccggcagaaagctgagcctgctgctgtgcagcgtgcccttcgtggccggcttcgccgtgatcaccgccgcccaggacgtgtggatgctgctgggcggcagactgctgaccggcctggcctgcggcgtggccagcctggtggcccccgtgtacatcagcgagatcgcctaccccgccgtgagaggcctgctgggcagctgcgtgcagctgatggtggtggtgggcatcctgctggcctacctggccggctgggtgctggagtggagatggctggccgtgctgggctgcgtgccccccagcctgatgctgctgctgatgtgcttcatgcccgagacccccagattcctgctgacccagcacagaagacaggaggccatggccgccctgagattcctgtggggcagcgagcagggctgggaggacccccccatcggcgccgagcagagcttccacctggccctgctgagacagcccggcatctacaagcccttcatcatcggcgtgagcctgatggccttccagcagctgagcggcgtgaacgccgtgatgttctacgccgagaccatcttcgaggaggccaagttcaaggacagcagcctggccagcgtggtggtgggcgtgatccaggtgctgttcaccgccgtggccgccctgatcatggacagagccggcagaagactgctgctggtgctgagcggcgtggtgatggtgttcagcaccagcgccttcggcgcctacttcaagctgacccagggcggccccggcaacagcagccacgtggccatcagcgcccccgtgagcgcccagcccgtggacgccagcgtgggcctggcctggctggccgtgggcagcatgtgcctgttcatcgccggcttcgccgtgggctggggccccatcccctggctgctgatgagcgagatcttccccctgcacgtgaagggcgtggccaccggcatctgcgtgctgaccaactggctgatggccttcctggtgaccaaggagttcagcagcctgatggaggtgctgagaccctacggcgccttctggctggccagcgccttctgcatcttcagcgtgctgttcaccctgttctgcgtgcccgagaccaagggcaagaccctggagcagatcaccgcccacttcgagggcagatag

SEQ ID NO: 99538 - DNA, 510 bp, Artificial Sequence
  Description of Artificial Sequence: Synthetic coding sequence
tgaggcagaagagtgttcctggccgccttcgccgccgccctgggccccctgagcttcggcttcgccctgggctacagcagccccgccatccccagcctgcagagagccgccccccccgcccccagactggacgacgccgccgccagctggttcggcgtgtacatcagcgagatcgcctaccccgccgtgagaggcctgctgggcagctgcgtgcagctgatggtggtggtgggcatcctgctggcctacctggccggctgggtgctggagtggagatggctggccgtgctgggctgcgtgccccccagcctgatgctgctgctgatgtgcttcatgcccgagacccccagattcctgctgacccagcacagaagacaggaggccatggccgccctgagattcctgtggggcagcgagcagggctgggaggacccccccatcggcgccgagcagcagctgagcggcgtgaacgccgtgatgttctacgccgagaccatcttcgaggagtag

SEQ ID NO: 99539 - DNA, 771 bp, Artificial Sequence
  Description of Artificial Sequence: Synthetic coding sequence
atgacccccgaggaccccgaggagacccagcccctgctgggcccccccggcggcagcgcccccagaggcagaagagtgttcctggccgccttcgccgccgccctgggccccctgagcttcggcttcgccctgggctacagcagccccgccatccccagcctgcagagagccgccccccccgcccccagactggacgacgccgccgccagctggttcggcgtgtacatcagcgagatcgcctaccccgccgtgagaggcctgctgggcagctgcgtgcagctgatggtggtggtgggcatcctgctggcctacctggccggctgggtgctggagtggagatggctggccgtgctgggctgcgtgccccccagcctgatgctgctgctgatgtgcttcatgcccgagacccccagattcctgctgacccagcacagaagacaggaggccatggccgccctgagattcctgtggggcagcgagcagggctgggaggacccccccatcggcgccgagcagagcttccacctggccctgctgagacagcccggcatctacaagcccttcatcatcggcgtgagcctgatggccttccagcagctgagcggcgtgaacgccgtgatgttctacgccgagaccatcttcgaggaggccaagttcaaggacagcagcctggccagcgtggtggtgggcgtgatccaggtgctgttcaccgccgtggccgccctgatcatggacagagccggcagaagactgctgctggtgctgagctag

SEQ ID NO: 99540 - DNA, 804 bp, Artificial Sequence; identical to SEQ ID NO: 99534
  Description of Artificial Sequence: Synthetic coding sequence

SEQ ID NO: 99541 - DNA, 831 bp, Artificial Sequence
  Description of Artificial Sequence: Synthetic coding sequence
cagctgatggtggtggtgggcatcctgctggcctacctggccggctgggtgctggagtggagatggctggccgtgctgggctgcgtgccccccagcctgatgctgctgctgatgtgcttcatgcccgagacccccagattcctgctgacccagcacagaagacaggaggccatggccgccctgagattcctgtggggcagcgagcagggctgggaggacccccccatcggcgccgagcagagcttccacctggccctgctgagacagcccggcatctacaagcccttcatcatcggcgtgagcctgatggccttccagcagctgagcggcgtgaacgccgtgatgttctacgccgagaccatcttcgaggaggccaagttcaaggacagcagcctggccagcgtggtggtgggcgtgatccaggtgctgttcaccgccgtggccgccctgatcatggacagagccggcagaagactgctgctggtgctgagcggcgtggtgatggtgttcagcaccagcgccttcggcgcctacttcaagctgacccagggcggccccggcaacagcagccacgtggccatcagcgcccccgtgagcgcccagcccgtggacgccagcgtgggcctggcctggctggccgtgggcagcatgtgcctgttcatcgccggcttcgccgtgggctggggccccatcccctggctgctgatgagcgagatcttccccctgcacgtgaagggcgtggccaccggcatctgcgtgctgaccaactggctgatggccttcctggtgaccaaggagttcagcagcctgatgctgctgctgctgctgtag

SEQ ID NO: 99542 - DNA, 726 bp, Artificial Sequence
  Description of Artificial Sequence: Synthetic coding sequence
atgacctgcagcctgggcaaggtgtacatcagcgagatcgcctaccccgccgtgagaggcctgctgggcagctgcgtgcagctgatggtggtggtgggcatcctgctggcctacctggccggctgggtgctggagtggagatggctggccgtgctgggctgcgtgccccccagcctgatgctgctgctgatgtgcttcatgcccgagacccccagattcctgctgacccagcacagaagacaggaggccatggccgccctgagattcctgtggggcagcgagcagggctgggaggacccccccatcggcgccgagcagcagctgagcggcgtgaacgccgtgatgttctacgccgagaccatcttcgaggaggccaagttcaaggacagcagcctggccagcgtggtggtgggcgtgatccaggtgctgttcaccgccgtggccgccctgatcatggacagagccggcagaagactgctgctggtgctgagcggcgtggtgatggtgttcagcaccagcgccttcggcgcctacttcaagctgacccagggcggccccggcaacagcagccacgtggccatcagcgcccccgtgagcgcccagcccgtggacgccagcgtgggcctggcctggctggccgtgggcagcatgtgcctgttcatcgccggcttcgccgtgggctggggccccatcccctggctgctgatgagcgagatcttcccctag

SEQ ID NO: 99543 - DNA, 798 bp, Artificial Sequence
  Description of Artificial Sequence: Synthetic coding sequence
atggtggtggtgggcatcctgctggcctacctggccggctgggtgctggagtggagatggctggccgtgctgggctgcgtgccccccagcctgatgctgctgctgatgtgcttcatgcccgagacccccagattcctgctgacccagcacagaagacaggaggccatggccgccctgagattcctgtggggcagcgagcagggctgggaggacccccccatcggcgccgagcagagcttccacctggccctgctgagacagcccggcatctacaagcccttcatcatcggcgtgagcctgatggccttccagcagctgagcggcgtgaacgccgtgatgttctacgccgagaccatcttcgaggaggccaagttcaaggacagcagcctggccagcgtggtggtgggcgtgatccaggtgctgttcaccgccgtggccgccctgatcatggacagagccggcagaagactgctgctggtgctgagcggcgtggtgatggtgttcagcaccagcgccttcggcgcctacttcaagctgacccagggcggccccggcaacagcagccacgtggccatcagcgcccccgtgagcgcccagcccgtggacgccagcgtgggcctggcctggctggccgtgggcagcatgtgcctgttcatcgccggcttcgccgtgggctggggccccatcccctggctgctgatgagcgagatcttccccctgcacgtgaagggcgtggccaccggcatctgcgtgctgaccaactggctgatggccttcctggtgaccaaggagttctag

SEQ ID NO: 99544 - DNA, 1623 bp, Artificial Sequence
  Description of Artificial Sequence: Synthetic coding sequence
atggccagaaagcagaacagaaacagcaaggagctgggcctggtgcccctgaccgacgacaccagccacgccggcccccccggccccggcagagccctgctggagtgcgaccacctgagaagcggcgtgcccggcggcagaagaagaaaggactggagctgcagcctgctggtggccagcctggccggcgccttcggcagcagcttcctgtacggctacaacctgagcgtggtgaacgcccccaccccctacatcaaggccttctacaacgagagctgggagagaagacacggcagacccatcgaccccgacaccctgaccctgctgtggagcgtgaccgtgagcatcttcgccatcggcggcctggtgggcaccctgatcgtgaagatgatcggcaaggtgctgggcagaaagcacaccctgctggccaacaacggcttcgccatcagcgccgccctgctgatggcctgcagcctgcaggccggcgccttcgagatgctgatcgtgggcagattcatcatgggcatcgacggcggcgtggccctgagcgtgctgcccatgtacctgagcgagatcagccccaaggagatcagaggcagcctgggccaggtgaccgccatcttcatctgcatcggcgtgttcaccggccagctgctgggcctgcccgagctgctgggcaaggagagcacctggccctacctgttcggcgtgatcgtggtgcccgccgtggtgcagctgctgagcctgcccttcctgcccgacagccccagatacctgctgctggagaagcacaacgaggccagagccgtgaaggccttccagaccttcctgggcaaggccgacgtgagccaggaggtggaggaggtgctggccgagagcagagtgcagagaagcatcagactggtgagcgtgctggagctgctgagagccccctacgtgagatggcaggtggtgaccgtgatcgtgaccatggcctgctaccagctgtgcggcctgaacgccatctggttctacaccaacagcatcttcggcaaggccggcatcccccccgccaagatcccctacgtgaccctgagcaccggcggcatcgagaccctggccgccgtgttcagcggcctggtgatcgagcacctgggcagaagacccctgctgatcggcggcttcggcctgatgggcctgttcttcggcaccctgaccatcaccctgaccctgcaggaccacgccccctgggtgccctacctgagcatcgtgggcatcctggccatcatcgccagcttctgcagcggccccggcggcatccccttcatcctgaccggcgagttcttccagcagagccagagacccgccgccttcatcatcgccggcaccgtgaactggctgagcaacttcgccgtgggcctgctgttccccttcatccagaagagcctggacacctactgcttcctggtgttcgccaccatctgcatcaccggcgccatctacctgtacttcgtgctgcccgagaccaagaacagaacctacgccgagatcagccaggccttcagcaagagaaacaaggcctacccccccgaggagaagatcgacagcgccgtgaccgacggcaagatcaacggcagaccctag

SEQ ID NO: 99545 - DNA, 1536 bp, Artificial Sequence
  Description of Artificial Sequence: Synthetic coding sequence
atgaagctgagcaagaaggacagaggcgaggacgaggagagcgacagcgccaagaagaagctggactggagctgcagcctgctggtggccagcctggccggcgccttcggcagcagcttcctgtacggctacaacctgagcgtggtgaacgcccccaccccctacatcaaggccttctacaacgagagctgggagagaagacacggcagacccatcgaccccgacaccctgaccctgctgtggagcgtgaccgtgagcatcttcgccatcggcggcctggtgggcaccctgatcgtgaagatgatcggcaaggtgctgggcagaaagcacaccctgctggccaacaacggcttcgccatcagcgccgccctgctgatggcctgcagcctgcaggccggcgccttcgagatgctgatcgtgggcagattcatcatgggcatcgacggcggcgtggccctgagcgtgctgcccatgtacctgagcgagatcagccccaaggagatcagaggcagcctgggccaggtgaccgccatcttcatctgcatcggcgtgttcaccggccagctgctgggcctgcccgagctgctgggcaaggagagcacctggccctacctgttcggcgtgatcgtggtgcccgccgtggtgcagctgctgagcctgcccttcctgcccgacagccccagatacctgctgctggagaagcacaacgaggccagagccgtgaaggccttccagaccttcctgggcaaggccgacgtgagccaggaggtggaggaggtgctggccgagagcagagtgcagagaagcatcagactggtgagcgtgctggagctgctgagagccccctacgtgagatggcaggtggtgaccgtgatcgtgaccatggcctgctaccagctgtgcggcctgaacgccatctggttctacaccaacagcatcttcggcaaggccggcatcccccccgccaagatcccctacgtgaccctgagcaccggcggcatcgagaccctggccgccgtgttcagcggcctggtgatcgagcacctgggcagaagacccctgctgatcggcggcttcggcctgatgggcctgttcttcggcaccctgaccatcaccctgaccctgcaggaccacgccccctgggtgccctacctgagcatcgtgggcatcctggccatcatcgccagcttctgcagcggccccggcggcatccccttcatcctgaccggcgagttcttccagcagagccagagacccgccgccttcatcatcgccggcaccgtgaactggctgagcaacttcgccgtgggcctgctgttccccttcatccagaagagcctggacacctactgcttcctggtgttcgccaccatctgcatcaccggcgccatctacctgtacttcgtgctgcccgagaccaagaacagaacctacgccgagatcagccaggccttcagcaagagaaacaaggcctacccccccgaggagaagatcgacagcgccgtgaccgacggcaagatcaacggcagaccctag

SEQ ID NO: 99546 - DNA, 1536 bp, Artificial Sequence; identical to SEQ ID NO: 99545
  Description of Artificial Sequence: Synthetic coding sequence

SEQ ID NO: 99547 - DNA, 597 bp, Artificial Sequence
  Description of Artificial Sequence: Synthetic coding sequence
atgaagctgagcaagaaggacagaggcgaggacgaggagagcgacagcgccaagaagaagctggactggagctgcagcctgctggtggccagcctggccggcgccttcggcagcagcttcctgtacggctacaacctgagcgtggtgaacgcccccaccccctacatcaaggccttctacaacgagagctgggagagaagacacggcagacccatcgaccccgacaccctgaccctgctgtggagcgtgaccgtgagcatcttcgccatcggcggcctggtgggcaccctgatcgtgaagatgatcggcaaggtgctgggcagaaagcacaccctgctggccaacaacggcttcgccatcagcgccgccctgctgatggcctgcagcctgcaggccggcgccttcgagatgctgatcgtgggcagattcatcatgggcatcgacggcggcgtggccctgagcgtgctgcccatgtacctgagcgagatcagccccaaggagatcagaggcagcctgggccaggtgaccgccatcttcatctgcatcggcgtgttcaccggccagctgctgggcctgcccgagctgctgggcaagtag

SEQ ID NO: 99548 - DNA, 735 bp, Artificial Sequence
  Description of Artificial Sequence: Synthetic coding sequence
atggagcagcaggaccagagcatgaaggagggcagactgaccctggtgctggccctggccaccctgatcgccgccttcggcagcagcttccagtacggctacaacgtggccgccgtgaacagccccgccctgctgatgcagcagttctacaacgagacctactacggcagaaccggcgagttcatggaggacttccccctgaccctgctgtggagcgtgaccgtgagcatgttccccttcggcggcttcatcggcagcctgctggtgggccccctggtgaacaagttcggcagaaagggcgccctgctgttcaacaacatcttcagcatcgtgcccgccatcctgatgggctgcagcagagtggccaccagcttcgagctgatcatcatcagcagactgctggtgggcatctgcgccggcgtgagcagcaacgtggtgcccatgtacctgggcgagctggcccccaagaacctgagaggcgccctgggcgtggtgccccagctgttcatcaccgtgggcatcctggtggcccagatcttcggcctgagaaacctgctggccaacgtggacggcgagttcagaaccagcagagagcacccccaccccttcaccaccaccctgggccccctgctggtgttccagagccaccaccacagaaccggcctgagcgccgactggagcctgctgaccggctggatgagcctgggcggccccagctgccccgagcccacctag

SEQ ID NO: 99549 - DNA, 1506 bp, Artificial Sequence
  Description of Artificial Sequence: Synthetic coding sequence
atggagcagcaggaccagagcatgaaggagggcagactgaccctggtgctggccctggccaccctgatcgccgccttcggcagcagcttccagtacggctacaacgtggccgccgtgaacagccccgccctgctgatgcagcagttctacaacgagacctactacggcagaaccggcgagttcatggaggacttccccctgaccctgctgtggagcgtgaccgtgagcatgttccccttcggcggcttcatcggcagcctgctggtgggccccctggtgaacaagttcggcagaaagggcgccctgctgttcaacaacatcttcagcatcgtgcccgccatcctgatgggctgcagcagagtggccaccagcttcgagctgatcatcatcagcagactgctggtgggcatctgcgccggcgtgagcagcaacgtggtgcccatgtacctgggcgagctggcccccaagaacctgagaggcgccctgggcgtggtgccccagctgttcatcaccgtgggcatcctggtggcccagatcttcggcctgagaaacctgctggccaacgtggacggctggcccatcctgctgggcctgaccggcgtgcccgccgccctgcagctgctgctgctgcccttcttccccgagagccccagatacctgctgatccagaagaaggacgaggccgccgccaagaaggccctgcagaccctgagaggctgggacagcgtggacagagaggtggccgagatcagacaggaggacgaggccgagaaggccgccggcttcatcagcgtgctgaagctgttcagaatgagaagcctgagatggcagctgctgagcatcatcgtgctgatgggcggccagcagctgagcggcgtgaacgccatctactactacgccgaccagatctacctgagcgccggcgtgcccgaggagcacgtgcagtacgtgaccgccggcaccggcgccgtgaacgtggtgatgaccttctgcgccgtgttcgtggtggagctgctgggcagaagactgctgctgctgctgggcttcagcatctgcctgatcgcctgctgcgtgctgaccgccgccctggccctgcaggacaccgtgagctggatgccctacatcagcatcgtgtgcgtgatcagctacgtgatcggccacgccctgggccccagccccatccccgccctgctgatcaccgagatcttcctgcagagcagcagacccagcgccttcatggtgggcggcagcgtgcactggctgagcaacttcaccgtgggcctgatcttccccttcatccaggagggcctgggcccctacagcttcatcgtgttcgccgtgatctgcctgctgaccaccatctacatcttcctgatcgtgcccgagaccaaggccaagaccttcatcgagatcaaccagatcttcaccaagatgaacaaggtgagcgaggtgtaccccgagaaggaggagctgaaggagctgccccccgtgaccagcgagcagtag

SEQ ID NO: 99550 - DNA, 1455 bp, Artificial Sequence
  Description of Artificial Sequence: Synthetic coding sequence
atggagcagcaggaccagagcatgaaggagggcagactgaccctggtgctggccctggccgccgtgaacagccccgccctgctgatgcagcagttctacaacgagacctactacggcagaaccggcgagttcatggaggacttccccctgaccctgctgtggagcgtgaccgtgagcatgttccccttcggcggcttcatcggcagcctgctggtgggccccctggtgaacaagttcggcagaaagggcgccctgctgttcaacaacatcttcagcatcgtgcccgccatcctgatgggctgcagcagagtggccaccagcttcgagctgatcatcatcagcagactgctggtgggcatctgcgccggcgtgagcagcaacgtggtgcccatgtacctgggcgagctggcccccaagaacctgagaggcgccctgggcgtggtgccccagctgttcatcaccgtgggcatcctggtggcccagatcttcggcctgagaaacctgctggccaacgtggacggctggcccatcctgctgggcctgaccggcgtgcccgccgccctgcagctgctgctgctgcccttcttccccgagagccccagatacctgctgatccagaagaaggacgaggccgccgccaagaaggccctgcagaccctgagaggctgggacagcgtggacagagaggtggccgagatcagacaggaggacgaggccgagaaggccgccggcttcatcagcgtgctgaagctgttcagaatgagaagcctgagatggcagctgctgagcatcatcgtgctgatgggcggccagcagctgagcggcgtgaacgccatctactactacgccgaccagatctacctgagcgccggcgtgcccgaggagcacgtgcagtacgtgaccgccggcaccggcgccgtgaacgtggtgatgaccttctgcgccgtgttcgtggtggagctgctgggcagaagactgctgctgctgctgggcttcagcatctgcctgatcgcctgctgcgtgctgaccgccgccctggccctgcaggacaccgtgagctggatgccctacatcagcatcgtgtgcgtgatcagctacgtgatcggccacgccctgggccccagccccatccccgccctgctgatcaccgagatcttcctgcagagcagcagacccagcgccttcatggtgggcggcagcgtgcactggctgagcaacttcaccgtgggcctgatcttccccttcatccaggagggcctgggcccctacagcttcatcgtgttcgccgtgatctgcctgctgaccaccatctacatcttcctgatcgtgcccgagaccaaggccaagaccttcatcgagatcaaccagatcttcaccaagatgaacaaggtgagcgaggtgtaccccgagaaggaggagctgaaggagctgccccccgtgaccagcgagcagtag

SEQ ID NO: 99551 - DNA, 1161 bp, Artificial Sequence
  Description of Artificial Sequence: Synthetic coding sequence
atgggctgcagcagagtggccaccagcttcgagctgatcatcatcagcagactgctggtgggcatctgcgccggcgtgagcagcaacgtggtgcccatgtacctgggcgagctggcccccaagaacctgagaggcgccctgggcgtggtgccccagctgttcatcaccgtgggcatcctggtggcccagatcttcggcctgagaaacctgctggccaacgtggacggctggcccatcctgctgggcctgaccggcgtgcccgccgccctgcagctgctgctgctgcccttcttccccgagagccccagatacctgctgatccagaagaaggacgaggccgccgccaagaaggccctgcagaccctgagaggctgggacagcgtggacagagaggtggccgagatcagacaggaggacgaggccgagaaggccgccggcttcatcagcgtgctgaagctgttcagaatgagaagcctgagatggcagctgctgagcatcatcgtgctgatgggcggccagcagctgagcggcgtgaacgccatctactactacgccgaccagatctacctgagcgccggcgtgcccgaggagcacgtgcagtacgtgaccgccggcaccggcgccgtgaacgtggtgatgaccttctgcgccgtgttcgtggtggagctgctgggcagaagactgctgctgctgctgggcttcagcatctgcctgatcgcctgctgcgtgctgaccgccgccctggccctgcaggacaccgtgagctggatgccctacatcagcatcgtgtgcgtgatcagctacgtgatcggccacgccctgggccccagccccatccccgccctgctgatcaccgagatcttcctgcagagcagcagacccagcgccttcatggtgggcggcagcgtgcactggctgagcaacttcaccgtgggcctgatcttccccttcatccaggagggcctgggcccctacagcttcatcgtgttcgccgtgatctgcctgctgaccaccatctacatcttcctgatcgtgcccgagaccaaggccaagaccttcatcgagatcaaccagatcttcaccaagatgaacaaggtgagcgaggtgtaccccgagaaggaggagctgaaggagctgccccccgtgaccagcgagcagtag

SEQ ID NO: 99552 - DNA, 1329 bp, Artificial Sequence
  Description of Artificial Sequence: Synthetic coding sequence
atgctggagctgcacagcctgaccgccagcagcatcatgagagtgctgatcatgagagcccccctgagagaggccccccccgagaagttcgccctgctgctgagcggcagccccggcaagggcgccctgctgttcaacaacatcttcagcatcgtgcccgccatcctgatgggctgcagcagagtggccaccagcttcgagctgatcatcatcagcagactgctggtgggcatctgcgccggcgtgagcagcaacgtggtgcccatgtacctgggcgagctggcccccaagaacctgagaggcgccctgggcgtggtgccccagctgttcatcaccgtgggcatcctggtggcccagatcttcggcctgagaaacctgctggccaacgtggacggctggcccatcctgctgggcctgaccggcgtgcccgccgccctgcagctgctgctgctgcccttcttccccgagagccccagatacctgctgatccagaagaaggacgaggccgccgccaagaaggccctgcagaccctgagaggctgggacagcgtggacagagaggtggccgagatcagacaggaggacgaggccgagaaggccgccggcttcatcagcgtgctgaagctgttcagaatgagaagcctgagatggcagctgctgagcatcatcgtgctgatgggcggccagcagctgagcggcgtgaacgccatctactactacgccgaccagatctacctgagcgccggcgtgcccgaggagcacgtgcagtacgtgaccgccggcaccggcgccgtgaacgtggtgatgaccttctgcgccgtgttcgtggtggagctgctgggcagaagactgctgctgctgctgggcttcagcatctgcctgatcgcctgctgcgtgctgaccgccgccctggccctgcaggacaccgtgagctggatgccctacatcagcatcgtgtgcgtgatcagctacgtgatcggccacgccctgggccccagccccatccccgccctgctgatcaccgagatcttcctgcagagcagcagacccagcgccttcatggtgggcggcagcgtgcactggctgagcaacttcaccgtgggcctgatcttccccttcatccaggagggcctgggcccctacagcttcatcgtgttcgccgtgatctgcctgctgaccaccatctacatcttcctgatcgtgcccgagaccaaggccaagaccttcatcgagatcaaccagatcttcaccaagatgaacaaggtgagcgaggtgtaccccgagaaggaggagctgaaggagctgccccccgtgaccagcgagcagtag

SEQ ID NO: 99553 - DNA, 2040 bp, Artificial Sequence
  Description of Artificial Sequence: Synthetic coding sequence
atggccaccctgatcaccagcaccaccgccgccaccgccgccagcggccccctggtggactacctgtggatgctgatcctgggcttcatcatcgccttcgtgctggccttcagcgtgggcgccaacgacgtggccaacagcttcggcaccgccgtgggcagcggcgtggtgaccctgaagcaggcctgcatcctggccagcatcttcgagaccgtgggcagcgtgctgctgggcgccaaggtgagcgagaccatcagaaagggcctgatcgacgtggagatgtacaacagcacccagggcctgctgatggccggcagcgtgagcgccatgttcggcagcgccgtgtggcagctggtggccagcttcctgaagctgcccatcagcggcacccactgcatcgtgggcgccaccatcggcttcagcctggtggccaagggccaggagggcgtgaagtggagcgagctgatcaagatcgtgatgagctggttcgtgagccccctgctgagcggcatcatgagcggcatcctgttcttcctggtgagagccttcatcctgcacaaggccgaccccgtgcccaacggcctgagagccctgcccgtgttctacgcctgcaccgtgggcatcaacctgttcagcatcatgtacaccggcgcccccctgctgggcttcgacaagctgcccctgtggggcaccatcctgatcagcgtgggctgcgccgtgttctgcgccctgatcgtgtggttcttcgtgtgccccagaatgaagagaaagatcgagagagagatcaagtgcagccccagcgagagccccctgatggagaagaagaacagcctgaaggaggaccacgaggagaccaagctgagcgtgggcgacatcgagaacaagcaccccgtgagcgaggtgggccccgccaccgtgcccctgcaggccgtggtggaggagagaaccgtgagcttcaagctgggcgacctggaggaggcccccgagagagagagactgcccagcgtggacctgaaggaggagaccagcatcgacagcaccgtgaacggcgccgtgcagctgcccaacggcaacctggtgcagttcagccaggccgtgagcaaccagatcaacagcagcggccactaccagtaccacaccgtgcacaaggacagcggcctgtacaaggagctgctgcacaagctgcacctggccaaggtgggcgactgcatgggcgacagcggcgacaagcccctgagaagaaacaacagctacaccagctacaccatggccatctgcggcatgcccctggacagcttcagagccaaggagggcgagcagaagggcgaggagatggagaagctgacctggcccaacgccgacagcaagaagagaatcagaatggacagctacaccagctactgcaacgccgtgagcgacctgcacagcgccagcgagatcgacatgagcgtgaaggccgagatgggcctgggcgacagaaagggcagcaacggcagcctggaggagtggtacgaccaggacaagcccgaggtgagcctgctgttccagttcctgcagatcctgaccgcctgcttcggcagcttcgcccacggcggcaacgacgtgagcaacgccatcggccccctggtggccctgtacctggtgtacgacaccggcgacgtgagcagcaaggtggccacccccatctggctgctgctgtacggcggcgtgggcatctgcgtgggcctgtgggtgtggggcagaagagtgatccagaccatgggcaaggacctgacccccatcacccccagcagcggcttcagcatcgagctggccagcgccctgaccgtggtgatcgccagcaacatcggcctgcccatcagcaccacccactgcaaggtgggcagcgtggtgagcgtgggctggctgagaagcaagaaggccgtggactggagactgttcagaaacatcttcatggcctggttcgtgaccgtgcccatcagcggcgtgatcagcgccgccatcatggccatcttcagatacgtgatcctgagaatgtag

SEQ ID NO: 99554 - DNA, 1137 bp, Artificial Sequence
  Description of Artificial Sequence: Synthetic coding sequence
atgggcaaccccagcgtgcccagaggcggcttcacccagtactgcagaggcctgctgccctggggcttccaggacgcccccttctacctgctggtgctgggcttcgacaagctgcccctgtggggcaccatcctgatcagcgtgggctgcgccgtgttctgcgccctgatcgtgtggttcttcgtgtgccccagaatgaagagaaagatcgagagagagatcaagtgcagccccagcgagagccccctgatggagaagaagaacagcctgaaggaggaccacgaggagaccaagctgagcgtgggcgacatcgagaacaagcaccccgtgagcgaggtgggccccgccaccgtgcccctgcaggccgtggtggaggagagaaccgtgagcttcaagctgggcgacctggaggaggcccccgagagagagagactgcccagcgtggacctgaaggaggagaccagcatcgacagcaccgtgaacggcgccgtgcagctgcccaacggcaacctggtgcagttcagccaggccgtgagcaaccagatcaacagcagcggccactaccagtaccacaccgtgcacaaggacagcggcctgtacaaggagctgctgcacaagctgcacctggccaaggtgggcgactgcatgggcgacagcggcgacaagcccctgagaagaaacaacagctacaccagctacaccatggccatctgcggcatgcccctggacagcttcagagccaaggagggcgagcagaagggcgaggagatggagaagctgacctggcccaacgccgacagcaagaagagaatcagaatggacagctacaccagctactgcaacgccgtgagcgacctgcacagcgccagcgagatcgacatgagcgtgaaggccgagatgggcctgggcgacagaaagggcagcaacggcagcctggaggagtggtacgaccaggacaagcccgaggtgagcctgctgttccagttcctgcagatcctgaccgcctgcttcggcagcttcgcccacggcggcaacgacgtgagcaacgccatcggccccctggtggccctgtacctggtgtacgacaccggcgacgtgagcagcaaggtggccacccccatctggctgctgtgctag

SEQ ID NO: 99555 - DNA, 1959 bp, Artificial Sequence
  Description of Artificial Sequence: Synthetic coding sequence
atggccatggacgagtacctgtggatggtgatcctgggcttcatcatcgccttcatcctggccttcagcgtgggcgccaacgacgtggccaacagcttcggcaccgccgtgggcagcggcgtggtgaccctgagacaggcctgcatcctggccagcatcttcgagaccaccggcagcgtgctgctgggcgccaaggtgggcgagaccatcagaaagggcatcatcgacgtgaacctgtacaacgagaccgtggagaccctgatggccggcgaggtgagcgccatggtgggcagcgccgtgtggcagctgatcgccagcttcctgagactgcccatcagcggcacccactgcatcgtgggcagcaccatcggcttcagcctggtggccatcggcaccaagggcgtgcagtggatggagctggtgaagatcgtggccagctggttcatcagccccctgctgagcggcttcatgagcggcctgctgttcgtgctgatcagaatcttcatcctgaagaaggaggaccccgtgcccaacggcctgagagccctgcccgtgttctacgccgccaccatcgccatcaacgtgttcagcatcatgtacaccggcgcccccgtgctgggcctggtgctgcccatgtgggccatcgccctgatcagcttcggcgtggccctgctgttcgccttcttcgtgtggctgttcgtgtgcccctggatgagaagaaagatcaccggcaagctgcagaaggagggcgccctgagcagagtgagcgacgagagcctgagcaaggtgcaggaggccgagagccccgtgttcaaggagctgcccggcgccaaggccaacgacgacagcaccatccccctgaccggcgccgccggcgagaccctgggcaccagcgagggcaccagcgccggcagccaccccagagccgcctacggcagagccctgagcatgacccacggcagcgtgaagagccccatcagcaacggcaccttcggcttcgacggccacaccagaagcgacggccacgtgtaccacaccgtgcacaaggacagcggcctgtacaaggacctgctgcacaagatccacatcgacagaggccccgaggagaagcccgcccaggagagcaactacagactgctgagaagaaacaacagctacacctgctacaccgccgccatctgcggcctgcccgtgcacgccaccttcagagccgccgacagcagcgcccccgaggacagcgagaagctggtgggcgacaccgtgagctacagcaagaagagactgagatacgacagctacagcagctactgcaacgccgtggccgaggccgagatcgaggccgaggagggcggcgtggagatgaagctggccagcgagctggccgaccccgaccagcccagagaggaccccgccgaggaggagaaggaggagaaggacgcccccgaggtgcacctgctgttccacttcctgcaggtgctgaccgcctgcttcggcagcttcgcccacggcggcaacgacgtgagcaacgccatcggccccctggtggccctgtggctgatctacaagcagggcggcgtgacccaggaggccgccacccccgtgtggctgctgttctacggcggcgtgggcatctgcaccggcctgtgggtgtggggcagaagagtgatccagaccatgggcaaggacctgacccccatcacccccagcagcggcttcaccatcgagctggccagcgccttcaccgtggtgatcgccagcaacatcggcctgcccgtgagcaccacccactgcaaggtgggcagcgtggtggccgtgggctggatcagaagcagaaaggccgtggactggagactgttcagaaacatcttcgtggcctggttcgtgaccgtgcccgtggccggcctgttcagcgccgccgtgatggccctgctgatgtacggcatcctgccctacgtgtag

SEQ ID NO: 99556 - DNA, 216 bp, Artificial Sequence
  Description of Artificial Sequence: Synthetic coding sequence
atggccatggacgagtacctgtggatggtgatcctgggcttcatcatcgccttcatcctggccttcagcgtgggcgccaacgacgtggccaacagcttcggcaccgccgtgggcagcggcgtggtgaccctgagacaggcctgcatcctggccagcatcttcgagaccaccggcagcgtgctgctgggcgccaaggtgggcgagaccatcagatag

SEQ ID NO: 99557 - DNA, 87 bp, Artificial Sequence
  Description of Artificial Sequence: Synthetic coding sequence
atggccatggacgagtacctgtggatggtgatcctgggcttcatcatcgccttcatcctggccttcagcgtgggcgccaacgactag

SEQ ID NO: 99558 - DNA, 237 bp, Artificial Sequence
  Description of Artificial Sequence: Synthetic coding sequence
atggccatggacgagtacctgtggatggtgatcctgggcttcatcatcgccttcatcctggccttcagcgtgggcgccaacgacgtggccaacagcttcggcaccgccgtgggcagcggcgtggtgaccctgagacaggcctgcatcctggccagcatcttcgagaccaccggcagcgtgctgctgggcgccaaggtgggcgagaccatcagaaagggcatcatcgacgtgaactag

SEQ ID NO: 99559 - DNA, 1959 bp, Artificial Sequence; identical to SEQ ID NO: 99555
  Description of Artificial Sequence: Synthetic coding sequence

SEQ ID NO: 99560 - DNA, 1959 bp, Artificial Sequence; identical to SEQ ID NO: 99555
  Description of Artificial Sequence: Synthetic coding sequence

SEQ ID NO: 99561 - DNA, 144 bp, Artificial Sequence
  Description of Artificial Sequence: Synthetic coding sequence
atggccatggacgagtacctgtggatggtgatcctgggcttcatcatcgccttcatcctggccttcagcgtgggcgccaacgacgtggccaacagcttcggcaccgccgtgggcagcggcgtggtgaccctgagacaggcctag

SEQ ID NO: 99562 - DNA, 1260 bp, Artificial Sequence
  Description of Artificial Sequence: Synthetic coding sequence
atggcccagagcatcttcatggccggcatcctgatcggcggcctggtgctgggcgacctgagcgacagattcggcagaagacccatcctgacctgcagctacctgctgctggccgccagcggcagcggcgccgccttcagccccaccttccccatctacatggtgttcagattcctgtgcggcttcggcatcagcggcatcaccctgagcaccgtgatcctgaacgtggagtgggtgcccaccagaatgagagccatcatgagcaccgccctgggctactgctacaccttcggccagttcatcctgcccggcctggcctacgccatcccccagtggagatggctgcagctgaccgtgagcatccccttcttcgtgttcttcctgagcagctggtggacccccgagagcatcagatggctggtgctgagcggcaagagcagcaaggccctgaagatcctgagaagagtggccgtgttcaacggcaagaaggaggagggcgagagactgagcctggaggagctgaagctgaacctgcagaaggagatcagcctggccaaggccaagtacaccgccagcgacctgttcagaatccccatgctgagaagaatgaccttctgcctgagcctggcctggttcgccaccggcttcgcctactacagcctggccatgggcgtggaggagttcggcgtgaacctgtacatcctgcagatcatcttcggcggcgtggacgtgcccgccaagttcatcaccatcctgagcctgagctacctgggcagacacaccacccaggccgccgccctgctgctggccggcggcgccatcctggccctgaccttcgtgcccctggacctgcagaccgtgagaaccgtgctggccgtgttcggcaagggctgcctgagcagcagcttcagctgcctgttcctgtacaccagcgagctgtaccccaccgtgatcagacagaccggcatgggcgtgagcaacctgtggaccagagtgggcagcatggtgagccccctggtgaagatcaccggcgaggtgcagcccttcatccccaacatcatctacggcatcaccgccctgctgggcggcagcgccgccctgttcctgcccgagaccctgaaccagcccctgcccgagaccatcgaggacctggagaactggagcctgagagccaagaagcccaagcaggagcccgaggtggagaaggccagccagagaatccccctgcagccccacggccccggcctgggcagcagctag

SEQ ID NO: 99563 - DNA, 1356 bp, Artificial Sequence
  Description of Artificial Sequence: Synthetic coding sequence
atggagccctgcctggacggctgggtgtacaacagcaccaaggacagcatcgtgaccgagtgggacctggtgtgcaacagcaacaagctgaaggagatggcccagagcatcttcatggccggcatcctgatcggcggcctggtgctgggcgacctgagcgacagattcggcagaagacccatcctgacctgcagctacctgctgctggccgccagcggcagcggcgccgccttcagccccaccttccccatctacatggtgttcagattcctgtgcggcttcggcatcagcggcatcaccctgagcaccgtgatcctgaacgtggagtgggtgcccaccagaatgagagccatcatgagcaccgccctgggctactgctacaccttcggccagttcatcctgcccggcctggcctacgccatcccccagtggagatggctgcagctgaccgtgagcatccccttcttcgtgttcttcctgagcagctggtggacccccgagagcatcagatggctggtgctgagcggcaagagcagcaaggccctgaagatcctgagaagagtggccgtgttcaacggcaagaaggaggagggcgagagactgagcctggaggagctgaagctgaacctgcagaaggagatcagcctggccaaggccaagtacaccgccagcgacctgttcagaatccccatgctgagaagaatgaccttctgcctgagcctggcctggttcgccaccggcttcgcctactacagcctggccatgggcgtggaggagttcggcgtgaacctgtacatcctgcagatcatcttcggcggcgtggacgtgcccgccaagttcatcaccatcctgagcctgagctacctgggcagacacaccacccaggccgccgccctgctgctggccggcggcgccatcctggccctgaccttcgtgcccctggacctgcagaccgtgagaaccgtgctggccgtgttcggcaagggctgcctgagcagcagcttcagctgcctgttcctgtacaccagcgagctgtaccccaccgtgatcagacagaccggcatgggcgtgagcaacctgtggaccagagtgggcagcatggtgagccccctggtgaagatcaccggcgaggtgcagcccttcatccccaacatcatctacggcatcaccgccctgctgggcggcagcgccgccctgttcctgcccgagaccctgaaccagcccctgcccgagaccatcgaggacctggagaactggagcctgagagccaagaagcccaagcaggagcccgaggtggagaaggccagccagagaatccccctgcagccccacggccccggcctgggcagcagctag

SEQ ID NO: 99564 - DNA, 1653 bp, Artificial Sequence
  Description of Artificial Sequence: Synthetic coding sequence
atggccttcaacgacctgctgcagcaggtgggcggcgtgggcagattccagcagatccaggtgaccctggtggtgctgcccctgctgctgatggccagccacaacaccctgcagaacttcaccgccgccatccccacccaccactgcagaccccccgccgacgccaacctgagcaagaacggcggcctggaggtgtggctgcccagagacagacagggccagcccgagagctgcctgagattcaccagcccccagtggggcctgcccttcctgaacggcaccgaggccaacggcaccggcgccaccgagccctgcaccgacggctggatctacgacaacagcaccttccccagcaccatcgtgaccgagtgggacctggtgtgcagccacagagccctgagacagctggcccagagcctgtacatggtgggcgtgctgctgggcgccatggtgttcggctacctggccgacagactgggcagaagaaaggtgctgatcctgaactacctgcagaccgccgtgagcggcacctgcgccgccttcgcccccaacttccccatctactgcgccttcagactgctgagcggcatggccctggccggcatcagcctgaactgcatgaccctgaacgtggagtggatgcccatccacaccagagcctgcgtgggcaccctgatcggctacgtgtacagcctgggccagttcctgctggccggcgtggcctacgccgtgccccactggagacacctgcagctgctggtgagcgcccccttcttcgccttcttcatctacagctggttcttcatcgagagcgccagatggcacagcagcagcggcagactggacctgaccctgagagccctgcagagagtggccagaatcaacggcaagagagaggagggcgccaagctgagcatggaggtgctgagagccagcctgcagaaggagctgaccatgggcaagggccaggccagcgccatggagctgctgagatgccccaccctgagacacctgttcctgtgcctgagcatgctgtggttcgccaccagcttcgcctactacggcctggtgatggacctgcagggcttcggcgtgagcatctacctgatccaggtgatcttcggcgccgtggacctgcccgccaagctggtgggcttcctggtgatcaacagcctgggcagaagacccgcccagatggccgccctgctgctggccggcatctgcatcctgctgaacggcgtgatcccccaggaccagagcatcgtgagaaccagcctggccgtgctgggcaagggctgcctggccgccagcttcaactgcatcttcctgtacaccggcgagctgtaccccaccatgatcagacagaccggcatgggcatgggcagcaccatggccagagtgggcagcatcgtgagccccctggtgagcatgaccgccgagctgtaccccagcatgcccctgttcatctacggcgccgtgcccgtggccgccagcgccgtgaccgtgctgctgcccgagaccctgggccagcccctgcccgacaccgtgcaggacctggagagcagaaagggcaagcagaccagacagcagcaggagcaccagaagtacatggtgcccctgcaggccagcgcccaggagaagaacggcctgtag

SEQ ID NO: 99565 - DNA, 1692 bp, Artificial Sequence
  Description of Artificial Sequence: Synthetic coding sequence
atggccttcaacgacctgctgcagcaggtgggcggcgtgggcagattccagcagatccaggtgaccctggtggtgctgcccctgctgctgatggccagccacaacaccctgcagaacttcaccgccgccatccccacccaccactgcagaccccccgccgacgccaacctgagcaagaacggcggcctggaggtgtggctgcccagagacagacagggccagcccgagagctgcctgagattcaccagcccccagtggggcctgcccttcctgaacggcaccgaggccaacggcaccggcgccaccgagccctgcaccgacggctggatctacgacaacagcaccttccccagcaccatcgtgaccgagtgggacctggtgtgcagccacagagccctgagacagctggcccagagcctgtacatggtgggcgtgctgctgggcgccatggtgttcggctacctggccgacagactgggcagaagaaaggtgctgatcctgaactacctgcagaccgccgtgagcggcacctgcgccgccttcgcccccaacttccccatctactgcgccttcagactgctgagcggcatggccctggccggcatcagcctgaactgcatgaccctgaacgtggagtggatgcccatccacaccagagcctgcgtgggcaccctgatcggctacgtgtacagcctgggccagttcctgctggccggcgtggcctacgccgtgccccactggagacacctgcagctgctggtgagcgcccccttcttcgccttcttcatctacagctggttcttcatcgagagcgccagatggcacagcagcagcggcagactggacctgaccctgagagccctgcagagagtggccagaatcaacggcaagagagaggagggcgccaagctgagcatggaggtgctgagagccagcctgcagaaggagctgaccatgggcaagggccaggccagcgccatggagctgctgagatgccccaccctgagacacctgttcctgtgcctgagcatgctgtggttcgccaccagcttcgcctactacggcctggtgatggacctgcagggcttcggcgtgagcatctacctgatccaggtgatcttcggcgccgtggacctgcccgccaagctggtgggcttcctggtgatcaacagcctgggcagaagacccgcccagatggccgccctgctgctggccggcatctgcatcctgctgaacggcgtgatcccccaggaccagagcatcgtgagaaccagcctggccgtgctgggcaagggctgcctggccgccagcttcaactgcatcttcctgtacaccggcgagctgtaccccaccatgatcagacagaccggcatgggcatgggcagcaccatggccagagtgggcagcatcgtgagccccctggtgagcatgaccgccgagctgtaccccagcatgcccctgttcatctacggcgccgtgcccgtggccgccagcgccgtgaccgtgctgctgcccgagaccctgggccagcccctgcccgacaccgtgcaggacctggagagcagatgggcccccacccagaaggaggccggcatctaccccagaaagggcaagcagaccagacagcagcaggagcaccagaagtacatggtgcccctgcaggccagcgcccaggagaagaacggcctgtag

SEQ ID NO: 99566 - DNA, 1590 bp, Artificial Sequence
  Description of Artificial Sequence: Synthetic coding sequence
atggccttcaacgacctgctgctgctgatggccagccacaacaccctgcagaacttcaccgccgccatccccacccaccactgcagaccccccgccgacgccaacctgagcaagaacggcggcctggaggtgtggctgcccagagacagacagggccagcccgagagctgcctgagattcaccagcccccagtggggcctgcccttcctgaacggcaccgaggccaacggcaccggcgccaccgagccctgcaccgacggctggatctacgacaacagcaccttccccagcaccatcgtgaccgagtgggacctggtgtgcagccacagagccctgagacagctggcccagagcctgtacatggtgggcgtgctgctgggcgccatggtgttcggctacctggccgacagactgggcagaagaaaggtgctgatcctgaactacctgcagaccgccgtgagcggcacctgcgccgccttcgcccccaacttccccatctactgcgccttcagactgctgagcggcatggccctggccggcatcagcctgaactgcatgaccctgaacgtggagtggatgcccatccacaccagagcctgcgtgggcaccctgatcggctacgtgtacagcctgggccagttcctgctggccggcgtggcctacgccgtgccccactggagacacctgcagctgctggtgagcgcccccttcttcgccttcttcatctacagctggttcttcatcgagagcgccagatggcacagcagcagcggcagactggacctgaccctgagagccctgcagagagtggccagaatcaacggcaagagagaggagggcgccaagctgagcatggaggtgctgagagccagcctgcagaaggagctgaccatgggcaagggccaggccagcgccatggagctgctgagatgccccaccctgagacacctgttcctgtgcctgagcatgctgtggttcgccaccagcttcgcctactacggcctggtgatggacctgcagggcttcggcgtgagcatctacctgatccaggtgatcttcggcgccgtggacctgcccgccaagctggtgggcttcctggtgatcaacagcctgggcagaagacccgcccagatggccgccctgctgctggccggcatctgcatcctgctgaacggcgtgatcccccaggaccagagcatcgtgagaaccagcctggccgtgctgggcaagggctgcctggccgccagcttcaactgcatcttcctgtacaccggcgagctgtaccccaccatgatcagacagaccggcatgggcatgggcagcaccatggccagagtgggcagcatcgtgagccccctggtgagcatgaccgccgagctgtaccccagcatgcccctgttcatctacggcgccgtgcccgtggccgccagcgccgtgaccgtgctgctgcccgagaccctgggccagcccctgcccgacaccgtgcaggacctggagagcagaaagggcaagcagaccagacagcagcaggagcaccagaagtacatggtgcccctgcaggccagcgcccaggagaagaacggcctgtag

SEQ ID NO: 99567 - DNA, 1560 bp, Artificial Sequence
  Description of Artificial Sequence: Synthetic coding sequence
atggccttcaacgacctgctgcagcaggtgggcggcgtgggcagattccagcagatccaggtgaccctggtggtgctgcccctgctgctgatggccagccacaacaccctgcagaacttcaccgccgccatccccacccaccactgcagaccccccgccgacgccaacctgagcaagaacggcggcctggaggtgtggctgcccagagacagacagggccagcccgagagctgcctgagattcaccagcccccagtggggcctgcccttcctgaacggcaccgaggccaacggcaccggcgccaccgagccctgcaccgacggctggatctacgacaacagcaccttccccagcaccatcgtgaccgagtgggacctggtgtgcagccacagagccctgagacagctggcccagagcctgtacatggtgggcgtgctgctgggcgccatggtgttcggctacctggccgacagactgggcagaagaaaggtgctgatcctgaactacctgcagaccgccgtgagcggcacctgcgccgccttcgcccccaacttccccatctactgcgccttcagactgctgagcggcatggccctggccggcatcagcctgaactgcatgaccctgaacgtggagtggatgcccatccacaccagagcctgcgtgggcaccctgatcggctacgtgtacagcctgggccagttcctgctggccggcgtggcctacgccgtgccccactggagacacctgcagctgctggtgagcgcccccttcttcgccttcttcatctacagctggttcttcatcgagagcgccagatggcacagcagcagcggcagactggacctgaccctgagagccctgcagagagtggccagaatcaacggcaagagagaggagggcgccaagctgagcatggaggtgctgagagccagcctgcagaaggagctgaccatgggcaagggccaggccagcgccatggagctgctgagatgccccaccctgagacacctgttcctgtgcctgagcatgctgtggttcgccaccagcttcgcctactacggcctggtgatggacctgcagggcttcggcgtgagcatctacctgatccaggtgatcttcggcgccgtggacctgcccgccaagctggtgggcttcctggtgatcaacagcctgggcagaagacccgcccagatggccgccctgctgctggccggcatctgcatcctgctgaacggcgtgatcccccaggaccagagcatcgtgagaaccagcctggccgtgctgggcaagggctgcctggccgccagcttcaactgcatcttcctgtacaccggcgagctgtaccccaccatgatcagagccgtgaccgtgctgctgcccgagaccctgggccagcccctgcccgacaccgtgcaggacctggagagcagatgggcccccacccagaaggaggccggcatctaccccagaaagggcaagcagaccagacagcagcaggagcaccagaagtacatggtgcccctgcaggccagcgcccaggagaagaacggcctgtag

SEQ ID NO: 99568 - DNA, 1521 bp, Artificial Sequence
  Description of Artificial Sequence: Synthetic coding sequence
atggccttcaacgacctgctgcagcaggtgggcggcgtgggcagattccagcagatccaggtgaccctggtggtgctgcccctgctgctgatggccagccacaacaccctgcagaacttcaccgccgccatccccacccaccactgcagaccccccgccgacgccaacctgagcaagaacggcggcctggaggtgtggctgcccagagacagacagggccagcccgagagctgcctgagattcaccagcccccagtggggcctgcccttcctgaacggcaccgaggccaacggcaccggcgccaccgagccctgcaccgacggctggatctacgacaacagcaccttccccagcaccatcgtgaccgagtgggacctggtgtgcagccacagagccctgagacagctggcccagagcctgtacatggtgggcgtgctgctgggcgccatggtgttcggctacctggccgacagactgggcagaagaaaggtgctgatcctgaactacctgcagaccgccgtgagcggcacctgcgccgccttcgcccccaacttccccatctactgcgccttcagactgctgagcggcatggccctggccggcatcagcctgaactgcatgaccctgaacgtggagtggatgcccatccacaccagagcctgcgtgggcaccctgatcggctacgtgtacagcctgggccagttcctgctggccggcgtggcctacgccgtgccccactggagacacctgcagctgctggtgagcgcccccttcttcgccttcttcatctacagctggttcttcatcgagagcgccagatggcacagcagcagcggcagactggacctgaccctgagagccctgcagagagtggccagaatcaacggcaagagagaggagggcgccaagctgagcatggaggtgctgagagccagcctgcagaaggagctgaccatgggcaagggccaggccagcgccatggagctgctgagatgccccaccctgagacacctgttcctgtgcctgagcatgctgtggttcgccaccagcttcgcctactacggcctggtgatggacctgcagggcttcggcgtgagcatctacctgatccaggtgatcttcggcgccgtggacctgcccgccaagctggtgggcttcctggtgatcaacagcctgggcagaagacccgcccagatggccgccctgctgctggccggcatctgcatcctgctgaacggcgtgatcccccaggaccagagcatcgtgagaaccagcctggccgtgctgggcaagggctgcctggccgccagcttcaactgcatcttcctgtacaccggcgagctgtaccccaccatgatcagagccgtgaccgtgctgctgcccgagaccctgggccagcccctgcccgacaccgtgcaggacctggagagcagaaagggcaagcagaccagacagcagcaggagcaccagaagtacatggtgcccctgcaggccagcgcccaggagaagaacggcctgtag

SEQ ID NO: 99569 - DNA, 1620 bp, Artificial Sequence
  Description of Artificial Sequence: Synthetic coding sequence
atgggcttcgaggagctgctggagcaggtgggcggcttcggccccttccagctgagaaacgtggccctgctggccctgcccagagtgctgctgcccctgcacttcctgctgcccatcttcctggccgccgtgcccgcccacagatgcgccctgcccggcgcccccgccaacttcagccaccaggacgtgtggctggaggcccacctgcccagagagcccgacggcaccctgagcagctgcctgagattcgcctacccccaggccctgcccaacaccaccctgggcgaggagagacagagcagaggcgagctggaggacgagcccgccaccgtgccctgcagccagggctgggagtacgaccacagcgagttcagcagcaccatcgccaccgagtgggacctggtgtgcgagcagaagggcctgaacagagccgccagcaccttcttcttcgccggcgtgctggtgggcgccgtggccttcggctacctgagcgacagattcggcagaagaagactgctgctggtggcctacgtgagcaccctggtgctgggcctggccagcgccgccagcgtgagctacgtgatgttcgccatcaccagaaccctgaccggcagcgccctggccggcttcaccatcatcgtgatgcccctggagctggagtggctggacgtggagcacagaaccgtggccggcgtgctgagcagcaccttctggaccggcggcgtgatgctgctggccctggtgggctacctgatcagagactggagatggctgctgctggccgtgaccctgccctgcgcccccggcatcctgagcctgtggtgggtgcccgagagcgccagatggctgctgacccagggccacgtgaaggaggcccacagatacctgctgcactgcgccagactgaacggcagacccgtgtgcgaggacagcttcagccaggaggccgtgagcaaggtggccgccggcgagagagtggtgagaagacccagctacctggacctgttcagaacccccagactgagacacatcagcctgtgctgcgtggtggtgtggttcggcgtgaacttcagctactacggcctgagcctggacgtgagcggcctgggcctgaacgtgtaccagacccagctgctgttcggcgccgtggagctgcccagcaagctgctggtgtacctgagcgtgagatacgccggcagaagactgacccaggccggcaccctgctgggcaccgccctggccttcggcaccagactgctggtgagcagcgacatgaagagctggagcaccgtgctggccgtgatgggcaaggccttcagcgaggccgccttcaccaccgcctacctgttcaccagcgagctgtaccccaccgtgctgagacagaccggcatgggcctgaccgccctggtgggcagactgggcggcagcctggcccccctggccgccctgctggacggcgtgtggctgagcctgcccaagctgacctacggcggcatcgccctgctggccgccggcaccgccctgctgctgcccgagaccagacaggcccagctgcccgagaccatccaggacgtggagagaaagagatgcgtgcacagaaccgtgagcgtgtacgtgtag

SEQ ID NO: 99570 - DNA, 1647 bp, Artificial Sequence
  Description of Artificial Sequence: Synthetic coding sequence
atgggcttcgaggagctgctggagcaggtgggcggcttcggccccttccagctgagaaacgtggccctgctggccctgcccagagtgctgctgcccctgcacttcctgctgcccatcttcctggccgccgtgcccgcccacagatgcgccctgcccggcgcccccgccaacttcagccaccaggacgtgtggctggaggcccacctgcccagagagcccgacggcaccctgagcagctgcctgagattcgcctacccccaggccctgcccaacaccaccctgggcgaggagagacagagcagaggcgagctggaggacgagcccgccaccgtgccctgcagccagggctgggagtacgaccacagcgagttcagcagcaccatcgccaccgagagccagtgggacctggtgtgcgagcagaagggcctgaacagagccgccagcaccttcttcttcgccggcgtgctggtgggcgccgtggccttcggctacctgagcgacagattcggcagaagaagactgctgctggtggcctacgtgagcaccctggtgctgggcctggccagcgccgccagcgtgagctacgtgatgttcgccatcaccagaaccctgaccggcagcgccctggccggcttcaccatcatcgtgatgcccctggagctggagtggctggacgtggagcacagaaccgtggccggcgtgctgagcagcaccttctggaccggcggcgtgatgctgctggccctggtgggctacctgatcagagactggagatggctgctgctggccgtgaccctgccctgcgcccccggcatcctgagcctgtggtgggtgcccgagagcgccagatggctgctgacccagggccacgtgaaggaggcccacagatacctgctgcactgcgccagactgaacggcagacccgtgtgcgaggacagcttcagccaggaggccgtgagcaaggtggccgccggcgagagagtggtgagaagacccagctacctggacctgttcagaacccccagactgagacacatcagcctgtgctgcgtggtggtgtggttcggcgtgaacttcagctactacggcctgagcctggacgtgagcggcctgggcctgaacgtgtaccagacccagctgctgttcggcgccgtggagctgcccagcaagctgctggtgtacctgagcgtgagatacgccggcagaagactgacccaggccggcaccctgctgggcaccgccctggccttcggcaccagactgctggtgagcagcgacatgaagagctggagcaccgtgctggccgtgatgggcaaggccttcagcgaggccgccttcaccaccgcctacctgttcaccagcgagctgtaccccaccgtgctgagacagaccggcatgggcctgaccgccctggtgggcagactgggcggcagcctggcccccctggccgccctgctggacggcgtgtggctgagcctgcccaagctgacctacggcggcatcgccctgctggccgccggcaccgccctgctgctgcccgagaccagacaggcccagctgcccgagaccatccaggacgtggagagaaagagcgcccccaccagcctgcaggaggaggagatgcccatgaagcaggtgcagaactag

SEQ ID NO: 99571 - DNA, 1641 bp, Artificial Sequence
  Description of Artificial Sequence: Synthetic coding sequence
atgggcttcgaggagctgctggagcaggtgggcggcttcggccccttccagctgagaaacgtggccctgctggccctgcccagagtgctgctgcccctgcacttcctgctgcccatcttcctggccgccgtgcccgcccacagatgcgccctgcccggcgcccccgccaacttcagccaccaggacgtgtggctggaggcccacctgcccagagagcccgacggcaccctgagcagctgcctgagattcgcctacccccaggccctgcccaacaccaccctgggcgaggagagacagagcagaggcgagctggaggacgagcccgccaccgtgccctgcagccagggctgggagtacgaccacagcgagttcagcagcaccatcgccaccgagtgggacctggtgtgcgagcagaagggcctgaacagagccgccagcaccttcttcttcgccggcgtgctggtgggcgccgtggccttcggctacctgagcgacagattcggcagaagaagactgctgctggtggcctacgtgagcaccctggtgctgggcctggccagcgccgccagcgtgagctacgtgatgttcgccatcaccagaaccctgaccggcagcgccctggccggcttcaccatcatcgtgatgcccctggagctggagtggctggacgtggagcacagaaccgtggccggcgtgctgagcagcaccttctggaccggcggcgtgatgctgctggccctggtgggctacctgatcagagactggagatggctgctgctggccgtgaccctgccctgcgcccccggcatcctgagcctgtggtgggtgcccgagagcgccagatggctgctgacccagggccacgtgaaggaggcccacagatacctgctgcactgcgccagactgaacggcagacccgtgtgcgaggacagcttcagccaggaggccgtgagcaaggtggccgccggcgagagagtggtgagaagacccagctacctggacctgttcagaacccccagactgagacacatcagcctgtgctgcgtggtggtgtggttcggcgtgaacttcagctactacggcctgagcctggacgtgagcggcctgggcctgaacgtgtaccagacccagctgctgttcggcgccgtggagctgcccagcaagctgctggtgtacctgagcgtgagatacgccggcagaagactgacccaggccggcaccctgctgggcaccgccctggccttcggcaccagactgctggtgagcagcgacatgaagagctggagcaccgtgctggccgtgatgggcaaggccttcagcgaggccgccttcaccaccgcctacctgttcaccagcgagctgtaccccaccgtgctgagacagaccggcatgggcctgaccgccctggtgggcagactgggcggcagcctggcccccctggccgccctgctggacggcgtgtggctgagcctgcccaagctgacctacggcggcatcgccctgctggccgccggcaccgccctgctgctgcccgagaccagacaggcccagctgcccgagaccatccaggacgtggagagaaagagcgcccccaccagcctgcaggaggaggagatgcccatgaagcaggtgcagaactag

SEQ ID NO: 99572 - DNA, 636 bp, Artificial Sequence
  Description of Artificial Sequence: Synthetic coding sequence
atgctgcagccccacctgctgccctaccaggccgtgagcaaggtggccgccggcgagagagtggtgagaagacccagctacctggacctgttcagaacccccagactgagacacatcagcctgtgctgcgtggtggtgtggttcggcgtgaacttcagctactacggcctgagcctggacgtgagcggcctgggcctgaacgtgtaccagacccagctgctgttcggcgccgtggagctgcccagcaagctgctggtgtacctgagcgtgagatacgccggcagaagactgacccaggccggcaccctgctgggcaccgccctggccttcggcaccagactgctggtgagcagcgacatgaagagctggagcaccgtgctggccgtgatgggcaaggccttcagcgaggccgccttcaccaccgcctacctgttcaccagcgagctgtaccccaccgtgctgagacagaccggcatgggcctgaccgccctggtgggcagactgggcggcagcctggcccccctggccgccctgctggacggcgtgtggctgagcctgcccaagctgacctacggcggcatcgccctgctggccgccggcaccgccctgctgctgcccgagaccagacaggcctag

SEQ ID NO: 99573 - DNA, 837 bp, Artificial Sequence
  Description of Artificial Sequence: Synthetic coding sequence
atgggcttcgaggagctgctggagcaggtgggcggcttcggccccttccagctgagaaacgtggccctgctggccctgcccagagtgctgctgcccctgcacttcctgctgcccatcttcctggccgccgtgcccgcccacagatgcgccctgcccggcgcccccgccaacttcagccaccaggacgtgtggctggaggcccacctgcccagagagcccgacggcaccctgagcagctgcctgagattcgcctacccccaggccctgcccaacaccaccctgggcgaggagagacagagcagaggcgagctggaggacgagcccgccaccgtgccctgcagccagggctgggagtacgaccacagcgagttcagcagcaccatcgccaccgagagccaggtgggcatctacatcatccacctggaggtggagtgcagatggagacagagcccctgggaggccgccggcagaggcctgccctgggaggaggccgaggccgccggcctgggcagagacaaggtgagctacagccccagctggagagagagcctgggcggcctgctgagcggcatggagtgggacctggtgtgcgagcagaagggcctgaacagagccgccagcaccttcttcttcgccggcgtgctggtgggcgccgtggccttcggctacctgagcgacagattcggcagaagaagactgctgctggtggcctacgtgagcaccctggtgctgggcctggccagcgccgccagcgtgagctacgtgatgttcgccatcaccagaaccctgaccggcagcgccctggccggcttcaccatcatcgtgatgcccctgtag

SEQ ID NO: 99574 - DNA, 444 bp, Artificial Sequence
  Description of Artificial Sequence: Synthetic coding sequence
atggagtgggacctggtgtgcgagcagaagggcctgaacagagccgccagcaccttcttcttcgccggcgtgctggtgggcgccgtggccttcggctacctgagcgacagattcggcagaagaagactgctgctggtggcctacgtgagcaccctggtgctgggcctggccagcgccgccagcgtgagctacgtgatgttcgccatcaccagaaccctgaccggcagcgccctggccggcttcaccatcatcgtgatgcccctgggcgaggccgagctggagtggctggacgtggagcacagaaccgtggccggcgtgctgagcagcaccttctggaccggcggcgtgatgctgctggccctggtgggctacctgatcagagactggagatggctgctgctggccgtgaccctgccctgcgcccccggcatcctgagcctgtag

SEQ ID NO: 99575 - DNA, 1629 bp, Artificial Sequence
  Description of Artificial Sequence: Synthetic coding sequence
atgaccttcagcgagatcctggacagagtgggcagcatgggccacttccagttcctgcacgtggccatcctgggcctgcccatcctgaacatggccaaccacaacctgctgcagatcttcaccgccgccacccccgtgcaccactgcagacccccccacaacgccagcaccggcccctgggtgctgcccatgggccccaacggcaagcccgagagatgcctgagattcgtgcacccccccaacgccagcctgcccaacgacacccagagagccatggagccctgcctggacggctgggtgtacaacagcaccaaggacagcatcgtgaccgagtgggacctggtgtgcaacagcaacaagctgaaggagatggcccagagcatcttcatggccggcatcctgatcggcggcctggtgctgggcgacctgagcgacagattcggcagaagacccatcctgacctgcagctacctgctgctggccgccagcggcagcggcgccgccttcagccccaccttccccatctacatggtgttcagattcctgtgcggcttcggcatcagcggcatcaccctgagcaccgtgatcctgaacgtggagtgggtgcccaccagaatgagagccatcatgagcaccgccctgggctactgctacaccttcggccagttcatcctgcccggcctggcctacgccatcccccagtggagatggctgcagctgaccgtgagcatccccttcttcgtgttcttcctgagcagctggtggacccccgagagcatcagatggctggtgctgagcggcaagagcagcaaggccctgaagatcctgagaagagtggccgtgttcaacggcaagaaggaggagggcgagagactgagcctggaggagctgaagctgaacctgcagaaggagatcagcctggccaaggccaagtacaccgccagcgacctgttcagaatccccatgctgagaagaatgaccttctgcctgagcctggcctggttcgccaccggcttcgcctactacagcctggccatgggcgtggaggagttcggcgtgaacctgtacatcctgcagatcatcttcggcggcgtggacgtgcccgccaagttcatcaccatcctgagcctgagctacctgggcagacacaccacccaggccgccgccctgctgctggccggcggcgccatcctggccctgaccttcgtgcccctggacctgcagaccgtgagaaccgtgctggccgtgttcggcaagggctgcctgagcagcagcttcagctgcctgttcctgtacaccagcgagctgtaccccaccgtgatcagacagaccggcatgggcgtgagcaacctgtggaccagagtgggcagcatggtgagccccctggtgaagatcaccggcgaggtgcagcccttcatccccaacatcatctacggcatcaccgccctgctgggcggcagcgccgccctgttcctgcccgagaccctgaaccagcccctgcccgagaccatcgaggacctggagaactggagcctgagagccaagaagcccaagcaggagcccgaggtggagaaggccagccagagaatccccctgcagccccacggccccggcctgggcagcagctag

SEQ ID NO: 99576 - DNA, 1629 bp, Artificial Sequence; identical to SEQ ID NO: 99575
  Description of Artificial Sequence: Synthetic coding sequence

SEQ ID NO: 99577 - DNA, 1587 bp, Artificial Sequence
  Description of Artificial Sequence: Synthetic coding sequence
atgaccttcagcgagatcctggacagagtgggcagcatgggccacttccagttcctgcacgtggccatcctgggcctgcccatcctgaacatggccaaccactgcagacccccccacaacgccagcaccggcccctgggtgctgcccatgggccccaacggcaagcccgagagatgcctgagattcgtgcacccccccaacgccagcctgcccaacgacacccagagagccatggagccctgcctggacggctgggtgtacaacagcaccaaggacagcatcgtgaccgagtgggacctggtgtgcaacagcaacaagctgaaggagatggcccagagcatcttcatggccggcatcctgatcggcggcctggtgctgggcgacctgagcgacagattcggcagaagacccatcctgacctgcagctacctgctgctggccgccagcggcagcggcgccgccttcagccccaccttccccatctacatggtgttcagattcctgtgcggcttcggcatcagcggcatcaccctgagcaccgtgatcctgaacgtggagtgggtgcccaccagaatgagagccatcatgagcaccgccctgggctactgctacaccttcggccagttcatcctgcccggcctggcctacgccatcccccagtggagatggctgcagctgaccgtgagcatccccttcttcgtgttcttcctgagcagctggtggacccccgagagcatcagatggctggtgctgagcggcaagagcagcaaggccctgaagatcctgagaagagtggccgtgttcaacggcaagaaggaggagggcgagagactgagcctggaggagctgaagctgaacctgcagaaggagatcagcctggccaaggccaagtacaccgccagcgacctgttcagaatccccatgctgagaagaatgaccttctgcctgagcctggcctggttcgccaccggcttcgcctactacagcctggccatgggcgtggaggagttcggcgtgaacctgtacatcctgcagatcatcttcggcggcgtggacgtgcccgccaagttcatcaccatcctgagcctgagctacctgggcagacacaccacccaggccgccgccctgctgctggccggcggcgccatcctggccctgaccttcgtgcccctggacctgcagaccgtgagaaccgtgctggccgtgttcggcaagggctgcctgagcagcagcttcagctgcctgttcctgtacaccagcgagctgtaccccaccgtgatcagacagaccggcatgggcgtgagcaacctgtggaccagagtgggcagcatggtgagccccctggtgaagatcaccggcgaggtgcagcccttcatccccaacatcatctacggcatcaccgccctgctgggcggcagcgccgccctgttcctgcccgagaccctgaaccagcccctgcccgagaccatcgaggacctggagaactggagcctgagagccaagaagcccaagcaggagcccgaggtggagaaggccagccagagaatccccctgcagccccacggccccggcctgggcagcagctag

SEQ ID NO: 99578 - DNA, 1653 bp, Artificial Sequence
  Description of Artificial Sequence: Synthetic coding sequence
atggccttcagcaagctgctggagcaggccggcggcgtgggcctgttccagaccctgcaggtgctgaccttcatcctgccctgcctgatgatccccagccagatgctgctggagaacttcagcgccgccatccccggccacagatgctggacccacatgctggacaacggcagcgccgtgagcaccaacatgacccccaaggccctgctgaccatcagcatcccccccggccccaaccagggcccccaccagtgcagaagattcagacagccccagtggcagctgctggaccccaacgccaccgccaccagctggagcgaggccgacaccgagccctgcgtggacggctgggtgtacgacagaagcgtgttcaccagcaccatcgtggccaagtgggacctggtgtgcagcagccagggcctgaagcccctgagccagagcatcttcatgagcggcatcctggtgggcagcttcatctggggcctgctgagctacagattcggcagaaagcccatgctgagctggtgctgcctgcagctggccgtggccggcaccagcaccatcttcgcccccaccttcgtgatctactgcggcctgagattcgtggccgccttcggcatggccggcatcttcctgagcagcctgaccctgatggtggagtggaccaccaccagcagaagagccgtgaccatgaccgtggtgggctgcgccttcagcgccggccaggccgccctgggcggcctggccttcgccctgagagactggagaaccctgcagctggccgccagcgtgcccttcttcgccatcagcctgatcagctggtggctgcccgagagcgccagatggctgatcatcaagggcaagcccgaccaggccctgcaggagctgagaaaggtggccagaatcaacggccacaaggaggccaagaacctgaccatcgaggtgctgatgagcagcgtgaaggaggaggtggccagcgccaaggagcccagaagcgtgctggacctgttctgcgtgcccgtgctgagatggagaagctgcgccatgctggtggtgaacttcagcctgctgatcagctactacggcctggtgttcgacctgcagagcctgggcagagacatcttcctgctgcaggccctgttcggcgccgtggacttcctgggcagagccaccaccgccctgctgctgagcttcctgggcagaagaaccatccaggccggcagccaggccatggccggcctggccatcctggccaacatgctggtgccccaggacctgcagaccctgagagtggtgttcgccgtgctgggcaagggctgcttcggcatcagcctgacctgcctgaccatctacaaggccgagctgttccccacccccgtgagaatgaccgccgacggcatcctgcacaccgtgggcagactgggcgccatgatgggccccctgatcctgatgagcagacaggccctgcccctgctgccccccctgctgtacggcgtgatcagcatcgccagcagcctggtggtgctgttcttcctgcccgagacccagggcctgcccctgcccgacaccatccaggacctggagagccagaagagcaccgccgcccagggcaacagacaggaggccgtgaccgtggagagcaccagcctgtag

SEQ ID NO: 99579 - DNA, 1338 bp, Artificial Sequence
  Description of Artificial Sequence: Synthetic coding sequence
atggccttcagcgagctgctggacctggtgggcggcctgggcagattccaggtgctgcagaccatggccctgatggtgagcatcatgtggctgtgcacccagagcatgctggagaacttcagcgccgccgtgcccagccacagatgctgggcccccctgctggacaacagcaccgcccaggccagcatcctgggcagcctgagccccgaggccctgctggccatcagcatcccccccggccccaaccagagaccccaccagtgcagaagattcagacagccccagtggcagctgctggaccccaacgccaccgccaccagctggagcgaggccgacaccgagccctgcgtggacggctgggtgtacgacagaagcatcttcaccagcaccatcgtggccaagtggaacctggtgtgcgacagccacgccctgaagcccatggcccagagcatctacctggccggcatcctggtgggcgccgccgcctgcggccccgccagcgacagatggctggccgagagcgccagatggctgctgaccaccggcagactggactggggcctgcaggagctgtggagagtggccgccatcaacggcaagggcgccgtgcaggacaccctgacccccgaggtgctgctgagcgccatgagagaggagctgagcatgggccagccccccgccagcctgggcaccctgctgagaatgcccggcctgagattcagaacctgcatcagcaccctgtgctggttcgccttcggcttcaccttcttcggcctggccctggacctgcaggccctgggcagcaacatcttcctgctgcagatgttcatcggcgtggtggacatccccgccaagatgggcgccctgctgctgctgagccacctgggcagaagacccaccctggccgccagcctgctgctggccggcctgtgcatcctggccaacaccctggtgccccacgagatgggcgccctgagaagcgccctggccgtgctgggcctgggcggcgtgggcgccgccttcacctgcatcaccatctacagcagcgagctgttccccaccgtgctgagaatgaccgccgtgggcctgggccagatggccgccagaggcggcgccatcctgggccccctggtgagactgctgggcgtgcacggcccctggctgcccctgctggtgtacggcaccgtgcccgtgctgagcggcctggccgccctgctgctgcccgagacccagagcctgcccctgcccgacaccatccaggacgtgcagaaccaggccgtgaagaaggccacccacggcaccctgggcaacagcgtgctgaagagcacccagttctag

SEQ ID NO: 99580 - DNA, 1662 bp, Artificial Sequence
  Description of Artificial Sequence: Synthetic coding sequence
atggccttcagcgagctgctggacctggtgggcggcctgggcagattccaggtgctgcagaccatggccctgatggtgagcatcatgtggctgtgcacccagagcatgctggagaacttcagcgccgccgtgcccagccacagatgctgggcccccctgctggacaacagcaccgcccaggccagcatcctgggcagcctgagccccgaggccctgctggccatcagcatcccccccggccccaaccagagaccccaccagtgcagaagattcagacagccccagtggcagctgctggaccccaacgccaccgccaccagctggagcgaggccgacaccgagccctgcgtggacggctgggtgtacgacagaagcatcttcaccagcaccatcgtggccaagtggaacctggtgtgcgacagccacgccctgaagcccatggcccagagcatctacctggccggcatcctggtgggcgccgccgcctgcggccccgccagcgacagattcggcagaagactggtgctgacctggagctacctgcagatggccgtgatgggcaccgccgccgccttcgcccccgccttccccgtgtactgcctgttcagattcctgctggccttcgccgtggccggcgtgatgatgaacaccggcaccctgctgatggagtggaccgccgccagagccagacccctggtgatgaccctgaacagcctgggcttcagcttcggccacggcctgaccgccgccgtggcctacggcgtgagagactggaccctgctgcagctggtggtgagcgtgcccttcttcctgtgcttcctgtacagctggtggctggccgagagcgccagatggctgctgaccaccggcagactggactggggcctgcaggagctgtggagagtggccgccatcaacggcaagggcgccgtgcaggacaccctgacccccgaggtgctgctgagcgccatgagagaggagctgagcatgggccagccccccgccagcctgggcaccctgctgagaatgcccggcctgagattcagaacctgcatcagcaccctgtgctggttcgccttcggcttcaccttcttcggcctggccctggacctgcaggccctgggcagcaacatcttcctgctgcagatgttcatcggcgtggtggacatccccgccaagatgggcgccctgctgctgctgagccacctgggcagaagacccaccctggccgccagcctgctgctggccggcctgtgcatcctggccaacaccctggtgccccacgagatgggcgccctgagaagcgccctggccgtgctgggcctgggcggcgtgggcgccgccttcacctgcatcaccatctacagcagcgagctgttccccaccgtgctgagaatgaccgccgtgggcctgggccagatggccgccagaggcggcgccatcctgggccccctggtgagactgctgggcgtgcacggcccctggctgcccctgctggtgtacggcaccgtgcccgtgctgagcggcctggccgccctgctgctgcccgagacccagagcctgcccctgcccgacaccatccaggacgtgcagaaccaggccgtgaagaaggccacccacggcaccctgggcaacagcgtgctgaagagcacccagttctag

SEQ ID NO: 99581 - DNA, 999 bp, Artificial Sequence
  Description of Artificial Sequence: Synthetic coding sequence
atggagtggaccgccgccagagccagacccctggtgatgaccctgaacagcctgggcttcagcttcggccacggcctgaccgccgccgtggcctacggcgtgagagactggaccctgctgcagctggtggtgagcgtgcccttcttcctgtgcttcctgtacagctggtggctggccgagagcgccagatggctgctgaccaccggcagactggactggggcctgcaggagctgtggagagtggccgccatcaacggcaagggcgccgtgcaggacaccctgacccccgaggtgctgctgagcgccatgagagaggagctgagcatgggccagccccccgccagcctgggcaccctgctgagaatgcccggcctgagattcagaacctgcatcagcaccctgtgctggttcgccttcggcttcaccttcttcggcctggccctggacctgcaggccctgggcagcaacatcttcctgctgcagatgttcatcggcgtggtggacatccccgccaagatgggcgccctgctgctgctgagccacctgggcagaagacccaccctggccgccagcctgctgctggccggcctgtgcatcctggccaacaccctggtgccccacgagatgggcgccctgagaagcgccctggccgtgctgggcctgggcggcgtgggcgccgccttcacctgcatcaccatctacagcagcgagctgttccccaccgtgctgagaatgaccgccgtgggcctgggccagatggccgccagaggcggcgccatcctgggccccctggtgagactgctgggcgtgcacggcccctggctgcccctgctggtgtacggcaccgtgcccgtgctgagcggcctggccgccctgctgctgcccgagacccagagcctgcccctgcccgacaccatccaggacgtgcagaaccaggccgtgaagaaggccacccacggcaccctgggcaacagcgtgctgaagagcacccagttctag

SEQ ID NO: 99582 - DNA, 1665 bp, Artificial Sequence
  Description of Artificial Sequence: Synthetic coding sequence
atgcccaccgtggacgacatcctggagcaggtgggcgagagcggctggttccagaagcaggccttcctgatcctgtgcctgctgagcgccgccttcgcccccatctgcgtgggcatcgtgttcctgggcttcacccccgaccaccactgccagagccccggcgtggccgagctgagccagagatgcggctggagccccgccgaggagctgaactacaccgtgcccggcctgggccccgccggcgaggccttcctgggccagtgcagaagatacgaggtggactggaaccagagcgccctgagctgcgtggaccccctggccagcctggccaccaacagaagccacctgcccctgggcccctgccaggacggctgggtgtacgacacccccggcagcagcatcgtgaccgagttcaacctggtgtgcgccgacagctggaagctggacctgttccagagctgcctgaacgccggcttcctgttcggcagcctgggcgtgggctacttcgccgacagattcggcagaaagctgtgcctgctgggcaccgtgctggtgaacgccgtgagcggcgtgctgatggccttcagccccaactacatgagcatgctgctgttcagactgctgcagggcctggtgagcaagggcaactggatggccggctacaccctgatcaccgagttcgtgggcagcggcagcagaagaaccgtggccatcatgtaccagatggccttcaccgtgggcctggtggccctgaccggcctggcctacgccctgccccactggagatggctgcagctggccgtgagcctgcccaccttcctgttcctgctgtactactggtgcgtgcccgagagccccagatggctgctgagccagaagagaaacaccgaggccatcaagatcatggaccacatcgcccagaagaacggcaagctgccccccgccgacctgaagatgctgagcctggaggaggacgtgaccgagaagctgagccccagcttcgccgacctgttcagaacccccagactgagaaagagaaccttcatcctgatgtacctgtggttcaccgacagcgtgctgtaccagggcctgatcctgcacatgggcgccaccagcggcaacctgtacctggacttcctgtacagcgccctggtggagatccccggcgccttcatcgccctgatcaccatcgacagagtgggcagaatctaccccatggccatgagcaacctgctggccggcgccgcctgcctggtgatgatcttcatcagccccgacctgcactggctgaacatcatcatcatgtgcgtgggcagaatgggcatcaccatcgccatccagatgatctgcctggtgaacgccgagctgtaccccaccttcgtgagaaacctgggcgtgatggtgtgcagcagcctgtgcgacatcggcggcatcatcacccccttcatcgtgttcagactgagagaggtgtggcaggccctgcccctgatcctgttcgccgtgctgggcctgctggccgccggcgtgaccctgctgctgcccgagaccaagggcgtggccctgcccgagaccatgaaggacgccgagaacctgggcagaaaggccaagcccaaggagaacaccatctacctgaaggtgcagaccagcgagcccagcggcacctag

SEQ ID NO: 99583 - DNA, 1005 bp, Artificial Sequence
  Description of Artificial Sequence: Synthetic coding sequence
atgttcttcctgctggccctgctgagcgccaccttcgcccccatctacgtgggcatcgtgttcctgggcttcacccccgaccacagatgcagaagccccggcgtggccgagctgagcctgagatgcggctggagccccgccgaggagctgaactacaccgtgcccggccccggccccgccggcgaggccagccccagacagtgcagaagatacgaggtggactggaaccagagcaccttcgactgcgtggaccccctggccagcctggacaccaacagaagcagactgcccctgggcccctgcagagacggctgggtgtacgagacccccggcagcagcatcgtgaccgagttcaacctggtgtgcgccaacagctggatgctggacctgttccagagcagcgtgaacgtgggcttcttcatcggcagcatgagcatcggctacatcgccgacagattcggcagaaagctgtgcctgctgaccaccgtgctgatcaacgccgccgccggcgtgctgatggccatcagccccacctacacctggatgctgatcttcagactgatccagggcctggtgagcaaggccggctggctgatcggctacatcctgatcaccgagttcgtgggcagaagatacagaagaaccgtgggcatcttctaccaggtggcctacaccgtgggcctgctggtgctggccggcgtggcctacgccctgccccactggagatggctgcagttcaccgtgagcctgcccaacttcttcttcctgctgtactactggtgcatccccgagagccccagatggctgatcagccagaacaagaacgccgaggccatgagaatcatcaagcacatcgccaagaagaacggcaagagcctgcccgccagcctgcagagactgagactggaggaggagaccggcaagaagctgaaccccagcttcctggacctggtgagaaccccccagatcagaaagcacaccatgatcctgatgtacaactggtag

SEQ ID NO: 99584 - DNA, 1668 bp, Artificial Sequence
  Description of Artificial Sequence: Synthetic coding sequence
atgcccaccaccgtggacgacgtgctggagcacggcggcgagttccacttcttccagaagcagatgttcttcctgctggccctgctgagcgccaccttcgcccccatctacgtgggcatcgtgttcctgggcttcacccccgaccacagatgcagaagccccggcgtggccgagctgagcctgagatgcggctggagccccgccgaggagctgaactacaccgtgcccggccccggccccgccggcgaggccagccccagacagtgcagaagatacgaggtggactggaaccagagcaccttcgactgcgtggaccccctggccagcctggacaccaacagaagcagactgcccctgggcccctgcagagacggctgggtgtacgagacccccggcagcagcatcgtgaccgagttcaacctggtgtgcgccaacagctggatgctggacctgttccagagcagcgtgaacgtgggcttcttcatcggcagcatgagcatcggctacatcgccgacagattcggcagaaagctgtgcctgctgaccaccgtgctgatcaacgccgccgccggcgtgctgatggccatcagccccacctacacctggatgctgatcttcagactgatccagggcctggtgagcaaggccggctggctgatcggctacatcctgatcaccgagttcgtgggcagaagatacagaagaaccgtgggcatcttctaccaggtggcctacaccgtgggcctgctggtgctggccggcgtggcctacgccctgccccactggagatggctgcagttcaccgtgagcctgcccaacttcttcttcctgctgtactactggtgcatccccgagagccccagatggctgatcagccagaacaagaacgccgaggccatgagaatcatcaagcacatcgccaagaagaacggcaagagcctgcccgccagcctgcagagactgagactggaggaggagaccggcaagaagctgaaccccagcttcctggacctggtgagaaccccccagatcagaaagcacaccatgatcctgatgtacaactggttcaccagcagcgtgctgtaccagggcctgatcatgcacatgggcctggccggcgacaacatctacctggacttcttctacagcgccctggtggagttccccgccgccttcatgatcatcctgaccatcgacagaatcggcagaagatacccctgggccgccagcaacatggtggccggcgccgcctgcctggccagcgtgttcatccccggcgacctgcagtggctgaagatcatcatcagctgcctgggcagaatgggcatcaccatggcctacgagatcgtgtgcctggtgaacgccgagctgtaccccaccttcatcagaaacctgggcgtgcacatctgcagcagcatgtgcgacatcggcggcatcatcacccccttcctggtgtacagactgaccaacatctggctggagctgcccctgatggtgttcggcgtgctgggcctggtggccggcggcctggtgctgctgctgcccgagaccaagggcaaggccctgcccgagaccatcgaggaggccgagaacatgcagagacccagaaagaacaaggagaagatgatctacctgcaggtgcagaagctggacatccccctgaactag

SEQ ID NO: 99585 - DNA, 1632 bp, Artificial Sequence
  Description of Artificial Sequence: Synthetic coding sequence
atgagaaccctgcacgccgtgagccacccctacagcaacagcatgagattccagagagtgctgtacttcatctgcgccttccagaacatcagctgcggcatccactacctggccagcgtgttcatgggcgtgaccccccaccacgtgtgcagaccccccggcaacctgcagaacggcgagatctgggagctgagcagatgcagcagaaacaagagagagaacaccagcagcctgggctacgagtacaccggcagcaagaaggagttcccctgcgtggacggctacatctacgaccagaacacctggaagagcaccgccgtgacccagtggaacctggtgtgcgacagaaagtggctggccatgctgatccagcccctgttcatgttcggcgtgctgctgggcagcgtgaccttcggctacttcagcgacagactgggcagaagagtggtgctgtgggccaccagcagcagcatgttcctgttcggcatcgccgccgccttcgccgtggactactacaccttcatggccgccagattcttcctggccatggtggccagcggctacctggtggtgggcttcgtgtacgtgatggagttcatcggcatgaagagcagaacctgggccagcgtgcacctgcacagcttcttcgccgtgggcaccctgctggtggccctgaccggctacctggtgagaacctggtggctgtaccagatgatcctgagcaccgtgaccgtgcccttcatcctgtgctgctgggtgctgcccgagacccccttctggctgctgagcgagggcagatacgaggaggcccagaagatcgtggacatcatggccaagtggaacagagccagcagctgcaagctgagcgagctgctgagcctggacctgcagggccccgtgagcaacagccccaccgaggtgcagaagcacaacctgagctacctgttctacaactggagcatcaccaagagaaccctgaccgtgtggctgatctggttcaccggcagcctgggcttctacagcttcagcctgaacagcgtgaacctgggcggcaacgagtacctgaacctgttcctgctgggcgtggtggagatccccgcctacaccttcgtgtgcatcgccatggacaaggtgggcagaagaaccgtgctggcctacagcctgttctgcagcgccctggcctgcggcgtggtgatggtgatcccccagaagcactacatcctgggcgtggtgaccgccatggtgggcaagttcgccatcggcgccgccttcggcctgatctacctgtacaccgccgagctgtaccccaccatcgtgagaagcctggccgtgggcagcggcagcatggtgtgcagactggccagcatcctggcccccttcagcgtggacctgagcagcatctggatcttcatcccccagctgttcgtgggcaccatggccctgctgagcggcgtgctgaccctgaagctgcccgagaccctgggcaagagactggccaccacctgggaggaggccgccaagctggagagcgagaacgagagcaagagcagcaagctgctgctgaccaccaacaacagcggcctggagaagaccgaggccatcacccccagagacagcggcctgggcgagtag

SEQ ID NO: 99586 - DNA, 1734 bp, Artificial Sequence
  Description of Artificial Sequence: Synthetic coding sequence
atgggcagcagacacttcgagggcatctacgaccacgtgggccacttcggcagattccagagagtgctgtacttcatctgcgccttccagaacatcagctgcggcatccactacctggccagcgtgttcatgggcgtgaccccccaccacgtgtgcagaccccccggcaacgtgagccaggtggtgttccacaaccacagcaactggagcctggaggacaccggcgccctgctgagcagcggccagaaggactacgtgaccgtgcagctgcagaacggcgagatctgggagctgagcagatgcagcagaaacaagagagagaacaccagcagcctgggctacgagtacaccggcagcaagaaggagttcccctgcgtggacggctacatctacgaccagaacacctggaagagcaccgccgtgacccagtggaacctggtgtgcgacagaaagtggctggccatgctgatccagcccctgttcatgttcggcgtgctgctgggcagcgtgaccttcggctacttcagcgacagactgggcagaagagtggtgctgtgggccaccagcagcagcatgttcctgttcggcatcgccgccgccttcgccgtggactactacaccttcatggccgccagattcttcctggccatggtggccagcggctacctggtggtgggcttcgtgtacgtgatggagttcatcggcatgaagagcagaacctgggccagcgtgcacctgcacagcttcttcgccgtgggcaccctgctggtggccctgaccggctacctggtgagaacctggtggctgtaccagatgatcctgagcaccgtgaccgtgcccttcatcctgtgctgctgggtgctgcccgagacccccttctggctgctgagcgagggcagatacgaggaggcccagaagatcgtggacatcatggccaagtggaacagagccagcagctgcaagctgagcgagctgctgagcctggacctgcagggccccgtgagcaacagccccaccgaggtgcagaagcacaacctgagctacctgttctacaactggagcatcaccaagagaaccctgaccgtgtggctgatctggttcaccggcagcctgggcttctacagcttcagcctgaacagcgtgaacctgggcggcaacgagtacctgaacctgttcctgctgggcgtggtggagatccccgcctacaccttcgtgtgcatcgccatggacaaggtgggcagaagaaccgtgctggcctacagcctgttctgcagcgccctggcctgcggcgtggtgatggtgatcccccagaagcactacatcctgggcgtggtgaccgccatggtgggcaagttcgccatcggcgccgccttcggcctgatctacctgtacaccgccgagctgtaccccaccatcgtgagaagcctggccgtgggcagcggcagcatggtgtgcagactggccagcatcctggcccccttcagcgtggacctgagcagcatctggatcttcatcccccagctgttcgtgggcaccatggccctgctgagcggcgtgctgaccctgaagctgcccgagaccctgggcaagagactggccaccacctgggaggaggccgccaagctggagagcgagaacgagagcaagagcagcaagctgctgctgaccaccaacaacagcggcctggagaagaccgaggccatcacccccagagacagcggcctgggcgagtag

SEQ ID NO: 99587 - DNA, 525 bp, Artificial Sequence
  Description of Artificial Sequence: Synthetic coding sequence
atgggcgtgaccccccaccacgtgtgcagaccccccggcaacgtgagccaggtggtgttccacaaccacagcaactggagcctggaggacaccggcgccctgctgagcagcggccagaaggactacgtgaccgtgcagctgcagaacggcgagatctgggagctgagcagatgcagcagaaacaagagagagaacaccagcagcctgggctacgagtacaccggcagcaagaaggagttcccctgcgtggacggctacatctacgaccagaacacctggaagagcaccgccgtgacccagtggaacctggtgtgcgacagaaagtggctggccatgctgatccagcccctgttcatgttcggcgtgctgctgggcagcgtgaccttcggctacttcagcgacagactgggcagaagagtggtgctgtgggccaccagcagcagcatgttcctgttcggcatcgccgccgccttcgccgtggactactacaccttcatggccgccagattcttcctggccatgtag

SEQ ID NO: 99588 - DNA, 804 bp, Artificial Sequence
  Description of Artificial Sequence: Synthetic coding sequence
atgagcgccggcccccaggccatgctgggcagaagagtggtgctgtgggccaccagcagcagcatgttcctgttcggcatcgccgccgccttcgccgtggactactacaccttcatggccgccagattcttcctggccatggtggccagcggctacctggtggtgggcttcgtgtacgtgatggagttcatcggcatgaagagcagaacctgggccagcgtgcacctgcacagcttcttcgccgtgggcaccctgctggtggccctgaccggctacctggtgagaacctggtggctgtaccagatgatcctgagcaccgtgaccgtgcccttcatcctgtgctgctgggtgctgcccgagacccccttctggctgctgagcgagggcagatacgaggaggcccagaagatcgtggacatcatggccaagtggaacagagccagcagctgcaagctgagcgagctgctgagcctggacctgcagggccccgtgagcaacagccccaccgaggtgcagaagcacaacctgagctacctgttctacaactggagcatcaccaagagaaccctgaccgtgtggctgatctggttcaccggcagcctgggcttctacagcttcagcctgaacagcgtgaacctgggcggcaacgagtacctgaacctgttcctgctgggcgtggtggagatccccgcctacaccttcgtgtgcatcgccatggacaaggtgggcagaagaaccgtgctggcctacagcctgttctgcagcgccctggcctgcggcgtggtgatggtgatcccccagtag

SEQ ID NO: 99589 - DNA, 1056 bp, Artificial Sequence
  Description of Artificial Sequence: Synthetic coding sequence
atgggcgtgaccccccaccacgtgtgcagaccccccggcaacgtgagccaggtggtgttccacaaccacagcaactggagcctggaggacaccggcgccctgctgagcagcggccagaaggactacgtgaccgtgcagctgcagaacggcgagatctgggagctgagcagatgcagcagaaacaagagagagaacaccagcagcctgggctacgagtacaccggcagcaagaaggagttcccctgcgtggacggctacatctacgaccagaacacctggaagagcaccgccgtgacccagtggaacctggtgtgcgacagaaagtggctggccatgctgatccagcccctgttcatgttcggcgtgctgctgggcagcgtgaccttcggctacttcagcgacagactgggcagaagagtggtgctgtgggccaccagcagcagcatgttcctgttcggcatcgccgccgccttcgccgtggactactacaccttcatggccgccagattcttcctggccatggtggccagcggctacctggtggtgggcttcgtgtacgtgatggagttcatcggcatgaagagcagaacctgggccagcgtgcacctgcacagcttcttcgccgtgggcaccctgctggtggccctgaccggctacctggtgagaacctggtggctgtaccagatgatcctgagcaccgtgaccgtgcccttcatcctgtgctgctgggtgctgcccgagacccccttctggctgctgagcgagggcagatacgaggaggcccagaagatcgtggacatcatggccaagtggaacagagccagcagctgcaagctgagcgagctgctgagcctggacctgcagggccccgtgagcaacagccccaccgaggtgcagaagcacaacctgagctacctgttctacaactggagcatcaccaagagaaccctgaccgtgtggctgatctggttcaccggcagcctgggcttctacagcttcagcctgaacagcgtgaacctgggcggcaacgagtacctgaacctgttcctgctgtag

SEQ ID NO: 99590 - DNA, 1548 bp, Artificial Sequence
  Description of Artificial Sequence: Synthetic coding sequence
atgggcagcagacacttcgagggcatctacgaccacgtgggccacttcggcagattccagagagtgctgtacttcatctgcgccttccagaacatcagctgcggcatccactacctggccagcgtgttcatgggcgtgaccccccaccacgtgtgcagaccccccggcaacgtgagccaggtggtgttccacaaccacagcaactggagcctggaggacaccggcgccctgctgagcagcggccagaaggactacgtgaccgtgcagctgcagaacggcgagatctgggagctgagcagatgcagcagaaacaagagagagaacaccagcagcctgggctacgagtacaccggcagcaagaaggagttcccctgcgtggacggctacatctacgaccagaacacctggaagagcaccgccgtgacccagtggaacctggtgtgcgacagaaagtggctggccatgctgatccagcccctgttcatgttcggcgtgctgctgggcagcgtgaccttcggctacttcagcgacagactgggcagaagagtggtgctgtgggccaccagcagcagcatgttcctgttcggcatcgccgccgccttcgccgtggactactacaccttcatggccgccagattcttcctggccatggtggccagcggctacctggtggtgggcttcgtgtacgtgatggagttcatcggcatgaagagcagaacctgggccagcgtgcacctgcacagcttcttcgccgtgggcaccctgctggtggccctgaccggctacctggtgagaacctggtggctgtaccagatgatcctgagcaccgtgaccgtgcccttcatcctgtgctgctgggtgctgcccgagacccccttctggctgctgagcgagggcagatacgaggaggcccagaagatcgtggacatcatggccaagtggaacagagccagcagctgcaagctgagcgagctgctgagcctggacctgcagggccccgtgagcaacagccccaccgaggtgcagaagcacaacctgagctacctgttctacaactggagcatcaccaagagaaccctgaccgtgtggctgatctggttcaccggcagcctgggcttctacagcttcagcctgaacagcgtgaacctgggcggcaacgagtacctgaacctgttcctgctgggcgtggtggagatccccgcctacaccttcgtgtgcatcgccatggacaaggtgggcagaagaaccgtgctggcctacagcctgttctgcagcgccctggcctgcggcgtggtgatggtgatcccccagaagcactacatcctgggcgtggtgaccgccatggtgggcaagttcgccatcggcgccgccttcggcctgatctacctgtacaccgccgagctgtaccccaccatcgtgagaagcctggccgtgggcagcggcagcatggtgtgcagactggccagcatcctggcccccttcagcgtggacctgagcagcatctggatcttcatcccccagctgctgggccagcacctgcaggagtag

SEQ ID NO: 99591 - DNA, 1299 bp, Artificial Sequence
  Description of Artificial Sequence: Synthetic coding sequence
gactacgtgaccgtgcagctgcagaacggcgagatctgggagctgagcagatgcagcagaaacaagagagagaacaccagcagcctgggctacgagtacaccggcagcaagaaggagttcccctgcgtggacggctacatctacgaccagaacacctggaagagcaccgccgtgacccagtggaacctggtgtgcgacagaaagtggctggccatgctgatccagcccctgttcatgttcggcgtgctgctgggcagcgtgaccttcggctacttcagcgacagactgggcagaagagtggtgctgtgggccaccagcagcagcatgttcctgttcggcatcgccgccgccttcgccgtggactactacaccttcatggccgccagattcttcctggccatggtggccagcggctacctggtggtgggcttcgtgtacgtgatggagttcatcggcatgaagagcagaacctgggccagcgtgcacctgcacagcttcttcgccgtgggcaccctgctggtggccctgaccggctacctggtgagaacctggtggctgtaccagatgatcctgagcaccgtgaccgtgcccttcatcctgtgctgctgggtgctgcccgagacccccttctggctgctgagcgagggcagatacgaggaggcccagaagatcgtggacatcatggccaagtggaacagagccagcagctgcaagctgagcgagctgctgagcctggacctgcagggccccgtgagcaacagccccaccgaggtgcagaagcacaacctgagctacctgttctacaactggagcatcaccaagagaaccctgaccgtgtggctgatctggttcaccggcagcctgggcttctacagcttcagcctgaacagcgtgaacctgggcggcaacgagtacctgaacctgttcctgctgggcgtggtggagatccccgcctacaccttcgtgtgcatcgccatggacaaggtgggcagaagaaccgtgctggcctacagcctgttctgcagcgccctggcctgcggcgtggtgatggtgatcccccagaagcactacatcctgggcgtggtgaccgccatggtgggcaagttcgccatcggcgccgccttcggcctgatctacctgtacaccgccgagctgtaccccaccatcgtgagaagcctggccgtgggcagcggcagcatggtgtgcagactggccagcatcctggcccccttcagcgtggacctgagcagcatctggatcttcatcccccagctgctgggccagcacctgcaggagtag

SEQ ID NO: 99592 - DNA, 600 bp, Artificial Sequence
  Description of Artificial Sequence: Synthetic coding sequence
atgggcagcagacacttcgagggcatctacgaccacgtgggccacttcggcagattccagagagtgctgtacttcatctgcgccttccagaacatcagctgcggcatccactacctggccagcgtgttcatgggcgtgaccccccaccacgtgtgcagaccccccggcaacgtgagccaggtggtgttccacaaccacagcaactggagcctggaggacaccggcgccctgctgagcagcggccagaaggactacgtgaccgtgcagctgcagaacggcgagatctgggagctgagcagatgcagcagaaacaagagagagaacaccagcagcctgggctacgagtacaccggcagcaagaaggagttcccctgcgtggacggctacatctacgaccagaacacctggaagagcaccgccgtgacccagtggaacctggtgtgcgacagaaagtggctggccatgctgatccagcccctgttcatgttcggcgtgctgctgggcagcgtgaccttcggctacttcagcgacagagtgggcttcctgaccgcctggtacaagaccagcggcttccccaccagcagcgccccccccctgtag

SEQ ID NO: 99593 - DNA, 1674 bp, Artificial Sequence
  Description of Artificial Sequence: Synthetic coding sequence
atgagagactacgacgaggtgaccgccttcctgggcgagtggggccccttccagagactgatcttcttcctgctgagcgccagcatcatccccaacggcttcaccggcctgagcagcgtgttcctgatcgccacccccgagcacagatgcagagtgcccgacgccgccaacctgagcagcgcctggagaaaccacaccgtgcccctgagactgagagacggcagagaggtgccccacagctgcagaagatacagactggccaccatcgccaacttcagcgccctgggcctggagcccggcagagacgtggacctgggccagctggagcaggagagctgcctggacggctgggagttcagccaggacgtgtacctgagcaccatcgtgaccgagtggaacctggtgtgcgaggacgactggaaggcccccctgaccatcagcctgttcttcgtgggcgtgctgctgggcagcttcatcagcggccagctgagcgacagattcggcagaaagaacgtgctgttcgtgaccatgggcatgcagaccggcttcagcttcctgcagatcttcagcaagaacttcgagatgttcgtggtgctgttcgtgctggtgggcatgggccagatcagcaactacgtggccgccttcgtgctgggcaccgagatcctgggcaagagcgtgagaatcatcttcagcaccctgggcgtgtgcatcttctacgccttcggctacatggtgctgcccctgttcgcctacttcatcagagactggagaatgctgctggtggccctgaccatgcccggcgtgctgtgcgtggccctgtggtggttcatccccgagagccccagatggctgatcagccagggcagattcgaggaggccgaggtgatcatcagaaaggccgccaaggccaacggcatcgtggtgcccagcaccatcttcgaccccagcgagctgcaggacctgagcagcaagaagcagcagagccacaacatcctggacctgctgagaacctggaacatcagaatggtgaccatcatgagcatcatgctgtggatgaccatcagcgtgggctacttcggcctgagcctggacacccccaacctgcacggcgacatcttcgtgaactgcttcctgagcgccatggtggaggtgcccgcctacgtgctggcctggctgctgctgcagtacctgcccagaagatacagcatggccaccgccctgttcctgggcggcagcgtgctgctgttcatgcagctggtgccccccgacctgtactacctggccaccgtgctggtgatggtgggcaagttcggcgtgaccgccgccttcagcatggtgtacgtgtacaccgccgagctgtaccccaccgtggtgagaaacatgggcgtgggcgtgagcagcaccgccagcagactgggcagcatcctgagcccctacttcgtgtacctgggcgcctacgacagattcctgccctacatcctgatgggcagcctgaccatcctgaccgccatcctgaccctgttcctgcccgagagcttcggcacccccctgcccgacaccatcgaccagatgctgagagtgaagggcatgaagcacagaaagacccccagccacaccagaatgctgaaggacggccaggagagacccaccatcctgaagagcaccgccttctag

SEQ ID NO: 99594 - DNA, 1746 bp, Artificial Sequence
  Description of Artificial Sequence: Synthetic coding sequence
atgagagactacgacgaggtgaccgccttcctgggcgagtggggccccttccagagactgatcttcttcctgctgagcgccagcatcatccccaacggcttcaccggcctgagcagcgtgttcctgatcgccacccccgagcacagatgcagagtgcccgacgccgccaacctgagcagcgcctggagaaaccacaccgtgcccctgagactgagagacggcagagaggtgccccacagctgcagaagatacagactggccaccatcgccaacttcagcgccctgggcctggagcccggcagagacgtggacctgggccagctggagcaggagagctgcctggacggctgggagttcagccaggacgtgtacctgagcaccatcgtgaccgagcaggacagcggcgcctacaacgccatgaagaacagaatgggcaagaagcccgccctgtgcctgcccgcccagtggaacctggtgtgcgaggacgactggaaggcccccctgaccatcagcctgttcttcgtgggcgtgctgctgggcagcttcatcagcggccagctgagcgacagattcggcagaaagaacgtgctgttcgtgaccatgggcatgcagaccggcttcagcttcctgcagatcttcagcaagaacttcgagatgttcgtggtgctgttcgtgctggtgggcatgggccagatcagcaactacgtggccgccttcgtgctgggcaccgagatcctgggcaagagcgtgagaatcatcttcagcaccctgggcgtgtgcatcttctacgccttcggctacatggtgctgcccctgttcgcctacttcatcagagactggagaatgctgctggtggccctgaccatgcccggcgtgctgtgcgtggccctgtggtggttcatccccgagagccccagatggctgatcagccagggcagattcgaggaggccgaggtgatcatcagaaaggccgccaaggccaacggcatcgtggtgcccagcaccatcttcgaccccagcgagctgcaggacctgagcagcaagaagcagcagagccacaacatcctggacctgctgagaacctggaacatcagaatggtgaccatcatgagcatcatgctgtggatgaccatcagcgtgggctacttcggcctgagcctggacacccccaacctgcacggcgacatcttcgtgaactgcttcctgagcgccatggtggaggtgcccgcctacgtgctggcctggctgctgctgcagtacctgcccagaagatacagcatggccaccgccctgttcctgggcggcagcgtgctgctgttcatgcagctggtgccccccgacctgtactacctggccaccgtgctggtgatggtgggcaagttcggcgtgaccgccgccttcagcatggtgtacgtgtacaccgccgagctgtaccccaccgtggtgagaaacatgggcgtgggcgtgagcagcaccgccagcagactgggcagcatcctgagcccctacttcgtgtacctgggcgcctacgacagattcctgccctacatcctgatgggcagcctgaccatcctgaccgccatcctgaccctgttcctgcccgagagcttcggcacccccctgcccgacaccatcgaccagatgctgagagtgaagggcatgaagcacagaaagacccccagccacaccagaatgctgaaggacggccaggagagacccaccatcctgaagagcaccgccttctag

SEQ ID NO: 99595 - DNA, 1656 bp, Artificial Sequence
  Description of Artificial Sequence: Synthetic coding sequence
atgagagactacgacgaggtgatcgccttcctgggcgagtggggccccttccagagactgatcttcttcctgctgagcgccagcatcatccccaacggcttcaacggcatgagcgtggtgttcctggccggcacccccgagcacagatgcagagtgcccgacgccgccaacctgagcagcgcctggagaaacaacagcgtgcccctgagactgagagacggcagagaggtgccccacagctgcagcagatacagactggccaccatcgccaacttcagcgccctgggcctggagcccggcagagacgtggacctgggccagctggagcaggagagctgcctggacggctgggagttcagccaggacgtgtacctgagcaccgtggtgaccgagtggaacctggtgtgcgaggacaactggaaggtgcccctgaccaccagcctgttcttcgtgggcgtgctgctgggcagcttcgtgagcggccagctgagcgacagattcggcagaaagaacgtgctgttcgccaccatggccgtgcagaccggcttcagcttcctgcagatcttcagcatcagctgggagatgttcaccgtgctgttcgtgatcgtgggcatgggccagatcagcaactacgtggtggccttcatcctgggcaccgagatcctgggcaagagcgtgagaatcatcttcagcaccctgggcgtgtgcaccttcttcgccgtgggctacatgctgctgcccctgttcgcctacttcatcagagactggagaatgctgctgctggccctgaccgtgcccggcgtgctgtgcgtgcccctgtggtggttcatccccgagagccccagatggctgatcagccagagaagattcagagaggccgaggacatcatccagaaggccgccaagatgaacaacatcgccgtgcccgccgtgatcttcgacagcgtggaggagctgaaccccctgaagcagcagaaggccttcatcctggacctgttcagaaccagaaacatcgccatcatgaccatcatgagcctgctgctgtggatgctgaccagcgtgggctacttcgccctgagcctggacgcccccaacctgcacggcgacgcctacctgaactgcttcctgagcgccctgatcgagatccccgcctacatcaccgcctggctgctgctgagaaccctgcccagaagatacatcatcgccgccgtgctgttctggggcggcggcgtgctgctgttcatccagctggtgcccgtggactactacttcctgagcatcggcctggtgatgctgggcaagttcggcatcaccagcgccttcagcatgctgtacgtgttcaccgccgagctgtaccccaccctggtgagaaacatggccgtgggcgtgaccagcaccgccagcagagtgggcagcatcatcgccccctacttcgtgtacctgggcgcctacaacagaatgctgccctacatcgtgatgggcagcctgaccgtgctgatcggcatcctgaccctgttcttccccgagagcctgggcatgaccctgcccgagaccctggagcagatgcagaaggtgaagtggttcagaagcggcaagaagaccagagacagcatggagaccgaggagaaccccaaggtgctgatcaccgccttctag

SEQ ID NO: 99596 - DNA, 1656 bp, Artificial Sequence
  Description of Artificial Sequence: Synthetic coding sequence
atgggcttcgacgtgctgctggaccaggtgggcggcatgggcagattccagatctgcctgatcgccttcttctgcatcaccaacatcctgctgttccccaacatcgtgctggagaacttcaccgccttcacccccagccacagatgctgggtgcccctgctggacaacgacaccgtgagcgacaacgacaccggcaccctgagcaaggacgacctgctgagaatcagcatccccctggacagcaacctgagaccccagaagtgccagagattcatccacccccagtggcagctgctgcacctgaacggcaccttccccaacaccaacgagcccgacaccgagccctgcgtggacggctgggtgtacgacagaagcagcttcctgagcaccatcgtgaccgagtgggacctggtgtgcgagagccagagcctgaagagcatggtgcagagcctgttcatggccggcagcctgctgggcggcctgatctacggccacctgagcgacagagtgggcagaaagatcatctgcaagctgtgcttcctgcagctggccatcagcaacacctgcgccgccttcgcccccaccttcctggtgtactgcatcctgagattcctggccggcttcagcaccatgaccatcctgggcaacaccttcatcctgagcctggagtggaccctgcccagaagcagaagcatgaccatcatggtgctgctgtgcagctacagcgtgggccagatgctgctgggcggcctggccttcgccatccaggactggcacatcctgcagctgaccgtgagcacccccatcatcgtgctgttcctgagcagctggaagatggtggagagcgccagatggctgatcatcaacaaccagctggacgagggcctgaaggagctgagaagagtggcccacatcaacggcaagaagaacaccgaggagaccctgaccaccgagctggtgagaagcaccatgaagaaggagctggacgccgtgagaatcaagaccagcatcttcagcctgttcagagcccccaagctgagaatgagagtgttcggcctgtgcttcgtgagattcgccatcaccgtgcccttctacggcctgatcctgaacctgcagcacctgggcagcaacgtgagcctgttccagatcctgtgcggcgccgtgaccttcaccgccagatgcgtgagcctgctgaccctgaaccacatgggcagaagaatcagccagatcctgttcaccttccccgtgggcctgttcatcctggtgaacaccttcctgccccaggagatgcagatcctgagagtggtgctggccaccctgggcatcggcagcgtgagcgccgccagcaacagcgccagcgtgcaccacaacgagctggtgcccaccatcctgagaagcaccgtggccggcatcaacgccgtgagcggcagaaccggcgccgccctggcccccctgctgatgaccctgatggcctacagcccccacctgccctggatcagctacggcgtgttccccatcctggccgtgcccgtgatcctgctgctgcccgagaccagagacctgcccctgcccaacaccatccaggacgtggagaacgagaaggacagcagaaacatcaagcaggaggacacctgcatgaaggtgacccagttctag

SEQ ID NO: 99597 - DNA, 738 bp, Artificial Sequence
  Description of Artificial Sequence: Synthetic coding sequence
atggaggtggaggaggccttccaggccgtgggcgagatgggcatctaccagatgtacctgtgcttcctgctggccgtgctgctgcagctgtacgtggccaccgaggccatcctgatcgccctggtgggcgccacccccagctaccactgggacctggccgagctgctgcccaaccagagccacggcaaccagagcgccggcgaggaccaggccttcggcgactggctgctgaccgccaacggcagcgagatccacaagcacgtgcacttcagcagcagcttcaccagcatcgccagcgagtggttcctgatcgccaacagaagctacaaggtgagcgccgccagcagcttcttcttcagcggcgtgttcgtgggcgtgatcagcttcggccagctgagcgacagattcggcagaaagaaggtgtacctgaccggcttcgccctggacatcctgttcgccatcgccaacggcttcagccccagctacgagttcttcgccgtgaccagattcctggtgggcatgatgaacggcggcatgagcctggtggccttcgtgctgctgaacgagtgcgtgggcaccgcctactgggccctggccggcagcatcggcggcctgttcttcgccgtgggcatcgcccagtacgccctgctgggctacttcatcagaagctggagaaccctggccatcctggtgaacctgcagggcaccgtggtgttcctgctgagcctggtggactag

SEQ ID NO: 99598 - DNA, 1644 bp, Artificial Sequence
  Description of Artificial Sequence: Synthetic coding sequence
atggaggtggaggaggccttccaggccgtgggcgagatgggcatctaccagatgtacctgtgcttcctgctggccgtgctgctgcagctgtacgtggccaccgaggccatcctgatcgccctggtgggcgccacccccagctaccactgggacctggccgagctgctgcccaaccagagccacggcaaccagagcgccggcgaggaccaggccttcggcgactggctgctgaccgccaacggcagcgagatccacaagcacgtgcacttcagcagcagcttcaccagcatcgccagcgagtggttcctgatcgccaacagaagctacaaggtgagcgccgccagcagcttcttcttcagcggcgtgttcgtgggcgtgatcagcttcggccagctgagcgacagattcggcagaaagaaggtgtacctgaccggcttcgccctggacatcctgttcgccatcgccaacggcttcagccccagctacgagttcttcgccgtgaccagattcctggtgggcatgatgaacggcggcatgagcctggtggccttcgtgctgctgaacgagtgcgtgggcaccgcctactgggccctggccggcagcatcggcggcctgttcttcgccgtgggcatcgcccagtacgccctgctgggctacttcatcagaagctggagaaccctggccatcctggtgaacctgcagggcaccgtggtgttcctgctgagcctgttcatccccgagagccccagatggctgtacagccagggcagactgagcgaggccgaggaggccctgtacctgatcgccaagagaaacagaaagctgaagtgcaccttcagcctgacccaccccgccaacagaagctgcagagagaccggcagcttcctggacctgttcagatacagagtgctgctgggccacaccctgatcctgatgttcatctggttcgtgtgcagcctggtgtactacggcctgaccctgagcgccggcgacctgggcggcagcatctacgccaacctggccctgagcggcctgatcgagatccccagctaccccctgtgcatctacctgatcaaccagaagtggttcggcagaaagagaaccctgagcgccttcctgtgcctgggcggcctggcctgcctgatcgtgatgttcctgcccgagaagaaggacaccggcgtgttcgccgtggtgaacagccacagcctgagcctgctgggcaagctgaccatcagcgccgccttcaacatcgtgtacatctacaccagcgagctgtaccccaccgtgatcagaaacgtgggcctgggcacctgcagcatgttcagcagagtgggcggcatcatcgcccccttcatccccagcctgaagtacgtgcagtggagcctgcccttcatcgtgttcggcgccaccggcctgaccagcggcctgctgagcctgctgctgcccgagaccctgaacagccccctgctggagaccttcagcgacctgcaggtgtacagctacagaagactgggcgaggaggccctgagcctgcaggccctggacccccagcagtgcgtggacaaggagagcagcctgggcagcgagagcgaggaggaggaggagttctacgacgccgacgaggagacccagatgatcaagtag

SEQ ID NO: 99599 - DNA, 1008 bp, Artificial Sequence
  Description of Artificial Sequence: Synthetic coding sequence
atgcccgccgtgctgggcttcgagggcagcgccaacaagatcggcgtgggcgtggtgagagacggcaaggtgctggccaaccccagaagaacctacgtgaccccccccggcaccggcttcctgcccggcgacaccgccagacaccacagagccgtgatcctggacctgctgcaggaggccctgaccgagagcggcctgaccagccaggacatcgactgcatcgcctacaccaagggccccggcatgggcgcccccctggtgagcgtggccgtggtggccagaaccgtggcccagctgtggaacaagcccctggtgggcgtgaaccactgcatcggccacatcgagatgggcagactgatcaccggcgccaccagccccaccgtgctgtacgtgagcggcggcaacacccaggtgatcgcctacagcgagcacagatacagaatcttcggcgagaccatcgacatcgccgtgggcaactgcctggacagattcgccagagtgctgaagatcagcaacgaccccagccccggctacaacatcgagcagatggccaagagaggcaagaagctggtggagctgccctacaccgtgaagggcatggacgtgagcttcagcggcatcctgagcttcatcgaggacgtggcccacagaatgctggccaccggcgagtgcacccccgaggacctgtgcttcagcctgcaggagaccgtgttcgccatgctggtggagatcaccgagagagccatggcccactgcggcagccaggaggccctgatcgtgggcggcgtgggctgcaacgtgagactgcaggagatgatggccaccatgtgccaggagagaggcgccagactgttcgccaccgacgagagattctgcatcgacaacggcgccatgatcgcccaggccggctgggagatgttcagagccggccacagaacccccctgagcgacagcggcgtgacccagagatacagaaccgacgaggtggaggtgacctggagagactag

SEQ ID NO: 99600 - DNA, 1563 bp, Artificial Sequence
  Description of Artificial Sequence: Synthetic coding sequence
atggccagcgaccccatcttcaccctggccccccccctgcactgccactacggcgccttcccccccaacgccagcggctgggagcagccccccaacgccagcggcgtgagcgtggccagcgccgccctggccgccagcgccgccagcagagtggccaccagcaccgaccccagctgcagcggcttcgccccccccgacttcaaccactgcctgaaggactgggactacaacggcctgcccgtgctgaccaccaacgccatcggccagtgggacctggtgtgcgacctgggctggcaggtgatcctggagcagatcctgttcatcctgggcttcgccagcggctacctgttcctgggctaccccgccgacagattcggcagaagaggcatcgtgctgctgaccctgggcctggtgggcccctgcggcgtgggcggcgccgccgccggcagcagcaccggcgtgatggccctgagattcctgctgggcttcctgctggccggcgtggacctgggcgtgtacctgatgagactggagctgtgcgaccccacccagagactgagagtggccctggccggcgagctggtgggcgtgggcggccacttcctgttcctgggcctggccctggtgagcaaggactggagattcctgcagagaatgatcaccgccccctgcatcctgttcctgttctacggctggcccggcctgttcctggagagcgccagatggctgatcgtgaagagacagatcgaggaggcccagagcgtgctgagaatcctggccgagagaaacagaccccacggccagatgctgggcgaggaggcccaggaggccctgcaggacctggagaacacctgccccctgcccgccaccagcagcttcagcttcgccagcctgctgaactacagaaacatctggaagaacctgctgatcctgggcttcaccaacttcatcgcccacgccatcagacactgctaccagcccgtgggcggcggcggcagccccagcgacttctacctgtgcagcctgctggccagcggcaccgccgccctggcctgcgtgttcctgggcgtgaccgtggacagattcggcagaagaggcatcctgctgctgagcatgaccctgaccggcatcgccagcctggtgctgctgggcctgtgggactacctgaacgaggccgccatcaccaccttcagcgtgctgggcctgttcagcagccaggccgccgccatcctgagcaccctgctggccgccgaggtgatccccaccaccgtgagaggcagaggcctgggcctgatcatggccctgggcgccctgggcggcctgagcggccccgcccagagactgcacatgggccacggcgccttcctgcagcacgtggtgctggccgcctgcgccctgctgtgcatcctgagcatcatgctgctgcccgagaccaagagaaagctgctgcccgaggtgctgagagacggcgagctgtgcagaagacccagcctgctgagacagcccccccccaccagatgcgaccacgtgcccctgctggccacccccaaccccgccctgtag

SEQ ID NO: 99601 - DNA, 1617 bp, Artificial Sequence
  Description of Artificial Sequence: Synthetic coding sequence
atggccagcgaccccatcttcaccctggccccccccctgcactgccactacggcgccttcccccccaacgccagcggctgggagcagccccccaacgccagcggcgtgagcgtggccagcgccgccctggccgccagcgccgccagcagagtggccaccagcaccgaccccagctgcagcggcttcgccccccccgacttcaaccactgcctgaaggactgggactacaacggcctgcccgtgctgaccaccaacgccatcggccagtgggacctggtgtgcgacctgggctggcaggtgatcctggagcagatcctgttcatcctgggcttcgccagcggctacctgttcctgggctaccccgccgacagattcggcagaagaggcatcgtgctgctgaccctgggcctggtgggcccctgcggcgtgggcggcgccgccgccggcagcagcaccggcgtgatggccctgagattcctgctgggcttcctgctggccggcgtggacctgggcgtgtacctgatgagactggagctgtgcgaccccacccagagactgagagtggccctggccggcgagctggtgggcgtgggcggccacttcctgttcctgggcctggccctggtgagcaaggactggagattcctgcagagaatgatcaccgccccctgcatcctgttcctgttctacggctggcccggcctgttcctggagagcgccagatggctgatcgtgaagagacagatcgaggaggcccagagcgtgctgagaatcctggccgagagaaacagaccccacggccagatgctgggcgaggaggcccaggaggccctgcaggacctggagaacacctgccccctgcccgccaccagcagcttcagcttcgccagcctgctgaactacagaaacatctggaagaacctgctgatcctgggcttcaccaacttcatcgcccacgccatcagacactgctaccagcccgtgggcggcggcggcagccccagcgacttctacctgtgcagcctgctggccagcggcaccgccgccctggcctgcgtgttcctgggcgtgaccgtggacagattcggcagaagaggcatcctgctgctgagcatgaccctgaccggcatcgccagcctggtgctgctgggcctgtgggactgcgagcaccccatcttccccaccgtgtgggcccagcagggcaaccccaacagagacctgaacgaggccgccatcaccaccttcagcgtgctgggcctgttcagcagccaggccgccgccatcctgagcaccctgctggccgccgaggtgatccccaccaccgtgagaggcagaggcctgggcctgatcatggccctgggcgccctgggcggcctgagcggccccgcccagagactgcacatgggccacggcgccttcctgcagcacgtggtgctggccgcctgcgccctgctgtgcatcctgagcatcatgctgctgcccgagaccaagagaaagctgctgcccgaggtgctgagagacggcgagctgtgcagaagacccagcctgctgagacagcccccccccaccagatgcgaccacgtgcccctgctggccacccccaaccccgccctgtag

SEQ ID NO: 99602 - DNA, 1086 bp, Artificial Sequence
  Description of Artificial Sequence: Synthetic coding sequence
atggccatcgacagaagaagagaggccgccggcggcggccccggcagacagcccgcccccgccgaggagaacggcagcctgccccccggcgacgccgccgccagcgcccccctgggcggcagagccggccccggcggcggcgccgagatccagcccctgccccccctgcaccccggcggcggcccccaccccagctgctgcagcgccgccgccgcccccagcctgctgctgctggactacgacggcagcgtgctgcccttcctgggcggcctgggcggcggctaccagaagaccctggtgctgctgacctggatccccgccctgttcatcggcttcagccagttcagcgacagcttcctgctggaccagcccaacttctggtgcagaggcgccggcaagggcaccgagctggccggcgtgaccaccaccggcagaggcggcgacatgggcaactggaccagcctgcccaccacccccttcgccaccgccccctgggaggccgccggcaacagaagcaacagcagcggcgccgacggcggcgacaccccccccctgcccagcccccccgacaagggcgacaacgccagcaactgcgactgcagagcctgggactacggcatcagagccggcctggtgcagaacgtggtgagcaagtgggacctggtgtgcgacaacgcctggaaggtgcacatcgccaagttcagcctgctggtgggcctgatcttcggctacctgatcaccggctgcatcgccgactgggtgggcagaagacccgtgctgctgttcagcatcatcttcatcctgatcttcggcctgaccgtggccctgagcgtgaacgtgaccatgttcagcaccctgagattcttcgagggcttctgcctggccggcatcatcctgaccctgtacgccctgagaatcgagctgtgcccccccggcaagagattcatgatcaccatggtggccagcttcgtggccatggccggccagttcctgatgcccggcctggccgccctgtgcagagactggcaggtgctgcaggccctgatcatctgccccttcctgctgatgctgctgtactggagctag

SEQ ID NO: 99603 - DNA, 1218 bp, Artificial Sequence
  Description of Artificial Sequence: Synthetic coding sequence
atgttcagcaccctgagattcttcgagggcttctgcctggccggcatcatcctgaccctgtacgccctgagaatcgagctgtgcccccccggcaagagattcatgatcaccatggtggccagcttcgtggccatggccggccagttcctgatgcccggcctggccgccctgtgcagagactggcaggtgctgcaggccctgatcatctgccccttcctgctgatgctgctgtactggagcatcttccccgagagcctgagatggctgatggccacccagcagttcgagagcgccaagagactgatcctgcacttcacccagaagaacagaatgaaccccgagggcgacatcaagggcgtgatccccgagctggagaaggagctgagcagaagacccaagaaggtgtgcatcgtgaaggtggtgggcaccagaaacctgtggaagaacatcgtggtgctgtgcgtgaacagcctgaccggctacggcatccaccactgcttcgccagaagcatgatgggccacgaggtgaaggtgcccctgctggagaacttctacgccgactactacaccaccgccagcatcgccctggtgagctgcctggccatgtgcgtggtggtgagattcctgggcagaagaggcggcctgctgctgttcatgatcctgaccgccctggccagcctgctgcagctgggcctgctgaacctgatcggcaagtacagccagcaccccgacagcggcatgagcgacagcgtgaaggacaagttcagcatcgccttcagcatcgtgggcatgttcgccagccacgccgtgggcagcctgagcgtgttcttctgcgccgagatcacccccaccgtgatcagatgcggcggcctgggcctggtgctggccagcgccggcttcggcatgctgaccgcccccatcatcgagctgcacaaccagaagggctacttcctgcaccacatcatcttcgcctgctgcaccctgatctgcatcatctgcatcctgctgctgcccgagagcagagaccagaacctgcccgagaacatcagcaacggcgagcactacaccagacagcccctgctgccccacaagaagggcgagcagcccctgctgctgaccaacgccgagctgaaggactacagcggcctgcacgacgccgccgccgccggcgacaccctgcccgagggcgccaccgccaacggcatgaaggccatgtag

SEQ ID NO: 99604 - DNA, 2061 bp, Artificial Sequence
  Description of Artificial Sequence: Synthetic coding sequence
atggccatcgacagaagaagagaggccgccggcggcggccccggcagacagcccgcccccgccgaggagaacggcagcctgccccccggcgacgccgccgccagcgcccccctgggcggcagagccggccccggcggcggcgccgagatccagcccctgccccccctgcaccccggcggcggcccccaccccagctgctgcagcgccgccgccgcccccagcctgctgctgctggactacgacggcagcgtgctgcccttcctgggcggcctgggcggcggctaccagaagaccctggtgctgctgacctggatccccgccctgttcatcggcttcagccagttcagcgacagcttcctgctggaccagcccaacttctggtgcagaggcgccggcaagggcaccgagctggccggcgtgaccaccaccggcagaggcggcgacatgggcaactggaccagcctgcccaccacccccttcgccaccgccccctgggaggccgccggcaacagaagcaacagcagcggcgccgacggcggcgacaccccccccctgcccagcccccccgacaagggcgacaacgccagcaactgcgactgcagagcctgggactacggcatcagagccggcctggtgcagaacgtggtgagcaagtgggacctggtgtgcgacaacgcctggaaggtgcacatcgccaagttcagcctgctggtgggcctgatcttcggctacctgatcaccggctgcatcgccgactgggtgggcagaagacccgtgctgctgttcagcatcatcttcatcctgatcttcggcctgaccgtggccctgagcgtgaacgtgaccatgttcagcaccctgagattcttcgagggcttctgcctggccggcatcatcctgaccctgtacgccctgagaatcgagctgtgcccccccggcaagagattcatgatcaccatggtggccagcttcgtggccatggccggccagttcctgatgcccggcctggccgccctgtgcagagactggcaggtgctgcaggccctgatcatctgccccttcctgctgatgctgctgtactggagcatcttccccgagagcctgagatggctgatggccacccagcagttcgagagcgccaagagactgatcctgcacttcacccagaagaacagaatgaaccccgagggcgacatcaagggcgtgatccccgagctggagaaggagctgagcagaagacccaagaaggtgtgcatcgtgaaggtggtgggcaccagaaacctgtggaagaacatcgtggtgctgtgcgtgaacagcctgaccggctacggcatccaccactgcttcgccagaagcatgatgggccacgaggtgaaggtgcccctgctggagaacttctacgccgactactacaccaccgccagcatcgccctggtgagctgcctggccatgtgcgtggtggtgagattcctgggcagaagaggcggcctgctgctgttcatgatcctgaccgccctggccagcctgctgcagctgggcctgctgaacctgatcggcaagtacagccagcaccccgacagcggcatgagcgacagcgtgaaggacaagttcagcatcgccttcagcatcgtgggcatgttcgccagccacgccgtgggcagcctgagcgtgttcttctgcgccgagatcacccccaccgtgatcagatgcggcggcctgggcctggtgctggccagcgccggcttcggcatgctgaccgcccccatcatcgagctgcacaaccagaagggctacttcctgcaccacatcatcttcgcctgctgcaccctgatctgcatcatctgcatcctgctgctgcccgagagcagagaccagaacctgcccgagaacatcagcaacggcgagcactacaccagacagcccctgctgccccacaagaagggcgagcagcccctgctgctgaccaacgccgagctgaaggactacagcggcctgcacgacgccgccgccgccggcgacaccctgcccgagggcgccaccgccaacggcatgaaggccatgtag

SEQ ID NO: 99605 - DNA, 1218 bp, Artificial Sequence; identical to SEQ ID NO: 99603
  Description of Artificial Sequence: Synthetic coding sequence

SEQ ID NO: 99606 - DNA, 969 bp, Artificial Sequence
  Description of Artificial Sequence: Synthetic coding sequence
atgggcttcgacgtgctgctggaccaggtgggcggcatgggcagattccagatctgcctgatcgccttcttctgcatcaccaacatcctgctgttccccaacatcgtgctggagaacttcaccgccttcacccccagccacagatgctgggtgcccctgctggacaacgacaccgtgagcgacaacgacaccggcaccctgagcaaggacgacctgctgagaatcagcatccccctggacagcaacctgagaccccagaagtgccagagattcatccacccccagtggcagctgctgcacctgaacggcaccttccccaacaccaacgagcccgacaccgagccctgcgtggacggctgggtgtacgacagaagcagcttcctgagcaccatcgtgaccgagtgggacctggtgtgcgagagccagagcctgaagagcatggtgcagagcctgttcatggccggcagcctgctgggcggcctgatctacggccacctgagcgacagagtgggcagaaagatcatctgcaagctgtgcttcctgcagctggccatcagcaacacctgcgccgccttcgcccccaccttcctggtgtactgcatcctgagattcctggccggcttcagcaccatgaccatcctgggcaacaccttcatcctgagcctggagtggaccctgcccagaagcagaagcatgaccatcatggtgctgctgtgcagctacagcgtgggccagatgctgctgggcggcctggccttcgccatccaggactggcacatcctgcagctgaccgtgagcacccccatcatcgtgctgttcctgagcagctggtacgagcagagcccccacagcctgcccgtgagcgaggccatggtggacatcgagagaaagatcctgacccccggcatctgcagcgtgagcggcctggtgctgagccacgacgtgcacagcacctactgcgtgacctag

SEQ ID NO: 99607 - DNA, 780 bp, Artificial Sequence
  Description of Artificial Sequence: Synthetic coding sequence
atgagagcccaggaggacctggagggcagaacccagcacgagaccaccagagaccccagcacccccctgcccaccgagcccaagttcgacatgctgtacaagatcgaggacgtgcccccctggtacctgtgcatcctgctgggcttccagcactacctgacctgcttcagcggcaccatcgccgtgcccttcctgctggccgaggccctgtgcgtgggccacgaccagcacatggtgagccagctgatcggcaccatcttcacctgcgtgggcatgttctgcaccctgttcggcatgatcaccgccgtgggcctgagcaacctgcagttcgtggacatgaacagcagcagaaacctgttcgtgctgggcttcagcatgttcttcggcctgaccctgcccaactacctggagagcaaccccggcgccatcaacaccggcatcctggaggtggaccagatcctgatcgtgctgctgaccaccgagatgttcgtgggcggctgcctggccttcatcctggacaacaccgtgcccggcagccccgaggagagaggcctgatccagtggaaggccggcgcccacgccaacagcgacatgagcagcagcctgaagagctacgacttccccatcggcatgggcatcgtgaagagaatcaccttcctgaagtacatccccatctgccccgtgttcaagggcttcagcagcagcagcaaggaccagatcgccatccccgaggacacccccgagaacaccgagaccgccagcgtgtgcaccaaggtgtag

SEQ ID NO: 99608 - DNA, 1797 bp, Artificial Sequence
  Description of Artificial Sequence: Synthetic coding sequence
atgagagcccaggaggacctggagggcagaacccagcacgagaccaccagagaccccagcacccccctgcccaccgagcccaagttcgacatgctgtacaagatcgaggacgtgcccccctggtacctgtgcatcctgctgggcttccagcactacctgacctgcttcagcggcaccatcgccgtgcccttcctgctggccgaggccctgtgcgtgggccacgaccagcacatggtgagccagctgatcggcaccatcttcacctgcgtgggcatcaccaccctgatccagaccaccgtgggcatcagactgcccctgttccaggccagcgccttcgccttcctggtgcccgccaaggccatcctggccctggagagatggaagtgcccccccgaggaggagatctacggcaactggagcctgcccctgaacaccagccacatctggcaccccagaatcagagaggtgcagggcgccatcatggtgagcagcgtggtggaggtggtgatcggcctgctgggcctgcccggcgccctgctgaactacatcggccccctgaccgtgacccccaccgtgagcctgatcggcctgagcgtgttccaggccgccggcgacagagccggcagccactggggcatcagcgcctgcagcatcctgctgatcatcctgttcagccagtacctgagaaacctgaccttcctgctgcccgtgtacagatggggcaagggcctgaccctgctgagaatccagatcttcaagatgttccccatcatgctggccatcatgaccgtgtggctgctgtgctacgtgctgaccctgaccgacgtgctgcccaccgaccccaaggcctacggcttccaggccagaaccgacgccagaggcgacatcatggccatcgccccctggatcagaatcccctacccctgccagtggggcctgcccaccgtgaccgccgccgccgtgctgggcatgttcagcgccaccctggccggcatcatcgagagcatcggcgactactacgcctgcgccagactggccggcgccccccccccccccgtgcacgccatcaacagaggcatcttcaccgagggcatctgctgcatcatcgccggcctgctgggcaccggcaacggcagcaccagcagcagccccaacatcggcgtgctgggcatcaccaaggtgggcagcagaagagtggtgcagtacggcgccgccatcatgctggtgctgggcaccatcggcaagttcaccgccctgttcagcagcctgcccgaccccatcctgggcggcatgttctgcaccctgttcggcatgatcaccgccgtgggcctgagcaacctgcagttcgtggacatgaacagcagcagaaacctgttcgtgctgggcttcagcatgttcttcggcctgaccctgcccaactacctggagagcaaccccggcgccatcaacaccggcatcctggaggtggaccagatcctgatcgtgctgctgaccaccgagatgttcgtgggcggctgcctggccttcatcctggacaacaccgtgcccggcagccccgaggagagaggcctgatccagtggaaggccggcgcccacgccaacagcgacatgagcagcagcctgaagagctacgacttccccatcggcatgggcatcgtgaagagaatcaccttcctgaagtacatccccatctgccccgtgttcaagggcttcagcagcagcagcaaggaccagatcgccatccccgaggacacccccgagaacaccgagaccgccagcgtgtgcaccaaggtgtag

SEQ ID NO: 99609 - DNA, 1809 bp, Artificial Sequence
  Description of Artificial Sequence: Synthetic coding sequence
atgagagcccaggaggacctggagggcagaacccagcacgagaccaccagagaccccagcacccccctgcccaccgagcccaagttcgacatgctgtacaagatcgaggacgtgcccccctggtacctgtgcatcctgctgggcttccagcactacctgacctgcttcagcggcaccatcgccgtgcccttcctgctggccgaggccctgtgcgtgggccacgaccagcacatggtgagccagctgatcggcaccatcttcacctgcgtgggcatcaccaccctgatccagaccaccgtgggcatcagactgcccctgttccaggccagcgccttcgccttcctggtgcccgccaaggccatcctggccctggagagatggaagtgcccccccgaggaggagatctacggcaactggagcctgcccctgaacaccagccacatctggcaccccagaatcagagaggtgggcctgcacgtgcagggcgccatcatggtgagcagcgtggtggaggtggtgatcggcctgctgggcctgcccggcgccctgctgaactacatcggccccctgaccgtgacccccaccgtgagcctgatcggcctgagcgtgttccaggccgccggcgacagagccggcagccactggggcatcagcgcctgcagcatcctgctgatcatcctgttcagccagtacctgagaaacctgaccttcctgctgcccgtgtacagatggggcaagggcctgaccctgctgagaatccagatcttcaagatgttccccatcatgctggccatcatgaccgtgtggctgctgtgctacgtgctgaccctgaccgacgtgctgcccaccgaccccaaggcctacggcttccaggccagaaccgacgccagaggcgacatcatggccatcgccccctggatcagaatcccctacccctgccagtggggcctgcccaccgtgaccgccgccgccgtgctgggcatgttcagcgccaccctggccggcatcatcgagagcatcggcgactactacgcctgcgccagactggccggcgccccccccccccccgtgcacgccatcaacagaggcatcttcaccgagggcatctgctgcatcatcgccggcctgctgggcaccggcaacggcagcaccagcagcagccccaacatcggcgtgctgggcatcaccaaggtgggcagcagaagagtggtgcagtacggcgccgccatcatgctggtgctgggcaccatcggcaagttcaccgccctgttcagcagcctgcccgaccccatcctgggcggcatgttctgcaccctgttcggcatgatcaccgccgtgggcctgagcaacctgcagttcgtggacatgaacagcagcagaaacctgttcgtgctgggcttcagcatgttcttcggcctgaccctgcccaactacctggagagcaaccccggcgccatcaacaccggcatcctggaggtggaccagatcctgatcgtgctgctgaccaccgagatgttcgtgggcggctgcctggccttcatcctggacaacaccgtgcccggcagccccgaggagagaggcctgatccagtggaaggccggcgcccacgccaacagcgacatgagcagcagcctgaagagctacgacttccccatcggcatgggcatcgtgaagagaatcaccttcctgaagtacatccccatctgccccgtgttcaagggcttcagcagcagcagcaaggaccagatcgccatccccgaggacacccccgagaacaccgagaccgccagcgtgtgcaccaaggtgtag

SEQ ID NO: 99610 - DNA, 1179 bp, Artificial Sequence
  Description of Artificial Sequence: Synthetic coding sequence
atgagagcccaggaggacctggagggcagaacccagcacgagaccaccagagaccccagcacccccctgcccaccgagcccaagttcgacatgctgtacaagatcgaggacgtgcccccctggtacctgtgcatcctgctgggcttccagcactacctgacctgcttcagcggcaccatcgccgtgcccttcctgctggccgaggccctgtgcgtgggccacgaccagcacatggtgagccagctgatcggcaccatcttcacctgcgtgggcatcaccaccctgatccagaccaccgtgggcatcagactgcccctgttccaggccagcgccttcgccttcctggtgcccgccaaggccatcctggccctggagagatggaagtgcccccccgaggaggagatctacggcaactggagcctgcccctgaacaccagccacatctggcaccccagaatcagagaggtgggcctgcacgtgagcatcgaggaggccggcggctacatgggcgtgagagtggccgccgagttcggcgacctgagaagatggagcagaagcttcgtgcccgccagcagcagccaggtgcagggcgccatcatggtgagcagcgtggtggaggtggtgatcggcctgctgggcctgcccggcgccctgctgaactacatcggccccctgaccgtgacccccaccgtgagcctgatcggcctgagcgtgttccaggccgccggcgacagagccggcagccactggggcatcagcgcctgcagcatcctgctgatcatcctgttcagccagtacctgagaaacctgaccttcctgctgccctgcgcccagcagagcgcccccctgtggcaggccagcctgagccccagcgagatcaccacccccgtgcccgcctggctggtgcaccaccccctgcagtacatgctgagcaccggcgccagcagccccaaggccttcgccgccagcagcagaggctactgggccagagccaccggcccccccagacccgtgcccaccctggccagctgggagctgcccagatgggccgccggcgcctggtgcagcatggtgagactgagctgctggagctgggcccccagcgccagcagcagacccagcagccccagaagcctgacccccagctggggcgcctgcagcgccctgagcctggcctag

SEQ ID NO: 99611 - DNA, 1953 bp, Artificial Sequence
  Description of Artificial Sequence: Synthetic coding sequence
atgatgggcatcggcaagaacaccaccagcaagagcatggaggccggcagcagcaccgagggcaagtacgaggacgaggccaagcaccccgccttcttcaccctgcccgtggtgatcaacggcggcgccaccagcagcggcgagcaggacaacgaggacaccgagctgatggccatctacaccaccgagaacggcatcgccgagaagagcagcctggccgagaccctggacagcaccggcagcctggacccccagagaagcgacatgatctacaccatcgaggacgtgcccccctggtacctgtgcatcttcctgggcctgcagcactacctgacctgcttcagcggcaccatcgccgtgcccttcctgctggccgacgccatgtgcgtgggctacgaccagtgggccaccagccagctgatcggcaccatcttcttctgcgtgggcatcaccaccctgctgcagaccaccttcggctgcagactgcccctgttccaggccagcgccttcgccttcctggcccccgccagagccatcctgagcctggacaagtggaagtgcaacaccaccgacgtgagcgtggccaacggcaccgccgagctgctgcacaccgagcacatctggtaccccagaatcagagagatccagggcgccatcatcatgagcagcctgatcgaggtggtgatcggcctgctgggcctgcccggcgccctgctgaagtacatcggccccctgaccatcacccccaccgtggccctgatcggcctgagcggcttccaggccgccggcgagagagccggcaagcactggggcatcgccatgctgaccatcttcctggtgctgctgttcagccagtacgccagaaacgtgaagttccccctgcccatctacaagagcaagaagggctggaccgcctacaagctgcagctgttcaagatgttccccatcatcctggccatcctggtgagctggctgctgtgcttcatcttcaccgtgaccgacgtgttcccccccgacagcaccaagtacggcttctacgccagaaccgacgccagacagggcgtgctgctggtggccccctggttcaaggtgccctaccccttccagtggggcctgcccaccgtgagcgccgccggcgtgatcggcatgctgagcgccgtggtggccagcatcatcgagagcatcggcgactactacgcctgcgccagactgagctgcgccccccccccccccatccacgccatcaacagaggcatcttcgtggagggcctgagctgcgtgctggacggcatcttcggcaccggcaacggcagcaccagcagcagccccaacatcggcgtgctgggcatcaccaaggtgggcagcagaagagtgatccagtgcggcgccgccctgatgctggccctgggcatgatcggcaagttcagcgccctgttcgccagcctgcccgaccccgtgctgggcgccctgttctgcaccctgttcggcatgatcaccgccgtgggcctgagcaacctgcagttcatcgacctgaacagcagcagaaacctgttcgtgctgggcttcagcatcttcttcggcctggtgctgcccagctacctgagacagaaccccctggtgaccggcatcaccggcatcgaccaggtgctgaacgtgctgctgaccaccgccatgttcgtgggcggctgcgtggccttcatcctggacaacaccatccccggcacccccgaggagagaggcatcagaaagtggaagaagggcgtgggcaagggcaacaagagcctggacggcatggagagctacaacctgcccttcggcatgaacatcatcaagaagtacagatgcttcagctacctgcccatcagccccaccttcgtgggctacacctggaagggcctgagaaagagcgacaacagcagaagcagcgacgaggacagccaggccaccggctag

SEQ ID NO: 99612 - DNA, 1953 bp, Artificial Sequence; identical to SEQ ID NO: 99611
  Description of Artificial Sequence: Synthetic coding sequence

SEQ ID NO: 99613 - DNA, 915 bp, Artificial Sequence
  Description of Artificial Sequence: Synthetic coding sequence
tgaggctacgaccagtgggccaccagccagctgatcggcaccatcttcttctgcgtgggcatcaccaccctgctgcagaccaccttcggctgcagaaccatcttcctggtgctgctgttcagccagtacgccagaaacgtgaagttccccctgcccatctacaagagcaagaagggctggaccgcctacaagctgcagctgttcaagatgttccccatcatcctggccatcctggtgagctggctgctgtgcttcatcttcaccgtgaccgacgtgttcccccccgacagcaccaagtacggcttctacgccagaaccgacgccagacagggcgtgctgctggtggccccctggttcaaggtgccctaccccttccagtggggcctgcccaccgtgagcgccgccggcgtgatcggcatgctgagcgccgtggtggccagcatcatcgagagcatcggcgactactacgcctgcgccagactgagctgcgccccccccccccccatccacgccatcaacagaggcatcttcgtggagggcctgagctgcgtgctggacggcatcttcggcaccggcaacggcagcaccagcagcagccccaacatcggcgtgctgggcatcaccaaggtgggcagcagaagagtgatccagtgcggcgccgccctgatgctggccctgggcatgatcggcaagttcagcgccctgttcgccagcctgcccgaccccgtgctgggcgccctgttctgcaccctgttcggcatgatcaccgccgtgggcctgagcaacctgcagttcatcgacctgaacagcagcagaaacctgttcgtgctgggcttcagcatcttcttcggcctggtgctgcccagctacctgagacagaaccccctggtgaccggcatcaccggcatcgactag

SEQ ID NO: 99614 - DNA, 1611 bp, Artificial Sequence
  Description of Artificial Sequence: Synthetic coding sequence
atgatgggcatcggcaagaacaccaccagcaagagcatggaggccggcagcagcaccgagggcaagtacgaggacgaggccaagcaccccgccttcttcaccctgcccgtggtgatcaacggcggcgccaccagcagcggcgagcaggacaacgaggacaccgagctgatggccatctacaccaccgagaacggcatcgccgagaagagcagcctggccgagaccctggacagcaccggcagcctggacccccagagaagcgacatgatctacaccatcgaggacgtgcccccctggtacctgtgcatcttcctgggcctgcagcactacctgacctgcttcagcggcaccatcgccgtgcccttcctgctggccgacgccatgtgcgtgggctacgaccagtgggccaccagccagctgatcggcaccatcttcttctgcgtgggcatcaccaccctgctgcagaccaccttcggctgcagaaccatcttcctggtgctgctgttcagccagtacgccagaaacgtgaagttccccctgcccatctacaagagcaagaagggctggaccgcctacaagctgcagctgttcaagatgttccccatcatcctggccatcctggtgagctggctgctgtgcttcatcttcaccgtgaccgacgtgttcccccccgacagcaccaagtacggcttctacgccagaaccgacgccagacagggcgtgctgctggtggccccctggttcaaggtgccctaccccttccagtggggcctgcccaccgtgagcgccgccggcgtgatcggcatgctgagcgccgtggtggccagcatcatcgagagcatcggcgactactacgcctgcgccagactgagctgcgccccccccccccccatccacgccatcaacagaggcatcttcgtggagggcctgagctgcgtgctggacggcatcttcggcaccggcaacggcagcaccagcagcagccccaacatcggcgtgctgggcatcaccaaggtgggcagcagaagagtgatccagtgcggcgccgccctgatgctggccctgggcatgatcggcaagttcagcgccctgttcgccagcctgcccgaccccgtgctgggcgccctgttctgcaccctgttcggcatgatcaccgccgtgggcctgagcaacctgcagttcatcgacctgaacagcagcagaaacctgttcgtgctgggcttcagcatcttcttcggcctggtgctgcccagctacctgagacagaaccccctggtgaccggcatcaccggcatcgaccaggtgctgaacgtgctgctgaccaccgccatgttcgtgggcggctgcgtggccttcatcctggacaacaccatccccggcacccccgaggagagaggcatcagaaagtggaagaagggcgtgggcaagggcaacaagagcctggacggcatggagagctacaacctgcccttcggcatgaacatcatcaagaagtacagatgcttcagctacctgcccatcagccccaccttcgtgggctacacctggaagggcctgagaaagagcgacaacagcagaagcagcgacgaggacagccaggccaccggctag

SEQ ID NO: 99615 - DNA, 3300 bp, Artificial Sequence
  Description of Artificial Sequence: Synthetic coding sequence
atgggcaagctgatcagaatgggcccccaggagagatggctgctgagaaccaagagactgcactggagcagactgctgttcctgctgggcatgctgatcatcggcagcacctaccagcacctgagaagacccagaggcctgagcagcctgtgggccgccgtgagcagccaccagcccatcaagctggccagcagagacctgagcagcgaggagatgatgatgatgagcagcagccccagcaagcccagcagcgagatgggcggcaagatgctggtgccccaggccagcgtgggcagcgacgaggccaccctgagcatgaccgtggagaacatccccagcatgcccaagagaaccgccaagatgatccccaccaccaccaagaacaactacagccccaccgccgccggcaccgagagaagaaaggaggacacccccaccagcagcagaaccctgacctactacaccagcaccagcagcagacagatcgtgaagaagtacacccccacccccagaggcgagatgaagagctacagccccacccaggtgagagagaaggtgaagtacacccccagccccagaggcagaagagtgggcacctacgtgcccagcaccttcatgaccatggagaccagccacgccatcacccccagaaccaccgtgaaggacagcgacatcaccgccacctacaagatcctggagaccaacagcctgaagagaatcatggaggagaccacccccaccaccctgaagggcatgttcgacagcacccccaccttcctgacccacgaggtggaggccaacgtgctgaccagccccagaagcgtgatggagaagaacaacctgttcccccccagaagagtggagagcaacagcagcgcccacccctggggcctggtgggcaagagcaaccccaagaccccccagggcaccgtgctgctgcacacccccgccaccagcgagggccaggtgaccatcagcaccatgaccggcagcagccccgccgagaccaaggccttcaccgccgcctggagcctgagaaaccccagccccagaaccagcgtgagcgccatcaagaccgcccccgccatcgtgtggagactggccaagaagcccagcaccgcccccagcaccagcaccacccccaccgtgagagccaagctgaccatgcaggtgcaccactgcgtggtggtgaagcccacccccgccatgctgaccacccccagccccagcctgaccaccgccctgctgcccgaggagctgagccccagccccagcgtgctgccccccagcctgcccgacctgcaccccaagggcgagtacccccccgacctgttcagcgtggaggagagaagacagggctgggtggtgctgcacgtgttcggcatgatgtacgtgttcgtggccctggccatcgtgtgcgacgagtacttcgtgcccgccctgggcgtgatcaccgacaagctgcagatcagcgaggacgtggccggcgccaccttcatggccgccggcggcagcgcccccgagctgttcaccagcctgatcggcgtgttcatcagccacagcaacgtgggcatcggcaccatcgtgggcagcgccgtgttcaacatcctgttcgtgatcggcacctgcagcctgttcagcagagagatcctgaacctgacctggtggcccctgttcagagacgtgagcttctacatcctggacctgatcatgctgatcctgttcttcctggacagcctgatcgcctggtgggagagcctgctgctgctgctggcctacgccttctacgtgttcaccatgaagtggaacaagcacatcgaggtgtgggtgaaggagcagctgagcagaagacccgtggccaaggtgatggccctggaggacctgagcaagcccggcgacggcgccatcgccgtggacgagctgcaggacaacaagaagctgaagctgcccagcctgctgaccagaggcagcagcagcaccagcctgcacaacagcaccatcagaagcaccatctaccagctgatgctgcacagcctggaccccctgagagaggtgagactggccaaggagaaggaggaggagagcctgaaccagggcgccagagcccagccccaggccaaggccgagagcaagcccgaggaggaggagcccgccaagctgcccgccgtgaccgtgacccccgcccccgtgcccgacatcaagggcgaccagaaggagaaccccggcggccaggaggacgtggccgaggccgagagcaccggcgagatgcccggcgaggagggcgagaccgccggcgagggcgagaccgaggagaagagcggcggcgagacccagcccgagggcgagggcgagaccgagacccagggcaagggcgaggagtgcgaggacgagaacgaggccgagggcaagggcgacaacgagggcgaggacgagggcgagatccacgccgaggacggcgagatgaagggcaacgagggcgagaccgagagccaggagctgagcgccgagaaccacggcgaggccaagaacgacgagaagggcgtggaggacggcggcggcagcgacggcggcgacagcgaggaggaggaggaggaggaggaggagcaggaggaggaggaggaggaggaggagcaggaggaggaggaggaggaggaggaggaggaggaggagaagggcaacgaggagcccctgagcctggactggcccgagaccagacagaagcaggccatctacctgttcctgctgcccatcgtgttccccctgtggctgaccgtgcccgacgtgagaagacaggagagcagaaagttcttcgtgttcaccttcctgggcagcatcatgtggatcgccatgttcagctacctgatggtgtggtgggcccaccaggtgggcgagaccatcggcatcagcgaggagatcatgggcctgaccatcctggccgccggcaccagcatccccgacctgatcaccagcgtgatcgtggccagaaagggcctgggcgacatggccgtgagcagcagcgtgggcagcaacatcttcgacatcaccgtgggcctgcccgtgccctggctgctgttcagcctgatcaacggcctgcagcccgtgcccgtgagcagcaacggcctgttctgcgccatcgtgctgctgttcctgatgctgctgttcgtgatcagcagcatcgccagctgcaagtggagaatgaacaagatcctgggcttcaccatgttcctgctgtacttcgtgttcctgatcatcagcgtgatgctggaggacagaatcatcagctgccccgtgagcgtgtag

SEQ ID NO: 99616 - DNA, 3246 bp, Artificial Sequence
  Description of Artificial Sequence: Synthetic coding sequence
atgggcaagctgatcagaatgggcccccaggagagatggctgctgagaaccaagagactgcactggagcagactgctgttcctgctgggcatgctgatcatcggcagcacctaccagcacctgagaagacccagaggcctgagcagcctgtgggccgccgtgagcagccaccagcccatcaagctggccagcagagacctgagcagcgaggagatgatgatgatgagcagcagccccagcaagcccagcagcgagatgggcggcaagatgctggtgccccaggccagcgtgggcagcgacgaggccaccctgagcatgaccgtggagaacatccccagcatgcccaagagaaccgccaagatgatccccaccaccaccaagaacaactacagccccaccgccgccggcaccgagagaagaaaggaggacacccccaccagcagcagaaccctgacctactacaccagcaccagcagcagacagatcgtgaagaagtacacccccacccccagaggcgagatgaagagctacagccccacccaggtgagagagaaggtgaagtacacccccagccccagaggcagaagagtgggcacctacgtgcccagcaccttcatgaccatggagaccagccacgccatcacccccagaaccaccgtgaaggacagcgacatcaccgccacctacaagatcctggagaccaacagcctgaagagaatcatggaggagaccacccccaccaccctgaagggcatgttcgacagcacccccaccttcctgacccacgaggtggaggccaacgtgctgaccagccccagaagcgtgatggagaagaacaacctgttcccccccagaagagtggagagcaacagcagcgcccacccctggggcctggtgggcaagagcaaccccaagaccccccagggcaccgtgctgctgcacacccccgccaccagcgagggccaggtgaccatcagcaccatgaccggcagcagccccgccgagaccaaggccttcaccgccgcctggagcctgagaaaccccagccccagaaccagcgtgagcgccatcaagaccgcccccgccatcgtgtggagactggccaagaagcccagcaccgcccccagcaccagcaccacccccaccgtgagagccaagctgaccatgcaggtgcaccactgcgtggtggtgaagcccacccccgccatgctgaccacccccagccccagcctgaccaccgccctgctgcccgaggagctgagccccagccccagcgtgctgccccccagcctgcccgacctgcaccccaagggcgagtacccccccgacctgttcagcgtggaggagagaagacagggctgggtggtgctgcacgtgttcggcatgatgtacgtgttcgtggccctggccatcgtgtgcgacgagtacttcgtgcccgccctgggcgtgatcaccgacaagctgcagatcagcgaggacgtggccggcgccaccttcatggccgccggcggcagcgcccccgagctgttcaccagcctgatcggcgtgttcatcagccacagcaacgtgggcatcggcaccatcgtgggcagcgccgtgttcaacatcctgttcgtgatcggcacctgcagcctgttcagcagagagatcctgaacctgacctggtggcccctgttcagagacgtgagcttctacatcctggacctgatcatgctgatcctgttcttcctggacagcctgatcgcctggtgggagagcctgctgctgctgctggcctacgccttctacgtgttcaccatgaagtggaacaagcacatcgaggtgtgggtgaaggagcagctgagcagaagacccgtggccaaggtgatggccctggaggacctgagcaagctgcccagcctgctgaccagaggcagcagcagcaccagcctgcacaacagcaccatcagaagcaccatctaccagctgatgctgcacagcctggaccccctgagagaggtgagactggccaaggagaaggaggaggagagcctgaaccagggcgccagagcccagccccaggccaaggccgagagcaagcccgaggaggaggagcccgccaagctgcccgccgtgaccgtgacccccgcccccgtgcccgacatcaagggcgaccagaaggagaaccccggcggccaggaggacgtggccgaggccgagagcaccggcgagatgcccggcgaggagggcgagaccgccggcgagggcgagaccgaggagaagagcggcggcgagacccagcccgagggcgagggcgagaccgagacccagggcaagggcgaggagtgcgaggacgagaacgaggccgagggcaagggcgacaacgagggcgaggacgagggcgagatccacgccgaggacggcgagatgaagggcaacgagggcgagaccgagagccaggagctgagcgccgagaaccacggcgaggccaagaacgacgagaagggcgtggaggacggcggcggcagcgacggcggcgacagcgaggaggaggaggaggaggaggaggagcaggaggaggaggaggaggaggaggagcaggaggaggaggaggaggaggaggaggaggaggaggagaagggcaacgaggagcccctgagcctggactggcccgagaccagacagaagcaggccatctacctgttcctgctgcccatcgtgttccccctgtggctgaccgtgcccgacgtgagaagacaggagagcagaaagttcttcgtgttcaccttcctgggcagcatcatgtggatcgccatgttcagctacctgatggtgtggtgggcccaccaggtgggcgagaccatcggcatcagcgaggagatcatgggcctgaccatcctggccgccggcaccagcatccccgacctgatcaccagcgtgatcgtggccagaaagggcctgggcgacatggccgtgagcagcagcgtgggcagcaacatcttcgacatcaccgtgggcctgcccgtgccctggctgctgttcagcctgatcaacggcctgcagcccgtgcccgtgagcagcaacggcctgttctgcgccatcgtgctgctgttcctgatgctgctgttcgtgatcagcagcatcgccagctgcaagtggagaatgaacaagatcctgggcttcaccatgttcctgctgtacttcgtgttcctgatcatcagcgtgatgctggaggacagaatcatcagctgccccgtgagcgtgtag

SEQ ID NO: 99617 - DNA, 3210 bp, Artificial Sequence
  Description of Artificial Sequence: Synthetic coding sequence
atgggcaagctgatcagaatgggcccccaggagagatggctgctgagaaccaagagactgcactggagcagactgctgttcctgctgggcatgctgatcatcggcagcacctaccagcacctgagaagacccagaggcctgagcagcctgtgggccgccgtgagcagccaccagcccatcaagctggccagcagagacctgagcagcgaggagatgatgatgatgagcagcagccccagcaagcccagcagcgagatgggcggcaagatgctggtgccccaggccagcgtgggcagcgacgaggccaccctgagcatgaccgtggagaacatccccagcatgcccaagagaaccgccaagatgatccccaccaccaccaagaacaactacagccccaccgccgccggcaccgagagaagaaaggaggacacccccaccagcagcagaaccctgacctactacaccagcaccagcagcagacagatcgtgaagaagtacacccccacccccagaggcgagatgaagagctacagccccacccaggtgagagagaaggtgaagtacacccccagccccagaggcagaagagtgggcacctacgtgcccagcaccttcatgaccatggagaccagccacgccatcacccccagaaccaccgtgaaggacagcgacatcaccgccacctacaagatcctggagaccaacagcctgaagagaatcatggaggagaccacccccaccaccctgaagggcatgttcgacagcacccccaccttcctgacccacgaggtggaggccaacgtgctgaccagccccagaagcgtgatggagaagaacaacctgttcccccccagaagagtggagagcaacagcagcgcccacccctggggcctggtgggcaagagcaaccccaagaccccccagggcaccgtgctgctgcacacccccgccaccagcgagggccaggtgaccatcagcaccatgaccggcagcagccccgccgagaccaaggccttcaccgccgcctggagcctgagaaaccccagccccagaaccagcgtgagcgccatcaagaccgcccccgccatcgtgtggagactggccaagaagcccagcaccgcccccagcaccagcaccacccccaccgtgagagccaagctgaccatgcaggtgcaccactgcgtggtggtgaagcccacccccgccatgctgaccacccccagccccagcctgaccaccgccctgctgcccgaggagctgagccccagccccagcgtgctgccccccagcctgcccgacctgcaccccaagggcgagtacccccccgacctgttcagcgtggaggagagaagacagggctgggtggtgctgcacgtgttcggcatgatgtacgtgttcgtggccctggccatcgtgtgcgacgagtacttcgtgcccgccctgggcgtgatcaccgacaagctgcagatcagcgaggacgtggccggcgccaccttcatggccgccggcggcagcgcccccgagctgttcaccagcctgatcggcgtgttcatcagccacagcaacgtgggcatcggcaccatcgtgggcagcgccgtgttcaacatcctgttcgtgatcggcacctgcagcctgttcagcagagagatcctgaacctgacctggtggcccctgttcagagacgtgagcttctacatcctggacctgatcatgctgatcctgttcttcctggacagcctgatcgcctggtgggagagcctgctgctgctgctggcctacgccttctacgtgttcaccatgaagtggaacaagcacatcgaggtgtgggtgaaggagcagctgagcagaagacccgtggccaaggtgatggccctggaggacctgagcaagcccggcgacggcgccatcgccgtggacgagctgcaggacaacaagaagctgaagctgcccagcctgctgaccagaggcagcagcagcaccagcctgcacaacagcaccatcagaagcaccatctaccagctgatgctgcacagcctggaccccctgagagaggtgagactggccaaggagaaggaggaggagagcctgaaccagggcgccagagcccagccccaggccaaggccgagagcaagcccgaggaggaggagcccgccaagctgcccgccgtgaccgtgacccccgcccccgtgcccgacatcaagggcgaccagaaggagaaccccggcggccaggaggacgtggccgaggccgagagcaccggcgagatgcccggcgaggagggcgagaccgccggcgagggcgagaccgaggagaagagcggcggcgagacccagcccgagggcgagggcgagaccgagacccagggcaagggcgaggagtgcgaggacgagaacgaggccgagggcaagggcgacaacgagggcgaggacgagggcgagatccacgccgaggacggcgagatgaagggcaacgagggcgagaccgagagccaggagctgagcgccgagaaccacggcgaggccaagaacgacgagaagggcgtggaggacggcggcggcagcgacggcggcgacagcgaggaggaggaggaggaggaggaggagcaggaggaggaggaggaggaggaggagcaggaggaggaggaggaggaggaggaggaggaggaggagaagggcaacgaggagcccctgagcctggactggcccgagaccagacagaagcaggccatctacctgttcctgctgcccatcgtgttccccctgtggctgaccgtgcccgacgtgagaagacaggtgggcgagaccatcggcatcagcgaggagatcatgggcctgaccatcctggccgccggcaccagcatccccgacctgatcaccagcgtgatcgtggccagaaagggcctgggcgacatggccgtgagcagcagcgtgggcagcaacatcttcgacatcaccgtgggcctgcccgtgccctggctgctgttcagcctgatcaacggcctgcagcccgtgcccgtgagcagcaacggcctgttctgcgccatcgtgctgctgttcctgatgctgctgttcgtgatcagcagcatcgccagctgcaagtggagaatgaacaagatcctgggcttcaccatgttcctgctgtacttcgtgttcctgatcatcagcgtgatgctggaggacagaatcatcagctgccccgtgagcgtgtag

SEQ ID NO: 99618 - DNA, 3246 bp, Artificial Sequence; identical to SEQ ID NO: 99616
  Description of Artificial Sequence: Synthetic coding sequence

SEQ ID NO: 99619 - DNA, 1935 bp, Artificial Sequence
  Description of Artificial Sequence: Synthetic coding sequence
atggacctgcagcagagcaccaccatcaccagcctggagaagtggtgcctggacgagagcctgagcggctgcagaagacactacagcgtgaagaagaagctgaagctgatcagagtgctgggcctgttcatgggcctggtggccatcagcaccgtgagcttcagcatcagcgccttcagcgagaccgacacccagagcaccggcgaggccagcgtggtgagcggccccagagtggcccagggctaccaccagagaaccctgctggacctgaacgacaagatcctggactacaccccccagccccccctgagcaaggagggcgagagcgagaacagcaccgaccacgcccagggcgactaccccaaggacatcttcagcctggaggagagaagaaagggcgccatcatcctgcacgtgatcggcatgatctacatgttcatcgccctggccatcgtgtgcgacgagttcttcgtgcccagcctgaccgtgatcaccgagaagctgggcatcagcgacgacgtggccggcgccaccttcatggccgccggcggcagcgcccccgagctgttcaccagcctgatcggcgtgttcatcgcccacagcaacgtgggcatcggcaccatcgtgggcagcgccgtgttcaacatcctgttcgtgatcggcatgtgcgccctgttcagcagagagatcctgaacctgacctggtggcccctgttcagagacgtgagcttctacatcgtggacctgatcatgctgatcatcttcttcctggacaacgtgatcatgtggtgggagagcctgctgctgctgaccgcctacttctgctacgtggtgttcatgaagttcaacgtgcaggtggagaagtgggtgaagcagatgatcaacagaaacaaggtggtgaaggtgaccgcccccgaggcccaggccaagcccagcgccgccagagacaaggacgagcccaccctgcccgccaagcccagactgcagagaggcggcagcagcgccagcctgcacaacagcctgatgagaaacagcatcttccagctgatgatccacaccctggaccccctggccgagggcagattcagagagaaggccagcatcctgcacaagatcgccaagaagaagtgccacgtggacgagaacgagagacagaacggcgccgccaaccacgtggagaagatcgagctgcccaacagcaccagcaccgacgtggagatgacccccagcagcgacgccagcgagcccgtgcagaacggcaacctgagccacaacatcgagggcgccgaggcccagaccgccgacgaggaggaggaccagcccctgagcctggcctggcccagcgagaccagaaagcaggtgaccttcctgatcgtgttccccatcgtgttccccctgtggatcaccctgcccgacgtgagaaagcccagcagcagaaagttcttccccatcaccttcttcggcagcatcacctggatcgccgtgttcagctacctgatggtgtggtgggcccaccaggtgggcgagaccatcggcatcagcgaggagatcatgggcctgaccatcctggccgccggcaccagcatccccgacctgatcaccagcgtgatcgtggccagaaagggcctgggcgacatggccgtgagcagcagcgtgggcagcaacatcttcgacatcaccgtgggcctgcccctgccctggctgctgtacaccgtgatccacagattccagcccgtggccgtgagcagcaacggcctgttctgcgccatcgtgctgctgttcatcatgctgctgttcgtgatcctgagcatcgccctgtgcaagtggagaatgaacaagatcctgggcttcatcatgttcggcctgtacttcgtgttcctggtggtgagcgtgctgctggaggacagaatcctgacctgccccgtgagcatctag

SEQ ID NO: 99620 - DNA, 1986 bp, Artificial Sequence
  Description of Artificial Sequence: Synthetic coding sequence
atggacctgcagcagagcaccaccatcaccagcctggagaagtggtgcctggacgagagcctgagcggctgcagaagacactacagcgtgaagaagaagctgaagctgatcagagtgctgggcctgttcatgggcctggtggccatcagcaccgtgagcttcagcatcagcgccttcagcgagaccgacacccagagcaccggcgaggccagcgtggtgagcggccccagagtggcccagggctaccaccagagaaccctgctggacctgaacgacaagatcctggactacaccccccagccccccctgagcaaggagggcgagagcgagaacagcaccgaccacgcccagggcgactaccccaaggacatcttcagcctggaggagagaagaaagggcgccatcatcctgcacgtgatcggcatgatctacatgttcatcgccctggccatcgtgtgcgacgagttcttcgtgcccagcctgaccgtgatcaccgagaagctgggcatcagcgacgacgtggccggcgccaccttcatggccgccggcggcagcgcccccgagctgttcaccagcctgatcggcgtgttcatcgcccacagcaacgtgggcatcggcaccatcgtgggcagcgccgtgttcaacatcctgttcgtgatcggcatgtgcgccctgttcagcagagagatcctgaacctgacctggtggcccctgttcagagacgtgagcttctacatcgtggacctgatcatgctgatcatcttcttcctggacaacgtgatcatgtggtgggagagcctgctgctgctgaccgcctacttctgctacgtggtgttcatgaagttcaacgtgcaggtggagaagtgggtgaagcagatgatcaacagaaacaaggtggtgaaggtgaccgcccccgaggcccaggccaagcccagcgccgccagagacaaggacgagcccaccctgcccgccaagcccagactgcagagaggcggcagcagcgccagcctgcacaacagcctgatgagaaacagcatcttccagctgatgatccacaccctggaccccctggccgaggagctgggcagctacggcaagctgaagtactacgacaccatgaccgaggagggcagattcagagagaaggccagcatcctgcacaagatcgccaagaagaagtgccacgtggacgagaacgagagacagaacggcgccgccaaccacgtggagaagatcgagctgcccaacagcaccagcaccgacgtggagatgacccccagcagcgacgccagcgagcccgtgcagaacggcaacctgagccacaacatcgagggcgccgaggcccagaccgccgacgaggaggaggaccagcccctgagcctggcctggcccagcgagaccagaaagcaggtgaccttcctgatcgtgttccccatcgtgttccccctgtggatcaccctgcccgacgtgagaaagcccagcagcagaaagttcttccccatcaccttcttcggcagcatcacctggatcgccgtgttcagctacctgatggtgtggtgggcccaccaggtgggcgagaccatcggcatcagcgaggagatcatgggcctgaccatcctggccgccggcaccagcatccccgacctgatcaccagcgtgatcgtggccagaaagggcctgggcgacatggccgtgagcagcagcgtgggcagcaacatcttcgacatcaccgtgggcctgcccctgccctggctgctgtacaccgtgatccacagattccagcccgtggccgtgagcagcaacggcctgttctgcgccatcgtgctgctgttcatcatgctgctgttcgtgatcctgagcatcgccctgtgcaagtggagaatgaacaagatcctgggcttcatcatgttcggcctgtacttcgtgttcctggtggtgagcgtgctgctggaggacagaatcctgacctgccccgtgagcatctag

SEQ ID NO: 99621 - DNA, 1935 bp, Artificial Sequence
  Description of Artificial Sequence: Synthetic coding sequence
atgagacccagcggcgacgaggacagagccagaagaagaagaagaagaagaagaagaagagacctgctgctgagccagctgtgcttcctggccagcgtggccctgctgctgtggagcctgagcagcctgagagagcagaaggagctggacctgatggacctggtgggcgaggacagaaagtggatgatggccagaaagctgatgcaggtgaacgacaccctgaccagcgaggacgccggcctgagaaacagcaagaactgcaccgagcccgccctgcacgagttccccaacgacatcttcaccaacgaggacagaagacagggcgccgtggtgctgcacgtgctgtgcgccatctacatgttctacgccctggccatcgtgtgcgacgacttcttcgtgcccagcctggagaagatctgcgagagactgcacctgagcgaggacgtggccggcgccaccttcatggccgccggcagcagcgcccccgagctgttcaccagcgtgatcggcgtgttcatcaccaagggcgacgtgggcgtgggcaccatcgtgggcagcgccgtgttcaacatcctgtgcatcatcggcgtgtgcggcctgttcgccggccaggtggtggccctgagcagctggtgcctgctgagagacagcatctactacaccctgagcgtgatcgccctgatcgtgttcatctacgacgagaaggtgagctggtgggagagcctggtgctggtgctgatgtacctgatctacatcgtgatcatgaagtacaacgcctgcatccaccagtgcttcgagagaagaaccaagggcgccggcaacatggtgaacggcctggccaacaacgccgagatcgacgacagcagcaactgcgacgccaccgtggtgctgctgaagaaggccaacttccacagaaaggccagcgtgatcatggtggacgagctgctgagcgcctacccccaccagctgagcttcagcgaggccggcctgagaatcatgatcaccagccacttcccccccaagaccagactgagcatggccagcagaatgctgatcaacgagagacagagactgatcaacagcagagcctacaccaacggcgagagcgaggtggccatcaagatccccatcaagcacaccgtggagaacggcaccggccccagcagcgcccccgacagaggcgtgaacggcaccagaagagacgacgtggtggccgaggccggcaacgagaccgagaacgagaacgaggacaacgagaacgacgaggaggaggaggaggacgaggacgacgacgagggcccctacacccccttcgacacccccagcggcaagctggagaccgtgaagtgggccttcacctggcccctgagcttcgtgctgtacttcaccgtgcccaactgcaacaagcccagatgggagaagtggttcatggtgaccttcgccagcagcaccctgtggatcgccgccttcagctacatgatggtgtggatggtgaccatcatcggctacaccctgggcatccccgacgtgatcatgggcatcaccttcctggccgccggcaccagcgtgcccgactgcatggccagcctgatcgtggccagacagggcatgggcgacatggccgtgagcaacagcatcggcagcaacgtgttcgacatcctgatcggcctgggcctgccctgggccctgcagaccctggccgtggactacggcagctacatcagactgaacagcagaggcctgatctacagcgtgggcctgctgctggccagcgtgttcgtgaccgtgttcggcgtgcacctgaacaagtggcagctggacaagaagctgggctgcggctgcctgctgctgtacggcgtgttcctgtgcttcagcatcatgaccgagttcaacgtgttcaccttcgtgaacctgcccatgtgcggcgaccactag

SEQ ID NO: 99622 - DNA, 1755 bp, Artificial Sequence
  Description of Artificial Sequence: Synthetic coding sequence
atggccggcagaagactgaacctgagatgggccctgagcgtgctgtgcgtgctgctgatggccgagaccgtgagcggcaccagaggcagcagcaccggcgcccacatcagcccccagttccccgccagcggcgtgaaccagacccccgtggtggactgcagaaaggtgtgcggcctgaacgtgagcgacagatgcgacttcatcagaaccaaccccgactgccacagcgacggcggctacctggactacctggagggcatcttctgccacttcccccccagcctgctgcccctggccgtgaccctgtacgtgagctggctgctgtacctgttcctgatcctgggcgtgaccgccgccaagttcttctgccccaacctgagcgccatcagcaccaccctgaagctgagccacaacgtggccggcgtgaccttcctggccttcggcaacggcgcccccgacatcttcagcgccctggtggccttcagcgacccccacaccgccggcctggccctgggcgccctgttcggcgccggcgtgctggtgaccaccgtggtggccggcggcatcaccatcctgcaccccttcatggccgccagcagacccttcttcagagacatcgtgttctacatggtggccgtgttcctgaccttcctgatgctgttcagaggcagagtgaccctggcctgggccctgggctacctgggcctgtacgtgttctacgtggtgaccgtgatcctgtgcacctggatctaccagagacagagaagaggcagcctgttctgccccatgcccgtgacccccgagatcctgagcgacagcgaggaggacagagtgagcagcaacaccaacagctacgactacggcgacgagtacagacccctgttcttctaccaggagaccaccgcccagatcctggtgagagccctgaaccccctggactacatgaagtggagaagaaagagcgcctactggaaggccctgaaggtgttcaagctgcccgtggagttcctgctgctgctgaccgtgcccgtggtggaccccgacaaggacgaccagaactggaagagacccctgaactgcctgcacctggtgatcagccccctggtggtggtgctgaccctgcagagcggcacctacggcgtgtacgagatcggcggcctggtgcccgtgtgggtggtggtggtgatcgccggcaccgccctggccagcgtgaccttcttcgccaccagcgacagccagccccccagactgcactggctgttcgccttcctgggcttcctgaccagcgccctgtggatcaacgccgccgccaccgaggtggtgaacatcctgagaagcctgggcgtggtgttcagactgagcaacaccgtgctgggcctgaccctgctggcctggggcaacagcatcggcgacgccttcagcgacttcaccctggccagacagggctaccccagaatggccttcagcgcctgcttcggcggcatcatcttcaacatcctggtgggcgtgggcctgggctgcctgctgcagatcagcagaagccacaccgaggtgaagctggagcccgacggcctgctggtgtgggtgctggccggcgccctgggcctgagcctggtgttcagcctggtgagcgtgcccctgcagtgcttccagctgagcagagtgtacggcttctgcctgctgctgttctacctgaacttcctggtggtggccctgctgaccgagttcggcgtgatccacctgaagagcatgtag

SEQ ID NO: 99623 - DNA, 1587 bp, Artificial Sequence
  Description of Artificial Sequence: Synthetic coding sequence
atggccggcagaagactgaacctgagatgggccctgagcgtgctgtgcgtgctgctgatggccgagaccgtgagcggcaccagaggcagcagcaccggcgcccacatcagcccccagttccccgccagcggcgtgaaccagacccccgtggtggactgcagaaaggtgtgcggcctgaacgtgagcgacagatgcgacttcatcagaaccaaccccgactgccacagcgacggcggctacctggactacctggagggcatcttctgccacttcccccccagcctgctgcccctggccgtgaccctgtacgtgagctggctgctgtacctgttcctgatcctgggcgtgaccgccgccaagttcttctgccccaacctgagcgccatcagcaccaccctgaagctgagccacaacgtggccggcgtgaccttcctggccttcggcaacggcgcccccgacatcttcagcgccctggtggccttcagcgacccccacaccgccggcctggccctgggcgccctgttcggctacctgggcctgtacgtgttctacgtggtgaccgtgatcctgtgcacctggatctaccagagacagagaagaggcagcctgttctgccccatgcccgtgacccccgagatcctgagcgacagcgaggaggacagagtgagcagcaacaccaacagctacgactacggcgacgagtacagacccctgttcttctaccaggagaccaccgcccagatcctggtgagagccctgaaccccctggactacatgaagtggagaagaaagagcgcctactggaaggccctgaaggtgttcaagctgcccgtggagttcctgctgctgctgaccgtgcccgtggtggaccccgacaaggacgaccagaactggaagagacccctgaactgcctgcacctggtgatcagccccctggtggtggtgctgaccctgcagagcggcacctacggcgtgtacgagatcggcggcctggtgcccgtgtgggtggtggtggtgatcgccggcaccgccctggccagcgtgaccttcttcgccaccagcgacagccagccccccagactgcactggctgttcgccttcctgggcttcctgaccagcgccctgtggatcaacgccgccgccaccgaggtggtgaacatcctgagaagcctgggcgtggtgttcagactgagcaacaccgtgctgggcctgaccctgctggcctggggcaacagcatcggcgacgccttcagcgacttcaccctggccagacagggctaccccagaatggccttcagcgcctgcttcggcggcatcatcttcaacatcctggtgggcgtgggcctgggctgcctgctgcagatcagcagaagccacaccgaggtgaagctggagcccgacggcctgctggtgtgggtgctggccggcgccctgggcctgagcctggtgttcagcctggtgagcgtgcccctgcagtgcttccagctgagcagagtgtacggcttctgcctgctgctgttctacctgaacttcctggtggtggccctgctgaccgagttcggcgtgatccacctgaagagcatgtag

SEQ ID NO: 99624 - DNA, 1587 bp, Artificial Sequence; identical to SEQ ID NO: 99623
  Description of Artificial Sequence: Synthetic coding sequence

SEQ ID NO: 99625 - DNA, 396 bp, Artificial Sequence
  Description of Artificial Sequence: Synthetic coding sequence
atggccggcagaagactgaacctgagatgggccctgagcgtgctgtgcgtgctgctgatggccgagaccgtgagcggcaccagaggcagcagcaccggcgcccacatcagcccccagttccccgccagcggcgtgaaccagacccccgtggtggactgcagaaaggtgtgcggcctgaacgtgagcgacagatgcgacttcatcagaaccaaccccgactgccacagcgacggcggctacctggactacctggagggcatcttctgccacttcccccccagcctgctgcccctggccgtgaccctgtacgtgagctggctgctgtacctgttcctgatcctgggcgtgaccgccgccaagttcttctgccccaacctgagcgccatcagcacctag

SEQ ID NO: 99626 - DNA, 696 bp, Artificial Sequence
  Description of Artificial Sequence: Synthetic coding sequence
atggccggcagaagactgaacctgagatgggccctgagcgtgctgtgcgtgctgctgatggccgagaccgtgagcggcaccagaggcagcagcaccggcgcccacatcagcccccagttccccgccagcggcgtgaaccagacccccgtggtggactgcagaaaggtgtgcggcctgaacgtgagcgacagatgcgacttcatcagaaccaaccccgactgccacagcgacggcggctacctggactacctggagggcatcttctgccacttcccccccagcctgctgcccctggccgtgaccctgtacgtgagctggctgctgtacctgttcctgatcctgggcgtgaccgccgccaagttcttctgccccaacctgagcgccatcagcaccaccctgaagctgagccacaacgtggccggcgtgaccttcctggccttcggcaacggcgcccccgacatcttcagcgccctggtggccttcagcgacccccacaccgccggcctggccctgggcgccctgttcggcgccggcgtgctggtgaccaccgtggtggccggcggcatcaccatcctgcaccccttcatggccgccagcagacccttcttcagagacatcgtgttctacatggtggccgtgttcctgaccttcctgatgctgttcagaggcagagtgaccctggcctgggccctgtag

SEQ ID NO: 99627 - DNA, 312 bp, Artificial Sequence
  Description of Artificial Sequence: Synthetic coding sequence
atggccggcagaagactgaacctgagatgggccctgagcgtgctgtgcgtgctgctgatggccgagaccgtgagcggcaccagaggcagcagcaccggcgcccacatcagcccccagttccccgccagcggcgtgaaccagacccccgtggtggactgcagaaaggtgtgcggcctgaacgtgagcgacagatgcgacttcatcagaaccaaccccgactgccacagcgacggcggctacctggactacctggagggcatcttctgccacttcccccccagcctgctgcccctggccgtgaccctgtactag

SEQ ID NO: 99628 - DNA, 1755 bp, Artificial Sequence; identical to SEQ ID NO: 99622
  Description of Artificial Sequence: Synthetic coding sequence

SEQ ID NO: 99629 - DNA, 906 bp, Artificial Sequence
  Description of Artificial Sequence: Synthetic coding sequence
atggccgaccagcccaagcccatcagccccctgaagaacctgctggccggcggcttcggcggcgtgtgcctggtgttcgtgggccaccccctggacaccgtgaaggtgagactgcagacccagccccccagcctgcccggccagccccccatgtacagcggcaccttcgactgcttcagaaagaccctgttcagagagggcatcaccggcctgtacagaggcatggccgcccccatcatcggcgtgacccccatgttcgccgtgtgcttcttcggcttcggcctgggcaagaagctgcagcagaagcaccccgaggacgtgctgagctacccccagctgttcgccgccggcatgctgagcggcgtgttcaccaccggcatcatgacccccggcgagagaatcaagtgcctgctgcagatccaggccagcagcggcgagagcaagtacaccggcaccctggactgcgccaagaagctgtaccaggagttcggcatcagaggcatctacaagggcaccgtgctgaccctgatgagagacgtgcccgccagcggcatgtacttcatgacctacgagtggctgaagaacatcttcacccccgagggcaagagagtgagcgagctgagcgcccccagaatcctggtggccggcggcatcgccggcatcttcaactgggccgtggccatcccccccgacgtgctgaagagcagattccagaccgccccccccggcaagtaccccaacggcttcagagacgtgctgagagagctgatcagagacgagggcgtgaccagcctgtacaagggcttcaacgccgtgatgatcagagccttccccgccaacgccgcctgcttcctgggcttcgaggtggccatgaagttcctgaactgggccacccccaacctgtag

SEQ ID NO: 99630 - DNA, 756 bp, Artificial Sequence
  Description of Artificial Sequence: Synthetic coding sequence
atgtacagcggcaccttcgactgcttcagaaagaccctgttcagagagggcatcaccggcctgtacagaggcatggccgcccccatcatcggcgtgacccccatgttcgccgtgtgcttcttcggcttcggcctgggcaagaagctgcagcagaagcaccccgaggacgtgctgagctacccccagctgttcgccgccggcatgctgagcggcgtgttcaccaccggcatcatgacccccggcgagagaatcaagtgcctgctgcagatccaggccagcagcggcgagagcaagtacaccggcaccctggactgcgccaagaagctgtaccaggagttcggcatcagaggcatctacaagggcaccgtgctgaccctgatgagagacgtgcccgccagcggcatgtacttcatgacctacgagtggctgaagaacatcttcacccccgagggcaagagagtgagcgagctgagcgcccccagaatcctggtggccggcggcatcgccggcatcttcaactgggccgtggccatcccccccgacgtgctgaagagcagattccagaccgccccccccggcaagtaccccaacggcttcagagacgtgctgagagagctgatcagagacgagggcgtgaccagcctgtacaagggcttcaacgccgtgatgatcagagccttccccgccaacgccgcctgcttcctgggcttcgaggtggccatgaagttcctgaactgggccacccccaacctgtag

SEQ ID NO: 99631 - DNA, 948 bp, Artificial Sequence
  Description of Artificial Sequence: Synthetic coding sequence
atgacccaccaggacctgagcatcaccgccaagctgatcaacggcggcgtggccggcctggtgggcgtgacctgcgtgttccccatcgacctggccaagaccagactgcagaaccagcacggcaaggccatgtacaagggcatgatcgactgcctgatgaagaccgccagagccgagggcttcttcggcatgtacagaggcgccgccgtgaacctgaccctggtgacccccgagaaggccatcaagctggccgccaacgacttcttcagaagactgctgatggaggacggcatgcagagaaacctgaagatggagatgctggccggctgcggcgccggcatgtgccaggtggtggtgacctgccccatggagatgctgaagatccagctgcaggacgccggcagactggccgtgcaccaccagggcagcgccagcgcccccagcaccagcagaagctacaccaccggcagcgccagcacccacagaagacccagcgccaccctgatcgcctgggagctgctgagaacccagggcctggccggcctgtacagaggcctgggcgccaccctgctgagagacatccccttcagcatcatctacttccccctgttcgccaacctgaacaacctgggcttcaacgagctggccggcaaggccagcttcgcccacagcttcgtgagcggctgcgtggccggcagcatcgccgccgtggccgtgacccccctggacgtgctgaagaccagaatccagaccctgaagaagggcctgggcgaggacatgtacagcggcatcaccgactgcgccagaaagctgtggatccaggagggccccagcgccttcatgaagggcgccggctgcagagccctggtgatcgcccccctgttcggcatcgcccagggcgtgtacttcatcggcatcggcgagagaatcctgaagtgcttcgactag

SEQ ID NO: 99632 - DNA, 948 bp, Artificial Sequence; identical to SEQ ID NO: 99631
  Description of Artificial Sequence: Synthetic coding sequence

SEQ ID NO: 99633 - DNA, 1716 bp, Artificial Sequence
  Description of Artificial Sequence: Synthetic coding sequence
atggagaacgtgaaggagatcttcggccagaccatcatccaccaccacatccccttcaactgggactgcgagttcatcagactgcacttcggccacaacagaaagaagcacctgaactacaccgagttcacccagttcctgcaggagctgcagctggagcacgccagacaggccttcgccctgaaggacaagagcaagagcggcatgatcagcggcctggacttcagcgacatcatggtgaccatcagaagccacatgctgacccccttcgtggaggagaacctggtgagcgccgccggcggcagcatcagccaccaggtgagcttcagctacttcaacgccttcaacagcctgctgaacaacatggagctggtgagaaagatctacagcaccctggccggcaccagaaaggacgtggaggtgaccaaggaggagttcgcccagagcgccatcagatacggccaggtgacccccctggagatcgacatcctgtaccagctggccgacctgtacaacgccagcggcagactgaccctggccgacatcgagagaatcgcccccctggccgagggcgccctgccctacaacctggccgagctgcagagacagcagagccccggcctgggcagacccatctggctgcagatcgccgagagcgcctacagattcaccctgggcagcgtggccggcgccgtgggcgccaccgccgtgtaccccatcgacctggtgaagaccagaatgcagaaccagagaggcagcggcagcgtggtgggcgagctgatgtacaagaacagcttcgactgcttcaagaaggtgctgagatacgagggcttcttcggcctgtacagaggcctgatcccccagctgatcggcgtggcccccgagaaggccatcaagctgaccgtgaacgacttcgtgagagacaagttcaccagaagagacggcagcgtgcccctgcccgccgaggtgctggccggcggctgcgccggcggcagccaggtgatcttcaccaaccccctggagatcgtgaagatcagactgcaggtggccggcgagatcaccaccggccccagagtgagcgccctgaacgtgctgagagacctgggcatcttcggcctgtacaagggcgccaaggcctgcttcctgagagacatccccttcagcgccatctacttccccgtgtacgcccactgcaagctgctgctggccgacgagaacggccacgtgggcggcctgaacctgctggccgccggcgccatggccggcgtgcccgccgccagcctggtgacccccgccgacgtgatcaagaccagactgcaggtggccgccagagccggccagaccacctacagcggcgtgatcgactgcttcagaaagatcctgagagaggagggccccagcgccttctggaagggcaccgccgccagagtgttcagaagcagcccccagttcggcgtgaccctggtgacctacgagctgctgcagagatggttctacatcgacttcggcggcctgaagcccgccggcagcgagcccacccccaagagcagaatcgccgacctgccccccgccaaccccgaccacatcggcggctacagactggccaccgccaccttcgccggcatcgagaacaagttcggcctgtacctgcccaagttcaagagccccagcgtggccgtggtgcagcccaaggccgccgtggccgccacccagtag

SEQ ID NO: 99634 - DNA, 2037 bp, Artificial Sequence
  Description of Artificial Sequence: Synthetic coding sequence
atggccgtgaaggtgcagaccaccaagagaggcgacccccacgagctgagaaacatcttcctgcagtacgccagcaccgaggtggacggcgagagatacatgacccccgaggacttcgtgcagagatacctgggcctgtacaacgaccccaacagcaaccccaagatcgtgcagctgctggccggcgtggccgaccagaccaaggacggcctgatcagctaccaggagttcctggccttcgagagcgtgctgtgcgcccccgacagcatgttcatcgtggccttccagctgttcgacaagagcggcaacggcgaggtgaccttcgagaacgtgaaggagatcttcggccagaccatcatccaccaccacatccccttcaactgggactgcgagttcatcagactgcacttcggccacaacagaaagaagcacctgaactacaccgagttcacccagttcctgcaggagctgcagctggagcacgccagacaggccttcgccctgaaggacaagagcaagagcggcatgatcagcggcctggacttcagcgacatcatggtgaccatcagaagccacatgctgacccccttcgtggaggagaacctggtgagcgccgccggcggcagcatcagccaccaggtgagcttcagctacttcaacgccttcaacagcctgctgaacaacatggagctggtgagaaagatctacagcaccctggccggcaccagaaaggacgtggaggtgaccaaggaggagttcgcccagagcgccatcagatacggccaggtgacccccctggagatcgacatcctgtaccagctggccgacctgtacaacgccagcggcagactgaccctggccgacatcgagagaatcgcccccctggccgagggcgccctgccctacaacctggccgagctgcagagacagcagagccccggcctgggcagacccatctggctgcagatcgccgagagcgcctacagattcaccctgggcagcgtggccggcgccgtgggcgccaccgccgtgtaccccatcgacctggtgaagaccagaatgcagaaccagagaggcagcggcagcgtggtgggcgagctgatgtacaagaacagcttcgactgcttcaagaaggtgctgagatacgagggcttcttcggcctgtacagaggcctgatcccccagctgatcggcgtggcccccgagaaggccatcaagctgaccgtgaacgacttcgtgagagacaagttcaccagaagagacggcagcgtgcccctgcccgccgaggtgctggccggcggctgcgccggcggcagccaggtgatcttcaccaaccccctggagatcgtgaagatcagactgcaggtggccggcgagatcaccaccggccccagagtgagcgccctgaacgtgctgagagacctgggcatcttcggcctgtacaagggcgccaaggcctgcttcctgagagacatccccttcagcgccatctacttccccgtgtacgcccactgcaagctgctgctggccgacgagaacggccacgtgggcggcctgaacctgctggccgccggcgccatggccggcgtgcccgccgccagcctggtgacccccgccgacgtgatcaagaccagactgcaggtggccgccagagccggccagaccacctacagcggcgtgatcgactgcttcagaaagatcctgagagaggagggccccagcgccttctggaagggcaccgccgccagagtgttcagaagcagcccccagttcggcgtgaccctggtgacctacgagctgctgcagagatggttctacatcgacttcggcggcctgaagcccgccggcagcgagcccacccccaagagcagaatcgccgacctgccccccgccaaccccgaccacatcggcggctacagactggccaccgccaccttcgccggcatcgagaacaagttcggcctgtacctgcccaagttcaagagccccagcgtggccgtggtgcagcccaaggccgccgtggccgccacccagtag

SEQ ID NO: 99635 - DNA, 1944 bp, Artificial Sequence
  Description of Artificial Sequence: Synthetic coding sequence
atggccgccggcctggccacctggctgcccttcgccagagccgccgccgtgggctggctgcccctggcccagcagcccctgccccccgcccccggcgtgaaggccagcagaggcgacgaggtgctggtggtgaacgtgagcggcagaagattcgagacctggaagaacaccctggacagataccccgacaccctgctgggcagcagcgagaaggagttcttctacgacgccgacagcggcgagtacttcttcgacagagaccccgacatgttcagacacgtgctgaacttctacagaaccggcagactgcactgccccagacaggagtgcatccaggccttcgacgaggagctggccttctacggcctggtgcccgagctggtgggcgactgctgcctggaggagtacagagacagaaagaaggagaacgccgagagactggccgaggacgaggaggccgagcaggccggcgacggccccgccctgcccgccggcagcagcctgagacagagactgtggagagccttcgagaacccccacaccagcaccgccgccctggtgttctactacgtgaccggcttcttcatcgccgtgagcgtgatcgccaacgtggtggagaccatcccctgcagaggcagcgccagaagaagcagcagagagcagccctgcggcgagagattcccccaggccttcttctgcatggacaccgcctgcgtgctgatcttcaccggcgagtacctgctgagactgttcgccgcccccagcagatgcagattcctgagaagcgtgatgagcctgatcgacgtggtggccatcctgccctactacatcggcctgctggtgcccaagaacgacgacgtgagcggcgccttcgtgaccctgagagtgttcagagtgttcagaatcttcaagttcagcagacacagccagggcctgagaatcctgggctacaccctgaagagctgcgccagcgagctgggcttcctgctgttcagcctgaccatggccatcatcatcttcgccaccgtgatgttctacgccgagaagggcaccaacaagaccaacttcaccagcatccccgccgccttctggtacaccatcgtgaccatgaccaccctgggctacggcgacatggtgcccagcaccatcgccggcaagatcttcggcagcatctgcagcctgagcggcgtgctggtgatcgccctgcccgtgcccgtgatcgtgagcaacttcagcagaatctaccaccagaaccagagagccgacaagagaagagcccagcagaaggtgagactggccagaatcagactggccaagagcggcaccaccaacgccttcctgcagtacaagcagaacggcggcctggaggacagcggcagcggcgaggagcaggccctgtgcgtgagaaacagaagcgccttcgagcagcagcaccaccacctgctgcactgcctggagaagaccacctgccacgagttcaccgacgagctgaccttcagcgaggccctgggcgccgtgagccccggcggcagaaccagcagaagcaccagcgtgagcagccagcccgtgggccccggcagcctgctgagcagctgctgccccagaagagccaagagaagagccatcagactggccaacagcaccgccagcgtgagcagaggcagcatgcaggagctggacatgctggccggcctgagaagaagccacgccccccagagcagaagcagcctgaacgccaagccccacgacagcctggacctgaactgcgacagcagagacttcgtggccgccatcatcagcatccccaccccccccgccaacacccccgacgagagccagcccagcagccccggcggcggcggcagagccggcagcaccctgagaaacagcagcctgggcaccccctgcctgttccccgagaccgtgaagatcagcagcctgtag

SEQ ID NO: 99636 - DNA, 1062 bp, Artificial Sequence
  Description of Artificial Sequence: Synthetic coding sequence
atgggcatcttccccggcatcatcctgatcttcctgagagtgaagttcgccaccgccgccgtgatccaccagaagagcaccaccgtgagccacgagatgagcggcctgaactggaagcccttcgtgtacggcggcctggccagcatcgtggccgagttcggcaccttccccgtggacctgaccaagaccagactgcaggtgcagggccagagcatcgacgccagattcaaggagatcaagtacagaggcatgttccacgccctgttcagaatctgcaaggaggagggcgtgctggccctgtacagcggcatcgcccccgccctgctgagacaggccagctacggcaccatcaagatcggcatctaccagagcctgaagagactgttcgtggagagactggaggacgagaccctgctgatcaacatgatctgcggcgtggtgagcggcgtgatcagcagcaccatcgccaaccccaccgacgtgctgaagatcagaatgcaggcccagggcagcctgttccagggcagcatgatcggcagcttcatcgacatctaccagcaggagggcaccagaggcctgtggagatgcctgtgcagcaaggccgtgaccggctgcgtgctgtggctgatgcccgtgatccccgccctgtgggaggccaacgccggcggcagcctggagggcgtggtgcccaccgcccagagagccgccatcgtggtgggcgtggagctgcccgtgtacgacatcaccaagaagcacctgatcctgagcggcatgatgggcgacaccatcctgacccacttcgtgagcagcttcacctgcggcctggccggcgccctggccagcaaccccgtggacgtggtgagaaccagaatgatgaaccagagagccatcgtgggccacgtggacctgtacaagggcaccgtggacggcatcctgaagatgtggaagcacgagggcttcttcgccctgtacaagggcttctggcccaactggctgagactgggcccctggaacatcatcttcttcatcacctacgagcagctgaagagactgcagatctag

SEQ ID NO: 99637 - DNA, 969 bp, Artificial Sequence
  Description of Artificial Sequence: Synthetic coding sequence
atgggcatcttccccggcatcatcctgatcttcctgagagtgaagttcgccaccgccgccgtgatccaccagaagagcaccaccgtgagccacgagatgagcggcctgaactggaagcccttcgtgtacggcggcctggccagcatcgtggccgagttcggcaccttccccgtggacctgaccaagaccagactgcaggtgcagggccagagcatcgacgccagattcaaggagatcaagtacagaggcatgttccacgccctgttcagaatctgcaaggaggagggcgtgctggccctgtacagcggcatcgcccccgccctgctgagacaggccagctacggcaccatcaagatcggcatctaccagagcctgaagagactgttcgtggagagactggaggacgagaccctgctgatcaacatgatctgcggcgtggtgagcggcgtgatcagcagcaccatcgccaaccccaccgacgtgctgaagatcagaatgcaggcccagggcagcctgttccagggcagcatgatcggcagcttcatcgacatctaccagcaggagggcaccagaggcctgtggagaggcgtggtgcccaccgcccagagagccgccatcgtggtgggcgtggagctgcccgtgtacgacatcaccaagaagcacctgatcctgagcggcatgatgggcgacaccatcctgacccacttcgtgagcagcttcacctgcggcctggccggcgccctggccagcaaccccgtggacgtggtgagaaccagaatgatgaaccagagagccatcgtgggccacgtggacctgtacaagggcaccgtggacggcatcctgaagatgtggaagcacgagggcttcttcgccctgtacaagggcttctggcccaactggctgagactgggcccctggaacatcatcttcttcatcacctacgagcagctgaagagactgcagatctag

SEQ ID NO: 99638 - DNA, 597 bp, Artificial Sequence
  Description of Artificial Sequence: Synthetic coding sequence
atgggcatcttccccggcatcatcctgatcttcctgagagtgaagttcgccaccgccgccgtgatcgtgagcggccaccagaagagcaccaccgtgagccacgagatgagcggcctgaactggaagcccttcgtgtacggcggcctggccagcatcgtggccgagttcggcaccttccccgtggacctgaccaagaccagactgcaggtgcagggccagagcatcgacgccagattcaaggagatcaagtacagaggcatgttccacgccctgttcagaatctgcaaggaggagggcgtgctggccctgtacagcggcatcgcccccgccctgctgagacaggccagctacggcaccatcaagatcggcatctaccagagcctgaagagactgttcgtggagagactggaggacgagaccctgctgatcaacatgatctgcggcgtggtgagcggcgtgatcagcagcaccatcgccaaccccaccgacgtgctgaagatcagaatgcaggcccagggcagcctgttccagggcagcatgatcggcagcttcatcgacatctaccagcaggagggcaccagaggcctgtggagatag

SEQ ID NO: 99639 - DNA, 618 bp, Artificial Sequence
  Description of Artificial Sequence: Synthetic coding sequence
atgagcggcctgaactggaagcccttcgtgtacggcggcctggccagcatcgtggccgagttcggcaccttccccgtggacctgaccaagaccagactgcaggtgcagggccagagcatcgacgccagattcaaggagatcaagtacagaggcatgttccacgccctgttcagaatctgcaaggaggagggcgtgctggccctgtacagcggcatcgcccccgccctgctgagacaggccagctacggcaccatcaagatcggcatctaccagagcctgaagagactgttcgtggagagactggaggacgagaccctgctgatcaacatgatctgcggcgtggtgagcggcgtgatcagcagcaccatcgccaaccccaccgacgtgctgaagatcagaatgcaggcccagggcagcctgttccagggcagcatgatcggcagcttcatcgacatctaccagcaggagggcaccagaggcctgtggagaggcgtggtgcccaccgcccagagagccgccatcgtggtgggcgtggagctgcccgtgtacgacatcaccaagaagcacctgatcctgagcggcatgatgggcgacaccatcctgacccacttcgtgtag

SEQ ID NO: 99640 - DNA, 723 bp, Artificial Sequence
  Description of Artificial Sequence: Synthetic coding sequence
atgggcatcttccccggcatcatcctgatcttcctgagagtgaagttcgccaccgccgccgtgatcgtgagcggccaccagaagagcaccaccgtgagccacgagatgagcggcctgaactggaagcccttcgtgtacggcggcctggccagcatcgtggccgagttcggcaccttccccgtggacctgaccaagaccagactgcaggtgcagggccagagcatcgacgccagattcaaggagatcaagtacagaggcatgttccacgccctgttcagaatctgcaaggaggagggcgtgctggccctgtacagcggcatcgcccccgccctgctgagacaggccagctacggcaccatcaagatcggcatctaccagagcctgaagagactgttcgtggagagactggaggacgagaccctgctgatcaacatgatctgcggcgtggtgagcggcgtgatcagcagcaccatcgccaaccccaccgacgtgctgaagatcagaatgcaggcccagggcagcctgttccagggcagcatgatcggcagcttcatcgacatctaccagcaggagggcaccagaggcctgtggagaggcgtggtgcccaccgcccagagagccgccatcgtggtgggcgtggagctgcccgtgtacgacatcaccaagaagcacctgatcctgagcggcatgatgggcgacaccatcctgacccacttcgtgtag

SEQ ID NO: 99641 - DNA, 972 bp, Artificial Sequence
  Description of Artificial Sequence: Synthetic coding sequence
atggccgacaagcagatcagcctgcccgccaagctgatcaacggcggcatcgccggcctgatcggcgtgacctgcgtgttccccatcgacctggccaagaccagactgcagaaccagcagaacggccagagagtgtacaccagcatgagcgactgcctgatcaagaccgtgagaagcgagggctacttcggcatgtacagaggcgccgccgtgaacctgaccctggtgacccccgagaaggccatcaagctggccgccaacgacttcttcagacaccagctgagcaaggacggccagaagctgaccctgctgaaggagatgctggccggctgcggcgccggcacctgccaggtgatcgtgaccacccccatggagatgctgaagatccagctgcaggacgccggcagaatcgccgcccagagaaagatcctggccgcccagggccagctgagcgcccagggcggcgcccagcccagcgtggaggcccccgccgcccccagacccaccgccacccagctgaccagagacctgctgagaagcagaggcatcgccggcctgtacaagggcctgggcgccaccctgctgagagacgtgcccttcagcgtggtgtacttccccctgttcgccaacctgaaccagctgggcagacccgccagcgaggagaagagccccttctacgtgagcttcctggccggctgcgtggccggcagcgccgccgccgtggccgtgaacccctgcgacgtggtgaagaccagactgcagagcctgcagagaggcgtgaacgaggacacctacagcggcatcctggactgcgccagaaagatcctgagacacgagggccccagcgccttcctgaagggcgcctactgcagagccctggtgatcgcccccctgttcggcatcgcccaggtggtgtacttcctgggcatcgccgagagcctgctgggcctgctgcaggacccccaggcctag

SEQ ID NO: 99642 - DNA, 333 bp, Artificial Sequence
  Description of Artificial Sequence: Synthetic coding sequence
atggccgacaagcagatcagcctgcccgccaagctgatcaacggcggcatcgccggcctgatcggcgtgacctgcgtgttccccatcgacctggccaagaccagactgcagaaccagcagaacggccagagagtgtacaccagcatgagcgactgcctgatcaagaccgtgagaagcgagggctacttcggcatgtacagaggcgccgccgtgaacctgaccctggtgacccccgagaaggccatcaagctggccgccaacgacttcttcagacaccagctgagcaaggacggccagaagctgaccctgctgaaggagatgctggccggctag

SEQ ID NO: 99643 - DNA, 384 bp, Artificial Sequence
  Description of Artificial Sequence: Synthetic coding sequence
atggccgacaagcagatcagcctgcccgccaagctgatcaacggcggcatcgccggcctgatcggcgtgacctgcgtgttccccatcgacctggccaagaccagactgcagaaccagcagaacggccagagagtgtacaccagcatgagcgactgcctgatcaagaccgtgagaagcgagggctacttcggcatgtacagaggcgccgccgtgaacctgaccctggtgacccccgagaaggccatcaagctggccgccaacgacttcttcagacaccagctgagcaaggacggccagaagctgaccctgctgaaggagatgctggccggctgcggcgccggcacctgccaggtgatcgtgaccacccccatggagatgctgtag

SEQ ID NO: 99644 - DNA, 360 bp, Artificial Sequence
  Description of Artificial Sequence: Synthetic coding sequence
atggccgacaagcagatcagcctgcccgccaagctgatcaacggcggcatcgccggcctgatcggcgtgacctgcgtgttccccatcgacctggccaagaccagactgcagaaccagcagaacggccagagagtgtacaccagcatgagcgactgcctgatcaagaccgtgagaagcgagggctacttcggcatgtacagaggcgccgccgtgaacctgaccctggtgacccccgagaaggccatcaagctggccgccaacgacttcttcagacaccagctgagcaaggacggccagaagctgaccctgctgaaggagatgctggccggctgcggcgccggcacctgccaggtgatctag

SEQ ID NO: 99645 - DNA, 372 bp, Artificial Sequence
  Description of Artificial Sequence: Synthetic coding sequence
atggccgacaagcagatcagcctgcccgccaagctgatcaacggcggcatcgccggcctgatcggcgtgacctgcgtgttccccatcgacctggccaagaccagactgcagaaccagcagaacggccagagagtgtacaccagcatgagcgactgcctgatcaagaccgtgagaagcgagggctacttcggcatgtacagaggcgccgccgtgaacctgaccctggtgacccccgagaaggccatcaagctggccgccaacgacttcttcagacaccagctgagcaaggacggccagaagctgaccctgctgaaggagatgctggccggctgcggcgccggcacctgccaggtgatcgtgaccaccccctag

SEQ ID NO: 99646 - DNA, 342 bp, Artificial Sequence
  Description of Artificial Sequence: Synthetic coding sequence
atggccgacaagcagatcagcctgcccgccaagctgatcaacggcggcatcgccggcctgatcggcgtgacctgcgtgttccccatcgacctggccaagaccagactgcagaaccagcagaacggccagagagtgtacaccagcatgagcgactgcctgatcaagaccgtgagaagcgagggctacttcggcatgtacagaggcgccgccgtgaacctgaccctggtgacccccgagaaggccatcaagctggccgccaacgacttcttcagacaccagctgagcaaggacggccagaagctgaccctgctgaaggagatgctggccggctgcggcgcctag

SEQ ID NO: 99647 - DNA, 237 bp, Artificial Sequence
  Description of Artificial Sequence: Synthetic coding sequence
atggccgacaagcagatcagcctgcccgccaagctgatcaacggcggcatcgccggcctgatcggcgtgacctgcgtgttccccatcgacctggccaagaccagactgcagaaccagcagaacggccagagagtgtacaccagcatgagcgactgcctgatcaagaccgtgagaagcgagggctacttcggcatgtacagaggcgccgccgtgaacctgaccctggtgaccccctag

SEQ ID NO: 99648 - DNA, 180 bp, Artificial Sequence
  Description of Artificial Sequence: Synthetic coding sequence
atggccgacaagcagatcagcctgcccgccaagctgatcaacggcggcatcgccggcctgatcggcgtgacctgcgtgttccccatcgacctggccaagaccagactgcagaaccagcagaacggccagagagtgtacaccagcatgagcgactgcctgatcaagaccgtgagaagctag

SEQ ID NO: 99649 - DNA, 972 bp, Artificial Sequence; identical to SEQ ID NO: 99641
  Description of Artificial Sequence: Synthetic coding sequence

SEQ ID NO: 99650 - DNA, 345 bp, Artificial Sequence
  Description of Artificial Sequence: Synthetic coding sequence
atggccgacaagcagatcagcctgcccgccaagctgatcaacggcggcatcgccggcctgatcggcgtgacctgcgtgttccccatcgacctggccaagaccagactgcagaaccagcagaacggccagagagtgtacaccagcatgagcgactgcctgatcaagaccgtgagaagcgagggctacttcggcatgtacagaggcgccgccgtgaacctgaccctggtgacccccgagaaggccatcaagctggccgccaacgacttcttcagacaccagctgagcaaggacggccagaagctgaccctgctgaaggagatgctggccggctgcggcgccggctag

SEQ ID NO: 99651 - DNA, 237 bp, Artificial Sequence; identical to SEQ ID NO: 99647
  Description of Artificial Sequence: Synthetic coding sequence

SEQ ID NO: 99652 - DNA, 321 bp, Artificial Sequence
  Description of Artificial Sequence: Synthetic coding sequence
atggccgacaagcagatcagcctgcccgccaagctgatcaacggcggcatcgccggcctgatcggcgtgacctgcgtgttccccatcgacctggccaagaccagactgcagaaccagcagaacggccagagagtgtacaccagcatgagcgactgcctgatcaagaccgtgagaagcgagggctacttcggcatgtacagaggcgccgccgtgaacctgaccctggtgacccccgagaaggccatcaagctggccgccaacgacttcttcagacaccagctgagcaaggacggccagaagctgaccctgctgaaggagtag

SEQ ID NO: 99653 - DNA, 408 bp, Artificial Sequence
  Description of Artificial Sequence: Synthetic coding sequence
atggccgacaagcagatcagcctgcccgccaagctgatcaacggcggcatcgccggcctgatcggcgtgacctgcgtgttccccatcgacctggccaagaccagactgcagaaccagcagaacggccagagagtgtacaccagcatgagcgactgcctgatcaagaccgtgagaagcgagggctacttcggcatgtacagaggcgccgccgtgaacctgaccctggtgacccccgagaaggccatcaagctggccgccaacgacttcttcagacaccagctgagcaaggacggccagaagctgaccctgctgaaggagatgctggccggctgcggcgccggcacctgccaggtgatcgtgaccacccccatggagatgctgaagatccagctgcaggacgccggctag

SEQ ID NO: 99654 - DNA, 948 bp, Artificial Sequence
  Description of Artificial Sequence: Synthetic coding sequence
atgcacagagagcccgccaagaagaaggccgagaagagactgttcgacgccagcagcttcggcaaggacctgctggccggcggcgtggccgccgccgtgagcaagaccgccgtggcccccatcgagagagtgaagctgctgctgcaggtgcaggccagcagcaagcagatcagccccgaggccagatacaagggcatggtggactgcctggtgagaatccccagagagcagggcttcttcagcttctggagaggcaacctggccaacgtgatcagatacttccccacccaggccctgaacttcgccttcaaggacaagtacaagcagctgttcatgagcggcgtgaacaaggagaagcagttctggagatggttcctggccaacctggccagcggcggcgccgccggcgccaccagcctgtgcgtggtgtaccccctggacttcgccagaaccagactgggcgtggacatcggcaagggccccgaggagagacagttcaagggcctgggcgactgcatcatgaagatcgccaagagcgacggcatcgccggcctgtaccagggcttcggcgtgagcgtgcagggcatcatcgtgtacagagccagctacttcggcgcctacgacaccgtgaagggcctgctgcccaagcccaagaagacccccttcctggtgagcttcttcatcgcccaggtggtgaccacctgcagcggcatcctgagctaccccttcgacaccgtgagaagaagaatgatgatgcagagcggcgaggccaagagacagtacaagggcaccctggactgcttcgtgaagatctaccagcacgagggcatcagcagcttcttcagaggcgccttcagcaacgtgctgagaggcaccggcggcgccctggtgctggtgctgtacgacaagatcaaggagttcttccacatcgacatcggcggcagatag

SEQ ID NO: 99655 - DNA, 897 bp, Artificial Sequence
  Description of Artificial Sequence: Synthetic coding sequence
atgggcgaccacgcctggagcttcctgaaggacttcctggccggcggcgtggccgccgccgtgagcaagaccgccgtggcccccatcgagagagtgaagctgctgctgcaggtgcagcacgccagcaagcagatcagcgccgagaagcagtacaagggcatcatcgactgcgtggtgagaatccccaaggagcagggcttcctgagcttctggagaggcaacctggccaacgtgatcagatacttccccacccaggccctgaacttcgccttcaaggacaagtacaagcagctgttcctgggcggcgtggacagacacaagcagttctggagatacttcgccggcaacctggccagcggcggcgccgccggcgccaccagcctgtgcttcgtgtaccccctggacttcgccagaaccagactggccgccgacgtgggcaagggcgccgcccagagagagttccacggcctgggcgactgcatcatcaagatcttcaagagcgacggcctgagaggcctgtaccagggcttcaacgtgagcgtgcagggcatcatcatctacagagccgcctacttcggcgtgtacgacaccgccaagggcatgctgcccgaccccaagaacgtgcacatcttcgtgagctggatgatcgcccagagcgtgaccgccgtggccggcctggtgagctaccccttcgacaccgtgagaagaagaatgatgatgcagagcggcagaaagggcgccgacatcatgtacaccggcaccgtggactgctggagaaagatcgccaaggacgagggcgccaaggccttcttcaagggcgcctggagcaacgtgctgagaggcatgggcggcgccttcgtgctggtgctgtacgacgagatcaagaagtacgtgtag

SEQ ID NO: 99656 - DNA, 897 bp, Artificial Sequence
  Description of Artificial Sequence: Synthetic coding sequence
atgaccgacgccgccgtgagcttcgccaaggacttcctggccggcggcgtggccgccgccatcagcaagaccgccgtggcccccatcgagagagtgaagctgctgctgcaggtgcagcacgccagcaagcagatcaccgccgacaagcagtacaagggcatcatcgactgcgtggtgagaatccccaaggagcagggcgtgctgagcttctggagaggcaacctggccaacgtgatcagatacttccccacccaggccctgaacttcgccttcaaggacaagtacaagcagatcttcctgggcggcgtggacaagagaacccagttctggctgtacttcgccggcaacctggccagcggcggcgccgccggcgccaccagcctgtgcttcgtgtaccccctggacttcgccagaaccagactggccgccgacgtgggcaaggccggcgccgagagagagttcagaggcctgggcgactgcctggtgaagatctacaagagcgacggcatcaagggcctgtaccagggcttcaacgtgagcgtgcagggcatcatcatctacagagccgcctacttcggcatctacgacaccgccaagggcatgctgcccgaccccaagaacacccacatcgtgatcagctggatgatcgcccagaccgtgaccgccgtggccggcctgaccagctaccccttcgacaccgtgagaagaagaatgatgatgcagagcggcagaaagggcaccgacatcatgtacaccggcaccctggactgctggagaaagatcgccagagacgagggcggcaaggccttcttcaagggcgcctggagcaacgtgctgagaggcatgggcggcgccttcgtgctggtgctgtacgacgagatcaagaagtacacctag

SEQ ID NO: 99657 - DNA, 897 bp, Artificial Sequence
  Description of Artificial Sequence: Synthetic coding sequence
atgaccgagcaggccatcagcttcgccaaggacttcctggccggcggcatcgccgccgccatcagcaagaccgccgtggcccccatcgagagagtgaagctgctgctgcaggtgcagcacgccagcaagcagatcgccgccgacaagcagtacaagggcatcgtggactgcatcgtgagaatccccaaggagcagggcgtgctgagcttctggagaggcaacctggccaacgtgatcagatacttccccacccaggccctgaacttcgccttcaaggacaagtacaagcagatcttcctgggcggcgtggacaagcacacccagttctggagatacttcgccggcaacctggccagcggcggcgccgccggcgccaccagcctgtgcttcgtgtaccccctggacttcgccagaaccagactggccgccgacgtgggcaagagcggcaccgagagagagttcagaggcctgggcgactgcctggtgaagatcaccaagagcgacggcatcagaggcctgtaccagggcttcagcgtgagcgtgcagggcatcatcatctacagagccgcctacttcggcgtgtacgacaccgccaagggcatgctgcccgaccccaagaacacccacatcgtggtgagctggatgatcgcccagaccgtgaccgccgtggccggcgtggtgagctaccccttcgacaccgtgagaagaagaatgatgatgcagagcggcagaaagggcgccgacatcatgtacaccggcaccgtggactgctggagaaagatcttcagagacgagggcggcaaggccttcttcaagggcgcctggagcaacgtgctgagaggcatgggcggcgccttcgtgctggtgctgtacgacgagctgaagaaggtgatctag

SEQ ID NO: 99658 - DNA, 477 bp, Artificial Sequence
  Description of Artificial Sequence: Synthetic coding sequence
atgaccgagcaggccatcagcttcgccaaggacttcctggccggcggcatcgccgccgccatcagcaagaccgccgtggcccccatcgagagagtgaagctgctgctgcaggtgcagcacgccagcaagcagatcgccgccgacaagcagtacaagggcatcgtggactgcatcgtgagaatccccaaggagcagggcgtgctgagcttctggagaggcaacctggccaacgtgatcagatacttccccacccaggccctgaacttcgccttcaaggacaagtacaagcagatcttcctgggcggcgtggacaagcacacccagttctggagatacttcgccggcaacctggccagcggcggcgccgccggcgccaccagcctgtgcttcgtgtaccccctggacttcgccagaaccagactggccgccgacgtgggcaagagcggcaccgagagagagttcagaggcctgggctag

SEQ ID NO: 99659 - DNA, 2913 bp, Artificial Sequence
  Description of Artificial Sequence: Synthetic coding sequence
atgctgtgcttcctggacgacggcgccggcatggaccccagcgacgccgccagcgtgatccagttcggcaagagcgccaagagaacccccgagagcacccagatcggccagtacggcaacggcctgaagagcggcagcatgagaatcggcaaggacttcatcctgttcaccaagaaggaggacaccatgacctgcctgttcctgagcagaaccttccacgaggaggagggcatcgacgaggtgatcgtgcccctgcccacctggaacgccagaaccagagagcccgtgaccgacaacgtggagaagttcgccatcgagaccgagctgatctacaagtacagccccttcagaaccgaggaggaggtgatgacccagttcatgaagatccccggcgacagcggcaccctggtgatcatcttcaacctgaagctgatggacaacggcgagcccgagctggacatcatcagcaaccccagagacatccagatggccgagaccagccccgagggcaccaagcccgagagaagaagcttcagagcctacgccgccgtgctgtacatcgaccccagaatgagaatcttcatccacggccacaaggtgcagaccaagagactgagctgctgcctgtacaagcccagaatgtacaagtacaccagcagcagattcaagaccagagccgagcaggaggtgaagaaggccgagcacgtggccagaatcgccgaggagaaggccagagaggccgagagcaaggccagaaccctggaggtgagactgggcggcgacctgaccagagacagcagagtgatgctgagacaggtgcagaacagagccatcaccctgagaagagaggccgacgtgaagaagagaatcaaggaggccaagcagagagccctgaaggagcccaaggagctgaacttcgtgttcggcgtgaacatcgagcacagagacctggacggcatgttcatctacaactgcagcagactgatcaagatgtacgagaaggtgggcccccagctggagggcggcatggcctgcggcggcgtggtgggcgtggtggacgtgccctacctggtgctggagcccacccacaacaagcaggacttcgccgacgccaaggagtacagacacctgctgagagccatgggcgagcacctggcccagtactggaaggacatcgccatcgcccagagaggcatcatcaagttctgggacgagttcggctacctgagcgccaactggaaccagccccccagcagcgagctgagatacaagagaagaagagccatggagatccccaccaccatccagtgcgacctgtgcctgaagtggagaaccctgcccttccagctgagcagcgtggagaaggactaccccgacacctgggtgtgcagcatgaaccccgaccccgagcaggacagatgcgaggccagcgagcagaagcagaaggtgcccctgggcaccttcagaaaggacatgaagacccaggaggagaagcagaagcagctgaccgagaagatcagacagcagcaggagaagctggaggccctgcagaagaccacccccatcagaagccaggccgacctgaagaagctgcccctggaggtgaccaccagacccagcaccgaggagcccgtgagaagaccccagagacccagaagcccccccctgcccgccgtgatcagaaacgcccccagcagaccccccagcctgcccacccccagacccgccagccagcccagaaaggcccccgtgatcagcagcacccccaagctgcccgccctggccgccagagaggaggccagcaccagcagactgctgcagccccccgaggcccccagaaagcccgccaacaccctggtgaagaccgccagcagacccgcccccctggtgcagcagctgagccccagcctgctgcccaacagcaagagccccagagaggtgcccagccccaaggtgatcaagacccccgtggtgaagaagaccgagagccccatcaagctgagccccgccacccccagcagaaagagaagcgtggccgtgagcgacgaggaggaggtggaggaggaggccgagagaagaaaggagagatgcaagagaggcagattcgtggtgaaggaggagaagaaggacagcaacgagctgagcgacagcgccggcgaggaggacagcgccgacctgaagagagcccagaaggacaagggcctgcacgtggaggtgagagtgaacagagagtggtacaccggcagagtgaccgccgtggaggtgggcaagcacgtggtgagatggaaggtgaagttcgactacgtgcccaccgacaccacccccagagacagatgggtggagaagggcagcgaggacgtgagactgatgaagccccccagccccgagcaccagagcctggacacccagcaggagggcggcgaggaggaggtgggccccgtggcccagcaggccatcgccgtggccgagcccagcaccagcgagtgcctgagaatcgagcccgacaccaccgccctgagcaccaaccacgagaccatcgacctgctggtgcagatcctgagaaactgcctgagatacttcctgccccccagcttccccatcagcaagaagcagctgagcgccatgaacagcgacgagctgatcagcttccccctgaaggagtacttcaagcagtacgaggtgggcctgcagaacctgtgcaacagctaccagagcagagccgacagcagagccaaggccagcgaggagagcctgagaaccagcgagagaaagctgagagagaccgaggagaagctgcagaagctgagaaccaacatcgtggccctgctgcagaaggtgcaggaggacatcgacatcaacaccgacgacgagctggacgcctacatcgaggacctgatcaccaagggcgactag

SEQ ID NO: 99660 - DNA, 627 bp, Artificial Sequence
  Description of Artificial Sequence: Synthetic coding sequence
atgttcgagttcctgagcaaccacatgagagacgcccagggcagactggacagcaccagaggcctgctgtgcggcctgggcgccggcgtggccgaggccgtggtggtggtgtgccccatggagaccatcaaggtgaagttcatccacgaccagaccagccccaaccccaagtacagaggcttcttccacggcgtgagagagatcgtgagagagcagggcctgaagggcacctaccagggcctgaccgccaccgtgctgaagcagggcagcaaccaggccatcagattcttcgtgatgaccagcctgagaaactggtacagaggcgacaaccccaacaagcccatgaaccccctgatcaccggcgtgttcggcgccatcgccggcgccgccagcgtgttcggcaacacccccctggacgtgatcaagaccagaatgcagggcctggaggcccacaagtacagaaacacctgggactgcggcctgcagatcctgaagaaggagggcctgaaggccttctacaagggcaccgtgcccagactgggcagagtgtgcctggacgtggccatcgtgttcgtgatctacgacgaggtggtgaagctgctgaacaaggtgtggaagaccgactag

SEQ ID NO: 99661 - DNA, 999 bp, Artificial Sequence
  Description of Artificial Sequence: Synthetic coding sequence
atggccgccgccaccgccgccgccgccctggccgccgccgaccccccccccgccatgccccaggccgccggcgccggcggccccaccaccagaagagacttctactggctgagaagcttcctggccggcggcatcgccggctgctgcgccaagaccaccgtggcccccctggacagagtgaaggtgctgctgcaggcccacaaccaccactacaagcacctgggcgtgttcagcgccctgagagccgtgccccagaaggagggcttcctgggcctgtacaagggcaacggcgccatgatgatcagaatcttcccctacggcgccatccagttcatggccttcgagcactacaagaccctgatcaccaccaagctgggcatcagcggccacgtgcacagactgatggccggcagcatggccggcatgaccgccgtgatctgcacctaccccctggacatggtgagagtgagactggccttccaggtgaagggcgagcacagctacaccggcatcatccacgccttcaagaccatctacgccaaggagggcggcttcttcggcttctacagaggcctgatgcccaccatcctgggcatggccccctacgccggcgtgagcttcttcaccttcggcaccctgaagagcgtgggcctgagccacgcccccaccctgctgggcagacccagcagcgacaaccccaacgtgctggtgctgaagacccacgtgaacctgctgtgcggcggcgtggccggcgccatcgcccagaccatcagctaccccttcgacgtgaccagaagaagaatgcagctgggcaccgtgctgcccgagttcgagaagtgcctgaccatgagagacaccatgaagtacgtgtacggccaccacggcatcagaaagggcctgtacagaggcctgagcctgaactacatcagatgcatccccagccaggccgtggccttcaccacctacgagctgatgaagcagttcttccacctgaactag

SEQ ID NO: 99662 - DNA, 705 bp, Artificial Sequence
  Description of Artificial Sequence: Synthetic coding sequence
atgatgatcagaatcttcccctacggcgccatccagttcatggccttcgagcactacaagaccctgatcaccaccaagctgggcatcagcggccacgtgcacagactgatggccggcagcatggccggcatgaccgccgtgatctgcacctaccccctggacatggtgagagtgagactggccttccaggtgaagggcgagcacagctacaccggcatcatccacgccttcaagaccatctacgccaaggagggcggcttcttcggcttctacagaggcctgatgcccaccatcctgggcatggccccctacgccggcgtgagcttcttcaccttcggcaccctgaagagcgtgggcctgagccacgcccccaccctgctgggcagacccagcagcgacaaccccaacgtgctggtgctgaagacccacgtgaacctgctgtgcggcggcgtggccggcgccatcgcccagaccatcagctaccccttcgacgtgaccagaagaagaatgcagctgggcaccgtgctgcccgagttcgagaagtgcctgaccatgagagacaccatgaagtacgtgtacggccaccacggcatcagaaagggcctgtacagaggcctgagcctgaactacatcagatgcatccccagccaggccgtggccttcaccacctacgagctgatgaagcagttcttccacctgaactag

SEQ ID NO: 99663 - DNA, 906 bp, Artificial Sequence
  Description of Artificial Sequence: Synthetic coding sequence
atgaagagcaaccccgccatccaggccgccatcgacctgaccgccggcgccgccggcggcaccgcctgcgtgctgaccggccagcccttcgacaccatgaaggtgaagatgcagaccttccccgacctgtacagaggcctgaccgactgctgcctgaagacctacagccaggtgggcttcagaggcttctacaagggcaccagccccgccctgatcgccaacatcgccgagaacagcgtgctgttcatgtgctacggcttctgccagcaggtggtgagaaaggtggccggcctggacaagcaggccaagctgagcgacctgcagaacgccgccgccggcagcttcgccagcgccttcgccgccctggtgctgtgccccaccgagctggtgaagtgcagactgcagaccatgtacgagatggagaccagcggcaagatcgccaagagccagaacaccgtgtggagcgtgatcaagagcatcctgagaaaggacggccccctgggcttctaccacggcctgagcagcaccctgctgagagaggtgcccggctacttcttcttcttcggcggctacgagctgagcagaagcttcttcgccagcggcagaagcaaggacgagctgggccccgtgcccctgatgctgagcggcggcgtgggcggcatctgcctgtggctggccgtgtaccccgtggactgcatcaagagcagaatccaggtgctgagcatgagcggcaagcaggccggcttcatcagaaccttcatcaacgtggtgaagaacgagggcatcaccgccctgtacagcggcctgaagcccaccatgatcagagccttccccgccaacggcgccctgttcctggcctacgagtacagcagaaagctgatgatgaaccagctggaggcctactag

SEQ ID NO: 99664 - DNA, 402 bp, Artificial Sequence
  Description of Artificial Sequence: Synthetic coding sequence
atgaagagcaaccccgccatccaggccgccatcgacctgaccgccggcgccgccggcggcaccgcctgcgtgctgaccggccagcccttcgacaccatgaaggtgaagatgcagaccttccccgacctgtacagaggcctgaccgactgctgcctgaagacctacagccaggtgggcttcagaggcttctacaagggcaccagccccgccctgatcgccaacatcgccgagaacagcgtgctgttcatgtgctacggcttctgccagcaggtggtgagaaaggtggccggcctggacaagcaggccaagctgagcaccgtgtggagcgtgatcaagagcatcctgagaaaggacggccccctgggcttctaccacggcctgagcagcaccctgctgagatag

SEQ ID NO: 99665 - DNA, 402 bp, Artificial Sequence; identical to SEQ ID NO: 99664
  Description of Artificial Sequence: Synthetic coding sequence

SEQ ID NO: 99666 - DNA, 906 bp, Artificial Sequence; identical to SEQ ID NO: 99663
  Description of Artificial Sequence: Synthetic coding sequence

SEQ ID NO: 99667 - DNA, 726 bp, Artificial Sequence
  Description of Artificial Sequence: Synthetic coding sequence
atgaagagcaaccccgccatccaggccgccatcgacctgaccgccggcgccgccggcggcaccgcctgcgtgctgaccggccagcccttcgacaccatgaaggtggccggcctggacaagcaggccaagctgagcgacctgcagaacgccgccgccggcagcttcgccagcgccttcgccgccctggtgctgtgccccaccgagctggtgaagtgcagactgcagaccatgtacgagatggagaccagcggcaagatcgccaagagccagaacaccgtgtggagcgtgatcaagagcatcctgagaaaggacggccccctgggcttctaccacggcctgagcagcaccctgctgagagaggtgcccggctacttcttcttcttcggcggctacgagctgagcagaagcttcttcgccagcggcagaagcaaggacgagctgggccccgtgcccctgatgctgagcggcggcgtgggcggcatctgcctgtggctggccgtgtaccccgtggactgcatcaagagcagaatccaggtgctgagcatgagcggcaagcaggccggcttcatcagaaccttcatcaacgtggtgaagaacgagggcatcaccgccctgtacagcggcctgaagcccaccatgatcagagccttccccgccaacggcgccctgttcctggcctacgagtacagcagaaagctgatgatgaaccagctggaggcctactag

SEQ ID NO: 99668 - DNA, 906 bp, Artificial Sequence
  Description of Artificial Sequence: Synthetic coding sequence
atgaagagcggccccggcatccaggccgccatcgacctgaccgccggcgccgccggcggcaccgcctgcgtgctgaccggccagcccttcgacaccatcaaggtgaagatgcagaccttccccgacctgtacaagggcctgaccgactgcttcctgaagacctacgcccaggtgggcctgagaggcttctacaagggcaccggccccgccctgatggcctacgtggccgagaacagcgtgctgttcatgtgctacggcttctgccagcagttcgtgagaaaggtggccggcatggacaagcaggccaagctgagcgacctgcagaccgccgccgccggcagcttcgccagcgccttcgccgccctggccctgtgccccaccgagctggtgaagtgcagactgcagaccatgtacgagatggagatgagcggcaagatcgccaagagccacaacaccatctggagcgtggtgaagggcatcctgaagaaggacggccccctgggcttctaccacggcctgagcagcaccctgctgcaggaggtgcccggctacttcttcttcttcggcggctacgagctgagcagaagcttcttcgccagcggcagaagcaaggacgagctgggccccgtgcacctgatgctgagcggcggcgtggccggcatctgcctgtggctggtggtgttccccgtggactgcatcaagagcagaatccaggtgctgagcatgtacggcaagcaggccggcttcatcggcaccctgctgagcgtggtgagaaacgagggcatcgtggccctgtacagcggcctgaaggccaccatgatcagagccatccccgccaacggcgccctgttcgtggcctacgagtacagcagaaagatgatgatgaagcagctggaggcctactag

SEQ ID NO: 99669 - DNA, 423 bp, Artificial Sequence
  Description of Artificial Sequence: Synthetic coding sequence
atggccggctggaacgcctacatcgacaacctgatggccgacggcacctgccaggacgccgccatcgtgggctacaaggacagccccagcgtgtgggccgccgtgcccggcaagaccttcgtgaacatcacccccgccgaggtgggcgtgctggtgggcaaggacagaagcagcttctacgtgaacggcctgaccctgggcggccagaagtgcagcgtgatcagagacagcctgctgcaggacggcgagttcagcatggacctgagaaccaagagcaccggcggcgcccccaccttcaacgtgaccgtgaccaagaccgacaagaccctggtgctgctgatgggcaaggagggcgtgcacggcggcctgatcaacaagaagtgctacgagatggccagccacctgagaagaagccagtactag

SEQ ID NO: 99670 - DNA, 792 bp, Artificial Sequence
  Description of Artificial Sequence: Synthetic coding sequence
atggccgccaccgccagcgccggcgccggcggcatcgacggcaagcccagaaccagccccaagagcgtgaagttcctgttcggcggcctggccggcctgagcgccggcctgctgagacaggccacctacaccaccaccagactgggcatctacaccgtgctgttcgagagactgaccggcgccgacggcaccccccccggcttcctgctgaaggccgtgatcggcatgaccgccggcgccaccggcgccttcgtgggcacccccgccgaggtggccctgatcagaatgaccgccgacggcagactgcccgccgaccagagaagaggctacaagaacgtgttcaacgccctgatcagaatcaccagagaggagggcgtgctgaccctgtggagaggctgcatccccaccatggccagagccgtggtggtgaacgccgcccagctggccagctacagccagagcaagcagttcctgctggacagcggctacttcagcgacaacatcctgtgccacttctgcgccagcatgatcagcggcctggtgaccaccgccgccagcatgcccgtggacatcgccaagaccagaatccagaacatgagaatgatcgacggcaagcccgagtacaagaacggcctggacgtgctgttcaaggtggtgagatacgagggcttcttcagcctgtggaagggcttcaccccctactacgccagactgggcccccacaccgtgctgaccttcatcttcctggagcagatgaacaaggcctacaagagactgttcctgagcggctag

SEQ ID NO: 99671 - DNA, 678 bp, Artificial Sequence
  Description of Artificial Sequence: Synthetic coding sequence
atggagtactggtacgtggccctgaagcagcagagcctgaaggccgacatcctgcccagcctgttcctgagcatcttcctggtgaagggcgtggtgaacgtgctgctgaccacccccctgtgggtggtgaacaccagactgaagctgcagggcgccaagttcagaaacgaggacatcgtgcccaccaactacaagggcatcatcgacgccttccaccagatcatcagagacgagggcatcagcgccctgtggaacggcaccttccccagcctgctgctggtgttcaaccccgccatccagttcatgttctacgagggcctgaagagacagctgctgaagaagagaatgaagctgagcagcctggacgtgttcatcatcggcgccgtggccaaggccatcgccaccaccgtgacctaccccctgcagaccgtgcagagcatcctgagattcggcagacacagactgaaccccgagaacagaaccctgggcagcctgagaaacatcctgtacctgctgcaccagagagtgagaagattcggcatcatgggcctgtacaagggcctggaggccaagctgctgcagaccgtgctgaccgccgccctgatgttcctggtgtacgagaagctgaccgccgccaccttcaccgtgatgggcctgaagagagcccaccagcactag

SEQ ID NO: 99672 - DNA, 279 bp, Artificial Sequence
  Description of Artificial Sequence: Synthetic coding sequence
atgggcagcgtgaccgccatgaccgtgttcttccccctggacaccgccagactgagactgcaggtggacgagaagagaaagagcaagaccacccacatggtgctgctggagatcatcaaggaggagggcctgctggccccctacagaggctggttccccgtgatcagcagcctgtgctgcagcaacttcgtgtacttctacaccttcaacagcctgaaggccctgtgggtgaagggccagcacagcaccaccggcaaggacctggtggtgggcttctag

SEQ ID NO: 99673 - DNA, 924 bp, Artificial Sequence
  Description of Artificial Sequence: Synthetic coding sequence
atggccagcgtgctgagctacgagagcctggtgcacgccgtggccggcgccgtgggcagcgtgaccgccatgaccgtgttcttccccctggacaccgccagactgagactgcaggtggacgagaagagaaagagcaagaccacccacatggtgctgctggagatcatcaaggaggagggcctgctggccccctacagaggctggttccccgtgatcagcagcctgtgctgcagcaacttcgtgtacttctacaccttcaacagcctgaaggccctgtgggtgaagggccagcacagcaccaccggcaaggacctggtggtgggcttcgtggccggcgtggtgaacgtgctgctgaccacccccctgtgggtggtgaacaccagactgaagctgcagggcgccaagttcagaaacgaggacatcgtgcccaccaactacaagggcatcatcgacgccttccaccagatcatcagagacgagggcatcagcgccctgtggaacggcaccttccccagcctgctgctggtgttcaaccccgccatccagttcatgttctacgagggcctgaagagacagctgctgaagaagagaatgaagctgagcagcctggacgtgttcatcatcggcgccgtggccaaggccatcgccaccaccgtgacctaccccctgcagaccgtgcagagcatcctgagattcggcagacacagactgaaccccgagaacagaaccctgggcagcctgagaaacatcctgtacctgctgcaccagagagtgagaagattcggcatcatgggcctgtacaagggcctggaggccaagctgctgcagaccgtgctgaccgccgccctgatgttcctggtgtacgagaagctgaccgccgccaccttcaccgtgatgggcctgaagagagcccaccagcactag

SEQ ID NO: 99674 - DNA, 705 bp, Artificial Sequence
  Description of Artificial Sequence: Synthetic coding sequence
atggccagcgtgctgagctacgagagcctggtgcacgccgtggccggcgccgtgggcagcgtgaccgccatgaccgtgttcttccccctggacaccgccagactgagactgcagggcgtggtgaacgtgctgctgaccacccccctgtgggtggtgaacaccagactgaagctgcagggcgccaagttcagaaacgaggacatcgtgcccaccaactacaagggcatcatcgacgccttccaccagatcatcagagacgagggcatcagcgccctgtggaacggcaccttccccagcctgctgctggtgttcaaccccgccatccagttcatgttctacgagggcctgaagagacagctgctgaagaagagaatgaagctgagcagcctggacgtgttcatcatcggcgccgtggccaaggccatcgccaccaccgtgacctaccccctgcagaccgtgcagagcatcctgagattcggcagacacagactgaaccccgagaacagaaccctgggcagcctgagaaacatcctgtacctgctgcaccagagagtgagaagattcggcatcatgggcctgtacaagggcctggaggccaagctgctgcagaccgtgctgaccgccgccctgatgttcctggtgtacgagaagctgaccgccgccaccttcaccgtgatgggcctgaagagagcccaccagcactag

SEQ ID NO: 99675 - DNA, 813 bp, Artificial Sequence
  Description of Artificial Sequence: Synthetic coding sequence
atgatcgacgagaagagaaagagcaagaccacccacatggtgctgctggagatcatcaaggaggagggcctgctggccccctacagaggctggttccccgtgatcagcagcctgtgctgcagcaacttcgtgtacttctacaccttcaacagcctgaaggccctgtgggtgaagggccagcacagcaccaccggcaaggacctggtggtgggcttcgtggccggcgtggtgaacgtgctgctgaccacccccctgtgggtggtgaacaccagactgaagctgcagggcgccaagttcagaaacgaggacatcgtgcccaccaactacaagggcatcatcgacgccttccaccagatcatcagagacgagggcatcagcgccctgtggaacggcaccttccccagcctgctgctggtgttcaaccccgccatccagttcatgttctacgagggcctgaagagacagctgctgaagaagagaatgaagctgagcagcctggacgtgttcatcatcggcgccgtggccaaggccatcgccaccaccgtgacctaccccctgcagaccgtgcagagcatcctgagattcggcagacacagactgaaccccgagaacagaaccctgggcagcctgagaaacatcctgtacctgctgcaccagagagtgagaagattcggcatcatgggcctgtacaagggcctggaggccaagctgctgcagaccgtgctgaccgccgccctgatgttcctggtgtacgagaagctgaccgccgccaccttcaccgtgatgggcctgaagagagcccaccagcactag

SEQ ID NO: 99676 - DNA, 1086 bp, Artificial Sequence
  Description of Artificial Sequence: Synthetic coding sequence
atgttcagcagcgtggcccacctggccagagccaaccccttcaacaccccccacctgcagctggtgcacgacggcctgggcgacctgagaagcagcagccccggccccaccggccagcccagaagacccagaaacctggccgccgccgccgtggaggagtacagctgcgagttcggcagcgccaagtactacgccctgtgcggcttcggcggcgtgctgagctgcggcctgacccacaccgccgtggtgcccctggacctggtgaagtgcagaatgcaggtggacccccagaagtacaagggcatcttcaacggcttcagcgtgaccctgaaggaggacggcgtgagaggcctggccaagggctgggcccccaccttcctgggctacagcatgcagggcctgtgcaagttcggcttctacgaggtgttcaaggtgctgtacagcaacatgctgggcgaggagaacacctacctgtggagaaccagcctgtacctggccgccagcgccagcgccgagttcttcgccgacatcgccctggcccccatggaggccgccaaggtgagaatccagacccagcccggctacgccaacaccctgagagacgccgcccccaagatgtacaaggaggagggcctgaaggccttctacaagggcgtggcccccctgtggatgagacagatcccctacaccatgatgaagttcgcctgcttcgagagaaccgtggaggccctgtacaagttcgtggtgcccaagcccagaagcgagtgcagcaagcccgagcagctggtggtgaccttcgtggccggctacatcgccggcgtgttctgcgccatcgtgagccaccccgccgacagcgtggtgagcgtgctgaacaaggagaagggcagcagcgccagcctggtgctgaagagactgggcttcaagggcgtgtggaagggcctgttcgccagaatcatcatgatcggcaccctgaccgccctgcagtggttcatctacgacagcgtgaaggtgtacttcagactgcccagaccccccccccccgagatgcccgagagcctgaagaagaagctgggcctgacccagtag

SEQ ID NO: 99677 - DNA, 1776 bp, Artificial Sequence
  Description of Artificial Sequence: Synthetic coding sequence
atggacgacctggacgccctgctggccgacctggagagcaccaccagccacatcagcaagagacccgtgttcctgagcgaggagaccccctacagctaccccaccggcaaccacacctaccaggagatcgccgtgcccccccccgtgccccccccccccagcagcgaggccctgaacggcaccatcctggaccccctggaccagtggcagcccagcagcagcagattcatccaccagcagccccagagcagcagccccgtgtacggcagcagcgccaagaccagcagcgtgagcaacccccaggacagcgtgggcagcccctgcagcagagtgggcgaggaggagcacgtgtacagcttccccaacaagcagaagagcgccgagcccagccccaccgtgatgagcaccagcctgggcagcaacctgagcgagctggacagactgctgctggagctgaacgccgtgcagcacaacccccccggcttccccgccgacgaggccaacagcagcccccccctgcccggcgccctgagccccctgtacggcgtgcccgagaccaacagccccctgggcggcaaggccggccccctgaccaaggagaagcccaagagaaacggcggcagaggcctggaggacgtgagacccagcgtggagagcctgctggacgagctggagagcagcgtgcccagccccgtgcccgccatcaccgtgaaccagggcgagatgagcagcccccagagagtgaccagcacccagcagcagaccagaatcagcgccagcagcgccaccagagagctggacgagctgatggccagcctgagcgacttcaagatccagggcctggagcagagagccgacggcgagagatgctgggccgccggctggcccagagacggcggcagaagcagccccggcggccaggacgagggcggcttcatggcccagggcaagaccggcagcagcagcccccccggcggcccccccaagcccggcagccagctggacagcatgctgggcagcctgcagagcgacctgaacaagctgggcgtggccaccgtggccaagggcgtgtgcggcgcctgcaagaagcccatcgccggccaggtggtgaccgccatgggcaagacctggcaccccgagcacttcgtgtgcacccactgccaggaggagatcggcagcagaaacttcttcgagagagacggccagccctactgcgagaaggactaccacaacctgttcagccccagatgctactactgcaacggccccatcctggacaaggtggtgaccgccctggacagaacctggcaccccgagcacttcttctgcgcccagtgcggcgccttcttcggccccgagggcttccacgagaaggacggcaaggcctactgcagaaaggactacttcgacatgttcgcccccaagtgcggcggctgcgccagagccatcctggagaactacatcagcgccctgaacaccctgtggcaccccgagtgcttcgtgtgcagagagtgcttcacccccttcgtgaacggcagcttcttcgagcacgacggccagccctactgcgaggtgcactaccacgagagaagaggcagcctgtgcagcggctgccagaagcccatcaccggcagatgcatcaccgccatggccaagaagttccaccccgagcacttcgtgtgcgccttctgcctgaagcagctgaacaagggcaccttcaaggagcagaacgacaagccctactgccagaactgcttcctgaagctgttctgctag

SEQ ID NO: 99678 - DNA, 1086 bp, Artificial Sequence; identical to SEQ ID NO: 99676
  Description of Artificial Sequence: Synthetic coding sequence

SEQ ID NO: 99679 - DNA, 1086 bp, Artificial Sequence; identical to SEQ ID NO: 99676
  Description of Artificial Sequence: Synthetic coding sequence

SEQ ID NO: 99680 - DNA, 1089 bp, Artificial Sequence; identical to SEQ ID NO: 90888
  Description of Artificial Sequence: Synthetic coding sequence

SEQ ID NO: 99681 - DNA, 1086 bp, Artificial Sequence; identical to SEQ ID NO: 99676
  Description of Artificial Sequence: Synthetic coding sequence

SEQ ID NO: 99682 - DNA, 897 bp, Artificial Sequence
  Description of Artificial Sequence: Synthetic coding sequence
atgagcgccaagcccgaggtgagcctggtgagagaggccagcagacagatcgtggccggcggcagcgccggcctggtggagatctgcctgatgcaccccctggacgtggtgaagaccagattccagatccagagatgcgccaccgaccccaacagctacaagagcctggtggacagcttcagaatgatcttccagatggagggcctgttcggcttctacaagggcatcctgccccccatcctggccgagacccccaagagagccgtgaagttcttcaccttcgagcagtacaagaagctgctgggctacgtgagcctgagccccgccctgaccttcgccatcgccggcctgggcagcggcctgaccgaggccatcgtggtgaaccccttcgaggtggtgaaggtgggcctgcaggccaacagaaacaccttcgccgagcagcccagcaccgtgggctacgccagacagatcatcaagaaggagggctggggcctgcagggcctgaacaagggcctgaccgccaccctgggcagacacggcgtgttcaacatggtgtacttcggcttctactacaacgtgaagaacatgatccccgtgaacaaggaccccatcctggagttctggagaaagttcggcatcggcctgctgagcggcaccatcgccagcgtgatcaacatccccttcgacgtggccaagagcagaatccagggcccccagcccgtgcccggcgagatcaagtacagaacctgcttcaagaccatggccaccgtgtaccaggaggagggcatcctggccctgtacaagggcctgctgcccaagatcatgagactgggccccggcggcgccgtgatgctgctggtgtacgagtacacctacagctggctgcaggagaactag

SEQ ID NO: 99683 - DNA, 900 bp, Artificial Sequence
  Description of Artificial Sequence: Synthetic coding sequence
atgagcgccaagcccgaggtgagcctggtgagagaggccagcagacagatcgtggccggcggcagcgccggcctggtggagatctgcctgatgcaccccctggacgtggtgaagaccagattccagatccagagatgcgccaccgaccccaacagctacaagagcctggtggacagcttcagaatgatcttccagatggagggcctgttcggcttctacaagggcatcctgccccccatcctggccgagacccccaagagagccgtgaagttcttcaccttcgagcagtacaagaagctgctgggctacgtgagcctgagccccgccctgaccttcgccatcgccggcctgggcagcggcctgaccgaggccatcgtggtgaaccccttcgaggtggtgaaggtgggcctgcaggccaacagaaacaccttcgccgagcagcccagcaccgtgggctacgccagacagatcatcaagaaggagggctggggcctgcagggcctgaacaagggcctgaccgccaccctgggcagacacggcgtgttcaacatggtgtacttcggcttctactacaacgtgaagaacatgatccccgtgaacaaggaccccatcctggagttctggagaaagttcggcatcggcctgctgagcggcaccatcgccagcgtgatcaacatccccttcgacgtggccaagagcagaatccagggcccccagcccgtgcccggcgagatcaagtacagaacctgcttcaagaccatggccaccgtgtaccaggaggagggcatcctggccctgtacaagggcctgctgcccaagatcatgagactgggccccggcggcgccgtgatgctgctggtgtacgagtacacctacagctggctgcaggagaactggtag

SEQ ID NO: 99684 - DNA, 963 bp, Artificial Sequence
  Description of Artificial Sequence: Synthetic coding sequence
atggtgggctacgaccccaagcccgacggcagaaacaacaccaagttccaggtggccgtggccggcagcgtgagcggcctggtgaccagagccctgatcagccccttcgacgtgatcaagatcagattccagctgcagcacgagagactgagcagaagcgaccccagcgccaagtaccacggcatcctgcaggccagcagacagatcctgcaggaggagggccccaccgccttctggaagggccacgtgcccgcccagatcctgagcatcggctacggcgccgtgcagttcctgagcttcgagatgctgaccgagctggtgcacagaggcagcgtgtacgacgccagagagttcagcgtgcacttcgtgtgcggcggcctggccgcctgcatggccaccctgaccgtgcaccccgtggacgtgctgagaaccagattcgccgcccagggcgagcccaaggtgtacaacaccctgagacacgccgtgggcaccatgtacagaagcgagggcccccaggtgttctacaagggcctggcccccaccctgatcgccatcttcccctacgccggcctgcagttcagctgctacagcagcctgaagcacctgtacaagtgggccatccccgccgagggcaagaagaacgagaacctgcagaacctgctgtgcggcagcggcgccggcgtgatcagcaagaccctgacctaccccctggacctgttcaagaagagactgcaggtgggcggcttcgagcacgccagagccgccttcggccaggtgagaagatacaagggcctgatggactgcgccaagcaggtgctgcagaaggagggcgccctgggcttcttcaagggcctgagccccagcctgctgaaggccgccctgagcaccggcttcatgttcttcagctacgagttcttctgcaacgtgttccactgcatgaacagaaccgccagccagagatag

SEQ ID NO: 99685 - DNA, 963 bp, Artificial Sequence; identical to SEQ ID NO: 99684
  Description of Artificial Sequence: Synthetic coding sequence

SEQ ID NO: 99686 - DNA, 792 bp, Artificial Sequence
  Description of Artificial Sequence: Synthetic coding sequence
atggtgggctacgaccccaagcccgacggcagaaacaacaccaagttccaggtggccgtggccggcagcgtgagcggcctggtgaccagagccctgatcagccccttcgacgtgatcaagatcagattccagctgcagcacgagagactgagcagaagcgaccccagcgccaagtaccacggcatcctgcaggccagcagacagatcctgcaggaggagggccccaccgccttctggaagggccacgtgcccgcccagatcctgagcatcggctacggcgccgtgcaggtgtacaacaccctgagacacgccgtgggcaccatgtacagaagcgagggcccccaggtgttctacaagggcctggcccccaccctgatcgccatcttcccctacgccggcctgcagttcagctgctacagcagcctgaagcacctgtacaagtgggccatccccgccgagggcaagaagaacgagaacctgcagaacctgctgtgcggcagcggcgccggcgtgatcagcaagaccctgacctaccccctggacctgttcaagaagagactgcaggtgggcggcttcgagcacgccagagccgccttcggccaggtgagaagatacaagggcctgatggactgcgccaagcaggtgctgcagaaggagggcgccctgggcttcttcaagggcctgagccccagcctgctgaaggccgccctgagcaccggcttcatgttcttcagctacgagttcttctgcaacgtgttccactgcatgaacagaaccgccagccagagatag

SEQ ID NO: 99687 - DNA, 963 bp, Artificial Sequence; identical to SEQ ID NO: 99684
  Description of Artificial Sequence: Synthetic coding sequence

SEQ ID NO: 99688 - DNA, 963 bp, Artificial Sequence; identical to SEQ ID NO: 99684
  Description of Artificial Sequence: Synthetic coding sequence

SEQ ID NO: 99689 - DNA, 963 bp, Artificial Sequence; identical to SEQ ID NO: 99684
  Description of Artificial Sequence: Synthetic coding sequence

SEQ ID NO: 99690 - DNA, 2028 bp, Artificial Sequence
  Description of Artificial Sequence: Synthetic coding sequence
atggccgccgccaaggtggccctgaccaagagagccgaccccgccgagctgagaaccatcttcctgaagtacgccagcatcgagaagaacggcgagttcttcatgagccccaacgacttcgtgaccagatacctgaacatcttcggcgagagccagcccaaccccaagaccgtggagctgctgagcggcgtggtggaccagaccaaggacggcctgatcagcttccaggagttcgtggccttcgagagcgtgctgtgcgcccccgacgccctgttcatggtggccttccagctgttcgacaaggccggcaagggcgaggtgaccttcgaggacgtgaagcaggtgttcggccagaccaccatccaccagcacatccccttcaactgggacagcgagttcgtgcagctgcacttcggcaaggagagaaagagacacctgacctacgccgagttcacccagttcctgctggagatccagctggagcacgccaagcaggccttcgtgcagagagacaacgccagaaccggcagagtgaccgccatcgacttcagagacatcatggtgaccatcagaccccacgtgctgacccccttcgtggaggagtgcctggtggccgccgccggcggcaccaccagccaccaggtgagcttcagctacttcaacggcttcaacagcctgctgaacaacatggagctgatcagaaagatctacagcaccctggccggcaccagaaaggacgtggaggtgaccaaggaggagttcgtgctggccgcccagaagttcggccaggtgacccccatggaggtggacatcctgttccagctggccgacctgtacgagcccagaggcagaatgaccctggccgacatcgagagaatcgcccccctggaggagggcaccctgcccttcaacctggccgaggcccagagacagaaggccagcggcgacagcgccagacccgtgctgctgcaggtggccgagagcgcctacagattcggcctgggcagcgtggccggcgccgtgggcgccaccgccgtgtaccccatcgacctggtgaagaccagaatgcagaaccagagaagcaccggcagcttcgtgggcgagctgatgtacaagaacagcttcgactgcttcaagaaggtgctgagatacgagggcttcttcggcctgtacagaggcctgctgccccagctgctgggcgtggcccccgagaaggccatcaagctgaccgtgaacgacttcgtgagagacaagttcatgcacaaggacggcagcgtgcccctggccgccgagatcctggccggcggctgcgccggcggcagccaggtgatcttcaccaaccccctggagatcgtgaagatcagactgcaggtggccggcgagatcaccaccggccccagagtgagcgccctgagcgtggtgagagacctgggcttcttcggcatctacaagggcgccaaggcctgcttcctgagagacatccccttcagcgccatctacttcccctgctacgcccacgtgaaggccagcttcgccaacgaggacggccaggtgagccccggcagcctgctgctggccggcgccatcgccggcatgcccgccgccagcctggtgacccccgccgacgtgatcaagaccagactgcaggtggccgccagagccggccagaccacctacagcggcgtgatcgactgcttcagaaagatcctgagagaggagggccccaaggccctgtggaagggcgccggcgccagagtgttcagaagcagcccccagttcggcgtgaccctgctgacctacgagctgctgcagagatggttctacatcgacttcggcggcgtgaagcccatgggcagcgagcccgtgcccaagagcagaatcaacctgcccgcccccaaccccgaccacgtgggcggctacaagctggccgtggccaccttcgccggcatcgagaacaagttcggcctgtacctgcccctgttcaagcccagcgtgagcaccagcaaggccatcggcggcggcccctag

SEQ ID NO: 99691 - DNA, 2031 bp, Artificial Sequence
  Description of Artificial Sequence: Synthetic coding sequence
atggccgccgccaaggtggccctgaccaagagagccgaccccgccgagctgagaaccatcttcctgaagtacgccagcatcgagaagaacggcgagttcttcatgagccccaacgacttcgtgaccagatacctgaacatcttcggcgagagccagcccaaccccaagaccgtggagctgctgagcggcgtggtggaccagaccaaggacggcctgatcagcttccaggagttcgtggccttcgagagcgtgctgtgcgcccccgacgccctgttcatggtggccttccagctgttcgacaaggccggcaagggcgaggtgaccttcgaggacgtgaagcaggtgttcggccagaccaccatccaccagcacatccccttcaactgggacagcgagttcgtgcagctgcacttcggcaaggagagaaagagacacctgacctacgccgagttcacccagttcctgctggagatccagctggagcacgccaagcaggccttcgtgcagagagacaacgccagaaccggcagagtgaccgccatcgacttcagagacatcatggtgaccatcagaccccacgtgctgacccccttcgtggaggagtgcctggtggccgccgccggcggcaccaccagccaccaggtgagcttcagctacttcaacggcttcaacagcctgctgaacaacatggagctgatcagaaagatctacagcaccctggccggcaccagaaaggacgtggaggtgaccaaggaggagttcgtgctggccgcccagaagttcggccaggtgacccccatggaggtggacatcctgttccagctggccgacctgtacgagcccagaggcagaatgaccctggccgacatcgagagaatcgcccccctggaggagggcaccctgcccttcaacctggccgaggcccagagacagcagaaggccagcggcgacagcgccagacccgtgctgctgcaggtggccgagagcgcctacagattcggcctgggcagcgtggccggcgccgtgggcgccaccgccgtgtaccccatcgacctggtgaagaccagaatgcagaaccagagaagcaccggcagcttcgtgggcgagctgatgtacaagaacagcttcgactgcttcaagaaggtgctgagatacgagggcttcttcggcctgtacagaggcctgctgccccagctgctgggcgtggcccccgagaaggccatcaagctgaccgtgaacgacttcgtgagagacaagttcatgcacaaggacggcagcgtgcccctggccgccgagatcctggccggcggctgcgccggcggcagccaggtgatcttcaccaaccccctggagatcgtgaagatcagactgcaggtggccggcgagatcaccaccggccccagagtgagcgccctgagcgtggtgagagacctgggcttcttcggcatctacaagggcgccaaggcctgcttcctgagagacatccccttcagcgccatctacttcccctgctacgcccacgtgaaggccagcttcgccaacgaggacggccaggtgagccccggcagcctgctgctggccggcgccatcgccggcatgcccgccgccagcctggtgacccccgccgacgtgatcaagaccagactgcaggtggccgccagagccggccagaccacctacagcggcgtgatcgactgcttcagaaagatcctgagagaggagggccccaaggccctgtggaagggcgccggcgccagagtgttcagaagcagcccccagttcggcgtgaccctgctgacctacgagctgctgcagagatggttctacatcgacttcggcggcgtgaagcccatgggcagcgagcccgtgcccaagagcagaatcaacctgcccgcccccaaccccgaccacgtgggcggctacaagctggccgtggccaccttcgccggcatcgagaacaagttcggcctgtacctgcccctgttcaagcccagcgtgagcaccagcaaggccatcggcggcggcccctag

SEQ ID NO: 99692 - DNA, 1704 bp, Artificial Sequence
  Description of Artificial Sequence: Synthetic coding sequence
atggaggacgtgaagcaggtgttcggccagaccaccatccaccagcacatccccttcaactgggacagcgagttcgtgcagctgcacttcggcaaggagagaaagagacacctgacctacgccgagttcacccagttcctgctggagatccagctggagcacgccaagcaggccttcgtgcagagagacaacgccagaaccggcagagtgaccgccatcgacttcagagacatcatggtgaccatcagaccccacgtgctgacccccttcgtggaggagtgcctggtggccgccgccggcggcaccaccagccaccaggtgagcttcagctacttcaacggcttcaacagcctgctgaacaacatggagctgatcagaaagatctacagcaccctggccggcaccagaaaggacgtggaggtgaccaaggaggagttcgtgctggccgcccagaagttcggccaggtgacccccatggaggtggacatcctgttccagctggccgacctgtacgagcccagaggcagaatgaccctggccgacatcgagagaatcgcccccctggaggagggcaccctgcccttcaacctggccgaggcccagagacagaaggccagcggcgacagcgccagacccgtgctgctgcaggtggccgagagcgcctacagattcggcctgggcagcgtggccggcgccgtgggcgccaccgccgtgtaccccatcgacctggtgaagaccagaatgcagaaccagagaagcaccggcagcttcgtgggcgagctgatgtacaagaacagcttcgactgcttcaagaaggtgctgagatacgagggcttcttcggcctgtacagaggcctgctgccccagctgctgggcgtggcccccgagaaggccatcaagctgaccgtgaacgacttcgtgagagacaagttcatgcacaaggacggcagcgtgcccctggccgccgagatcctggccggcggctgcgccggcggcagccaggtgatcttcaccaaccccctggagatcgtgaagatcagactgcaggtggccggcgagatcaccaccggccccagagtgagcgccctgagcgtggtgagagacctgggcttcttcggcatctacaagggcgccaaggcctgcttcctgagagacatccccttcagcgccatctacttcccctgctacgcccacgtgaaggccagcttcgccaacgaggacggccaggtgagccccggcagcctgctgctggccggcgccatcgccggcatgcccgccgccagcctggtgacccccgccgacgtgatcaagaccagactgcaggtggccgccagagccggccagaccacctacagcggcgtgatcgactgcttcagaaagatcctgagagaggagggccccaaggccctgtggaagggcgccggcgccagagtgttcagaagcagcccccagttcggcgtgaccctgctgacctacgagctgctgcagagatggttctacatcgacttcggcggcgtgaagcccatgggcagcgagcccgtgcccaagagcagaatcaacctgcccgcccccaaccccgaccacgtgggcggctacaagctggccgtggccaccttcgccggcatcgagaacaagttcggcctgtacctgcccctgttcaagcccagcgtgagcaccagcaaggccatcggcggcggcccctag

SEQ ID NO: 99693 - DNA, 561 bp, Artificial Sequence
  Description of Artificial Sequence: Synthetic coding sequence
atgaagcacatgctggccgccagcgccggcgaggtggtggcctgcctgatcagagtgcccagcgaggtggtgaagcagagagcccaggtgagcgccagcaccagaaccttccagatcttcagcaacatcctgtacgaggagggcatccagggcctgtacagaggctacaagagcaccgtgctgagagagatccccttcagcctggtgcagttccccctgtgggagagcctgaaggccctgtggagctggagacaggaccacgtggtggacagctggcagagcgccgtgtgcggcgccttcgccggcggcttcgccgccgccgtgaccacccccctggacgtggccaagaccagaatcaccctggccaaggccggcagcagcaccgccgacggcaacgtgctgagcgtgctgcacggcgtgtggagaagccagggcctggccggcctgttcgccggcgtgttccccagaatggccgccatcagcctgggcggcttcatcttcctgggcgcctacgacagaacccacagcctgctgctggaggtgggcagaaagagcccctag

SEQ ID NO: 99694 - DNA, 825 bp, Artificial Sequence
  Description of Artificial Sequence: Synthetic coding sequence
atggacagacccggcttcgtggccgccctggtggccggcggcgtggccggcgtgagcgtggacctgatcctgttccccctggacaccatcaagaccagactgcagagcccccagggcttcagcaaggccggcggcttccacggcatctacgccggcgtgcccagcgccgccatcggcagcttccccaacgccgccgccttcttcatcacctacgagtacgtgaagtggttcctgcacgccgacagcagcagctacctgacccccatgaagcacatgctggccgccagcgccggcgaggtggtggcctgcctgatcagagtgcccagcgaggtggtgaagcagagagcccaggtgagcgccagcaccagaaccttccagatcttcagcaacatcctgtacgaggagggcatccagggcctgtacagaggctacaagagcaccgtgctgagagagatccccttcagcctggtgcagttccccctgtgggagagcctgaaggccctgtggagctggagacaggaccacgtggtggacagctggcagagcgccgtgtgcggcgccttcgccggcggcttcgccgccgccgtgaccacccccctggacgtggccaagaccagaatcaccctggccaaggccggcagcagcaccgccgacggcaacgtgctgagcgtgctgcacggcgtgtggagaagccagggcctggccggcctgttcgccggcgtgttccccagaatggccgccatcagcctgggcggcttcatcttcctgggcgcctacgacagaacccacagcctgctgctggaggtgggcagaaagagcccctag

SEQ ID NO: 99695 - DNA, 66 bp, Artificial Sequence
  Description of Artificial Sequence: Synthetic coding sequence
atggacagacccggcttcgtggccgccctggtgctgctgcacttcctgagccccatgaacatgtag

SEQ ID NO: 99696 - DNA, 477 bp, Artificial Sequence
  Description of Artificial Sequence: Synthetic coding sequence
atggagggcaagagaaagctggagggcaagcccctgagattcagaggcgtgcaccacgccttcgccaagatcctggccgagggcggcatcagaggcctgtgggccggctgggtgcccaacatccagagagccgccctggtgaacatgggcgacctgaccacctacgacaccgtgaagcactacctggtgctgaacacccccctggaggacaacatcatgacccacggcctgagcagcctgtgcagcggcctggtggccagcatcctgggcacccccgccgacgtgatcaagagcagaatcatgaaccagcccagagacaagcagggcagaggcctgctgtacaagagcagcaccgactgcctgatccaggccgtgcagggcgagggcttcatgagcctgtacaagggcttcctgcccagctggctgagaatggccgccgtgatcgtgaacagcagcagaagccagctgaaggtgtag

SEQ ID NO: 99697 - DNA, 972 bp, Artificial Sequence
  Description of Artificial Sequence: Synthetic coding sequence
atgagcgtgcccgaggaggaggagagactgctgcccctgacccagagatggcccagagccagcaagttcctgctgagcggctgcgccgccaccgtggccgagctggccaccttccccctggacctgaccaagaccagactgcagatgcagggcgaggccgccctggccagactgggcgacggcgccagagagagcgccccctacagaggcatggtgagaaccgccctgggcatcatcgaggaggagggcttcctgaagctgtggcagggcgtgacccccgccatctacagacacgtggtgtacagcggcggcagaatggtgacctacgagcacctgagagaggtggtgttcggcaagagcgaggacgagcactaccccctgtggaagagcgtgatcggcggcatgatggccggcgtgatcggccagttcctggccaaccccaccgacctggtgaaggtgcagatgcagatggagggcaagagaaagctggagggcaagcccctgagattcagaggcgtgcaccacgccttcgccaagatcctggccgagggcggcatcagaggcctgtgggccggctgggtgcccaacatccagagagccgccctggtgaacatgggcgacctgaccacctacgacaccgtgaagcactacctggtgctgaacacccccctggaggacaacatcatgacccacggcctgagcagcctgtgcagcggcctggtggccagcatcctgggcacccccgccgacgtgatcaagagcagaatcatgaaccagcccagagacaagcagggcagaggcctgctgtacaagagcagcaccgactgcctgatccaggccgtgcagggcgagggcttcatgagcctgtacaagggcttcctgcccagctggctgagaatgaccccctggagcatggtgttctggctgacctacgagaagatcagagagatgagcggcgtgagccccttctag

SEQ ID NO: 99698 - DNA, 738 bp, Artificial Sequence
  Description of Artificial Sequence: Synthetic coding sequence
atgagcgtgcccgaggaggaggagagactgctgcccctgacccagagatggcccagagccagcaagttcctgctgagcggctgcgccgccaccgtggccgagctggccaccttccccctggacctgaccaagaccagactgcagatgcagggcgaggccgccctggccagactgggcgacggcgccagagagagcgccccctacagaggcatggtgagaaccgccctgggcatcatcgaggaggagggcttcctgaagctgtggcagggcgtgacccccgccatctacagacacgtggtgtacagcggcggcagaatggtgacctacgagcacctgagagaggtggtgttcggcaagagcgaggacgagcactaccccctgtggaagagcgtgatcggcggcatgatggccggcgtgatcggccagttcctggccaaccccaccgacctggtgaaggtgcagatgcagatggagggcaagagaaagctggagggcaagcccctgagattcagaggcgtgcaccacgccttcgccaagatcctggccgagggcggcatcagaggcctgtgggccggctgggtgcccaacatccagagagccgccctggtgaacatgggcgacctgaccacctacgacaccgtgaagcactacctggtgctgaacacccccctggaggacaacatcatgacccacggcctgagcagcgacctggtgggcagccacaaggccatccagtag

SEQ ID NO: 99699 - DNA, 297 bp, Artificial Sequence
  Description of Artificial Sequence: Synthetic coding sequence
tgaaacatgggcgacctgaccacctacgacaccgtgaagcactacctggtgctgaacacccccctggaggacaacatcatgacccacggcctgagcagcctgtgcagcggcctggtggccagcatcctgggcacccccgccgacgtgatcaagagcagaatcatgaaccagcccagagacaagcagggcagaggcctgctgtacaagagcagcaccgactgcctgatccaggccgtgcagggcgagggcttcatgagcctgtacaagggcttcctgcccagctggctgagaatgtag

SEQ ID NO: 99700 - DNA, 450 bp, Artificial Sequence
  Description of Artificial Sequence: Synthetic coding sequence
atgagcgagtgccccctgatcctgtacatccacaagcacatcgacacctacagccagagctacctgttcaacgacctgttctaccccgtgtacagcggcggcagaatggtgacctacgagcacctgagagaggtggtgttcggcaagagcgaggacgagcactaccccctgtggaagagcgtgatcggcggcatgatggccggcgtgatcggccagttcctggccaaccccaccgacctggtgaaggtgcagatgcagatggagggcaagagaaagctggagggcaagcccctgagattcagaggcgtgcaccacgccttcgccaagatcctggccgagggcggcatcagaggcctgtgggccggctgggtgcccaacatccagagagccgccctggtgaacatgggcgacctgaccacctacgacaccgtgaagcactacctggtgtag

SEQ ID NO: 99701 - DNA, 480 bp, Artificial Sequence
  Description of Artificial Sequence: Synthetic coding sequence
tgaatggagggcaagagaaagctggagggcaagcccctgagattcagaggcgtgcaccacgccttcgccaagatcctggccgagggcggcatcagaggcctgtgggccggctgggtgcccaacatccagagagccgccctggtgaacatgggcgacctgaccacctacgacaccgtgaagcactacctggtgctgaacacccccctggaggacaacatcatgacccacggcctgagcagcctgtgcagcggcctggtggccagcatcctgggcacccccgccgacgtgatcaagagcagaatcatgaaccagcccagagacaagcagggcagaggcctgctgtacaagagcagcaccgactgcctgatccaggccgtgcagggcgagggcttcatgagcctgtacaagggcttcctgcccagctggctgagaatggccgccgtgatcgtgaacagcagcagaagccagctgaaggtgtag

SEQ ID NO: 99702 - DNA, 714 bp, Artificial Sequence
  Description of Artificial Sequence: Synthetic coding sequence
atgtacctgtacctgatgaagatgcccgccgcctaccaggtgtacagcggcggcagaatggtgacctacgagcacctgagagaggtggtgttcggcaagagcgaggacgagcactaccccctgtggaagagcgtgatcggcggcatgatggccggcgtgatcggccagttcctggccaaccccaccgacctggtgaaggtgcagatgcagatggagggcaagagaaagctggagggcaagcccctgagattcagaggcgtgcaccacgccttcgccaagatcctggccgagggcggcatcagaggcctgtgggccggctgggtgcccaacatccagagagccgccctggtgaacatgggcgacctgaccacctacgacaccgtgaagcactacctggtgctgaacacccccctggaggacaacatcatgacccacggcctgagcagcctgtgcagcggcctggtggccagcatcctgggcacccccgccgacgtgatcaagagcagaatcatgaaccagcccagagacaagcagggcagaggcctgctgtacaagagcagcaccgactgcctgatccaggccgtgcagggcgagggcttcatgagcctgtacaagggcttcctgcccagctggctgagaatgaccccctggagcatggtgttctggctgacctacgagaagatcagagagatgagcggcgtgagccccttctag

SEQ ID NO: 99703 - DNA, 1095 bp, Artificial Sequence
  Description of Artificial Sequence: Synthetic coding sequence
atggagctggagggcagaggcgccggcggcgtggccggcggccccgccgccggccccggcagaagccccggcgagagcgccctgctggacggctggctgcagagaggcgtgggcagaggcgccggcggcggcgaggccggcgcctgcagaccccccgtgagacaggaccccgacagcggccccgactacgaggccctgcccgccggcgccaccgtgaccacccacatggtggccggcgccgtggccggcatcctggagcactgcgtgatgtaccccatcgactgcgtgaagaccagaatgcagagcctgcagcccgaccccgccgccagatacagaaacgtgctggaggccctgtggagaatcatcagaaccgagggcctgtggagacccatgagaggcctgaacgtgaccgccaccggcgccggccccgcccacgccctgtacttcgcctgctacgagaagctgaagaagaccctgagcgacgtgatccaccccggcggcaacagccacatcgccaacggcgccgccggctgcgtggccaccctgctgcacgacgccgccatgaaccccgccgaggtggtgaagcagagaatgcagatgtacaacagcccctaccacagagtgaccgactgcgtgagagccgtgtggcagaacgagggcgccggcgccttctacagaagctacaccacccagctgaccatgaacgtgcccttccaggccatccacttcatgacctacgagttcctgcaggagcacttcaacccccagagaagatacaaccccagcagccacgtgctgagcggcgcctgcgccggcgccgtggccgccgccgccaccacccccctggacgtgtgcaagaccctgctgaacacccaggagagcctggccctgaacagccacatcaccggccacatcaccggcatggccagcgccttcagaaccgtgtaccaggtgggcggcgtgaccgcctacttcagaggcgtgcaggccagagtgatctaccagatccccagcaccgccatcgcctggagcgtgtacgagttcttcaagtacctgatcaccaagagacaggaggagtggagagccggcaagtag

SEQ ID NO: 99704 - DNA, 678 bp, Artificial Sequence
  Description of Artificial Sequence: Synthetic coding sequence
agaggcgccgccggctggagccactgccaccacgcccacggcggcagaagaagaggcagagaccccggcgccctgagagacgtgccccacagactgagacagggcgccgccggctgcgtggccaccctgctgcacgacgccgccatgaaccccgccgaggtggtgaagcagagaatgcagatgtacaacagcccctaccacagagtgaccgactgcgtgagagccgtgtggcagaacgagggcgccggcgccttctacagaagctacaccacccagctgaccatgaacgtgcccttccaggccatccacttcatgacctacgagttcctgcaggagcacttcaacccccagagaagatacaaccccagcagccacgtgctgagcggcgcctgcgccggcgccgtggccgccgccgccaccacccccctggacgtgtgcaagaccctgctgaacacccaggagagcctggccctgaacagccacatcaccggccacatcaccggcatggccagcgccttcagaaccgtgtaccaggtgggcggcgtgaccgcctacttcagaggcgtgcaggccagagtgatctaccagatccccagcaccgccatcgcctggagcgtgtacgagttcttcaagtacctgatcaccaagagacaggaggagtggagagccggcaagtag

SEQ ID NO: 99705 - DNA, 876 bp, Artificial Sequence
  Description of Artificial Sequence: Synthetic coding sequence
atgagcgccctgaactggaagcccttcgtgtacggcggcctggccagcatcaccgccgagtgcggcaccttccccatcgacctgaccaagaccagactgcagatccagggccagaccaacgacgccaagttcaaggagatcagatacagaggcatgctgcacgccctggtgagaatcggcagagaggagggcctgaaggccctgtacagcggcatcgcccccgccatgctgagacaggccagctacggcaccatcaagatcggcacctaccagagcctgaagagactgttcatcgagagacccgaggacgagaccctgcccatcaacgtgatctgcggcatcctgagcggcgtgatcagcagcaccatcgccaaccccaccgacgtgctgaagatcagaatgcaggcccagagcaacaccatccagggcggcatgatcggcaacttcatgaacatctaccagcaggagggcaccagaggcctgtggaagggcgtgagcctgaccgcccagagagccgccatcgtggtgggcgtggagctgcccgtgtacgacatcaccaagaagcacctgatcctgagcggcctgatgggcgacaccgtgtacacccacttcctgagcagcttcacctgcggcctggccggcgccctggccagcaaccccgtggacgtggtgagaaccagaatgatgaaccagagagtgctgagagacggcagatgcagcggctacaccggcaccctggactgcctgctgcagacctggaagaacgagggcttcttcgccctgtacaagggcttctggcccaactggctgagactgggcccctggaacatcatcttcttcgtgacctacgagcagctgaagaagctggacctgtag

SEQ ID NO: 99706 - DNA, 651 bp, Artificial Sequence
  Description of Artificial Sequence: Synthetic coding sequence
atgctgagacaggccagctacggcaccatcaagatcggcacctaccagagcctgaagagactgttcatcgagagacccgaggacgagaccctgcccatcaacgtgatctgcggcatcctgagcggcgtgatcagcagcaccatcgccaaccccaccgacgtgctgaagatcagaatgcaggcccagagcaacaccatccagggcggcatgatcggcaacttcatgaacatctaccagcaggagggcaccagaggcctgtggaagggcgtgagcctgaccgcccagagagccgccatcgtggtgggcgtggagctgcccgtgtacgacatcaccaagaagcacctgatcctgagcggcctgatgggcgacaccgtgtacacccacttcctgagcagcttcacctgcggcctggccggcgccctggccagcaaccccgtggacgtggtgagaaccagaatgatgaaccagagagtgctgagagacggcagatgcagcggctacaccggcaccctggactgcctgctgcagacctggaagaacgagggcttcttcgccctgtacaagggcttctggcccaactggctgagactgggcccctggaacatcatcttcttcgtgacctacgagcagctgaagaagctggacctgtag

SEQ ID NO: 99707 - DNA, 723 bp, Artificial Sequence
  Description of Artificial Sequence: Synthetic coding sequence
atgctgcacgccctggtgagaatcggcagagaggagggcctgaaggccctgtacagcggcatcgcccccgccatgctgagacaggccagctacggcaccatcaagatcggcacctaccagagcctgaagagactgttcatcgagagacccgaggacgagaccctgcccatcaacgtgatctgcggcatcctgagcggcgtgatcagcagcaccatcgccaaccccaccgacgtgctgaagatcagaatgcaggcccagagcaacaccatccagggcggcatgatcggcaacttcatgaacatctaccagcaggagggcaccagaggcctgtggaagggcgtgagcctgaccgcccagagagccgccatcgtggtgggcgtggagctgcccgtgtacgacatcaccaagaagcacctgatcctgagcggcctgatgggcgacaccgtgtacacccacttcctgagcagcttcacctgcggcctggccggcgccctggccagcaaccccgtggacgtggtgagaaccagaatgatgaaccagagagtgctgagagacggcagatgcagcggctacaccggcaccctggactgcctgctgcagacctggaagaacgagggcttcttcgccctgtacaagggcttctggcccaactggctgagactgggcccctggaacatcatcttcttcgtgacctacgagcagctgaagaagctggacctgtag

SEQ ID NO: 99708 - DNA, 948 bp, Artificial Sequence
  Description of Artificial Sequence: Synthetic coding sequence
atgaccggccagggccagagcgccagcggcagcagcgcctggagcaccgtgttcagacacgtgagatacgagaacctgatcgccggcgtgagcggcggcgtgctgagcaacctggccctgcaccccctggacctggtgaagatcagattcgccgtgagcgacggcctggagctgagacccaagtacaacggcatcctgcactgcctgaccaccatctggaagctggacggcctgagaggcctgtaccagggcgtgacccccaacatctggggcgccggcctgagctggggcctgtacttcttcttctacaacgccatcaagagctacaagaccgagggcagagccgagagactggaggccaccgagtacctggtgagcgccgccgaggccggcgccatgaccctgtgcatcaccaaccccctgtgggtgaccaagaccagactgatgctgcagtacgacgccgtggtgaacagcccccacagacagtacaagggcatgttcgacaccctggtgaagatctacaagtacgagggcgtgagaggcctgtacaagggcttcgtgcccggcctgttcggcaccagccacggcgccctgcagttcatggcctacgagctgctgaagctgaagtacaaccagcacatcaacagactgcccgaggcccagctgagcaccgtggagtacatcagcgtggccgccctgagcaagatcttcgccgtggccgccacctacccctaccaggtggtgagagccagactgcaggaccagcacatgttctacagcggcgtgatcgacgtgatcaccaagacctggagaaaggagggcgtgggcggcttctacaagggcatcgcccccaacctgatcagagtgacccccgcctgctgcatcaccttcgtggtgtacgagaacgtgagccacttcctgctggacctgagagagaagagaaagtag

SEQ ID NO: 99709 - DNA, 900 bp, Artificial Sequence
  Description of Artificial Sequence: Synthetic coding sequence
atgaccggccagggccagagcgccagcggcagcagcgcctggagcggcggcgtgctgagcaacctggccctgcaccccctggacctggtgaagatcagattcgccgtgagcgacggcctggagctgagacccaagtacaacggcatcctgcactgcctgaccaccatctggaagctggacggcctgagaggcctgtaccagggcgtgacccccaacatctggggcgccggcctgagctggggcctgtacttcttcttctacaacgccatcaagagctacaagaccgagggcagagccgagagactggaggccaccgagtacctggtgagcgccgccgaggccggcgccatgaccctgtgcatcaccaaccccctgtgggtgaccaagaccagactgatgctgcagtacgacgccgtggtgaacagcccccacagacagtacaagggcatgttcgacaccctggtgaagatctacaagtacgagggcgtgagaggcctgtacaagggcttcgtgcccggcctgttcggcaccagccacggcgccctgcagttcatggcctacgagctgctgaagctgaagtacaaccagcacatcaacagactgcccgaggcccagctgagcaccgtggagtacatcagcgtggccgccctgagcaagatcttcgccgtggccgccacctacccctaccaggtggtgagagccagactgcaggaccagcacatgttctacagcggcgtgatcgacgtgatcaccaagacctggagaaaggagggcgtgggcggcttctacaagggcatcgcccccaacctgatcagagtgacccccgcctgctgcatcaccttcgtggtgtacgagaacgtgagccacttcctgctggacctgagagagaagagaaagtag

SEQ ID NO: 99710 - DNA, 552 bp, Artificial Sequence
  Description of Artificial Sequence: Synthetic coding sequence
atgaccctgtgcatcaccaaccccctgtgggtgaccaagaccagactgatgctgcagtacgacgccgtggtgaacagcccccacagacagtacaagggcatgttcgacaccctggtgaagatctacaagtacgagggcgtgagaggcctgtacaagggcttcgtgcccggcctgttcggcaccagccacggcgccctgcagttcatggcctacgagctgctgaagctgaagtacaaccagcacatcaacagactgcccgaggcccagctgagcaccgtggagtacatcagcgtggccgccctgagcaagatcttcgccgtggccgccacctacccctaccaggtggtgagagccagactgcaggaccagcacatgttctacagcggcgtgatcgacgtgatcaccaagacctggagaaaggagggcgtgggcggcttctacaagggcatcgcccccaacctgatcagagtgacccccgcctgctgcatcaccttcgtggtgtacgagaacgtgagccacttcctgctggacctgagagagaagagaaagtag

SEQ ID NO: 99711 - DNA, 966 bp, Artificial Sequence
  Description of Artificial Sequence: Synthetic coding sequence
atggccaccggcggccagcagaaggagaacaccctgctgcacctgttcgccggcggctgcggcggcaccgtgggcgccatcttcacctgccccctggaggtgatcaagaccagactgcagagcagcagactggccctgagaaccgtgtactacccccaggtgcacctgggcaccatcagcggcgccggcatggtgagacccaccagcgtgacccccggcctgttccaggtgctgaagagcatcctggagaaggagggccccaagagcctgttcagaggcctgggccccaacctggtgggcgtggcccccagcagagccgtgtacttcgcctgctacagcaaggccaaggagcagttcaacggcatcttcgtgcccaacagcaacatcgtgcacatcttcagcgccggcagcgccgccttcatcaccaacagcctgatgaaccccatctggatggtgaagaccagaatgcagctggagcagaaggtgagaggcagcaagcagatgaacaccctgcagtgcgccagatacgtgtaccagaccgagggcatcagaggcttctacagaggcctgaccgccagctacgccggcatcagcgagaccatcatctgcttcgccatctacgagagcctgaagaagtacctgaaggaggcccccctggccagcagcgccaacggcaccgagaagaacagcaccagcttcttcggcctgatggccgccgccgccctgagcaagggctgcgccagctgcatcgcctacccccacgaggtgatcagaaccagactgagagaggagggcaccaagtacaagagcttcgtgcagaccgccagactggtgttcagagaggagggctacctggccttctacagaggcctgttcgcccagctgatcagacagatccccaacaccgccatcgtgctgagcacctacgagctgatcgtgtacctgctggaggacagaacccagtag

SEQ ID NO: 99712 - DNA, 915 bp, Artificial Sequence
  Description of Artificial Sequence: Synthetic coding sequence
atggagaccgtgccccccgccgtggacctggtgctgggcgccagcgcctgctgcctggcctgcgtgttcaccaaccccctggaggtggtgaagaccagactgcagctgcagggcgagctgcaggccagaggcacctaccccagaccctaccacggcttcatcgccagcgtggccgccgtggccagagccgacggcctgtggggcctgcagaagggcctggccgccggcctgctgtaccagggcctgatgaacggcgtgagattctactgctacagcctggcctgccaggccggcctgacccagcagcccggcggcaccgtggtggccggcgccgtggccggcgccctgggcgccttcgtgggcagccccgcctacctgatcaagacccagctgcaggcccagaccgtggccgccgtggccgtgggccaccagcacaaccaccagaccgtgctgggcgccctggagaccatctggagacagcagggcctgctgggcctgtggcagggcgtgggcggcgccgtgcccagagtgatggtgggcagcgccgcccagctggccaccttcgccagcgccaaggcctgggtgcagaagcagcagtggctgcccgaggacagctggctggtggccctggccggcggcatgatcagcagcatcgccgtggtggtggtgatgacccccttcgacgtggtgagcaccagactgtacaaccagcccgtggacaccgccggcagaggccagctgtacggcggcctgaccgactgcatggtgaagatctggagacaggagggccccctggccctgtacaagggcctgggccccgcctacctgagactgggcccccacaccatcctgagcatgctgttctgggacgagctgagaaagctggccggcagagcccagcacaagggcacctag

SEQ ID NO: 99713 - DNA, 888 bp, Artificial Sequence
  Description of Artificial Sequence: Synthetic coding sequence
atggacttcctgatgagcggcctggccgcctgcggcgcctgcgtgttcaccaaccccctggaggtggtgaagaccagaatgcagctgcagggcgagctgcaggcccccggcacctaccagagacactacagaaacgtgttccacgccttcatcaccatcggcaaggtggacggcctggccgccctgcagaagggcctggcccccgccctgctgtaccagttcctgatgaacggcatcagactgggcacctacggcctggccgaggccggcggctacctgcacaccgccgagggcacccacagccccgccagaagcgccgccgccggcgccatggccggcgtgatgggcgcctacctgggcagccccatctacatggtgaagacccacctgcaggcccaggccgccagcgagatcgccgtgggccaccagtacaagcaccagggcatgttccaggccctgaccgagatcggccagaagcacggcctggtgggcctgtggagaggcgccctgggcggcctgcccagagtgatcgtgggcagcagcacccagctgtgcaccttcagcagcaccaaggacctgctgagccagtgggagatcttccccccccagagctggaagctggccctggtggccgccatgatgagcggcatcgccgtggtgctggccatggcccccttcgacgtggcctgcaccagactgtacaaccagcccaccgacgcccagggcaagaacagagtgcccaagttcagcgccaccagctgcagcgccagcgcccccctgctgggcaccaaggacgtgagaatcgtgaagggccagaccggccaccagctgttcaaggtgacccaggcccccggctgcagccccatcctgctgggcacccagagctag

SEQ ID NO: 99714 - DNA, 876 bp, Artificial Sequence
  Description of Artificial Sequence: Synthetic coding sequence
atggacttcctgatgagcggcctggccgcctgcggcgcctgcgtgttcaccaaccccctggaggtggtgaagaccagaatgcagctgcagggcgagctgcaggcccccggcacctaccagagacactacagaaacgtgttccacgccttcatcaccatcggcaaggtggacggcctggccgccctgcagaagggcctggcccccgccctgctgtaccagttcctgatgaacggcatcagactgggcacctacggcctggccgaggccggcggctacctgcacaccgccgagggcacccacagccccgccagaagcgccgccgccggcgccatggccggcgtgatgggcgcctacctgggcagccccatctacatggtgaagacccacctgcaggcccaggccgccagcgagatcgccgtgggccaccagtacaagcaccagggcatgttccaggccctgaccgagatcggccagaagcacggcctggtgggcctgtggagaggcgccctgggcggcctgcccagagtgatcgtgggcagcagcacccagctgtgcaccttcagcagcaccaaggacctgctgagccagtgggagatcttccccccccagagctggaagctggccctggtggccgccatgatgagcggcatcgccgtggtgctggccatggcccccttcgacgtggcctgcaccagactgtacaaccagcccaccgacgcccagggcaagggcctgatgtacagaggcatcctggacgccctgctgcagaccgccagaaccgagggcatcttcggcatgtacaaggagcccagcccccaggtgctgagcaacatcatgcagtgcttcagcgccttcaccggcgaccagagatgctag

SEQ ID NO: 99715 - DNA, 915 bp, Artificial Sequence
  Description of Artificial Sequence: Synthetic coding sequence
atgatccagaacagcagacccagcctgctgcagccccaggacgtgggcgacaccgtggagaccctgatgctgcaccccgtgatcaaggccttcctgtgcggcagcatcagcggcacctgcagcaccctgctgttccagcccctggacctgctgaagaccagactgcagaccctgcagcccagcgaccacggcagcagaagagtgggcatgctggccgtgctgctgaaggtggtgagaaccgagagcctgctgggcctgtggaagggcatgagccccagcatcgtgagatgcgtgcccggcgtgggcatctacttcggcaccctgtacagcctgaagcagtacttcctgagaggccacccccccaccgccctggagagcgtgatgctgggcgtgggcagcagaagcgtggccggcgtgtgcatgagccccatcaccgtgatcaagaccagatacgagagcggcaagtacggctacgagagcatctacgccgccctgagaagcatctaccacagcgagggccacagaggcctgttcagcggcctgaccgccaccctgctgagagacgcccccttcagcggcatctacctgatgttctacaaccagaccaagaacatcgtgccccacgaccaggtggacgccaccctgatccccatcaccaacttcagctgcggcatcttcgccggcatcctggccagcctggtgacccagcccgccgacgtgatcaagacccacatgcagctgtaccccctgaagttccagtggatcggccaggccgtgaccctgatcttcaaggactacggcctgagaggcttcttccagggcggcatccccagagccctgagaagaaccctgatggccgccatggcctggaccgtgtacgaggagatgatggccaagatgggcctgaagagctag

SEQ ID NO: 99716 - DNA, 1671 bp, Artificial Sequence
  Description of Artificial Sequence: Synthetic coding sequence
atgccccccgagagaagaagaagaatgaagctggacagaagaaccggcgccaagcccaagagaaagcccggcatgagacccgactggaaggccggcgccggccccggcggccccccccagaagcccgcccccagcagccagagaaagccccccgccagacccagcgccgccgccgccgccatcgccgtggccgccgccgaggaggagagaagactgagacagagaaacagactgagactggaggaggacaagcccgccgtggagagatgcctggaggagctggtgttcggcgacgtggagaacgacgaggacgccctgctgagaagactgagaggccccagagtgcaggagcacgaggacagcggcgacagcgaggtggagaacgaggccaagggcaacttccccccccagaagaagcccgtgtgggtggacgaggaggacgaggacgaggagatggtggacatgatgaacaacagattcagaaaggacatgatgaagaacgccagcgagagcaagctgagcaaggacaacctgaagaagagactgaaggaggagttccagcacgccatgggcggcgtgcccgcctgggccgagaccaccaagagaaagaccagcagcgacgacgagagcgaggaggacgaggacgacctgctgcagagaaccggcaacttcatcagcaccagcaccagcctgcccagaggcatcctgaagatgaagaactgccagcacgccaacgccgagagacccaccgtggccagaatcagcagcgtgcagttccaccccggcgcccagatcgtgatggtggccggcctggacaacgccgtgagcctgttccaggtggacggcaagaccaaccccaagatccagagcatctacctggagagattccccatcttcaaggcctgcttcagcgccaacggcgaggaggtgctggccaccagcacccacagcaaggtgctgtacgtgtacgacatgctggccggcaagctgatccccgtgcaccaggtgagaggcctgaaggagaagatcgtgagaagcttcgaggtgagccccgacggcagcttcctgctgatcaacggcatcgccggctacctgcacctgctggccatgaagaccaaggagctgatcggcagcatgaagatcaacggcagagtggccgccagcaccttcagcagcgacagcaagaaggtgtacgccagcagcggcgacggcgaggtgtacgtgtgggacgtgaacagcagaaagtgcctgaacagattcgtggacgagggcagcctgtacggcctgagcatcgccaccagcagaaacggccagtacgtggcctgcggcagcaactgcggcgtggtgaacatctacaaccaggacagctgcctgcaggagaccaaccccaagcccatcaaggccatcatgaacctggtgaccggcgtgaccagcctgaccttcaaccccaccaccgagatcctggccatcgccagcgagaagatgaaggaggccgtgagactggtgcacctgcccagctgcaccgtgttcagcaacttccccgtgatcaagaacaagaacatcagccacgtgcacaccatggacttcagccccagaagcggctacttcgccctgggcaacgagaagggcaaggccctgatgtacagactgcaccactacagcgacttctag

SEQ ID NO: 99717 - DNA, 1080 bp, Artificial Sequence
  Description of Artificial Sequence: Synthetic coding sequence
atggccgaccaggaccccgccggcatcagccccctgcagcagatggtggccagcggcaccggcgccgtggtgaccagcctgttcatgacccccctggacgtggtgaaggtgagactgcagagccagagacccagcatggccagcgagctgatgcccagcagcagactgtggagcctgagctacaccaagctgcccagcagcctgcagagcaccggcaagtgcctgctgtactgcaacggcgtgctggagcccctgtacctgtgccccaacggcgccagatgcgccacctggttccaggaccccaccagattcaccggcaccatggacgccttcgtgaagatcgtgagacacgagggcaccagaaccctgtggagcggcctgcccgccaccctggtgatgaccgtgcccgccaccgccatctacttcaccgcctacgaccagctgaaggccttcctgtgcggcagagccctgaccagcgacctgtacgcccccatggtggccggcgccctggccagactgggcaccgtgaccgtgatcagccccctggagctgatgagaaccaagctgcaggcccagcacgtgagctacagagagctgggcgcctgcgtgagaaccgccgtggcccagggcggctggagaagcctgtggctgggctggggccccaccgccctgagagacgtgcccttcagcgccctgtactggttcaactacgagctggtgaagagctggctgaacggcttcagacccaaggaccagaccagcgtgggcatgagcttcgtggccggcggcatcagcggcaccgtggccgccgtgctgaccctgcccttcgacgtggtgaagacccagagacaggtggccctgggcgccatggaggccgtgagagtgaaccccctgcacgtggacagcacctggctgctgctgagaagaatcagagccgagagcggcaccaagggcctgttcgccggcttcctgcccagaatcatcaaggccgcccccagctgcgccatcatgatcagcacctacgagttcggcaagagcttcttccagagactgaaccaggacagactgctgggcggctag

SEQ ID NO: 99718 - DNA, 1011 bp, Artificial Sequence
  Description of Artificial Sequence: Synthetic coding sequence
atggccgaccaggaccccgccggcatcagccccctgcagcagatggtggccagcggcaccggcgccgtggtgaccagcctgttcatgacccccctggacgtggtgaaggtgagactgcagagccagagacccagcatggccagcggcaagtgcctgctgtactgcaacggcgtgctggagcccctgtacctgtgccccaacggcgccagatgcgccacctggttccaggaccccaccagattcaccggcaccatggacgccttcgtgaagatcgtgagacacgagggcaccagaaccctgtggagcggcctgcccgccaccctggtgatgaccgtgcccgccaccgccatctacttcaccgcctacgaccagctgaaggccttcctgtgcggcagagccctgaccagcgacctgtacgcccccatggtggccggcgccctggccagactgggcaccgtgaccgtgatcagccccctggagctgatgagaaccaagctgcaggcccagcacgtgagctacagagagctgggcgcctgcgtgagaaccgccgtggcccagggcggctggagaagcctgtggctgggctggggccccaccgccctgagagacgtgcccttcagcgccctgtactggttcaactacgagctggtgaagagctggctgaacggcttcagacccaaggaccagaccagcgtgggcatgagcttcgtggccggcggcatcagcggcaccgtggccgccgtgctgaccctgcccttcgacgtggtgaagacccagagacaggtggccctgggcgccatggaggccgtgagagtgaaccccctgcacgtggacagcacctggctgctgctgagaagaatcagagccgagagcggcaccaagggcctgttcgccggcttcctgcccagaatcatcaaggccgcccccagctgcgccatcatgatcagcacctacgagttcggcaagagcttcttccagagactgaaccaggacagactgctgggcggctag

SEQ ID NO: 99719 - DNA, 1017 bp, Artificial Sequence
  Description of Artificial Sequence: Synthetic coding sequence
atggaccccgagaccagaggccaggagatcatcaaggtgacccccctgcagcagatgctggccagctgcaccggcgccatcctgaccagcgtgatcgtgacccccctggacgtggtgaagatcagactgcaggcccagaacaaccccctgcccaagggcaagtgcttcgtgtacagcaacggcctgatggaccacctgtgcgtgtgcgaggagggcggcaacaagctgtggtacaagaagcccggcaacttccagggcaccctggacgccttcttcaagatcatcagaaacgagggcatcaagagcctgtggagcggcctgccccccaccctggtgatggccgtgcccgccaccgtgatctacttcacctgctacgaccagctgagcgccctgctgagaagcaagctgggcgagaacgagacctgcatccccatcgtggccggcatcgtggccagattcggcgccgtgaccgtgatcagccccctggagctgatcagaaccaagatgcagagcaagaagttcagctacgtggagctgcacagattcgtgagcaagaaggtgagcgaggacggctggatcagcctgtggagaggctgggcccccaccgtgctgagagacgtgcccttcagcgccatgtactggtacaactacgagatcctgaagaagtggctgtgcgagaagagcggcctgtacgagcccaccttcatgatcaacttcaccagcggcgccctgagcggcagcttcgccgccgtggccaccctgcccttcgacgtggtgaagacccagaagcagacccagctgtggacctacgagagccacaagatcagcatgcccctgcacatgagcacctggatcatcatgaagaacatcgtggccaagaacggcttcagcggcctgttcagcggcctgatccccagactgatcaagatcgcccccgcctgcgccatcatgatcagcacctacgagttcggcaaggccttcttccagaagcagaacgtgagaagacagcagtactag

SEQ ID NO: 99720 - DNA, 1113 bp, Artificial Sequence
  Description of Artificial Sequence: Synthetic coding sequence
atgggcgcccagcccggcgagccccagaacacctgcagcagaatccagaccctgttcagaagagtgaagaccctgctgatcaaggcccccccccccccccagccccccccccccccccccagctggaaccccggctgcacccacgtgtacggctacgccttcggccacatgcacgacaacaacctggagcacctgcccagccagcaggtgctggacaccggcgagcagctgatggtgcccgtggaggtgctggaggtggacaacaaggaggccctgtggaagttcctgctgagcggcgccatggccggcgccgtgagcagaaccggcaccgcccccctggacagagccaaggtgtacatgcaggtgtacagcagcaagaccaacttcaccaacctgctgggcggcctgcagagcatggtgcaggagggcggcttcagaagcctgtggagaggcaacggcatcaacgtgctgaagatcgcccccgagtacgccatcaagttcagcgtgttcgagcagtgcaagaactacttctgcggcatccagggcagcccccccttccaggagagactgctggccggcagcctggccgtggccatcagccagaccctgatcaaccccatggaggtgctgaagaccagactgaccctgagaagaaccggccagtacaagggcctgctggactgcgccagacagatcctgcagagagagggcaccagagccctgtacagaggctacctgcccaacatgctgggcatcatcccctacgcctgcaccgacctggccgtgtacgagatgctgcagtgcttctgggtgaagagcggcagagacatgggcgaccccagcggcctggtgagcctgagcagcgtgaccctgagcaccacctgcggccagatggccagctaccccctgaccctggtgagaaccagaatgcaggcccaggacaccgtggagggcagcaaccccaccatgagaggcgtgctgcagagaatcctggcccagcagggctggctgggcctgtacagaggcatgacccccaccctgctgaaggtgctgcccgccggcggcatcagctacgtggtgtacgaggccatgaagaagaccctgggcatctag

SEQ ID NO: 99721 - DNA, 729 bp, Artificial Sequence
  Description of Artificial Sequence: Synthetic coding sequence
atgggcgcccagcccggcgagccccagaacacctgcagcagaatccagaccctgttcagaagagtgaagaccctgctgatcaaggcccccccccccccccagccccccccccccccccccagctggaaccccggctgcacccacgtgtacggctacgccttcggccacatgcacgacaacaacctggagcacctgcccagccagcaggtgctggacaccggcgagcagctgatggtgcccgtggaggtgctggaggtggacaacaaggaggccctgtggaagttcctgctgagcggcgccatggccggcgccgtgagcagaaccggcaccgcccccctggacagagccaaggtgtacatgcagctgctgggcagactgagacaggagaacagactgaacctgggcggcggcggctgcagcgagcccagaagccccgacagaacccccgcctgggccaccgagagcaccccccccagaagaaccagccccacctgctggggcggctacagagcctggagcagaagagccgccagcgccccctgcggcggcgccaccgccagcacctgcagcagactgctgctgagcatgcccagcagcagcccctacagcagcagcgccagaatcaccagcgtggagtacaagggccccagacccagcagaagcgtgagcctgctggccccctggctgtggcccagccccagacccagcagcaccccctggagatgctag

SEQ ID NO: 99722 - DNA, 957 bp, Artificial Sequence
  Description of Artificial Sequence: Synthetic coding sequence
atgggcaacggcgtgaaggagggccccgtgagactgcacgaggacgccgaggccgtgctgagcagcagcgtgagcagcaagagagaccacagacaggtgctgagcagcctgctgagcggcgccctggccggcgccctggccaagaccgccgtggcccccctggacagaaccaagatcatcttccaggtgagcagcaagagattcagcgccaaggaggccttcagagtgctgtactacacctacctgaacgagggcttcctgagcctgtggagaggcaacagcgccaccatggtgagagtggtgccctacgccgccatccagttcagcgcccacgaggagtacaagagaatcctgggcagctactacggcttcagaggcgaggccctgcccccctggcccagactgttcgccggcgccctggccggcaccaccgccgccagcctgacctaccccctggacctggtgagagccagaatggccgtgacccccaaggagatgtacagcaacatcttccacgtgttcatcagaatcagcagagaggagggcctgaagaccctgtaccacggcttcatgcccaccgtgctgggcgtgatcccctacgccggcctgagcttcttcacctacgagaccctgaagagcctgcacagagagtacagcggcagaagacagccctaccccttcgagagaatgatcttcggcgcctgcgccggcctgatcggccagagcgccagctaccccctggacgtggtgagaagaagaatgcagaccgccggcgtgaccggctaccccagagccagcatcgccagaaccctgagaaccatcgtgagagaggagggcgccgtgagaggcctgtacaagggcctgagcatgaactgggtgaagggccccatcgccgtgggcatcagcttcaccaccttcgacctgatgcagatcctgctgagacacctgcagagctag

SEQ ID NO: 99723 - DNA, 1011 bp, Artificial Sequence
  Description of Artificial Sequence: Synthetic coding sequence
atgagcgtgctgttcttctacatcatgagatacaagcagagcgaccccgagaaccccgacaacgacagattcgtgctggccaagatcgccaccagaaaggcctgcggcctggccctggccaagctgggctacgccaacaacagagtggtggtgctggacggcgacaccagatacagcaccttcagcgagatcttcaacaaggagtaccccgagagattcatcgagtgcttcatggccgagcagaacatggtgagcgtggccctgggctgcgccagcagaggcagaaccatcgccttcgccagcaccttcgccgccttcctgaccagagccttcgaccacatcagaatcggcggcctggccgagagcaacatcaacatcatcggcagccactgcggcgtgagcgtgggcgacgacggcgccagccagatggccctggaggacatcgccatgttcagaaccatccccaagtgcaccatcttctaccccaccgacgccgtgagcaccgagcacgccgtggccctggccgccaacgccaagggcatgtgcttcatcagaaccaccagacccgagaccatggtgatctacaccccccaggagagattcgagatcggccaggccaaggtgctgagacactgcgtgagcgacaaggtgaccgtgatcggcgccggcatcaccgtgtacgaggccctggccgccgccgacgagctgagcaagcaggacatcttcatcagagtgatcgacctgttcaccatcaagcccctggacgtggccaccatcgtgagcagcgccaaggccaccgagggcagaatcatcaccgtggaggaccactacccccagggcggcatcggcgaggccgtgtgcgccgccgtgagcatggaccccgacatccaggtgcacagcctggccgtgagcggcgtgccccagagcggcaagagcgaggagctgctggacatgtacggcatcagcgccagacacatcatcgtggccgtgaagtgcatgctgctgaactag

SEQ ID NO: 99724 - DNA, 870 bp, Artificial Sequence
  Description of Artificial Sequence: Synthetic coding sequence
atggccacctggagaagagacggcagactgaccggcggccagagactgctgtgcgccggcctggccggcaccctgagcctgagcctgaccgcccccctggagctggccgcctacagaaagttcgtggtgctgttcaccgacgacctgggccacatcagccagtggagcagcatcatggccggcagcctggccggcatggtgagcaccatcgtgacctaccccaccgacctgatcaagaccagactgatcatgcagaacatcctggagcccagctacagaggcctgctgcacgccttcagcaccatctaccagcaggagggcttcctggccctgtacagaggcgtgagcctgaccgtggtgggcgccctgcccttcagcgccggcagcctgctggtgtacatgaacctggagaagatctggaacggccccagagaccagttcagcctgccccagaacttcgccaacgtgtgcctggccgccgccgtgacccagaccctgagcttccccttcgagaccgtgaagagaaagatgcaggcccagagcccctacctgccccacagcggcggcgtggacgtgcacttcagcggcgccgtggactgcttcagacagatcgtgaaggcccagggcgtgctgggcctgtggaacggcctgaccgccaacctgctgaagatcgtgccctacttcggcatcatgttcagcaccttcgagttctgcaagagaatctgcctgtaccagaacggctacatcctgagccccctgagctacaagctgacccccggcgtggaccagagcctgcagccccaggagctgagagagctgaagaagttcttcaagaccagaaagcccaagcccaagaagcccaccctgtag

SEQ ID NO: 99725 - DNA, 681 bp, Artificial Sequence
  Description of Artificial Sequence: Synthetic coding sequence
atggccacctggagaagagacggcagactgaccggcggccagagactgctgtgcgccggcctggccggcaccctgagcctgagcctgaccgcccccctggagctggccaccgtgctggcccaggtgggcgtggtgagaggccacgccagaggcccctgggccaccggccacagagtgtggagagccgagggcctgagagccctgtggaagggcaacgccgtggcctgcctgagactgttcccctgcagcgccgtgcagctggccgcctacagaaagttcgtggtgctgttcaccgacgacctgggccacatcagccagtggagcagcatcatggccggcagcctggccggcatggtgagcaccatcgtgacctaccccaccgacctgatcaagaccagactgatcatgcagaacatcctggagcccagctacagaggcctgctgcacgccttcagcaccatctaccagcaggagggcttcctggccctgtacagaggcgtgagcctgaccgtggtgggcagcgagcccctgccccccacccagtggagaagcagatgccccttcctgagaagcagcggcctgctgcccgccgacagcgagggccccggcggccccggcgccctggagtggatcgacagccagttcaccgaggacagcagcatcttctggaactacgtgtag

SEQ ID NO: 99726 - DNA, 945 bp, Artificial Sequence
  Description of Artificial Sequence: Synthetic coding sequence
atggaggacaagagaaacatccagatcatcgagtgggagcacctggacaagaagaagttctacgtgttcggcgtggccatgaccatgatgatcagagtgagcgtgtaccccttcaccctgatcagaaccagactgcaggtgcagaagggcaagagcctgtaccacggcaccttcgacgccttcatcaagatcctgagagccgacggcatcaccggcctgtacagaggcttcctggtgaacaccttcaccctgatcagcggccagtgctacgtgaccacctacgagctgaccagaaagttcgtggccgactacagccagagcaacaccgtgaagagcctggtggccggcggcagcgccagcctggtggcccagagcatcaccgtgcccatcgacgtggtgagccagcacctgatgatgcagagaaagggcgagaagatgggcagattccaggtgagaggcaaccccgagggccagggcgtggtggccttcggccagaccaaggacatcatcagacagatcctgcaggccgacggcctgagaggcttctacagaggctacgtggccagcctgctgacctacatccccaacagcgccgtgtggtggcccttctaccacttctacgccgagcagctgagctacctgtgccccaaggagtgcccccacatcgtgttccaggccgtgagcggccccctggccgccgccaccgccagcatcctgaccaaccccatggacgtgatcagaaccagagtgcaggtggagggcaagaacagcatcatcctgaccttcagacagctgatggccgaggagggcccctggggcctgatgaagggcctgagcgccagaatcatcagcgccacccccagcaccatcgtgatcgtggtgggctacgagagcctgaagaagctgagcctgagacccgagctggtggacagcagacactggtag

SEQ ID NO: 99727 - DNA, 489 bp, Artificial Sequence
  Description of Artificial Sequence: Synthetic coding sequence
atggaggacaagagaaacatccagatcatcgagtgggagcacctggacaagaagaagttctacgtgttcggcgtggccatgaccatgatgatcagagtgagcgtgtaccccttcaccctgatcagaaccagactgcaggtgcagaagggcaagagcctgtaccacggcaccttcgacgccttcatcaagatcctgagagccgacggcatcaccggcctgtacagaggcttcctggtgaacaccttcaccctgatcagcggccagtgctacgtgaccacctacgagctgaccagaaagttcgtggccgactacagccagagcaacaccgtgaagagcctgatggccgaggagggcccctggggcctgatgaagggcctgagcgccagaatcatcagcgccacccccagcaccatcgtgatcgtggtgggctacgagagcctgaagaagctgagcctgagacccgagctggtggacagcagacactggtag

SEQ ID NO: 99728 - DNA, 876 bp, Artificial Sequence
  Description of Artificial Sequence: Synthetic coding sequence
atggaggacaagagaaacatccagatcatcgagtgggagcacctggacaagaagaagttctacgtgttcggcgtggccatgaccatgatgatcagagtgagcgtgtaccccttcaccctgatcagaaccagactgcaggtgcagaagggcaagagcctgtaccacggcaccttcgacgccttcatcaagatcctgagagccgacggcatcaccggcctgtacagaggcttcctggtgaacaccttcaccctgatcagcggccagtgctacgtgaccacctacgagctgaccagaaagttcgtggccgactacagccagagcaacaccgtgaagagcctggtggccggcggcagcgccagcctggtggcccagagcatcaccgtgagaggcaaccccgagggccagggcgtggtggccttcggccagaccaaggacatcatcagacagatcctgcaggccgacggcctgagaggcttctacagaggctacgtggccagcctgctgacctacatccccaacagcgccgtgtggtggcccttctaccacttctacgccgagcagctgagctacctgtgccccaaggagtgcccccacatcgtgttccaggccgtgagcggccccctggccgccgccaccgccagcatcctgaccaaccccatggacgtgatcagaaccagagtgcaggtggagggcaagaacagcatcatcctgaccttcagacagctgatggccgaggagggcccctggggcctgatgaagggcctgagcgccagaatcatcagcgccacccccagcaccatcgtgatcgtggtgggctacgagagcctgaagaagctgagcctgagacccgagctggtggacagcagacactggtag

SEQ ID NO: 99729 - DNA, 741 bp, Artificial Sequence
  Description of Artificial Sequence: Synthetic coding sequence
atggtgaagatctacagacacgagagcctgctgggcttcttcaagggcatgagcttccccatcgccagcatcgccgtggtgaacagcgtgctgttcggcgtgtacagcaacaccctgctggtgctgaccgccaccagccaccaggagagaagagcccagccccccagctacatgcacatcttcctggccggctgcaccggcggcttcctgcaggcctactgcctggcccccttcgacctgatcaaggtgagactgcagaaccagaccgagcccagagcccagcccggcagccccccccccagataccagggccccgtgcactgcgccgccagcatcttcagagaggagggccccagaggcctgttcagaggcgcctgggccctgaccctgagagacacccccaccgtgggcatctacttcatcacctacgagggcctgtgcagacagtacacccccgagggccagaaccccagcagcgccaccgtgctggtggccggcggcttcgccggcatcgccagctgggtggccgccacccccctggacatgatcaagagcagaatgcagatggacggcctgagaagaagagtgtaccagggcatgctggactgcatggtgagcagcatcagacaggagggcctgggcgtgttcttcagaggcgtgaccatcaacagcgccagagccttccccgtgaacgccgtgaccttcctgagctacgagtacctgctgagatggtggggctag

SEQ ID NO: 99730 - DNA, 795 bp, Artificial Sequence
  Description of Artificial Sequence: Synthetic coding sequence
atgcccgtggaggagttcgtggccggctggatcagcggcgccctgggcctggtgctgggccaccccttcgacaccgtgaagctgctgggcttcttcaagggcatgagcttccccatcgccagcatcgccgtggtgaacagcgtgctgttcggcgtgtacagcaacaccctgctggtgctgaccgccaccagccaccaggagagaagagcccagccccccagctacatgcacatcttcctggccggctgcaccggcggcttcctgcaggcctactgcctggcccccttcgacctgatcaaggtgagactgcagaaccagaccgagcccagagcccagcccggcagccccccccccagataccagggccccgtgcactgcgccgccagcatcttcagagaggagggccccagaggcctgttcagaggcgcctgggccctgaccctgagagacacccccaccgtgggcatctacttcatcacctacgagggcctgtgcagacagtacacccccgagggccagaaccccagcagcgccaccgtgctggtggccggcggcttcgccggcatcgccagctgggtggccgccacccccctggacatgatcaagagcagaatgcagatggacggcctgagaagaagagtgtaccagggcatgctggactgcatggtgagcagcatcagacaggagggcctgggcgtgttcttcagaggcgtgaccatcaacagcgccagagccttccccgtgaacgccgtgaccttcctgagctacgagtacctgctgagatggtggggctag

SEQ ID NO: 99731 - DNA, 555 bp, Artificial Sequence
  Description of Artificial Sequence: Synthetic coding sequence
atggtgaagatctacagacacgagagcgcctactgcctggcccccttcgacctgatcaaggtgagactgcagaaccagaccgagcccagagcccagcccggcagccccccccccagataccagggccccgtgcactgcgccgccagcatcttcagagaggagggccccagaggcctgttcagaggcgcctgggccctgaccctgagagacacccccaccgtgggcatctacttcatcacctacgagggcctgtgcagacagtacacccccgagggccagaaccccagcagcgccaccgtgctggtggccggcggcttcgccggcatcgccagctgggtggccgccacccccctggacatgatcaagagcagaatgcagatggacggcctgagaagaagagtgtaccagggcatgctggactgcatggtgagcagcatcagacaggagggcctgggcgtgttcttcagaggcgtgaccatcaacagcgccagagccttccccgtgaacgccgtgaccttcctgagctacgagtacctgctgagatggtggggctag

SEQ ID NO: 99732 - DNA, 867 bp, Artificial Sequence
  Description of Artificial Sequence: Synthetic coding sequence
atgcccgtggaggagttcgtggccggctggatcagcggcgccctgggcctggtgctgggccaccccttcgacaccgtgaaggtgagactgcagacccagaccacctacagaggcatcgtggactgcatggtgaagatctacagacacgagagcctgctgggcttcttcaagggcatgagcttccccatcgccagcatcgccgtggtgaacagcgtgctgttcggcgtgtacagcaacaccctgctggtgctgaccgccaccagccaccaggagagaagagcccagccccccagctacatgcacatcttcctggccggctgcaccggcggcttcctgcaggcctactgcctggcccccttcgacctgatcaaggtgagactgcagaaccagaccgagcccagagcccagcccggcagccccccccccagataccagggccccgtgcactgcgccgccagcatcttcagagaggagggccccagaggcctgttcagaggcgcctgggccctgaccctgagagacacccccaccgtgggcatctacttcatcacctacgagggcctgtgcagacagtacacccccgagggccagaaccccagcagcgccaccgtgctggtggccggcggcttcgccggcatcgccagctgggtggccgccacccccctggacatgatcaagagcagaatgcagatggacggcctgagaagaagagtgtaccagggcatgctggactgcatggtgagcagcatcagacaggagggcctgggcgtgttcttcagaggcgtgaccatcaacagcgccagagccttccccgtgaacgccgtgaccttcctgagctacgagtacctgctgagatggtggggctag

SEQ ID NO: 99733 - DNA, 741 bp, Artificial Sequence; identical to SEQ ID NO: 99729
  Description of Artificial Sequence: Synthetic coding sequence

SEQ ID NO: 99734 - DNA, 867 bp, Artificial Sequence; identical to SEQ ID NO: 99732
  Description of Artificial Sequence: Synthetic coding sequence

SEQ ID NO: 99735 - DNA, 357 bp, Artificial Sequence
  Description of Artificial Sequence: Synthetic coding sequence
atgcccgtggaggagttcgtggccggctggatcagcggcgccctgggcctggtgctgggccaccccttcgacaccgtgaaggtgagactgcagacccagaccacctacagaggcatcgtggactgcatggtgaagatctacagacacgagagcctgctgggcttcttcaagggcatgagcttccccatcgccagcatcgccgtggtgaacagcgtgctgttcggcgtgtacagcaacaccctgctggtgctgaccgccaccagccaccaggagagaagagcccagccccccagctacatgcacatcttcctggccggctgcaccggcggcttcctgcaggcctactgcctggcctag

SEQ ID NO: 99736 - DNA, 1257 bp, Artificial Sequence
  Description of Artificial Sequence: Synthetic coding sequence
atgcaccccagaagacccgacggcttcgacggcctgggctacagaggcggcgccagagacgagcagggcttcggcggcgccttccccgccagaagcttcagcaccggcagcgacctgggccactgggtgaccaccccccccgacatccccggcagcagaaacctgcactggggcgagaagagccccccctacggcgtgcccaccaccagcaccccctacgagggccccaccgaggagcccttcagcagcggcggcggcggcagcgtgcagggccagagcagcgagcagctgaacagattcgccggcttcggcatcggcctggccagcctgttcaccgagaacgtgctggcccacccctgcatcgtgctgagaagacagtgccaggtgaactaccacgcccagcactaccacctgacccccttcaccgtgatcaacatcatgtacagcttcaacaagacccagggccccagagccctgtggaagggcatgggcagcaccttcatcgtgcagggcgtgaccctgggcgccgagggcatcatcagcgagttcacccccctgcccagagaggtgctgcacaagtggagccccaagcagatcggcgagcacctgctgctgaagagcctgacctacgtggtggccatgcccttctacagcgccagcctgatcgagaccgtgcagagcgagatcatcagagacaacaccggcatcctggagtgcgtgaaggagggcatcggcagagtgatcggcatgggcgtgccccacagcaagagactgctgcccctgctgagcctgatcttccccaccgtgctgcacggcgtgctgcactacatcatcagcagcgtgatccagaagttcgtgctgctgatcctgaagagaaagacctacaacagccacctggccgagagcaccagccccgtgcagagcatgctggacgcctacttccccgagctgatcgccaacttcgccgccagcctgtgcagcgacgtgatcctgtaccccctggagaccgtgctgcacagactgcacatccagggcaccagaaccatcatcgacaacaccgacctgggctacgaggtgctgcccatcaacacccagtacgagggcatgagagactgcatcaacaccatcagacaggaggagggcgtgttcggcttctacaagggcttcggcgccgtgatcatccagtacaccctgcacgccgccgtgctgcagatcaccaagatcatctacagcaccctgctgcagaacaacatctag

SEQ ID NO: 99737 - DNA, 1014 bp, Artificial Sequence
  Description of Artificial Sequence: Synthetic coding sequence
atgcaccccagaagacccgacggcttcgacggcctgggctacagaggcggcgccagagacgagcagggcttcggcggcgccttccccgccagaagcttcagcaccggcagcgacctgggccactgggtgaccaccccccccgacatccccggcagcagaaacctgcactggggcgagaagagccccccctacggcgtgcccaccaccagcaccccctacgagggccccaccgaggagcccttcagcagcggcggcggcggcagcgtgcagggccagagcagcgagcagctgaacagattcgccggcttcggcatcggcctggccagcctgttcaccgagaacgtgctggcccacccctgcatcgtgctgagaagacagtgccaggtgaactaccacgcccagcactaccacctgacccccttcaccgtgatcaacatcatgtacagcttcaacaagacccagggccccagagccctgtggaagggcatgggcagcaccttcatcgtgcagggcgtgaccctgggcgccgagggcatcatcagcgagttcacccccctgcccagagaggtgctgcacaagtggagccccaagcagatcggcgagcacctgctgctgaagagcctgacctacgtggtggccatgcccttctacagcgccagcctgatcgagaccgtgcagagcatgctggacgcctacttccccgagctgatcgccaacttcgccgccagcctgtgcagcgacgtgatcctgtaccccctggagaccgtgctgcacagactgcacatccagggcaccagaaccatcatcgacaacaccgacctgggctacgaggtgctgcccatcaacacccagtacgagggcatgagagactgcatcaacaccatcagacaggaggagggcgtgttcggcttctacaagggcttcggcgccgtgatcatccagtacaccctgcacgccgccgtgctgcagatcaccaagatcatctacagcaccctgctgcagaacaacatctag

SEQ ID NO: 99738 - DNA, 819 bp, Artificial Sequence
  Description of Artificial Sequence: Synthetic coding sequence
atgtacagcttcaacaagacccagggccccagagccctgtggaagggcatgggcagcaccttcatcgtgcagggcgtgaccctgggcgccgagggcatcatcagcgagttcacccccctgcccagagaggtgctgcacaagtggagccccaagcagatcggcgagcacctgctgctgaagagcctgacctacgtggtggccatgcccttctacagcgccagcctgatcgagaccgtgcagagcgagatcatcagagacaacaccggcatcctggagtgcgtgaaggagggcatcggcagagtgatcggcatgggcgtgccccacagcaagagactgctgcccctgctgagcctgatcttccccaccgtgctgcacggcgtgctgcactacatcatcagcagcgtgatccagaagttcgtgctgctgatcctgaagagaaagacctacaacagccacctggccgagagcaccagccccgtgcagagcatgctggacgcctacttccccgagctgatcgccaacttcgccgccagcctgtgcagcgacgtgatcctgtaccccctggagaccgtgctgcacagactgcacatccagggcaccagaaccatcatcgacaacaccgacctgggctacgaggtgctgcccatcaacacccagtacgagggcatgagagactgcatcaacaccatcagacaggaggagggcgtgttcggcttctacaagggcttcggcgccgtgatcatccagtacaccctgcacgccgccgtgctgcagatcaccaagatcatctacagcaccctgctgcagaacaacatctag

SEQ ID NO: 99739 - DNA, 618 bp, Artificial Sequence
  Description of Artificial Sequence: Synthetic coding sequence
atgcccttctacagcgccagcctgatcgagaccgtgcagagcgagatcatcagagacaacaccggcatcctggagtgcgtgaaggagggcatcggcagagtgatcggcatgggcgtgccccacagcaagagactgctgcccctgctgagcctgatcttccccaccgtgctgcacggcgtgctgcactacatcatcagcagcgtgatccagaagttcgtgctgctgatcctgaagagaaagacctacaacagccacctggccgagagcaccagccccgtgcagagcatgctggacgcctacttccccgagctgatcgccaacttcgccgccagcctgtgcagcgacgtgatcctgtaccccctggagaccgtgctgcacagactgcacatccagggcaccagaaccatcatcgacaacaccgacctgggctacgaggtgctgcccatcaacacccagtacgagggcatgagagactgcatcaacaccatcagacaggaggagggcgtgttcggcttctacaagggcttcggcgccgtgatcatccagtacaccctgcacgccgccgtgctgcagatcaccaagatcatctacagcaccctgctgcagaacaacatctag

SEQ ID NO: 99740 - DNA, 984 bp, Artificial Sequence
  Description of Artificial Sequence: Synthetic coding sequence
atgaagaccgagcagctgaacagattcgccggcttcggcatcggcctggccagcctgttcaccgagaacgtgctggcccacccctgcatcgtgctgagaagacagtgccaggtgaactaccacgcccagcactaccacctgacccccttcaccgtgatcaacatcatgtacagcttcaacaagacccagggccccagagccctgtggaagggcatgggcagcaccttcatcgtgcagggcgtgaccctgggcgccgagggcatcatcagcgagttcacccccctgcccagagaggtgctgcacaagtggagccccaagcagatcggcgagcacctgctgctgaagagcctgacctacgtggtggccatgcccttctacagcgccagcctgatcgagaccgtgcagagcgagatcatcagagacaacaccggcatcctggagtgcgtgaaggagggcatcggcagagtgatcggcatgggcgtgccccacagcaagagactgctgcccctgctgagcctgatcttccccaccgtgctgcacggcgtgctgcactacatcatcagcagcgtgatccagaagttcgtgctgctgatcctgaagagaaagacctacaacagccacctggccgagagcaccagccccgtgcagagcatgctggacgcctacttccccgagctgatcgccaacttcgccgccagcctgtgcagcgacgtgatcctgtaccccctggagaccgtgctgcacagactgcacatccagggcaccagaaccatcatcgacaacaccgacctgggctacgaggtgctgcccatcaacacccagtacgagggcatgagagactgcatcaacaccatcagacaggaggagggcgtgttcggcttctacaagggcttcggcgccgtgatcatccagtacaccctgcacgccgccgtgctgcagatcaccaagatcatctacagcaccctgctgcagaacaacatctag

SEQ ID NO: 99741 - DNA, 771 bp, Artificial Sequence
  Description of Artificial Sequence: Synthetic coding sequence
atgggcagcaccttcatcgtgcagggcgtgaccctgggcgccgagggcatcatcagcgagttcacccccctgcccagagaggtgctgcacaagtggagccccaagcagatcggcgagcacctgctgctgaagagcctgacctacgtggtggccatgcccttctacagcgccagcctgatcgagaccgtgcagagcgagatcatcagagacaacaccggcatcctggagtgcgtgaaggagggcatcggcagagtgatcggcatgggcgtgccccacagcaagagactgctgcccctgctgagcctgatcttccccaccgtgctgcacggcgtgctgcactacatcatcagcagcgtgatccagaagttcgtgctgctgatcctgaagagaaagacctacaacagccacctggccgagagcaccagccccgtgcagagcatgctggacgcctacttccccgagctgatcgccaacttcgccgccagcctgtgcagcgacgtgatcctgtaccccctggagaccgtgctgcacagactgcacatccagggcaccagaaccatcatcgacaacaccgacctgggctacgaggtgctgcccatcaacacccagtacgagggcatgagagactgcatcaacaccatcagacaggaggagggcgtgttcggcttctacaagggcttcggcgccgtgatcatccagtacaccctgcacgccgccgtgctgcagatcaccaagatcatctacagcaccctgctgcagaacaacatctag

SEQ ID NO: 99742 - DNA, 819 bp, Artificial Sequence; identical to SEQ ID NO: 99738
  Description of Artificial Sequence: Synthetic coding sequence

SEQ ID NO: 99743 - DNA, 2220 bp, Artificial Sequence
  Description of Artificial Sequence: Synthetic coding sequence
atgagcagcgagagcaaggagcagcacaacgtgagccccagagacagcgccgagggcaacgacagctaccccagcggcatccacctggagctgcagagagagagcagcaccgacttcaagcagttcgagaccaacgaccagtgcagaccctaccacagaatcctgatcgagagacaggagaagagcgacaccaacttcaaggagttcgtgatcaagaagctgcagaagaactgccagtgcagccccgccaaggccaagaacatgatcctgggcttcctgcccgtgctgcagtggctgcccaagtacgacctgaagaagaacatcctgggcgacgtgatgagcggcctgatcgtgggcatcctgctggtgccccagagcatcgcctacagcctgctggccggccaggagcccgtgtacggcctgtacaccagcttcttcgccagcatcatctacttcctgctgggcaccagcagacacatcagcgtgggcatcttcggcgtgctgtgcctgatgatcggcgagaccgtggacagagagctgcagaaggccggctacgacaacgcccacagcgcccccagcctgggcatggtgagcaacggcagcaccctgctgaaccacaccagcgacagaatctgcgacaagagctgctacgccatcatggtgggcagcaccgtgaccttcatcgccggcgtgtaccaggtggccatgggcttcttccaggtgggcttcgtgagcgtgtacctgagcgacgccctgctgagcggcttcgtgaccggcgccagcttcaccatcctgaccagccaggccaagtacctgctgggcctgaacctgcccagaaccaacggcgtgggcagcctgatcaccacctggatccacgtgttcagaaacatccacaagaccaacctgtgcgacctgatcaccagcctgctgtgcctgctggtgctgctgcccaccaaggagctgaacgagcacttcaagagcaagctgaaggcccccatccccatcgagctggtggtggtggtggccgccaccctggccagccacttcggcaagctgcacgagaactacaacagcagcatcgccggccacatccccaccggcttcatgccccccaaggtgcccgagtggaacctgatccccagcgtggccgtggacgccatcgccatcagcatcatcggcttcgccatcaccgtgagcctgagcgagatgttcgccaagaagcacggctacaccgtgaaggccaaccaggagatgtacgccatcggcttctgcaacatcatccccagcttcttccactgcttcaccaccagcgccgccctggccaagaccctggtgaaggagagcaccggctgccacacccagctgagcggcgtggtgaccgccctggtgctgctgctggtgctgctggtgatcgcccccctgttctacagcctgcagaagagcgtgctgggcgtgatcaccatcgtgaacctgagaggcgccctgagaaagttcagagacctgcccaagatgtggagcatcagcagaatggacaccgtgatctggttcgtgaccatgctgagcagcgccctgctgagcaccgagatcggcctgctggtgggcgtgtgcttcagcatcttctgcgtgatcctgagaacccagaagcccaagagcagcctgctgggcctggtggaggagagcgaggtgttcgagagcgtgagcgcctacaagaacctgcagatcaagcccggcatcaagatcttcagattcgtggcccccctgtactacatcaacaaggagtgcttcaagagcgccctgtacaagcagaccgtgaaccccatcctgatcaaggtggcctggaagaaggccgccaagagaaagatcaaggagaaggtggtgaccctgggcggcatccaggacgagatgagcgtgcagctgagccacgaccccctggagctgcacaccatcgtgatcgactgcagcgccatccagttcctggacaccgccggcatccacaccctgaaggaggtgagaagagactacgaggccatcggcatccaggtgctgctggcccagtgcaaccccaccgtgagagacagcctgaccaacggcgagtactgcaagaaggaggaggagaacctgctgttctacagcgtgtacgaggccatggccttcgccgaggtgagcaagaaccagaagggcgtgtgcgtgcccaacggcctgagcctgagcagcgactag

SEQ ID NO: 99744 - DNA, 72 bp, Artificial Sequence
  Description of Artificial Sequence: Synthetic coding sequence
atgagcagcgagagcaaggagcagcacaacgtgagccccagagacagcgccgagggcaacgacagctactag

SEQ ID NO: 99745 - DNA, 2295 bp, Artificial Sequence
  Description of Artificial Sequence: Synthetic coding sequence
atgatcgagcccttcggcaaccagtacatcgtggccagacccgtgtacagcaccaacgccttcgaggagaaccacaagaagaccggcagacaccacaagaccttcctggaccacctgaaggtgtgctgcagctgcagcccccagaaggccaagagaatcgtgctgagcctgttccccatcgccagctggctgcccgcctacagactgaaggagtggctgctgagcgacatcgtgagcggcatcagcaccggcatcgtggccgtgctgcagggcctggccttcgccctgctggtggacatcccccccgtgtacggcctgtacgccagcttcttccccgccatcatctacctgttcttcggcaccagcagacacatcagcgtgggccccttccccatcctgagcatgatggtgggcctggccgtgagcggcgccgtgagcaaggccgtgcccgacagaaacgccaccaccctgggcctgcccaacaacagcaacaacagcagcctgctggacgacgagagagtgagagtggccgccgccgccagcgtgaccgtgctgagcggcatcatccagctggccttcggcatcctgagaatcggcttcgtggtgatctacctgagcgagagcctgatcagcggcttcaccaccgccgccgccgtgcacgtgctggtgagccagctgaagttcatcttccagctgaccgtgcccagccacaccgaccccgtgagcatcttcaaggtgctgtacagcgtgttcagccagatcgagaagaccaacatcgccgacctggtgaccgccctgatcgtgctgctggtggtgagcatcgtgaaggagatcaaccagagattcaaggacaagctgcccgtgcccatccccatcgagttcatcatgaccgtgatcgccgccggcgtgagctacggctgcgacttcaagaacagattcaaggtggccgtggtgggcgacatgaaccccggcttccagccccccatcacccccgacgtggagaccttccagaacaccgtgggcgactgcttcggcatcgccatggtggccttcgccgtggccttcagcgtggccagcgtgtacagcctgaagtacgactaccccctggacggcaaccaggagctgatcgccctgggcctgggcaacatcgtgtgcggcgtgttcagaggcttcgccggcagcaccgccctgagcagaagcgccgtgcaggagagcaccggcggcaagacccagatcgccggcctgatcggcgccatcatcgtgctgatcgtggtgctggccatcggcttcctgctggcccccctgcagaagagcgtgctggccgccctggccctgggcaacctgaagggcatgctgatgcagttcgccgagatcggcagactgtggagaaaggacaagtacgactgcctgatctggatcatgaccttcatcttcaccatcgtgctgggcctgggcctgggcctggccgccagcgtggccttccagctgctgaccatcgtgttcagaacccagttccccaagtgcagcaccctggccaacatcggcagaaccaacatctacaagaacaagaaggactactacgacatgtacgagcccgagggcgtgaagatcttcagatgccccagccccatctacttcgccaacatcggcttcttcagaagaaagctgatcgacgccgtgggcttcagccccctgagaatcctgagaaagagaaacaaggccctgagaaagatcagaaagctgcagaagcagggcctgctgcaggtgacccccaagggcttcatctgcaccgtggacaccatcaaggacagcgacgaggagctggacaacaaccagatcgaggtgctggaccagcccatcaacaccaccgacctgcccttccacatcgactggaacgacgacctgcccctgaacatcgaggtgcccaagatcagcctgcacagcctgatcctggacttcagcgccgtgagcttcctggacgtgagcagcgtgagaggcctgaagagcatcctgcaggagttcatcagaatcaaggtggacgtgtacatcgtgggcaccgacgacgacttcatcgagaagctgaacagatacgagttcttcgacggcgaggtgaagagcagcatcttcttcctgaccatccacgacgccgtgctgcacatcctgatgaagaaggactacagcaccagcaagttcaaccccagccaggagaaggacggcaagatcgacttcaccatcaacaccaacggcggcctgagaaacagagtgtacgaggtgcccgtggagaccaagttctag

SEQ ID NO: 99746 - DNA, 1956 bp, Artificial Sequence
  Description of Artificial Sequence: Synthetic coding sequence
atgctgctgagaaagatcatcaagagacaggaggacatcatcagacacttctggatcatcagcaagtgcgtggtggccagctggctgcccgcctacagactgaaggagtggctgctgagcgacatcgtgagcggcatcagcaccggcatcgtggccgtgctgcagggcctggccttcgccctgctggtggacatcccccccgtgtacggcctgtacgccagcttcttccccgccatcatctacctgttcttcggcaccagcagacacatcagcgtgggccccttccccatcctgagcatgatggtgggcctggccgtgagcggcgccgtgagcaaggccgtgcccgacagaaacgccaccaccctgggcctgcccaacaacagcaacaacagcagcctgctggacgacgagagagtgagagtggccgccgccgccagcgtgaccgtgctgagcggcatcatccagctggccttcggcatcctgagaatcggcttcgtggtgatctacctgagcgagagcctgatcagcggcttcaccaccgccgccgccgtgcacgtgctggtgagccagctgaagttcatcttccagctgaccgtgcccagccacaccgaccccgtgagcatcttcaaggtgctgtacagcgtgttcagccagatcgagaagaccaacatcgccgacctggtgaccgccctgatcgtgctgctggtggtgagcatcgtgaaggagatcaaccagagattcaaggacaagctgcccgtgcccatccccatcgagttcatcatgaccgtgatcgccgccggcgtgagctacggctgcgacttcaagaacagattcaaggtggccgtggtgggcgacatgaaccccggcttccagccccccatcacccccgacgtggagaccttccagaacaccgtgggcgactgcttcggcatcgccatggtggccttcgccgtggccttcagcgtggccagcgtgtacagcctgaagtacgactaccccctggacggcaaccaggagctgatcgccctgggcctgggcaacatcgtgtgcggcgtgttcagaggcttcgccggcagcaccgccctgagcagaagcgccgtgcaggagagcaccggcggcaagacccagatcgccggcctgatcggcgccatcatcgtgctgatcgtggtgctggccatcggcttcctgctggcccccctgcagaagagcgtgctggccgccctggccctgggcaacctgaagggcatgctgatgcagttcgccgagatcggcagactgtggagaaaggacaagtacgactgcctgatctggatcatgaccttcatcttcaccatcgtgctgggcctgggcctgggcctggccgccagcgtggccttccagctgctgaccatcgtgttcagaacccagttccccaagtgcagcaccctggccaacatcggcagaaccaacatctacaagaacaagaaggactactacgacatgtacgagcccgagggcgtgaagatcttcagatgccccagccccatctacttcgccaacatcggcttcttcagaagaaagctgatcgacgccgtgggcttcagccccctgagaatcctgagaaagagaaacaaggccctgagaaagatcagaaagctgcagaagcagggcctgctgcaggtgacccccatcctgcaggagttcatcagaatcaaggtggacgtgtacatcgtgggcaccgacgacgacttcatcgagaagctgaacagatacgagttcttcgacggcgaggtgaagagcagcatcttcttcctgaccatccacgacgccgtgctgcacatcctgatgaagaaggactacagcaccagcaagttcaaccccagccaggagaaggacggcaagatcgacttcaccatcaacaccaacggcggcctgagaaacagagtgtacgaggtgcccgtggagaccaagttctag

SEQ ID NO: 99747 - DNA, 363 bp, Artificial Sequence
  Description of Artificial Sequence: Synthetic coding sequence
atgatcgagcccttcggcaaccagtacatcgtggccagacccgtgtacagcaccaacgccttcgaggagaaccacaagaagaccggcagacaccacaagaccttcctggaccacctgaaggtgtgctgcagctgcagcccccagaaggccaagagaatcgtgctgagcctgttccccatcgccagctggctgcccgcctacagactgaaggagtggctgctgagcgacatcgtgagcggcatcagcaccggcatcgtggccgtgctgcagggcctggccttcgccctgctggtggacatcccccccgtgtacggcctgtacgccagcttcttccccgccatcatctacctgttcttcggctag

SEQ ID NO: 99748 - DNA, 2343 bp, Artificial Sequence
  Description of Artificial Sequence: Synthetic coding sequence
atggccgcccccggcggcagaagcgagcccccccagctgcccgagtacagctgcagctacatggtgagcagacccgtgtacagcgagctggccttccagcagcagcacgagagaagactgcaggagagaaagaccctgagagagagcctggccaagtgctgcagctgcagcagaaagagagccttcggcgtgctgaagaccctggtgcccatcctggagtggctgcccaagtacagagtgaaggagtggctgctgagcgacgtgatcagcggcgtgagcaccggcctggtggccaccctgcagggcatggcctacgccctgctggccgccgtgcccgtgggctacggcctgtacagcgccttcttccccatcctgacctacttcatcttcggcaccagcagacacatcagcgtgggccccttccccgtggtgagcctgatggtgggcagcgtggtgctgagcatggcccccgacgagcacttcctggtgagcagcagcaacggcaccgtgctgaacaccaccatgatcgacaccgccgccagagacaccgccagagtgctgatcgccagcgccctgaccctgctggtgggcatcatccagctgatcttcggcggcctgcagatcggcttcatcgtgagatacctggccgaccccctggtgggcggcttcaccaccgccgccgccttccaggtgctggtgagccagctgaagatcgtgctgaacgtgagcaccaagaactacaacggcgtgctgagcatcatctacaccctggtggagatcttccagaacatcggcgacaccaacctggccgacttcaccgccggcctgctgaccatcgtggtgtgcatggccgtgaaggagctgaacgacagattcagacacaagatccccgtgcccatccccatcgaggtgatcgtgaccatcatcgccaccgccatcagctacggcgccaacctggagaagaactacaacgccggcatcgtgaagagcatccccagaggcttcctgccccccgagctgccccccgtgagcctgttcagcgagatgctggccgccagcttcagcatcgccgtggtggcctacgccatcgccgtgagcgtgggcaaggtgtacgccaccaagtacgactacaccatcgacggcaaccaggagttcatcgccttcggcatcagcaacatcttcagcggcttcttcagctgcttcgtggccaccaccgccctgagcagaaccgccgtgcaggagagcaccggcggcaagacccaggtggccggcatcatcagcgccgccatcgtgatgatcgccatcctggccctgggcaagctgctggagcccctgcagaagagcgtgctggccgccgtggtgatcgccaacctgaagggcatgttcatgcagctgtgcgacatccccagactgtggagacagaacaagatcgacgccgtgatctgggtgttcacctgcatcgtgagcatcatcctgggcctggacctgggcctgctggccggcctgatcttcggcctgctgaccgtggtgctgagagtgcagttccccagctggaacggcctgggcagcatccccagcaccgacatctacaagagcaccaagaactacaagaacatcgaggagccccagggcgtgaagatcctgagattcagcagccccatcttctacggcaacgtggacggcttcaagaagtgcatcaagagcaccgtgggcttcgacgccatcagagtgtacaacaagagactgaaggccctgagaaagatccagaagctgatcaagagcggccagctgagagccaccaagaacggcatcatcagcgacgccgtgagcaccaacaacgccttcgagcccgacgaggacatcgaggacctggaggagctggacatccccaccaaggagatcgagatccaggtggactggaacagcgagctgcccgtgaaggtgaacgtgcccaaggtgcccatccacagcctggtgctggactgcggcgccatcagcttcctggacgtggtgggcgtgagaagcctgagagtgatcgtgaaggagttccagagaatcgacgtgaacgtgtacttcgccagcctgcaggactacgtgatcgagaagctggagcagtgcggcttcttcgacgacaacatcagaaaggacaccttcttcctgaccgtgcacgacgccatcctgtacctgcagaaccaggtgaagagccaggagggccagggcagcatcctggagaccatcaccctgatccaggactgcaaggacaccctggagctgatcgagaccgagctgaccgaggaggagctggacgtgcaggacgaggccatgagaaccctggccagctag

SEQ ID NO: 99749 - DNA, 396 bp, Artificial Sequence
  Description of Artificial Sequence: Synthetic coding sequence
atggccgcccccggcggcagaagcgagcccccccagctgcccgagtacagctgcagctacatggtgagcagacccgtgtacagcgagctggccttccagcagcagcacgagagaagactgcaggagagaaagaccctgagagagagcctggccaagtgctgcagctgcagcagaaagagagccttcggcgtgctgaagaccctggtgcccatcctggagtggctgcccaagtacagagtgaaggagtggctgctgagcgacgtgatcagcggcgtgagcaccggcctggtggccaccctgcagggcatggcctacgccctgctggccgccgtgcccgtgggctacggcctgtacagcgccttcttccccatcctgacctacttcatcttcggctag

SEQ ID NO: 99750 - DNA, 1026 bp, Artificial Sequence
  Description of Artificial Sequence: Synthetic coding sequence
atgagacacggcctggccgtgcccagcgtgctggccgccgtggtgatcgccaacctgaagggcatgttcatgcagctgtgcgacatccccagactgtggagacagaacaagatcgacgccgtgatctgggtgttcacctgcatcgtgagcatcatcctgggcctggacctgggcctgctggccggcctgatcttcggcctgctgaccgtggtgctgagagtgcagttccccagctggaacggcctgggcagcatccccagcaccgacatctacaagagcaccaagaactacaagaacatcgaggagccccagggcgtgaagatcctgagattcagcagccccatcttctacggcaacgtggacggcttcaagaagtgcatcaagagcaccgtgggcttcgacgccatcagagtgtacaacaagagactgaaggccctgagaaagatccagaagctgatcaagagcggccagctgagagccaccaagaacggcatcatcagcgacgccgtgagcaccaacaacgccttcgagcccgacgaggacatcgaggacctggaggagctggacatccccaccaaggagatcgagatccaggtggactggaacagcgagctgcccgtgaaggtgaacgtgcccaaggtgcccatccacagcctggtgctggactgcggcgccatcagcttcctggacgtggtgggcgtgagaagcctgagagtgatcgtgaaggagttccagagaatcgacgtgaacgtgtacttcgccagcctgcaggactacgtgatcgagaagctggagcagtgcggcttcttcgacgacaacatcagaaaggacaccttcttcctgaccgtgcacgacgccatcctgtacctgcagaaccaggtgaagagccaggagggccagggcagcatcctggagaccatcaccctgatccaggactgcaaggacaccctggagctgatcgagaccgagctgaccgaggaggagctggacgtgcaggacgaggccatgagaaccctggccagctag

SEQ ID NO: 99751 - DNA, 1050 bp, Artificial Sequence
  Description of Artificial Sequence: Synthetic coding sequence
atgatcgccatcctggccctgggcaagctgctggagcccctgcagaagagcgtgctggccgccgtggtgatcgccaacctgaagggcatgttcatgcagctgtgcgacatccccagactgtggagacagaacaagatcgacgccgtgatctgggtgttcacctgcatcgtgagcatcatcctgggcctggacctgggcctgctggccggcctgatcttcggcctgctgaccgtggtgctgagagtgcagttccccagctggaacggcctgggcagcatccccagcaccgacatctacaagagcaccaagaactacaagaacatcgaggagccccagggcgtgaagatcctgagattcagcagccccatcttctacggcaacgtggacggcttcaagaagtgcatcaagagcaccgtgggcttcgacgccatcagagtgtacaacaagagactgaaggccctgagaaagatccagaagctgatcaagagcggccagctgagagccaccaagaacggcatcatcagcgacgccgtgagcaccaacaacgccttcgagcccgacgaggacatcgaggacctggaggagctggacatccccaccaaggagatcgagatccaggtggactggaacagcgagctgcccgtgaaggtgaacgtgcccaaggtgcccatccacagcctggtgctggactgcggcgccatcagcttcctggacgtggtgggcgtgagaagcctgagagtgatcgtgaaggagttccagagaatcgacgtgaacgtgtacttcgccagcctgcaggactacgtgatcgagaagctggagcagtgcggcttcttcgacgacaacatcagaaaggacaccttcttcctgaccgtgcacgacgccatcctgtacctgcagaaccaggtgaagagccaggagggccagggcagcatcctggagaccatcaccctgatccaggactgcaaggacaccctggagctgatcgagaccgagctgaccgaggaggagctggacgtgcaggacgaggccatgagaaccctggccagctag

SEQ ID NO: 99752 - DNA, 1104 bp, Artificial Sequence
  Description of Artificial Sequence: Synthetic coding sequence
atgagacacggcctggccgtgcccgtggccggcatcatcagcgccgccatcgtgatgatcgccatcctggccctgggcaagctgctggagcccctgcagaagagcgtgctggccgccgtggtgatcgccaacctgaagggcatgttcatgcagctgtgcgacatccccagactgtggagacagaacaagatcgacgccgtgatctgggtgttcacctgcatcgtgagcatcatcctgggcctggacctgggcctgctggccggcctgatcttcggcctgctgaccgtggtgctgagagtgcagttccccagctggaacggcctgggcagcatccccagcaccgacatctacaagagcaccaagaactacaagaacatcgaggagccccagggcgtgaagatcctgagattcagcagccccatcttctacggcaacgtggacggcttcaagaagtgcatcaagagcaccgtgggcttcgacgccatcagagtgtacaacaagagactgaaggccctgagaaagatccagaagctgatcaagagcggccagctgagagccaccaagaacggcatcatcagcgacgccgtgagcaccaacaacgccttcgagcccgacgaggacatcgaggacctggaggagctggacatccccaccaaggagatcgagatccaggtggactggaacagcgagctgcccgtgaaggtgaacgtgcccaaggtgcccatccacagcctggtgctggactgcggcgccatcagcttcctggacgtggtgggcgtgagaagcctgagagtgatcgtgaaggagttccagagaatcgacgtgaacgtgtacttcgccagcctgcaggactacgtgatcgagaagctggagcagtgcggcttcttcgacgacaacatcagaaaggacaccttcttcctgaccgtgcacgacgccatcctgtacctgcagaaccaggtgaagagccaggagggccagggcagcatcctggagaccatcaccctgatccaggactgcaaggacaccctggagctgatcgagaccgagctgaccgaggaggagctggacgtgcaggacgaggccatgagaaccctggccagctag

SEQ ID NO: 99753 - DNA, 2235 bp, Artificial Sequence
  Description of Artificial Sequence: Synthetic coding sequence
atggaccacgccgaggagaacgagatcctggccgccacccagagatactacgtggagagacccatcttcagccaccccgtgctgcaggagagactgcacaccaaggacaaggtgcccgacagcatcgccgacaagctgaagcaggccttcacctgcacccccaagaagatcagaaacatcatctacatgttcctgcccatcaccaagtggctgcccgcctacaagttcaaggagtacgtgctgggcgacctggtgagcggcatcagcaccggcgtgctgcagctgccccagggcctggccttcgccatgctggccgccgtgccccccatcttcggcctgtacagcagcttctaccccgtgatcatgtactgcttcctgggcaccagcagacacatcagcatcggccccttcgccgtgatcagcctgatgatcggcggcgtggccgtgagactggtgcccgacgacatcgtgatccccggcggcgtgaacgccaccaacggcaccgaggccagagacgccctgagagtgaaggtggccatgagcgtgaccctgctgagcggcatcatccagttctgcctgggcgtgtgcagattcggcttcgtggccatctacctgaccgagcccctggtgagaggcttcaccaccgccgccgccgtgcacgtgttcaccagcatgctgaagtacctgttcggcgtgaagaccaagagatacagcggcatcttcagcgtggtgtacagcaccgtggccgtgctgcagaacgtgaagaacctgaacgtgtgcagcctgggcgtgggcctgatggtgttcggcctgctgctgggcggcaaggagttcaacgagagattcaaggagaagctgcccgcccccatccccctggagttcttcgccgtggtgatgggcaccggcatcagcgccggcttcaacctgaaggagagctacaacgtggacgtggtgggcaccctgcccctgggcctgctgccccccgccaaccccgacaccagcctgttccacctggtgtacgtggacgccatcgccatcgccatcgtgggcttcagcgtgaccatcagcatggccaagaccctggccaacaagcacggctaccaggtggacggcaaccaggagctgatcgccctgggcctgtgcaacagcatcggcagcctgttccagaccttcagcatcagctgcagcctgagcagaagcctggtgcaggagggcaccggcggcaagacccagctggccggctgcctggccagcctgatgatcctgctggtgatcctggccaccggcttcctgttcgagagcctgccccaggccgtgctgagcgccatcgtgatcgtgaacctgaagggcatgttcatgcagttcagcgacctgcccttcttctggagaaccagcaagatcgagctgaccatctggctgaccaccttcgtgagcagcctgttcctgggcctggactacggcctgatcaccgccgtgatcatcgccctgctgaccgtgatctacagaacccagagccccagctacaaggtgctgggcaagctgcccgagaccgacgtgtacatcgacatcgacgcctacgaggaggtgaaggagatccccggcatcaagatcttccagatcaacgcccccatctactacgccaacagcgacctgtacagcaacgccctgaagagaaagaccggcgtgaaccccgccgtgatcatgggcgccagaagaaaggccatgagaaagtacgccaaggaggtgggcaacgccaacatggccaacgccaccgtggtgaaggccgacgccgaggtggacggcgaggacgccaccaagcccgaggaggaggacggcgaggtgaagtacccccccatcgtgatcaagagcaccttccccgaggagatgcagagattcatgccccccggcgacaacgtgcacaccgtgatcctggacttcacccaggtgaacttcatcgacagcgtgggcgtgaagaccctggccggcatcgtgaaggagtacggcgacgtgggcatctacgtgtacctggccggctgcagcgcccaggtggtgaacgacctgaccagaaacagattcttcgagaaccccgccctgtgggagctgctgttccacagcatccacgacgccgtgctgggcagccagctgagagaggccctggccgagcaggaggccagcgccccccccagccaggaggacctggagcccaacgccacccccgccacccccgaggcctag

SEQ ID NO: 99754 - DNA, 2058 bp, Artificial Sequence
  Description of Artificial Sequence: Synthetic coding sequence
atggaccacgccgaggagaacgagatcctggccgccacccagagatactacgtggagagacccatcttcagccaccccgtgctgcaggagagactgcacaccaaggacaaggtgcccgacagcatcgccgacaagctgaagcaggccttcacctgcacccccaagaagatcagaaacatcatctacatgttcctgcccatcaccaagtggctgcccgcctacaagttcaaggagtacgtgctgggcgacctggtgagcggcatcagcaccggcgtgctgcagctgccccagggcctggccttcgccatgctggccgccgtgccccccatcttcggcctgtacagcagcttctaccccgtgatcatgtactgcttcctgggcaccagcagacacatcagcatcggccccttcgccgtgatcagcctgatgatcggcggcgtggccgtgagactggtgcccgacgacatcgtgatccccggcggcgtgaacgccaccaacggcaccgaggccagagacgccctgagagtgaaggtggccatgagcgtgaccctgctgagcggcatcatccagttctgcctgggcgtgtgcagattcggcttcgtggccatctacctgaccgagcccctggtgagaggcttcaccaccgccgccgccgtgcacgtgttcaccagcatgctgaagtacctgttcggcgtgaagaccaagagatacagcggcatcttcagcgtggtgtacagcaccgtggccgtgctgcagaacgtgaagaacctgaacgtgtgcagcctgggcgtgggcctgatggtgttcggcctgctgctgggcggcaaggagttcaacgagagattcaaggagaagctgcccgcccccatccccctggagttcttcgccgtggtgatgggcaccggcatcagcgccggcttcaacctgaaggagagctacaacgtggacgtggtgggcaccctgcccctgggcctgctgccccccgccaaccccgacaccagcctgttccacctggtgtacgtggacgccatcgccatcgccatcgtgggcttcagcgtgaccatcagcatggccaagaccctggccaacaagcacggctaccaggtggacggcaaccaggagctgatcgccctgggcctgtgcaacagcatcggcagcctgttccagaccttcagcatcagctgcagcctgagcagaagcctggtgcaggagggcaccggcggcaagacccagctggccggctgcctggccagcctgatgatcctgctggtgatcctggccaccggcttcctgttcgagagcctgccccaggccgtgctgagcgccatcgtgatcgtgaacctgaagggcatgttcatgcagttcagcgacctgcccttcttctggagaaccagcaagatcgagctgaccatctggctgaccaccttcgtgagcagcctgttcctgggcctggactacggcctgatcaccgccgtgatcatcgccctgctgaccgtgatctacagaacccagagccccagctacaaggtgctgggcaagctgcccgagaccgacgtgtacatcgacatcgacgcctacgaggaggtgaaggagatccccggcatcaagatcttccagatcaacgcccccatctactacgccaacagcgacctgtacagcaacgccctgaagagaaagaccggcgtgaaccccgccgtgatcatgggcgccagaagaaaggccatgagaaagtacgccaaggaggtgggcaacgccaacatggccaacgccaccgtggtgaaggccgacgccgaggtggacggcgaggacgccaccaagcccgaggaggaggacggcgaggtgaagtacccccccatcgtgatcaagagcaccttccccgaggagatgcagagattcatgccccccggcgacaacgtgcacaccgtgatcctggacttcacccaggtgaacttcatcgacagcgtgggcgtgaagaccctggccggcatcgtgaaggagtacggcgacgtgggcatctacgtgtacctggccggctgcagcgccttcatccagagatag

SEQ ID NO: 99755 - DNA, 534 bp, Artificial Sequence
  Description of Artificial Sequence: Synthetic coding sequence
atgggcgccagaagaaaggccatgagaaagtacgccaaggaggtgggcaacgccaacatggccaacgccaccgtggtgaaggccgacgccgaggtggacggcgaggacgccaccaagcccgaggaggaggacggcgaggtgaagtacccccccatcgtgatcaagagcaccttccccgaggagatgcagagattcatgccccccggcgacaacgtgcacaccgtgatcctggacttcacccaggtgaacttcatcgacagcgtgggcgtgaagaccctggccggcatcgtgaaggagtacggcgacgtgggcatctacgtgtacctggccggctgcagcgcccaggtggtgaacgacctgaccagaaacagattcttcgagaaccccgccctgtgggagctgctgttccacagcatccacgacgccgtgctgggcagccagctgagagaggccctggccgagcaggaggccagcgccccccccagccaggaggacctggagcccaacgccacccccgccacccccgaggcctag

SEQ ID NO: 99756 - DNA, 1008 bp, Artificial Sequence
  Description of Artificial Sequence: Synthetic coding sequence
atggaccacgccgaggagaacgagatcctggccgccacccagagatactacgtggagagacccatcttcagccaccccgtgctgcaggagagactgcacaccaaggacaaggtgcccgacagcatcgccgacaagctgaagcaggccttcacctgcacccccaagaagatcagaaacatcatctacatgttcctgcccatcaccaagtggctgcccgcctacaagttcaaggagtacgtgctgggcgacctggtgagcggcatcagcaccggcgtgctgcagctgccccagggcctggccttcgccatgctggccgccgtgccccccatcttcggcctgtacagcagcttctaccccgtgatcatgtactgcttcctgggcaccagcagacacatcagcatcggccccttcgccgtgatcagcctgatgatcggcggcgtggccgtgagactggtgcccgacgacatcgtgatccccggcggcgtgaacgccaccaacggcaccgaggccagagacgccctgagagtgaaggtggccatgagcgtgaccctgctgagcggcatcatccagttctgcctgggcgtgtgcagattcggcttcgtggccatctacctgaccgagcccctggtgagaggcttcaccaccgccgccgccgtgcacgtgttcaccagcatgctgaagtacctgttcggcgtgaagaccaagagatacagcggcatcttcagcgtggtgtacagcaccgtggccgtgctgcagaacgtgaagaacctgaacgtgtgcagcctgggcgtgggcctgatggtgttcggcctgctgctgggcggcaaggagttcaacgagagattcaaggagaagctgcccgcccccatccccctggagttcttcgccgtggtgatgggcaccggcatcagcgccggcttcaacctgaaggagagctacaacgtggacgtggtgggcaccctgcccctgggcttccacaccgagatgaccagaagatggagaccctag

SEQ ID NO: 99757 - DNA, 2145 bp, Artificial Sequence
  Description of Artificial Sequence: Synthetic coding sequence
atggaccacgccgaggagaacgagatcctggccgccacccagagatactacgtggagagacccatcttcagccaccccgtgctgcaggagagactgcacaccaaggacaaggtgcccgacagcatcgccgacaagctgaagcaggccttcacctgcacccccaagaagatcagaaacatcatctacatgttcctgcccatcaccaagtggctgcccgcctacaagttcaaggagtacgtgctgggcgacctggtgagcggcatcagcaccggcgtgctgcagctgccccagggcctggccttcgccatgctggccgccgtgccccccatcttcggcctgtacagcagcttctaccccgtgatcatgtactgcttcctgggcaccagcagacacatcagcatcggccccttcgccgtgatcagcctgatgatcggcggcgtggccgtgagactggtgcccgacgacatcgtgatccccggcggcgtgaacgccaccaacggcaccgaggccagagacgccctgagagtgaaggtggccatgagcgtgaccctgctgagcggcatcatccagttctgcctgggcgtgtgcagattcggcttcgtggccatctacctgaccgagcccctggtgagaggcttcaccaccgccgccgccgtgcacgtgttcaccagcatgctgaagtacctgttcggcgtgaagaccaagagatacagcggcatcttcagcgtggtgtacagcaccgtggccgtgctgcagaacgtgaagaacctgaacgtgtgcagcctgggcgtgggcctgatggtgttcggcctgctgctgggcggcaaggagttcaacgagagattcaaggagaagctgcccgcccccatccccctggagttcttcgccgtggtgatgggcaccggcatcagcgccggcttcaacctgaaggagagctacaacgtggacgtggtgggcaccctgcccctgggcctgctgccccccgccaaccccgacaccagcctgttccacctggtgtacgtggacgccatcgccatcgccatcgtgggcttcagcgtgaccatcagcatggccaagaccctggccaacaagcacggctaccaggtggacggcaaccaggagctgatcgccctgggcctgtgcaacagcatcggcagcctgttccagaccttcagcatcagctgcagcctgagcagaagcctggtgcaggagggcaccggcggcaagacccagctggccggctgcctggccagcctgatgatcctgctggtgatcctggccaccggcttcctgttcgagagcctgccccagaccatctggctgaccaccttcgtgagcagcctgttcctgggcctggactacggcctgatcaccgccgtgatcatcgccctgctgaccgtgatctacagaacccagagccccagctacaaggtgctgggcaagctgcccgagaccgacgtgtacatcgacatcgacgcctacgaggaggtgaaggagatccccggcatcaagatcttccagatcaacgcccccatctactacgccaacagcgacctgtacagcaacgccctgaagagaaagaccggcgtgaaccccgccgtgatcatgggcgccagaagaaaggccatgagaaagtacgccaaggaggtgggcaacgccaacatggccaacgccaccgtggtgaaggccacccaggacgccgaggtggacggcgaggacgccaccaagcccgaggaggaggacggcgaggtgaagtacccccccatcgtgatcaagagcaccttccccgaggagatgcagagattcatgccccccggcgacaacgtgcacaccgtgatcctggacttcacccaggtgaacttcatcgacagcgtgggcgtgaagaccctggccggcatcgtgaaggagtacggcgacgtgggcatctacgtgtacctggccggctgcagcgcccaggtggtgaacgacctgaccagaaacagattcttcgagaaccccgccctgtgggagctgctgttccacagcatccacgacgccgtgctgggcagccagctgagagaggccctggccgagcaggaggccagcgccccccccagccaggaggacctggagcccaacgccacccccgccacccccgaggcctag

SEQ ID NO: 99758 - DNA, 2241 bp, Artificial Sequence
  Description of Artificial Sequence: Synthetic coding sequence
atggaccacgccgaggagaacgagatcctggccgccacccagagatactacgtggagagacccatcttcagccaccccgtgctgcaggagagactgcacaccaaggacaaggtgcccgacagcatcgccgacaagctgaagcaggccttcacctgcacccccaagaagatcagaaacatcatctacatgttcctgcccatcaccaagtggctgcccgcctacaagttcaaggagtacgtgctgggcgacctggtgagcggcatcagcaccggcgtgctgcagctgccccagggcctggccttcgccatgctggccgccgtgccccccatcttcggcctgtacagcagcttctaccccgtgatcatgtactgcttcctgggcaccagcagacacatcagcatcggccccttcgccgtgatcagcctgatgatcggcggcgtggccgtgagactggtgcccgacgacatcgtgatccccggcggcgtgaacgccaccaacggcaccgaggccagagacgccctgagagtgaaggtggccatgagcgtgaccctgctgagcggcatcatccagttctgcctgggcgtgtgcagattcggcttcgtggccatctacctgaccgagcccctggtgagaggcttcaccaccgccgccgccgtgcacgtgttcaccagcatgctgaagtacctgttcggcgtgaagaccaagagatacagcggcatcttcagcgtggtgtacagcaccgtggccgtgctgcagaacgtgaagaacctgaacgtgtgcagcctgggcgtgggcctgatggtgttcggcctgctgctgggcggcaaggagttcaacgagagattcaaggagaagctgcccgcccccatccccctggagttcttcgccgtggtgatgggcaccggcatcagcgccggcttcaacctgaaggagagctacaacgtggacgtggtgggcaccctgcccctgggcctgctgccccccgccaaccccgacaccagcctgttccacctggtgtacgtggacgccatcgccatcgccatcgtgggcttcagcgtgaccatcagcatggccaagaccctggccaacaagcacggctaccaggtggacggcaaccaggagctgatcgccctgggcctgtgcaacagcatcggcagcctgttccagaccttcagcatcagctgcagcctgagcagaagcctggtgcaggagggcaccggcggcaagacccagctggccggctgcctggccagcctgatgatcctgctggtgatcctggccaccggcttcctgttcgagagcctgccccaggccgtgctgagcgccatcgtgatcgtgaacctgaagggcatgttcatgcagttcagcgacctgcccttcttctggagaaccagcaagatcgagctgaccatctggctgaccaccttcgtgagcagcctgttcctgggcctggactacggcctgatcaccgccgtgatcatcgccctgctgaccgtgatctacagaacccagagccccagctacaaggtgctgggcaagctgcccgagaccgacgtgtacatcgacatcgacgcctacgaggaggtgaaggagatccccggcatcaagatcttccagatcaacgcccccatctactacgccaacagcgacctgtacagcaacgccctgaagagaaagaccggcgtgaaccccgccgtgatcatgggcgccagaagaaaggccatgagaaagtacgccaaggaggtgggcaacgccaacatggccaacgccaccgtggtgaaggccacccaggacgccgaggtggacggcgaggacgccaccaagcccgaggaggaggacggcgaggtgaagtacccccccatcgtgatcaagagcaccttccccgaggagatgcagagattcatgccccccggcgacaacgtgcacaccgtgatcctggacttcacccaggtgaacttcatcgacagcgtgggcgtgaagaccctggccggcatcgtgaaggagtacggcgacgtgggcatctacgtgtacctggccggctgcagcgcccaggtggtgaacgacctgaccagaaacagattcttcgagaaccccgccctgtgggagctgctgttccacagcatccacgacgccgtgctgggcagccagctgagagaggccctggccgagcaggaggccagcgccccccccagccaggaggacctggagcccaacgccacccccgccacccccgaggcctag

SEQ ID NO: 99759 - DNA, 2124 bp, Artificial Sequence
  Description of Artificial Sequence: Synthetic coding sequence
atggaccacgccgaggagaacgagatcctggccgccacccagagatactacgtggagagacccatcttcagccaccccgtgctgcaggagagactgcacaccaaggacaaggtgcccgacagcatcgccgacaagctgaagcaggccttcacctgcacccccaagaagatcagaaacatcatctacatgttcctgcccatcaccaagtggctgcccgcctacaagttcaaggagtacgtgctgggcgacctggtgagcggcatcagcaccggcgtgctgcagctgccccagggccccttcgccgtgatcagcctgatgatcggcggcgtggccgtgagactggtgcccgacgacatcgtgatccccggcggcgtgaacgccaccaacggcaccgaggccagagacgccctgagagtgaaggtggccatgagcgtgaccctgctgagcggcatcatccagttctgcctgggcgtgtgcagattcggcttcgtggccatctacctgaccgagcccctggtgagaggcttcaccaccgccgccgccgtgcacgtgttcaccagcatgctgaagtacctgttcggcgtgaagaccaagagatacagcggcatcttcagcgtggtgtacagcaccgtggccgtgctgcagaacgtgaagaacctgaacgtgtgcagcctgggcgtgggcctgatggtgttcggcctgctgctgggcggcaaggagttcaacgagagattcaaggagaagctgcccgcccccatccccctggagttcttcgccgtggtgatgggcaccggcatcagcgccggcttcaacctgaaggagagctacaacgtggacgtggtgggcaccctgcccctgggcctgctgccccccgccaaccccgacaccagcctgttccacctggtgtacgtggacgccatcgccatcgccatcgtgggcttcagcgtgaccatcagcatggccaagaccctggccaacaagcacggctaccaggtggacggcaaccaggagctgatcgccctgggcctgtgcaacagcatcggcagcctgttccagaccttcagcatcagctgcagcctgagcagaagcctggtgcaggagggcaccggcggcaagacccagctggccggctgcctggccagcctgatgatcctgctggtgatcctggccaccggcttcctgttcgagagcctgccccaggccgtgctgagcgccatcgtgatcgtgaacctgaagggcatgttcatgcagttcagcgacctgcccttcttctggagaaccagcaagatcgagctgaccatctggctgaccaccttcgtgagcagcctgttcctgggcctggactacggcctgatcaccgccgtgatcatcgccctgctgaccgtgatctacagaacccagagccccagctacaaggtgctgggcaagctgcccgagaccgacgtgtacatcgacatcgacgcctacgaggaggtgaaggagatccccggcatcaagatcttccagatcaacgcccccatctactacgccaacagcgacctgtacagcaacgccctgaagagaaagaccggcgtgaaccccgccgtgatcatgggcgccagaagaaaggccatgagaaagtacgccaaggaggtgggcaacgccaacatggccaacgccaccgtggtgaaggccgacgccgaggtggacggcgaggacgccaccaagcccgaggaggaggacggcgaggtgaagtacccccccatcgtgatcaagagcaccttccccgaggagatgcagagattcatgccccccggcgacaacgtgcacaccgtgatcctggacttcacccaggtgaacttcatcgacagcgtgggcgtgaagaccctggccggcatcgtgaaggagtacggcgacgtgggcatctacgtgtacctggccggctgcagcgcccaggtggtgaacgacctgaccagaaacagattcttcgagaaccccgccctgtgggagctgctgttccacagcatccacgacgccgtgctgggcagccagctgagagaggccctggccgagcaggaggccagcgccccccccagccaggaggacctggagcccaacgccacccccgccacccccgaggcctag

SEQ ID NO: 99760 - DNA, 2139 bp, Artificial Sequence
  Description of Artificial Sequence: Synthetic coding sequence
atggaccacgccgaggagaacgagatcctggccgccacccagagatactacgtggagagacccatcttcagccaccccgtgctgcaggagagactgcacaccaaggacaaggtgcccgacagcatcgccgacaagctgaagcaggccttcacctgcacccccaagaagatcagaaacatcatctacatgttcctgcccatcaccaagtggctgcccgcctacaagttcaaggagtacgtgctgggcgacctggtgagcggcatcagcaccggcgtgctgcagctgccccagggcctggccttcgccatgctggccgccgtgccccccatcttcggcctgtacagcagcttctaccccgtgatcatgtactgcttcctgggcaccagcagacacatcagcatcggccccttcgccgtgatcagcctgatgatcggcggcgtggccgtgagactggtgcccgacgacatcgtgatccccggcggcgtgaacgccaccaacggcaccgaggccagagacgccctgagagtgaaggtggccatgagcgtgaccctgctgagcggcatcatccagttctgcctgggcgtgtgcagattcggcttcgtggccatctacctgaccgagcccctggtgagaggcttcaccaccgccgccgccgtgcacgtgttcaccagcatgctgaagtacctgttcggcgtgaagaccaagagatacagcggcatcttcagcgtggtgtacagcaccgtggccgtgctgcagaacgtgaagaacctgaacgtgtgcagcctgggcgtgggcctgatggtgttcggcctgctgctgggcggcaaggagttcaacgagagattcaaggagaagctgcccgcccccatccccctggagttcttcgccgtggtgatgggcaccggcatcagcgccggcttcaacctgaaggagagctacaacgtggacgtggtgggcaccctgcccctgggcctgctgccccccgccaaccccgacaccagcctgttccacctggtgtacgtggacgccatcgccatcgccatcgtgggcttcagcgtgaccatcagcatggccaagaccctggccaacaagcacggctaccaggtggacggcaaccaggagctgatcgccctgggcctgtgcaacagcatcggcagcctgttccagaccttcagcatcagctgcagcctgagcagaagcctggtgcaggagggcaccggcggcaagacccagctggccggctgcctggccagcctgatgatcctgctggtgatcctggccaccggcttcctgttcgagagcctgccccagaccatctggctgaccaccttcgtgagcagcctgttcctgggcctggactacggcctgatcaccgccgtgatcatcgccctgctgaccgtgatctacagaacccagagccccagctacaaggtgctgggcaagctgcccgagaccgacgtgtacatcgacatcgacgcctacgaggaggtgaaggagatccccggcatcaagatcttccagatcaacgcccccatctactacgccaacagcgacctgtacagcaacgccctgaagagaaagaccggcgtgaaccccgccgtgatcatgggcgccagaagaaaggccatgagaaagtacgccaaggaggtgggcaacgccaacatggccaacgccaccgtggtgaaggccgacgccgaggtggacggcgaggacgccaccaagcccgaggaggaggacggcgaggtgaagtacccccccatcgtgatcaagagcaccttccccgaggagatgcagagattcatgccccccggcgacaacgtgcacaccgtgatcctggacttcacccaggtgaacttcatcgacagcgtgggcgtgaagaccctggccggcatcgtgaaggagtacggcgacgtgggcatctacgtgtacctggccggctgcagcgcccaggtggtgaacgacctgaccagaaacagattcttcgagaaccccgccctgtgggagctgctgttccacagcatccacgacgccgtgctgggcagccagctgagagaggccctggccgagcaggaggccagcgccccccccagccaggaggacctggagcccaacgccacccccgccacccccgaggcctag

SEQ ID NO: 99761 - DNA, 1551 bp, Artificial Sequence
  Description of Artificial Sequence: Synthetic coding sequence
atggaccacgccgaggagaacgagatcctggccgccacccagagatactacgtggagagacccatcttcagccaccccgtgctgcaggagagactgcacaccaaggacaaggtgcccgacagcatcgccgacaagctgaagcaggccttcacctgcacccccaagaagatcagaaacatcatctacatgttcctgcccatcaccaagtggctgcccgcctacaagttcaaggagtacgtgctgggcgacctggtgagcggcatcagcaccggcgtgctgcagctgccccagggcctggccttcgccatgctggccgccgtgccccccatcttcggcctgtacagcagcttctaccccgtgatcatgtactgcttcctgggcaccagcagacacatcagcatcggccccttcgccgtgatcagcctgatgatcggcggcgtggccgtgagactggtgcccgacgacatcgtgatccccggcggcgtgaacgccaccaacggcaccgaggccagagacgccctgagagtgaaggtggccatgagcgtgaccctgctgagcggcatcatccagttctgcctgggcgtgtgcagattcggcttcgtggccatctacctgaccgagcccctggtgagaggcttcaccaccgccgccgccgtgcacgtgttcaccagcatgctgaagtacctgttcggcgtgaagaccaagagatacagcggcatcttcagcgtggtgtacagcaccgtggccgtgctgcagaacgtgaagaacctgaacgtgtgcagcctgggcgtgggcctgatggtgttcggcctgctgctgggcggcaaggagttcaacgagagattcaaggagaagctgcccgcccccatccccctggagttcttcgccgtggtgatgggcaccggcatcagcgccggcttcaacctgaaggagagctacaacgtggacgtggtgggcaccctgcccctgggcctgctgccccccgccaaccccgacaccagcctgttccacctggtgtacgtggacgccatcgccatcgccatcgtgggcttcagcgtgaccatcagcatggccaagaccctggccaacaagcacggctaccaggtggacggcaaccaggagctgatcgccctgggcctgtgcaacagcatcggcagcctgttccagaccttcagcatcagctgcagcctgagcagaagcctggtgcaggagggcaccggcggcaagacccagctggccggctgcctggccagcctgatgatcctgctggtgatcctggccaccggcttcctgttcgagagcctgccccaggccgtgctgagcgccatcgtgatcgtgaacctgaagggcatgttcatgcagttcagcgacctgcccttcttctggagaaccagcaagatcgagctgaccatctggctgaccaccttcgtgagcagcctgttcctgggcctggactacggcctgatcaccgccgtgatcatcgccctgctgaccgtgatctacagaacccagagcttccacaccgagatgaccagaagatggagaccctag

SEQ ID NO: 99762 - DNA, 1422 bp, Artificial Sequence
  Description of Artificial Sequence: Synthetic coding sequence
atggaccacgccgaggagaacgagatcctggccgccacccagagatactacgtggagagacccatcttcagccaccccgtgctgcaggagagactgcacaccaaggacaaggtgcccgacagcatcgccgacaagctgaagcaggccttcacctgcacccccaagaagatcagaaacatcatctacatgttcctgcccatcaccaagtggctgcccgcctacaagttcaaggagtacgtgctgggcgacctggtgagcggcatcagcaccggcgtgctgcagctgccccagggcctggccttcgccatgctggccgccgtgccccccatcttcggcctgtacagcagcttctaccccgtgatcatgtactgcttcctgggcaccagcagacacatcagcatcggccccttcgccgtgatcagcctgatgatcggcggcgtggccgtgagactggtgcccgacgacatcgtgatccccggcggcgtgaacgccaccaacggcaccgaggccagagacgccctgagagtgaaggtggccatgagcgtgaccctgctgagcggcatcatccagttctgcctgggcgtgtgcagattcggcttcgtggccatctacctgaccgagcccctggtgagaggcttcaccaccgccgccgccgtgcacgtgttcaccagcatgctgaagtacctgttcggcgtgaagaccaagagatacagcggcatcttcagcgtggtgtacagcaccgtggccgtgctgcagaacgtgaagaacctgaacgtgtgcagcctgggcgtgggcctgatggtgttcggcctgctgctgggcggcaaggagttcaacgagagattcaaggagaagctgcccgcccccatccccctggagttcttcgccgtggtgatgggcaccggcatcagcgccggcttcaacctgaaggagagctacaacgtggacgtggtgggcaccctgcccctgggcctgctgccccccgccaaccccgacaccagcctgttccacctggtgtacgtggacgccatcgccatcgccatcgtgggcttcagcgtgaccatcagcatggccaagaccctggccaacaagcacggctaccaggtggacggcaaccaggagctgatcgccctgggcctgtgcaacagcatcggcagcctgttccagaccttcagcatcagctgcagcctgagcagaagcctggtgcaggagggcaccggcggcaagacccagctggccggctgcctggccagcctgatgatcctgctggtgatcctggccaccggcttcctgttcgagagcctgccccagaccatctggctgaccaccttcgtgagcagcctgttcctgggcctggactacggcctgatcaccgccgtgatcatcgccctgctgaccgtgatctacagaacccagagatag

SEQ ID NO: 99763 - DNA, 2139 bp, Artificial Sequence; identical to SEQ ID NO: 99760
  Description of Artificial Sequence: Synthetic coding sequence

SEQ ID NO: 99764 - DNA, 1344 bp, Artificial Sequence
  Description of Artificial Sequence: Synthetic coding sequence
atggaccacgccgaggagaacgagatcctggccgccacccagagatactacgtggagagacccatcttcagccaccccgtgctgcaggagagactgcacaccaaggacaaggtgcccgacagcatcgccgacaagctgaagcaggccttcacctgcacccccaagaagatcagaaacatcatctacatgttcctgcccatcaccaagtggctgcccgcctacaagttcaaggagtacgtgctgggcgacctggtgagcggcatcagcaccggcgtgctgcagctgccccagggcctggccttcgccatgctggccgccgtgccccccatcttcggcctgtacagcagcttctaccccgtgatcatgtactgcttcctgggcaccagcagacacatcagcatcggccccttcgccgtgatcagcctgatgatcggcggcgtggccgtgagactggtgcccgacgacatcgtgatccccggcggcgtgaacgccaccaacggcaccgaggccagagacgccctgagagtgaaggtggccatgagcgtgaccctgctgagcggcatcatccagttctgcctgggcgtgtgcagattcggcttcgtggccatctacctgaccgagcccctggtgagaggcttcaccaccgccgccgccgtgcacgtgttcaccagcatgctgaagtacctgttcggcgtgaagaccaagagatacagcggcatcttcagcgtggtgtacagcaccgtggccgtgctgcagaacgtgaagaacctgaacgtgtgcagcctgggcgtgggcctgatggtgttcggcctgctgctgggcggcaaggagttcaacgagagattcaaggagaagctgcccgcccccatccccctggagttcttcgccgtggtgatgggcaccggcatcagcgccggcttcaacctgaaggagagctacaacgtggacgtggtgggcaccctgcccctgggcctgctgccccccgccaaccccgacaccagcctgttccacctggtgtacgtggacgccatcgccatcgccatcgtgggcttcagcgtgaccatcagcatggccaagaccctggccaacaagcacggctaccaggtggacggcaaccaggagctgatcgccctgggcctgtgcaacagcatcggcagcctgttccagaccttcagcatcagctgcagcctgagcagaagcctggtgcaggagggcaccggcggcaagacccagaccatctggctgaccaccttcgtgagcagcctgttcctgggcctggactacggcctgatcaccgccgtgatcatcgccctgctgaccgtgatctacagaacccagagatag

SEQ ID NO: 99765 - DNA, 1956 bp, Artificial Sequence
  Description of Artificial Sequence: Synthetic coding sequence
atgggcctggccgacgccagcggccccagagacacccaggccctgctgagcgccacccaggccatggacctgagaagaagagactaccacatggagagacccctgctgaaccaggagcacctggaggagctgggcagatggggcagcgcccccagaacccaccagtggagaacctggctgcagtgcagcagagccagagcctacgccctgctgctgcagcacctgcccgtgctggtgtggctgcccagataccccgtgagagactggctgctgggcgacctgctgagcggcctgagcgtggccatcatgcagctgccccagggcctggcctacgccctgctggccggcctgccccccgtgttcggcctgtacagcagcttctaccccgtgttcatctacttcctgttcggcaccagcagacacatcagcgtggtgctggaggtgtgctggaagctgccccagagcaaggtgggcaccgtggtgaccgccgccgtggccggcgtggtgctggtggtggtgaagctgctgaacgacaagctgcagcagcagctgcccatgcccatccccggcgagctgctgaccctgatcggcgccaccggcatcagctacggcatgggcctgaagcacagattcgaggtggacgtggtgggcaacatccccgccggcctggtgccccccgtggcccccaacacccagctgttcagcaagctggtgggcagcgccttcaccatcgccgtggtgggcttcgccatcgccatcagcctgggcaagatcttcgccctgagacacggctacagagtggacagcaaccaggagctggtggccctgggcctgagcaacctgatcggcggcatcttccagtgcttccccgtgagctgcagcatgagcagaagcctggtgcaggagagcaccggcggcaacagccaggtggccggcgccatcagcagcctgttcatcctgctgatcatcgtgaagctgggcgagctgttccacgacctgcccaaggccgtgctggccgccatcatcatcgtgaacctgaagggcatgctgagacagctgagcgacatgagaagcctgtggaaggccaacagagccgacctgctgatctggctggtgaccttcaccgccaccatcctgctgaacctggacctgggcctggtggtggccgtgatcttcagcctgctgctggtggtggtgagaacccagatgccccactacagcgtgctgggccaggtgcccgacaccgacatctacagagacgtggccgagtacagcgaggccaaggaggtgagaggcgtgaaggtgttcagaagcagcgccaccgtgtacttcgccaacgccgagttctacagcgacgccctgaagcagagatgcggcgtggacgtggacttcctgatcagccagaagaagaagctgctgaagaagcaggagcagctgaagctgaagcagctgcagaaggaggagaagctgagaaagcaggccgccagccccaagggcgccagcgtgagcatcaacgtgaacaccagcctggaggacatgagaagcaacaacgtggaggactgcaagatgatggtgagcagcggcgacaagatggaggacgccaccgccaacggccaggaggacagcaaggcccccgacggcagcaccctgaaggccctgggcctgccccagcccgacttccacagcctgatcctggacctgggcgccctgagcttcgtggacaccgtgtgcctgaagagcctgaagaacatcttccacgacttcagagagatcgaggtggaggtgtacatggccgcctgccacagccccgtggtgagccagctggaggccggccacttcttcgacgccagcatcaccaagaagcacctgttcgccagcgtgcacgacgccgtgaccttcgccctgcagcaccccagacccgtgcccgacagccccgtgagcgtgaccagactgtag

SEQ ID NO: 99766 - DNA, 2217 bp, Artificial Sequence
  Description of Artificial Sequence: Synthetic coding sequence
atggacctgagaagaagagactaccacatggagagacccctgctgaaccaggagcacctggaggagctgggcagatggggcagcgcccccagaacccaccagtggagaacctggctgcagtgcagcagagccagagcctacgccctgctgctgcagcacctgcccgtgctggtgtggctgcccagataccccgtgagagactggctgctgggcgacctgctgagcggcctgagcgtggccatcatgcagctgccccagggcctggcctacgccctgctggccggcctgccccccgtgttcggcctgtacagcagcttctaccccgtgttcatctacttcctgttcggcaccagcagacacatcagcgtgggcaccttcgccgtgatgagcgtgatggtgggcagcgtgaccgagagcctggccccccaggccctgaacgacagcatgatcaacgagaccgccagagacgccgccagagtgcaggtggccagcaccctgagcgtgctggtgggcctgttccaggtgggcctgggcctgatccacttcggcttcgtggtgacctacctgagcgagcccctggtgagaggctacaccaccgccgccgccgtgcaggtgttcgtgagccagctgaagtacgtgttcggcctgcacctgagcagccacagcggccccctgagcctgatctacaccgtgctggaggtgtgctggaagctgccccagagcaaggtgggcaccgtggtgaccgccgccgtggccggcgtggtgctggtggtggtgaagctgctgaacgacaagctgcagcagcagctgcccatgcccatccccggcgagctgctgaccctgatcggcgccaccggcatcagctacggcatgggcctgaagcacagattcgaggtggacgtggtgggcaacatccccgccggcctggtgccccccgtggcccccaacacccagctgttcagcaagctggtgggcagcgccttcaccatcgccgtggtgggcttcgccatcgccatcagcctgggcaagatcttcgccctgagacacggctacagagtggacagcaaccaggagctggtggccctgggcctgagcaacctgatcggcggcatcttccagtgcttccccgtgagctgcagcatgagcagaagcctggtgcaggagagcaccggcggcaacagccaggtggccggcgccatcagcagcctgttcatcctgctgatcatcgtgaagctgggcgagctgttccacgacctgcccaaggccgtgctggccgccatcatcatcgtgaacctgaagggcatgctgagacagctgagcgacatgagaagcctgtggaaggccaacagagccgacctgctgatctggctggtgaccttcaccgccaccatcctgctgaacctggacctgggcctggtggtggccgtgatcttcagcctgctgctggtggtggtgagaacccagatgccccactacagcgtgctgggccaggtgcccgacaccgacatctacagagacgtggccgagtacagcgaggccaaggaggtgagaggcgtgaaggtgttcagaagcagcgccaccgtgtacttcgccaacgccgagttctacagcgacgccctgaagcagagatgcggcgtggacgtggacttcctgatcagccagaagaagaagctgctgaagaagcaggagcagctgaagctgaagcagctgcagaaggaggagaagctgagaaagcaggccgccagccccaagggcgccagcgtgagcatcaacgtgaacaccagcctggaggacatgagaagcaacaacgtggaggactgcaagatgatgcaggtgagcagcggcgacaagatggaggacgccaccgccaacggccaggaggacagcaaggcccccgacggcagcaccctgaaggccctgggcctgccccagcccgacttccacagcctgatcctggacctgggcgccctgagcttcgtggacaccgtgtgcctgaagagcctgaagaacatcttccacgacttcagagagatcgaggtggaggtgtacatggccgcctgccacagccccgtggtgagccagctggaggccggccacttcttcgacgccagcatcaccaagaagcacctgttcgccagcgtgcacgacgccgtgaccttcgccctgcagcaccccagacccgtgcccgacagccccgtgagcgtgaccagactgtag

SEQ ID NO: 99767 - DNA, 2223 bp, Artificial Sequence
  Description of Artificial Sequence: Synthetic coding sequence
atgggcctggccgacgccagcggccccagagacacccaggccctgctgagcgccacccaggccatggacctgagaagaagagactaccacatggagagacccctgctgaaccaggagcacctggaggagctgggcagatggggcagcgcccccagaacccaccagtggagaacctggctgcagtgcagcagagccagagcctacgccctgctgctgcagcacctgcccgtgctggtgtggctgcccagataccccgtgagagactggctgctgggcgacctgctgagcggcctgagcgtggccatcatgcagctgccccagggcctggcctacgccctgctggccggcctgccccccgtgttcggcctgtacagcagcttctaccccgtgttcatctacttcctgttcggcaccagcagacacatcagcgtgggcaccttcgccgtgatgagcgtgatggtgggcagcgtgaccgagagcctggccccccaggccctgaacgacagcatgatcaacgagaccgccagagacgccgccagagtgcaggtggccagcaccctgagcgtgctggtgggcctgttccaggtgggcctgggcctgatccacttcggcttcgtggtgacctacctgagcgagcccctggtgagaggctacaccaccgccgccgccgtgcaggtgttcgtgagccagctgaagtacgtgttcggcctgcacctgagcagccacagcggccccctgagcctgatctacaccgtgctggaggtgtgctggaagctgccccagagcaaggtgggcaccgtggtgaccgccgccgtggccggcgtggtgctggtggtggtgaagctgctgaacgacaagctgcagcagcagctgcccatgcccatccccggcgagctgctgaccctgatcggcgccaccggcatcagctacggcatgggcctgaagcacagattcgaggtggacgtggtgggcaacatccccgccggcctggtgccccccgtggcccccaacacccagctgttcagcaagctggtgggcagcgccttcaccatcgccgtggtgggcttcgccatcgccatcagcctgggcaagatcttcgccctgagacacggctacagagtggacagcaaccaggagctggtggccctgggcctgagcaacctgatcggcggcatcttccagtgcttccccgtgagctgcagcatgagcagaagcctggtgcaggagagcaccggcggcaacagccaggtggccggcgccatcagcagcctgttcatcctgctgatcatcgtgaagctgggcgagctgttccacgacctgcccaaggccgtgctggccgccatcatcatcgtgaacctgaagggcatgctgagacagctgagcgacatgagaagcctgtggaaggccaacagagccgacctgctgatctggctggtgaccttcaccgccaccatcctgctgaacctggacctgggcctggtggtggccgtgatcttcagcctgctgctggtggtggtgagaacccagatgccccactacagcgtgctgggccaggtgcccgacaccgacatctacagagacgtggccgagtacagcgaggccaaggaggtgagaggcgtgaaggtgttcagaagcagcgccaccgtgtacttcgccaacgccgagttctacagcgacgccctgaagcagagatgcggcgtggacgtggacttcctgatcagccagaagaagaagctgctgaagaagcaggagcagctgaagctgaagcagctgcagaaggaggagaagctgagaaagcaggccggccccctgctgagcgcctgcctggccccccagcaggtgagcagcggcgacaagatggaggacgccaccgccaacggccaggaggacagcaaggcccccgacggcagcaccctgaaggccctgggcctgccccagcccgacttccacagcctgatcctggacctgggcgccctgagcttcgtggacaccgtgtgcctgaagagcctgaagaacatcttccacgacttcagagagatcgaggtggaggtgtacatggccgcctgccacagccccgtggtgagccagctggaggccggccacttcttcgacgccagcatcaccaagaagcacctgttcgccagcgtgcacgacgccgtgaccttcgccctgcagcaccccagacccgtgcccgacagccccgtgagcgtgaccagactgtag

SEQ ID NO: 99768 - DNA, 2280 bp, Artificial Sequence
  Description of Artificial Sequence: Synthetic coding sequence
atgggcctggccgacgccagcggccccagagacacccaggccctgctgagcgccacccaggccatggacctgagaagaagagactaccacatggagagacccctgctgaaccaggagcacctggaggagctgggcagatggggcagcgcccccagaacccaccagtggagaacctggctgcagtgcagcagagccagagcctacgccctgctgctgcagcacctgcccgtgctggtgtggctgcccagataccccgtgagagactggctgctgggcgacctgctgagcggcctgagcgtggccatcatgcagctgccccagggcctggcctacgccctgctggccggcctgccccccgtgttcggcctgtacagcagcttctaccccgtgttcatctacttcctgttcggcaccagcagacacatcagcgtgggcaccttcgccgtgatgagcgtgatggtgggcagcgtgaccgagagcctggccccccaggccctgaacgacagcatgatcaacgagaccgccagagacgccgccagagtgcaggtggccagcaccctgagcgtgctggtgggcctgttccaggtgggcctgggcctgatccacttcggcttcgtggtgacctacctgagcgagcccctggtgagaggctacaccaccgccgccgccgtgcaggtgttcgtgagccagctgaagtacgtgttcggcctgcacctgagcagccacagcggccccctgagcctgatctacaccgtgctggaggtgtgctggaagctgccccagagcaaggtgggcaccgtggtgaccgccgccgtggccggcgtggtgctggtggtggtgaagctgctgaacgacaagctgcagcagcagctgcccatgcccatccccggcgagctgctgaccctgatcggcgccaccggcatcagctacggcatgggcctgaagcacagattcgaggtggacgtggtgggcaacatccccgccggcctggtgccccccgtggcccccaacacccagctgttcagcaagctggtgggcagcgccttcaccatcgccgtggtgggcttcgccatcgccatcagcctgggcaagatcttcgccctgagacacggctacagagtggacagcaaccaggagctggtggccctgggcctgagcaacctgatcggcggcatcttccagtgcttccccgtgagctgcagcatgagcagaagcctggtgcaggagagcaccggcggcaacagccaggtggccggcgccatcagcagcctgttcatcctgctgatcatcgtgaagctgggcgagctgttccacgacctgcccaaggccgtgctggccgccatcatcatcgtgaacctgaagggcatgctgagacagctgagcgacatgagaagcctgtggaaggccaacagagccgacctgctgatctggctggtgaccttcaccgccaccatcctgctgaacctggacctgggcctggtggtggccgtgatcttcagcctgctgctggtggtggtgagaacccagatgccccactacagcgtgctgggccaggtgcccgacaccgacatctacagagacgtggccgagtacagcgaggccaaggaggtgagaggcgtgaaggtgttcagaagcagcgccaccgtgtacttcgccaacgccgagttctacagcgacgccctgaagcagagatgcggcgtggacgtggacttcctgatcagccagaagaagaagctgctgaagaagcaggagcagctgaagctgaagcagctgcagaaggaggagaagctgagaaagcaggccgccagccccaagggcgccagcgtgagcatcaacgtgaacaccagcctggaggacatgagaagcaacaacgtggaggactgcaagatgatgcaggtgagcagcggcgacaagatggaggacgccaccgccaacggccaggaggacagcaaggcccccgacggcagcaccctgaaggccctgggcctgccccagcccgacttccacagcctgatcctggacctgggcgccctgagcttcgtggacaccgtgtgcctgaagagcctgaagaacatcttccacgacttcagagagatcgaggtggaggtgtacatggccgcctgccacagccccgtggtgagccagctggaggccggccacttcttcgacgccagcatcaccaagaagcacctgttcgccagcgtgcacgacgccgtgaccttcgccctgcagcaccccagacccgtgcccgacagccccgtgagcgtgaccagactgtag

SEQ ID NO: 99769 - DNA, 2277 bp, Artificial Sequence
  Description of Artificial Sequence: Synthetic coding sequence
atgggcctggccgacgccagcggccccagagacacccaggccctgctgagcgccacccaggccatggacctgagaagaagagactaccacatggagagacccctgctgaaccaggagcacctggaggagctgggcagatggggcagcgcccccagaacccaccagtggagaacctggctgcagtgcagcagagccagagcctacgccctgctgctgcagcacctgcccgtgctggtgtggctgcccagataccccgtgagagactggctgctgggcgacctgctgagcggcctgagcgtggccatcatgcagctgccccagggcctggcctacgccctgctggccggcctgccccccgtgttcggcctgtacagcagcttctaccccgtgttcatctacttcctgttcggcaccagcagacacatcagcgtgggcaccttcgccgtgatgagcgtgatggtgggcagcgtgaccgagagcctggccccccaggccctgaacgacagcatgatcaacgagaccgccagagacgccgccagagtgcaggtggccagcaccctgagcgtgctggtgggcctgttccaggtgggcctgggcctgatccacttcggcttcgtggtgacctacctgagcgagcccctggtgagaggctacaccaccgccgccgccgtgcaggtgttcgtgagccagctgaagtacgtgttcggcctgcacctgagcagccacagcggccccctgagcctgatctacaccgtgctggaggtgtgctggaagctgccccagagcaaggtgggcaccgtggtgaccgccgccgtggccggcgtggtgctggtggtggtgaagctgctgaacgacaagctgcagcagcagctgcccatgcccatccccggcgagctgctgaccctgatcggcgccaccggcatcagctacggcatgggcctgaagcacagattcgaggtggacgtggtgggcaacatccccgccggcctggtgccccccgtggcccccaacacccagctgttcagcaagctggtgggcagcgccttcaccatcgccgtggtgggcttcgccatcgccatcagcctgggcaagatcttcgccctgagacacggctacagagtggacagcaaccaggagctggtggccctgggcctgagcaacctgatcggcggcatcttccagtgcttccccgtgagctgcagcatgagcagaagcctggtgcaggagagcaccggcggcaacagccaggtggccggcgccatcagcagcctgttcatcctgctgatcatcgtgaagctgggcgagctgttccacgacctgcccaaggccgtgctggccgccatcatcatcgtgaacctgaagggcatgctgagacagctgagcgacatgagaagcctgtggaaggccaacagagccgacctgctgatctggctggtgaccttcaccgccaccatcctgctgaacctggacctgggcctggtggtggccgtgatcttcagcctgctgctggtggtggtgagaacccagatgccccactacagcgtgctgggccaggtgcccgacaccgacatctacagagacgtggccgagtacagcgaggccaaggaggtgagaggcgtgaaggtgttcagaagcagcgccaccgtgtacttcgccaacgccgagttctacagcgacgccctgaagcagagatgcggcgtggacgtggacttcctgatcagccagaagaagaagctgctgaagaagcaggagcagctgaagctgaagcagctgcagaaggaggagaagctgagaaagcaggccgccagccccaagggcgccagcgtgagcatcaacgtgaacaccagcctggaggacatgagaagcaacaacgtggaggactgcaagatgatggtgagcagcggcgacaagatggaggacgccaccgccaacggccaggaggacagcaaggcccccgacggcagcaccctgaaggccctgggcctgccccagcccgacttccacagcctgatcctggacctgggcgccctgagcttcgtggacaccgtgtgcctgaagagcctgaagaacatcttccacgacttcagagagatcgaggtggaggtgtacatggccgcctgccacagccccgtggtgagccagctggaggccggccacttcttcgacgccagcatcaccaagaagcacctgttcgccagcgtgcacgacgccgtgaccttcgccctgcagcaccccagacccgtgcccgacagccccgtgagcgtgaccagactgtag

SEQ ID NO: 99770 - DNA, 2262 bp, Artificial Sequence
  Description of Artificial Sequence: Synthetic coding sequence
atgggcctggccgacgccagcggccccagagacacccaggccctgctgagcgccacccaggccatggacctgagaagaagagactaccacatggagagacccctgctgaaccaggagcacctggaggagctgggcagatggggcagcgcccccagaacccaccagtggagaacctggctgcagtgcagcagagccagagcctacgccctgctgctgcagcacctgcccgtgctggtgtggctgcccagataccccgtgagagactggctgctgggcgacctgctgagcggcctgagcgtggccatcatgcagctgccccaggacctgctgagcagactgcactgctaccacagcaccctgggcctggcctacgccctgctggccggcctgccccccgtgttcggcctgtacagcagcttctaccccgtgttcatctacttcctgttcggcaccagcagacacatcagcgtgggcaccttcgccgtgatgagcgtgatggtgggcagcgtgaccgagagcctggccccccaggccctgaacgacagcatgatcaacgagaccgccagagacgccgccagagtgcaggtggccagcaccctgagcgtgctggtgggcctgttccaggtgggcctgggcctgatccacttcggcttcgtggtgacctacctgagcgagcccctggtgagaggctacaccaccgccgccgccgtgcaggtgttcgtgagccagctgaagtacgtgttcggcctgcacctgagcagccacagcggccccctgagcctgatctacaccgtgctggaggtgtgctggaagctgccccagagcaaggtgggcaccgtggtgaccgccgccgtggccggcgtggtgctggtggtggtgaagctgctgaacgacaagctgcagcagcagctgcccatgcccatccccggcgagctgctgaccctgatcggcgccaccggcatcagctacggcatgggcctgaagcacagattcgaggtggacgtggtgggcaacatccccgccggcctggtgccccccgtggcccccaacacccagctgttcagcaagctggtgggcagcgccttcaccatcgccgtggtgggcttcgccatcgccatcagcctgggcaagatcttcgccctgagacacggctacagagtggacagcaaccaggagctggtggccctgggcctgagcaacctgatcggcggcatcttccagtgcttccccgtgagctgcagcatgagcagaagcctggtgcaggagagcaccggcggcaacagccaggtggccggcgccatcagcagcctgttcatcctgctgatcatcgtgaagctgggcgagctgttccacgacctgcccaaggccgtgctggccgccatcatcatcgtgaacctgaagggcatgctgagacagctgagcgacatgagaagcctgtggaaggccaacagagccgacctgctgatctggctggtgaccttcaccgccaccatcctgctgaacctggacctgggcctggtggtggccgtgatcttcagcctgctgctggtggtggtgagaacccagatgccccactacagcgtgctgggccaggtgcccgacaccgacatctacagagacgtggccgagtacagcgaggccaaggaggtgagaggcgtgaaggtgttcagaagcagcgccaccgtgtacttcgccaacgccgagttctacagcgacgccctgaagcagagatgcggcgtggacgtggacttcctgatcagccagaagaagaagctgctgaagaagcaggagcagctgaagctgaagcagctgcagaaggaggagaagctgagaaagcaggccggccccctgctgagcgcctgcctggccccccagcaggtgagcagcggcgacaagatggaggacgccaccgccaacggccaggaggacagcaaggcccccgacggcagcaccctgaaggccctgggcctgccccagcccgacttccacagcctgatcctggacctgggcgccctgagcttcgtggacaccgtgtgcctgaagagcctgaagaacatcttccacgacttcagagagatcgaggtggaggtgtacatggccgcctgccacagccccgtggtgagccagctggaggccggccacttcttcgacgccagcatcaccaagaagcacctgttcgccagcgtgcacgacgccgtgaccttcgccctgcagcaccccagacccgtgcccgacagccccgtgagcgtgaccagactgtag

SEQ ID NO: 99771 - DNA, 2172 bp, Artificial Sequence
  Description of Artificial Sequence: Synthetic coding sequence
atgggcctggccgacgccagcggccccagagacacccaggccctgctgagcgccacccaggccatggacctgagaagaagagactaccacatggagagacccctgctgaaccaggagcacctggaggagctgggcagatggggcagcgcccccagaacccaccagtggagaacctggctgcagtgcagcagagccagagcctacgccctgctgctgcagcacctgcccgtgctggtgtggctgcccagataccccgtgagagactggctgctgggcgacctgctgagcggcctgagcgtggccatcatgcagctgccccagggcctggcctacgccctgctggccggcctgccccccgtgttcggcctgtacagcagcttctaccccgtgttcatctacttcctgttcggcaccagcagacacatcagcgtggccacccccggccccctgcccctgctgaccgcccccggcagacccaccggcggcgccggccccgaccccctgagactgagaggccacctgcccgtgagaaccagctgccccagactgtaccacagctgcagctgcgccggcctgagactgaccgcccaggtgtgcgtgtggccccccagcgagcagcccctgtgggccaccgtgccccacctgctgctggaggtgtgctggaagctgccccagagcaaggtgggcaccgtggtgaccgccgccgtggccggcgtggtgctggtggtggtgaagctgctgaacgacaagctgcagcagcagctgcccatgcccatccccggcgagctgctgaccctgatcggcgccaccggcatcagctacggcatgggcctgaagcacagattcgaggtggacgtggtgggcaacatccccgccggcctggtgccccccgtggcccccaacacccagctgttcagcaagctggtgggcagcgccttcaccatcgccgtggtgggcttcgccatcgccatcagcctgggcaagatcttcgccctgagacacggctacagagtggacagcaaccaggagctggtggccctgggcctgagcaacctgatcggcggcatcttccagtgcttccccgtgagctgcagcatgagcagaagcctggtgcaggagagcaccggcggcaacagccaggtggccggcgccatcagcagcctgttcatcctgctgatcatcgtgaagctgggcgagctgttccacgacctgcccaaggccgtgctggccgccatcatcatcgtgaacctgaagggcatgctgagacagctgagcgacatgagaagcctgtggaaggccaacagagccgacctgctgatctggctggtgaccttcaccgccaccatcctgctgaacctggacctgggcctggtggtggccgtgatcttcagcctgctgctggtggtggtgagaacccagatgccccactacagcgtgctgggccaggtgcccgacaccgacatctacagagacgtggccgagtacagcgaggccaaggaggtgagaggcgtgaaggtgttcagaagcagcgccaccgtgtacttcgccaacgccgagttctacagcgacgccctgaagcagagatgcggcgtggacgtggacttcctgatcagccagaagaagaagctgctgaagaagcaggagcagctgaagctgaagcagctgcagaaggaggagaagctgagaaagcaggccgccagccccaagggcgccagcgtgagcatcaacgtgaacaccagcctggaggacatgagaagcaacaacgtggaggactgcaagatgatgcaggtgagcagcggcgacaagatggaggacgccaccgccaacggccaggaggacagcaaggcccccgacggcagcaccctgaaggccctgggcctgccccagcccgacttccacagcctgatcctggacctgggcgccctgagcttcgtggacaccgtgtgcctgaagagcctgaagaacatcttccacgacttcagagagatcgaggtggaggtgtacatggccgcctgccacagccccgtggtgagccagctggaggccggccacttcttcgacgccagcatcaccaagaagcacctgttcgccagcgtgcacgacgccgtgaccttcgccctgcagcaccccagacccgtgcccgacagccccgtgagcgtgaccagactgtag

SEQ ID NO: 99772 - DNA, 1941 bp, Artificial Sequence
  Description of Artificial Sequence: Synthetic coding sequence
atgagagcccccggcgccggcgccgccagcgtggtgagcctggccctgctgtggctgctgggcctgccctggacctggagcgccgccgccgccctgggcgtgtacgtgggcagcggcggctggagattcctgagaatcgtgtgcaagaccgccagaagagacctgttcggcctgagcgtgctgatcagagtgagactggagctgagaagacaccagagagccggccacaccatccccagaatcttccaggccgtggtgcagagacagcccgagagactggccctggtggacgccggcaccggcgagtgctggaccttcgcccagctggacgcctacagcaacgccgtggccaacctgttcagacagctgggcttcgcccccggcgacgtggtggccatcttcctggagggcagacccgagttcgtgggcctgtggctgggcctggccaaggccggcatggaggccgccctgctgaacgtgaacctgagaagagagcccctggccttctgcctgggcaccagcggcgccaaggccctgatcttcggcggcgagatggtggccgccgtggccgaggtgagcggccacctgggcaagagcctgatcaagttctgcagcggcgacctgggccccgagggcatcctgcccgacacccacctgctggaccccctgctgaaggaggccagcaccgcccccctggcccagatccccagcaagggcatggacgacagactgttctacatctacaccagcggcaccaccggcctgcccaaggccgccatcgtggtgcacagcagatactacagaatggccgccttcggccaccacgcctacagaatgcaggccgccgacgtgctgtacgactgcctgcccctgtaccacagcgccggcaacatcatcggcgtgggccagtgcctgatctacggcctgaccgtggtgctgagaaagaagttcagcgccagcagattctgggacgactgcatcaagtacaactgcaccgtggtgcagtacatcggcgagatctgcagatacctgctgaagcagcccgtgagagaggccgagagaagacacagagtgagactggccgtgggcaacggcctgagacccgccatctgggaggagttcaccgagagattcggcgtgagacagatcggcgagttctacggcgccaccgagtgcaactgcagcatcgccaacatggacggcaaggtgggcagctgcggcttcaacagcagaatcctgccccacgtgtaccccatcagactggtgaaggtgaacgaggacaccatggagctgctgagagacgcccagggcctgtgcatcccctgccaggccggcgagcccggcctgctggtgggccagatcaaccagcaggaccccctgagaagattcgacggctacgtgagcgagagcgccaccagcaagaagatcgcccacagcgtgttcagcaagggcgacagcgcctacctgagcggcgacgtgctggtgatggacgagctgggctacatgtacttcagagacagaagcggcgacaccttcagatggagaggcgagaacgtgagcaccaccgaggtggagggcgtgctgagcagactgctgggccagaccgacgtggccgtgtacggcgtggccgtgcccggcgtggagggcaaggccggcatggccgccgtggccgacccccacagcctgctggaccccaacgccatctaccaggagctgcagaaggtgctggccccctacgccagacccatcttcctgagactgctgccccaggtggacaccaccggcaccttcaagatccagaagaccagactgcagagagagggcttcgaccccagacagaccagcgacagactgttcttcctggacctgaagcagggccactacctgcccctgaacgaggccgtgtacaccagaatctgcagcggcgccttcgccctgtag

SEQ ID NO: 99773 - DNA, 723 bp, Artificial Sequence
  Description of Artificial Sequence: Synthetic coding sequence
cccgagttcgtgggcctgtggctgggcctggccaaggccggcatggaggccgccctgctgaacgtgaacctgagaagagagcccctggccttctgcctgggcaccagcggcgccaaggccctgatcttcggcggcgagatggtggccgccgtggccgaggtgagcggccacctgggcaagagcctgatcaagttctgcagcggcgacctgggccccgagggcatcctgcccgacacccacctgctggaccccctgctgaaggaggccagcaccgcccccctggcccagatccccagcaagggcatggacgacagactgttctacatctacaccagcggcaccaccggcctgcccaaggccgccatcgtggtgcacagcagatactacagaatggccgccttcggccaccacgcctacagaatgcaggccgccgacgtgctgtacgactgcctgcccctgtaccacagcgccggcaacatcatcggcgtgggccagtgcctgatctacggcctgaccgtggtgctgagaaagaagttcagcgccagcagattctgggacgactgcatcaagtacaactgcacctggcacggccccagctggaccgagaagctggagccccagagaaacccctgcctgagcgccgccctggtgcccctgtgcctgccccccctgcccgccttccagcccctgagccccagcatccccgtgcccgtgtggccctag

SEQ ID NO: 99774 - DNA, 1941 bp, Artificial Sequence; identical to SEQ ID NO: 99772
  Description of Artificial Sequence: Synthetic coding sequence

SEQ ID NO: 99775 - DNA, 1863 bp, Artificial Sequence
  Description of Artificial Sequence: Synthetic coding sequence
atgctgagcgccatctacaccgtgctggccggcctgctgttcctgcccctgctggtgaacctgtgctgcccctacttcttccaggacatcggctacttcctgaaggtggccgccgtgggcagaagagtgagaagctacggcaagagaagacccgccagaaccatcctgagagccttcctggagaaggccagacagaccccccacaagcccttcctgctgttcagagacgagaccctgacctacgcccaggtggacagaagaagcaaccaggtggccagagccctgcacgaccacctgggcctgagacagggcgactgcgtggccctgctgatgggcaacgagcccgcctacgtgtggctgtggctgggcctggtgaagctgggctgcgccatggcctgcctgaactacaacatcagagccaagagcctgctgcactgcttccagtgctgcggcgccaaggtgctgctggtgagccccgagctgcaggccgccgtggaggagatcctgcccagcctgaagaaggacgacgtgagcatctactacgtgagcagaaccagcaacaccgacggcatcgacagcttcctggacaaggtggacgaggtgagcaccgagcccatccccgagagctggagaagcgaggtgaccttcagcacccccgccctgtacatctacaccagcggcaccaccggcctgcccaaggccgccatgatcacccaccagagaatctggtacggcaccggcctgaccttcgtgagcggcctgaaggccgacgacgtgatctacatcaccctgcccttctaccacagcgccgccctgctgatcggcatccacggctgcatcgtggccggcgccaccctggccctgagaaccaagttcagcgccagccagttctgggacgactgcagaaagtacaacgtgaccgtgatccagtacatcggcgagctgctgagatacctgtgcaacagcccccagaagcccaacgacagagaccacaaggtgagactggccctgggcaacggcctgagaggcgacgtgtggagacagttcgtgaagagattcggcgacatctgcatctacgagttctacgccgccaccgagggcaacatcggcttcatgaactacgccagaaaggtgggcgccgtgggcagagtgaactacctgcagaagaagatcatcacctacgacctgatcaagtacgacgtggagaaggacgagcccgtgagagacgagaacggctactgcgtgagagtgcccaagggcgaggtgggcctgctggtgtgcaagatcacccagctgacccccttcaacggctacgccggcgccaaggcccagaccgagaagaagaagctgagagacgtgttcaagaagggcgacctgtacttcaacagcggcgacctgctgatggtggaccacgagaacttcatctacttccacgacagagtgggcgacaccttcagatggaagggcgagaacgtggccaccaccgaggtggccgacaccgtgggcctggtggacttcgtgcaggaggtgaacgtgtacggcgtgcacgtgcccgaccacgagggcagaatcggcatggccagcatcaagatgaaggagaaccacgagttcgacggcaagaagctgttccagcacatcgccgactacctgcccagctacgccagacccagattcctgagaatccaggacaccatcgagatcaccggcaccttcaagcacagaaagatgaccctggtggaggagggcttcaaccccgccgtgatcaaggacgccctgtacttcctggacgacaccgccaagatgtacgtgcccatgaccgaggacatctacaacgccatcagcgccaagaccctgaagctgtag

SEQ ID NO: 99776 - DNA, 1704 bp, Artificial Sequence
  Description of Artificial Sequence: Synthetic coding sequence
atgctgagcgccatctacaccgtgctggccggcctgctgttcctgcccctgctggtgaacctgtgctgcccctacttcttccaggacatcggctacttcctgaaggtggccgccgtgggcagaagagtgagaagctacggcaagagaagacccgccagaaccatcctgagagccttcctggagaaggccagacagaccccccacaagcccttcctgctgttcagagacgagaccctgacctacgcccaggtggacagaagaagcaaccaggtggccagagccctgcacgaccacctgggcctgagacagggcgactgcgtggccctgctgatgggcaacgagcccgcctacgtgtggctgtggctgggcctggtgaagctgggctgcgccatggcctgcctgaactacaacatcagagccaagagcctgctgcactgcttccagtgctgcggcgccaaggtgctgctggtgagccccgagctgcaggccgccgtggaggagatcctgcccagcctgaagaaggacgacgtgagcatctactacgtgagcagaaccagcaacaccgacggcatcgacagcttcctggacaaggtggacgaggtgagcaccgagcccatccccgagagctggagaagcgaggtgaccttcagcacccccgccctgtacatctacaccagcggcaccaccggcgccaccctggccctgagaaccaagttcagcgccagccagttctgggacgactgcagaaagtacaacgtgaccgtgatccagtacatcggcgagctgctgagatacctgtgcaacagcccccagaagcccaacgacagagaccacaaggtgagactggccctgggcaacggcctgagaggcgacgtgtggagacagttcgtgaagagattcggcgacatctgcatctacgagttctacgccgccaccgagggcaacatcggcttcatgaactacgccagaaaggtgggcgccgtgggcagagtgaactacctgcagaagaagatcatcacctacgacctgatcaagtacgacgtggagaaggacgagcccgtgagagacgagaacggctactgcgtgagagtgcccaagggcgaggtgggcctgctggtgtgcaagatcacccagctgacccccttcaacggctacgccggcgccaaggcccagaccgagaagaagaagctgagagacgtgttcaagaagggcgacctgtacttcaacagcggcgacctgctgatggtggaccacgagaacttcatctacttccacgacagagtgggcgacaccttcagatggaagggcgagaacgtggccaccaccgaggtggccgacaccgtgggcctggtggacttcgtgcaggaggtgaacgtgtacggcgtgcacgtgcccgaccacgagggcagaatcggcatggccagcatcaagatgaaggagaaccacgagttcgacggcaagaagctgttccagcacatcgccgactacctgcccagctacgccagacccagattcctgagaatccaggacaccatcgagatcaccggcaccttcaagcacagaaagatgaccctggtggaggagggcttcaaccccgccgtgatcaaggacgccctgtacttcctggacgacaccgccaagatgtacgtgcccatgaccgaggacatctacaacgccatcagcgccaagaccctgaagctgtag

SEQ ID NO: 99777 - DNA, 2436 bp, Artificial Sequence
  Description of Artificial Sequence: Synthetic coding sequence
atgcccaagccccccaagcccagaaacaacctggaggacagacacaaccccggcatccagggcagaagagagcacagacccggccccggcagagtgagagccgccagcagccccggcggcagcgcccccagagccgagagaagactgtggggcgagggctgggagagcggcgccgccccccacccccacagcagcagagtgagcgccctgagaccctgcggcgtggtgggcgcctgggtgggcatgggcgtgtgccagagaaccagagccccctggaaggagaagagccagctggagagagccgccctgggcttcagaaagggcggcagcggcatgttcgccagcggctggaaccagaccgtgcccatcgaggaggccggcagcatggccgccctgctgctgctgcccctgctgctgctgctgcccctgctgctgctgaagctgcacctgtggccccagctgagatggctgcccgccgacctggccttcgccgtgagagccctgtgctgcaagagagccctgagagccagagccctggccgccgccgccgccgaccccgagggccccgagggcggctgcagcctggcctggagactggccgagctggcccagcagagagccgcccacaccttcctgatccacggcagcagaagattcagctacagcgaggccgagagagagagcaacagagccgccagagccttcctgagagccctgggctgggactggggccccgacggcggcgacagcggcgagggcagcgccggcgagggcgagagagccgcccccggcgccggcgacgccgccgccggcagcggcgccgagttcgccggcggcgacggcgccgccagaggcggcggcgccgccgcccccctgagccccggcgccaccgtggccctgctgctgcccgccggccccgagttcctgtggctgtggttcggcctggccaaggccggcctgagaaccgccttcgtgcccaccgccctgagaagaggccccctgctgcactgcctgagaagctgcggcgccagagccctggtgctggcccccgagttcctggagagcctggagcccgacctgcccgccctgagagccatgggcctgcacctgtgggccgccggccccggcacccaccccgccggcatcagcgacctgctggccgaggtgagcgccgaggtggacggccccgtgcccggctacctgagcagcccccagagcatcaccgacacctgcctgtacatcttcaccagcggcaccaccggcctgcccaaggccgccagaatcagccacctgaagatcctgcagtgccagggcttctaccagctgtgcggcgtgcaccaggaggacgtgatctacctggccctgcccctgtaccacatgagcggcagcctgctgggcatcgtgggctgcatgggcatcggcgccaccgtggtgctgaagagcaagttcagcgccggccagttctgggaggactgccagcagcacagagtgaccgtgttccagtacatcggcgagctgtgcagatacctggtgaaccagccccccagcaaggccgagagaggccacaaggtgagactggccgtgggcagcggcctgagacccgacacctgggagagattcgtgagaagattcggccccctgcaggtgctggagacctacggcctgaccgagggcaacgtggccaccatcaactacaccggccagagaggcgccgtgggcagagccagctggctgtacaagcacatcttccccttcagcctgatcagatacgacgtgaccaccggcgagcccatcagagacccccagggccactgcatggccaccagccccggcgagcccggcctgctggtggcccccgtgagccagcagagccccttcctgggctacgccggcggccccgagctggcccagggcaagctgctgaaggacgtgttcagacccggcgacgtgttcttcaacaccggcgacctgctggtgtgcgacgaccagggcttcctgagattccacgacagaaccggcgacaccttcagatggaagggcgagaacgtggccaccaccgaggtggccgaggtgttcgaggccctggacttcctgcaggaggtgaacgtgtacggcgtgaccgtgcccggccacgagggcagagccggcatggccgccctggtgctgagacccccccacgccctggacctgatgcagctgtacacccacgtgagcgagaacctgcccccctacgccagacccagattcctgagactgcaggagagcctggccaccaccgagaccttcaagcagcagaaggtgagaatggccaacgagggcttcgaccccagcaccctgagcgaccccctgtacgtgctggaccaggccgtgggcgcctacctgcccctgaccaccgccagatacagcgccctgctggccggcaacctgagaatctag

SEQ ID NO: 99778 - DNA, 2193 bp, Artificial Sequence
  Description of Artificial Sequence: Synthetic coding sequence
atgggcgtgtgccagagaaccagagccccctggaaggagaagagccagctggagagagccgccctgggcttcagaaagggcggcagcggcatgttcgccagcggctggaaccagaccgtgcccatcgaggaggccggcagcatggccgccctgctgctgctgcccctgctgctgctgctgcccctgctgctgctgaagctgcacctgtggccccagctgagatggctgcccgccgacctggccttcgccgtgagagccctgtgctgcaagagagccctgagagccagagccctggccgccgccgccgccgaccccgagggccccgagggcggctgcagcctggcctggagactggccgagctggcccagcagagagccgcccacaccttcctgatccacggcagcagaagattcagctacagcgaggccgagagagagagcaacagagccgccagagccttcctgagagccctgggctgggactggggccccgacggcggcgacagcggcgagggcagcgccggcgagggcgagagagccgcccccggcgccggcgacgccgccgccggcagcggcgccgagttcgccggcggcgacggcgccgccagaggcggcggcgccgccgcccccctgagccccggcgccaccgtggccctgctgctgcccgccggccccgagttcctgtggctgtggttcggcctggccaaggccggcctgagaaccgccttcgtgcccaccgccctgagaagaggccccctgctgcactgcctgagaagctgcggcgccagagccctggtgctggcccccgagttcctggagagcctggagcccgacctgcccgccctgagagccatgggcctgcacctgtgggccgccggccccggcacccaccccgccggcatcagcgacctgctggccgaggtgagcgccgaggtggacggccccgtgcccggctacctgagcagcccccagagcatcaccgacacctgcctgtacatcttcaccagcggcaccaccggcctgcccaaggccgccagaatcagccacctgaagatcctgcagtgccagggcttctaccagctgtgcggcgtgcaccaggaggacgtgatctacctggccctgcccctgtaccacatgagcggcagcctgctgggcatcgtgggctgcatgggcatcggcgccaccgtggtgctgaagagcaagttcagcgccggccagttctgggaggactgccagcagcacagagtgaccgtgttccagtacatcggcgagctgtgcagatacctggtgaaccagccccccagcaaggccgagagaggccacaaggtgagactggccgtgggcagcggcctgagacccgacacctgggagagattcgtgagaagattcggccccctgcaggtgctggagacctacggcctgaccgagggcaacgtggccaccatcaactacaccggccagagaggcgccgtgggcagagccagctggctgtacaagcacatcttccccttcagcctgatcagatacgacgtgaccaccggcgagcccatcagagacccccagggccactgcatggccaccagccccggcgagcccggcctgctggtggcccccgtgagccagcagagccccttcctgggctacgccggcggccccgagctggcccagggcaagctgctgaaggacgtgttcagacccggcgacgtgttcttcaacaccggcgacctgctggtgtgcgacgaccagggcttcctgagattccacgacagaaccggcgacaccttcagatggaagggcgagaacgtggccaccaccgaggtggccgaggtgttcgaggccctggacttcctgcaggaggtgaacgtgtacggcgtgaccgtgcccggccacgagggcagagccggcatggccgccctggtgctgagacccccccacgccctggacctgatgcagctgtacacccacgtgagcgagaacctgcccccctacgccagacccagattcctgagactgcaggagagcctggccaccaccgagaccttcaagcagcagaaggtgagaatggccaacgagggcttcgaccccagcaccctgagcgaccccctgtacgtgctggaccaggccgtgggcgcctacctgcccctgaccaccgccagatacagcgccctgctggccggcaacctgagaatctag

SEQ ID NO: 99779 - DNA, 1932 bp, Artificial Sequence
  Description of Artificial Sequence: Synthetic coding sequence
atgctgctgggcgccagcctggtgggcgtgctgctgttcagcaagctggtgctgaagctgccctggacccaggtgggcttcagcctgctgttcctgtacctgggcagcggcggctggagattcatcagagtgttcatcaagaccatcagaagagacatcttcggcggcctggtgctgctgaaggtgaaggccaaggtgagacagtgcctgcaggagagaagaaccgtgcccatcctgttcgccagcaccgtgagaagacaccccgacaagaccgccctgatcttcgagggcaccgacacccactggaccttcagacagctggacgagtacagcagcagcgtggccaacttcctgcaggccagaggcctggccagcggcgacgtggccgccatcttcatggagaacagaaacgagttcgtgggcctgtggctgggcatggccaagctgggcgtggaggccgccctgatcaacaccaacctgagaagagacgccctgctgcactgcctgaccaccagcagagccagagccctggtgttcggcagcgagatggccagcgccatctgcgaggtgcacgccagcctggaccccagcctgagcctgttctgcagcggcagctgggagcccggcgccgtgccccccagcaccgagcacctggaccccctgctgaaggacgcccccaagcacctgcccagctgccccgacaagggcttcaccgacaagctgttctacatctacaccagcggcaccaccggcctgcccaaggccgccatcgtggtgcacagcagatactacagaatggccgccctggtgtactacggcttcagaatgagacccaacgacatcgtgtacgactgcctgcccctgtaccacagcgccggcaacatcgtgggcatcggccagtgcctgctgcacggcatgaccgtggtgatcagaaagaagttcagcgccagcagattctgggacgactgcatcaagtacaactgcaccatcgtgcagtacatcggcgagctgtgcagatacctgctgaaccagccccccagagaggccgagaaccagcaccaggtgagaatggccctgggcaacggcctgagacagagcatctggaccaacttcagcagcagattccacatcccccaggtggccgagttctacggcgccaccgagtgcaactgcagcctgggcaacttcgacagccaggtgggcgcctgcggcttcaacagcagaatcctgagcttcgtgtaccccatcagactggtgagagtgaacgaggacaccatggagctgatcagaggccccgacggcgtgtgcatcccctgccagcccggcgagcccggccagctggtgggcagaatcatccagaaggaccccctgagaagattcgacggctacctgaaccagggcgccaacaacaagaagatcgccaaggacgtgttcaagaagggcgaccaggcctacctgaccggcgacgtgctggtgatggacgagctgggctacctgtacttcagagacagaaccggcgacaccttcagatggaagggcgagaacgtgagcaccaccgaggtggagggcaccctgagcagactgctggacatggccgacgtggccgtgtacggcgtggaggtgcccggcaccgagggcagagccggcatggccgccgtggccagccccaccggcaactgcgacctggagagattcgcccaggtgctggagaaggagctgcccctgtacgccagacccatcttcctgagactgctgcccgagctgcacaagaccggcacctacaagttccagaagaccgagctgagaaaggagggcttcgaccccgccatcgtgaaggaccccctgttctacctggacgcccagaagggcagatacgtgcccctggaccaggaggcctacagcagaatccaggccggcgaggagaagctgtag

SEQ ID NO: 99780 - DNA, 714 bp, Artificial Sequence
  Description of Artificial Sequence: Synthetic coding sequence
atgcccctgaccctgagcaccctgctgcagcccggcagaatctggaccggcagaagagccgccgagcccacccccggccacaacgccgcctggagcctgagcggcggcggcgccgccgtgctgcaggccggcgccgagaccgccctggaccccggcggcatcctgcccgtggtgcccctgctgggcatctggagactggccctgcaccccggcctgcaccaggaccaccaggcctacctgaccggcgacgtgctggtgatggacgagctgggctacctgtacttcagagacagaaccggcgacaccttcagatggaagggcgagaacgtgagcaccaccgaggtggagggcaccctgagcagactgctggacatggccgacgtggccgtgtacggcgtggaggtgcccggcaccgagggcagagccggcatggccgccgtggccagccccaccggcaactgcgacctggagagattcgcccaggtgctggagaaggagctgcccctgtacgccagacccatcttcctgagactgctgcccgagctgcacaagaccggcacctacaagttccagaagaccgagctgagaaaggagggcttcgaccccgccatcgtgaaggaccccctgttctacctggacgcccagaagggcagatacgtgcccctggaccaggaggcctacagcagaatccaggccggcgaggagaagctgtag

SEQ ID NO: 99781 - DNA, 2073 bp, Artificial Sequence
  Description of Artificial Sequence: Synthetic coding sequence
atgggcgtgagacagcagctggccctgctgctgctgctgctgctgctgctgtggggcctgggccagcccgtgtggcccgtggccgtggccctgaccctgagatggctgctgggcgaccccacctgctgcgtgctgctgggcctggccatgctggccagaccctggctgggcccctgggtgccccacggcctgagcctggccgccgccgccctggccctgaccctgctgcccgccagactgccccccggcctgagatggctgcccgccgacgtgatcttcctggccaagatcctgcacctgggcctgaagatcagaggctgcctgagcagacagccccccgacaccttcgtggacgccttcgagagaagagccagagcccagcccggcagagccctgctggtgtggaccggccccggcgccggcagcgtgaccttcggcgagctggacgccagagcctgccaggccgcctgggccctgaaggccgagctgggcgaccccgccagcctgtgcgccggcgagcccaccgccctgctggtgctggccagccaggccgtgcccgccctgtgcatgtggctgggcctggccaagctgggctgccccaccgcctggatcaacccccacggcagaggcatgcccctggcccacagcgtgctgagcagcggcgccagagtgctggtggtggaccccgacctgagagagagcctggaggagatcctgcccaagctgcaggccgagaacatcagatgcttctacctgagccacaccagccccacccccggcgtgggcgccctgggcgccgccctggacgccgcccccagccaccccgtgcccgccgacctgagagccggcatcacctggagaagccccgccctgttcatctacaccagcggcaccaccggcctgcccaagcccgccatcctgacccacgagagagtgctgcagatgagcaagatgctgagcctgagcggcgccaccgccgacgacgtggtgtacaccgtgctgcccctgtaccacgtgatgggcctggtggtgggcatcctgggctgcctggacctgggcgccacctgcgtgctggcccccaagttcagcaccagctgcttctgggacgactgcagacagcacggcgtgaccgtgatcctgtacgtgggcgagctgctgagatacctgtgcaacatcccccagcagcccgaggacagaacccacaccgtgagactggccatgggcaacggcctgagagccgacgtgtgggagaccttccagcagagattcggccccatcagaatctgggaggtgtacggcagcaccgagggcaacatgggcctggtgaactacgtgggcagatgcggcgccctgggcaagatgagctgcctgctgagaatgctgagccccttcgagctggtgcagttcgacatggaggccgccgagcccgtgagagacaaccagggcttctgcatccccgtgggcctgggcgagcccggcctgctgctgaccaaggtggtgagccagcagcccttcgtgggctacagaggccccagagagctgagcgagagaaagctggtgagaaacgtgagacagagcggcgacgtgtactacaacaccggcgacgtgctggccatggacagagagggcttcctgtacttcagagacagactgggcgacaccttcagatggaagggcgagaacgtgagcacccacgaggtggagggcgtgctgagccaggtggacttcctgcagcaggtgaacgtgtacggcgtgtgcgtgcccggctgcgagggcaaggtgggcatggccgccgtgcagctggcccccggccagaccttcgacggcgagaagctgtaccagcacgtgagagcctggctgcccgcctacgccaccccccacttcatcagaatccaggacgccatggaggtgaccagcaccttcaagctgatgaagaccagactggtgagagagggcttcaacgtgggcatcgtggtggaccccctgttcgtgctggacaacagagcccagagcttcagacccctgaccgccgagatgtaccaggccgtgtgcgagggcacctggagactgtag

SEQ ID NO: 99782 - DNA, 1950 bp, Artificial Sequence
  Description of Artificial Sequence: Synthetic coding sequence
atggagaacgaccccagcagaagaagagagagcatcagcctgacccccgtggccaagggcctggagaacatgggcgccgacttcctggagagcctggaggagggccagctgcccagaagcgacctgagccccgccgagatcagaagcagctggagcgaggccgcccccaagcccttcagcagatggagaaacctgcagcccgccctgagagccagaagcttctgcagagagcacatgcagctgttcagatggatcggcaccggcctgctgtgcaccggcctgagcgccttcctgctggtggcctgcctgctggacttccagagagccctggccctgttcgtgctgacctgcgtggtgctgaccttcctgggccacagactgctgaagagactgctgggccccaagctgagaagattcctgaagccccagggccaccccagactgctgctgtggttcaagagaggcctggccctggccgccttcctgggcctggtgctgtggctgagcctggacaccagccagagacccgagcagctggtgagcttcgccggcatctgcgtgttcgtggccctgctgttcgcctgcagcaagcaccactgcgccgtgagctggagagccgtgagctggggcctgggcctgcagttcgtgctgggcctgctggtgatcagaaccgagcccggcttcatcgccttcgagtggctgggcgagcagatcagaatcttcctgagctacaccaaggccggcagcagcttcgtgttcggcgaggccctggtgaaggacgtgttcgccttccaggtgctgcccatcatcgtgttcttcagctgcgtgatcagcgtgctgtaccacgtgggcctgatgcagtgggtgatcctgaagatcgcctggctgatgcaggtgaccatgggcaccaccgccaccgagaccctgagcgtggccggcaacatcttcgtgagccagaccgaggcccccctgctgatcagaccctacctggccgacatgaccctgagcgaggtgcacgtggtgatgaccggcggctacgccaccatcgccggcagcctgctgggcgcctacatcagcttcggcatcgacgccaccagcctgatcgccgccagcgtgatggccgccccctgcgccctggccctgagcaagctggtgtaccccgaggtggaggagagcaagttcagaagagaggagggcgtgaagctgacctacggcgacgcccagaacctgatcgaggccgccagcaccggcgccgccatcagcgtgaaggtggtggccaacatcgccgccaacctgatcgccttcctggccgtgctggacttcatcaacgccgccctgagctggctgggcgacatggtggacatccagggcctgagcttccagctgatctgcagctacatcctgagacccgtggccttcctgatgggcgtggcctgggaggactgccccgtggtggccgagctgctgggcatcaagctgttcctgaacgagttcgtggcctaccaggacctgagcaagtacaagcagagaagactggccggcgccgaggagtgggtgggcgacagaaagcagtggatcagcgtgagagccgaggtgctgaccaccttcgccctgtgcggcttcgccaacttcagcagcatcggcatcatgctgggcggcctgaccagcatggtgccccagagaaagagcgacttcagccagatcgtgctgagagccctgttcaccggcgcctgcgtgagcctggtgaacgcctgcatggccggcatcctgtacatgcccagaggcgccgaggtggactgcatgagcctgctgaacaccaccctgagcagcagcagcttcgagatctaccagtgctgcagagaggccttccagagcgtgaaccccgagttcagccccgaggccctggacaactgctgcagattctacaaccacaccatctgcgcccagtag

SEQ ID NO: 99783 - DNA, 528 bp, Artificial Sequence
  Description of Artificial Sequence: Synthetic coding sequence
atggagaacgaccccagcagaagaagagagagcatcagcctgacccccgtggccaagggcctggagaacatgggcgccgacttcctggagagcctggaggagggccagctgcccagaagcgacctgagccccgccgagatcagaagcagctggagcgaggccgcccccaagcccttcagcagatggagaaacctgcagcccgccctgagagccagaagcttctgcagagagcacatgcagctgttcagatggatcggcaccggcctgctgtgcaccggcctgagcgccttcctgctggtggcctgcctgctggacttccagagagccctggccctgttcgtgctgacctgcgtggtgctgaccttcctgggccacagactgctgaagagactgctgggccccaagctgagaagattcctgaagccccagggccaccccagactgctgctgtggttcaagagagaccccagaccctggagcaaggagggccccaaccagtacctgccccagatcacctggaccgtgtag

SEQ ID NO: 99784 - DNA, 1950 bp, Artificial Sequence; identical to SEQ ID NO: 99782
  Description of Artificial Sequence: Synthetic coding sequence

SEQ ID NO: 99785 - DNA, 1632 bp, Artificial Sequence
  Description of Artificial Sequence: Synthetic coding sequence
atggagaacgaccccagcagaagaagagagagcatcagcctgacccccgtggccaagggcctggagaacatgggcgccgacttcctggagagcctggaggagggccagctgcccagaagcgacctgagccccgccgagatcagaagcagctggagcgaggccgcccccaagcccttcagcagatggagaaacctgcagcccgccctgagagccagaagcttctgcagagagcacatgcagctgttcagatggatcggcaccggcctgctgtgcaccggcctgagcgccttcctgctggtggcctgcctgctggacttccagagagccctggccctgttcgtgctgacctgcgtggtgctgaccttcctgggccacagactgctgaagagactgctgggccccaagctgagaagattcctgaagccccagggccaccccagactgctgctgtggttcaagagaggcctggccctggccgccttcctgggcctggtgctgtggctgagcctggacaccagccagagacccgagcagctggtgagcttcgccggcatctgcgtgttcgtggccctgctgttcgcctgcagcaagcaccactgcgccgtgagctggagagccgtgagctggggcctgggcctgcagttcgtgctgggcctgctggtgatcagaaccgagcccggcttcatcgccttcgagtggctgggcgagcagatcagaatcttcctgagctacaccaaggccggcagcagcttcgtgttcggcgaggccctggtgaaggacgtgttcgccttccaggtgctgcccatcatcgtgttcttcagctgcgtgatcagcgtgctgtaccacgtgggcctgatgcagtgggtgatcctgaagatcgcctggctgatgcaggtgaccatgggcaccaccgccaccgagaccctgagcgtggccggcaacatcttcgtgagccagaccgaggcccccctgctgatcagaccctacctggccgacatgaccctgagcgaggtgcacgtggtgatgaccggcggctacgccaccatcgccggcagcctgctgggcgcctacatcagcttcggcatcgacgccaccagcctgatcgccgccagcgtgatggccgccccctgcgccctggccctgagcaagctggtgtaccccgaggtggaggagagcaagttcagaagagaggagggcgtgaagctgacctacggcgacgcccagaacctgatcgaggccgccagcaccggcgccgccatcagcgtgaaggtggtggccaacatcgccgccaacctgatcgccttcctggccgtgctggacttcatcaacgccgccctgagctggctgggcgacatggtggacatccagggcctgagcttccagctgatctgcagctacatcctgagacccgtggccttcctgatgggcgtggcctgggaggactgccccgtggtggccgagctgctgggcatcaagctgttcctgaacgagttcgtggcctaccaggacctgagcaagtacaagcagagaagactggccggcgccgaggagtgggtgggcgacagaaagcagtggatcagcagaagaggcctggccatgctgaccagactggtgctgaacagctggccctag

SEQ ID NO: 99786 - DNA, 1911 bp, Artificial Sequence
  Description of Artificial Sequence: Synthetic coding sequence
atggagaacgaccccagcagaagaagagagagcatcagcctgacccccgtggccaagggcctggagaacatgggcgccgacttcctggagagcctggaggagggccagctgcccagaagcgacctgagccccgccgagatcagaagcagctggagcgaggccgcccccaagcccttcagcagatggagaaacctgcagcccgccctgagagccagaagcttctgcagagagcacatgcagctgttcagatggatcggcaccggcctgctgtgcaccggcctgagcgccttcctgctggtggcctgcctgctggacttccagagagccctggccctgttcgtgctgacctgcgtggtgctgaccttcctgggccacagactgctgaagagactgctgggccccaagctgagaagattcctgaagccccagggccaccccagactgctgctgtggttcaagagaggcctggccctggccgccttcctgggcctggtgctgtggctgagcctggacaccagccagagacccgagcagctggtgagcttcgccggcatctgcgtgttcgtggccctgctgttcgcctgcagcaagcaccactgcgccgtgagctggagagccgtgagctggggcctgggcctgcagttcgtgctgggcctgctggtgatcagaaccgagcccggcttcatcgccttcgagtggctgggcgagcagatcagaatcttcctgagctacaccaaggccggcagcagcttcgtgttcggcgaggccctggtgaaggacgtgttcgccttccaggtgctgcccatcatcgtgttcttcagctgcgtgatcagcgtgctgtaccacgtgggcctgatgcagtgggtgatcctgaagatcgcctggctgatgcaggtgaccatgggcaccaccgccaccgagaccctgagcgtggccggcaacatcttcgtgagccagaccgaggcccccctgctgatcagaccctacctggccgacatgaccctgagcgaggtgcacgtggtgatgaccggcggctacgccaccatcgccggcagcctgctgggcgcctacatcagcttcggcatcgacgccaccagcctgatcgccgccagcgtgatggccgccccctgcgccctggccctgagcaagctggtgtaccccgaggtggaggagagcaagttcagaagagaggagggcgtgaagctgacctacggcgacgcccagaacctgatcgaggccgccagcaccggcgccgccatcagcgtgaaggtggtggccaacatcgccgccaacctgatcgccttcctggccgtgctggacttcatcaacgccgccctgagctggctgggcgacatggtggacatccagggcctgagcttccagctgatctgcagctacatcctgagacccgtggccttcctgatgggcgtggcctgggaggactgccccgtggtggccgagctgctgggcatcaagctgttcctgaacgagttcgtggcctaccaggacctgagcaagtacaagcagagaagactggccggcgccgaggagtgggtgggcgacagaaagcagtggatcagcgtgagagccgaggtgctgaccaccttcgccctgtgcggcttcgccaacttcagcagcatcggcatcatgctgggcggcctgaccagcatggtgccccagagaaagagcgacttcagccagatcgtgctgagagccctgttcaccggcgcctgcgtgagcctggtgaacgcctgcatggccggcatcctgtacatgcccagaggcgccgaggtggactgcatgagcctgctgaacaccaccctgagcagcagcagcttcgagatctaccagtgctgcagagaggccttccagagaatcttcaagagcacccccgccgagagccagccctag

SEQ ID NO: 99787 - DNA, 864 bp, Artificial Sequence
  Description of Artificial Sequence: Synthetic coding sequence
atgcagctgttcagatggatcggcaccggcctgctgtgcaccggcctgagcgccttcctgctggtggcctgcctgctggacttccagagagccctggccctgttcgtgctgacctgcgtggtgctgaccttcctgggccacagactgctgaagagactgctgggccccaagctgagaagattcctgaagccccagggccaccccagactgctgctgtggttcaagagaggcctggccctggccgccttcctgggcctggtgctgtggctgagcctggacaccagccagagacccgagcagctggtgagcttcgccggcatctgcgtgttcgtggccctgctgttcgcctgcagcaagcaccactgcgccgtgagctggagagccgtgagctggggcctgggcctgcagttcgtgctgggcctgctggtgatcagaaccgagcccggcttcatcgccttcgagtggctgggcgagcagatcagaatcttcctgagctacaccaaggccggcagcagcttcgtgttcggcgaggccctggtgaaggacgtgttcgccttccaggtgctgcccatcatcgtgttcttcagctgcgtgatcagcgtgctgtaccacgtgggcctgatgcagtgggtgatcctgaagatcgcctggctgatgcaggtgaccatgggcaccaccgccaccgagaccctgagcgtggccggcaacatcttcgtgagccagaccgaggcccccctgctgatcagaccctacctggccgacatgaccctgagcgaggtgcacgtggtgatgaccggcggctacgccaccatcgccggcagcctgctgggcgcctacatcagcttcggcctggagaagctgtag

SEQ ID NO: 99788 - DNA, 1452 bp, Artificial Sequence
  Description of Artificial Sequence: Synthetic coding sequence
atggagaacgaccccagcagaagaagagagagcatcagcctgacccccgtggccaagggcctggagaacatgggcgccgacttcctggagagcctggaggagggccagctgcccagaagcgacctgagccccgccgagatcagaagcagctggagcgaggccgcccccaagcccttcagcagatggagaaacctgcagcccgccctgagagccagaagcttctgcagagagcacatgcagctgttcagatggatcggcaccggcctgctgtgcaccggcctgagcgccttcctgctggtggcctgcctgctggacttccagagagccctggccctgttcgtgctgacctgcgtggtgctgaccttcctgggccacagactgctgaagagactgctgggccccaagctgagaagattcctgaagccccagggccaccccagactgctgctgtggttcaagagaggcctggccctggccgccttcctgggcctggtgctgtggctgagcctggacaccagccagagacccgagcagctggtgagcttcgccggcatctgcgtgttcgtggccctgctgttcgcctgcagcaagcaccactgcgccgtgagctggagagccgtgagctggggcctgggcctgcagttcgtgctgggcctgctggtgatcagaaccgagcccggcttcatcgccttcgagtggctgggcgagcagatcagaatcttcctgagctacaccaaggccggcagcagcttcgtgttcggcgaggccctggtgaaggacgtgttcgccttccaggtgctgcccatcatcgtgttcttcagctgcgtgatcagcgtgctgtaccacgtgggcctgatgcagtgggtgatcctgaagatcgcctggctgatgcaggtgaccatgggcaccaccgccaccgagaccctgagcgtggccggcaacatcttcgtgagccagaccgaggcccccctgctgatcagaccctacctggccgacatgaccctgagcgaggtgcacgtggtgatgaccggcggctacgccaccatcgccggcagcctgctgggcgcctacatcagcttcggcgtgagagccgaggtgctgaccaccttcgccctgtgcggcttcgccaacttcagcagcatcggcatcatgctgggcggcctgaccagcatggtgccccagagaaagagcgacttcagccagatcgtgctgagagccctgttcaccggcgcctgcgtgagcctggtgaacgcctgcatggccggcatcctgtacatgcccagaggcgccgaggtggactgcatgagcctgctgaacaccaccctgagcagcagcagcttcgagatctaccagtgctgcagagaggccttccagagcgtgaaccccgagttcagccccgaggccctggacaactgctgcagattctacaaccacaccatctgcgcccagtag

SEQ ID NO: 99789 - DNA, 1977 bp, Artificial Sequence
  Description of Artificial Sequence: Synthetic coding sequence
atggagaaggccagcggcagacagagcatcgccctgagcaccgtggagaccggcaccgtgaaccccggcctggagctgatggagaaggaggtggagcccgagggcagcaagagaaccgacgcccagggccacagcctgggcgacggcctgggccccagcacctaccagagaagaagcagatggcccttcagcaaggccagaagcttctgcaagacccacgccagcctgttcaagaagatcctgctgggcctgctgtgcctggcctacgccgcctacctgctggccgcctgcatcctgaacttccagagagccctggccctgttcgtgatcacctgcctggtgatcttcgtgctggtgcacagcttcctgaagaagctgctgggcaagaagctgaccagatgcctgaagcccttcgagaacagcagactgagactgtggaccaagtgggtgttcgccggcgtgagcctggtgggcctgatcctgtggctggccctggacaccgcccagagacccgagcagctgatccccttcgccggcatctgcatgttcatcctgatcctgttcgcctgcagcaagcaccacagcgccgtgagctggagaaccgtgttcagcggcctgggcctgcagttcgtgttcggcatcctggtgatcagaaccgacctgggctacaccgtgttccagtggctgggcgagcaggtgcagatcttcctgaactacaccgtggccggcagcagcttcgtgttcggcgacaccctggtgaaggacgtgttcgccttccaggccctgcccatcatcatcttcttcggctgcgtggtgagcatcctgtactacctgggcctggtgcagtgggtggtgcagaaggtggcctggttcctgcagatcaccatgggcaccaccgccaccgagaccctggccgtggccggcaacatcttcgtgggcatgaccgaggcccccctgctgatcagaccctacctgggcgacatgaccctgagcgagatccacgccgtgatgaccggcggcttcgccaccatcagcggcaccgtgctgggcgccttcatcgccttcggcgtggacgccagcagcctgatcagcgccagcgtgatggccgccccctgcgccctggccagcagcaagctggcctaccccgaggtggaggagagcaagttcaagagcgaggagggcgtgaagctgcccagaggcaaggagagaaacgtgctggaggccgccagcaacggcgccgtggacgccatcggcctggccaccaacgtggccgccaacctgatcgccttcctggccgtgctggccttcatcaacgccgccctgagctggctgggcgagctggtggacatccagggcctgaccttccaggtgatctgcagctacctgctgagacccatggtgttcatgatgggcgtggagtggaccgactgccccatggtggccgagatggtgggcatcaagttcttcatcaacgagttcgtggcctaccagcagctgagccagtacaagaacaagagactgagcggcatggaggagtggatcgagggcgagaagcagtggatcagcgtgagagccgagatcatcaccaccttcagcctgtgcggcttcgccaacctgagcagcatcggcatcaccctgggcggcctgaccagcatcgtgccccacagaaagagcgacctgagcaaggtggtggtgagagccctgttcaccggcgcctgcgtgagcctgatcagcgcctgcatggccggcatcctgtacgtgcccagaggcgccgaggccgactgcgtgagcttccccaacaccagcttcaccaacagaacctacgagacctacatgtgctgcagaggcctgttccagagcaccagcctgaacggcaccaacccccccagcttcagcggcccctgggaggacaaggagttcagcgccatggccctgaccaactgctgcggcttctacaacaacaccgtgtgcgcctag

SEQ ID NO: 99790 - DNA, 2076 bp, Artificial Sequence
  Description of Artificial Sequence: Synthetic coding sequence
atggagctgagaagcaccgccgcccccagagccgagggctacagcaacgtgggcttccagaacgaggagaacttcctggagaacgagaacaccagcggcaacaacagcatcagaagcagagccgtgcagagcagagagcacaccaacaccaagcaggacgaggagcaggtgaccgtggagcaggacagccccagaaacagagagcacatggaggacgacgacgaggagatgcagcagaagggctgcctggagagaagatacgacaccgtgtgcggcttctgcagaaagcacaagaccaccctgagacacatcatctggggcatcctgctggccggctacctggtgatggtgatcagcgcctgcgtgctgaacttccacagagccctgcccctgttcgtgatcaccgtggccgccatcttcttcgtggtgtgggaccacctgatggccaagtacgagcacagaatcgacgagatgctgagccccggcagaagactgctgaacagccactggttctggctgaagtgggtgatctggagcagcctggtgctggccgtgatcttctggctggccttcgacaccgccaagctgggccagcagcagctggtgagcttcggcggcctgatcatgtacatcgtgctgctgttcctgttcagcaagtaccccaccagagtgtactggagacccgtgctgtggggcatcggcctgcagttcctgctgggcctgctgatcctgagaaccgaccccggcttcatcgccttcgactggctgggcagacaggtgcagaccttcctggagtacaccgacgccggcgccagcttcgtgttcggcgagaagtacaaggaccacttcttcgccttcaaggtgctgcccatcgtggtgttcttcagcaccgtgatgagcatgctgtactacctgggcctgatgcagtggatcatcagaaaggtgggctggatcatgctggtgaccaccggcagcagccccatcgagagcgtggtggccagcggcaacatcttcgtgggccagaccgagagccccctgctggtgagaccctacctgccctacatcaccaagagcgagctgcacgccatcatgaccgccggcttcagcaccatcgccggcagcgtgctgggcgcctacatcagcttcggcgtgcccagcagccacctgctgaccgccagcgtgatgagcgcccccgccagcctggccgccgccaagctgttctggcccgagaccgagaagcccaagatcaccctgaagaacgccatgaagatggagagcggcgacagcggcaacctgctggaggccgccacccagggcgccagcagcagcatcagcctggtggccaacatcgccgtgaacctgatcgccttcctggccctgctgagcttcatgaacagcgccctgagctggttcggcaacatgttcgactacccccagctgagcttcgagctgatctgcagctacatcttcatgcccttcagcttcatgatgggcgtggagtggcaggacagcttcatggtggccagactgatcggctacaagaccttcttcaacgagttcgtggcctacgagcacctgagcaagtggatccacctgagaaaggagggcggccccaagttcgtgaacggcgtgcagcagtacatcagcatcagaagcgagatcatcgccacctacgccctgtgcggcttcgccaacatcggcagcctgggcatcgtgatcggcggcctgaccagcatggcccccagcagaaagagagacatcgccagcggcgccgtgagagccctgatcgccggcaccgtggcctgcttcatgaccgcctgcatcgccggcatcctgagcagcacccccgtggacatcaactgccaccacgtgctggagaacgccttcaacagcaccttccccggcaacaccaccaaggtgatcgcctgctgccagagcctgctgagcagcaccgtggccaagggccccggcgaggtgatccccggcggcaaccacagcctgtacagcctgaagggctgctgcaccctgctgaaccccagcaccttcaactgcaacggcatcagcaacaccttctag

SEQ ID NO: 99791 - DNA, 1869 bp, Artificial Sequence
  Description of Artificial Sequence: Synthetic coding sequence
atggaggacgacgacgaggagatgcagcagaagggctgcctggagagaagatacgacaccgtgtgcggcttctgcagaaagcacaagaccaccctgagacacatcatctggggcatcctgctggccggctacctggtgatggtgatcagcgcctgcgtgctgaacttccacagagccctgcccctgttcgtgatcaccgtggccgccatcttcttcgtggtgtgggaccacctgatggccaagtacgagcacagaatcgacgagatgctgagccccggcagaagactgctgaacagccactggttctggctgaagtgggtgatctggagcagcctggtgctggccgtgatcttctggctggccttcgacaccgccaagctgggccagcagcagctggtgagcttcggcggcctgatcatgtacatcgtgctgctgttcctgttcagcaagtaccccaccagagtgtactggagacccgtgctgtggggcatcggcctgcagttcctgctgggcctgctgatcctgagaaccgaccccggcttcatcgccttcgactggctgggcagacaggtgcagaccttcctggagtacaccgacgccggcgccagcttcgtgttcggcgagaagtacaaggaccacttcttcgccttcaaggtgctgcccatcgtggtgttcttcagcaccgtgatgagcatgctgtactacctgggcctgatgcagtggatcatcagaaaggtgggctggatcatgctggtgaccaccggcagcagccccatcgagagcgtggtggccagcggcaacatcttcgtgggccagaccgagagccccctgctggtgagaccctacctgccctacatcaccaagagcgagctgcacgccatcatgaccgccggcttcagcaccatcgccggcagcgtgctgggcgcctacatcagcttcggcgtgcccagcagccacctgctgaccgccagcgtgatgagcgcccccgccagcctggccgccgccaagctgttctggcccgagaccgagaagcccaagatcaccctgaagaacgccatgaagatggagagcggcgacagcggcaacctgctggaggccgccacccagggcgccagcagcagcatcagcctggtggccaacatcgccgtgaacctgatcgccttcctggccctgctgagcttcatgaacagcgccctgagctggttcggcaacatgttcgactacccccagctgagcttcgagctgatctgcagctacatcttcatgcccttcagcttcatgatgggcgtggagtggcaggacagcttcatggtggccagactgatcggctacaagaccttcttcaacgagttcgtggcctacgagcacctgagcaagtggatccacctgagaaaggagggcggccccaagttcgtgaacggcgtgcagcagtacatcagcatcagaagcgagatcatcgccacctacgccctgtgcggcttcgccaacatcggcagcctgggcatcgtgatcggcggcctgaccagcatggcccccagcagaaagagagacatcgccagcggcgccgtgagagccctgatcgccggcaccgtggcctgcttcatgaccgcctgcatcgccggcatcctgagcagcacccccgtggacatcaactgccaccacgtgctggagaacgccttcaacagcaccttccccggcaacaccaccaaggtgatcgcctgctgccagagcctgctgagcagcaccgtggccaagggccccggcgaggtgatccccggcggcaaccacagcctgtacagcctgaagggctgctgcaccctgctgaaccccagcaccttcaactgcaacggcatcagcaacaccttctag

SEQ ID NO: 99792 - DNA, 1608 bp, Artificial Sequence
  Description of Artificial Sequence: Synthetic coding sequence
atgagaagagagagaaccagaggcccccaggcctgggagttccccagccccaccaagagcggctgcagcctgcagagcctgagcagagacctgagagagctgagagagggcgagaagcccgaggaccaggccgagaccgaggagagctggcagggcctggccagaaagacccccggcaaggcctgcgcccccgagggcggcagctgccagcccggcaagaccgagaacaccatcaccatgaccaccagccaccagccccaggacagatacaaggccgtgtggctgatcttcttcatgctgggcctgggcaccctgctgccctggaacttcttcatgaccgccacccagtacttcaccaacagactggacatgagccagaacgtgagcctggtgaccgccgagctgagcaaggacgcccaggccagcgccgcccccgccgcccccctgcccgagagaaacagcctgagcgccatcttcaacaacgtgatgaccctgtgcgccatgctgcccctgctgctgttcacctacctgaacagcttcctgcaccagagaatcccccagagcgtgagaatcctgggcagcctggtggccatcctgctggtgttcctgatcaccgccatcctggtgaaggtgcagctggacgccctgcccttcttcgtgatcaccatgatcaagatcgtgctgatcaacagcttcggcgccatcctgcagggcagcctgttcggcctggccggcctgctgcccgccagctacaccgcccccatcatgagcggccagggcctggccggcttcttcgccagcgtggccatgatctgcgccatcgccagcggcagcgagctgagcgagagcgccttcggctacttcatcaccgcctgcgccgtgatcatcctgaccatcatctgctacctgggcctgcccagactggagttctacagatactaccagcagctgaagctggagggccccggcgagcaggagaccaagctggacctgatcagcaagggcgaggagcccagagccggcaaggaggagagcggcgtgagcgtgagcaacagccagcccaccaacgagagccacagcatcaaggccatcctgaagaacatcagcgtgctggccttcagcgtgtgcttcatcttcaccatcaccatcggcatgttccccgccgtgaccgtggaggtgaagagcagcatcgccggcagcagcacctgggagagatacttcatccccgtgagctgcttcctgaccttcaacatcttcgactggctgggcagaagcctgaccgccgtgttcatgtggcccggcaaggacagcagatggctgcccagcctggtgctggccagactggtgttcgtgcccctgctgctgctgtgcaacatcaagcccagaagatacctgaccgtggtgttcgagcacgacgcctggttcatcttcttcatggccgccttcgccttcagcaacggctacctggccagcctgtgcatgtgcttcggccccaagaaggtgaagcccgccgaggccgagaccgccggcgccatcatggccttcttcctgtgcctgggcctggccctgggcgccgtgttcagcttcctgttcagagccatcgtgtag

SEQ ID NO: 99793 - DNA, 1371 bp, Artificial Sequence
  Description of Artificial Sequence: Synthetic coding sequence
atgaccaccagccaccagccccaggacagatacaaggccgtgtggctgatcttcttcatgctgggcctgggcaccctgctgccctggaacttcttcatgaccgccacccagtacttcaccaacagactggacatgagccagaacgtgagcctggtgaccgccgagctgagcaaggacgcccaggccagcgccgcccccgccgcccccctgcccgagagaaacagcctgagcgccatcttcaacaacgtgatgaccctgtgcgccatgctgcccctgctgctgttcacctacctgaacagcttcctgcaccagagaatcccccagagcgtgagaatcctgggcagcctggtggccatcctgctggtgttcctgatcaccgccatcctggtgaaggtgcagctggacgccctgcccttcttcgtgatcaccatgatcaagatcgtgctgatcaacagcttcggcgccatcctgcagggcagcctgttcggcctggccggcctgctgcccgccagctacaccgcccccatcatgagcggccagggcctggccggcttcttcgccagcgtggccatgatctgcgccatcgccagcggcagcgagctgagcgagagcgccttcggctacttcatcaccgcctgcgccgtgatcatcctgaccatcatctgctacctgggcctgcccagactggagttctacagatactaccagcagctgaagctggagggccccggcgagcaggagaccaagctggacctgatcagcaagggcgaggagcccagagccggcaaggaggagagcggcgtgagcgtgagcaacagccagcccaccaacgagagccacagcatcaaggccatcctgaagaacatcagcgtgctggccttcagcgtgtgcttcatcttcaccatcaccatcggcatgttccccgccgtgaccgtggaggtgaagagcagcatcgccggcagcagcacctgggagagatacttcatccccgtgagctgcttcctgaccttcaacatcttcgactggctgggcagaagcctgaccgccgtgttcatgtggcccggcaaggacagcagatggctgcccagcctggtgctggccagactggtgttcgtgcccctgctgctgctgtgcaacatcaagcccagaagatacctgaccgtggtgttcgagcacgacgcctggttcatcttcttcatggccgccttcgccttcagcaacggctacctggccagcctgtgcatgtgcttcggccccaagaaggtgaagcccgccgaggccgagaccgccggcgccatcatggccttcttcctgtgcctgggcctggccctgggcgccgtgttcagcttcctgttcagagccatcgtgtag

SEQ ID NO: 99794 - DNA, 1371 bp, Artificial Sequence; identical to SEQ ID NO: 99793
  Description of Artificial Sequence: Synthetic coding sequence

SEQ ID NO: 99795 - DNA, 1371 bp, Artificial Sequence; identical to SEQ ID NO: 99793
  Description of Artificial Sequence: Synthetic coding sequence

SEQ ID NO: 99796 - DNA, 1371 bp, Artificial Sequence; identical to SEQ ID NO: 99793
  Description of Artificial Sequence: Synthetic coding sequence

SEQ ID NO: 99797 - DNA, 1371 bp, Artificial Sequence; identical to SEQ ID NO: 99793
  Description of Artificial Sequence: Synthetic coding sequence

SEQ ID NO: 99798 - DNA, 1371 bp, Artificial Sequence; identical to SEQ ID NO: 99793
  Description of Artificial Sequence: Synthetic coding sequence

SEQ ID NO: 99799 - DNA, 1371 bp, Artificial Sequence; identical to SEQ ID NO: 99793
  Description of Artificial Sequence: Synthetic coding sequence

SEQ ID NO: 99800 - DNA, 1371 bp, Artificial Sequence; identical to SEQ ID NO: 99793
  Description of Artificial Sequence: Synthetic coding sequence

SEQ ID NO: 99801 - DNA, 1371 bp, Artificial Sequence; identical to SEQ ID NO: 99793
  Description of Artificial Sequence: Synthetic coding sequence

SEQ ID NO: 99802 - DNA, 510 bp, Artificial Sequence
  Description of Artificial Sequence: Synthetic coding sequence
atgagaagagagagaaccagaggcccccaggcctgggagttccccagccccaccaagagcggctgcagcctgcagagcctgagcagatacaaggccgtgtggctgatcttcttcatgctgggcctgggcaccctgctgccctggaacttcttcatgaccgccacccagtacttcaccaacagactggacatgagccagaacgtgagcctggtgaccgccgagctgagcaaggacgcccaggccagcgccgcccccgccgcccccctgcccgagagaaacagcctgagcgccatcttcaacaacgtgatgaccctgtgcgccatgctgcccctgctgctgttcacctacctgaacagcttcctgcaccagagaatcccccagagcgtgagaatcctgggcagcctggtggccatcctgctggtgttcctgatcaccgccatcctggtgaaggtgcagctggacgccctgcccttcttcgtgatcaccatgatcaagatcgtgctgatctag

SEQ ID NO: 99803 - DNA, 1371 bp, Artificial Sequence
  Description of Artificial Sequence: Synthetic coding sequence
atggccagaggcgacgcccccagagacagctaccacctggtgggcatcagcttcttcatcctgggcctgggcaccctgctgccctggaacttcttcatcaccgccatcccctacttccaggccagactggccggcgccggcaacagcaccgccagaatcctgagcaccaaccacaccggccccgaggacgccttcaacttcaacaactgggtgaccctgctgagccagctgcccctgctgctgttcaccctgctgaacagcttcctgtaccagtgcgtgcccgagaccgtgagaatcctgggcagcctgctggccatcctgctgctgttcgccctgaccgccgccctggtgaaggtggacatgagccccggccccttcttcagcatcaccatggccagcgtgtgcttcatcaacagcttcagcgccgtgctgcagggcagcctgttcggccagctgggcaccatgcccagcacctacagcaccctgttcctgagcggccagggcctggccggcatcttcgccgccctggccatgctgctgagcatggccagcggcgtggacgccgagaccagcgccctgggctacttcatcaccccctgcgtgggcatcctgatgagcatcgtgtgctacctgagcctgccccacctgaagttcgccagatactacctggccaacaagagcagccaggcccaggcccaggagctggagaccaaggccgagctgctgcagagcgacgagaacggcatccccagcagcccccagaaggtggccctgaccctggacctggacctggagaaggagcccgagagcgagcccgacgagccccagaagcccggcaagcccagcgtgttcaccgtgttccagaagatctggctgaccgccctgtgcctggtgctggtgttcaccgtgaccctgagcgtgttccccgccatcaccgccatggtgaccagcagcaccagccccggcaagtggagccagttcttcaaccccatctgctgcttcctgctgttcaacatcatggactggctgggcagaagcctgaccagctacttcctgtggcccgacgaggacagcagactgctgcccctgctggtgtgcctgagattcctgttcgtgcccctgttcatgctgtgccacgtgccccagagaagcagactgcccatcctgttcccccaggacgcctacttcatcaccttcatgctgctgttcgccgtgagcaacggctacctggtgagcctgaccatgtgcctggcccccagacaggtgctgccccacgagagagaggtggccggcgccctgatgaccttcttcctggccctgggcctgagctgcggcgccagcctgagcttcctgttcaaggccctgctgtag

SEQ ID NO: 99804 - DNA, 1371 bp, Artificial Sequence; identical to SEQ ID NO: 99803
  Description of Artificial Sequence: Synthetic coding sequence

SEQ ID NO: 99805 - DNA, 1371 bp, Artificial Sequence; identical to SEQ ID NO: 99803
  Description of Artificial Sequence: Synthetic coding sequence

SEQ ID NO: 99806 - DNA, 1428 bp, Artificial Sequence
  Description of Artificial Sequence: Synthetic coding sequence
atggccgtggtgagcgaggacgacttccagcacagcagcaacagcacctacagaaccaccagcagcagcctgagagccgaccaggaggccctgctggagaagctgctggacagacccccccccggcctgcagagacccgaggacagattctgcggcacctacatcatcttcttcagcctgggcatcggcagcctgctgccctggaacttcttcatcaccgccaaggagtactggatgttcaagctgagaaacagcagcagccccgccaccggcgaggaccccgagggcagcgacatcctgaactacttcgagagctacctggccgtggccagcaccgtgcccagcatgctgtgcctggtggccaacttcctgctggtgaacagagtggccgtgcacatcagagtgctggccagcctgaccgtgatcctggccatcttcatggtgatcaccgccctggtgaaggtggacaccagcagctggaccagaggcttcttcgccgtgaccatcgtgtgcatggtgatcctgagcggcgccagcaccgtgttcagcagcagcatctacggcatgaccggcagcttccccatgagaaacagccaggccctgatcagcggcggcgccatgggcggcaccgtgagcgccgtggccagcctggtggacctggccgccagcagcgacgtgagaaacagcgccctggccttcttcctgaccgccaccgtgttcctggtgctgtgcatgggcctgtacctgctgctgagcagactggagtacgccagatactacatgagacccgtgctggccgcccacgtgttcagcggcgaggaggagctgccccaggacagcctgagcgcccccagcgtggccagcagattcatcgacagccacaccccccccctgagacccatcctgaagaagaccgccagcctgggcttctgcgtgacctacgtgttcttcatcaccagcctgatctaccccgccatctgcaccaacatcgagagcctgaacaagggcagcggcagcctgtggaccaccaagttcttcatccccctgaccaccttcctgctgtacaacttcgccgacctgtgcggcagacagctgaccgcctggatccaggtgcccggccccaacagcaaggccctgcccggcttcgtgctgctgagaacctgcctgatccccctgttcgtgctgtgcaactaccagcccagagtgcacctgaagaccgtggtgttccagagcgacgtgtaccccgccctgctgagcagcctgctgggcctgagcaacggctacctgagcaccctggccctgctgtacggccccaagatcgtgcccagagagctggccgaggccaccggcgtggtgatgagcttctacgtgtgcctgggcctgaccctgggcagcgcctgcagcaccctgctggtgcacctgatctag

SEQ ID NO: 99807 - DNA, 1590 bp, Artificial Sequence
  Description of Artificial Sequence: Synthetic coding sequence
atgagccaggacaccgaggtggacatgaaggaggtggagctgaacgagctggagcccgagaagcagcccatgaacgccgccagcggcgccgccatgagcctggccggcgccgagaagaacggcctggtgaagatcaaggtggccgaggacgaggccgaggccgccgccgccgccaagttcaccggcctgagcaaggaggagctgctgaaggtggccggcagccccggctgggtgagaaccagatgggccctgctgctgctgttctggctgggctggctgggcatgctggccggcgccgtggtgatcatcgtgagagcccccagatgcagagagctgcccgcccagaagtggtggcacaccggcgccctgtacagaatcggcgacctgcaggccttccagggccacggcgccggcaacctggccggcctgaagggcagactggactacctgagcagcctgaaggtgaagggcctggtgctgggccccatccacaagaaccagaaggacgacgtggcccagaccgacctgctgcagatcgaccccaacttcggcagcaaggaggacttcgacagcctgctgcagagcgccaagaagaagagcatcagagtgatcctggacctgacccccaactacagaggcgagaacagctggttcagcacccaggtggacaccgtggccaccaaggtgaaggacgccctggagttctggctgcaggccggcgtggacggcttccaggtgagagacatcgagaacctgaaggacgccagcagcttcctggccgagtggcagaacatcaccaagggcttcagcgaggacagactgctgatcgccggcaccaacagcagcgacctgcagcagatcctgagcctgctggagagcaacaaggacctgctgctgaccagcagctacctgagcgacagcggcagcaccggcgagcacaccaagagcctggtgacccagtacctgaacgccaccggcaacagatggtgcagctggagcctgagccaggccagactgctgaccagcttcctgcccgcccagctgctgagactgtaccagctgatgctgttcaccctgcccggcacccccgtgttcagctacggcgacgagatcggcctggacgccgccgccctgcccggccagcccatggaggcccccgtgatgctgtgggacgagagcagcttccccgacatccccggcgccgtgagcgccaacatgaccgtgaagggccagagcgaggaccccggcagcctgctgagcctgttcagaagactgagcgaccagagaagcaaggagagaagcctgctgcacggcgacttccacgccttcagcgccggccccggcctgttcagctacatcagacactgggaccagaacgagagattcctggtggtgctgaacttcggcgacgtgggcctgagcgccggcctgcaggccagcgacctgcccgccagcgccagcctgcccgccaaggccgacctgctgctgagcacccagcccggcagagaggagggcagccccctggagctggagagactgaagctggagccccacgagggcctgctgctgagattcccctacgccgcctag

SEQ ID NO: 99808 - DNA, 1707 bp, Artificial Sequence
  Description of Artificial Sequence: Synthetic coding sequence
atggagctgcagccccccgaggccagcatcgccgtggtgagcatccccagacagctgcccggcagccacagcgaggccggcgtgcagggcctgagcgccggcgacgacagcggcaccatgagccaggacaccgaggtggacatgaaggaggtggagctgaacgagctggagcccgagaagcagcccatgaacgccgccagcggcgccgccatgagcctggccggcgccgagaagaacggcctggtgaagatcaaggtggccgaggacgaggccgaggccgccgccgccgccaagttcaccggcctgagcaaggaggagctgctgaaggtggccggcagccccggctgggtgagaaccagatgggccctgctgctgctgttctggctgggctggctgggcatgctggccggcgccgtggtgatcatcgtgagagcccccagatgcagagagctgcccgcccagaagtggtggcacaccggcgccctgtacagaatcggcgacctgcaggccttccagggccacggcgccggcaacctggccggcctgaagggcagactggactacctgagcagcctgaaggtgaagggcctggtgctgggccccatccacaagaaccagaaggacgacgtggcccagaccgacctgctgcagatcgaccccaacttcggcagcaaggaggacttcgacagcctgctgcagagcgccaagaagaagagcatcagagtgatcctggacctgacccccaactacagaggcgagaacagctggttcagcacccaggtggacaccgtggccaccaaggtgaaggacgccctggagttctggctgcaggccggcgtggacggcttccaggtgagagacatcgagaacctgaaggacgccagcagcttcctggccgagtggcagaacatcaccaagggcttcagcgaggacagactgctgatcgccggcaccaacagcagcgacctgcagcagatcctgagcctgctggagagcaacaaggacctgctgctgaccagcagctacctgagcgacagcggcagcaccggcgagcacaccaagagcctggtgacccagtacctgaacgccaccggcaacagatggtgcagctggagcctgagccaggccagactgctgaccagcttcctgcccgcccagctgctgagactgtaccagctgatgctgttcaccctgcccggcacccccgtgttcagctacggcgacgagatcggcctggacgccgccgccctgcccggccagcccatggaggcccccgtgatgctgtgggacgagagcagcttccccgacatccccggcgccgtgagcgccaacatgaccgtgaagggccagagcgaggaccccggcagcctgctgagcctgttcagaagactgagcgaccagagaagcaaggagagaagcctgctgcacggcgacttccacgccttcagcgccggccccggcctgttcagctacatcagacactgggaccagaacgagagattcctggtggtgctgaacttcggcgacgtgggcctgagcgccggcctgcaggccagcgacctgcccgccagcgccagcctgcccgccaaggccgacctgctgctgagcacccagcccggcagagaggagggcagccccctggagctggagagactgaagctggagccccacgagggcctgctgctgagattcccctacgccgcctag

SEQ ID NO: 99809 - DNA, 1893 bp, Artificial Sequence
  Description of Artificial Sequence: Synthetic coding sequence
atggagctgcagccccccgaggccagcatcgccgtggtgagcatccccagacagctgcccggcagccacagcgaggccggcgtgcagggcctgagcgccggcgacgacagcgagctgggcagccactgcgtggcccagaccggcctggagctgctggccagcggcgaccccctgcccagcgccagccagaacgccgagatgatcgagaccggcagcgactgcgtgacccaggccggcctgcagctgctggccagcagcgacccccccgccctggccagcaagaacgccgaggtgaccggcaccatgagccaggacaccgaggtggacatgaaggaggtggagctgaacgagctggagcccgagaagcagcccatgaacgccgccagcggcgccgccatgagcctggccggcgccgagaagaacggcctggtgaagatcaaggtggccgaggacgaggccgaggccgccgccgccgccaagttcaccggcctgagcaaggaggagctgctgaaggtggccggcagccccggctgggtgagaaccagatgggccctgctgctgctgttctggctgggctggctgggcatgctggccggcgccgtggtgatcatcgtgagagcccccagatgcagagagctgcccgcccagaagtggtggcacaccggcgccctgtacagaatcggcgacctgcaggccttccagggccacggcgccggcaacctggccggcctgaagggcagactggactacctgagcagcctgaaggtgaagggcctggtgctgggccccatccacaagaaccagaaggacgacgtggcccagaccgacctgctgcagatcgaccccaacttcggcagcaaggaggacttcgacagcctgctgcagagcgccaagaagaagagcatcagagtgatcctggacctgacccccaactacagaggcgagaacagctggttcagcacccaggtggacaccgtggccaccaaggtgaaggacgccctggagttctggctgcaggccggcgtggacggcttccaggtgagagacatcgagaacctgaaggacgccagcagcttcctggccgagtggcagaacatcaccaagggcttcagcgaggacagactgctgatcgccggcaccaacagcagcgacctgcagcagatcctgagcctgctggagagcaacaaggacctgctgctgaccagcagctacctgagcgacagcggcagcaccggcgagcacaccaagagcctggtgacccagtacctgaacgccaccggcaacagatggtgcagctggagcctgagccaggccagactgctgaccagcttcctgcccgcccagctgctgagactgtaccagctgatgctgttcaccctgcccggcacccccgtgttcagctacggcgacgagatcggcctggacgccgccgccctgcccggccagcccatggaggcccccgtgatgctgtgggacgagagcagcttccccgacatccccggcgccgtgagcgccaacatgaccgtgaagggccagagcgaggaccccggcagcctgctgagcctgttcagaagactgagcgaccagagaagcaaggagagaagcctgctgcacggcgacttccacgccttcagcgccggccccggcctgttcagctacatcagacactgggaccagaacgagagattcctggtggtgctgaacttcggcgacgtgggcctgagcgccggcctgcaggccagcgacctgcccgccagcgccagcctgcccgccaaggccgacctgctgctgagcacccagcccggcagagaggagggcagccccctggagctggagagactgaagctggagccccacgagggcctgctgctgagattcccctacgccgcctag

SEQ ID NO: 99810 - DNA, 1896 bp, Artificial Sequence
  Description of Artificial Sequence: Synthetic coding sequence
atggagctgcagccccccgaggccagcatcgccgtggtgagcatccccagacagctgcccggcagccacagcgaggccggcgtgcagggcctgagcgccggcgacgacagcgagaccggcagcgactgcgtgacccaggccggcctgcagctgctggccagcagcgacccccccgccctggccagcaagaacgccgaggtgaccgtggagaccggcttccaccacgtgagccaggccgacatcgagttcctgaccagcatcgaccccaccgccagcgccagcggcagcgccggcatcaccggcaccatgagccaggacaccgaggtggacatgaaggaggtggagctgaacgagctggagcccgagaagcagcccatgaacgccgccagcggcgccgccatgagcctggccggcgccgagaagaacggcctggtgaagatcaaggtggccgaggacgaggccgaggccgccgccgccgccaagttcaccggcctgagcaaggaggagctgctgaaggtggccggcagccccggctgggtgagaaccagatgggccctgctgctgctgttctggctgggctggctgggcatgctggccggcgccgtggtgatcatcgtgagagcccccagatgcagagagctgcccgcccagaagtggtggcacaccggcgccctgtacagaatcggcgacctgcaggccttccagggccacggcgccggcaacctggccggcctgaagggcagactggactacctgagcagcctgaaggtgaagggcctggtgctgggccccatccacaagaaccagaaggacgacgtggcccagaccgacctgctgcagatcgaccccaacttcggcagcaaggaggacttcgacagcctgctgcagagcgccaagaagaagagcatcagagtgatcctggacctgacccccaactacagaggcgagaacagctggttcagcacccaggtggacaccgtggccaccaaggtgaaggacgccctggagttctggctgcaggccggcgtggacggcttccaggtgagagacatcgagaacctgaaggacgccagcagcttcctggccgagtggcagaacatcaccaagggcttcagcgaggacagactgctgatcgccggcaccaacagcagcgacctgcagcagatcctgagcctgctggagagcaacaaggacctgctgctgaccagcagctacctgagcgacagcggcagcaccggcgagcacaccaagagcctggtgacccagtacctgaacgccaccggcaacagatggtgcagctggagcctgagccaggccagactgctgaccagcttcctgcccgcccagctgctgagactgtaccagctgatgctgttcaccctgcccggcacccccgtgttcagctacggcgacgagatcggcctggacgccgccgccctgcccggccagcccatggaggcccccgtgatgctgtgggacgagagcagcttccccgacatccccggcgccgtgagcgccaacatgaccgtgaagggccagagcgaggaccccggcagcctgctgagcctgttcagaagactgagcgaccagagaagcaaggagagaagcctgctgcacggcgacttccacgccttcagcgccggccccggcctgttcagctacatcagacactgggaccagaacgagagattcctggtggtgctgaacttcggcgacgtgggcctgagcgccggcctgcaggccagcgacctgcccgccagcgccagcctgcccgccaaggccgacctgctgctgagcacccagcccggcagagaggagggcagccccctggagctggagagactgaagctggagccccacgagggcctgctgctgagattcccctacgccgcctag

SEQ ID NO: 99811 - DNA, 1986 bp, Artificial Sequence
  Description of Artificial Sequence: Synthetic coding sequence
atggagctgcagccccccgaggccagcatcgccgtggtgagcatccccagacagctgcccggcagccacagcgaggccggcgtgcagggcctgagcgccggcgacgacagcgagctgggcagccactgcgtggcccagaccggcctggagctgctggccagcggcgaccccctgcccagcgccagccagaacgccgagatgatcgagaccggcagcgactgcgtgacccaggccggcctgcagctgctggccagcagcgacccccccgccctggccagcaagaacgccgaggtgaccgagaccggcttccaccacgtgagccaggccgacatcgagttcctgaccagcatcgaccccaccgccagcgccagcggcagcgccggcatcaccggcaccatgagccaggacaccgaggtggacatgaaggaggtggagctgaacgagctggagcccgagaagcagcccatgaacgccgccagcggcgccgccatgagcctggccggcgccgagaagaacggcctggtgaagatcaaggtggccgaggacgaggccgaggccgccgccgccgccaagttcaccggcctgagcaaggaggagctgctgaaggtggccggcagccccggctgggtgagaaccagatgggccctgctgctgctgttctggctgggctggctgggcatgctggccggcgccgtggtgatcatcgtgagagcccccagatgcagagagctgcccgcccagaagtggtggcacaccggcgccctgtacagaatcggcgacctgcaggccttccagggccacggcgccggcaacctggccggcctgaagggcagactggactacctgagcagcctgaaggtgaagggcctggtgctgggccccatccacaagaaccagaaggacgacgtggcccagaccgacctgctgcagatcgaccccaacttcggcagcaaggaggacttcgacagcctgctgcagagcgccaagaagaagagcatcagagtgatcctggacctgacccccaactacagaggcgagaacagctggttcagcacccaggtggacaccgtggccaccaaggtgaaggacgccctggagttctggctgcaggccggcgtggacggcttccaggtgagagacatcgagaacctgaaggacgccagcagcttcctggccgagtggcagaacatcaccaagggcttcagcgaggacagactgctgatcgccggcaccaacagcagcgacctgcagcagatcctgagcctgctggagagcaacaaggacctgctgctgaccagcagctacctgagcgacagcggcagcaccggcgagcacaccaagagcctggtgacccagtacctgaacgccaccggcaacagatggtgcagctggagcctgagccaggccagactgctgaccagcttcctgcccgcccagctgctgagactgtaccagctgatgctgttcaccctgcccggcacccccgtgttcagctacggcgacgagatcggcctggacgccgccgccctgcccggccagcccatggaggcccccgtgatgctgtgggacgagagcagcttccccgacatccccggcgccgtgagcgccaacatgaccgtgaagggccagagcgaggaccccggcagcctgctgagcctgttcagaagactgagcgaccagagaagcaaggagagaagcctgctgcacggcgacttccacgccttcagcgccggccccggcctgttcagctacatcagacactgggaccagaacgagagattcctggtggtgctgaacttcggcgacgtgggcctgagcgccggcctgcaggccagcgacctgcccgccagcgccagcctgcccgccaaggccgacctgctgctgagcacccagcccggcagagaggagggcagccccctggagctggagagactgaagctggagccccacgagggcctgctgctgagattcccctacgccgcctag

SEQ ID NO: 99812 - DNA, 1536 bp, Artificial Sequence
  Description of Artificial Sequence: Synthetic coding sequence
atgagccaggacaccgaggtggacatgaaggaggtggagctgaacgagctggagcccgagaagcagcccatgaacgccgccagcggcgccgccatgagcctggccggcgccgagaagaacggcctggtgaagatcaaggtggccgaggacgaggccgaggccgccgccgccgccaagttcaccggcctgagcaaggaggagctgctgttctggctgggctggctgggcatgctggccggcgccgtggtgatcatcgtgagagcccccagatgcagagagctgcccgcccagaagtggtggcacaccggcgccctgtacagaatcggcgacctgcaggccttccagggccacggcgccggcaacctggccggcctgaagggcagactggactacctgagcagcctgaaggtgaagggcctggtgctgggccccatccacaagaaccagaaggacgacgtggcccagaccgacctgctgcagatcgaccccaacttcggcagcaaggaggacttcgacagcctgctgcagagcgccaagaagaagagcatcagagtgatcctggacctgacccccaactacagaggcgagaacagctggttcagcacccaggtggacaccgtggccaccaaggtgaaggacgccctggagttctggctgcaggccggcgtggacggcttccaggtgagagacatcgagaacctgaaggacgccagcagcttcctggccgagtggcagaacatcaccaagggcttcagcgaggacagactgctgatcgccggcaccaacagcagcgacctgcagcagatcctgagcctgctggagagcaacaaggacctgctgctgaccagcagctacctgagcgacagcggcagcaccggcgagcacaccaagagcctggtgacccagtacctgaacgccaccggcaacagatggtgcagctggagcctgagccaggccagactgctgaccagcttcctgcccgcccagctgctgagactgtaccagctgatgctgttcaccctgcccggcacccccgtgttcagctacggcgacgagatcggcctggacgccgccgccctgcccggccagcccatggaggcccccgtgatgctgtgggacgagagcagcttccccgacatccccggcgccgtgagcgccaacatgaccgtgaagggccagagcgaggaccccggcagcctgctgagcctgttcagaagactgagcgaccagagaagcaaggagagaagcctgctgcacggcgacttccacgccttcagcgccggccccggcctgttcagctacatcagacactgggaccagaacgagagattcctggtggtgctgaacttcggcgacgtgggcctgagcgccggcctgcaggccagcgacctgcccgccagcgccagcctgcccgccaaggccgacctgctgctgagcacccagcccggcagagaggagggcagccccctggagctggagagactgaagctggagccccacgagggcctgctgctgagattcccctacgccgcctag

SEQ ID NO: 99813 - DNA, 408 bp, Artificial Sequence
  Description of Artificial Sequence: Synthetic coding sequence
atgagccaggacaccgaggtggacatgaaggaggtggagctgaacgagctggagcccgagaagcagcccatgaacgccgccagcggcgccgccatgagcctggccggcgccgagaagaacggcctggtgaagatcaaggtggccgaggacgaggccgaggccgccgccgccgccaagttcaccggcctgagcaaggaggagctgctgaaggtggccggcagccccggctgggtgagaaccagatgggccctgctgctgctgttctggctgggctggctgggcatgctggccggcgccgtggtgatcatcgtgagagcccccagatgcagagagctgcccgcccagaagtggtggcacaccggcgccctgtacagaatcggcgacctgcaggccttccagggccactag

SEQ ID NO: 99814 - DNA, 2058 bp, Artificial Sequence
  Description of Artificial Sequence: Synthetic coding sequence
atggccgaggacaagagcaagagagacagcatcgagatgagcatgaagggctgccagaccaacaacggcttcgtgcacaacgaggacatcctggagcagacccccgaccccggcagcagcaccgacaacctgaagcacagcaccagaggcatcctgggcagccaggagcccgacttcaagggcgtgcagccctacgccggcatgcccaaggaggtgctgttccagttcagcggccaggccagatacagaatccccagagagatcctgttctggctgaccgtggccagcgtgctggtgctgatcgccgccaccatcgccatcatcgccctgagccccaagtgcctggactggtggcaggagggccccatgtaccagatctaccccagaagcttcaaggacagcaacaaggacggcaacggcgacctgaagggcatccaggacaagctggactacatcaccgccctgaacatcaagaccgtgtggatcaccagcttctacaagagcagcctgaaggacttcagatacggcgtggaggacttcagagaggtggaccccatcttcggcaccatggaggacttcgagaacctggtggccgccatccacgacaagggcctgaagctgatcatcgacttcatccccaaccacaccagcgacaagcacatctggttccagctgagcagaaccagaaccggcaagtacaccgactactacatctggcacgactgcacccacgagaacggcaagaccatcccccccaacaactggctgagcgtgtacggcaacagcagctggcacttcgacgaggtgagaaaccagtgctacttccaccagttcatgaaggagcagcccgacctgaacttcagaaaccccgacgtgcaggaggagatcaaggagatcctgagattctggctgaccaagggcgtggacggcttcagcctggacgccgtgaagttcctgctggaggccaagcacctgagagacgagatccaggtgaacaagacccagatccccgacaccgtgacccagtacagcgagctgtaccacgacttcaccaccacccaggtgggcatgcacgacatcgtgagaagcttcagacagaccatggaccagtacagcaccgagcccggcagatacagattcatgggcaccgaggcctacgccgagagcatcgacagaaccgtgatgtactacggcctgcccttcatccaggaggccgacttccccttcaacaactacctgagcatgctggacaccgtgagcggcaacagcgtgtacgaggtgatcaccagctggatggagaacatgcccgagggcaagtggcccaactggatgatcggcggccccgacagcagcagactgaccagcagactgggcaaccagtacgtgaacgtgatgaacatgctgctgttcaccctgcccggcacccccatcacctactacggcgaggagatcggcatgggcaacatcgtggccgccaacctgaacgagagctacgacatcaacaccctgagaagcaagagccccatgcagtgggacaacagcagcaacgccggcttcagcgaggccagcaacacctggctgcccaccaacagcgactaccacaccgtgaacgtggacgtgcagaagacccagcccagaagcgccctgaagctgtaccaggacctgagcctgctgcacgccaacgagctgctgctgaacagaggctggttctgccacctgagaaacgacagccactacgtggtgtacaccagagagctggacggcatcgacagaatcttcatcgtggtgctgaacttcggcgagagcaccctgctgaacctgcacaacatgatcagcggcctgcccgccaagatgagaatcagactgagcaccaacagcgccgacaagggcagcaaggtggacaccagcggcatcttcctggacaagggcgagggcctgatcttcgagcacaacaccaagaacctgctgcacagacagaccgccttcagagacagatgcttcgtgagcaacagagcctgctacagcagcgtgctgaacatcctgtacaccagctgctag

SEQ ID NO: 99815 - DNA, 1866 bp, Artificial Sequence
  Description of Artificial Sequence: Synthetic coding sequence
atgaagaccttctggagcagacccagaatccagttcagcggccaggccagatacagaatccccagagagatcctgttctggctgaccgtggccagcgtgctggtgctgatcgccgccaccatcgccatcatcgccctgagccccaagtgcctggactggtggcaggagggccccatgtaccagatctaccccagaagcttcaaggacagcaacaaggacggcaacggcgacctgaagggcatccaggacaagctggactacatcaccgccctgaacatcaagaccgtgtggatcaccagcttctacaagagcagcctgaaggacttcagatacggcgtggaggacttcagagaggtggaccccatcttcggcaccatggaggacttcgagaacctggtggccgccatccacgacaagggcctgaagctgatcatcgacttcatccccaaccacaccagcgacaagcacatctggttccagctgagcagaaccagaaccggcaagtacaccgactactacatctggcacgactgcacccacgagaacggcaagaccatcccccccaacaactggctgagcgtgtacggcaacagcagctggcacttcgacgaggtgagaaaccagtgctacttccaccagttcatgaaggagcagcccgacctgaacttcagaaaccccgacgtgcaggaggagatcaaggagatcctgagattctggctgaccaagggcgtggacggcttcagcctggacgccgtgaagttcctgctggaggccaagcacctgagagacgagatccaggtgaacaagacccagatccccgacaccgtgacccagtacagcgagctgtaccacgacttcaccaccacccaggtgggcatgcacgacatcgtgagaagcttcagacagaccatggaccagtacagcaccgagcccggcagatacagattcatgggcaccgaggcctacgccgagagcatcgacagaaccgtgatgtactacggcctgcccttcatccaggaggccgacttccccttcaacaactacctgagcatgctggacaccgtgagcggcaacagcgtgtacgaggtgatcaccagctggatggagaacatgcccgagggcaagtggcccaactggatgatcggcggccccgacagcagcagactgaccagcagactgggcaaccagtacgtgaacgtgatgaacatgctgctgttcaccctgcccggcacccccatcacctactacggcgaggagatcggcatgggcaacatcgtggccgccaacctgaacgagagctacgacatcaacaccctgagaagcaagagccccatgcagtgggacaacagcagcaacgccggcttcagcgaggccagcaacacctggctgcccaccaacagcgactaccacaccgtgaacgtggacgtgcagaagacccagcccagaagcgccctgaagctgtaccaggacctgagcctgctgcacgccaacgagctgctgctgaacagaggctggttctgccacctgagaaacgacagccactacgtggtgtacaccagagagctggacggcatcgacagaatcttcatcgtggtgctgaacttcggcgagagcaccctgctgaacctgcacaacatgatcagcggcctgcccgccaagatgagaatcagactgagcaccaacagcgccgacaagggcagcaaggtggacaccagcggcatcttcctggacaagggcgagggcctgatcttcgagcacaacaccaagaacctgctgcacagacagaccgccttcagagacagatgcttcgtgagcaacagagcctgctacagcagcgtgctgaacatcctgtacaccagctgctag

SEQ ID NO: 99816 - DNA, 1656 bp, Artificial Sequence
  Description of Artificial Sequence: Synthetic coding sequence
atggccgaggacaagagcaagagagacagcatcgagatgagcatgaagggctgccagaccaacaacggcttcgtgcacaacgaggacatcctggagcagacccccgaccccggcagcagcaccgacaacctgaagcacagcaccagaggcatcctgggcagccaggagcccgacttcaagggcgtgcagccctacgccggcatgcccaaggaggtgctgttccagttcagcggccaggccagatacagaatccccagagagatcctgttctggctgaccgtggccagcgtgctggtgctgatcgccgccaccatcgccatcatcgccctgagccccaagtgcctggactggtggcaggagggccccatgtaccagatctaccccagaagcttcaaggacagcaacaaggacggcaacggcgacctgaagggcatccaggacaagctggactacatcaccgccctgaacatcaagaccgtgtggatcaccagcttctacaagagcagcctgaaggacttcagatacggcgtggaggacttcagagaggtggaccccatcttcggcaccatggaggacttcgagaacctggtggccgccatccacgacaagggcctgaagctgatcatcgacttcatccccaaccacaccagcgacaagcacatctggttccagctgagcagaaccagaaccggcaagtacaccgactactacatctggcacgactgcacccacgagaacggcaagaccatcccccccaacaactggctgagcgtgtacggcaacagcagctggcacttcgacgaggtgagaaaccagtgctacttccaccagttcatgaaggagcagcccgacctgaacttcagaaaccccgacgtgcaggaggagatcaaggagatcctgagattctggctgaccaagggcgtggacggcttcagcctggacgccgtgaagttcctgctggaggccaagcacctgagagacgagatccaggtgaacaagacccagatccccgacaccgtgacccagtacagcgagctgtaccacgacttcaccaccacccaggtgggcatgcacgacatcgtgagaagcttcagacagaccatggaccagtacagcaccgagcccggcagatacagattcatgggcaccgaggcctacgccgagagcatcgacagaaccgtgatgtactacggcctgcccttcatccaggaggccgacttccccttcaacaactacctgagcatgctggacaccgtgagcggcaacagcgtgtacgaggtgatcaccagctggatggagaacatgcccgagggcaagtggcccaactggatgatcggcggccccgacagcagcagactgaccagcagactgggcaaccagtacgtgaacgtgatgaacatgctgctgttcaccctgcccggcacccccatcacctactacggcgaggagatcggcatgggcaacatcgtggccgccaacctgaacgagagctacgacatcaacaccctgagaagcaagagccccatgcagtgggacaacagcagcaacgccggcttcagcgaggccagcaacacctggctgcccaccaacagcgactaccacaccgtgaacgtggacgtgctgctgagacacccctgcagcagcgccgtggcctag

SEQ ID NO: 99817 - DNA, 1524 bp, Artificial Sequence
  Description of Artificial Sequence: Synthetic coding sequence
atgggctgctggggcagaaacagaggcagactgctgtgcatgctggccctgaccttcatgttcatggtgctggaggtggtggtgagcagagtgaccagcagcctggccatgctgagcgacagcttccacatgctgagcgacgtgctggccctggtggtggccctggtggccgagagattcgccagaagaacccacgccacccagaagaacaccttcggctggatcagagccgaggtgatgggcgccctggtgaacgccatcttcctgaccggcctgtgcttcgccatcctgctggaggccatcgagagattcatcgagccccacgagatgcagcagcccctggtggtgctgggcgtgggcgtggccggcctgctggtgaacgtgctgggcctgtgcctgttccaccaccacagcggcttcagccaggacagcggccacggccacagccacggcggccacggccacggccacggcctgcccaagggccccagagtgaagagcaccagacccggcagcagcgacatcaacgtggcccccggcgagcagggccccgaccaggaggagaccaacaccctggtggccaacaccagcaacagcaacggcctgaagctggaccccgccgaccccgagaaccccagaagcggcgacaccgtggaggtgcaggtgaacggcaacctggtgagagagcccgaccacatggagctggaggaggacagagccggccagctgaacatgagaggcgtgttcctgcacgtgctgggcgacgccctgggcagcgtgatcgtggtggtgaacgccctggtgttctacttcagctggaagggctgcagcgagggcgacttctgcgtgaacccctgcttccccgacccctgcaaggccttcgtggagatcatcaacagcacccacgccagcgtgtacgaggccggcccctgctgggtgctgtacctggaccccaccctgtgcgtggtgatggtgtgcatcctgctgtacaccacctaccccctgctgaaggagagcgccctgatcctgctgcagaccgtgcccaagcagatcgacatcagaaacctgatcaaggagctgagaaacgtggagggcgtggaggaggtgcacgagctgcacgtgtggcagctggccggcagcagaatcatcgccaccgcccacatcaagtgcgaggaccccaccagctacatggaggtggccaagaccatcaaggacgtgttccacaaccacggcatccacgccaccaccatccagcccgagttcgccagcgtgggcagcaagagcagcgtggtgccctgcgagctggcctgcagaacccagtgcgccctgaagcagtgctgcggcaccctgccccaggcccccagcggcaaggacgccgagaagacccccgccgtgagcatcagctgcctggagctgagcaacaacctggagaagaagcccagaagaaccaaggccgagaacatccccgccgtggtgatcgagatcaagaacatgcccaacaagcagcccgagagcagcctgtag

SEQ ID NO: 99818 - DNA, 1119 bp, Artificial Sequence
  Description of Artificial Sequence: Synthetic coding sequence
atggaggccaaggagaagcagcacctgctggacgccagacccgccatcagaagctacaccggcagcctgtggcaggagggcgccggctggatccccctgcccagacccggcctggacctgcaggccatcgagctggccgcccagagcaaccaccactgccacgcccagaagggccccgacagccactgcgaccccaagaagggcaaggcccagagacagctgtacgtggccagcgccatctgcctgctgttcatgatcggcgaggtggtgggcggctacctggcccacagcctggccgtgatgaccgacgccgcccacctgctgaccgacttcgccagcatgctgatcagcctgttcagcctgtggatgagcagcagacccgccaccaagaccatgaacttcggctggcagagagccgagatcctgggcgccctggtgagcgtgctgagcatctgggtggtgaccggcgtgctggtgtacctggccgtggagagactgatcagcggcgactacgagatcgacggcggcaccatgctgatcaccagcggctgcgccgtggccgtgaacatcatcatgggcctgaccctgcaccagagcggccacggccacagccacggcaccaccaaccagcaggaggagaaccccagcgtgagagccgccttcatccacgtgatcggcgacttcatgcagagcatgggcgtgctggtggccgcctacatcctgtacttcaagcccgagtacaagtacgtggaccccatctgcaccttcgtgttcagcatcctggtgctgggcaccaccctgaccatcctgagagacgtgatcctggtgctgatggagggcacccccaagggcgtggacttcaccgccgtgagagacctgctgctgagcgtggagggcgtggaggccctgcacagcctgcacatctgggccctgaccgtggcccagcccgtgctgagcgtgcacatcgccatcgcccagaacaccgacgcccaggccgtgctgaagaccgccagcagcagactgcagggcaagttccacttccacaccgtgaccatccagatcgaggactacagcgaggacatgaaggactgccaggcctgccagggccccagcgactag

SEQ ID NO: 99819 - DNA, 972 bp, Artificial Sequence
  Description of Artificial Sequence: Synthetic coding sequence
atggaggccaaggagaagcagcacctgctggacgccagacccgccatcagaagctacaccggcagcctgtggcaggagggcgccggctggatccccctgcccagacccggcctggacctgcaggccatcgagctggccgcccagagcaaccaccactgccacgcccagaagggccccgacagccactgcgaccccaagaagggcaaggcccagagacagctgtacgtggccagcgccatctgcctgctgttcatgatcggcgaggtggtggagatcctgggcgccctggtgagcgtgctgagcatctgggtggtgaccggcgtgctggtgtacctggccgtggagagactgatcagcggcgactacgagatcgacggcggcaccatgctgatcaccagcggctgcgccgtggccgtgaacatcatcatgggcctgaccctgcaccagagcggccacggccacagccacggcaccaccaaccagcaggaggagaaccccagcgtgagagccgccttcatccacgtgatcggcgacttcatgcagagcatgggcgtgctggtggccgcctacatcctgtacttcaagcccgagtacaagtacgtggaccccatctgcaccttcgtgttcagcatcctggtgctgggcaccaccctgaccatcctgagagacgtgatcctggtgctgatggagggcacccccaagggcgtggacttcaccgccgtgagagacctgctgctgagcgtggagggcgtggaggccctgcacagcctgcacatctgggccctgaccgtggcccagcccgtgctgagcgtgcacatcgccatcgcccagaacaccgacgcccaggccgtgctgaagaccgccagcagcagactgcagggcaagttccacttccacaccgtgaccatccagatcgaggactacagcgaggacatgaaggactgccaggcctgccagggccccagcgactag

SEQ ID NO: 99820 - DNA, 345 bp, Artificial Sequence
  Description of Artificial Sequence: Synthetic coding sequence
atgggccccagaagaagaagcagaaagcccgaggcccccagaagaagaagccccagccccacccccacccccggccccagcagaagaggccccagcctgggcgccagcagccaccagcacagcagaagaagacagggctggctgaaggagatcagaaagctgcagaagagcacccacctgctgatcagaaagctgcccttcagcagactggccgccgaggccttcctggtgcacctgttcgaggacgcctacctgctgaccctgcacgccggcagagtgaccctgttccccaaggacgtgcagctggccagaagaatcagaggcctggaggagggcctgggctag

SEQ ID NO: 99821 - DNA, 300 bp, Artificial Sequence
  Description of Artificial Sequence: Synthetic coding sequence
atgcccttccaccactgccacagagaccccctgcccccccccggcctgacccccgagagactgcacgccagaagacagctgtacgccgcctgcgccgtgtgcttcgtgttcatggccggcgaggtggtgggcggctacctggcccacagcctggccatcatgaccgacgccgcccacctgctggccgacgtgggcagcatgatgggcagcctgttcagcctgtggctgagcaccagacccgccaccagaaccatgaccttcggctggcacagaagcgagaccctgggcgccctggcctag

SEQ ID NO: 99822 - DNA, 723 bp, Artificial Sequence
  Description of Artificial Sequence: Synthetic coding sequence
atgcccttccaccactgccacagagaccccctgcccccccccggcctgacccccgagagactgcacgccagaagacagctgtacgccgcctgcgccgtgtgcttcgtgttcatggccggcgaggtggtgggcggctacctggcccacagcctggccatcatgaccgacgccgcccacctgctggccgacgtgggcagcatgatgggcagcctgttcagcctgtggctgagcaccagacccgccaccagaaccatgaccttcggctggcacagaagcgagaccctgggcgccctggccagcgtggtgagcctgtggatggtgaccggcatcctgctgtacctggccttcgtgagactgctgcacagcgactaccacatcgagggcggcgccatgctgctgaccgccagcatcgccgtgtgcgccaacctgctgatggccttcgtgctgcaccaggccggccccccccacagccacggcagcagaggcgccgagtacgcccccctggaggagggccccgaggagcccctgcccctgggcaacaccagcgtgagagccgccttcgtgcacgtgctgggcgacctgctgcagagcttcggcgtgctggccgccagcatcctgatctacttcaagccccagtacaaggccgccgaccccatcagcaccttcctgttcagcatctgcgccctgggcagcaccgcccccaccctgagagacgtgctgtag

SEQ ID NO: 99823 - DNA, 1152 bp, Artificial Sequence
  Description of Artificial Sequence: Synthetic coding sequence
atgagagtggccgccggcgccagaggcgagaacatcgagcacctgaagctgagactggaggccagaccccccaccctgctgctgttcaccgagcccagcgagcccctgcccgaggagagcaagcccgtggagatgcccttccaccactgccacagagaccccctgcccccccccggcctgacccccgagagactgcacgccagaagacagctgtacgccgcctgcgccgtgtgcttcgtgttcatggccggcgaggtggtgggcggctacctggcccacagcctggccatcatgaccgacgccgcccacctgctggccgacgtgggcagcatgatgggcagcctgttcagcctgtggctgagcaccagacccgccaccagaaccatgaccttcggctggcacagaagcgagaccctgggcgccctggccagcgtggtgagcctgtggatggtgaccggcatcctgctgtacctggccttcgtgagactgctgcacagcgactaccacatcgagggcggcgccatgctgctgaccgccagcatcgccgtgtgcgccaacctgctgatggccttcgtgctgcaccaggccggccccccccacagccacggcagcagaggcgccgagtacgcccccctggaggagggccccgaggagcccctgcccctgggcaacaccagcgtgagagccgccttcgtgcacgtgctgggcgacctgctgcagagcttcggcgtgctggccgccagcatcctgatctacttcaagccccagtacaaggccgccgaccccatcagcaccttcctgttcagcatctgcgccctgggcagcaccgcccccaccctgagagacgtgctgagaatcctgatggagggcacccccagaaacgtgggcttcgagcccgtgagagacaccctgctgagcgtgcccggcgtgagagccacccacgagctgcacctgtgggccctgaccctgacctaccacgtggccagcgcccacctggccatcgacagcaccgccgaccccgaggccgtgctggccgaggccagcagcagactgtacagcagattcggcttcagcagctgcaccctgcaggtggagcagtaccagcccgagatggcccagtgcctgagatgccaggagcccccccaggcctag

SEQ ID NO: 99824 - DNA, 336 bp, Artificial Sequence
  Description of Artificial Sequence: Synthetic coding sequence
atgcccttccaccactgccacagagaccccctgcccccccccggcctgacccccgagagactgcacgccagaagacagctgtacgccgcctgcgccgtgtgcttcgtgttcatggccggcgaggtggtgggcggctacctggcccacagcctggccatcatgaccgacgccgcccacctgctggccgacgtgggcagcatgatgggcagcctgttcagcctgtggctgagcaccagacccgccaccagaaccatgaccttcggctggcacagaagcgagaccctgggcgccctggccagcgtggtgagcctgtggatggtgaccggcatcctgtag

SEQ ID NO: 99825 - DNA, 1290 bp, Artificial Sequence
  Description of Artificial Sequence: Synthetic coding sequence
atggccggcagcggcgcctggaagagactgaagagcatgctgagaaaggacgacgcccccctgttcctgaacgacaccagcgccttcgacttcagcgacgaggccggcgacgagggcctgagcagattcaacaagctgagagtggtggtggccgacgacggcagcgaggcccccgagagacccgtgaacggcgcccaccccaccctgcaggccgacgacgacagcctgctggaccaggacctgcccctgaccaacagccagctgagcctgaaggtggacagctgcgacaactgcagcaagcagagagagatcctgaagcagagaaaggtgaaggccagactgaccatcgccgccgtgctgtacctgctgttcatgatcggcgagctggtgggcggctacatcgccaacagcctggccatcatgaccgacgccctgcacatgctgaccgacctgagcgccatcatcctgaccctgctggccctgtggctgagcagcaagagccccaccaagagattcaccttcggcttccacagactggaggtgctgagcgccatgatcagcgtgctgctggtgtacatcctgatgggcttcctgctgtacgaggccgtgcagagaaccatccacatgaactacgagatcaacggcgacatcatgctgatcaccgccgccgtgggcgtggccgtgaacgtgatcatgggcttcctgctgaaccagagcggccacagacacagccacagccacagcctgcccagcaacagccccaccagaggcagcggctgcgagagaaaccacggccaggacagcctggccgtgagagccgccttcgtgcacgccctgggcgacctggtgcagagcgtgggcgtgctgatcgccgcctacatcatcagattcaagcccgagtacaagatcgccgaccccatctgcacctacgtgttcagcctgctggtggccttcaccaccttcagaatcatctgggacaccgtggtgatcatcctggagggcgtgcccagccacctgaacgtggactacatcaaggaggccctgatgaagatcgaggacgtgtacagcgtggaggacctgaacatctggagcctgaccagcggcaagagcaccgccatcgtgcacatccagctgatccccggcagcagcagcaagtgggaggaggtgcagagcaaggccaaccacctgctgctgaacaccttcggcatgtacagatgcaccatccagctgcagagctacagacaggaggtggacagaacctgcgccaactgccagagcagcagcccctag

SEQ ID NO: 99826 - DNA, 357 bp, Artificial Sequence
  Description of Artificial Sequence: Synthetic coding sequence
atggaggagaagtacggcggcgacgtgctggccggccccggcggcggcggcggcctgggccccgtggacgtgcccagcgccagactgaccaagtacatcgtgctgctgtgcttcaccaagttcctgaaggccgtgggcctgttcgagagctacgacctgctgaaggccgtgcacatcgtgcagttcatcttcatcctgaagctgggcaccgccttcttcatggtgctgttccagaagcccttcagcagcggcaagaccatcaccaagcaccagatcatcggcagcctgaagatccccggcagaaaggagttcaaggacaagaagctgaacgaccccagaaagctggtgggcaactag

SEQ ID NO: 99827 - DNA, 2298 bp, Artificial Sequence
  Description of Artificial Sequence: Synthetic coding sequence
atggaggagaagtacggcggcgacgtgctggccggccccggcggcggcggcggcctgggccccgtggacgtgcccagcgccagactgaccaagtacatcgtgctgctgtgcttcaccaagttcctgaaggccgtgggcctgttcgagagctacgacctgctgaaggccgtgcacatcgtgcagttcatcttcatcctgaagctgggcaccgccttcttcatggtgctgttccagaagcccttcagcagcggcaagaccatcaccaagcaccagtggatcaagatcttcaagcacgccgtggccggctgcatcatcagcctgctgtggttcttcggcctgaccctgtgcggccccctgagaaccctgctgctgttcgagcacagcgacatcgtggtgatcagcctgctgagcgtgctgttcaccagcagcggcggcggccccgccaagaccagaggcgccgccttcttcatcatcgccgtgatctgcctgctgctgttcgacaacgacgacctgatggccaagatggccgagcaccccgagggccaccacgacagcgccctgacccacatgctgtacaccgccatcgccttcctgggcgtggccgaccacaagggcggcgtgctgctgctggtgctggccctgtgctgcaaggtgggcttccacaccgccagcagaaagctgagcgtggacgtgggcggcgccaagagactgcaggccctgagccacctggtgagcgtgctgctgctgtgcccctgggtgatcgtgctgagcgtgaccaccgagagcaaggtggagagctggttcagcctgatcatgcccttcgccaccgtgatcttcttcgtgatgatcctggacttctacgtggacagcatctgcagcgtgaagatggaggtgagcaagtgcgccagatacggcagcttccccatcttcatcagcgccctgctgttcggcaacttctggacccaccccatcaccgaccagctgagagccatgaacaaggccgcccaccaggagagcaccgagcacgtgctgagcggcggcgtggtggtgagcgccatcttcttcatcctgagcgccaacatcctgagcagccccagcaagagaggccagaagggcaccctgatcggctacagccccgagggcacccccctgtacaacttcatgggcgacgccttccagcacagcagccagagcatccccagattcatcaaggagagcctgaagcagatcctggaggagagcgacagcagacagatcttctacttcctgtgcctgaacctgctgttcaccttcgtggagctgttctacggcgtgctgaccaacagcctgggcctgatcagcgacggcttccacatgctgttcgactgcagcgccctggtgatgggcctgttcgccgccctgatgagcagatggaaggccaccagaatcttcagctacggctacggcagaatcgagatcctgagcggcttcatcaacggcctgttcctgatcgtgatcgccttcttcgtgttcatggagagcgtggccagactgatcgacccccccgagctggacacccacatgctgacccccgtgagcgtgggcggcctgatcgtgaacctgatcggcatctgcgccttcagccacgcccacagccacgcccacggcgccagccagggcagctgccacagcagcgaccacagccacagccaccacatgcacggccacagcgaccacggccacggccacagccacggcagcgccggcggcggcatgaacgccaacatgagaggcgtgttcctgcacgtgctggccgacaccctgggcagcatcggcgtgatcgtgagcaccgtgctgatcgagcagttcggctggttcatcgccgaccccctgtgcagcctgttcatcgccatcctgatcttcctgagcgtggtgcccctgatcaaggacgcctgccaggtgctgctgctgagactgccccccgagtacgagaaggagctgcacatcgccctggagaagatccagaagatcgagggcctgatcagctacagagacccccacttctggagacacagcgccagcatcgtggccggcaccatccacatccaggtgaccagcgacgtgctggagcagagaatcgtgcagcaggtgaccggcatcctgaaggacgccggcgtgaacaacctgaccatccaggtggagaaggaggcctacttccagcacatgagcggcctgagcaccggcttccacgacgtgctggccatgaccaagcagatggagagcatgaagtactgcaaggacggcacctacatcatgtag

SEQ ID NO: 99828 - DNA, 1083 bp, Artificial Sequence
  Description of Artificial Sequence: Synthetic coding sequence
atgggcgacgccttccagcacagcagccagagcatccccagattcatcaaggagagcctgaagcagatcctggaggagagcgacagcagacagatcttctacttcctgtgcctgaacctgctgttcaccttcgtggagctgttctacggcgtgctgaccaacagcctgggcctgatcagcgacggcttccacatgctgttcgactgcagcgccctggtgatgggcctgttcgccgccctgatgagcagatggaaggccaccagaatcttcagctacggctacggcagaatcgagatcctgagcggcttcatcaacggcctgttcctgatcgtgatcgccttcttcgtgttcatggagagcgtggccagactgatcgacccccccgagctggacacccacatgctgaccccctgccacagccacgcccacggcgccagccagggcagctgccacagcagcgaccacagccacagccaccacatgcacggccacagcgaccacggccacggccacagccacggcagcgccggcggcggcatgaacgccaacatgagaggcgtgttcctgcacgtgctggccgacaccctgggcagcatcggcgtgatcgtgagcaccgtgctgatcgagcagttcggctggttcatcgccgaccccctgtgcagcctgttcatcgccatcctgatcttcctgagcgtggtgcccctgatcaaggacgcctgccaggtgctgctgctgagactgccccccgagtacgagaaggagctgcacatcgccctggagaagatccagaagatcgagggcctgatcagctacagagacccccacttctggagacacagcgccagcatcgtggccggcaccatccacatccaggtgaccagcgacgtgctggagcagagaatcgtgcagcaggtgaccggcatcctgaaggacgccggcgtgaacaacctgaccatccaggtggagaaggaggcctacttccagcacatgagcggcctgagcaccggcttccacgacgtgctggccatgaccaagcagatggagagcatgaagtactgcaaggacggcacctacatcatgtag

SEQ ID NO: 99829 - DNA, 1386 bp, Artificial Sequence
  Description of Artificial Sequence: Synthetic coding sequence
atgggcaccatccacctgttcagaaagccccagagaagcttcttcggcaagctgctgagagagttcagactggtggccgccgacagaagaagctggaagatcctgctgttcggcgtgatcaacctgatctgcaccggcttcctgctgatgtggtgcagcagcaccaacagcatcgccctgaccgcctacacctacctgaccatcttcgacctgttcagcctgatgacctgcctgatcagctactgggtgaccctgagaaagcccagccccgtgtacagcttcggcttcgagagactggaggtgctggccgtgttcgccagcaccgtgctggcccagctgggcgccctgttcatcctgaaggagagcgccgagagattcctggagcagcccgagatccacaccggcagactgctggtgggcaccttcgtggccctgtgcttcaacctgttcaccatgctgagcatcagaaacaagcccttcgcctacgtgagcgaggccgccagcaccagctggctgcaggagcacgtggccgacctgagcagaagcctgtgcggcatcatccccggcctgagcagcatcttcctgcccagaatgaaccccttcgtgctgatcgacctggccggcgccttcgccctgtgcatcacctacatgctgatcgagatcaacaactacttcgccgtggacaccgccagcgccatcgccatcgccctgatgaccttcggcaccatgtaccccatgagcgtgtacagcggcaaggtgctgctgcagaccacccccccccacgtgatcggccagctggacaagctgatcagagaggtgagcaccctggacggcgtgctggaggtgagaaacgagcacttctggaccctgggcttcggcagcctggccggcagcgtgcacgtgagaatcagaagagacgccaacgagcagatggtgctggcccacgtgaccaacagactgtacaccctggtgagcaccctgaccgtgcagatcttcaaggacgactggatcagacccgccctgctgagcggccccgtggccgccaacgtgctgaacttcagcgaccaccacgtgatccccatgcccctgctgaagggcaccgacgacctgaaccccgtgaccagcacccccgccaagcccagcagccccccccccgagttcagcttcaacacccccggcaagaacgtgaaccccgtgatcctgctgaacacccagaccagaccctacggcttcggcctgaaccacggccacaccccctacagcagcatgctgaaccagggcctgggcgtgcccggcatcggcgccacccagggcctgagaaccggcttcaccaacatccccagcagatacggcaccaacaacagaatcggccagcccagaccctag

SEQ ID NO: 99830 - DNA, 795 bp, Artificial Sequence
  Description of Artificial Sequence: Synthetic coding sequence
atgaaccccttcgtgctgatcgacctggccggcgccttcgccctgtgcatcacctacatgctgatcgagatcaacaactacttcgccgtggacaccgccagcgccatcgccatcgccctgatgaccttcggcaccatgtaccccatgagcgtgtacagcggcaaggtgctgctgcagaccacccccccccacgtgatcggccagctggacaagctgatcagagaggtgagcaccctggacggcgtgctggaggtgagaaacgagcacttctggaccctgggcttcggcagcctggccggcagcgtgcacgtgagaatcagaagagacgccaacgagcagatggtgctggcccacgtgaccaacagactgtacaccctggtgagcaccctgaccgtgcagatcttcaaggacgactggatcagacccgccctgctgagcggccccgtggccgccaacgtgctgaacttcagcgaccaccacgtgatccccatgcccctgctgaagggcaccgacgacctgaaccccgtgaccagcacccccgccaagcccagcagccccccccccgagttcagcttcaacacccccggcaagaacgtgaaccccgtgatcctgctgaacacccagaccagaccctacggcttcggcctgaaccacggccacaccccctacagcagcatgctgaaccagggcctgggcgtgcccggcatcggcgccacccagggcctgagaaccggcttcaccaacatccccagcagatacggcaccaacaacagaatcggccagcccagaccctag

SEQ ID NO: 99831 - DNA, 1506 bp, Artificial Sequence
  Description of Artificial Sequence: Synthetic coding sequence
atgggcaccatccacctgttcagaaagccccagagaagcttcttcggcaagctgctgagagagttcagactggtggccgccgacagaagaagctggaagatcctgctgttcggcgtgatcaacctgatctgcaccggcttcctgctgatgtggtgcagcagcaccaacagcatcgccctgaccgcctacacctacctgaccatcttcgacctgttcagagacggcgtgagccccttctggctgggctggagccagacccccgacctgaagtggagcacccacctgggcctgcccaagtgctgggacaacagaagagagctgccctgcctgagcaacagcctgatgacctgcctgatcagctactgggtgaccctgagaaagcccagccccgtgtacagcttcggcttcgagagactggaggtgctggccgtgttcgccagcaccgtgctggcccagctgggcgccctgttcatcctgaaggagagcgccgagagattcctggagcagcccgagatccacaccggcagactgctggtgggcaccttcgtggccctgtgcttcaacctgttcaccatgctgagcatcagaaacaagcccttcgcctacgtgagcgaggccgccagcaccagctggctgcaggagcacgtggccgacctgagcagaagcctgtgcggcatcatccccggcctgagcagcatcttcctgcccagaatgaaccccttcgtgctgatcgacctggccggcgccttcgccctgtgcatcacctacatgctgatcgagatcaacaactacttcgccgtggacaccgccagcgccatcgccatcgccctgatgaccttcggcaccatgtaccccatgagcgtgtacagcggcaaggtgctgctgcagaccacccccccccacgtgatcggccagctggacaagctgatcagagaggtgagcaccctggacggcgtgctggaggtgagaaacgagcacttctggaccctgggcttcggcagcctggccggcagcgtgcacgtgagaatcagaagagacgccaacgagcagatggtgctggcccacgtgaccaacagactgtacaccctggtgagcaccctgaccgtgcagatcttcaaggacgactggatcagacccgccctgctgagcggccccgtggccgccaacgtgctgaacttcagcgaccaccacgtgatccccatgcccctgctgaagggcaccgacgacctgaaccccgtgaccagcacccccgccaagcccagcagccccccccccgagttcagcttcaacacccccggcaagaacgtgaaccccgtgatcctgctgaacacccagaccagaccctacggcttcggcctgaaccacggccacaccccctacagcagcatgctgaaccagggcctgggcgtgcccggcatcggcgccacccagggcctgagaaccggcttcaccaacatccccagcagatacggcaccaacaacagaatcggccagcccagaccctag

SEQ ID NO: 99832 - DNA, 1164 bp, Artificial Sequence
  Description of Artificial Sequence: Synthetic coding sequence
atgacctgcctgatcagctactgggtgaccctgagaaagcccagccccgtgtacagcttcggcttcgagagactggaggtgctggccgtgttcgccagcaccgtgctggcccagctgggcgccctgttcatcctgaaggagagcgccgagagattcctggagcagcccgagatccacaccggcagactgctggtgggcaccttcgtggccctgtgcttcaacctgttcaccatgctgagcatcagaaacaagcccttcgcctacgtgagcgaggccgccagcaccagctggctgcaggagcacgtggccgacctgagcagaagcctgtgcggcatcatccccggcctgagcagcatcttcctgcccagaatgaaccccttcgtgctgatcgacctggccggcgccttcgccctgtgcatcacctacatgctgatcgagatcaacaactacttcgccgtggacaccgccagcgccatcgccatcgccctgatgaccttcggcaccatgtaccccatgagcgtgtacagcggcaaggtgctgctgcagaccacccccccccacgtgatcggccagctggacaagctgatcagagaggtgagcaccctggacggcgtgctggaggtgagaaacgagcacttctggaccctgggcttcggcagcctggccggcagcgtgcacgtgagaatcagaagagacgccaacgagcagatggtgctggcccacgtgaccaacagactgtacaccctggtgagcaccctgaccgtgcagatcttcaaggacgactggatcagacccgccctgctgagcggccccgtggccgccaacgtgctgaacttcagcgaccaccacgtgatccccatgcccctgctgaagggcaccgacgacctgaaccccgtgaccagcacccccgccaagcccagcagccccccccccgagttcagcttcaacacccccggcaagaacgtgaaccccgtgatcctgctgaacacccagaccagaccctacggcttcggcctgaaccacggccacaccccctacagcagcatgctgaaccagggcctgggcgtgcccggcatcggcgccacccagggcctgagaaccggcttcaccaacatccccagcagatacggcaccaacaacagaatcggccagcccagaccctag

SEQ ID NO: 99833 - DNA, 1317 bp, Artificial Sequence
  Description of Artificial Sequence: Synthetic coding sequence
atgggcaccatccacctgttcagaaagccccagagaagcttcttcggcaagctgctgagagagttcagactggtggccgccgacagaagaagctggaagatcctgctgttcggcgtgatcaacctgatctgcaccggcttcctgctgatgtggtgcagcagcaccaacagcatcgccctgaccgcctacacctacctgaccatcttcgacctgttcagcctgatgacctgcctgatcagctactgggtgaccctgagaaagcccagccccgtgtacagcttcggcttcgagagactggaggtgctggccgtgttcgccagcaccgtgctggcccagctgggcgccctgttcatcctgaaggagagcgccgagagattcctggagcagcccgagatccacaccggcagactgctggtgggcaccttcgtggccctgtgcttcaacctgttcaccatgctgagcatcagaaacaagcccttcgcctacgtgagcgaggccgccagcaccagctggctgcaggagcacgtggccgacctgagcagaagcctgtgcggcatcatccccggcctgagcagcatcttcctgcccagaatgaaccccttcgtgctgatcgacctggccggcgccttcgccctgtgcatcacctacatgctgatcgagatcaacaactacttcgccgtggacaccgccagcgccatcgccatcgccctgatgaccttcggcaccatgtaccccatgagcgtgtacagcggcaaggtgctgctgcagaccacccccccccacgtgatcggccagctggacaagctgatcagagaggccggcagcgtgcacgtgagaatcagaagagacgccaacgagcagatggtgctggcccacgtgaccaacagactgtacaccctggtgagcaccctgaccgtgcagatcttcaaggacgactggatcagacccgccctgctgagcggccccgtggccgccaacgtgctgaacttcagcgaccaccacgtgatccccatgcccctgctgaagggcaccgacgacctgaaccccgtgaccagcacccccgccaagcccagcagccccccccccgagttcagcttcaacacccccggcaagaacgtgaaccccgtgatcctgctgaacacccagaccagaccctacggcttcggcctgaaccacggccacaccccctacagcagcatgctgaaccagggcctgggcgtgcccggcatcggcgccacccagggcctgagaaccggcttcaccaacatccccagcagatacggcaccaacaacagaatcggccagcccagaccctag

SEQ ID NO: 99834 - DNA, 1299 bp, Artificial Sequence
  Description of Artificial Sequence: Synthetic coding sequence
atgagctggaagatcctgctgttcggcgtgatcaacctgatctgcaccggcttcctgctgatgtggtgcagcagcaccaacagcatcgccctgaccgcctacacctacctgaccatcttcgacctgttcagcctgatgacctgcctgatcagctactgggtgaccctgagaaagcccagccccgtgtacagcttcggcttcgagagactggaggtgctggccgtgttcgccagcaccgtgctggcccagctgggcgccctgttcatcctgaaggagagcgccgagagattcctggagcagcccgagatccacaccggcagactgctggtgggcaccttcgtggccctgtgcttcaacctgttcaccatgctgagcatcagaaacaagcccttcgcctacgtgagcgaggccgccagcaccagctggctgcaggagcacgtggccgacctgagcagaagcctgtgcggcatcatccccggcctgagcagcatcttcctgcccagaatgaaccccttcgtgctgatcgacctggccggcgccttcgccctgtgcatcacctacatgctgatcgagatcaacaactacttcgccgtggacaccgccagcgccatcgccatcgccctgatgaccttcggcaccatgtaccccatgagcgtgtacagcggcaaggtgctgctgcagaccacccccccccacgtgatcggccagctggacaagctgatcagagaggtgagcaccctggacggcgtgctggaggtgagaaacgagcacttctggaccctgggcttcggcagcctggccggcagcgtgcacgtgagaatcagaagagacgccaacgagcagatggtgctggcccacgtgaccaacagactgtacaccctggtgagcaccctgaccgtgcagatcttcaaggacgactggatcagacccgccctgctgagcggccccgtggccgccaacgtgctgaacttcagcgaccaccacgtgatccccatgcccctgctgaagggcaccgacgacctgaaccccgtgaccagcacccccgccaagcccagcagccccccccccgagttcagcttcaacacccccggcaagaacgtgaaccccgtgatcctgctgaacacccagaccagaccctacggcttcggcctgaaccacggccacaccccctacagcagcatgctgaaccagggcctgggcgtgcccggcatcggcgccacccagggcctgagaaccggcttcaccaacatccccagcagatacggcaccaacaacagaatcggccagcccagaccctag

SEQ ID NO: 99835 - DNA, 1131 bp, Artificial Sequence
  Description of Artificial Sequence: Synthetic coding sequence
atgctgcccctgagcatcaaggacgacgagtacaagccccccaagttcaacctgttcggcaagatcagcggctggttcagaagcatcctgagcgacaagaccagcagaaacctgttcttcttcctgtgcctgaacctgagcttcgccttcgtggagctgctgtacggcatctggagcaactgcctgggcctgatcagcgacagcttccacatgttcttcgacagcaccgccatcctggccggcctggccgccagcgtgatcagcaagtggagagacaacgacgccttcagctacggctacgtgagagccgaggtgctggccggcttcgtgaacggcctgttcctgatcttcaccgccttcttcatcttcagcgagggcgtggagagagccctggccccccccgacgtgcaccacgagagactgctgctggtgagcatcctgggcttcgtggtgaacctgatcggcatcttcgtgttcaagcacggcggccacggccacagccacggcagcggccacggccacagccacagcctgttcaacggcgccctggaccaggcccacggccacgtggaccactgccacagccacgaggtgaagcacggcgccgcccacagccacgaccacgcccacggccacggccacttccacagccacgacggccccagcctgaaggagaccaccggccccagcagacagatcctgcagggcgtgttcctgcacatcctggccgacaccctgggcagcatcggcgtgatcgccagcgccatcatgatgcagaacttcggcctgatgatcgccgaccccatctgcagcatcctgatcgccatcctgatcgtggtgagcgtgatccccctgctgagagagagcgtgggcatcctgatgcagagaaccccccccctgctggagaacagcctgccccagtgctaccagagagtgcagcagctgcagggcgtgtacagcctgcaggagcagcacttctggaccctgtgcagcgacgtgtacgtgggcaccctgaagctgatcgtggcccccgacgccgacgccagatggatcctgagccagacccacaacatcttcacccaggccggcgtgagacagctgtacgtgcagatcgacttcgccgccatgtag

SEQ ID NO: 99836 - DNA, 273 bp, Artificial Sequence
  Description of Artificial Sequence: Synthetic coding sequence
tgagtgatccccctgctgagagagagcgtgggcatcctgatgcagagaaccccccccctgctggagaacagcctgccccagtgctaccagagagtgcagcagctgcagggcgtgtacagcctgcaggagcagcacttctggaccctgtgcagcgacgtgtacgtgggcaccctgaagctgatcgtggcccccgacgccgacgccagatggatcctgagccagacccacaacatcttcacccagaagctggaggaggagaacgagaacctgtag

SEQ ID NO: 99837 - DNA, 1131 bp, Artificial Sequence; identical to SEQ ID NO: 99835
  Description of Artificial Sequence: Synthetic coding sequence

SEQ ID NO: 99838 - DNA, 963 bp, Artificial Sequence
  Description of Artificial Sequence: Synthetic coding sequence
atgtaccactgccacagcggcagcaagcccaccgagaagggcgccaacgagtacgcctacgccaagtggaagctgtgcagcgccagcgccatctgcttcatcttcatgatcgccgaggtggtgggcggccacatcgccggcagcctggccgtggtgaccgacgccgcccacctgctgatcgacctgaccagcttcctgctgagcctgttcagcctgtggctgagcagcaagccccccagcaagagactgaccttcggctggcacagagccgagatcctgggcgccctgctgagcatcctgtgcatctgggtggtgaccggcgtgctggtgtacctggcctgcgagagactgctgtaccccgactaccagatccaggccaccgtgatgatcatcgtgagcagctgcgccgtggccgccaacatcgtgctgaccgtggtgctgcaccagagatgcctgggccacaaccacaaggaggtgcaggccaacgccagcgtgagagccgccttcgtgcacgccctgggcgacctgttccagagcatcagcgtgctgatcagcgccctgatcatctacttcaagcccgagtacaagatcgccgaccccatctgcaccttcatcttcagcatcctggtgctggccagcaccatcaccatcctgaaggacttcagcatcctgctgatggagggcgtgcccaagagcctgaactacagcggcgtgaaggagctgatcctggccgtggacggcgtgctgagcgtgcacagcctgcacatctggagcctgaccatgaaccaggtgatcctgagcgcccacgtggccaccgccgccagcagagacagccaggtggtgagaagagagatcgccaaggccctgagcaagagcttcaccatgcacagcctgaccatccagatggagagccccgtggaccaggaccccgactgcctgttctgcgaggacccctgcgactag

SEQ ID NO: 99839 - DNA, 1110 bp, Artificial Sequence
  Description of Artificial Sequence: Synthetic coding sequence
atggagttcctggagagaacctacctggtgaacgacaaggccgccaagatgtacgccttcaccctggagagcgtggagctgcagcagaagcccgtgaacaaggaccagtgccccagagagagacccgaggagctggagagcggcggcatgtaccactgccacagcggcagcaagcccaccgagaagggcgccaacgagtacgcctacgccaagtggaagctgtgcagcgccagcgccatctgcttcatcttcatgatcgccgaggtggtgggcggccacatcgccggcagcctggccgtggtgaccgacgccgcccacctgctgatcgacctgaccagcttcctgctgagcctgttcagcctgtggctgagcagcaagccccccagcaagagactgaccttcggctggcacagagccgagatcctgggcgccctgctgagcatcctgtgcatctgggtggtgaccggcgtgctggtgtacctggcctgcgagagactgctgtaccccgactaccagatccaggccaccgtgatgatcatcgtgagcagctgcgccgtggccgccaacatcgtgctgaccgtggtgctgcaccagagatgcctgggccacaaccacaaggaggtgcaggccaacgccagcgtgagagccgccttcgtgcacgccctgggcgacctgttccagagcatcagcgtgctgatcagcgccctgatcatctacttcaagcccgagtacaagatcgccgaccccatctgcaccttcatcttcagcatcctggtgctggccagcaccatcaccatcctgaaggacttcagcatcctgctgatggagggcgtgcccaagagcctgaactacagcggcgtgaaggagctgatcctggccgtggacggcgtgctgagcgtgcacagcctgcacatctggagcctgaccatgaaccaggtgatcctgagcgcccacgtggccaccgccgccagcagagacagccaggtggtgagaagagagatcgccaaggccctgagcaagagcttcaccatgcacagcctgaccatccagatggagagccccgtggaccaggaccccgactgcctgttctgcgaggacccctgcgactag

SEQ ID NO: 99840 - DNA, 1458 bp, Artificial Sequence
  Description of Artificial Sequence: Synthetic coding sequence
atgggcagatacagcggcaagacctgcagactgctgttcatgctggtgctgaccgtggccttcttcgtggccgagctggtgagcggctacctgggcaacagcatcgccctgctgagcgacagcttcaacatgctgagcgacctgatcagcctgtgcgtgggcctgagcgccggctacatcgccagaagacccaccagaggcttcagcgccacctacggctacgccagagccgaggtggtgggcgccctgagcaacgccgtgttcctgaccgccctgtgcttcaccatcttcgtggaggccgtgctgagactggccagacccgagagaatcgacgaccccgagctggtgctgatcgtgggcgtgctgggcctgctggtgaacgtggtgggcctgctgatcttccaggactgcgccgcctggttcgcctgctgcctgagaggcagaagcagaagactgcagcagagacagcagctggccgagggctgcgtgcccggcgccttcggcggcccccagggcgccgaggaccccagaagagccgccgaccccaccgcccccggcagcgacagcgccgtgaccctgagaggcaccagcgtggagagaaagagagagaagggcgccaccgtgttcgccaacgtggccggcgacagcttcaacacccagaacgagcccgaggacatgatgaagaaggagaagaagagcgaggccctgaacatcagaggcgtgctgctgcacgtgatgggcgacgccctgggcagcgtggtggtggtgatcaccgccatcatcttctacgtgctgcccctgaagagcgaggacccctgcaactggcagtgctacatcgaccccagcctgaccgtgctgatggtgatcatcatcctgagcagcgccttccccctgatcaaggagaccgccgccatcctgctgcagatggtgcccaagggcgtgaacatggaggagctgatgagcaagctgagcgccgtgcccggcatcagcagcgtgcacgaggtgcacatctgggagctggtgagcggcaagatcatcgccaccctgcacatcaagtaccccaaggacagaggctaccaggacgccagcaccaagatcagagagatcttccaccacgccggcatccacaacgtgaccatccagttcgagaacgtggacctgaaggagcccctggagcagaaggacctgctgctgctgtgcaacagcccctgcatcagcaagggctgcgccaagcagctgtgctgcccccccggcgccctgcccctggcccacgtgaacggctgcgccgagcacaacggcggccccagcctggacacctacggcagcgacggcctgagcagaagagacgccagagaggtggccatcgaggtgagcctggacagctgcctgagcgaccacggccagagcctgaacaagacccaggaggaccagtgctacgtgaacagaacccacttctag

SEQ ID NO: 99841 - DNA, 723 bp, Artificial Sequence
  Description of Artificial Sequence: Synthetic coding sequence
atgggcgacgccctgggcagcgtggtggtggtgatcaccgccatcatcttctacgtgctgcccctgaagagcgaggacccctgcaactggcagtgctacatcgaccccagcctgaccgtgctgatggtgatcatcatcctgagcagcgccttccccctgatcaaggagaccgccgccatcctgctgcagatggtgcccaagggcgtgaacatggaggagctgatgagcaagctgagcgccgtgcccggcatcagcagcgtgcacgaggtgcacatctgggagctggtgagcggcaagatcatcgccaccctgcacatcaagtaccccaaggacagaggctaccaggacgccagcaccaagatcagagagatcttccaccacgccggcatccacaacgtgaccatccagttcgagaacgtggacctgaaggagcccctggagcagaaggacctgctgctgctgtgcaacagcccctgcatcagcaagggctgcgccaagcagctgtgctgcccccccggcgccctgcccctggcccacgtgaacggctgcgccgagcacaacggcggccccagcctggacacctacggcagcgacggcctgagcagaagagacgccagagaggtggccatcgaggtgagcctggacagctgcctgagcgaccacggccagagcctgaacaagacccaggaggaccagtgctacgtgaacagaacccacttctag

SEQ ID NO: 99842 - DNA, 672 bp, Artificial Sequence
  Description of Artificial Sequence: Synthetic coding sequence
atgggcagatacagcggcaagacctgcagactgctgttcatgctggtgctgaccgtggccttcttcgtggccgagctggtgagcggctacctgggcaacagcatcgccctgctgagcgacagcttcaacatgctgagcgacctgatcagcctgtgcgtgggcctgagcgccggctacatcgccagaagacccaccagaggcttcagcgccacctacggctacgccagagccgaggtggtgggcgccctgagcaacgccgtgttcctgaccgccctgtgcttcaccatcttcgtggaggccgtgctgagactggccagacccgagagaatcgacgaccccgagctggtgctgatcgtgggcgtgctgggcctgctggtgaacgtggtgggcctgctgatcttccaggactgcgccgcctggttcgcctgctgcctgagaggcagaagcagaagactgcagcagagacagcagctggccgagggctgcgtgcccggcgccttcggcggcccccagggcgccgaggaccccagaagagccgccgaccccaccgcccccggcagcgacagcgccgtgaccctgagaggcaccagcgtggagagaaagagagagaagggcgccaccgtgttcgccaacgtggccgagctgatccacaacaccagattcctgctgtag

SEQ ID NO: 99843 - DNA, 567 bp, Artificial Sequence
  Description of Artificial Sequence: Synthetic coding sequence
atggaccacagccaccacatgggcatgagctacatggacagcaacagcaccatgcagcccagccaccaccaccccaccaccagcgccagccacagccacggcggcggcgacagcagcatgatgatgatgcccatgaccttctacttcggcttcaagaacgtggagctgctgttcagcggcctggtgatcaacaccgccggcgagatggccggcgccttcgtggccgtgttcctgctggccatgttctacgagggcctgaagatcgccagagagagcctgctgagaaagagccaggtgagcatcagatacaacagcatgcccgtgcccggccccaacggcaccatcctgatggagacccacaagaccgtgggccagcagatgctgagcttcccccacctgctgcagacctgctgggactacagacacgagcccccccacctgagcctgagccccagctactacagcgacctgaactaccccaagaaggccaaggtgctgctgagagtgagcgtggagctgatgatccaggaggccctgatgatcaccgccggcgacagcctgtgctag

SEQ ID NO: 99844 - DNA, 573 bp, Artificial Sequence
  Description of Artificial Sequence: Synthetic coding sequence
atggaccacagccaccacatgggcatgagctacatggacagcaacagcaccatgcagcccagccaccaccaccccaccaccagcgccagccacagccacggcggcggcgacagcagcatgatgatgatgcccatgaccttctacttcggcttcaagaacgtggagctgctgttcagcggcctggtgatcaacaccgccggcgagatggccggcgccttcgtggccgtgttcctgctggccatgttctacgagggcctgaagatcgccagagagagcctgctgagaaagagccaggtgagcatcagatacaacagcatgcccgtgcccggccccaacggcaccatcctgatggagacccacaagaccgtgggccagcagatgctgagcttcccccacctgctgcagaccgtgctgcacatcatccaggtggtgatcagctacttcctgatgctgatcttcatgacctacaacggctacctgtgcatcgccgtggccgccggcgccggcaccggctacttcctgttcagctggaagaaggccgtggtggtggacatcaccgagcactgccactag

SEQ ID NO: 99845 - DNA, 432 bp, Artificial Sequence
  Description of Artificial Sequence: Synthetic coding sequence
atggccatgcacttcatcttcagcgacaccgccgtgctgctgttcgacttctggagcgtgcacagccccgccggcatggccctgagcgtgctggtgctgctgctgctggccgtgctgtacgagggcatcaaggtgggcaaggccaagctgctgaaccaggtgctggtgaacctgcccaccagcatcagccagcagaccatcgccgagaccgacggcgacagcgccggcagcgacagcttccccgtgggcagaacccaccacagatggtacctgtgccacttcggccagagcctgatccacgtgatccaggtggtgatcggctacttcatcatgctggccgtgatgagctacaacacctggatcttcctgggcgtggtgctgggcagcgccgtgggctactacctggcctaccccctgctgagcaccgcctag

SEQ ID NO: 99846 - DNA, 1650 bp, Artificial Sequence
  Description of Artificial Sequence: Synthetic coding sequence
atgagccccaccatcagccacaaggacagcagcagacagagaagacccggcaacttcagccacagcctggacatgaagagcggccccctgccccccggcggctgggacgacagccacctggacagcgccggcagagagggcgacagagaggccctgctgggcgacaccggcaccggcgacttcctgaaggccccccagagcttcagagccgagctgagcagcatcctgctgctgctgttcctgtacgtgctgcagggcatccccctgggcctggccggcagcatccccctgatcctgcagagcaagaacgtgagctacaccgaccaggccttcttcagcttcgtgttctggcccttcagcctgaagctgctgtgggcccccctggtggacgccgtgtacgtgaagaacttcggcagaagaaagagctggctggtgcccacccagtacatcctgggcctgttcatgatctacctgagcacccaggtggacagactgctgggcaacaccgacgacagaacccccgacgtgatcgccctgaccgtggccttcttcctgttcgagttcctggccgccacccaggacatcgccgtggacggctgggccctgaccatgctgagcagagagaacgtgggctacgccagcacctgcaacagcgtgggccagaccgccggctacttcctgggcaacgtgctgttcctggccctggagagcgccgacttctgcaacaagtacctgagattccagccccagcccagaggcatcgtgaccctgagcgacttcctgttcttctggggcaccgtgttcctgatcaccaccaccctggtggccctgctgaagaaggagaacgaggtgagcgtggtgaaggaggagacccagggcatcaccgacacctacaagctgctgttcgccatcatcaagatgcccgccgtgctgaccttctgcctgctgatcctgaccgccaagatcggcttcagcgccgccgacgccgtgaccggcctgaagctggtggaggagggcgtgcccaaggagcacctggccctgctggccgtgcccatggtgcccctgcagatcatcctgcccctgatcatcagcaagtacaccgccggcccccagcccctgaacaccttctacaaggccatgccctacagactgctgctgggcctggagtacgccctgctggtgtggtggacccccaaggtggagcaccagggcggcttccccatctactactacatcgtggtgctgctgagctacgccctgcaccaggtgaccgtgtacagcatgtacgtgagcatcatggccttcaacgccaaggtgagcgaccccctgatcggcggcacctacatgaccctgctgaacaccgtgagcaacctgggcggcaactggcccagcaccgtggccctgtggctggtggaccccctgaccgtgaaggagtgcgtgggcgccagcaaccagaactgcagaacccccgacgccgtggagctgtgcaagaagctgggcggcagctgcgtgaccgccctggacggctactacgtggagagcatcatctgcgtgttcatcggcttcggctggtggttcttcctgggccccaagttcaagaagctgcaggacgagggcagcagcagctggaagtgcaagagaaacaactag

SEQ ID NO: 99847 - DNA, 1650 bp, Artificial Sequence; identical to SEQ ID NO: 99846
  Description of Artificial Sequence: Synthetic coding sequence

SEQ ID NO: 99848 - DNA, 1920 bp, Artificial Sequence
  Description of Artificial Sequence: Synthetic coding sequence
atgctgagctacggcgagagactgggcagccccgccgtgagccccctgcccgtgagaggcggccacgtgatgagaggcaccgccttcgcctacgtgcccagcccccaggtgctgcacagaatccccggcaccagcgcctacgccttccccagcctgggccccgtggccctggccgagcacacctgcccctgcggcgaggtgctggagagacacgagcccctgcccgccaagctggccctggaggaggagcagaagcccgagagcagactggtgcccaagctgagacaggccggcgccatgctgctgaaggtgcccctgatgctgaccttcctgtacctgttcgtgtgcagcctggacatgctgagcagcgccttccagctggccggcggcaaggtggccggcgacatcttcaaggacaacgccatcctgagcaaccccgtggccggcctggtggtgggcatcctggtgaccgtgctggtgcagagcagcagcaccagcaccagcatcatcgtgagcatggtgagcagcggcctgctggaggtgagcagcgccatccccatcatcatgggcagcaacatcggcaccagcgtgaccaacaccatcgtggccctgatgcaggccggcgacagaaccgacttcagaagagccttcgccggcgccaccgtgcacgactgcttcaactggctgagcgtgctggtgctgctgcccctggaggccgccaccggctacctgcaccacatcaccagactggtggtggccagcttcaacatccacggcggcagagacgcccccgacctgctgaagatcatcaccgagcccttcaccaagctgatcatccagctggacgagagcgtgatcaccagcatcgccaccggcgacgagagcctgagaaaccacagcctgatccagatctggtgccaccccgacagcctgcaggcccccaccagcatgagcagagccgaggccaacagcagccagaccctgggcaacgccaccatggagaagtgcaaccacatcttcgtggacaccggcctgcccgacctggccgtgggcctgatcctgctggccggcagcctggtgctgctgtgcacctgcctgatcctgctggtgaagatgctgaacagcctgctgaagggccaggtggccaaggtgatccagaaggtgatcaacaccgacttccccgcccccttcacctgggtgaccggctacttcgccatggtggtgggcgccagcatgaccttcgtggtgcagagcagcagcgtgttcaccagcgccatcacccccctgatcggcctgggcgtgatcagcatcgagagagcctaccccctgaccctgggcagcaacatcggcaccaccaccaccgccatcctggccgccctggccagccccagagagaagctgagcagcgccttccagatcgccctgtgccacttcttcttcaacatcagcggcatcctgctgtggtaccccgtgccctgcaccagactgcccatcagaatggccaaggccctgggcaagagaaccgccaagtacagatggttcgccgtgctgtacctgctggtgtgcttcctgctgctgcccagcctggtgttcggcatcagcatggccggctggcaggtgatggtgggcgtgggcacccccttcggcgccctgctggccttcgtggtgctgatcaacgtgctgcagagcagaagccccggccacctgcccaagtggctgcagacctgggacttcctgcccagatggatgcacagcctgaagcccctggaccacctgatcaccagagccaccctgtgctgcgccagacccgagcccagaagcccccccctgccccccagagtgttcctggaggagctgccccccgccacccccagccccagactggccctgcccgcccaccacaacgccaccagactgtag

SEQ ID NO: 99849 - DNA, 330 bp, Artificial Sequence
  Description of Artificial Sequence: Synthetic coding sequence
atgctgagctacggcgagagactgggcagccccgccgtgagccccctgcccgtgagaggcggccacgtgatgagaggcaccgccttcgcctacgtgcccagcccccaggtgctgcacagaatccccggcaccagcgcctacgccttccccagcctgggccccgtggccctggccgagcacacctgcccctgcggcgaggtgctggagagacacgagcccctgcccgccaagctggccctggaggaggagcagaagcccgagagcagactggtgcccaagctgagacaggccggcgccatgctgctgaaggtgcccctgatgctgacctag

SEQ ID NO: 99850 - DNA, 1023 bp, Artificial Sequence
  Description of Artificial Sequence: Synthetic coding sequence
atgctgagctacggcgagagactgggcagccccgccgtgagccccctgcccgtgagaggcggccacgtgatgagaggcaccgccttcgcctacgtgcccagcccccaggtgctgcacagaatccccggcaccagcgcctacgccttccccagcctgggccccgtggccctggccgagcacacctgcccctgcggcgaggtgctggagagacacgagcccctgcccgccaagctggccctggaggaggagcagaagcccgagagcagactggtgcccaagctgagacaggccggcgccatgctgctgaaggtgcccctgatgctgaccttcctgtacctgttcgtgtgcagcctggacatgctgagcagcgccttccagctggccggcggcaaggtggccggcgacatcttcaaggacaacgccatcctgagcaaccccgtggccggcctggtggtgggcatcctggtgaccgtgctggtgcagagcagcagcaccagcaccagcatcatcgtgagcatggtgagcagcggcctgctggaggtgagcagcgccatccccatcatcatgggcagcaacatcggcaccagcgtgaccaacaccatcgtggccctgatgcaggccggcgacagaaccgacttcagaagagccttcgccggcgccaccgtgcacgactgcttcaactggctgagcgtgctggtgctgctgcccctggaggccgccaccggctacctgcaccacatcaccagactggtggtggccagcttcaacatccacggcggcagagacgcccccgacctgctgaagatcatcaccgagcccttcaccaagctgatcatccagctggacgagagcgtgatcaccagcatcgccaccggcgacgagagcctgagaaaccacagcctgatccagatctggtgccaccccgacagcctgcagcagaacctggagggcagagagatcacccacttcgacctgagaaagaagcaggccatggaggacagcagcgtgccccactgcccctag

SEQ ID NO: 99851 - DNA, 2073 bp, Artificial Sequence
  Description of Artificial Sequence: Synthetic coding sequence
atggccccctggcccgagctgggcgacgcccagcccaaccccgacaagtacctggagggcgccgccggccagcagcccaccgcccccgacaagagcaaggagaccaacaagaccgacaacaccgaggcccccgtgaccaagatcgagctgctgcccagctacagcaccgccaccctgatcgacgagcccaccgaggtggacgacccctggaacctgcccaccctgcaggacagcggcatcaagtggagcgagagagacaccaagggcaagatcctgtgcttcttccagggcatcggcagactgatcctgctgctgggcttcctgtacttcttcgtgtgcagcctggacatcctgagcagcgccttccagctggtgggcggcaagatggccggccagttcttcagcaacagcagcatcatgagcaaccccctgctgggcctggtgatcggcgtgctggtgaccgtgctggtgcagagcagcagcaccagcaccagcatcgtggtgagcatggtgagcagcagcctgctgaccgtgagagccgccatccccatcatcatgggcgccaacatcggcaccagcatcaccaacaccatcgtggccctgatgcaggtgggcgacagaagcgagttcagaagagccttcgccggcgccaccgtgcacgacttcttcaactggctgagcgtgctggtgctgctgcccgtggaggtggccacccactacctggagatcatcacccagctgatcgtggagagcttccacttcaagaacggcgaggacgcccccgacctgctgaaggtgatcaccaagcccttcaccaagctgatcgtgcagctggacaagaaggtgatcagccagatcgccatgaacgacgagaaggccaagaacaagagcctggtgaagatctggtgcaagaccttcaccaacaagacccagatcaacgtgaccgtgcccagcaccgccaactgcaccagccccagcctgtgctggaccgacggcatccagaactggaccatgaagaacgtgacctacaaggagaacatcgccaagtgccagcacatcttcgtgaacttccacctgcccgacctggccgtgggcaccatcctgctgatcctgagcctgctggtgctgtgcggctgcctgatcatgatcgtgaagatcctgggcagcgtgctgaagggccaggtggccaccgtgatcaagaagaccatcaacaccgacttccccttccccttcgcctggctgaccggctacctggccatcctggtgggcgccggcatgaccttcatcgtgcagagcagcagcgtgttcaccagcgccctgacccccctgatcggcatcggcgtgatcaccatcgagagagcctaccccctgaccctgggcagcaacatcggcaccaccaccaccgccatcctggccgccctggccagccccggcaacgccctgagaagcagcctgcagatcgccctgtgccacttcttcttcaacatcagcggcatcctgctgtggtaccccatccccttcaccagactgcccatcagaatggccaagggcctgggcaacatcagcgccaagtacagatggttcgccgtgttctacctgatcatcttcttcttcctgatccccctgaccgtgttcggcctgagcctggccggctggagagtgctggtgggcgtgggcgtgcccgtggtgttcatcatcatcctggtgctgtgcctgagactgctgcagagcagatgccccagagtgctgcccaagaagctgcagaactggaacttcctgcccctgtggatgagaagcctgaagccctgggacgccgtggtgagcaagttcaccggctgcttccagatgagatgctgctgctgctgcagagtgtgctgcagagcctgctgcctgctgtgcgactgccccaagtgctgcagatgcagcaagtgctgcgaggacctggaggaggcccaggagggccaggacgtgcccgtgaaggcccccgagaccttcgacaacatcaccatcagcagagaggcccagggcgaggtgcccgccagcgacagcaagaccgagtgcaccgccctgtag

SEQ ID NO: 99852 - DNA, 2070 bp, Artificial Sequence
  Description of Artificial Sequence: Synthetic coding sequence
atggccccctggcccgagctgggcgacgcccagcccaaccccgacaagtacctggagggcgccgccggccagcagcccaccgcccccgacaagagcaaggagaccaacaagaacaacaccgaggcccccgtgaccaagatcgagctgctgcccagctacagcaccgccaccctgatcgacgagcccaccgaggtggacgacccctggaacctgcccaccctgcaggacagcggcatcaagtggagcgagagagacaccaagggcaagatcctgtgcttcttccagggcatcggcagactgatcctgctgctgggcttcctgtacttcttcgtgtgcagcctggacatcctgagcagcgccttccagctggtgggcggcaagatggccggccagttcttcagcaacagcagcatcatgagcaaccccctgctgggcctggtgatcggcgtgctggtgaccgtgctggtgcagagcagcagcaccagcaccagcatcgtggtgagcatggtgagcagcagcctgctgaccgtgagagccgccatccccatcatcatgggcgccaacatcggcaccagcatcaccaacaccatcgtggccctgatgcaggtgggcgacagaagcgagttcagaagagccttcgccggcgccaccgtgcacgacttcttcaactggctgagcgtgctggtgctgctgcccgtggaggtggccacccactacctggagatcatcacccagctgatcgtggagagcttccacttcaagaacggcgaggacgcccccgacctgctgaaggtgatcaccaagcccttcaccaagctgatcgtgcagctggacaagaaggtgatcagccagatcgccatgaacgacgagaaggccaagaacaagagcctggtgaagatctggtgcaagaccttcaccaacaagacccagatcaacgtgaccgtgcccagcaccgccaactgcaccagccccagcctgtgctggaccgacggcatccagaactggaccatgaagaacgtgacctacaaggagaacatcgccaagtgccagcacatcttcgtgaacttccacctgcccgacctggccgtgggcaccatcctgctgatcctgagcctgctggtgctgtgcggctgcctgatcatgatcgtgaagatcctgggcagcgtgctgaagggccaggtggccaccgtgatcaagaagaccatcaacaccgacttccccttccccttcgcctggctgaccggctacctggccatcctggtgggcgccggcatgaccttcatcgtgcagagcagcagcgtgttcaccagcgccctgacccccctgatcggcatcggcgtgatcaccatcgagagagcctaccccctgaccctgggcagcaacatcggcaccaccaccaccgccatcctggccgccctggccagccccggcaacgccctgagaagcagcctgcagatcgccctgtgccacttcttcttcaacatcagcggcatcctgctgtggtaccccatccccttcaccagactgcccatcagaatggccaagggcctgggcaacatcagcgccaagtacagatggttcgccgtgttctacctgatcatcttcttcttcctgatccccctgaccgtgttcggcctgagcctggccggctggagagtgctggtgggcgtgggcgtgcccgtggtgttcatcatcatcctggtgctgtgcctgagactgctgcagagcagatgccccagagtgctgcccaagaagctgcagaactggaacttcctgcccctgtggatgagaagcctgaagccctgggacgccgtggtgagcaagttcaccggctgcttccagatgagatgctgctgctgctgcagagtgtgctgcagagcctgctgcctgctgtgcgactgccccaagtgctgcagatgcagcaagtgctgcgaggacctggaggaggcccaggagggccaggacgtgcccgtgaaggcccccgagaccttcgacaacatcaccatcagcagagaggcccagggcgaggtgcccgccagcgacagcaagaccgagtgcaccgccctgtag

SEQ ID NO: 99853 - DNA, 2070 bp, Artificial Sequence; identical to SEQ ID NO: 99852
  Description of Artificial Sequence: Synthetic coding sequence

SEQ ID NO: 99854 - DNA, 486 bp, Artificial Sequence
  Description of Artificial Sequence: Synthetic coding sequence
atggccccctggcccgagctgggcgacgcccagcccaaccccgacaagtacctggagggcgccgccggccagcagcccaccgcccccgacaagagcaaggagaccaacaagaccgacaacaccgaggcccccgtgaccaagatcgagctgctgcccagctacagcaccgccaccctgatcgacgagcccaccgaggtggacgacccctggaacctgcccaccctgcaggacagcggcatcaagtggagcgagagagacaccaagggcaagatcctgtgcttcttccagggcatcggcagactgatcctgctgctgggcttcctgtacttcttcgtgtgcagcctggacatcctgagcagcgccttccagctggtgggcggcaagatggccggccagttcttcagcaacagcagcatcatgagcaaccccctgctgggcctggtgatcggcgtgctggtgaccgtgctggtgcagagcagcagctag

SEQ ID NO: 99855 - DNA, 492 bp, Artificial Sequence
  Description of Artificial Sequence: Synthetic coding sequence
atggccccctggcccgagctgggcgacgcccagcccaaccccgacaagtacctggagggcgccgccggccagcagcccaccgcccccgacaagagcaaggagaccaacaagaacaacaccgaggcccccgtgaccaagatcgagctgctgcccagctacagcaccgccaccctgatcgacgagcccaccgaggtggacgacccctggaacctgcccaccctgcaggacagcggcatcaagtggagcgagagagacaccaagggcaagatcctgtgcttcttccagggcatcggcagactgatcctgctgctgggcttcctgtacttcttcgtgtgcagcctggacatcctgagcagcgccttccagctggtgggcggcaagatggccggccagttcttcagcaacagcagcatcatgagcaaccccctgctgggcctggtgatcggcgtgctggtgaccgtgctggtgcagagcagcagcaccagcacctag

SEQ ID NO: 99856 - DNA, 1800 bp, Artificial Sequence
  Description of Artificial Sequence: Synthetic coding sequence
atgcccagcagcctgcccggcagccaggtgccccaccccaccctggacgccgtggacctggtggagaagaccctgagaaacgagggcaccagcagcagcgcccccgtgctggaggagggcgacaccgacccctggaccctgccccagctgaaggacaccagccagccctggaaggagctgagagtggccggcagactgagaagagtggccggcagcgtgctgaaggcctgcggcctgctgggcagcctgtacttcttcatctgcagcctggacgtgctgagcagcgccttccagctgctgggcagcaaggtggccggcgacatcttcaaggacaacgtggtgctgagcaaccccgtggccggcctggtgatcggcgtgctggtgaccgccctggtgcagagcagcagcaccagcagcagcatcgtggtgagcatggtggccgccaagctgctgaccgtgagagtgagcgtgcccatcatcatgggcgtgaacgtgggcaccagcatcaccagcaccctggtgagcatggcccagagcggcgacagagacgagttccagagagccttcagcggcagcgccgtgcacggcatcttcaactggctgaccgtgctggtgctgctgcccctggagagcgccaccgccctgctggagagactgagcgagctggccctgggcgccgccagcctgacccccagagcccaggcccccgacatcctgaaggtgctgaccaagcccctgacccacctgatcgtgcagctggacagcgacatgatcatgagcagcgccaccggcaacgccaccaacagcagcctgatcaagcactggtgcggcaccaccggccagcccacccaggagaacagcagctgcggcgccttcggcccctgcaccgagaagaacagcaccgcccccgccgacagactgccctgcagacacctgttcgccggcaccgagctgaccgacctggccgtgggctgcatcctgctggccggcagcctgctggtgctgtgcggctgcctggtgctgatcgtgaagctgctgaacagcgtgctgagaggcagagtggcccaggtggtgagaaccgtgatcaacgccgacttccccttccccctgggctggctgggcggctacctggccgtgctggccggcgccggcctgaccttcgccctgcagagcagcagcgtgttcaccgccgccgtggtgcccctgatgggcgtgggcgtgatcagcctggacagagcctaccccctgctgctgggcagcaacatcggcaccaccaccaccgccctgctggccgccctggccagccccgccgacagaatgctgagcgccctgcaggtggccctgatccacttcttcttcaacctggccggcatcctgctgtggtacctggtgcccgccctgagactgcccatccccctggccagacacttcggcgtggtgaccgccagatacagatgggtggccggcgtgtacctgctgctgggcttcctgctgctgcccctggccgccttcggcctgagcctggccggcggcatggagctggccgccgtgggcggccccctggtgggcctggtgctgctggtgatcctggtgaccgtgctgcagagaagaagacccgcctggctgcccgtgagactgagaagctgggcctggctgcccgtgtggctgcacagcctggagccctgggacagactggtgaccagatgctgcccctgcaacgtgtgcagcccccccaaggccaccaccaaggaggcctactgctacgagaaccccgagatcctggccagccagcagctgtag

SEQ ID NO: 99857 - DNA, 1800 bp, Artificial Sequence; identical to SEQ ID NO: 99856
  Description of Artificial Sequence: Synthetic coding sequence

SEQ ID NO: 99858 - DNA, 570 bp, Artificial Sequence
  Description of Artificial Sequence: Synthetic coding sequence
atgaccctgatggccgccgtgtacaccatcgccctgagatacaccagaaccagcgacaaggagctgtacttcagcaccaccgccgtgtgcatcaccgaggtgatcaagctgctgctgagcgtgggcatcctggccaaggagaccggcagcctgggcagattcaaggccagcctgagagagaacgtgctgggcagccccaaggagctgctgaagctgagcgtgcccagcctggtgtacgccgtgcagaacaacatggccttcctggccctgagcaacctggacgccgccgtgtaccaggtgacctaccagctgaagatcccctgcaccgccctgtgcaccgtgctgatgctgaacagaaccctgagcaagctgcagtgggtgagcgtgttcatgctgtgcgccggcgtgaccctggtgcagtggaagcccgcccaggccaccaaggtggtggagtacatcctgaagaagttcaaggagttcagatacttcagcctgggcgagaagcacagcaacgtgagcatcagagactactgcgacatcagctggagactgctggtgagatggagctag

SEQ ID NO: 99859 - DNA, 1014 bp, Artificial Sequence
  Description of Artificial Sequence: Synthetic coding sequence
atggccgcccccagagacaacgtgaccctgctgttcaagctgtactgcctggccgtgatgaccctgatggccgccgtgtacaccatcgccctgagatacaccagaaccagcgacaaggagctgtacttcagcaccaccgccgtgtgcatcaccgaggtgatcaagctgctgctgagcgtgggcatcctggccaaggagaccggcagcctgggcagattcaaggccagcctgagagagaacgtgctgggcagccccaaggagctgctgaagctgagcgtgcccagcctggtgtacgccgtgcagaacaacatggccttcctggccctgagcaacctggacgccgccgtgtaccaggtgacctaccagctgaagatcccctgcaccgccctgtgcaccgtgctgatgctgaacagaaccctgagcaagctgcagtgggtgagcgtgttcatgctgtgcgccggcgtgaccctggtgcagtggaagcccgcccaggccaccaaggtggtggtggagcagaaccccctgctgggcttcggcgccatcgccatcgccgtgctgtgcagcggcttcgccggcgtgtacttcgagaaggtgctgaagagcagcgacaccagcctgtgggtgagaaacatccagatgtacctgagcggcatcatcgtgaccctggccggcgtgtacctgagcgacggcgccgagatcaaggagaagggcttcttctacggctacacctactacgtgtggttcgtgatcttcctggccagcgtgggcggcctgtacaccagcgtggtggtgaagtacaccgacaacatcatgaagggcttcagcgccgccgccgccatcgtgctgagcaccatcgccagcgtgatgctgttcggcctgcagatcaccctgaccttcgccctgggcaccctgctggtgtgcgtgagcatctacctgtacggcctgcccagacaggacaccaccagcatccagcagggcgagaccgccagcaaggagagagtgatcggcgtgtag

SEQ ID NO: 99860 - DNA, 837 bp, Artificial Sequence
  Description of Artificial Sequence: Synthetic coding sequence
atggccgcccccagagacaacgtgaccctgctgttcaagctgtactgcctggccgtgatgaccctgatggccgccgtgtacaccatcgccctgagatacaccagaaccagcgacaaggagctgtacttcagcaccaccgccgtgtgcatcaccgaggtgatcaagctgctgctgagcgtgggcatcctggccaaggagaccggcagcctgggcagattcaaggccagcctgagagagaacgtgctgggcagccccaaggagctgctgaagctgagcgtgcccagcctggtgtacgccgtgcagaacaacatggccttcctggccctgagcaacctggacgccgccgtgtaccaggtgacctaccagctgaagatcccctgcaccgccctgtgcaccgtgctgatgctgaacagaaccctgagcaagctgcagtgggtgagcgtgttcatgctgtgcgccggcgtgaccctggtgcagtggaagcccgcccaggccaccaaggtggtggtggagcagaaccccctgctgggcttcggcgccatcgccatcgccgtgctgtgcagcggcttcgccgtgctggccagcgtgggcggcctgtacaccagcgtggtggtgaagtacaccgacaacatcatgaagggcttcagcgccgccgccgccatcgtgctgagcaccatcgccagcgtgatgctgttcggcctgcagatcaccctgaccttcgccctgggcaccctgctggtgtgcgtgagcatctacctgtacggcctgcccagacaggacaccaccagcatccagcagggcgagaccgccagcaaggagagagtgatcggcgtgtag

SEQ ID NO: 99861 - DNA, 570 bp, Artificial Sequence
  Description of Artificial Sequence: Synthetic coding sequence
atggccgcccccagagacaacgtgaccctgctgttcaagctgtactgcctggccgtgatgaccctgatggccgccgtgtacaccatcgccctgagatacaccagaaccagcgacaaggagctgtacttcagcaccaccgccgtgtgcatcaccgaggtgatcaagctgctgctgagcgtgggcatcctggccaaggagaccggcagcctgggcagattcaaggccagcctgagagagaacgtgctgggcagccccaaggagctgctgaagctgagcgtgcccagcctggtgtacgccgtgcagaacaacatggccttcctggccctgagcaacctggacgccgccgtgtaccaggtgacctaccagctgaagatcccctgcaccgccctgtgcaccgtgctgatgctgaacagaaccctgagcaagctgcagtgggtgagcgtgttcatgctgtgcgccggcgtgaccctggtgcagtggaagcccgcccaggccaccaaggtggtgttcctgcaggtgctggtggccagcaccctgctgctgtggctgagcacccagaccaccagctag

SEQ ID NO: 99862 - DNA, 537 bp, Artificial Sequence
  Description of Artificial Sequence: Synthetic coding sequence
atggccgcccccagagacaacgtgaccctgctgttcaagctgtactgcctggccgtgatgaccctgatggccgccgtgtacaccatcgccctgagatacaccagaaccagcgacaaggagctgtacttcagcaccaccgccgtgtgcatcaccgaggtgatcaagctgctgctgagcgtgggcatcctggccaaggagaccggcagcctgggcagattcaaggccagcctgagagagaacgtgctgggcagccccaaggagctgctgaagctgagcgtgcccagcctggtgtacgccgtgcagaacaacatggccttcctggccctgagcaacctggacgccgccgtgtaccaggtgacctaccagctgaagatcccctgcaccgccctgtgcaccgtgctgatgctgaacagaaccctgagcaagctgcagaagaaggacttcagcatggtgacccacatcatgagcggcctgagcagcgtgagcatccaggagctgaaggtgctgagcagaagcttcatcttcttcctgagctag

SEQ ID NO: 99863 - DNA, 612 bp, Artificial Sequence
  Description of Artificial Sequence: Synthetic coding sequence
atgctgaacagaaccctgagcaagctgcagtgggtgagcgtgttcatgctgtgcgccggcgtgaccctggtgcagtggaagcccgcccaggccaccaaggtggtggtggagcagaaccccctgctgggcttcggcgccatcgccatcgccgtgctgtgcagcggcttcgccggcgtgtacttcgagaaggtgctgaagagcagcgacaccagcctgtgggtgagaaacatccagatgtacctgagcggcatcatcgtgaccctggccggcgtgtacctgagcgacggcgccgagatcaaggagaagggcttcttctacggctacacctactacgtgtggttcgtgatcttcctggccagcgtgggcggcctgtacaccagcgtggtggtgaagtacaccgacaacatcatgaagggcttcagcgccgccgccgccatcgtgctgagcaccatcgccagcgtgatgctgttcggcctgcagatcaccctgaccttcgccctgggcaccctgctggtgtgcgtgagcatctacctgtacggcctgcccagacaggacaccaccagcatccagcagggcgagaccgccagcaaggagagagtgatcggcgtgtag

SEQ ID NO: 99864 - DNA, 1191 bp, Artificial Sequence
  Description of Artificial Sequence: Synthetic coding sequence
atggccgccgtgggcgccggcggcagcaccgccgcccccggccccggcgccgtgagcgccggcgccctggagcccggcaccgccagcgccgcccacagaagactgaagtacatcagcctggccgtgctggtggtgcagaacgccagcctgatcctgagcatcagatacgccagaaccctgcccggcgacagattcttcgccaccaccgccgtggtgatggccgaggtgctgaagggcctgacctgcctgctgctgctgttcgcccagaagagaggcaacgtgaagcacctggtgctgttcctgcacgaggccgtgctggtgcagtacgtggacaccctgaagctggccgtgcccagcctgatctacaccctgcagaacaacctgcagtacgtggccatcagcaacctgcccgccgccaccttccaggtgacctaccagctgaagatcctgaccaccgccctgttcagcgtgctgatgctgaacagaagcctgagcagactgcagtgggccagcctgctgctgctgttcaccggcgtggccatcgtgcaggcccagcaggccggcggcggcggccccagacccctggaccagaaccccggcgccggcctggccgccgtggtggccagctgcctgagcagcggcttcgccggcgtgtacttcgagaagatcctgaagggcagcagcggcagcgtgtggctgagaaacctgcagctgggcctgttcggcaccgccctgggcctggtgggcctgtggtgggccgagggcaccgccgtggccaccagaggcttcttcttcggctacacccccgccgtgtggggcgtggtgctgaaccaggccttcggcggcctgctggtggccgtggtggtgaagtacgccgacaacatcctgaagggcttcgccaccagcctgagcatcgtgctgagcaccgtggccagcatcagactgttcggcttccacgtggaccccctgttcgccctgggcgccggcctggtgatcggcgccgtgtacctgtacagcctgcccagaggcgccgccaaggccatcgccagcgccagcgccagcgccagcggcccctgcgtgcaccagcagccccccggccagcccccccccccccagctgagcagccacagaggcgacctgatcaccgagcccttcctgcccaagctgctgaccaaggtgaagggcagctag

SEQ ID NO: 99865 - DNA, 492 bp, Artificial Sequence
  Description of Artificial Sequence: Synthetic coding sequence
atggccgccgtgggcgccggcggcagcaccgccgcccccggccccggcgccgtgagcgccggcgccctggagcccggcaccgccagcgccgcccacagaagactgaagtacatcagcctggccgtgctggtggtgcagaacgccagcctgatcctgagcatcagatacgccagaaccctgcccggcgacagattcttcgccaccaccgccgtggtgatggccgaggtgctgaagggcctgacctgcctgctgctgctgttcgcccagaagagaggcaacgtgaagcacctggtgctgttcctgcacgaggccgtgctggtgcagtacgtggacaccctgaagctggccgtgcccagcctgatctacaccctgcagaacaacctgcagtacgtggccatcagcaacctgcccgccgccaccttccaggtgagccccaagcccagcatggcccccgaggagctgaccggcctgggcaccggcgtgtgggagtag

SEQ ID NO: 99866 - DNA, 657 bp, Artificial Sequence
  Description of Artificial Sequence: Synthetic coding sequence
atgaagctgtgcagagacgcccacagaagactgaagtacatcagcctggccgtgctggtggtgcagaacgccagcctgatcctgagcatcagatacgccagaaccctgcccggcgacagattcttcgccaccaccgccgtggtgatggccgaggtgctgaagggcctgacctgcctgctgctgctgttcgcccagaagagaggcaacgtgaagcacctggtgctgttcctgcacgaggccgtgctggtgcagtacgtggacaccctgaagctggccgtgcccagcctgatctacaccctgcagaacaacctgcagtacgtggccatcagcaacctgcccgccgccaccttccagcccagccccagatgcagccagagccacagcctgtgcctgtgcctgagactgagagccctgagaagccccgccgccagcagagccgccaccaccaccgccgccgtgttccccccctggagaccccaccacggcgccctgagcgccaaggtgagcgccggcgaggtgagagccggcagcaacggcggcacccagggcagaggcaccggcgtggagggcgtgggccacctgcaggaccccagcagacacccccccggccccggcagcagcggcttcggcagatggagcttcctgcccggccactag

SEQ ID NO: 99867 - DNA, 1182 bp, Artificial Sequence
  Description of Artificial Sequence: Synthetic coding sequence
atggccgccgtgggcgccggcggcagcaccgccgcccccggccccggcgccgtgagcgccggcgccctggagcccggcaccgccagcgccgcccacagaagactgaagtacatcagcctggccgtgctggtggtgcagaacgccagcctgatcctgagcatcagatacgccagaaccctgcccggcgacagattcttcgccaccaccgccgtggtgatggccgaggtgctgaagggcctgacctgcctgctgctgctgttcgcccagaagagaggcaacgtgaagcacctggtgctgttcctgcacgaggccgtgctggtgcagtacgtggacaccctgaagctggccgtgcccagcctgatctacaccctgcagaacaacctgcagtacgtggccatcagcaacctgcccgccgccaccttccaggtgacctaccagctgaagatcctgaccaccgccctgttcagcgtgctgatgctgaacagaagcctgagcagactgcagtgggccagcctgctgctgctgttcaccggcgtggccatcgtgcaggcccagcaggccggcggcggcggccccagacccctggaccagaaccccggcgccggcctggccgccgtggtggccagctgcctgagcagcggcttcgccggcgtgtacttcgagaagatcctgaagggcagcagcggcagcgtgtggctgagaaacctgcagctgggcctgttcggcaccgccctgggcctggtgggcctgtggtgggccgagggcaccgccgtggccaccagaggcttcttcttcggctacacccccgccgtgtggggcgtggtgctgaaccaggccttcggcggcctgctggtggccgtggtggtgaagtacgccgacaacatcctgaagggcttcgccaccagcctgagcatcgtgctgagcaccgtggccagcatcagactgttcggcttccacgtggaccccctgttcgccctgggcgccggcctggtgatcggcgccgtgtacctgtacagcctgcccagaggcgccgccaaggccatcgccagcgccagcgccagcgccagcggcccctgcgtgcaccagcagccccccggccagcccccccccccccagctgagcagccacagaggcgacctgatcaccgagcccttcctgcccaagagcgtgctggtgaagtag

SEQ ID NO: 99868 - DNA, 675 bp, Artificial Sequence
  Description of Artificial Sequence: Synthetic coding sequence
atggccgccgtgggcgccggcggcagcaccgccgcccccggccccggcgccgtgagcgccggcgccctggagcccggcaccgccagcgccgcccacagaagactgaagtacatcagcctggccgtgctggtggtgcagaacgccagcctgatcctgagcatcagatacgccagaaccctgcccggcgacagattcttcgccaccaccgccgtggtgatggccgaggtgctgaagggcctgacctgcctgctgctgctgttcgcccagaagagaggcaacgtgaagcacctggtgctgttcctgcacgaggccgtgctggtgcagtacgtggacaccctgaagctggccgtgcccagcctgatctacaccctgcagaacaacctgcagtacgtggccatcagcaacctgcccgccgccaccttccagcccagccccagatgcagccagagccacagcctgtgcctgtgcctgagactgagagccctgagaagccccgccgccagcagagccgccaccaccaccgccgccgtgttccccccctggagaccccaccacggcgccctgagcgccaaggtggcccaccagggcgagggcttcctggccgccggcatcgaggacatcggcctggccagcttcagcctgctggccctgggccccgccggcaccaagctgtag

SEQ ID NO: 99869 - DNA, 999 bp, Artificial Sequence
  Description of Artificial Sequence: Synthetic coding sequence
atggccgccgtgggcgccggcggcagcaccgccgcccccggccccggcgccgtgagcgccggcgccctggagcccggcaccgccagcgccggcaacgtgaagcacctggtgctgttcctgcacgaggccgtgctggtgcagtacgtggacaccctgaagctggccgtgcccagcctgatctacaccctgcagaacaacctgcagtacgtggccatcagcaacctgcccgccgccaccttccaggtgacctaccagctgaagatcctgaccaccgccctgttcagcgtgctgatgctgaacagaagcctgagcagactgcagtgggccagcctgctgctgctgttcaccggcgtggccatcgtgcaggcccagcaggccggcggcggcggccccagacccctggaccagaaccccggcgccggcctggccgccgtggtggccagctgcctgagcagcggcttcgccggcgtgtacttcgagaagatcctgaagggcagcagcggcagcgtgtggctgagaaacctgcagctgggcctgttcggcaccgccctgggcctggtgggcctgtggtgggccgagggcaccgccgtggccaccagaggcttcttcttcggctacacccccgccgtgtggggcgtggtgctgaaccaggccttcggcggcctgctggtggccgtggtggtgaagtacgccgacaacatcctgaagggcttcgccaccagcctgagcatcgtgctgagcaccgtggccagcatcagactgttcggcttccacgtggaccccctgttcgccctgggcgccggcctggtgatcggcgccgtgtacctgtacagcctgcccagaggcgccgccaaggccatcgccagcgccagcgccagcgccagcggcccctgcgtgcaccagcagccccccggccagcccccccccccccagctgagcagccacagaggcgacctgatcaccgagcccttcctgcccaagagcgtgctggtgaagtag

SEQ ID NO: 99870 - DNA, 729 bp, Artificial Sequence
  Description of Artificial Sequence: Synthetic coding sequence
atggccgccgtgggcgccggcggcagcaccgccgcccccggccccggcgccgtgagcgccggcgccctggagcccggcaccgccagcgccgcccacagaagactgaagtacatcagcctggccgtgctggtggtgcagaacgccagcctgatcctgagcatcagatacgccagaaccctgcccggcgacagattcttcgccaccaccgccgtggtgatggccgaggtgctgaagggcctgacctgcctgctgctgctgttcgcccagaagagaggcaacgtgaagcacctggtgctgttcctgcacgaggccgtgctggtgcagtacgtggacaccctgaagctggccgtgcccagcctgatctacaccctgcagaacaacctgcagtacgtggccatcagcaacctgcccgccgccaccttccagcccagccccagatgcagccagagccacagcctgtgcctgtgcctgagactgagagccctgagaagccccgccgccagcagagccgccaccaccaccgccgccgtgttccccccctggagaccccaccacggcgccctgagcgccaaggtgagcgccggcgaggtgagagccggcagcaacggcggcacccagggcagaggcaccggcgtggagggcgtgggccacctgcaggaccccagcagacacccccccggccccggcagcagcggcttcggcagatggagcttcctgcccggccactag

SEQ ID NO: 99871 - DNA, 531 bp, Artificial Sequence
  Description of Artificial Sequence: Synthetic coding sequence
atggccgaggtgctgaagggcctgacctgcctgctgctgctgttcgcccagaagagaggcaacgtgaagcacctggtgctgttcctgcacgaggccgtgctggtgcagtacgtggacaccctgaagctggccgtgcccagcctgatctacaccctgcagaacaacctgcagtacgtggccatcagcaacctgcccgccgccaccttccaggtgacctaccagctgaagatcctgaccaccgccctgttcagcgtgctgatgctgaacagaagcctgagcagactgcagtgggccagcctgctgctgctgttcaccggcgtggccatcgtgcaggcccagcaggccggcggcggcggccccagacccctggaccagaaccccggcgccggcctggccgccgtggtggccagctgcctgagcagcggcttcgccggcgtgtacttcgagaagatcctgaagggcagcagcggcagcgtgtggctgagaaacctgcagctgggcctgttcggcaccgccctgggcctggtgtag

SEQ ID NO: 99872 - DNA, 1266 bp, Artificial Sequence
  Description of Artificial Sequence: Synthetic coding sequence
atggccgccgtgggcgccggcggcagcaccgccgcccccggccccggcgccgtgagcgccggcgccctggagcccggcaccgccagcgccgagctgctgctgacctgggaggaggccgaggccagaggccagggcctgccccagcccctgcccgacaccagcgtgagaatccccgcccacagaagactgaagtacatcagcctggccgtgctggtggtgcagaacgccagcctgatcctgagcatcagatacgccagaaccctgcccggcgacagattcttcgccaccaccgccgtggtgatggccgaggtgctgaagggcctgacctgcctgctgctgctgttcgcccagaagagaggcaacgtgaagcacctggtgctgttcctgcacgaggccgtgctggtgcagtacgtggacaccctgaagctggccgtgcccagcctgatctacaccctgcagaacaacctgcagtacgtggccatcagcaacctgcccgccgccaccttccaggtgacctaccagctgaagatcctgaccaccgccctgttcagcgtgctgatgctgaacagaagcctgagcagactgcagtgggccagcctgctgctgctgttcaccggcgtggccatcgtgcaggcccagcaggccggcggcggcggccccagacccctggaccagaaccccggcgccggcctggccgccgtggtggccagctgcctgagcagcggcttcgccggcgtgtacttcgagaagatcctgaagggcagcagcggcagcgtgtggctgagaaacctgcagctgggcctgttcggcaccgccctgggcctggtgggcctgtggtgggccgagggcaccgccgtggccaccagaggcttcttcttcggctacacccccgccgtgtggggcgtggtgctgaaccaggccttcggcggcctgctggtggccgtggtggtgaagtacgccgacaacatcctgaagggcttcgccaccagcctgagcatcgtgctgagcaccgtggccagcatcagactgttcggcttccacgtggaccccctgttcgccctgggcgccggcctggtgatcggcgccgtgtacctgtacagcctgcccagaggcgccgccaaggccatcgccagcgccagcgccagcgccagcggcccctgcgtgcaccagcagccccccggccagcccccccccccccagctgagcagccacagaggcgacctgatcaccgagcccttcctgcccaagagcgtgctggtgaagtag

SEQ ID NO: 99873 - DNA, 1068 bp, Artificial Sequence
  Description of Artificial Sequence: Synthetic coding sequence
atggccgaggtgcacagaagacagcacgccagagtgaagggcgaggcccccgccaagagcagcaccctgagagacgaggaggagctgggcatggccagcgccgagaccctgaccgtgttcctgaagctgctggccgccggcttctacggcgtgagcagcttcctgatcgtggtggtgaacaagagcgtgctgaccaactacagattccccagcagcctgtgcgtgggcctgggccagatggtggccaccgtggccgtgctgtgggtgggcaaggccctgagagtggtgaagttccccgacctggacagaaacgtgcccagaaagaccttccccctgcccctgctgtacttcggcaaccagatcaccggcctgttcagcaccaagaagctgaacctgcccatgttcaccgtgctgagaagattcagcatcctgttcaccatgttcgccgagggcgtgctgctgaagaagaccttcagctggggcatcaagatgaccgtgttcgccatgatcatcggcgccttcgtggccgccagcagcgacctggccttcgacctggagggctacgccttcatcctgatcaacgacgtgctgaccgccgccaacggcgcctacgtgaagcagaagctggacagcaaggagctgggcaagtacggcctgctgtactacaacgccctgttcatgatcctgcccaccctggccatcgcctacttcaccggcgacgcccagaaggccgtggagttcgagggctgggccgacaccctgttcctgctgcagttcaccctgagctgcgtgatgggcttcatcctgatgtacgccaccgtgctgtgcacccagtacaacagcgccctgaccaccaccatcgtgggctgcatcaagaacatcctgatcacctacatcggcatggtgttcggcggcgactacatcttcacctggaccaacttcatcggcctgaacatcagcatcgccggcagcctggtgtacagctacatcaccttcaccgaggagcagctgagcaagcagagcgaggccaacaacaagctggacatcaagggcaagggcgccgtgtag

SEQ ID NO: 99874 - DNA, 783 bp, Artificial Sequence
  Description of Artificial Sequence: Synthetic coding sequence
atggtggccaccgtggccgtgctgtgggtgggcaaggccctgagagtggtgaagttccccgacctggacagaaacgtgcccagaaagaccttccccctgcccctgctgtacttcggcaaccagatcaccggcctgttcagcaccaagaagctgaacctgcccatgttcaccgtgctgagaagattcagcatcctgttcaccatgttcgccgagggcgtgctgctgaagaagaccttcagctggggcatcaagatgaccgtgttcgccatgatcatcggcgccttcgtggccgccagcagcgacctggccttcgacctggagggctacgccttcatcctgatcaacgacgtgctgaccgccgccaacggcgcctacgtgaagcagaagctggacagcaaggagctgggcaagtacggcctgctgtactacaacgccctgttcatgatcctgcccaccctggccatcgcctacttcaccggcgacgcccagaaggccgtggagttcgagggctgggccgacaccctgttcctgctgcagttcaccctgagctgcgtgatgggcttcatcctgatgtacgccaccgtgctgtgcacccagtacaacagcgccctgaccaccaccatcgtgggctgcatcaagaacatcctgatcacctacatcggcatggtgttcggcggcgactacatcttcacctggaccaacttcatcggcctgaacatcagctgcatctgccacagaggcctgtgcgagctgagagtgggcagcgccaccctgggcggctag

SEQ ID NO: 99875 - DNA, 1104 bp, Artificial Sequence
  Description of Artificial Sequence: Synthetic coding sequence
atgagcagcagaagcgtgctgagccccgtggtgggcaccgacgcccccgaccagcacctggagctgaagaagccccaggagctgaaggagatggagagactgcccctggccaacgaggacaagaccatgttcgccaacctgaagtacgtgagcctgggcatcctggtgttccagaccaccagcctggtgctgaccatgagatacagcagaaccctgaaggaggagggccccagatacctgagcagcaccgccgtggtggtggccgagctgctgaagatcatggcctgcatcctgctggtgtacaaggacagcaagtgcagcctgagagccctgaacagagtgctgcacgacgagatcctgaacaagcccatggagaccctgaagctggccatccccagcggcatctacaccctgcagaacaacctgctgtacgtggccctgagcaacctggacgccgccacctaccaggtgacctaccagctgaagatcctgaccaccgccctgttcagcgtgagcatgctgagcaagaagctgggcgtgtaccagtggctgagcctggtgatcctgatgaccggcgtggccttcgtgcagtggcccagcgacagccagctggacagcaaggagctgagcgccggcagccagttcgtgggcctgatggccgtgctgaccgcctgcttcagcagcggcttcgccggcgtgtacttcgagaagatcctgaaggagaccaagcagagcgtgtggatcagaaacatccagctgggcttcttcggcagcatcttcggcctgatgggcgtgtacatctacgacggcgagctggtgagcaagaacggcttcttccagggctacaacagactgacctggatcgtggtggtgctgcaggccctgggcggcctggtgatcgccgccgtgatcaagtacgccgacaacatcctgaagggcttcgccaccagcctgagcatcatcctgagcaccctgatcagctacttctggctgcaggacttcgtgcccaccagcgtgttcttcctgggcgccatcctggtgatcaccgccaccttcctgtacggctacgaccccaagcccgccggcaaccccaccaaggcctag

SEQ ID NO: 99876 - DNA, 978 bp, Artificial Sequence
  Description of Artificial Sequence: Synthetic coding sequence
atgttcgccaacctgaagtacgtgagcctgggcatcctggtgttccagaccaccagcctggtgctgaccatgagatacagcagaaccctgaaggaggagggccccagatacctgagcagcaccgccgtggtggtggccgagctgctgaagatcatggcctgcatcctgctggtgtacaaggacagcaagtgcagcctgagagccctgaacagagtgctgcacgacgagatcctgaacaagcccatggagaccctgaagctggccatccccagcggcatctacaccctgcagaacaacctgctgtacgtggccctgagcaacctggacgccgccacctaccaggtgacctaccagctgaagatcctgaccaccgccctgttcagcgtgagcatgctgagcaagaagctgggcgtgtaccagtggctgagcctggtgatcctgatgaccggcgtggccttcgtgcagtggcccagcgacagccagctggacagcaaggagctgagcgccggcagccagttcgtgggcctgatggccgtgctgaccgcctgcttcagcagcggcttcgccggcgtgtacttcgagaagatcctgaaggagaccaagcagagcgtgtggatcagaaacatccagctgggcttcttcggcagcatcttcggcctgatgggcgtgtacatctacgacggcgagctggtgagcaagaacggcttcttccagggctacaacagactgacctggatcgtggtggtgctgcaggccctgggcggcctggtgatcgccgccgtgatcaagtacgccgacaacatcctgaagggcttcgccaccagcctgagcatcatcctgagcaccctgatcagctacttctggctgcaggacttcgtgcccaccagcgtgttcttcctgggcgccatcctggtgatcaccgccaccttcctgtacggctacgaccccaagcccgccggcaaccccaccaaggcctag

SEQ ID NO: 99877 - DNA, 675 bp, Artificial Sequence
  Description of Artificial Sequence: Synthetic coding sequence
atgttcgccaacctgaagtacgtgagcctgggcatcctggtgttccagaccaccagcctggtgctgaccatgagatacagcagaaccctgaaggaggagggccccagatacctgagcagcaccgccgtggtggtggccgagctgctgaagatcatggcctgcatcctgctggtgtacaaggacagcaagtgcagcctgagagccctgaacagagtgctgcacgacgagatcctgaacaagcccatggagaccctgaagctggccatccccagcggcatctacaccctgcagaacaacctgctgtacgtggccctgagcaacctggacgccgccacctaccaggtgacctaccagctgaagatcctgaccaccgccctgttcagcgtgagcatgctgagcaagaagctgggcgtgtaccagtggctgagcctggtgatcctgatgaccggcgtggccttcgtgcagtggcccagcgacagccagctggacagcaaggagctgagcgccggcagccagttcgtgggcctgatggccgtgctgaccgcctgcttcagcagcggcttcgccggcgtgtacttcgagaagatcctgaaggagaccaagcagagcgtgtggatcagaaacatccagctgggcttcttcggcagcatcttcggcctgatgggcgtgtactag

SEQ ID NO: 99878 - DNA, 978 bp, Artificial Sequence; identical to SEQ ID NO: 99876
  Description of Artificial Sequence: Synthetic coding sequence

SEQ ID NO: 99879 - DNA, 663 bp, Artificial Sequence
  Description of Artificial Sequence: Synthetic coding sequence
atgttcgccaacctgaagtacgtgagcctgggcatcctggtgttccagaccaccagcctggtgctgaccatgagatacagcagaaccctgaaggaggagggccccagatacctgagcagcaccgccgtggtggtggccgagctgctgaagatcatggcctgcatcctgctggtgtacaaggacagcaagtgcagcctgagagccctgaacagagtgctgcacgacgagatcctgaacaagcccatggagaccctgaagctggccatccccagcggcatctacaccctgcagaacaacctgctgtacgtggccctgagcaacctggacgccgccacctaccaggtgacctaccagctgaagatcctgaccaccgccctgttcagcgtgagcatgctgagcaagaagctgggcgtgtaccagtggctgagcctggtgatcctgatgaccggcgtggccttcgtgcagtggcccagcgacagccagctggacagcaaggagctgagcgccggcagccagttcgtgggcctgatggccgtgctgaccgcctgcttcagcagcggcttcgccggcgtgtacttcgagaagatcctgaaggagaccaagcagagcgtgtggatcagaaacatccagctggtgagcttcagcctggagcccagcctgtag

SEQ ID NO: 99880 - DNA, 258 bp, Artificial Sequence
  Description of Artificial Sequence: Synthetic coding sequence
atgttcgccaacctgaagtacgtgagcctgggcatcctggtgttccagaccaccagcctggtgctgaccatgagatacagcagaaccctgaaggaggagggccccagatacctgagcagcaccgccgtggtggtggccgagctgctgaagatcatggcctgcatcctgctggtgtacaaggacagcaagtgcagcctgagagccctgaacagagtgctgcacgacgagatcctgaacaagcccatggagaccctgtag

SEQ ID NO: 99881 - DNA, 1104 bp, Artificial Sequence; identical to SEQ ID NO: 99875
  Description of Artificial Sequence: Synthetic coding sequence

SEQ ID NO: 99882 - DNA, 969 bp, Artificial Sequence
  Description of Artificial Sequence: Synthetic coding sequence
atggccagcagcagcagcctggtgcccgacagactgagactgcccctgtgcttcctgggcgtgttcgtgtgctacttctactacggcatcctgcaggagaagatcaccagaggcaagtacggcgagggcgccaagcaggagaccttcaccttcgccctgaccctggtgttcatccagtgcgtgatcaacgccgtgttcgccaagatcctgatccagttcttcgacaccgccagagtggacagaaccagaagctggctgtacgccgcctgcagcatcagctacctgggcgccatggtgagcagcaacagcgccctgcagttcgtgaactaccccacccaggtgctgggcaagagctgcaagcccatccccgtgatgctgctgggcgtgaccctgctgaagaagaagtaccccctggccaagtacctgtgcgtgctgctgatcgtggccggcgtggccctgttcatgtacaagcccaagaaggtggtgggcatcgaggagcacaccgtgggctacggcgagctgctgctgctgctgagcctgaccctggacggcctgaccggcgtgagccaggaccacatgagagcccactaccagaccggcagcaaccacatgatgctgaacatcaacctgtggagcaccctgctgctgggcatgggcatcctgttcaccggcgagctgtgggagttcctgagcttcgccgagagataccccgccatcatctacaacatcctgctgttcggcctgaccagcgccctgggccagagcttcatcttcatgaccgtggtgtacttcggccccctgacctgcagcatcatcaccaccaccagaaagttcttcaccatcctggccagcgtgatcctgttcgccaaccccatcagccccatgcagtgggtgggcaccgtgctggtgttcctgggcctgggcctggacgccaagttcggcaagggcgccaagaagaccagccactag

SEQ ID NO: 99883 - DNA, 450 bp, Artificial Sequence
  Description of Artificial Sequence: Synthetic coding sequence
ccccagagctgcctgatcggcaagatcagcagagccagagaccagagcagaggctgcagattcccctggcccagcggcatggagcccagaaccagagtgggccccctgctggtgctgcccgacgcctgcaagcagcccatcagacccagaccctggtgccacagcagaaacaccgtgagcagctgcctgggcaccagaggcaagtacggcgagggcgccaagcaggagaccttcaccttcgccctgaccctggtgttcatccagtgcgtgatcaacgccgtgttcgccaagatctggtggatcgtgcccggcgccggcagcatgctgcccgtgctgagccccatctgggtgccctggagccccgccatccagcactacagcctgagcaccacccagctgagaagcctggtgaaccccgccagccagagccagagctgcagcctgggctag

SEQ ID NO: 99884 - DNA, 1080 bp, Artificial Sequence
  Description of Artificial Sequence: Synthetic coding sequence
atgagacccctgccccccgtgggcgacgtgagactggagctgagcccccccccccccctgctgcccgtgcccgtggtgagcggcagccccgtgggcagcagcggcagactgatggccagcagcagcagcctggtgcccgacagactgagactgcccctgtgcttcctgggcgtgttcgtgtgctacttctactacggcatcctgcaggagaagatcaccagaggcaagtacggcgagggcgccaagcaggagaccttcaccttcgccctgaccctggtgttcatccagtgcgtgatcaacgccgtgttcgccaagatcctgatccagttcttcgacaccgccagagtggacagaaccagaagctggctgtacgccgcctgcagcatcagctacctgggcgccatggtgagcagcaacagcgccctgcagttcgtgaactaccccacccaggtgctgggcaagagctgcaagcccatccccgtgatgctgctgggcgtgaccctgctgaagaagaagtaccccctggccaagtacctgtgcgtgctgctgatcgtggccggcgtggccctgttcatgtacaagcccaagaaggtggtgggcatcgaggagcacaccgtgggctacggcgagctgctgctgctgctgagcctgaccctggacggcctgaccggcgtgagccaggaccacatgagagcccactaccagaccggcagcaaccacatgatgctgaacatcaacctgtggagcaccctgctgctgggcatgggcatcctgttcaccggcgagctgtgggagttcctgagcttcgccgagagataccccgccatcatctacaacatcctgctgttcggcctgaccagcgccctgggccagagcttcatcttcatgaccgtggtgtacttcggccccctgacctgcagcatcatcaccaccaccagaaagttcttcaccatcctggccagcgtgatcctgttcgccaaccccatcagccccatgcagtgggtgggcaccgtgctggtgttcctgggcctgggcctggacgccaagttcggcaagggcgccaagaagaccagccactag

SEQ ID NO: 99885 - DNA, 720 bp, Artificial Sequence
  Description of Artificial Sequence: Synthetic coding sequence
atggccagcagcagcagcctggtgcccgacagactgagactgcccctgtgcttcctgggcgtgttcgtgtgctacttctactacggcatcctgcaggagaagatcaccagaggcaagtacggcgagggcgccaagcaggagaccttcaccttcgccctgaccctggtgttcatccagtgcgtgatcaacgccgtgttcgccaagatcctgatccagttcttcgacaccgccagagtggacagaaccagaagctggctgtacgccgcctgcagcatcagctacctgggcgccatggtgagcagcaacagcgccctgcagttcgtgaactaccccacccaggtgctgggcaagagctgcaagcccatccccgtgatgctgctgggcgtgaccctgctgaagaagaagtaccccctggccaagtacctgtgcgtgctgctgatcgtggccggcgtggccctgttcatgtacaagcccaagaaggtggtgggcatcgaggagcacaccgtgggctacggcgagctgctgctgctgctgagcctgaccctggacggcctgaccggcgtgagccaggaccacatgagagcccactaccagaccggcagcaaccacatgatgctgaacatcaacctgtggagcaccctgctgctgggcatgggcgagagccagttctgctgcagcagccacgtgagccccgagggcagactgcccagcagcttctag

SEQ ID NO: 99886 - DNA, 597 bp, Artificial Sequence
  Description of Artificial Sequence: Synthetic coding sequence
atgctgctgggcgtgaccctgctgaagaagaagtaccccctggccaagtacctgtgcgtgctgctgatcgtggccggcgtggccctgttcatgtacaagcccaagaaggtggtgggcatcgaggagcacaccgtgggctacggcgagctgctgctgctgctgagcctgaccctggacggcctgaccggcgtgagccaggaccacatgagagcccactaccagaccggcagcaaccacatgatgctgaacatcaacctgtggagcaccctgctgctgggcatgggcatcctgttcaccggcgagctgtgggagttcctgagcttcgccgagagataccccgccatcatctacaacatcctgctgttcggcctgaccagcgccctgggccagagcttcatcttcatgaccgtggtgtacttcggccccctgacctgcagcatcatcaccaccaccagaaagttcttcaccatcctggccagcgtgatcctgttcgccaaccccatcagccccatgcagtgggtgggcaccgtgctggtgttcctgggcctgggcctggacgccaagttcggcaagggcgccaagaagaccagccactag

SEQ ID NO: 99887 - DNA, 570 bp, Artificial Sequence
  Description of Artificial Sequence: Synthetic coding sequence
atgctgctgggcgtgaccctgctgaagaagaagtaccccctggccaagtacctgtgcgtgctgctgatcgtggccggcgtggccctgttcatgtacaagcccaagaaggtggtgggcatcgaggagcacaccgtgggctacggcgagctgctgctgctgctgagcctgaccctggacggcctgaccggcgtgagccaggaccacatgagagcccactaccagaccggcagcaaccacatgatgctgaacatcaacctgtggagcaccctgctgctgggcatgggcatcctgttcaccggcgagctgtgggagttcctgagcttcgccgagagataccccgccatcatctacaacatcctgctgttcggcctgaccagcgccctgggccagagcttcatcttcatgaccgtggtgtacttcggccccctgacctgcagcatcatcaccaccaccagaaagttcttcaccatcctggccagcgtgatcctgttcgccaaccccatcagccccatgcagtgggtgggcaccgtgctggtgttcctggccatgggcagctgctgcgtggcctag

SEQ ID NO: 99888 - DNA, 1179 bp, Artificial Sequence
  Description of Artificial Sequence: Synthetic coding sequence
atggacgccagatggtgggccgtggtggtgctggccgccttccccagcctgggcgccggcggcgagacccccgaggccccccccgagagctggacccagctgtggttcttcagattcgtggtgaacgccgccggctacgccagcttcatggtgcccggctacctgctggtgcagtacttcagaagaaagaactacctggagaccggcagaggcctgtgcttccccctggtgaaggcctgcgtgttcggcaacgagcccaaggccagcgacgaggtgcccctggcccccagaaccgaggccgccgagaccacccccatgtggcaggccctgaagctgctgttctgcgccaccggcctgcaggtgagctacctgacctggggcgtgctgcaggagagagtgatgaccagaagctacggcgccaccgccaccagccccggcgagagattcaccgacagccagttcctggtgctgatgaacagagtgctggccctgatcgtggccggcctgagctgcgtgctgtgcaagcagcccagacacggcgcccccatgtacagatacagcttcgccagcctgagcaacgtgctgagcagctggtgccagtacgaggccctgaagttcgtgagcttccccacccaggtgctggccaaggccagcaaggtgatccccgtgatgctgatgggcaagctggtgagcagaagaagctacgagcactgggagtacctgaccgccaccctgatcagcatcggcgtgagcatgttcctgctgagcagcggccccgagcccagaagcagccccgccaccaccctgagcggcctgttcaccgtgggcagcctgctggagcagggcgccctgctggagggcaccagattcatgggcagacacagcgagttcgccgcccacgccctgctgctgagcatctgcagcgcctgcggccagctgttcatcttctacaccatcggccagttcggcgccgccgtgttcaccatcatcatgaccctgagacaggccttcgccatcctgctgagctgcctgctgtacggccacaccgtgaccgtggtgggcggcctgggcgtggccgtggtgttcgccgccctgctgctgagagtgtacgccagaggcagactgaagcagagaggcaagaaggccgtgcccgtggagagccccgtgcagaaggtgtag

SEQ ID NO: 99889 - DNA, 1299 bp, Artificial Sequence
  Description of Artificial Sequence: Synthetic coding sequence
atggacgccagatggtgggccgtggtggtgctggccgccttccccagcctgggcgccggcggcgagacccccgaggccccccccgagagctggacccagctgtggttcttcagattcgtggtgaacgccgccggctacgccagcttcatggtgcccggctacctgctggtgcagtacttcagaagaaagaactacctggagaccggcagaggcctgtgcttccccctggtgaaggcctgcgtgttcggcaacgagcccaaggccagcgacgaggtgcccctggcccccagaaccgaggccgccgagaccacccccatgtggcaggccctgaagctgctgttctgcgccaccggcctgcaggtgagctacctgacctggggcgtgctgcaggagagagtgatgaccagaagctacggcgccaccgccaccagccccggcgagagattcaccgacagccagttcctggtgctgatgaacagagtgctggccctgatcgtggccggcctgagctgcgtgctgtgcaagcagcccagacacggcgcccccatgtacagatacagcttcgccagcctgagcaacgtgctgagcagctggtgccagtacgaggccctgaagttcgtgagcttccccacccaggtgctggccaaggccagcaaggtgatccccgtgatgctgatgggcaagctggtgagcagaagaagctacgagcactgggagtacctgaccgccaccctgatcagcatcggcgtgagcatgttcctgctgagcagcggccccgagcccagaagcagccccgccaccaccctgagcggcctgatcctgctggccggctacatcgccttcgacagcttcaccagcaactggcaggacgccctgttcgcctacaagatgagcagcgtgcagatgatgttcggcgtgaacttcttcagctgcctgttcaccgtgggcagcctgctggagcagggcgccctgctggagggcaccagattcatgggcagacacagcgagttcgccgcccacgccctgctgctgagcatctgcagcgcctgcggccagctgttcatcttctacaccatcggccagttcggcgccgccgtgttcaccatcatcatgaccctgagacaggccttcgccatcctgctgagctgcctgctgtacggccacaccgtgaccgtggtgggcggcctgggcgtggccgtggtgttcgccgccctgctgctgagagtgtacgccagaggcagactgaagcagagaggcaagaaggccgtgcccgtggagagccccgtgcagaaggtgtag

SEQ ID NO: 99890 - DNA, 900 bp, Artificial Sequence
  Description of Artificial Sequence: Synthetic coding sequence
atgaccagaagctacggcgccaccgccaccagccccggcgagagattcaccgacagccagttcctggtgctgatgaacagagtgctggccctgatcgtggccggcctgagctgcgtgctgtgcaagcagcccagacacggcgcccccatgtacagatacagcttcgccagcctgagcaacgtgctgagcagctggtgccagtacgaggccctgaagttcgtgagcttccccacccaggtgctggccaaggccagcaaggtgatccccgtgatgctgatgggcaagctggtgagcagaagaagctacgagcactgggagtacctgaccgccaccctgatcagcatcggcgtgagcatgttcctgctgagcagcggccccgagcccagaagcagccccgccaccaccctgagcggcctgatcctgctggccggctacatcgccttcgacagcttcaccagcaactggcaggacgccctgttcgcctacaagatgagcagcgtgcagatgatgttcggcgtgaacttcttcagctgcctgttcaccgtgggcagcctgctggagcagggcgccctgctggagggcaccagattcatgggcagacacagcgagttcgccgcccacgccctgctgctgagcatctgcagcgcctgcggccagctgttcatcttctacaccatcggccagttcggcgccgccgtgttcaccatcatcatgaccctgagacaggccttcgccatcctgctgagctgcctgctgtacggccacaccgtgaccgtggtgggcggcctgggcgtggccgtggtgttcgccgccctgctgctgagagtgtacgccagaggcagactgaagcagagaggcaagaaggccgtgcccgtggagagccccgtgcagaaggtgtag

SEQ ID NO: 99891 - DNA, 1020 bp, Artificial Sequence
  Description of Artificial Sequence: Synthetic coding sequence
atgctgctggccatgcccgccctgtggtacctggccaccagctggtgcagcaccagcggcggcagaaccacctggagacccgtgagctacctgacctggggcgtgctgcaggagagagtgatgaccagaagctacggcgccaccgccaccagccccggcgagagattcaccgacagccagttcctggtgctgatgaacagagtgctggccctgatcgtggccggcctgagctgcgtgctgtgcaagcagcccagacacggcgcccccatgtacagatacagcttcgccagcctgagcaacgtgctgagcagctggtgccagtacgaggccctgaagttcgtgagcttccccacccaggtgctggccaaggccagcaaggtgatccccgtgatgctgatgggcaagctggtgagcagaagaagctacgagcactgggagtacctgaccgccaccctgatcagcatcggcgtgagcatgttcctgctgagcagcggccccgagcccagaagcagccccgccaccaccctgagcggcctgatcctgctggccggctacatcgccttcgacagcttcaccagcaactggcaggacgccctgttcgcctacaagatgagcagcgtgcagatgatgttcggcgtgaacttcttcagctgcctgttcaccgtgggcagcctgctggagcagggcgccctgctggagggcaccagattcatgggcagacacagcgagttcgccgcccacgccctgctgctgagcatctgcagcgcctgcggccagctgttcatcttctacaccatcggccagttcggcgccgccgtgttcaccatcatcatgaccctgagacaggccttcgccatcctgctgagctgcctgctgtacggccacaccgtgaccgtggtgggcggcctgggcgtggccgtggtgttcgccgccctgctgctgagagtgtacgccagaggcagactgaagcagagaggcaagaaggccgtgcccgtggagagccccgtgcagaaggtgtag

SEQ ID NO: 99892 - DNA, 852 bp, Artificial Sequence
  Description of Artificial Sequence: Synthetic coding sequence
atggacctgacccagcaggccaaggacatccagaacatcaccgtgcaggagaccaacaagaacaacagcgagagcatcgagtgcagcaagatcaccatggacctgaagttcaacaacagcagaaagtacatcagcatcaccgtgcccagcaagacccagaccatgagcccccacatcaagagcgtggacgacgtggtggtgctgggcatgaacctgagcaagttcaacaagctgacccagttcttcatctgcgtggccggcgtgttcgtgttctacctgatctacggctacctgcaggagctgatcttcagcgtggagggcttcaagagctgcggctggtacctgaccctggtgcagttcgccttctacagcatcttcggcctgatcgagctgcagctgatccaggacaagagaagaagaatccccggcaagacctacatgatcatcgccttcctgaccgtgggcaccatgggcctgagcaacaccagcctgggctacctgaactaccccacccaggtgatcttcaagtgctgcaagctgatccccgtgatgctgggcggcgtgttcatccagggcaagagatacaacgtggccgacgtgagcgccgccatctgcatgagcctgggcctgatctggttcaccctggccgacagcaccaccgcccccaacttcaacctgaccggcgtggtgctgatcagcctggccctgtgcgccgacgccgtgatcggcaacgtgcaggagaaggccatgaagctgcacaacgccagcaacagcgagatgaacatcaccaccagcagctacagcggcgtgttcatcttccccaacaagctgaagatccccctggtgctgtag

SEQ ID NO: 99893 - DNA, 1206 bp, Artificial Sequence
  Description of Artificial Sequence: Synthetic coding sequence
atggacctgacccagcaggccaaggacatccagaacatcaccgtgcaggagaccaacaagaacaacagcgagagcatcgagtgcagcaagatcaccatggacctgaagttcaacaacagcagaaagtacatcagcatcaccgtgcccagcaagacccagaccatgagcccccacatcaagagcgtggacgacgtggtggtgctgggcatgaacctgagcaagttcaacaagctgacccagttcttcatctgcgtggccggcgtgttcgtgttctacctgatctacggctacctgcaggagctgatcttcagcgtggagggcttcaagagctgcggctggtacctgaccctggtgcagttcgccttctacagcatcttcggcctgatcgagctgcagctgatccaggacaagagaagaagaatccccggcaagacctacatgatcatcgccttcctgaccgtgggcaccatgggcctgagcaacaccagcctgggctacctgaactaccccacccaggtgatcttcaagtgctgcaagctgatccccgtgatgctgggcggcgtgttcatccagggcaagagatacaacgtggccgacgtgagcgccgccatctgcatgagcctgggcctgatctggttcaccctggccgacagcaccaccgcccccaacttcaacctgaccggcgtggtgctgatcagcctggccctgtgcgccgacgccgtgatcggcaacgtgcaggagaaggccatgaagctgcacaacgccagcaacagcgagatggtgctgtacagctacagcatcggcttcgtgtacatcctgctgggcctgacctgcaccagcggcctgggccccgccgtgaccttctgcgccaagaaccccgtgagaacctacggctacgccttcctgttcagcctgaccggctacttcggcatcagcttcgtgctggccctgatcaagatcttcggcgccctgatcgccgtgaccgtgaccaccggcagaaaggccatgaccatcgtgctgagcttcatcttcttcgccaagcccttcaccttccagtacgtgtggagcggcctgctggtggtgctgggcatcttcctgaacgtgtacagcaagaacatggacaagatcagactgcccagcctgtacgacctgatcaacaagagcgtggaggccagaaagagcagaaccctggcccagaccgtgtag

SEQ ID NO: 99894 - DNA, 657 bp, Artificial Sequence
  Description of Artificial Sequence: Synthetic coding sequence
atgctgagactggcccagacccccagaagactgcccagccccttcagagtgacctacagaccctggggcaccagagccttcggcgccttccccgtgttcggcacccagatcagcagcccccccgagaacctggacaccgcccacctgccccaccccgagggcgccttcgaggagtggatgagaagcggctggaagaagagagacctgacccagcaggccaaggacatccagaacatcaccgtgcaggagaccaacaagaacaacagcgagagcatcgagtgcagcaagatcaccatggacctgaagttcaacaacagcagaaagtacatcagcatcaccgtgcccagcaagacccagaccatgagcccccacatcaagagcgtggacgacgtggtggtgctgggcatgaacctgagcaagttcaacaagctgacccagttcttcatctgcgtggccggcgtgttcgtgttctacctgatctacggctacctgcaggagctgatcttcagcgtggagggcttcaagagctgcggctggtacctgaccctggtgcagttcgccttctacagcatcttcggcctgatcgagctgcagctgatccaggacaagagaagaagatacgtggtgtgcttctacttcctgatcttcctgtactag

SEQ ID NO: 99895 - DNA, 996 bp, Artificial Sequence
  Description of Artificial Sequence: Synthetic coding sequence
atgagacccgccctggccgtgggcctggtgttcgccggctgctgcagcaacgtgatcttcctggagctgctggccagaaagcaccccggctgcggcaacatcgtgaccttcgcccagttcctgttcatcgccgtggagggcttcctgttcgaggccgacctgggcagaaagccccccgccatccccatcagatactacgccatcatggtgaccatgttcttcaccgtgagcgtggtgaacaactacgccctgaacctgaacatcgccatgcccctgcacatgatcttcagaagcggcagcctgatcgccaacatgatcctgggcatcatcatcctgaagaagagatacagcatcttcaagtacaccagcatcgccctggtgagcgtgggcatcttcatctgcaccttcatgagcgccaagcaggtgaccagccagagcagcctgagcgagaacgacggcttccaggccttcgtgtggtggctgctgggcatcggcgccctgaccttcgccctgctgatgagcgccagaatgggcatcttccaggagaccctgtacaagagattcggcaagcacagcaaggaggccctgttctacaaccacgccctgcccctgcccggcttcgtgttcctggccagcgacatctacgaccacgccgtgctgttcaacaagagcgagctgtacgagatccccgtgatcggcgtgaccctgcccatcatgtggttctacctgctgatgaacatcatcacccagtacgtgtgcatcagaggcgtgttcatcctgaccaccgagtgcgccagcctgaccgtgaccctggtggtgaccctgagaaagttcgtgagcctgatcttcagcatcctgtacttccagaaccccttcaccctgtggcactggctgggcaccctgttcgtgttcatcggcaccctgatgtacaccgaggtgtggaacaacctgggcaccaccaagagcgagccccagaaggacagcaagaagaactag

SEQ ID NO: 99896 - DNA, 1095 bp, Artificial Sequence
  Description of Artificial Sequence: Synthetic coding sequence
atgaacagagcccccctgaagagaagcagaatcctgcacatggccctgaccggcgccagcgaccccagcgccgaggccgaggccaacggcgagaagcccttcctgctgagagccctgcagatcgccctggtggtgagcctgtactgggtgaccagcatcagcatggtgttcctgaacaagtacctgctggacagccccagcctgagactggacacccccatcttcgtgaccttctaccagtgcctggtgaccaccctgctgtgcaagggcctgagcgccctggccgcctgctgccccggcgccgtggacttccccagcctgagactggacctgagagtggccagaagcgtgctgcccctgagcgtggtgttcatcggcatgatcaccttcaacaacctgtgcctgaagtacgtgggcgtggccttctacaacgtgggcagaagcctgaccaccgtgttcaacgtgctgctgagctacctgctgctgaagcagaccaccagcttctacgccctgctgacctgcggcatcatcatcggcggcttctggctgggcgtggaccaggagggcgccgagggcaccctgagctggctgggcaccgtgttcggcgtgctggccagcctgtgcgtgagcctgaacgccatctacaccaccaaggtgctgcccgccgtggacggcagcatctggagactgaccttctacaacaacgtgaacgcctgcatcctgttcctgcccctgctgctgctgctgggcgagctgcaggccctgagagacttcgcccagctgggcagcgcccacttctggggcatgatgaccctgggcggcctgttcggcttcgccatcggctacgtgaccggcctgcagatcaagttcaccagccccctgacccacaacgtgagcggcaccgccaaggcctgcgcccagaccgtgctggccgtgctgtactacgaggagaccaagagcttcctgtggtggaccagcaacatgatggtgctgggcggcagcagcgcctacacctgggtgagaggctgggagatgaagaagacccccgaggagcccagccccaaggacagcgagaagagcgccatgggcgtgtag

SEQ ID NO: 99897 - DNA, 1056 bp, Artificial Sequence
  Description of Artificial Sequence: Synthetic coding sequence
atggccctgaccggcgccagcgaccccagcgccgaggccgaggccaacggcgagaagcccttcctgctgagagccctgcagatcgccctggtggtgagcctgtactgggtgaccagcatcagcatggtgttcctgaacaagtacctgctggacagccccagcctgagactggacacccccatcttcgtgaccttctaccagtgcctggtgaccaccctgctgtgcaagggcctgagcgccctggccgcctgctgccccggcgccgtggacttccccagcctgagactggacctgagagtggccagaagcgtgctgcccctgagcgtggtgttcatcggcatgatcaccttcaacaacctgtgcctgaagtacgtgggcgtggccttctacaacgtgggcagaagcctgaccaccgtgttcaacgtgctgctgagctacctgctgctgaagcagaccaccagcttctacgccctgctgacctgcggcatcatcatcggcggcttctggctgggcgtggaccaggagggcgccgagggcaccctgagctggctgggcaccgtgttcggcgtgctggccagcctgtgcgtgagcctgaacgccatctacaccaccaaggtgctgcccgccgtggacggcagcatctggagactgaccttctacaacaacgtgaacgcctgcatcctgttcctgcccctgctgctgctgctgggcgagctgcaggccctgagagacttcgcccagctgggcagcgcccacttctggggcatgatgaccctgggcggcctgttcggcttcgccatcggctacgtgaccggcctgcagatcaagttcaccagccccctgacccacaacgtgagcggcaccgccaaggcctgcgcccagaccgtgctggccgtgctgtactacgaggagaccaagagcttcctgtggtggaccagcaacatgatggtgctgggcggcagcagcgcctacacctgggtgagaggctgggagatgaagaagacccccgaggagcccagccccaaggacagcgagaagagcgccatgggcgtgtag

SEQ ID NO: 99898 - DNA, 1056 bp, Artificial Sequence; identical to SEQ ID NO: 99897
  Description of Artificial Sequence: Synthetic coding sequence

SEQ ID NO: 99899 - DNA, 219 bp, Artificial Sequence
  Description of Artificial Sequence: Synthetic coding sequence
atggccctgaccggcgccagcgaccccagcgccgaggccgaggccaacggcgagaagcccttcctgctgagagccctgcagatcgccctggtggtgagcctgtactgggtgaccagcatcagcatggtgttcctgaacaagtacctgctggacagccccagcctgagactggacacccccatcttcgtgaccttctaccagtgcctggtgaccacctag

SEQ ID NO: 99900 - DNA, 498 bp, Artificial Sequence
  Description of Artificial Sequence: Synthetic coding sequence
atggccctgaccggcgccagcgaccccagcgccgaggccgaggccaacggcgagaagcccttcctgctgagagccctgcagatcgccctggtggtgagcctgtactgggtgaccagcatcagcatggtgttcctgaacaagtacctgctggacagccccagcctgagactggacacccccatcttcgtgaccttctaccagtgcctggtgaccaccctgctgtgcaagggcctgagcgccctggccgcctgctgccccggcgccgtggacttccccagcctgagactggacctgagagtggccagaagcgtgctgcccctgagcgtggtgttcatcggcatgatcaccttcaacaacctgtgcctgaagtacgtgggcgtggccttctacaacgtgggcagaagcctgaccaccgtgttcaacgtgctgctgagctacctgctgctgaagcagaccaccagcttctacgccctgctgacctgcggcatcatcatctag

SEQ ID NO: 99901 - DNA, 741 bp, Artificial Sequence
  Description of Artificial Sequence: Synthetic coding sequence
atgaacagagcccccctgaagagaagcagaatcctgcacatggccctgaccggcgccagcgaccccagcgccgaggccgaggccaacggcgagaagcccttcctgctgagagccctgcagatcgccctggtggtgagcctgtactgggtgaccagcatcagcatggtgttcctgaacaagtacctgctggacagccccagcctgagactggacacccccatcttcgtgaccttctaccagtgcctggtgaccaccctgctgtgcaagggcctgagcgccctggccgcctgctgccccggcgccgtggacttccccagcctgagactggacctgagagtggccagaagcgtgctgcccctgagcgtggtgttcatcggcatgatcaccttcaacaacctgtgcctgaagtacgtgggcgtggccttctacaacgtgggcagaagcctgaccaccgtgttcaacgtgctgctgagctacctgctgctgaagcagaccaccagcttctacgccctgctgacctgcggcatcatcatcggcggcttctggctgggcgtggaccaggagggcgccgagggcaccctgagctggctgggcaccgtgttcggcgtgctggccagcctgtgcgtgagcctgaacgccatctacaccaccaaggtgctgcccgccgtggacggcagcatctggagactgaccttctacaacaacgtgaacgcctgcatcctgttcctgcccctgctgtag

SEQ ID NO: 99902 - DNA, 1014 bp, Artificial Sequence
  Description of Artificial Sequence: Synthetic coding sequence
atgaccgccggcggccaggccgaggccgagggcgccggcggcgagcccggcgccgccagactgcccagcagagtggccagactgctgagcgccctgttctacggcacctgcagcttcctgatcgtgctggtgaacaaggccctgctgaccacctacggcttccccagccccatcttcctgggcatcggccagatggccgccaccatcatgatcctgtacgtgagcaagctgaacaagatcatccacttccccgacttcgacaagaagatccccgtgaagctgttccccctgcccctgctgtacgtgggcaaccacatcagcggcctgagcagcaccagcaagctgagcctgcccatgttcaccgtgctgagaaagttcaccatccccctgaccctgctgctggagaccatcatcctgggcaagcagtacagcctgaacatcatcctgagcgtgttcgccatcatcctgggcgccttcatcgccgccggcagcgacctggccttcaacctggagggctacatcttcgtgttcctgaacgacatcttcaccgccgccaacggcgtgtacaccaagcagaagatggaccccaaggagctgggcaagtacggcgtgctgttctacaacgcctgcttcatgatcatccccaccctgatcatcagcgtgagcaccggcgacctgcagcaggccaccgagttcaaccagtggaagaacgtggtgttcatcctgcagttcctgctgagctgcttcctgggcttcctgctgatgtacagcaccgtgctgtgcagctactacaacagcgccctgaccaccgccgtggtgggcgccatcaagaacgtgagcgtggcctacatcggcatcctgatcggcggcgactacatcttcagcctgctgaacttcgtgggcctgaacatctgcatggccggcggcctgagatacagcttcctgaccctgagcagccagctgaagcccaagcccgtgggcgaggagaacatctgcctggacctgaagagctag

SEQ ID NO: 99903 - DNA, 492 bp, Artificial Sequence
  Description of Artificial Sequence: Synthetic coding sequence
atgaccgccggcggccaggccgaggccgagggcgccggcggcgagcccggcgccgccagactgcccagcagagtggccagactgctgagcgccctgttctacggcacctgcagcttcctgatcgtgctggtgaacaaggccctgctgaccacctacggcttccccagccccatcttcctgggcatcggccagatggccgccaccatcatgatcctgtacgtgagcaagctgaacaagatcatccacttccccgacttcgacaagaagatccccgtgaagctgttccccctgcccctgctgtacgtgggcaaccacatcagcggcctgagcagcaccagcaagctgagcctgcccatgttcaccgtgctgagaaagttcaccatccccctgaccctgctgctggagaccatcatcctgggcaagcagtacagcctgaacatcatcctgagcgtgttcgccatcatcctgggcgccttcatcgccgccggctag

SEQ ID NO: 99904 - DNA, 750 bp, Artificial Sequence
  Description of Artificial Sequence: Synthetic coding sequence
atgaccgccggcggccaggccgaggccgagggcgccggcggcgagcccggcgccgccagactgcccagcagagtggccagactgctgagcgccctgttctacggcacctgcagcttcctgatcgtgctggtgaacaaggccctgctgaccacctacggcttccccagccccatcttcctgggcatcggccagatggccgccaccatcatgatcctgtacgtgagcaagctgaacaagatcatccacttccccgacttcgacaagaagatccccgtgaagctgttccccctgcccctgctgtacgtgggcaaccacatcagcggcctgagcagcaccagcaagctgagcctgcccatgttcaccgtgctgagaaagttcaccatccccctgaccctgctgctggagaccatcatcctgggcaagcagtacagcctgaacatcatcctgagcgtgttcgccatcatcctgggcgccttcatcgccgccggcttcctgctgatgtacagcaccgtgctgtgcagctactacaacagcgccctgaccaccgccgtggtgggcgccatcaagaacgtgagcgtggcctacatcggcatcctgatcggcggcgactacatcttcagcctgctgaacttcgtgggcctgaacatctgcatggccggcggcctgagatacagcttcctgaccctgagcagccagctgaagcccaagcccgtgggcgaggagaacatctgcctggacctgaagagctag

SEQ ID NO: 99905 - DNA, 1251 bp, Artificial Sequence
  Description of Artificial Sequence: Synthetic coding sequence
atgagacagctgtgcagaggcagagtgctgggcatcagcgtggccatcgcccacggcgtgttcagcggcagcctgaacatcctgctgaagttcctgatcagcagataccagttcagcttcctgaccctggtgcagtgcctgaccagcagcaccgccgccctgagcctggagctgctgagaagactgggcctgatcgccgtgccccccttcggcctgagcctggccagaagcttcgccggcgtggccgtgctgagcaccctgcagagcagcctgaccctgtggagcctgagaggcctgagcctgcccatgtacgtggtgttcaagagatgcctgcccctggtgaccatgctgatcggcgtgctggtgctgaagaacggcgcccccagccccggcgtgctggccgccgtgctgatcaccacctgcggcgccgccctggccggcgccggcgacctgaccggcgaccccatcggctacgtgaccggcgtgctggccgtgctggtgcacgccgcctacctggtgctgatccagaaggccagcgccgacaccgagcacggccccctgaccgcccagtacgtgatcgccgtgagcgccacccccctgctggtgatctgcagcttcgccagcaccgacagcatccacgcctggaccttccccggctggaaggaccccgccatggtgtgcatcttcgtggcctgcatcctgatcggctgcgccatgaacttcaccaccctgcactgcacctacatcaacagcgccgtgaccaccagcttcgtgggcgtggtgaagagcatcgccaccatcaccgtgggcatggtggccttcagcgacgtggagcccaccagcctgttcatcgccggcgtggtggtgaacaccctgggcagcatcatctactgcgtggccaagttcatggagaccagaaagcagagcaactacgaggacctggaggcccagcccagaggcgaggaggcccagctgagcggcgaccagctgcccttcgtgatggaggagctgcccggcgagggcggcaacggcagaagcgagggcggcgaggccgccggcggccccgcccaggagagcagacaggaggtgagaggcagccccagaggcgtgcccctggtggccggcagcagcgaggagggcagcagaagaagcctgaaggacgcctacctggaggtgtggagactggtgagaggcaccagatacatgaagaaggactacctgatcgagaacgaggagctgcccagcccctag

SEQ ID NO: 99906 - DNA, 1431 bp, Artificial Sequence
  Description of Artificial Sequence: Synthetic coding sequence
atgagcacccagagactgagaaacgaggactaccacgactacagcagcaccgacgtgagccccgaggagagccccagcgagggcctgaacaacctgagcagccccggcagctaccagagattcggccagagcaacagcaccacctggttccagaccctgatccacctgctgaagggcaacatcggcaccggcctgctgggcctgcccctggccgtgaagaacgccggcatcgtgatgggccccatcagcctgctgatcatcggcatcgtggccgtgcactgcatgggcatcctggtgaagtgcgcccaccacttctgcagaagactgaacaagagcttcgtggactacggcgacaccgtgatgtacggcctggagagcagcccctgcagctggctgagaaaccacgcccactggggcagaagagtggtggacttcttcctgatcgtgacccagctgggcttctgctgcgtgtacttcgtgttcctggccgacaacttcaagcaggtgatcgaggccgccaacggcaccaccaacaactgccacaacaacgagaccgtgatcctgacccccaccatggacagcagactgtacatgctgagcttcctgcccttcctggtgctgctggtgttcatcagaaacctgagagccctgagcatcttcagcctgctggccaacatcaccatgctggtgagcctggtgatgatctaccagttcatcgtgcagagaatccccgaccccagccacctgcccctggtggccccctggaagacctaccccctgttcttcggcaccgccatcttcagcttcgagggcatcggcatggtgctgcccctggagaacaagatgaaggaccccagaaagttccccctgatcctgtacctgggcatggtgatcgtgaccatcctgtacatcagcctgggctgcctgggctacctgcagttcggcgccaacatccagggcagcatcaccctgaacctgcccaactgctggctgtaccagagcgtgaagctgctgtacagcatcggcatcttcttcacctacgccctgcagttctacgtgcccgccgagatcatcatccccttcttcgtgagcagagcccccgagcactgcgagctggtggtggacctgttcgtgagaaccgtgctggtgtgcctgacctgcatcctggccatcctgatccccagactggacctggtgatcagcctggtgggcagcgtgagcagcagcgccctggccctgatcatcccccccctgctggaggtgaccaccttctacagcgagggcatgagccccctgaccatcttcaaggacgccctgatcagcatcctgggcttcgtgggcttcgtggtgggcacctacgaggccctgtacgagctgatccagcccagcaacgcccccatcttcatcaacagcacctgcgccttcatctag

SEQ ID NO: 99907 - DNA, 1161 bp, Artificial Sequence
  Description of Artificial Sequence: Synthetic coding sequence
atgagcacccagagactgagaaacgaggactaccacgactacagcagcaccgacgtgagccccgaggagagccccagcgagggcctgaacaacctgagcagccccggcagctaccagagattcggccagagcaacagcaccacctggttccagaccctgatccacctgctgaagggcaacatcggcaccggcctgctgggcctgcccctggccgtgaagaacgccggcatcgtgatgggccccatcagcctgctgatcatcggcatcgtggccgtgcactgcatgggcatcctggtgaagtgcgcccaccacttctgcagaagactgaacaagagcttcgtggactacggcgacaccgtgatgtacggcctggagagcagcccctgcagctggctgagaaaccacgcccactggggcagaagagtggtggacttcttcctgatcgtgacccagctgggcttctgctgcgtgtacttcgtgttcctggccgacaacttcaagcaggtgatcgaggccgccaacggcaccaccaacaactgccacaacaacgagaccgtgatcctgacccccaccatggacagcagactgtacatgctgagcttcctgcccttcctggtgctgctggtgttcatcagaaacctgagagccctgagcatcttcagcctgctggccaacatcaccatgctggtgagcctggtgatgatctaccagttcatcgtgcagagaatccccgaccccagccacctgcccctggtggccccctggaagacctaccccctgttcttcggcaccgccatcttcagcttcgagggcatcggcatggtgctgcccctggagaacaagatgaaggaccccagaaagttccccctgatcctgtacctgggcatggtgatcgtgaccatcctgtacatcagcctgggctgcctgggctacctgcagttcggcgccaacatccagggcagcatcaccctgaacctgcccaactgctggctgtaccagagcgtgaagctgctgtacagcatcggcatcttcttcacctacgccctgcagttctacgtgcccgccgagatcatcatccccttcttcgtgagcagagcccccgagcactgcgagctggtggtggacctgttcgtgagaaccgtgctggtgtgcctgacctag

SEQ ID NO: 99908 - DNA, 213 bp, Artificial Sequence
  Description of Artificial Sequence: Synthetic coding sequence
atgagcacccagagactgagaaacgaggactaccacgactacagcagcaccgacgtgagccccgaggagagccccagcgagggcctgaacaacctgagcagccccggcagctaccagagattcggccagagcaacagcaccacctggttccagaccctgatccacctgctgaagggcaacatcggcaccggcctgctgggcctgcccctgtag

SEQ ID NO: 99909 - DNA, 219 bp, Artificial Sequence
  Description of Artificial Sequence: Synthetic coding sequence
atgagcacccagagactgagaaacgaggactaccacgactacagcagcaccgacgtgagccccgaggagagccccagcgagggcctgaacaacctgagcagccccggcagctaccagagattcggccagagcaacagcaccacctggttccagaccctgatccacctgctgaagggcaacatcggcaccggcctgctgggcctgcccctggccgtgtag

SEQ ID NO: 99910 - DNA, 1431 bp, Artificial Sequence; identical to SEQ ID NO: 99906
  Description of Artificial Sequence: Synthetic coding sequence

SEQ ID NO: 99911 - DNA, 1167 bp, Artificial Sequence
  Description of Artificial Sequence: Synthetic coding sequence
atgagcacccagagactgagaaacgaggactaccacgactacagcagcaccgacgtgagccccgaggagagccccagcgagggcctgaacaacctgagcagccccggcagctaccagagattcggccagagcaacagcaccacctggttccagaccctgatccacctgctgaagggcaacatcggcaccggcctgctgggcctgcccctggccgtgaagaacgccggcatcgtgatgggccccatcagcctgctgatcatcggcatcgtggccgtgcactgcatgggcatcctggtgaagtgcgcccaccacttctgcagaagactgaacaagagcttcgtggactacggcgacaccgtgatgtacggcctggagagcagcccctgcagctggctgagaaaccacgcccactggggcagaagagtggtggacttcttcctgatcgtgacccagctgggcttctgctgcgtgtacttcgtgttcctggccgacaacttcaagcaggtgatcgaggccgccaacggcaccaccaacaactgccacaacaacgagaccgtgatcctgacccccaccatggacagcagactgtacatgctgagcttcctgcccttcctggtgctgctggtgttcatcagaaacctgagagccctgagcatcttcagcctgctggccaacatcaccatgctggtgagcctggtgatgatctaccagttcatcgtgcagagaatccccgaccccagccacctgcccctggtggccccctggaagacctaccccctgttcttcggcaccgccatcttcagcttcgagggcatcggcatggtgctgcccctggagaacaagatgaaggaccccagaaagttccccctgatcctgtacctgggcatggtgatcgtgaccatcctgtacatcagcctgggctgcctgggctacctgcagttcggcgccaacatccagggcagcatcaccctgaacctgcccaactgctggctgtaccagagcgtgaagctgctgtacagcatcggcatcttcttcacctacgccctgcagttctacgtgcccgccgagatcatcatccccttcttcgtgagcagagcccccgagcactgcgagctggtggtggacctgttcgtgagaaccgtgctggtgtgcctgacctgcgagtag

SEQ ID NO: 99912 - DNA, 1452 bp, Artificial Sequence
  Description of Artificial Sequence: Synthetic coding sequence
atgagcgtgaccaagagcaccgagggcccccagggcgccgtggccatcaagctggacctgatgagcccccccgagagcgccaagaagctggagaacaaggacagcaccttcctggacgagagccccagcgagagcgccggcctgaagaagaccaagggcatcaccgtgttccaggccctgatccacctggtgaagggcaacatgggcaccggcatcctgggcctgcccctggccgtgaagaacgccggcatcctgatgggccccctgagcctgctggtgatgggcttcatcgcctgccactgcatgcacatcctggtgaagtgcgcccagagattctgcaagagactgaacaagcccttcatggactacggcgacaccgtgatgcacggcctggaggccaaccccaacgcctggctgcagaaccacgcccactggggcagacacatcgtgagcttcttcctgatcatcacccagctgggcttctgctgcgtgtacatcgtgttcctggccgacaacctgaagcaggtggtggaggccgtgaacagcaccaccaacaactgctacagcaacgagaccgtgatcctgacccccaccatggacagcagactgtacatgctgagcttcctgcccttcctggtgctgctggtgctgatcagaaacctgagaatcctgaccatcttcagcatgctggccaacatcagcatgctggtgagcctggtgatcatcatccagtacatcacccaggagatccccgaccccagcagactgcccctggtggccagctggaagacctaccccctgttcttcggcaccgccatcttcagcttcgagagcatcggcgtggtgctgcccctggagaacaagatgaagaacgccagacacttccccgccatcctgagcctgggcatgagcatcgtgaccagcctgtacatcggcatggccgccctgggctacctgagattcggcgacgacatcaaggccagcatcagcctgaacctgcccaactgctggctgtaccagagcgtgaagctgctgtacatcgccggcatcctgtgcacctacgccctgcagttctacgtgcccgccgagatcatcatccccttcgccatcagcagagtgagcaccagatgggccctgcccctggacctgagcatcagactggtgatggtgtgcctgacctgcctgctggccatcctgatccccagactggacctggtgatcagcctggtgggcagcgtgagcggcaccgccctggccctgatcatcccccccctgctggaggtgaccaccttctacagcgagggcatgagccccctgaccatcttcaaggacgccctgatcagcatcctgggcttcgtgggcttcgtggtgggcacctaccaggccctggacgagctgctgaagagcgaggacagccaccccttcagcaacagcaccaccttcgtgagatag

SEQ ID NO: 99913 - DNA, 624 bp, Artificial Sequence
  Description of Artificial Sequence: Synthetic coding sequence
atgaacgacaccgccgtgctgcccctggagaacaagatgaagaacgccagacacttccccgccatcctgagcctgggcatgagcatcgtgaccagcctgtacatcggcatggccgccctgggctacctgagattcggcgacgacatcaaggccagcatcagcctgaacctgcccaactgctggctgtaccagagcgtgaagctgctgtacatcgccggcatcctgtgcacctacgccctgcagttctacgtgcccgccgagatcatcatccccttcgccatcagcagagtgagcaccagatgggccctgcccctggacctgagcatcagactggtgatggtgtgcctgacctgcctgctggccatcctgatccccagactggacctggtgatcagcctggtgggcagcgtgagcggcaccgccctggccctgatcatcccccccctgctggaggtgaccaccttctacagcgagggcatgagccccctgaccatcttcaaggacgccctgatcagcatcctgggcttcgtgggcttcgtggtgggcacctaccaggccctggacgagctgctgaagagcgaggacagccaccccttcagcaacagcaccaccttcgtgagatag

SEQ ID NO: 99914 - DNA, 1413 bp, Artificial Sequence
  Description of Artificial Sequence: Synthetic coding sequence
atgagcctgctgggcagagactacaacagcgagctgaacagcctggacaacggcccccagagccccagcgagagcagcagcagcatcaccagcgagaacgtgcaccccgccggcgaggccggcctgagcatgatgcagaccctgatccacctgctgaagtgcaacatcggcaccggcctgctgggcctgcccctggccatcaagaacgccggcctgctggtgggccccgtgagcctgctggccatcggcgtgctgaccgtgcactgcatggtgatcctgctgaactgcgcccagcacctgagccagagactgcagaagaccttcgtgaactacggcgaggccaccatgtacggcctggagacctgccccaacacctggctgagagcccacgccgtgtggggcagatacaccgtgagcttcctgctggtgatcacccagctgggcttctgcagcgtgtacttcatgttcatggccgacaacctgcagcagatggtggagaaggcccacgtgaccagcaacatctgccagcccagagagatcctgaccctgacccccatcctggacatcagattctacatgctgatcatcctgcccttcctgatcctgctggtgttcatccagaacctgaaggtgctgagcgtgttcagcaccctggccaacatcaccaccctgggcagcatggccctgatcttcgagtacatcatggagggcatcccctaccccagcaacctgcccctgatggccaactggaagaccttcctgctgttcttcggcaccgccatcttcaccttcgagggcgtgggcatggtgctgcccctgaagaaccagatgaagcacccccagcagttcagcttcgtgctgtacctgggcatgagcatcgtgatcatcctgtacatcctgctgggcaccctgggctacatgaagttcggcagcgacacccaggccagcatcaccctgaacctgcccaactgctggctgtaccagagcgtgaagctgatgtacagcatcggcatcttcttcacctacgccctgcagttccacgtgcccgccgagatcatcatccccttcgccatcagccaggtgagcgagagctgggccctgttcgtggacctgagcgtgagaagcgccctggtgtgcctgacctgcgtgagcgccatcctgatccccagactggacctggtgatcagcctggtgggcagcgtgagcagcagcgccctggccctgatcatccccgccctgctggagatcgtgatcttctacagcgaggacatgagctgcgtgaccatcgccaaggacatcatgatcagcatcgtgggcctgctgggctgcatcttcggcacctaccaggccctgtacgagctgccccagcccatcagccacagcatggccaacagcaccggcgtgcacgcctag

SEQ ID NO: 99915 - DNA, 1536 bp, Artificial Sequence
  Description of Artificial Sequence: Synthetic coding sequence
atgagcctgctgggcagagactacaacagcgagctgaacagcctggacaacggcccccagagccccagcgagagcagcagcagcatcaccagcgagaacgtgcaccccgccggcgaggccggcctgagcatgatgcagaccctgatccacctgctgaagtgcaacatcggcaccggcctgctgggcctgcccctggccatcaagaacgccggcctgctggtgggccccgtgagcctgctggccatcggcgtgctgaccgtgcactgcatggtgatcctgctgaactgcgcccagcacctgagccagagactgcagaagaccttcgtgaactacggcgaggccaccatgtacggcctggagacctgccccaacacctggctgagagcccacgccgtgtggggcagatggaacctggccctgagccccagactggagtgcagcggcaagatcagcgcccactgcaacccccacctgcagggcagcagcaacagccccgcccaggccagcagagtggccggcatctacagatacaccgtgagcttcctgctggtgatcacccagctgggcttctgcagcgtgtacttcatgttcatggccgacaacctgcagcagatggtggagaaggcccacgtgaccagcaacatctgccagcccagagagatcctgaccctgacccccatcctggacatcagattctacatgctgatcatcctgcccttcctgatcctgctggtgttcatccagaacctgaaggtgctgagcgtgttcagcaccctggccaacatcaccaccctgggcagcatggccctgatcttcgagtacatcatggagggcatcccctaccccagcaacctgcccctgatggccaactggaagaccttcctgctgttcttcggcaccgccatcttcaccttcgagggcgtgggcatggtgctgcccctgaagaaccagatgaagcacccccagcagttcagcttcgtgctgtacctgggcatgagcatcgtgatcatcctgtacatcctgctgggcaccctgggctacatgaagttcggcagcgacacccaggccagcatcaccctgaacctgcccaactgctggctgtaccagagcgtgaagctgatgtacagcatcggcatcttcttcacctacgccctgcagttccacgtgcccgccgagatcatcatccccttcgccatcagccaggtgagcgagagctgggccctgttcgtggacctgagcgtgagaagcgccctggtgtgcctgacctgcgtgagcgccatcctgatccccagactggacctggtgatcagcctggtgggcagcgtgagcagcagcgccctggccctgatcatccccgccctgctggagatcgtgatcttctacagcgaggacatgagctgcgtgaccatcgccaaggacatcatgatcagcatcgtgggcctgctgggctgcatcttcggcacctaccaggccctgtacgagctgccccagcccatcagccacagcatggccaacagcaccggcgtgcacgcctag

SEQ ID NO: 99916 - DNA, 1515 bp, Artificial Sequence
  Description of Artificial Sequence: Synthetic coding sequence
atggaggccgccgccacccccgccgccgccggcgccgccagaagagaggagctggacatggacgtgatgagacccctgatcaacgagcagaacttcgacggcaccagcgacgaggagcacgagcaggagctgctgcccgtgcagaagcactaccagctggacgaccaggagggcatcagcttcgtgcagaccctgatgcacctgctgaagggcaacatcggcaccggcctgctgggcctgcccctggccatcaagaacgccggcatcgtgctgggccccatcagcctggtgttcatcggcatcatcagcgtgcactgcatgcacatcctggtgagatgcagccacttcctgtgcctgagattcaagaagagcaccctgggctacagcgacaccgtgagcttcgccatggaggtgagcccctggagctgcctgcagaagcaggccgcctggggcagaagcgtggtggacttcttcctggtgatcacccagctgggcttctgcagcgtgtacatcgtgttcctggccgagaacgtgaagcaggtgcacgagggcttcctggagagcaaggtgttcatcagcaacagcaccaacagcagcaacccctgcgagagaagaagcgtggacctgagaatctacatgctgtgcttcctgcccttcatcatcctgctggtgttcatcagagagctgaagaacctgttcgtgctgagcttcctggccaacgtgagcatggccgtgagcctggtgatcatctaccagtacgtggtgagaaacatgcccgacccccacaacctgcccatcgtggccggctggaagaagtaccccctgttcttcggcaccgccgtgttcgccttcgagggcatcggcgtggtgctgcccctggagaaccagatgaaggagagcaagagattcccccaggccctgaacatcggcatgggcatcgtgaccaccctgtacgtgaccctggccaccctgggctacatgtgcttccacgacgagatcaagggcagcatcaccctgaacctgccccaggacgtgtggctgtaccagagcgtgaagatcctgtacagcttcggcatcttcgtgacctacagcatccagttctacgtgcccgccgagatcatcatccccggcatcaccagcaagttccacaccaagtggaagcagatctgcgagttcggcatcagaagcttcctggtgagcatcacctgcgccggcgccatcctgatccccagactggacatcgtgatcagcttcgtgggcgccgtgagcagcagcaccctggccctgatcctgccccccctggtggagatcctgaccttcagcaaggagcactacaacatctggatggtgctgaagaacatcagcatcgccttcaccggcgtggtgggcttcctgctgggcacctacatcaccgtggaggagatcatctaccccacccccaaggtggtggccggcaccccccagagccccttcctgaacctgaacagcacctgcctgaccagcggcctgaagtag

SEQ ID NO: 99917 - DNA, 1602 bp, Artificial Sequence
  Description of Artificial Sequence: Synthetic coding sequence
atggccagactgcccgccggcatcagattcatcatcagcttcagcagagaccagtggtacagagccttcatcttcatcctgaccttcctgctgtacgccagcttccacctgagcagaaagcccatcagcatcgtgaagggcgagctgcacaagtactgcaccgcctgggacgaggccgacgtgagattcagcagccagaacagaaagagcggcagcgccgccccccaccagctgcccgacaacgagaccgactgcggctgggcccccttcgacaagaacaactaccagcagctgctgggcgccctggactacagcttcctgtgcgcctacgccgtgggcatgtacctgagcggcatcatcggcgagagactgcccatcagatactacctgaccttcggcatgctggccagcggcgccttcaccgccctgttcggcctgggctacttctacaacatccacagcttcggcttctacgtggtgacccaggtgatcaacggcctggtgcagaccaccggctggcccagcgtggtgacctgcctgggcaactggttcggcaagggcagaagaggcctgatcatgggcgtgtggaacagccacaccagcgtgggcaacatcctgggcagcctgatcgccggctactgggtgagcacctgctggggcctgagcttcgtggtgcccggcgccatcgtggccgccatgggcatcgtgtgcttcctgttcctgatcgagcaccccaacgacgtgagatgcagcagcaccctggtgacccacagcaagggctacgagaacggcaccaacagactgagactgcagaagcagatcctgaagagcgagaagaacaagcccctggaccccgagatgcagtgcctgctgctgagcgacggcaagggcagcatccaccccaaccacgtggtgatcctgcccggcgacggcggcagcggcaccgccgccatcagcttcaccggcgccctgaagatccccggcgtgatcgagttcagcctgtgcctgctgttcgccaagctggtgagctacaccttcctgttctggctgcccctgtacatcaccaacgtggaccacctggacgccaagaaggccggcgagctgagcaccctgttcgacgtgggcggcatcttcggcggcatcctggccggcgtgatcagcgacagactggagaagagagccagcacctgcggcctgatgctgctgctggccgcccccaccctgtacatcttcagcaccgtgagcaagatgggcctggaggccaccatcgccatgctgctgctgagcggcgccctggtgagcggcccctacaccctgatcaccaccgccgtgagcgccgacctgggcacccacaagagcctgaagggcaacgcccacgccctgagcaccgtgaccgccatcatcgacggcaccggcagcgtgggcgccgccctgggccccctgctggccggcctgctgagccccagcggctggagcaacgtgttctacatgctgatgttcgccgacgcctgcgccctgctgttcctgatcagactgatccacaaggagctgagctgccccggcagcgccaccggcgaccaggtgcccttcaaggagcagtag

SEQ ID NO: 99918 - DNA, 1602 bp, Artificial Sequence; identical to SEQ ID NO: 99917
  Description of Artificial Sequence: Synthetic coding sequence

SEQ ID NO: 99919 - DNA, 57 bp, Artificial Sequence
  Description of Artificial Sequence: Synthetic coding sequence
atggccagactgcccgccggcatcagattcatcatcagcttcagcagagaccagtag

SEQ ID NO: 99920 - DNA, 57 bp, Artificial Sequence; identical to SEQ ID NO: 99919
  Description of Artificial Sequence: Synthetic coding sequence

SEQ ID NO: 99921 - DNA, 1464 bp, Artificial Sequence
  Description of Artificial Sequence: Synthetic coding sequence
atgatgcacttcaagagcggcctggagctgaccgagctgcagaacatgaccgtgcccgaggacgacaacatcagcaacgacagcaacgacttcaccgaggtggagaacggccagatcaacagcaagttcatcagcgacagagagagcagaagaagcctgaccaacagccacctggagaagaagaagtgcgacgagtacatccccggcaccaccagcctgggcatgagcgtgttcaacctgagcaacgccatcatgggcagcggcatcctgggcctggccttcgccctggccaacaccggcatcctgctgttcctggtgctgctgaccagcgtgaccctgctgagcatctacagcatcaacctgctgctgatctgcagcaaggagaccggctgcatggtgtacgagaagctgggcgagcaggtgttcggcaccaccggcaagttcgtgatcttcggcgccaccagcctgcagaacaccggcgccatgctgagctacctgttcatcgtgaagaacgagctgcccagcgccatcaagttcctgatgggcaaggaggagaccttcagcgcctggtacgtggacggcagagtgctggtggtgatcgtgaccttcggcatcatcctgcccctgtgcctgctgaagaacctgggctacctgggctacaccagcggcttcagcctgagctgcatggtgttcttcctgatcgtggtgatctacaagaagttccagatcccctgcatcgtgcccgagctgaacagcaccatcagcgccaacagcaccaacgccgacacctgcacccccaagtacgtgaccttcaacagcaagaccgtgtacgccctgcccaccatcgccttcgccttcgtgtgccaccccagcgtgctgcccatctacagcgagctgaaggacagaagccagaagaagatgcagatggtgagcaacatcagcttcttcgccatgttcgtgatgtacttcctgaccgccatcttcggctacctgaccttctacgacaacgtgcagagcgacctgctgcacaagtaccagagcaaggacgacatcctgatcctgaccgtgagactggccgtgatcgtggccgtgatcctgaccgtgcccgtgctgttcttcaccgtgagaagcagcctgttcgagctggccaagaagaccaagttcaacctgtgcagacacaccgtggtgacctgcatcctgctggtggtgatcaacctgctggtgatcttcatccccagcatgaaggacatcttcggcgtggtgggcgtgaccagcgccaacatgctgatcttcatcctgcccagcagcctgtacctgaagatcaccgaccaggacggcgacaagggcacccagagaatctgggccgccctgttcctgggcctgggcgtgctgttcagcctggtgagcatccccctggtgatctacgactgggcctgcagcagcagcagcgacgagggccactag

SEQ ID NO: 99922 - DNA, 1464 bp, Artificial Sequence; identical to SEQ ID NO: 99921
  Description of Artificial Sequence: Synthetic coding sequence

SEQ ID NO: 99923 - DNA, 1464 bp, Artificial Sequence; identical to SEQ ID NO: 99921
  Description of Artificial Sequence: Synthetic coding sequence

SEQ ID NO: 99924 - DNA, 1464 bp, Artificial Sequence; identical to SEQ ID NO: 99921
  Description of Artificial Sequence: Synthetic coding sequence

SEQ ID NO: 99925 - DNA, 1521 bp, Artificial Sequence
  Description of Artificial Sequence: Synthetic coding sequence
atgaagaaggccgagatgggcagattcagcatcagccccgacgaggacagcagcagctacagcagcaacagcgacttcaactacagctaccccaccaagcaggccgccctgaagagccactacgccgacgtggaccccgagaaccagaacttcctgctggagagcaacctgggcaagaagaagtacgagaccgagttccaccccggcaccaccagcttcggcatgagcgtgttcaacctgagcaacgccatcgtgggcagcggcatcctgggcctgagctacgccatggccaacaccggcatcgccctgttcatcatcctgctgaccttcgtgagcatcttcagcctgtacagcgtgcacctgctgctgaagaccgccaacgagggcggcagcctgctgtacgagcagctgggctacaaggccttcggcctggtgggcaagctggccgccagcggcagcatcaccatgcagaacatcggcgccatgagcagctacctgttcatcgtgaagtacgagctgcccctggtgatccaggccctgaccaacatcgaggacaagaccggcctgtggtacctgaacggcaactacctggtgctgctggtgagcctggtggtgatcctgcccctgagcctgttcagaaacctgggctacctgggctacaccagcggcctgagcctgctgtgcatggtgttcttcctgatcgtggtgatctgcaagaagttccaggtgccctgccccgtggaggccgccctgatcatcaacgagaccatcaacaccaccctgacccagcccaccgccctggtgcccgccctgagccacaacgtgaccgagaacgacagctgcagaccccactacttcatcttcaacagccagaccgtgtacgccgtgcccatcctgatcttcagcttcgtgtgccaccccgccgtgctgcccatctacgaggagctgaaggacagaagcagaagaagaatgatgaacgtgagcaagatcagcttcttcgccatgttcctgatgtacctgctggccgccctgttcggctacctgaccttctacgagcacgtggagagcgagctgctgcacacctacagcagcatcctgggcaccgacatcctgctgctgatcgtgagactggccgtgctgatggccgtgaccctgaccgtgcccgtggtgatcttccccatcagaagcagcgtgacccacctgctgtgcgccagcaaggacttcagctggtggagacacagcctgatcaccgtgagcatcctggccttcaccaacctgctggtgatcttcgtgcccaccatcagagacatcttcggcttcatcggcgccagcgccgccagcatgctgatcttcatcctgcccagcgccttctacatcaagctggtgaagaaggagcccatgaagagcgtgcagaagatcggcgccctgttcttcctgctgagcggcgtgctggtgatgaccggcagcatggccctgatcgtgctggactgggtgcacaacgcccccggcggcggccactag

SEQ ID NO: 99926 - DNA, 1644 bp, Artificial Sequence
  Description of Artificial Sequence: Synthetic coding sequence
atggaccccatggagctgagaaacgtgaacatcgagcccgacgacgagagcagcagcggcgagagcgcccccgacagctacatcggcatcggcaacagcgagaaggccgccatgagcagccagttcgccaacgaggacaccgagagccagaagttcctgaccaacggcttcctgggcaagaagaagctggccgactacgccgacgagcaccaccccggcaccaccagcttcggcatgagcagcttcaacctgagcaacgccatcatgggcagcggcatcctgggcctgagctacgccatggccaacaccggcatcatcctgttcatcatcatgctgctggccgtggccatcctgagcctgtacagcgtgcacctgctgctgaagaccgccaaggagggcggcagcctgatctacgagaagctgggcgagaaggccttcggctggcccggcaagatcggcgccttcgtgagcatcaccatgcagaacatcggcgccatgagcagctacctgttcatcatcaagtacgagctgcccgaggtgatcagagccttcatgggcctggaggagaacaccggcgagtggtacctgaacggcaactacctgatcatcttcgtgagcgtgggcatcatcctgcccctgagcctgctgaagaacctgggctacctgggctacaccagcggcttcagcctgacctgcatggtgttcttcgtgagcgtggtgatctacaagaagttccagatcccctgccccctgcccgtgctggaccacagcgtgggcaacctgagcttcaacaacaccctgcccatgcacgtggtgatgctgcccaacaacagcgagagcagcgacgtgaacttcatgatggactacacccacagaaaccccgccggcctggacgagaaccaggccaagggcagcctgcacgacagcggcgtggagtacgaggcccacagcgacgacaagtgcgagcccaagtacttcgtgttcaacagcagaaccgcctacgccatccccatcctggtgttcgccttcgtgtgccaccccgaggtgctgcccatctacagcgagctgaaggacagaagcagaagaaagatgcagaccgtgagcaacatcagcatcaccggcatgctggtgatgtacctgctggccgccctgttcggctacctgaccttctacggcgaggtggaggacgagctgctgcacgcctacagcaaggtgtacaccctggacatccccctgctgatggtgagactggccgtgctggtggccgtgaccctgaccgtgcccatcgtgctgttccccatcagaaccagcgtgatcaccctgctgttccccaagagacccttcagctggatcagacacttcctgatcgccgccgtgctgatcgccctgaacaacgtgctggtgatcctggtgcccaccatcaagtacatcttcggcttcatcggcgccagcagcgccaccatgctgatcttcatcctgcccgccgtgttctacctgaagctggtgaagaaggagaccttcagaagcccccagaaggtgggcgccctgatcttcctggtggtgggcatcttcttcatgatcggcagcatggccctgatcatcatcgactggatctacgacccccccaacagcaagcaccactag

SEQ ID NO: 99927 - DNA, 780 bp, Artificial Sequence
  Description of Artificial Sequence: Synthetic coding sequence
atggaccccatggagctgagaaacgtgaacatcgagcccgacgacgagagcagcagcggcgagagcgcccccgacagctacatcggcatcggcaacagcgagaaggccgccatgagcagccagttcgccaacgaggacaccgagagccagaagttcctgaccaacggcttcctgggcaagaagaagctggccgactacgccgacgagcaccaccccggcaccaccagcttcggcatgagcagcttcaacctgagcaacgccatcatgggcagcggcatcctgggcctgagctacgccatggccaacaccggcatcatcctgttcatcatcatgctgctggccgtggccatcctgagcctgtacagcgtgcacctgctgctgaagaccgccaaggagggcggcagcctgatctacgagaagctgggcgagaaggccttcggctggcccggcaagatcggcgccttcgtgagcatcaccatgcagaacatcggcgccatgagcagctacctgttcatcatcaagtacgagctgcccgaggtgatcagagccttcatgggcctggaggagaacaccggcgagtggtacctgaacggcaactacctgatcatcttcgtgagcgtgggcatcatcctgcccctgagcctgctgaagaacctgggctacctgggctacaccagcggcttcagcctgacctgcatggtgttcttcgtgagcgtgatgatctacaagaagatcagcttcttcctgcagatcttcatcatcctgaagctgttcttctag

SEQ ID NO: 99928 - DNA, 1644 bp, Artificial Sequence; identical to SEQ ID NO: 99926
  Description of Artificial Sequence: Synthetic coding sequence

SEQ ID NO: 99929 - DNA, 579 bp, Artificial Sequence
  Description of Artificial Sequence: Synthetic coding sequence
atggaccccatggagctgagaaacgtgaacatcgagcccgacgacgagagcagcagcggcgagagcgcccccgacagctacatcggcatcggcaacagcgagaaggccgccatgagcagccagttcgccaacgaggacaccgagagccagaagttcctgaccaacggcttcctgggcaagaagaagctggccgactacgccgacgagcaccaccccggcaccaccagcttcggcatgagcagcttcaacctgagcaacgccatcatgggcagcggcatcctgggcctgagctacgccatggccaacaccggcatcatcctgttcatcatcatgctgctggccgtggccatcctgagcctgtacagcgtgcacctgctgctgaagaccgccaaggagggcggcagcctgatctacgagaagctgggcgagaaggccttcggctggcccggcaagatcggcgccttcgtgagcatcaccatgcagaacatcggcgccatgagcagctacctgttcatcatcaagtacgagctgcccgaggtgatcagagccttcatgggcctggaggagaacaccggctag

SEQ ID NO: 99930 - DNA, 660 bp, Artificial Sequence
  Description of Artificial Sequence: Synthetic coding sequence
atggaccccatggagctgagaaacgtgaacatcgagcccgacgacgagagcagcagcggcgagagcgcccccgacagctacatcggcatcggcaacagcgagaaggccgccatgagcagccagttcgccaacgaggacaccgagagccagaagttcctgaccaacggcttcctgggcaagaagaagctggccgactacgccgacgagcaccaccccggcaccaccagcttcggcatgagcagcttcaacctgagcaacgccatcatgggcagcggcatcctgggcctgagctacgccatggccaacaccggcatcatcctgttcatcatcatgctgctggccgtggccatcctgagcctgtacagcgtgcacctgctgctgaagaccgccaaggagggcggcagcctgatctacgagaagctgggcgagaaggccttcggctggcccggcaagatcggcgccttcgtgagcatcaccatgcagaacatcggcgccatgagcagctacctgttcatcatcaagtacgagctgcccgaggtgatcagagccttcatgggcctggaggagaacaccggcgagtggtacctgaacggcaactacctgatcatcttcgtgagcgtgggcatcatcctgcccctgagcctgctgaagaacctgtag

SEQ ID NO: 99931 - DNA, 1419 bp, Artificial Sequence
  Description of Artificial Sequence: Synthetic coding sequence
atggagctgcaggaccccaagatgaacggcgccctgcccagcgacgccgtgggctacagacaggagagagagggcttcctgcccagcagaggccccgcccccggcagcaagcccgtgcagttcatggacttcgagggcaagaccagcttcggcatgagcgtgttcaacctgagcaacgccatcatgggcagcggcatcctgggcctggcctacgccatggcccacaccggcgtgatcttcttcctggccctgctgctgtgcatcgccctgctgagcagctacagcatccacctgctgctgacctgcgccggcatcgccggcatcagagcctacgagcagctgggccagagagccttcggccccgccggcaaggtggtggtggccaccgtgatctgcctgcacaacgtgggcgccatgagcagctacctgttcatcatcaagagcgagctgcccctggtgatcggcaccttcctgtacatggaccccgagggcgactggttcctgaagggcaacctgctgatcatcatcgtgagcgtgctgatcatcctgcccctggccctgatgaagcacctgggctacctgggctacaccagcggcctgagcctgacctgcatgctgttcttcctggtgagcgtgatctacaagaagttccagctgggctgcgccatcggccacaacgagaccgccatggagagcgaggccctggtgggcctgcccagccagggcctgaacagcagctgcgaggcccagatgttcaccgtggacagccagatgagctacaccgtgcccatcatggccttcgccttcgtgtgccaccccgaggtgctgcccatctacaccgagctgtgcagacccagcaagagaagaatgcaggccgtggccaacgtgagcatcggcgccatgttctgcatgtacggcctgaccgccaccttcggctacctgaccttctacagcagcgtgaaggccgagatgctgcacatgtacagccagaaggaccccctgatcctgtgcgtgagactggccgtgctgctggccgtgaccctgaccgtgcccgtggtgctgttccccatcagaagagccctgcagcagctgctgttccccggcaaggccttcagctggcccagacacgtggccatcgccctgatcctgctggtgctggtgaacgtgctggtgatctgcgtgcccaccatcagagacatcttcggcgtgatcggcagcaccagcgcccccagcctgatcttcatcctgcccagcatcttctacctgagaatcgtgcccagcgaggtggagcccttcctgagctggcccaagatccaggccctgtgcttcggcgtgctgggcgtgctgttcatggccgtgagcctgggcttcatgttcgccaactgggccaccggccagagcagaatgagcggccactag

SEQ ID NO: 99932 - DNA, 1266 bp, Artificial Sequence
  Description of Artificial Sequence: Synthetic coding sequence
atgagcgtgttcaacctgagcaacgccatcatgggcagcggcatcctgggcctggcctacgccatggcccacaccggcgtgatcttcttcctggccctgctgctgtgcatcgccctgctgagcagctacagcatccacctgctgctgacctgcgccggcatcgccggcatcagagcctacgagcagctgggccagagagccttcggccccgccggcaaggtggtggtggccaccgtgatctgcctgcacaacgtgggcgccatgagcagctacctgttcatcatcaagagcgagctgcccctggtgatcggcaccttcctgtacatggaccccgagggcgactggttcctgaagggcaacctgctgatcatcatcgtgagcgtgctgatcatcctgcccctggccctgatgaagcacctgggctacctgggctacaccagcggcctgagcctgacctgcatgctgttcttcctggtgagcgtgatctacaagaagttccagctgggctgcgccatcggccacaacgagaccgccatggagagcgaggccctggtgggcctgcccagccagggcctgaacagcagctgcgaggcccagatgttcaccgtggacagccagatgagctacaccgtgcccatcatggccttcgccttcgtgtgccaccccgaggtgctgcccatctacaccgagctgtgcagacccagcaagagaagaatgcaggccgtggccaacgtgagcatcggcgccatgttctgcatgtacggcctgaccgccaccttcggctacctgaccttctacagcagcgtgaaggccgagatgctgcacatgtacagccagaaggaccccctgatcctgtgcgtgagactggccgtgctgctggccgtgaccctgaccgtgcccgtggtgctgttccccatcagaagagccctgcagcagctgctgttccccggcaaggccttcagctggcccagacacgtggccatcgccctgatcctgctggtgctggtgaacgtgctggtgatctgcgtgcccaccatcagagacatcttcggcgtgatcggcagcaccagcgcccccagcctgatcttcatcctgcccagcatcttctacctgagaatcgtgcccagcgaggtggagcccttcctgagctggcccaagatccaggccctgtgcttcggcgtgctgggcgtgctgttcatggccgtgagcctgggcttcatgttcgccaactgggccaccggccagagcagaatgagcggccactag

SEQ ID NO: 99933 - DNA, 1419 bp, Artificial Sequence; identical to SEQ ID NO: 99931
  Description of Artificial Sequence: Synthetic coding sequence

SEQ ID NO: 99934 - DNA, 660 bp, Artificial Sequence
  Description of Artificial Sequence: Synthetic coding sequence
atggagctgcaggaccccaagatgaacggcgccctgcccagcgacgccgtgggctacagacaggagagagagggcttcctgcccagcagaggccccgcccccggcagcaagcccgtgcagttcatggacttcgagggcaagaccagcttcggcatgagcgtgttcaacctgagcaacgccatcatgggcagcggcatcctgggcctggcctacgccatggcccacaccggcgtgatcttcttcctggccctgctgctgtgcatcgccctgctgagcagctacagcatccacctgctgctgacctgcgccggcatcgccggcatcagagcctacgagcagctgggccagagagccttcggccccgccggcaaggtggtggtggccaccgtgatctgcctgcacaacgtgggcgccatgagcagctacctgttcatcatcaagagcgagctgcccctggtgatcggcaccttcctgtacatggaccccgagggcgactggttcctgaagggcaacctgctgatcatcatcgtgagcgtgctgatcatcctgcccctggccctgatgaagcacctgggctacctgggctacaccagcggcctgagcctgacctgcatgctgttcttcctggtgagcgtgatctacaagaagttccagctgtag

SEQ ID NO: 99935 - DNA, 576 bp, Artificial Sequence
  Description of Artificial Sequence: Synthetic coding sequence
atggagctgcaggaccccaagatgaacggcgccctgcccagcgacgccgtgggctacagacaggagagagagggcttcctgcccagcagaggccccgcccccggcagcaagcccgtgcagttcatggacttcgagggcaagaccagcttcggcatgagcgtgttcaacctgagcaacgccatcatgggcagcggcatcctgggcctggcctacgccatggcccacaccggcgtgatcttcttcctggccctgctgctgtgcatcgccctgctgagcagctacagcatccacctgctgctgacctgcgccggcatcgccggcatcagagcctacgagcagctgggccagagagccttcggccccgccggcaaggtggtggtggccaccgtgatctgcctgcacaacgtgggcgccatgagcagctacctgttcatcatcaagagcgagctgcccctggtgatcggcaccttcctgtacatggaccccgagggcgactggttcctgaagggcaacctgctgatcatcatcgtgagcgtgctgatcatcctgcccctggccctgatgaagcacctgtag

SEQ ID NO: 99936 - DNA, 495 bp, Artificial Sequence
  Description of Artificial Sequence: Synthetic coding sequence
atggagctgcaggaccccaagatgaacggcgccctgcccagcgacgccgtgggctacagacaggagagagagggcttcctgcccagcagaggccccgcccccggcagcaagcccgtgcagttcatggacttcgagggcaagaccagcttcggcatgagcgtgttcaacctgagcaacgccatcatgggcagcggcatcctgggcctggcctacgccatggcccacaccggcgtgatcttcttcctggccctgctgctgtgcatcgccctgctgagcagctacagcatccacctgctgctgacctgcgccggcatcgccggcatcagagcctacgagcagctgggccagagagccttcggccccgccggcaaggtggtggtggccaccgtgatctgcctgcacaacgtgggcgccatgagcagctacctgttcatcatcaagagcgagctgcccctggtgatcggcaccttcctgtacatggaccccgagggctag

SEQ ID NO: 99937 - DNA, 840 bp, Artificial Sequence
  Description of Artificial Sequence: Synthetic coding sequence
atggagctgcaggaccccaagatgaacggcgccctgcccagcgacgccgtgggctacagacaggagagagagggcttcctgcccagcagaggccccgcccccggcagcaagcccgtgcagttcatggacttcgagggcaagaccagcttcggcatgagcgtgttcaacctgagcaacgccatcatgggcagcggcatcctgggcctggcctacgccatggcccacaccggcgtgatcttcttcctggccctgctgctgtgcatcgccctgctgagcagctacagcatccacctgctgctgacctgcgccggcatcgccggcatcagagcctacgagcagctgggccagagagccttcggccccgccggcaaggtggtggtggccaccgtgatctgcctgcacaacgtgggcgccatgagcagctacctgttcatcatcaagagcgagctgcccctggtgatcggcaccttcctgtacatggaccccgagggcgactggttcctgaagggcaacctgctgatcatcatcgtgagcgtgctgatcatcctgcccctggccctgatgaagcacctgggctacctgggctacaccagcggcctgagcctgacctgcatgctgttcttcctggtgagcgtgatctacaagaagttccagctgggctgcgccatcggccacaacgagaccgccatggagagcgaggccctggtgggcctgcccagccagggcctgaacagcagctgcgaggcccagatgttcaccgtggacagccagatgagctacaccgtgcccatcatggccttcgccttcgtgtgccaccccgaggtgctgcccatctactag

SEQ ID NO: 99938 - DNA, 819 bp, Artificial Sequence
  Description of Artificial Sequence: Synthetic coding sequence
atggagctgcaggaccccaagatgaacggcgccctgcccagcgacgccgtgggctacagacaggagagagagggcttcctgcccagcagaggccccgcccccggcagcaagcccgtgcagttcatggacttcgagggcaagaccagcttcggcatgagcgtgttcaacctgagcaacgccatcatgggcagcggcatcctgggcctggcctacgccatggcccacaccggcgtgatcttcttcctggccctgctgctgtgcatcgccctgctgagcagctacagcatccacctgctgctgacctgcgccggcatcgccggcatcagagcctacgagcagctgggccagagagccttcggccccgccggcaaggtggtggtggccaccgtgatctgcctgcacaacgtgggcgccatgagcagctacctgttcatcatcaagagcgagctgcccctggtgatcggcaccttcctgtacatggaccccgagggcgactggttcctgaagggcaacctgctgatcatcatcgtgagcgtgctgatcatcctgcccctggccctgatgaagcacctgggctacctgggctacaccagcggcctgagcctgacctgcatgctgttcttcctggtgagcgtgatctacaagaagttccagctgggctgcgccatcggccacaacgagaccgccatggagagcgaggccctggtgggcctgcccagccagggcctgaacagcagctgcgaggcccagatgttcaccgtggacagccagatgagctacaccgtgcccatcatggccttcgccttcgtgtgccactag

SEQ ID NO: 99939 - DNA, 1422 bp, Artificial Sequence
  Description of Artificial Sequence: Synthetic coding sequence
atggccacccaggccaagagacccagagtggccggccccgtggacggcggcgacctggaccccgtggcctgcttcctgagctggtgcagaagagtgggcctggagctgagccccaaggtgagcgagagagccggcggcagaagaaccagaggcggcgccagagccgccctgaccagcccccccgcccaggtggccgtgagcagacagggcaccgtggccggctacggcatggtggccagagagagcgtgcaggccggcgagctgctgttcgtggtgcccagagccgccctgctgagccagcacacctgcagcatcggcggcctgctggagagagagagagtggccctgcagagccagagcggctgggtgcccctgctgctggccctgctgcacgagctgcaggcccccgccagcagatggagaccctacttcgccctgtggcccgagctgggcagactggagcaccccatgttctggcccgaggaggagagaagatgcctgctgcagggcaccggcgtgcccgaggccgtggagaaggacctggccaacatcagaagcgagtaccagagcatcgtgctgcccttcatggaggcccaccccgacctgttcagcctgagagtgagaagcctggagctgtaccaccagctggtggccctggtgatggcctacagcttccaggagcccctggaggaggaggaggacgagaaggagcccaacagccccgtgatggtgcccgccgccgacatcctgaaccacctggccaaccacaacgccaacctggagtacagcgccaactgcctgagaatggtggccacccagcccatccccaagggccacgagatcttcaacacctacggccagatggccaactggcagctgatccacatgtacggcttcgtggagccctaccccgacaacaccgacgacaccgccgacatccagatggtgaccgtgagagaggccgccctgcagggcaccaagaccgaggccgagagacacctggtgtacgagagatgggacttcctgtgcaagctggagatggtgggcgaggagggcgccttcgtgatcggcagagaggaggtgctgaccgaggaggagctgaccaccaccctgaaggtgctgtgcatgcccgccgaggagttcagagagctgaaggaccaggacggcggcggcgacgacaagagagaggagggcagcctgaccatcaccaacatccccaagctgaaggccagctggagacagctgctgcagaacagcgtgctgctgaccctgcagacctacgccaccgacctgaagaccgaccagggcctgctgagcaacaaggaggtgtacgccaagctgagctggagagagcagcaggccctgcaggtgagatacggccagaagatgatcctgcaccagctgctggagctgaccagctag

SEQ ID NO: 99940 - DNA, 975 bp, Artificial Sequence
  Description of Artificial Sequence: Synthetic coding sequence
atgggcccctggggcgagcccgagctgctggtgtggagacccgaggccgtggccagcgagccccccgtgcccgtgggcctggaggtgaagctgggcgccctggtgctgctgctggtgctgaccctgctgtgcagcctggtgcccatctgcgtgctgagaagacccggcgccaaccacgagggcagcgccagcagacagaaggccctgagcctggtgagctgcttcgccggcggcgtgttcctggccacctgcctgctggacctgctgcccgactacctggccgccatcgacgaggccctggccgccctgcacgtgaccctgcagttccccctgcaggagttcatcctggccatgggcttcttcctggtgctggtgatggagcagatcaccctggcctacaaggagcagagcggccccagccccctggaggagaccagagccctgctgggcaccgtgaacggcggcccccagcactggcacgacggccccggcgtgccccaggccagcggcgcccccgccacccccagcgccctgagagcctgcgtgctggtgttcagcctggccctgcacagcgtgttcgagggcctggccgtgggcctgcagagagacagagccagagccatggagctgtgcctggccctgctgctgcacaagggcatcctggccgtgagcctgagcctgagactgctgcagagccacctgagagcccaggtggtggccggctgcggcatcctgttcagctgcatgacccccctgggcatcggcctgggcgccgccctggccgagagcgccggccccctgcaccagctggcccagagcgtgctggagggcatggccgccggcaccttcctgtacatcaccttcctggagatcctgccccaggagctggccagcagcgagcagagaatcctgaaggtgatcctgctgctggccggcttcgccctgctgaccggcctgctgttcatccagatctag

SEQ ID NO: 99941 - DNA, 975 bp, Artificial Sequence; identical to SEQ ID NO: 99940
  Description of Artificial Sequence: Synthetic coding sequence

SEQ ID NO: 99942 - DNA, 975 bp, Artificial Sequence; identical to SEQ ID NO: 99940
  Description of Artificial Sequence: Synthetic coding sequence

SEQ ID NO: 99943 - DNA, 975 bp, Artificial Sequence; identical to SEQ ID NO: 99940
  Description of Artificial Sequence: Synthetic coding sequence

SEQ ID NO: 99944 - DNA, 723 bp, Artificial Sequence
  Description of Artificial Sequence: Synthetic coding sequence
atgggcccctggggcgagcccgagctgctggtgtggagacccgaggccgtggccagcgagccccccgtgcccgtgggcctggaggtgaagctgggcgccctggtgctgctgctggtgctgaccctgctgtgcagcctggtgcccatctgcgtgctgagaagacccggcgccaaccacgagggcagcgccagcagacagaaggccctgagcctggtgagctgcttcgccggcggcgtgttcctggccacctgcctgctggacctgctgcccgactacctggccgccatcgacgaggccctggccgccctgcacgtgaccctgcagttccccctgcaggagttcatcctggccatgggcttcttcctggtgctggtgatggagcagatcaccctggcctacaaggagcagagcggccccagccccctggaggagaccagagccctgctgggcaccgtgaacggcggcccccagcactggcacgacggccccggcgtgccccaggccagcggcgcccccgccacccccagcgccctgagagcctgcgtgctggtgttcagcctggccctgcacagcgtgttcgagggcctggccgtgggcctgcagagagacagagccagagccatggagctgtgcctggccctgctgctgcacaagggcatcctggccgtgagcctgagcctgagactgctgcagagccacctgagagcccaggtggtggcctag

SEQ ID NO: 99945 - DNA, 621 bp, Artificial Sequence
  Description of Artificial Sequence: Synthetic coding sequence
atgggcccctggggcgagcccgagctgctggtgtggagacccgaggccgtggccagcgagccccccgtgcccgtgggcctggaggtgaagctgggcgccctggtgctgctgctggtgctgaccctgctgtgcagcctggtgcccatctgcgtgctgagaagacccggcgccaaccacgagggcagcgccagcagacagaaggccctgagcctggtgagctgcttcgccggcggcgtgttcctggccacctgcctgctggacctgctgcccgactacctggccgccatcgacgaggccctggccgccctgcacgtgaccctgcagttccccctgcaggagttcatcctggccatgggcttcttcctggtgctggtgatggagcagatcaccctggcctacaaggagcagagcggccccagccccctggaggagaccagagccctgctgggcaccgtgaacggcggcccccagcactggcacgacggccccggcgtgccccaggccagcggcgcccccgccacccccagcgccctgagagcctgcgtgctggtgttcagcctggccctgcacagcgtgttcgagggcctggccgtgggcctgcagagagacagagccagatag

SEQ ID NO: 99946 - DNA, 966 bp, Artificial Sequence
  Description of Artificial Sequence: Synthetic coding sequence
atgggcccctggggcgagcccgagctgctggtgtggagacccgaggccgtggccagcgagccccccgtgcccgtgggcctggaggtgaagctgggcgccctggtgctgctgctggtgctgaccctgctgtgcagcctggtgcccatctgcgtgctgagaagacccggcgccaaccacgagggcagcgccagcagacagaaggccctgagcctggtgagctgcttcgccggcggcgtgttcctggccacctgcctgctggacctgctgcccgactacctggccgccatcgacgaggccctggccgccctgcacgtgaccctgcagttccccctgcaggagttcatcctggccatgggcttcttcctggtgctggtgatggagcagatcaccctggcctacaaggagcagagcggccccagccccctggaggagaccagagccctgctgggcaccgtgaacggcggcccccagcactggcacgacggccccggcgtgccccaggccagcggcgcccccgccacccccagcgccctgagagcctgcgtgctggtgttcagcctggccctgcacagcgtgttcgagggcctggccgtgggcctgcagagagacagagccagagccatggagctgtgcctggccctgctgctgcacaagggcatcctggccgtgagcctgagcctgagactgctgcagagccacctgagagcccaggtggtggccggctgcggcatcctgttcagctgcatgacccccctgggcatcggcctgggcgccgccctggccgagagcgccggccccctgcaccagctggcccagagcgtgctggagggcatggccgccggcaccttcctgtacatcaccttcctggagatcctgccccaggagctggccagcagcgagcagagaatcctgaaggtgatcctgctgctggccggcttcgccctgctgaccggcctgctgttctag

SEQ ID NO: 99947 - DNA, 669 bp, Artificial Sequence
  Description of Artificial Sequence: Synthetic coding sequence
atgaaggcccagctgcagttccccctgcaggagttcatcctggccatgggcttcttcctggtgctggtgatggagcagatcaccctggcctacaaggagcagagcggccccagccccctggaggagaccagagccctgctgggcaccgtgaacggcggcccccagcactggcacgacggccccggcgtgccccaggccagcggcgcccccgccacccccagcgccctgagagcctgcgtgctggtgttcagcctggccctgcacagcgtgttcgagggcctggccgtgggcctgcagagagacagagccagagccatggagctgtgcctggccctgctgctgcacaagggcatcctggccgtgagcctgagcctgagactgctgcagagccacctgagagcccaggtggtggccggctgcggcatcctgttcagctgcatgacccccctgggcatcggcctgggcgccgccctggccgagagcgccggccccctgcaccagctggcccagagcgtgctggagggcatggccgccggcaccttcctgtacatcaccttcctggagatcctgccccaggagctggccagcagcgagcagagaatcctgaaggtgatcctgctgctggccggcttcgccctgctgaccggcctgctgttcatccagatctag

SEQ ID NO: 99948 - DNA, 942 bp, Artificial Sequence
  Description of Artificial Sequence: Synthetic coding sequence
atgggcccctggggcgagcccgagctgctggtgtggagacccgaggccgtggccagcgagccccccgtgcccgtgggcctggtgctgaccctgctgtgcagcctggtgcccatctgcgtgctgagaagacccggcgccaaccacgagggcagcgccagcagacagaaggccctgagcctggtgagctgcttcgccggcggcgtgttcctggccacctgcctgctggacctgctgcccgactacctggccgccatcgacgaggccctggccgccctgcacgtgaccctgcagttccccctgcaggagttcatcctggccatgggcttcttcctggtgctggtgatggagcagatcaccctggcctacaaggagcagagcggccccagccccctggaggagaccagagccctgctgggcaccgtgaacggcggcccccagcactggcacgacggccccggcgtgccccaggccagcggcgcccccgccacccccagcgccctgagagcctgcgtgctggtgttcagcctggccctgcacagcgtgttcgagggcctggccgtgggcctgcagagagacagagccagagccatggagctgtgcctggccctgctgctgcacaagggcatcctggccgtgagcctgagcctgagactgctgcagagccacctgagagcccaggtggtggccggctgcggcatcctgttcagctgcatgacccccctgggcatcggcctgggcgccgccctggccgagagcgccggccccctgcaccagctggcccagagcgtgctggagggcatggccgccggcaccttcctgtacatcaccttcctggagatcctgccccaggagctggccagcagcgagcagagaatcctgaaggtgatcctgctgctggccggcttcgccctgctgaccggcctgctgttcatccagatctag

SEQ ID NO: 99949 - DNA, 1095 bp, Artificial Sequence
  Description of Artificial Sequence: Synthetic coding sequence
atgcccggctgcccctgccccggctgcggcatggccggccccagactgctgttcctgaccgccctggccctggagctgctggagagagccggcggcagccagcccgccctgagaagcagaggcaccgccaccgcctgcagactggacaacaaggagagcgagagctggggcgccctgctgagcggcgagagactggacacctggatctgcagcctgctgggcagcctgatggtgggcctgagcggcgtgttccccctgctggtgatccccctggagatgggcaccatgctgagaagcgaggccggcgcctggagactgaagcagctgctgagcttcgccctgggcggcctgctgggcaacgtgttcctgcacctgctgcccgaggcctgggcctacacctgcagcgccagccccggcggcgagggccagagcctgcagcagcagcagcagctgggcctgtgggtgatcgccggcatcctgaccttcctggccctggagaagatgttcctggacagcaaggaggagggcaccagccaggcccccaacaaggaccccaccgccgccgccgccgccctgaacggcggccactgcctggcccagcccgccgccgagcccggcctgggcgccgtggtgagaagcatcaaggtgagcggctacctgaacctgctggccaacaccatcgacaacttcacccacggcctggccgtggccgccagcttcctggtgagcaagaagatcggcctgctgaccaccatggccatcctgctgcacgagatcccccacgaggtgggcgacttcgccatcctgctgagagccggcttcgacagatggagcgccgccaagctgcagctgagcaccgccctgggcggcctgctgggcgccggcttcgccatctgcacccagagccccaagggcgtggaggagaccgccgcctgggtgctgcccttcaccagcggcggcttcctgtacatcgccctggtgaacgtgctgcccgacctgctggaggaggaggacccctggagaagcctgcagcagctgctgctgctgtgcgccggcatcgtggtgatggtgctgttcagcctgttcgtggactag

SEQ ID NO: 99950 - DNA, 1116 bp, Artificial Sequence
  Description of Artificial Sequence: Synthetic coding sequence
atgcccggctgcccctgccccggctgcggcatggccggccccagactgctgttcctgaccgccctggccctggagctgctggagagagccggcggcagccagcccgccctgagaagcagaggcaccgccaccgcctgcagactggacaacaaggagagcgagagctggggcgccctgctgagcggcgagagactggacacctggatctgcagcctgctgggcagcctgatggtgggcctgagcggcgtgttccccctgctggtgatccccctggagatgggcaccatgctgagaagcgaggccggcgcctggagactgaagcagctgctgagcttcgccctgggcggcctgctgggcaacgtgttcctgcacctgctgcccgaggcctgggcctacacctgcagcgccagccccggcggcgagggccagagcctgcagcagcagcagcagctgggcctgtgggtgatcgccggcatcctgaccttcctggccctggagaagatgttcctggacagcaaggaggagggcaccagccaggcccccaacaaggaccccaccgccgccgccgccgccctgaacggcggccactgcctggcccagcccgccgccgagcccggcctgggcgccgtggtgagaagcatcaaggtgagcggctacctgaacctgctggccaacaccatcgacaacttcacccacggcctggccgtggccgccagcttcctggtgagcaagaagatcggcctgctgaccaccatggccatcctgctgcacgagatcccccacgaggtgggcgacttcgccatcctgctgagagccggcttcgacagatggagcgccgccaagctgcagctgagcaccgccctgggcggcctgctgggcgccggcttcgccatctgcacccagagccccaagggcgtggtgggctgcagccccgccgccgaggagaccgccgcctgggtgctgcccttcaccagcggcggcttcctgtacatcgccctggtgaacgtgctgcccgacctgctggaggaggaggacccctggagaagcctgcagcagctgctgctgctgtgcgccggcatcgtggtgatggtgctgttcagcctgttcgtggactag

SEQ ID NO: 99951 - DNA, 930 bp, Artificial Sequence
  Description of Artificial Sequence: Synthetic coding sequence
atggagcagctgctgggcatcaagctgggctgcctgttcgccctgctggccctgaccctgggctgcggcctgacccccatctgcttcaagtggttccagatcgacgccgccagaggccaccacagactggtgctgagactgctgggctgcatcagcgccggcgtgttcctgggcgccggcttcatgcacatgaccgccgaggccctggaggagatcgagagccagatccagaagttcatggtgcagaacagaagcgccagcgagagaaacagcagcggcgacgccgacagcgcccacatggagtacccctacggcgagctgatcatcagcctgggcttcttcttcgtgttcttcctggagagcctggccctgcagtgctgccccggcgccgccggcggcagcaccgtgcaggacgaggagtggggcggcgcccacatcttcgagctgcacagccacggccacctgcccagccccagcaagggccccctgagagccctggtgctgctgctgagcctgagcttccacagcgtgttcgagggcctggccgtgggcctgcagcccaccgtggccgccaccgtgcagctgtgcctggccgtgctggcccacaagggcctggtggtgttcggcgtgggcatgagactggtgcacctgggcaccagcagcagatgggccgtgttcagcatcctgctgctggccctgatgagccccctgggcctggccgtgggcctggccgtgaccggcggcgacagcgagggcggcagaggcctggcccaggccgtgctggagggcgtggccgccggcaccttcctgtacgtgaccttcctggagatcctgcccagagagctggccagccccgaggcccccctggccaagtggagctgcgtggccgccggcttcgccttcatggccttcatcgccctgtgggcctag

SEQ ID NO: 99952 - DNA, 945 bp, Artificial Sequence
  Description of Artificial Sequence: Synthetic coding sequence
atggtgaagctgctggtggccaagatcctgtgcatggtgggcgtgttcttcttcatgctgctgggcagcctgctgcccgtgaagatcatcgagaccgacttcgagaaggcccacagaagcaagaagatcctgagcctgtgcaacaccttcggcggcggcgtgttcctggccacctgcttcaacgccctgctgcccgccgtgagagagaagctgcagaaggtgctgagcctgggccacatcagcaccgactaccccctggccgagaccatcctgctgctgggcttcttcatgaccgtgttcctggagcagctgatcctgaccttcagaaaggagaagcccagcttcatcgacctggagaccttcaacgccggcagcgacgtgggcagcgacagcgagtacgagagccccttcatgggcggcgccagaggccacgccctgtacgtggagccccacggccacggccccagcctgagcgtgcagggcctgagcagagccagccccgtgagactgctgagcctggccttcgccctgagcgcccacagcgtgttcgagggcctggccctgggcctgcaggaggagggcgagaaggtggtgagcctgttcgtgggcgtggccgtgcacgagaccctggtggccgtggccctgggcatcagcatggccagaagcgccatgcccctgagagacgccgccaagctggccgtgaccgtgagcgccatgatccccctgggcatcggcctgggcctgggcatcgagagcgcccagggcgtgcccggcagcgtggccagcgtgctgctgcagggcctggccggcggcaccttcctgttcatcaccttcctggagatcctggccaaggagctggaggagaagagcgacagactgctgaaggtgctgttcctggtgctgggctacaccgtgctggccggcatggtgttcctgaagtggtag

SEQ ID NO: 99953 - DNA, 318 bp, Artificial Sequence
  Description of Artificial Sequence: Synthetic coding sequence
atggtgaagctgctggtggccaagatcctgtgcatggtgggcgtgttcttcttcatgctgctgggcagcctgctgcccgtgaagatcatcgagaccgacttcgagaaggcccacagaagcaagaagatcctgagcctgtgcaacaccttcggcggcggcgtgttcctggccacctgcttcaacgccctgctgcccgccgtgagagagaaggtgagagccccctgggccctggccgccgccctgggcaccctgtggcccagagacagcgacgccttcagcaccctgatgcccagcagcgtgaaggccctgatgctgtag

SEQ ID NO: 99954 - DNA, 972 bp, Artificial Sequence
  Description of Artificial Sequence: Synthetic coding sequence
atggtgaagctgctggtggccaagatcctgtgcatggtgggcgtgttcttcttcatgctgctgggcagcctgctgcccgtgaagatcatcgagaccgacttcgagaaggcccacagaagcaagaagatcctgagcctgtgcaacaccttcggcggcggcgtgttcctggccacctgcttcaacgccctgctgcccgccgtgagagagaagctgcagaaggtgctgagcctgggccacatcagcaccgactaccccctggccgagaccatcctgctgctgggcttcttcatgaccgtgttcctggagcagctgatcctgaccttcagaaaggagaagcccagcttcatcgacctggagaccttcaacgccggcagcgacgtgggcagcgacagcgagtacgagagccccttcatgggcggcgccagaggccacgccctgtacgtggagccccacggccacggccccagcctgagcgtgcagggcctgagcagagccagccccgtgagactgctgagcctggccttcgccctgagcgcccacagcgtgttcgagggcctggccctgggcctgcaggaggagggcgagaaggtggtgagcctgttcgtgggcgtggccgtgcacgagaccctggtggccgtggccctgggcatcagcatggccagaagcgccatgcccctgagagacgccgccaagctggccgtgaccgtgagcgccatgatccccctgggcatcggcctgggcctgggcatcgagagcgcccagggcgtgcccggcagcgtggccagcgtgctgctgcagggcctggccggcggcaccttcctgttcatcaccttcctggagatcctggccaaggagctggaggagaagagcgacagactgctgaaggtgctgttcctggtgctgggctacaccgtgctggccggcatggtgttcctgaagtggatcagcccccccgagcccagagtgagctag

SEQ ID NO: 99955 - DNA, 1869 bp, Artificial Sequence
  Description of Artificial Sequence: Synthetic coding sequence
atggtggacgtggtgggcctggagagagagaccggccccagaggcagcccctggcccggcctgcccctgcccagcctggtgggccccgcccccctgctgacctgcctgtgcccccagtgcctgagcgtggaggacgccctgggcctgggcgagcccgagggcagcggcctgccccccggccccgtgctggaggccagatacgtggccagactgagcgccgccgccgtgctgtacctgagcaaccccgagggcacctgcgaggacgccagagccggcctgtgggccagccacgccgaccacctgctggccctgctggagagccccaaggccctgacccccggcctgagctggctgctgcagagaatgcaggccagagccgccggccagacccccaagaccgcctgcgtggacatcccccagctgctggaggaggccgtgggcgccggcgcccccggcagcgccggcggcgtgctggccgccctgctggaccacgtgagaagcggcagctgcttccacgccctgcccagcccccagtacttcgtggacttcgtgttccagcagcacagcagcgaggtgcccatgaccctggccgagctgagcgccctgatgcagagactgggcgtgggcagagaggcccacagcgaccacagccacagacacagaggcgccagcagctgggaccccgtgcccctgatcagcagcagcaacagcagcagcgtgtgggacaccgtgtgcctgagcgccagagacgtgatggccgcctacggcctgagcgagcaggccggcgtgacccccgaggcctgggcccagctgagccccgccctgctgcagcagcagctgagcggcgcctgcaccagccagagcagaccccccgtgcaggaccagctgagccagagcgagagatacctgtacggcagcctggccaccctgctgatctgcctgtgcgccgtgttcggcctgctgctgctgacctgcaccggctgcagaggcgtgacccactacatcctgcagaccttcctgagcctggccgtgggcgccctgaccggcgacgccgtgctgcacctgacccccaaggtgctgggcctgcacacccacagcgaggagggcctgagcccccagcccacctggagactgctggccatgctggccggcctgtacgccttcttcctgttcgagaacctgttcaacctgctgctgcccagagaccccgaggacctggaggacggcccctgcggccacagcagccacagccacggcggccacagccacggcgtgagcctgcagctggcccccagcgagctgagacagcccaagcccccccacgagggcagcagagccgacctggtggccgaggagagccccgagctgctgaaccccgagcccagaagactgagccccgagctgagactgctgccctacatgatcaccctgggcgacgccgtgcacaacttcgccgacggcctggccgtgggcgccgccttcgccagcagctggaagaccggcctggccaccagcctggccgtgttctgccacgagctgccccacgagctgggcgacttcgccgccctgctgcacgccggcctgagcgtgagacaggccctgctgctgaacctggccagcgccctgaccgccttcgccggcctgtacgtggccctggccgtgggcgtgagcgaggagagcgaggcctggatcctggccgtggccaccggcctgttcctgtacgtggccctgtgcgacatgctgcccgccatgctgaaggtgagagaccccagaccctggctgctgttcctgctgcacaacgtgggcctgctgggcggctggaccgtgctgctgctgctgagcctgtacgaggacgacatcaccttctag

SEQ ID NO: 99956 - DNA, 1944 bp, Artificial Sequence
  Description of Artificial Sequence: Synthetic coding sequence
atggccagcctggtgagcctggagctgggcctgctgctggccgtgctggtggtgaccgccaccgccagcccccccgccggcctgctgagcctgctgaccagcggccagggcgccctggaccaggaggccctgggcggcctgctgaacaccctggccgacagagtgcactgcgccaacggcccctgcggcaagtgcctgagcgtggaggacgccctgggcctgggcgagcccgagggcagcggcctgccccccggccccgtgctggaggccagatacgtggccagactgagcgccgccgccgtgctgtacctgagcaaccccgagggcacctgcgaggacgccagagccggcctgtgggccagccacgccgaccacctgctggccctgctggagagccccaaggccctgacccccggcctgagctggctgctgcagagaatgcaggccagagccgccggccagacccccaagaccgcctgcgtggacatcccccagctgctggaggaggccgtgggcgccggcgcccccggcagcgccggcggcgtgctggccgccctgctggaccacgtgagaagcggcagctgcttccacgccctgcccagcccccagtacttcgtggacttcgtgttccagcagcacagcagcgaggtgcccatgaccctggccgagctgagcgccctgatgcagagactgggcgtgggcagagaggcccacagcgaccacagccacagacacagaggcgccagcagctgggaccccgtgcccctgatcagcagcagcaacagcagcagcgtgtgggacaccgtgtgcctgagcgccagagacgtgatggccgcctacggcctgagcgagcaggccggcgtgacccccgaggcctgggcccagctgagccccgccctgctgcagcagcagctgagcggcgcctgcaccagccagagcagaccccccgtgcaggaccagctgagccagagcgagagatacctgtacggcagcctggccaccctgctgatctgcctgtgcgccgtgttcggcctgctgctgctgacctgcaccggctgcagaggcgtgacccactacatcctgcagaccttcctgagcctggccgtgggcgccctgaccggcgacgccgtgctgcacctgacccccaaggtgctgggcctgcacacccacagcgaggagggcctgagcccccagcccacctggagactgctggccatgctggccggcctgtacgccttcttcctgttcgagaacctgttcaacctgctgctgcccagagaccccgaggacctggaggacggcccctgcggccacagcagccacagccacggcggccacagccacggcgtgagcctgcagctggcccccagcgagctgagacagcccaagcccccccacgagggcagcagagccgacctggtggccgaggagagccccgagctgctgaaccccgagcccagaagactgagccccgagctgagactgctgccctacatgatcaccctgggcgacgccgtgcacaacttcgccgacggcctggccgtgggcgccgccttcgccagcagctggaagaccggcctggccaccagcctggccgtgttctgccacgagctgccccacgagctgggcgacttcgccgccctgctgcacgccggcctgagcgtgagacaggccctgctgctgaacctggccagcgccctgaccgccttcgccggcctgtacgtggccctggccgtgggcgtgagcgaggagagcgaggcctggatcctggccgtggccaccggcctgttcctgtacgtggccctgtgcgacatgctgcccgccatgctgaaggtgagagaccccagaccctggctgctgttcctgctgcacaacgtgggcctgctgggcggctggaccgtgctgctgctgctgagcctgtacgaggacgacatcaccttctag

SEQ ID NO: 99957 - DNA, 1410 bp, Artificial Sequence
  Description of Artificial Sequence: Synthetic coding sequence
atggccagaggcctgggcgccccccactgggtggccgtgggcctgctgacctgggccaccctgggcctgctggtggccggcctgggcggccacgacgacctgcacgacgacctgcaggaggacttccacggccacagccacagacacagccacgaggacttccaccacggccacagccacgcccacggccacggccacacccacgagagcatctggcacggccacacccacgaccacgaccacggccacagccacgaggacctgcaccacggccacagccacggctacagccacgagagcctgtaccacagaggccacggccacgaccacgagcacagccacggcggctacggcgagagcggcgcccccggcatcaagcaggacctggacgccgtgaccctgtgggcctacgccctgggcgccaccgtgctgatcagcgccgcccccttcttcgtgctgttcctgatccccgtggagagcaacagccccagacacagaagcctgctgcagatcctgctgagcttcgccagcggcggcctgctgggcgacgccttcctgcacctgatcccccacgccctggagccccacagccaccacaccctggagcagcccggccacggccacagccacagcggccagggccccatcctgagcgtgggcctgtgggtgctgagcggcatcgtggccttcctggtggtggagaagttcgtgagacacgtgaagggcggccacggccacagccacggccacggccacgcccacagccacaccagaggcagccacggccacggcagacaggagagaagcaccaaggagaagcagagcagcgaggaggaggagaaggagaccagaggcgtgcagaagagaagaggcggcagcaccgtgcccaaggacggccccgtgagaccccagaacgccgaggaggagaagagaggcctggacctgagagtgagcggctacctgaacctggccgccgacctggcccacaacttcaccgacggcctggccatcggcgccagcttcagaggcggcagaggcctgggcatcctgaccaccatgaccgtgctgctgcacgaggtgccccacgaggtgggcgacttcgccatcctggtgcagagcggctgcagcaagaagcaggccatgagactgcagctgctgaccgccgtgggcgccctggccggcaccgcctgcgccctgctgaccgagggcggcgccgtgggcagcgagatcgccggcggcgccggccccggctgggtgctgcccttcaccgccggcggcttcatctacgtggccaccgtgagcgtgctgcccgagctgctgagagaggccagccccctgcagagcctgctggaggtgctgggcctgctgggcggcgtgatcatgatggtgctgatcgcccacctggagtag

SEQ ID NO: 99958 - DNA, 1410 bp, Artificial Sequence; identical to SEQ ID NO: 99957
  Description of Artificial Sequence: Synthetic coding sequence

SEQ ID NO: 99959 - DNA, 1410 bp, Artificial Sequence; identical to SEQ ID NO: 99957
  Description of Artificial Sequence: Synthetic coding sequence

SEQ ID NO: 99960 - DNA, 1410 bp, Artificial Sequence; identical to SEQ ID NO: 99957
  Description of Artificial Sequence: Synthetic coding sequence

SEQ ID NO: 99961 - DNA, 663 bp, Artificial Sequence
  Description of Artificial Sequence: Synthetic coding sequence
atggacagcagcctgcccgagtgcagacacatcggcaagggcatcagagccaaggtggagagaaacttcctgttcagcagagacctgaaggccggcctgcccagacccagcaagcccggcaaggagagaatccccgagcccgccctgggcgccaccgtgctgatcagcgccgcccccttcttcgtgctgttcctgatccccgtggagagcaacagccccagacacagaagcctgctgcagatcctgctgagcttcgccagcggcggcctgctgggcgacgccttcctgcacctgatcccccacgccctggagccccacagccaccacaccctggagcagcccggccacggccacagccacagcggccagggccccatcctgagcgtgggcctgtgggtgctgagcggcatcgtggccttcctggtggtggagaagttcgtgagacacgtgaagggcggccacggccacagccacggccacggccacgcccacagccacaccagaggcagccacggccacggcagacaggagagaagcaccaaggagaagcagagcagcgaggaggaggagaaggagaccagaggcgtgcagaagagaagaggcggcagcaccgtgcccaaggacggccccgtgagaccccagaacgccgaggaggagaagtag

SEQ ID NO: 99962 - DNA, 663 bp, Artificial Sequence; identical to SEQ ID NO: 99961
  Description of Artificial Sequence: Synthetic coding sequence

SEQ ID NO: 99963 - DNA, 1410 bp, Artificial Sequence; identical to SEQ ID NO: 99957
  Description of Artificial Sequence: Synthetic coding sequence

SEQ ID NO: 99964 - DNA, 1410 bp, Artificial Sequence; identical to SEQ ID NO: 99957
  Description of Artificial Sequence: Synthetic coding sequence

SEQ ID NO: 99965 - DNA, 1410 bp, Artificial Sequence; identical to SEQ ID NO: 99957
  Description of Artificial Sequence: Synthetic coding sequence

SEQ ID NO: 99966 - DNA, 663 bp, Artificial Sequence; identical to SEQ ID NO: 99961
  Description of Artificial Sequence: Synthetic coding sequence

SEQ ID NO: 99967 - DNA, 663 bp, Artificial Sequence; identical to SEQ ID NO: 99961
  Description of Artificial Sequence: Synthetic coding sequence

SEQ ID NO: 99968 - DNA, 1410 bp, Artificial Sequence; identical to SEQ ID NO: 99957
  Description of Artificial Sequence: Synthetic coding sequence

SEQ ID NO: 99969 - DNA, 1410 bp, Artificial Sequence; identical to SEQ ID NO: 99957
  Description of Artificial Sequence: Synthetic coding sequence

SEQ ID NO: 99970 - DNA, 1410 bp, Artificial Sequence; identical to SEQ ID NO: 99957
  Description of Artificial Sequence: Synthetic coding sequence

SEQ ID NO: 99971 - DNA, 1410 bp, Artificial Sequence; identical to SEQ ID NO: 99957
  Description of Artificial Sequence: Synthetic coding sequence

SEQ ID NO: 99972 - DNA, 663 bp, Artificial Sequence; identical to SEQ ID NO: 99961
  Description of Artificial Sequence: Synthetic coding sequence

SEQ ID NO: 99973 - DNA, 1125 bp, Artificial Sequence
  Description of Artificial Sequence: Synthetic coding sequence
atggccagaggcctgggcgccccccactgggtggccgtgggcctgctgacctgggccaccctgggcctgctggtggccggcctgggcggccacgacgacctgcacgacgacctgcaggaggacttccacggccacagccacagcgccgacctgagcagcagcatcttctgccccctgccctaccccagaggcgtggagctgagccccgccagcctgagcaccagcgacctggcccagttctgcttcagatgggcccccggcagatgcttcctgcacctgatcccccacgccctggagccccacagccaccacaccctggagcagcccggccacggccacagccacagcggccagggccccatcctgagcgtgggcctgtgggtgctgagcggcatcgtggccttcctggtggtggagaagttcgtgagacacgtgaagggcggccacggccacagccacggccacggccacgcccacagccacaccagaggcagccacggccacggcagacaggagagaagcaccaaggagaagcagagcagcgaggaggaggagaaggagaccagaggcgtgcagaagagaagaggcggcagcaccgtgcccaaggacggccccgtgagaccccagaacgccgaggaggagaagagaggcctggacctgagagtgagcggctacctgaacctggccgccgacctggcccacaacttcaccgacggcctggccatcggcgccagcttcagaggcggcagaggcctgggcatcctgaccaccatgaccgtgctgctgcacgaggtgccccacgaggtgggcgacttcgccatcctggtgcagagcggctgcagcaagaagcaggccatgagactgcagctgctgaccgccgtgggcgccctggccggcaccgcctgcgccctgctgaccgagggcggcgccgtgggcagcgagatcgccggcggcgccggccccggctgggtgctgcccttcaccgccggcggcttcatctacgtggccaccgtgagcgtgctgcccgagctgctgagagaggccagccccctgcagagcctgctggaggtgctgggcctgctgggcggcgtgatcatgatggtgctgatcgcccacctggagtag

SEQ ID NO: 99974 - DNA, 1353 bp, Artificial Sequence
  Description of Artificial Sequence: Synthetic coding sequence
atggccagaggcctgggcgccccccactgggtggccgtgggcctgctgacctgggccaccctgggcctgctggtggccggcctgggcggccacgacgacctgcacgacgacctgcaggaggacttccacggccacggccacacccacgagagcatctggcacggccacacccacgaccacgaccacggccacagccacgaggacctgcaccacggccacagccacggctacagccacgagagcctgtaccacagaggccacggccacgaccacgagcacagccacggcggctacggcgagagcggcgcccccggcatcaagcaggacctggacgccgtgaccctgtgggcctacgccctgggcgccaccgtgctgatcagcgccgcccccttcttcgtgctgttcctgatccccgtggagagcaacagccccagacacagaagcctgctgcagatcctgctgagcttcgccagcggcggcctgctgggcgacgccttcctgcacctgatcccccacgccctggagccccacagccaccacaccctggagcagcccggccacggccacagccacagcggccagggccccatcctgagcgtgggcctgtgggtgctgagcggcatcgtggccttcctggtggtggagaagttcgtgagacacgtgaagggcggccacggccacagccacggccacggccacgcccacagccacaccagaggcagccacggccacggcagacaggagagaagcaccaaggagaagcagagcagcgaggaggaggagaaggagaccagaggcgtgcagaagagaagaggcggcagcaccgtgcccaaggacggccccgtgagaccccagaacgccgaggaggagaagagaggcctggacctgagagtgagcggctacctgaacctggccgccgacctggcccacaacttcaccgacggcctggccatcggcgccagcttcagaggcggcagaggcctgggcatcctgaccaccatgaccgtgctgctgcacgaggtgccccacgaggtgggcgacttcgccatcctggtgcagagcggctgcagcaagaagcaggccatgagactgcagctgctgaccgccgtgggcgccctggccggcaccgcctgcgccctgctgaccgagggcggcgccgtgggcagcgagatcgccggcggcgccggccccggctgggtgctgcccttcaccgccggcggcttcatctacgtggccaccgtgagcgtgctgcccgagctgctgagagaggccagccccctgcagagcctgctggaggtgctgggcctgctgggcggcgtgatcatgatggtgctgatcgcccacctggagtag

SEQ ID NO: 99975 - DNA, 663 bp, Artificial Sequence; identical to SEQ ID NO: 99961
  Description of Artificial Sequence: Synthetic coding sequence

SEQ ID NO: 99976 - DNA, 1410 bp, Artificial Sequence; identical to SEQ ID NO: 99957
  Description of Artificial Sequence: Synthetic coding sequence

SEQ ID NO: 99977 - DNA, 1125 bp, Artificial Sequence; identical to SEQ ID NO: 99973
  Description of Artificial Sequence: Synthetic coding sequence

SEQ ID NO: 99978 - DNA, 1353 bp, Artificial Sequence; identical to SEQ ID NO: 99974
  Description of Artificial Sequence: Synthetic coding sequence

SEQ ID NO: 99979 - DNA, 1125 bp, Artificial Sequence; identical to SEQ ID NO: 99973
  Description of Artificial Sequence: Synthetic coding sequence

SEQ ID NO: 99980 - DNA, 1125 bp, Artificial Sequence; identical to SEQ ID NO: 99973
  Description of Artificial Sequence: Synthetic coding sequence

SEQ ID NO: 99981 - DNA, 1353 bp, Artificial Sequence; identical to SEQ ID NO: 99974
  Description of Artificial Sequence: Synthetic coding sequence

SEQ ID NO: 99982 - DNA, 1353 bp, Artificial Sequence; identical to SEQ ID NO: 99974
  Description of Artificial Sequence: Synthetic coding sequence

SEQ ID NO: 99983 - DNA, 1125 bp, Artificial Sequence; identical to SEQ ID NO: 99973
  Description of Artificial Sequence: Synthetic coding sequence

SEQ ID NO: 99984 - DNA, 1353 bp, Artificial Sequence; identical to SEQ ID NO: 99974
  Description of Artificial Sequence: Synthetic coding sequence

SEQ ID NO: 99985 - DNA, 1353 bp, Artificial Sequence; identical to SEQ ID NO: 99974
  Description of Artificial Sequence: Synthetic coding sequence

SEQ ID NO: 99986 - DNA, 1125 bp, Artificial Sequence; identical to SEQ ID NO: 99973
  Description of Artificial Sequence: Synthetic coding sequence

SEQ ID NO: 99987 - DNA, 2391 bp, Artificial Sequence
  Description of Artificial Sequence: Synthetic coding sequence
atgctggcccccctgagaaacgcccccggcagagagggcgccaccagccccagcccccccaccgacgccaccggcagcctgggcgagtgggacgtggacagaaacgtgaagaccgagggctgggtgagcaaggagagaatcagcaagctgcacagactgagaatggccgacatcctgagccagagcgagaccctggccagccaggacctgagcggcgacttcaagaagcccgccctgcccgtgagccccgccgccagaagcaaggcccccgccagcagcagcagcaaccccgaggaggtgcagaaggagggccccaccgccctgcaggacagcaacagcggcgagcccgacatcccccccccccagcccgactgcggcgacttcagaagcctgcaggaggagcagagcagaccccccaccgccgtgagcagccccggcggccccgccagagcccccccctaccaggagcccccctggggcggccccgccaccgccccctacagcctggagaccctgaagggcggcaccatcctgggcaccagaagcctgaagggcaccagctactgcctgttcggcagactgagcggctgcgacgtgtgcctggagcaccccagcgtgagcagataccacgccgtgctgcagcacagagccagcggccccgacggcgagtgcgacagcaacggccccggcttctacctgtacgacctgggcagcacccacggcaccttcctgaacaagaccagaatcccccccagaacctactgcagagtgcacgtgggccacgtggtgagattcggcggcagcaccagactgttcatcctgcagggccccgaggaggacagagaggccgagagcgagctgaccgtgacccagctgaaggagctgagaaagcagcagcagatcctgctggagaagaagatgctgggcgaggacagcgacgaggaggaggagatggacaccagcgagagaaagatcaacgccggcagccaggacgacgagatgggctgcacctggggcatgggcgaggacgccgtggaggacgacgccgaggagaaccccatcgtgctggagttccagcaggagagagaggccttctacatcaaggaccccaagaaggccctgcagggcttcttcgacagagagggcgaggagctggagtacgagttcgacgagcagggccacagcacctggctgtgcagagtgagactgcccgtggacgacagcaccggcaagcagctggtggccgaggccatccacagcggcaagaagaaggaggccatgatccagtgcagcctggaggcctgcagaatcctggacaccctgggcctgctgagacaggaggccgtgagcagaaagagaaaggccaagaactgggaggacgaggacttctacgacagcgacgacgacaccttcctggacagaaccggcctgatcgagaagaagagactgaacagaatgaagaaggccggcaagatcgacgagaagcccgagaccttcgagagcctggtggccaagctgaacgacgccgagagagagctgagcgagatcagcgagagactgaaggccagcagccaggtgctgagcgagagccccagccaggacagcctggacgccttcatgagcgagatgaagagcggcagcaccctggacggcgtgagcagaaagaagctgcacctgagaaccttcgagctgagaaaggagcagcagagactgaagggcctgatcaagatcgtgaagcccgccgagatccccgagctgaagaagaccgagacccagaccaccggcgccgagaacaaggccaagaagctgaccctgcccctgttcggcgccatgaagggcggcagcaagttcaagctgaagaccggcaccgtgggcaagctgccccccaagagacccgagctgccccccaccctgatgagaatgaaggacgagcccgaggtggaggaggaggaggaggaggaggaggaggaggagaaggagaaggaggagcacgagaagaagaagctggaggacggcagcctgagcagaccccagcccgagatcgagcccgaggccgccgtgcaggagatgagaccccccaccgacctgacccacttcaaggagacccagacccacgagaacatgagccagctgagcgaggaggagcagaacaaggactaccaggactgcagcaagaccaccagcctgtgcgccggccccagcgccagcaagaacgagtacgagaagagcagaggcgagctgaagaagaagaagacccccggccccggcaagctgccccccaccctgagcagcaagtaccccgaggacgaccccgactactgcgtgtgggtgccccccgagggccagagcggcgacggcagaacccacctgaacgacaagtacggctactag

SEQ ID NO: 99988 - DNA, 3699 bp, Artificial Sequence
  Description of Artificial Sequence: Synthetic coding sequence
atggacttcctgctgagaccccagcccgagcccgagagcctgggccccggcacccccggcttccccgagcaggaggaggacgagctgcacagaaccctgggcgtggagagattcgaggagatcctgcaggaggccggcagcagaggcggcgaggagcccggcagaagctacggcgaggaggacttcgagtaccacagacagagcagccaccacatccaccaccccctgagcacccacctgccccccgacgccagaagaagaaagaccccccagggccccggcagaaagcccagaagaagacccggcgccagccccaccggcgagacccccaccatcgaggagggcgaggaggacgaggacgaggccagcgaggccgagggcgccagagccctgacccagcccagccccgtgagcacccccagcagcgtgcagttcttcctgcaggaggacgacagcgccgacagaaaggccgagagaaccagccccagcagccccgcccccctgccccaccaggaggccacccccagagccagcaagggcgcccaggccggcacccaggtggaggaggccgaggccgaggccgtggccgtggccagcggcaccgccggcggcgacgacggcggcgccagcggcagacccctgcccaaggcccagcccggccacagaagctacaacctgcaggagagaagaagaatcggcagcatgaccggcgccgagcaggccctgctgcccagagtgcccaccgacgagatcgaggcccagaccctggccaccgccgacctggacctgatgaagagccacagattcgaggacgtgcccggcgtgagaagacacctggtgagaaagaacgccaagggcagcacccagagcggcagagagggcagagagcccggccccacccccagagccagacccagagccccccacaagccccacgaggtgttcgtggagctgaacgagctgctgctggacaagaaccaggagccccagtggagagagaccgccagatggatcaagttcgaggaggacgtggaggaggagaccgagagatggggcaagccccacgtggccagcctgagcttcagaagcctgctggagctgagaagaaccctggcccacggcgccgtgctgctggacctggaccagcagaccctgcccggcgtggcccaccaggtggtggagcagatggtgatcagcgaccagatcaaggccgaggacagagccaacgtgctgagagccctgctgctgaagcacagccaccccagcgacgagaaggacttcagcttccccagaaacatcagcgccggcagcctgggcagcctgctgggccaccaccacggccagggcgccgagagcgacccccacgtgaccgagcccctgatgggcggcgtgcccgagaccagactggaggtggagagagagagagagctgcccccccccgccccccccgccggcatcaccagaagcaagagcaagcacgagctgaagctgctggagaagatccccgagaacgccgaggccaccgtggtgctggtgggctgcgtggagttcctgagcagacccaccatggccttcgtgagactgagagaggccgtggagctggacgccgtgctggaggtgcccgtgcccgtgagattcctgttcctgctgctgggccccagcagcgccaacatggactaccacgagatcggcagaagcatcagcaccctgatgagcgacaagcagttccacgaggccgcctacctggccgacgagagagaggacctgctgaccgccatcaacgccttcctggactgcagcgtggtgctgccccccagcgaggtgcagggcgaggagctgctgagaagcgtggcccacttccagagacagatgctgaagaagagagaggagcagggcagactgctgcccaccggcgccggcctggagcccaagagcgcccaggacaaggccctgctgcagatggtggaggccgccggcgccgccgaggacgaccccctgagaagaaccggcagacccttcggcggcctgatcagagacgtgagaagaagatacccccactacctgagcgacttcagagacgccctggacccccagtgcctggccgccgtgatcttcatctacttcgccgccctgagccccgccatcaccttcggcggcctgctgggcgagaagacccaggacctgatcggcgtgagcgagctgatcatgagcaccgccctgcagggcgtggtgttctgcctgctgggcgcccagcccctgctggtgatcggcttcagcggccccctgctggtgttcgaggaggccttcttcagcttctgcagcagcaaccacctggagtacctggtgggcagagtgtggatcggcttctggctggtgttcctggccctgctgatggtggccctggagggcagcttcctggtgagattcgtgagcagattcacccaggagatcttcgccttcctgatcagcctgatcttcatctacgagaccttctacaagctggtgaagatcttccaggagcaccccctgcacggctgcagcgccagcaacagcagcgaggtggacggcggcgagaacatgacctgggccggcgccagacccaccctgggccccggcaacagaagcctggccggccagagcggccagggcaagcccagaggccagcccaacaccgccctgctgagcctggtgctgatggccggcaccttcttcatcgccttcttcctgagaaagttcaagaacagcagattcttccccggcagaatcagaagagtgatcggcgacttcggcgtgcccatcgccatcctgatcatggtgctggtggactacagcatcgaggacacctacacccagaagctgagcgtgcccagcggcttcagcgtgaccgcccccgagaagagaggctgggtgatcaaccccctgggcgagaagagccccttccccgtgtggatgatggtggccagcctgctgcccgccatcctggtgttcatcctgatcttcatggagacccagatcaccaccctgatcatcagcaagaaggagagaatgctgcagaagggcagcggcttccacctggacctgctgctgatcgtggccatgggcggcatctgcgccctgttcggcctgccctggctggccgccgccaccgtgagaagcgtgacccacgccaacgccctgaccgtgatgagcaaggccgtggcccccggcgacaagcccaagatccaggaggtgaaggagcagagagtgaccggcctgctggtggccctgctggtgggcctgagcatcgtgatcggcgacctgctgagacagatccccctggccgtgctgttcggcatcttcctgtacatgggcgtgaccagcctgaacggcatccagttctacgagagactgcacctgctgctgatgccccccaagcaccaccccgacgtgacctacgtgaagaaggtgagaaccctgagaatgcacctgttcaccgccctgcagctgctgtgcctggccctgctgtgggccgtgatgagcaccgccgccagcctggccttccccttcatcctgatcctgaccgtgcccctgagaatggtggtgctgaccagaatcttcaccgacagagagatgaagtgcctggacgccaacgaggccgagcccgtgttcgacgagagagagggcgtggacgagtacaacgagatgcccatgcccgtgtag

SEQ ID NO: 99989 - DNA, 3684 bp, Artificial Sequence
  Description of Artificial Sequence: Synthetic coding sequence
atgacccagcccgagcccgagagcctgggccccggcacccccggcttccccgagcaggaggaggacgagctgcacagaaccctgggcgtggagagattcgaggagatcctgcaggaggccggcagcagaggcggcgaggagcccggcagaagctacggcgaggaggacttcgagtaccacagacagagcagccaccacatccaccaccccctgagcacccacctgccccccgacgccagaagaagaaagaccccccagggccccggcagaaagcccagaagaagacccggcgccagccccaccggcgagacccccaccatcgaggagggcgaggaggacgaggacgaggccagcgaggccgagggcgccagagccctgacccagcccagccccgtgagcacccccagcagcgtgcagttcttcctgcaggaggacgacagcgccgacagaaaggccgagagaaccagccccagcagccccgcccccctgccccaccaggaggccacccccagagccagcaagggcgcccaggccggcacccaggtggaggaggccgaggccgaggccgtggccgtggccagcggcaccgccggcggcgacgacggcggcgccagcggcagacccctgcccaaggcccagcccggccacagaagctacaacctgcaggagagaagaagaatcggcagcatgaccggcgccgagcaggccctgctgcccagagtgcccaccgacgagatcgaggcccagaccctggccaccgccgacctggacctgatgaagagccacagattcgaggacgtgcccggcgtgagaagacacctggtgagaaagaacgccaagggcagcacccagagcggcagagagggcagagagcccggccccacccccagagccagacccagagccccccacaagccccacgaggtgttcgtggagctgaacgagctgctgctggacaagaaccaggagccccagtggagagagaccgccagatggatcaagttcgaggaggacgtggaggaggagaccgagagatggggcaagccccacgtggccagcctgagcttcagaagcctgctggagctgagaagaaccctggcccacggcgccgtgctgctggacctggaccagcagaccctgcccggcgtggcccaccaggtggtggagcagatggtgatcagcgaccagatcaaggccgaggacagagccaacgtgctgagagccctgctgctgaagcacagccaccccagcgacgagaaggacttcagcttccccagaaacatcagcgccggcagcctgggcagcctgctgggccaccaccacggccagggcgccgagagcgacccccacgtgaccgagcccctgatgggcggcgtgcccgagaccagactggaggtggagagagagagagagctgcccccccccgccccccccgccggcatcaccagaagcaagagcaagcacgagctgaagctgctggagaagatccccgagaacgccgaggccaccgtggtgctggtgggctgcgtggagttcctgagcagacccaccatggccttcgtgagactgagagaggccgtggagctggacgccgtgctggaggtgcccgtgcccgtgagattcctgttcctgctgctgggccccagcagcgccaacatggactaccacgagatcggcagaagcatcagcaccctgatgagcgacaagcagttccacgaggccgcctacctggccgacgagagagaggacctgctgaccgccatcaacgccttcctggactgcagcgtggtgctgccccccagcgaggtgcagggcgaggagctgctgagaagcgtggcccacttccagagacagatgctgaagaagagagaggagcagggcagactgctgcccaccggcgccggcctggagcccaagagcgcccaggacaaggccctgctgcagatggtggaggccgccggcgccgccgaggacgaccccctgagaagaaccggcagacccttcggcggcctgatcagagacgtgagaagaagatacccccactacctgagcgacttcagagacgccctggacccccagtgcctggccgccgtgatcttcatctacttcgccgccctgagccccgccatcaccttcggcggcctgctgggcgagaagacccaggacctgatcggcgtgagcgagctgatcatgagcaccgccctgcagggcgtggtgttctgcctgctgggcgcccagcccctgctggtgatcggcttcagcggccccctgctggtgttcgaggaggccttcttcagcttctgcagcagcaaccacctggagtacctggtgggcagagtgtggatcggcttctggctggtgttcctggccctgctgatggtggccctggagggcagcttcctggtgagattcgtgagcagattcacccaggagatcttcgccttcctgatcagcctgatcttcatctacgagaccttctacaagctggtgaagatcttccaggagcaccccctgcacggctgcagcgccagcaacagcagcgaggtggacggcggcgagaacatgacctgggccggcgccagacccaccctgggccccggcaacagaagcctggccggccagagcggccagggcaagcccagaggccagcccaacaccgccctgctgagcctggtgctgatggccggcaccttcttcatcgccttcttcctgagaaagttcaagaacagcagattcttccccggcagaatcagaagagtgatcggcgacttcggcgtgcccatcgccatcctgatcatggtgctggtggactacagcatcgaggacacctacacccagaagctgagcgtgcccagcggcttcagcgtgaccgcccccgagaagagaggctgggtgatcaaccccctgggcgagaagagccccttccccgtgtggatgatggtggccagcctgctgcccgccatcctggtgttcatcctgatcttcatggagacccagatcaccaccctgatcatcagcaagaaggagagaatgctgcagaagggcagcggcttccacctggacctgctgctgatcgtggccatgggcggcatctgcgccctgttcggcctgccctggctggccgccgccaccgtgagaagcgtgacccacgccaacgccctgaccgtgatgagcaaggccgtggcccccggcgacaagcccaagatccaggaggtgaaggagcagagagtgaccggcctgctggtggccctgctggtgggcctgagcatcgtgatcggcgacctgctgagacagatccccctggccgtgctgttcggcatcttcctgtacatgggcgtgaccagcctgaacggcatccagttctacgagagactgcacctgctgctgatgccccccaagcaccaccccgacgtgacctacgtgaagaaggtgagaaccctgagaatgcacctgttcaccgccctgcagctgctgtgcctggccctgctgtgggccgtgatgagcaccgccgccagcctggccttccccttcatcctgatcctgaccgtgcccctgagaatggtggtgctgaccagaatcttcaccgacagagagatgaagtgcctggacgccaacgaggccgagcccgtgttcgacgagagagagggcgtggacgagtacaacgagatgcccatgcccgtgtag

SEQ ID NO: 99990 - DNA, 2406 bp, Artificial Sequence
  Description of Artificial Sequence: Synthetic coding sequence
gtgatggaggtggtggaggccgagaagatcgtgctgctgaccagcgccagattcctgttcctgctgctgggccccgccggcaaggccccccagtaccacgagatcggcagaagcatcgccaccctgatgaccgacgagatcttccacgacgtggcctacaaggccaaggacagaaacgacctgctgagcggcatcgacgagttcctggaccaggtgaccgtgctgccccccggcgagtgggaccccagcatcagaatcgagccccccaagagcgtgcccagccaggagaagagaaagatccccgtgttccacaacggcagcacccccaccctgggcgagacccccaaggaggccgcccaccacgccggccccgagctgcagagaaccggcagactgttcggcggcctgatcctggacatcaagagaaaggcccccttcttcctgagcgacttcaaggacgccctgagcctgcagtgcctggccagcatcctgttcctgtactgcgcctgcatgagccccgtgatcaccttcggcggcctgctgggcgaggccaccgagggcagaatcagcgccatcgagagcctgttcggcgccagcctgaccggcatcgcctacagcctgttcgccggccagcccctgaccatcctgggcagcaccggccccgtgctggtgttcgagaagatcctgtacaagttctgcagagactaccagctgagctacctgagcctgagaaccagcatcggcctgtggaccagcttcctgtgcatcgtgctggtggccaccgacgccagcagcctggtgtgctacatcaccagattcaccgaggaggccttcgccgccctgatctgcatcatcttcatctacgaggccctggagaagctgttcgacctgggcgagacctacgccttcaacatgcacaacaacctggacaagctgaccagctacagctgcgtgtgcaccgagccccccaaccccagcaacgagaccctggcccagtggaagaaggacaacatcaccgcccacaacatcagctggagaaacctgaccgtgagcgagtgcaagaagctgagaggcgtgttcctgggcagcgcctgcggccaccacggcccctacatccccgacgtgctgttctggtgcgtgatcctgttcttcaccaccttcttcctgagcagcttcctgaagcagttcaagaccaagagatacttccccaccaaggtgagaagcaccatcagcgacttcgccgtgttcctgaccatcgtgatcatggtgaccatcgactacctggtgggcgtgcccagccccaagctgcacgtgcccgagaagttcgagcccacccaccccgagagaggctggatcatcagccccctgggcgacaacccctggtggaccctgctgatcgccgccatccccgccctgctgtgcaccatcctgatcttcatggaccagcagatcaccgccgtgatcatcaacagaaaggagcacaagctgaagaagggcgccggctaccacctggacctgctgatggtgggcgtgatgctgggcgtgtgcagcgtgatgggcctgccctggttcgtggccgccaccgtgctgagcatcagccacgtgaacagcctgaaggtggagagcgagtgcagcgcccccggcgagcagcccaagttcctgggcatcagagagcagagagtgaccggcctgatgatcttcatcctgatgggcctgagcgtgttcatgaccagcgtgctgaagttcatccccatgcccgtgctgtacggcgtgttcctgtacatgggcgtgagcagcctgaagggcatccagctgttcgacagaatcaagctgttcggcatgcccgccaagcaccagcccgacctgatctacctgagatacgtgcccctgtggaaggtgcacatcttcaccgtgatccagctgacctgcctggtgctgctgtgggtgatcaaggtgagcgccgccgccgtggtgttccccatgatggtgctggccctggtgttcgtgagaaagctgatggacctgtgcttcaccaagagagagctgagctggctggacgacctgatgcccgagagcaagaagaagaaggaggacgacaagaagaagaaggagaaggaggaggccgagagaatgctgcaggacgacgacgacaccgtgcacctgcccttcgagggcggcagcctgctgcagatccccgtgaaggccctgaagtacagcgtggaccccagcatcgtgaacatcagcgacgagatggccaagaccgcccagtggaaggccctgagcatgaacaccgagaacgccaaggtgaccagaagcaacatgagccccgacaagcccgtgagcgtgaagatcagcttcgaggacgagcccagaaagaagtacgtggacgccgagaccagcctgtag

SEQ ID NO: 99991 - DNA, 2244 bp, Artificial Sequence
  Description of Artificial Sequence: Synthetic coding sequence
atgcccctgggcagacagagccacagacaccacagaacccacggccagaagcacagaagaagaggcagaggcaagggcgccagccagggcgaggagggcctggaggccctggcccacgacacccccagccagagagtgcagttcatcctgggcaccgaggaggacgaggagcacgtgccccacgagctgttcaccgagctggacgagatctgcatgaaggagggcgaggacgccgagtggaaggagaccgccagatggctgaagttcgaggaggacgtggaggacggcggcgagagatggagcaagccctacgtggccaccctgagcctgcacagcctgttcgagctgagaagctgcctgatcaacggcaccgtgctgctggacatgcacgccaacagcatcgaggagatcagcgacctgatcctggaccagcaggagctgagcagcgacctgaacgacagcatgagagtgaaggtgagagaggccctgctgaagaagcaccaccaccagaacgagaagaagagaaacaacctgatccccatcgtgagaagcttcgccgaggtgggcaagaagcagagcgacccccacctgatggacaagcacggccagaccgtgagcccccagagcgtgcccaccaccaacctggaggtgaagaacggcgtgaactgcgagcacagccccgtggacctgagcaaggtggacctgcacttcatgaagaagatccccaccggcgccgaggccagcaacgtgctggtgggcgaggtggacatcctggacagacccatcgtggccttcgtgagactgagccccgccgtgctgctgagcggcctgaccgaggtgcccatccccaccagattcctgttcatcctgctgggccccgtgggcaagggccagcagtaccacgagatcggcagaagcatggccaccatcatgaccgacgagatcttccacgacgtggcctacaaggccaaggagagagacgacctgctggccggcatcgacgagttcctggaccaggtgaccgtgctgccccccggcgagtgggaccccagcatcagaatcgagccccccaagaacgtgcccagccaggagaagagaaagatgcccggcgtgcccaacggcaacgtgtgccacatcgagcaggagccccacggcggccacagcggccccgagctgcagagaaccggcagactgttcggcggcctggtgctggacatcaagagaaaggccccctggtactggagcgactacagagacgccctgagcctgcagtgcctggccagcttcctgttcctgtactgcgcctgcatgagccccgtgatcaccttcggcggcctgctgggcgaggccaccgagggcagaatcagcgccatcgagagcctgttcggcgccagcatgaccggcatcgcctacagcctgttcgccggccaggccctgaccatcctgggcagcaccggccccgtgctggtgttcgagaagatcctgttcaagttctgcaaggactacgccctgagctacctgagcctgagagcctgcatcggcctgtggaccgccttcctgtgcatcgtgctggtggccaccgacgccagcagcctggtgtgctacatcaccagattcaccgaggaggccttcgccagcctgatctgcatcatcttcatctacgaggccatcgagaagctgatccacctggccgagacctaccccatccacatgcacagccagctggaccacctgagcctgtactactgcagatgcaccctgcccgagaaccccaacaaccacaccctgcagtactggaaggaccacaacatcgtgaccgccgaggtgcactgggccaacctgaccgtgagcgagtgccaggagatgcacggcgagttcatgggcagcgcctgcggccaccacggcccctacacccccgacgtgctgttctggagctgcatcctgttcttcaccaccttcatcctgagcagcaccctgaagaccttcaagaccagcagatacttccccaccagaatggagagctgcagcgtggcctggctggagtgcggcggcgtgatcctggcccactgcaacctgagactgctgcccagcagctgggactacagacacgcccccccccagcccgccaacttctgcatcttcagcagagacggcgtgagcccctgctggcccggctggagccagagcctggacctggtgatctgcctgcccagaccccccaagatgctgggcctgcaggcctag

SEQ ID NO: 99992 - DNA, 3135 bp, Artificial Sequence
  Description of Artificial Sequence: Synthetic coding sequence
atgcccgccgccggcagcaacgagcccgacggcgtgctgagctaccagagacccgacgaggaggccgtggtggaccagggcggcaccagcaccatcctgaacatccactacgagaaggaggagctggagggccacagaaccctgtacgtgggcgtgagaatgcccctgggcagacagagccacagacaccacagaacccacggccagaagcacagaagaagaggcagaggcaagggcgccagccagggcgaggagggcctggaggccctggcccacgacacccccagccagagagtgcagttcatcctgggcaccgaggaggacgaggagcacgtgccccacgagctgttcaccgagctggacgagatctgcatgaaggagggcgaggacgccgagtggaaggagaccgccagatggctgaagttcgaggaggacgtggaggacggcggcgagagatggagcaagccctacgtggccaccctgagcctgcacagcctgttcgagctgagaagctgcctgatcaacggcaccgtgctgctggacatgcacgccaacagcatcgaggagatcagcgacctgatcctggaccagcaggagctgagcagcgacctgaacgacagcatgagagtgaaggtgagagaggccctgctgaagaagcaccaccaccagaacgagaagaagagaaacaacctgatccccatcgtgagaagcttcgccgaggtgggcaagaagcagagcgacccccacctgatggacaagcacggccagaccgtgagcccccagagcgtgcccaccaccaacctggaggtgaagaacggcgtgaactgcgagcacagccccgtggacctgagcaaggtggacctgcacttcatgaagaagatccccaccggcgccgaggccagcaacgtgctggtgggcgaggtggacatcctggacagacccatcgtggccttcgtgagactgagccccgccgtgctgctgagcggcctgaccgaggtgcccatccccaccagattcctgttcatcctgctgggccccgtgggcaagggccagcagtaccacgagatcggcagaagcatggccaccatcatgaccgacgagatcttccacgacgtggcctacaaggccaaggagagagacgacctgctggccggcatcgacgagttcctggaccaggtgaccgtgctgccccccggcgagtgggaccccagcatcagaatcgagccccccaagaacgtgcccagccaggagaagagaaagatgcccggcgtgcccaacggcaacgtgtgccacatcgagcaggagccccacggcggccacagcggccccgagctgcagagaaccggcagactgttcggcggcctggtgctggacatcaagagaaaggccccctggtactggagcgactacagagacgccctgagcctgcagtgcctggccagcttcctgttcctgtactgcgcctgcatgagccccgtgatcaccttcggcggcctgctgggcgaggccaccgagggcagaatcagcgccatcgagagcctgttcggcgccagcatgaccggcatcgcctacagcctgttcgccggccaggccctgaccatcctgggcagcaccggccccgtgctggtgttcgagaagatcctgttcaagttctgcaaggactacgccctgagctacctgagcctgagagcctgcatcggcctgtggaccgccttcctgtgcatcgtgctggtggccaccgacgccagcagcctggtgtgctacatcaccagattcaccgaggaggccttcgccagcctgatctgcatcatcttcatctacgaggccatcgagaagctgatccacctggccgagacctaccccatccacatgcacagccagctggaccacctgagcctgtactactgcagatgcaccctgcccgagaaccccaacaaccacaccctgcagtactggaaggaccacaacatcgtgaccgccgaggtgcactgggccaacctgaccgtgagcgagtgccaggagatgcacggcgagttcatgggcagcgcctgcggccaccacggcccctacacccccgacgtgctgttctggagctgcatcctgttcttcaccaccttcatcctgagcagcaccctgaagaccttcaagaccagcagatacttccccaccagagtgagaagcatggtgagcgacttcgccgtgttcctgaccatcttcaccatggtgatcatcgacttcctgatcggcgtgcccagccccaagctgcaggtgcccagcgtgttcaagcccaccagagacgacagaggctggatcatcaaccccatcggccccaacccctggtggaccgtgatcgccgccatcatccccgccctgctgtgcaccatcctgatcttcatggaccagcagatcaccgccgtgatcatcaacagaaaggagcacaagctgaagaagggctgcggctaccacctggacctgctgatggtggccatcatgctgggcgtgtgcagcatcatgggcctgccctggttcgtggccgccaccgtgctgagcatcacccacgtgaacagcctgaagctggagagcgagtgcagcgcccccggcgagcagcccaagttcctgggcatcagagagcagagagtgaccggcctgatgatcttcgtgctgatgggctgcagcgtgttcatgaccgccatcctgaagttcatccccatgcccgtgctgtacggcgtgttcctgtacatgggcgtgagcagcctgcagggcatccagttcttcgacagactgaagctgttcggcatgcccgccaagcaccagcccgacttcatctacctgagacacgtgcccctgagaaaggtgcacctgttcaccctgatccagctgacctgcctggtgctgctgtgggtgatcaaggccagccccgccgccatcgtgttccccatgatggtgctggccctggtgttcgtgagaaaggtgatggacctgtgcttcagcaagagagagctgagctggctggacgacctgatgcccgagagcaagaagaagaagctggacgacgccaagaagaaggccaaggaggaggaggtgatcgtgctggcccccaccgtgtacctgggcgccagcaactacagaacctag

SEQ ID NO: 99993 - DNA, 2736 bp, Artificial Sequence
  Description of Artificial Sequence: Synthetic coding sequence
atggaggagctgcaggacgactacgaggacatgatggaggagaacctggagcaggaggagtacgaggaccccgacatccccgagagccagatggaggagcccgccgcccacgacaccgaggccaccgccaccgactaccacaccaccagccaccccggcacccacaaggtgtacgtggagctgcaggagctggtgatggacgagaagaaccaggagctgagatggatggaggccgccagatgggtgcagctggaggagaacctgggcgagaacggcgcctggggcagaccccacctgagccacctgaccttctggagcctgctggagctgagaagagtgttcaccaagggcaccgtgctgctggacctgcaggagaccagcctggccggcgtggccaaccagctgctggacagattcatcttcgaggaccagatcagaccccaggacagagaggagctgctgagagccctgctgctgaagcacagccacgccggcgagctggaggccctgggcggcgtgaagcccgccgtgctgaccagaagcggcgaccccagccagcccctgctgccccagcacagcagcctggagacccagctgttctgcgagcagggcgacggcggcaccgagggccacagccccagcggcatcctggagaagatcccccccgacagcgaggccaccctggtgctggtgggcagagccgacttcctggagcagcccgtgctgggcttcgtgagactgcaggaggccgccgagctggaggccgtggagctgcccgtgcccatcagattcctgttcgtgctgctgggccccgaggccccccacatcgactacacccagctgggcagagccgccgccaccctgatgagcgagagagtgttcagaatcgacgcctacatggcccagagcagaggcgagctgctgcacagcctggagggcttcctggactgcagcctggtgctgccccccaccgacgcccccagcgagcaggccctgctgagcctggtgcccgtgcagagagagctgctgagaagaagataccagagcagccccgccaagcccgacagcagcttctacaagggcctggacctgaacggcggccccgacgaccccctgcagcagaccggccagctgttcggcggcctggtgagagacatcagaagaagatacccctactacctgagcgacatcaccgacgccttcagcccccaggtgctggccgccgtgatcttcatctacttcgccgccctgagccccgccatcaccttcggcggcctgctgggcgagaagaccagaaaccagatgggcgtgagcgagctgctgatcagcaccgccgtgcagggcatcctgttcgccctgctgggcgcccagcccctgctggtggtgggcttcagcggccccctgctggtgttcgaggaggccttcttcagcttctgcgagaccaacggcctggagtacatcgtgggcagagtgtggatcggcttctggctgatcctgctggtggtgctggtggtggccttcgagggcagcttcctggtgagattcatcagcagatacacccaggagatcttcagcttcctgatcagcctgatcttcatctacgagaccttcagcaagctgatcaagatcttccaggaccaccccctgcagaagacctacaactacaacgtgctgatggtgcccaagccccagggccccctgcccaacaccgccctgctgagcctggtgctgatggccggcaccttcttcttcgccatgatgctgagaaagttcaagaacagcagctacttccccggcaagctgagaagagtgatcggcgacttcggcgtgcccatcagcatcctgatcatggtgctggtggacttcttcatccaggacacctacacccagaagctgagcgtgcccgacggcttcaaggtgagcaacagcagcgccagaggctgggtgatccaccccctgggcctgagaagcgagttccccatctggatgatgttcgccagcgccctgcccgccctgctggtgttcatcctgatcttcctggagagccagatcaccaccctgatcgtgagcaagcccgagagaaagatggtgaagggcagcggcttccacctggacctgctgctggtggtgggcatgggcggcgtggccgccctgttcggcatgccctggctgagcgccaccaccgtgagaagcgtgacccacgccaacgccctgaccgtgatgggcaaggccagcacccccggcgccgccgcccagatccaggaggtgaaggagcagagaatcagcggcctgctggtggccgtgctggtgggcctgagcatcctgatggagcccatcctgagcagaatccccctggccgtgctgttcggcatcttcctgtacatgggcgtgaccagcctgagcggcatccagctgttcgacagaatcctgctgctgttcaagccccccaagtaccaccccgacgtgccctacgtgaagagagtgaagacctggagaatgcacctgttcaccggcatccagatcatctgcctggccgtgctgtgggtggtgaagagcacccccgccagcctggccctgcccttcgtgctgatcctgaccgtgcccctgagaagagtgctgctgcccctgatcttcagaaacgtggagctgcagtgcctggacgccgacgacgccaaggccaccttcgacgaggaggagggcagagacgagtacgacgaggtggccatgcccgtgtag

SEQ ID NO: 99994 - DNA, 3480 bp, Artificial Sequence
  Description of Artificial Sequence: Synthetic coding sequence
atgagcagcgcccccagaagacccgccaagggcgccgacagcttctgcacccccggccccggcagaaagcccagaagaagacccggcgccagccccaccggcgagacccccaccatcgaggagggcgaggaggacgaggacgaggccagcgaggccgagggcgccagagccctgacccagcccagccccgtgagcacccccagcagcgtgcagttcttcctgcaggaggacgacagcgccgacagaaaggccgagagaaccagccccagcagccccgcccccctgccccaccaggaggccacccccagagccagcaagggcgcccaggccggcacccaggtggaggaggccgaggccgaggccgtggccgtggccagcggcaccgccggcggcgacgacggcggcgccagcggcagacccctgcccaaggcccagcccggccacagaagctacaacctgcaggagagaagaagaatcggcagcatgaccggcgccgagcaggccctgctgcccagagtgcccaccgacgagatcgaggcccagaccctggccaccgccgacctggacctgatgaagagccacagattcgaggacgtgcccggcgtgagaagacacctggtgagaaagaacgccaagggcagcacccagagcggcagagagggcagagagcccggccccacccccagagccagacccagagccccccacaagccccacgaggtgttcgtggagctgaacgagctgctgctggacaagaaccaggagccccagtggagagagaccgccagatggatcaagttcgaggaggacgtggaggaggagaccgagagatggggcaagccccacgtggccagcctgagcttcagaagcctgctggagctgagaagaaccctggcccacggcgccgtgctgctggacctggaccagcagaccctgcccggcgtggcccaccaggtggtggagcagatggtgatcagcgaccagatcaaggccgaggacagagccaacgtgctgagagccctgctgctgaagcacagccaccccagcgacgagaaggacttcagcttccccagaaacatcagcgccggcagcctgggcagcctgctgggccaccaccacggccagggcgccgagagcgacccccacgtgaccgagcccctgatgggcggcgtgcccgagaccagactggaggtggagagagagagagagctgcccccccccgccccccccgccggcatcaccagaagcaagagcaagcacgagctgaagctgctggagaagatccccgagaacgccgaggccaccgtggtgctggtgggctgcgtggagttcctgagcagacccaccatggccttcgtgagactgagagaggccgtggagctggacgccgtgctggaggtgcccgtgcccgtgagattcctgttcctgctgctgggccccagcagcgccaacatggactaccacgagatcggcagaagcatcagcaccctgatgagcgacaagcagttccacgaggccgcctacctggccgacgagagagaggacctgctgaccgccatcaacgccttcctggactgcagcgtggtgctgccccccagcgaggtgcagggcgaggagctgctgagaagcgtggcccacttccagagacagatgctgaagaagagagaggagcagggcagactgctgcccaccggcgccggcctggagcccaagagcgcccaggacaaggccctgctgcagatggtggaggccgccggcgccgccgaggacgaccccctgagaagaaccggcagacccttcggcggcctgatcagagacgtgagaagaagatacccccactacctgagcgacttcagagacgccctggacccccagtgcctggccgccgtgatcttcatctacttcgccgccctgagccccgccatcaccttcggcggcctgctgggcgagaagacccaggacctgatcggcgtgagcgagctgatcatgagcaccgccctgcagggcgtggtgttctgcctgctgggcgcccagcccctgctggtgatcggcttcagcggccccctgctggtgttcgaggaggccttcttcagcttctgcagcagcaaccacctggagtacctggtgggcagagtgtggatcggcttctggctggtgttcctggccctgctgatggtggccctggagggcagcttcctggtgagattcgtgagcagattcacccaggagatcttcgccttcctgatcagcctgatcttcatctacgagaccttctacaagctggtgaagatcttccaggagcaccccctgcacggctgcagcgccagcaacagcagcgaggtggacggcggcgagaacatgacctgggccggcgccagacccaccctgggccccggcaacagaagcctggccggccagagcggccagggcaagcccagaggccagcccaacaccgccctgctgagcctggtgctgatggccggcaccttcttcatcgccttcttcctgagaaagttcaagaacagcagattcttccccggcagaatcagaagagtgatcggcgacttcggcgtgcccatcgccatcctgatcatggtgctggtggactacagcatcgaggacacctacacccagaagctgagcgtgcccagcggcttcagcgtgaccgcccccgagaagagaggctgggtgatcaaccccctgggcgagaagagccccttccccgtgtggatgatggtggccagcctgctgcccgccatcctggtgttcatcctgatcttcatggagacccagatcaccaccctgatcatcagcaagaaggagagaatgctgcagaagggcagcggcttccacctggacctgctgctgatcgtggccatgggcggcatctgcgccctgttcggcctgccctggctggccgccgccaccgtgagaagcgtgacccacgccaacgccctgaccgtgatgagcaaggccgtggcccccggcgacaagcccaagatccaggaggtgaaggagcagagagtgaccggcctgctggtggccctgctggtgggcctgagcatcgtgatcggcgacctgctgagacagatccccctggccgtgctgttcggcatcttcctgtacatgggcgtgaccagcctgaacggcatccagttctacgagagactgcacctgctgctgatgccccccaagcaccaccccgacgtgacctacgtgaagaaggtgagaaccctgagaatgcacctgttcaccgccctgcagctgctgtgcctggccctgctgtgggccgtgatgagcaccgccgccagcctggccttccccttcatcctgatcctgaccgtgcccctgagaatggtggtgctgaccagaatcttcaccgacagagagatgaagtgcctggacgccaacgaggccgagcccgtgttcgacgagagagagggcgtggacgagtacaacgagatgcccatgcccgtgtag

SEQ ID NO: 99995 - DNA, 3726 bp, Artificial Sequence
  Description of Artificial Sequence: Synthetic coding sequence
atgagcagcgcccccagaagacccgccaagggcgccgacagcttctgcacccccgagcccgagagcctgggccccggcacccccggcttccccgagcaggaggaggacgagctgcacagaaccctgggcgtggagagattcgaggagatcctgcaggaggccggcagcagaggcggcgaggagcccggcagaagctacggcgaggaggacttcgagtaccacagacagagcagccaccacatccaccaccccctgagcacccacctgccccccgacgccagaagaagaaagaccccccagggccccggcagaaagcccagaagaagacccggcgccagccccaccggcgagacccccaccatcgaggagggcgaggaggacgaggacgaggccagcgaggccgagggcgccagagccctgacccagcccagccccgtgagcacccccagcagcgtgcagttcttcctgcaggaggacgacagcgccgacagaaaggccgagagaaccagccccagcagccccgcccccctgccccaccaggaggccacccccagagccagcaagggcgcccaggccggcacccaggtggaggaggccgaggccgaggccgtggccgtggccagcggcaccgccggcggcgacgacggcggcgccagcggcagacccctgcccaaggcccagcccggccacagaagctacaacctgcaggagagaagaagaatcggcagcatgaccggcgccgagcaggccctgctgcccagagtgcccaccgacgagatcgaggcccagaccctggccaccgccgacctggacctgatgaagagccacagattcgaggacgtgcccggcgtgagaagacacctggtgagaaagaacgccaagggcagcacccagagcggcagagagggcagagagcccggccccacccccagagccagacccagagccccccacaagccccacgaggtgttcgtggagctgaacgagctgctgctggacaagaaccaggagccccagtggagagagaccgccagatggatcaagttcgaggaggacgtggaggaggagaccgagagatggggcaagccccacgtggccagcctgagcttcagaagcctgctggagctgagaagaaccctggcccacggcgccgtgctgctggacctggaccagcagaccctgcccggcgtggcccaccaggtggtggagcagatggtgatcagcgaccagatcaaggccgaggacagagccaacgtgctgagagccctgctgctgaagcacagccaccccagcgacgagaaggacttcagcttccccagaaacatcagcgccggcagcctgggcagcctgctgggccaccaccacggccagggcgccgagagcgacccccacgtgaccgagcccctgatgggcggcgtgcccgagaccagactggaggtggagagagagagagagctgcccccccccgccccccccgccggcatcaccagaagcaagagcaagcacgagctgaagctgctggagaagatccccgagaacgccgaggccaccgtggtgctggtgggctgcgtggagttcctgagcagacccaccatggccttcgtgagactgagagaggccgtggagctggacgccgtgctggaggtgcccgtgcccgtgagattcctgttcctgctgctgggccccagcagcgccaacatggactaccacgagatcggcagaagcatcagcaccctgatgagcgacaagcagttccacgaggccgcctacctggccgacgagagagaggacctgctgaccgccatcaacgccttcctggactgcagcgtggtgctgccccccagcgaggtgcagggcgaggagctgctgagaagcgtggcccacttccagagacagatgctgaagaagagagaggagcagggcagactgctgcccaccggcgccggcctggagcccaagagcgcccaggacaaggccctgctgcagatggtggaggccgccggcgccgccgaggacgaccccctgagaagaaccggcagacccttcggcggcctgatcagagacgtgagaagaagatacccccactacctgagcgacttcagagacgccctggacccccagtgcctggccgccgtgatcttcatctacttcgccgccctgagccccgccatcaccttcggcggcctgctgggcgagaagacccaggacctgatcggcgtgagcgagctgatcatgagcaccgccctgcagggcgtggtgttctgcctgctgggcgcccagcccctgctggtgatcggcttcagcggccccctgctggtgttcgaggaggccttcttcagcttctgcagcagcaaccacctggagtacctggtgggcagagtgtggatcggcttctggctggtgttcctggccctgctgatggtggccctggagggcagcttcctggtgagattcgtgagcagattcacccaggagatcttcgccttcctgatcagcctgatcttcatctacgagaccttctacaagctggtgaagatcttccaggagcaccccctgcacggctgcagcgccagcaacagcagcgaggtggacggcggcgagaacatgacctgggccggcgccagacccaccctgggccccggcaacagaagcctggccggccagagcggccagggcaagcccagaggccagcccaacaccgccctgctgagcctggtgctgatggccggcaccttcttcatcgccttcttcctgagaaagttcaagaacagcagattcttccccggcagaatcagaagagtgatcggcgacttcggcgtgcccatcgccatcctgatcatggtgctggtggactacagcatcgaggacacctacacccagaagctgagcgtgcccagcggcttcagcgtgaccgcccccgagaagagaggctgggtgatcaaccccctgggcgagaagagccccttccccgtgtggatgatggtggccagcctgctgcccgccatcctggtgttcatcctgatcttcatggagacccagatcaccaccctgatcatcagcaagaaggagagaatgctgcagaagggcagcggcttccacctggacctgctgctgatcgtggccatgggcggcatctgcgccctgttcggcctgccctggctggccgccgccaccgtgagaagcgtgacccacgccaacgccctgaccgtgatgagcaaggccgtggcccccggcgacaagcccaagatccaggaggtgaaggagcagagagtgaccggcctgctggtggccctgctggtgggcctgagcatcgtgatcggcgacctgctgagacagatccccctggccgtgctgttcggcatcttcctgtacatgggcgtgaccagcctgaacggcatccagttctacgagagactgcacctgctgctgatgccccccaagcaccaccccgacgtgacctacgtgaagaaggtgagaaccctgagaatgcacctgttcaccgccctgcagctgctgtgcctggccctgctgtgggccgtgatgagcaccgccgccagcctggccttccccttcatcctgatcctgaccgtgcccctgagaatggtggtgctgaccagaatcttcaccgacagagagatgaagtgcctggacgccaacgaggccgagcccgtgttcgacgagagagagggcgtggacgagtacaacgagatgcccatgcccgtgtag

SEQ ID NO: 99996 - DNA, 456 bp, Artificial Sequence
  Description of Artificial Sequence: Synthetic coding sequence
atgagcagcgcccccagaagacccgccaagggcgccgacagcttctgcacccccgagcccgagagcctgggccccggcacccccggcttccccgagcaggaggaggacgagctgcacagaaccctgggcgtggagagattcgaggagatcctgcaggaggccggcagcagaggcggcgaggagcccggcagaagctacggcgaggaggacttcgagtaccacagacagagcagccaccacatccaccaccccctgagcacccacctgccccccgacgccagaagaagaaagaccccccagggccccggcagaaagcccagaagaagacccggcgccagccccaccggcgagacccccaccatcgaggagggcgaggaggacgaggacgaggccagcgaggccgagggcgccagagccctgacccagcccagccccgtgagcacccccagcagctag

SEQ ID NO: 99997 - DNA, 384 bp, Artificial Sequence
  Description of Artificial Sequence: Synthetic coding sequence
atgagcagcgcccccagaagacccgccaagggcgccgacagcttctgcacccccgagcccgagagcctgggccccggcacccccggcttccccgagcaggaggaggacgagctgcacagaaccctgggcgtggagagattcgaggagatcctgcaggaggccggcagcagaggcggcgaggagcccggcagaagctacggcgaggaggacttcgagtaccacagacagagcagccaccacatccaccaccccctgagcacccacctgccccccgacgccagaagaagaaagaccccccagggccccggcagaaagcccagaagaagacccggcgccagccccaccggcgagacccccaccatcgaggagggcgaggaggactag

SEQ ID NO: 99998 - DNA, 438 bp, Artificial Sequence
  Description of Artificial Sequence: Synthetic coding sequence
atgagcagcgcccccagaagacccgccaagggcgccgacagcttctgcacccccgagcccgagagcctgggccccggcacccccggcttccccgagcaggaggaggacgagctgcacagaaccctgggcgtggagagattcgaggagatcctgcaggaggccggcagcagaggcggcgaggagcccggcagaagctacggcgaggaggacttcgagtaccacagacagagcagccaccacatccaccaccccctgagcacccacctgccccccgacgccagaagaagaaagaccccccagggccccggcagaaagcccagaagaagacccggcgccagccccaccggcgagacccccaccatcgaggagggcgaggaggacgaggacgaggccagcgaggccgagggcgccagagccctgacccagcccagcccctag

SEQ ID NO: 99999 - DNA, 3726 bp, Artificial Sequence; identical to SEQ ID NO: 99995
  Description of Artificial Sequence: Synthetic coding sequence

SEQ ID NO: 100000 - DNA, 213 bp, Artificial Sequence
  Description of Artificial Sequence: Synthetic coding sequence
atgagcagcgcccccagaagacccgccaagggcgccgacagcttctgcacccccgagcccgagagcctgggccccggcacccccggcttccccgagcaggaggaggacgagctgcacagaaccctgggcgtggagagattcgaggagatcctgcaggaggccggcagcagaggcggcgaggagcccggcagaagctacggcgaggaggactag

SEQ ID NO: 100001 - DNA, 510 bp, Artificial Sequence
  Description of Artificial Sequence: Synthetic coding sequence
atgagcagcgcccccagaagacccgccaagggcgccgacagcttctgcacccccgagcccgagagcctgggccccggcacccccggcttccccgagcaggaggaggacgagctgcacagaaccctgggcgtggagagattcgaggagatcctgcaggaggccggcagcagaggcggcgaggagcccggcagaagctacggcgaggaggacttcgagtaccacagacagagcagccaccacatccaccaccccctgagcacccacctgccccccgacgccagaagaagaaagaccccccagggccccggcagaaagcccagaagaagacccggcgccagccccaccggcgagacccccaccatcgaggagggcgaggaggacgaggacgaggccagcgaggccgagggcgccagagccctgacccagcccagccccgtgagcacccccagcagcgtgcagttcttcctgcaggaggacgacagcgccgacagaaaggccgagagaacctag

SEQ ID NO: 100002 - DNA, 3240 bp, Artificial Sequence
  Description of Artificial Sequence: Synthetic coding sequence
atggaggacgaggccgtgctggacagaggcgccagcttcctgaagcacgtgtgcgacgaggaggaggtggagggccaccacaccatctacatcggcgtgcacgtgcccaagagctacagaagaagaagaagacacaagagaaagaccggccacaaggagaagaaggagaaggagagaatcagcgagaactacagcgacaagagcgacatcgagaacgccgacgagagcagcagcagcatcctgaagcccctgatcagccccgccgccgagagaatcagattcatcctgggcgaggaggacgacagccccgcccccccccagctgttcaccgagctggacgagctgctggccgtggacggccaggagatggagtggaaggagaccgccagatggatcaagttcgaggagaaggtggagcagggcggcgagagatggagcaagccccacgtggccaccctgagcctgcacagcctgttcgagctgagaacctgcatggagaagggcagcatcatgctggacagagaggccagcagcctgccccagctggtggagatgatcgtggaccaccagatcgagaccggcctgctgaagcccgagctgaaggacaaggtgacctacaccctgctgagaaagcacagacaccagaccaagaagagcaacctgagaagcctggccgacatcggcaagaccgtgagcagcgccagcagaatgttcaccaaccccgacaacggcagccccgccatgacccacagaaacctgaccagcagcagcctgaacgacatcagcgacaagcccgagaaggaccagctgaagaacaagttcatgaagaagctgcccagagacgccgaggccagcaacgtgctggtgggcgaggtggacttcctggacacccccttcatcgccttcgtgagactgcagcaggccgtgatgctgggcgccctgaccgaggtgcccgtgcccaccagattcctgttcatcctgctgggccccaagggcaaggccaagagctaccacgagatcggcagagccatcgccaccctgatgagcgacgaggtgttccacgacatcgcctacaaggccaaggacagacacgacctgatcgccggcatcgacgagttcctggacgaggtgatcgtgctgccccccggcgagtgggaccccgccatcagaatcgagccccccaagagcctgcccagcagcgacaagagaaagaacatgtacagcggcggcgagaacgtgcagatgaacggcgacaccccccacgacggcggccacggcggcggcggccacggcgactgcgaggagctgcagagaaccggcagattctgcggcggcctgatcaaggacatcaagagaaaggcccccttcttcgccagcgacttctacgacgccctgaacatccaggccctgagcgccatcctgttcatctacctggccaccgtgaccaacgccatcaccttcggcggcctgctgggcgacgccaccgacaacatgcagggcgtgctggagagcttcctgggcaccgccgtgagcggcgccatcttctgcctgttcgccggccagcccctgaccatcctgagcagcaccggccccgtgctggtgttcgagagactgctgttcaacttcagcaaggacaacaacttcgactacctggagttcagactgtggatcggcctgtggagcgccttcctgtgcctgatcctggtggccaccgacgccagcttcctggtgcagtacttcaccagattcaccgaggagggcttcagcagcctgatcagcttcatcttcatctacgacgccttcaagaagatgatcaagctggccgactactaccccatcaacagcaacttcaaggtgggctacaacaccctgttcagctgcacctgcgtgccccccgaccccgccaacatcagcatcagcaacgacaccaccctggcccccgagtacctgcccaccatgagcagcaccgacatgtaccacaacaccaccttcgactgggccttcctgagcaagaaggagtgcagcaagtacggcggcaacctggtgggcaacaactgcaacttcgtgcccgacatcaccctgatgagcttcatcctgttcctgggcacctacaccagcagcatggccctgaagaagttcaagaccagcccctacttccccaccaccgccagaaagctgatcagcgacttcgccatcatcctgagcatcctgatcttctgcgtgatcgacgccctggtgggcgtggacacccccaagctgatcgtgcccagcgagttcaagcccaccagccccaacagaggctggttcgtgccccccttcggcgagaacccctggtgggtgtgcctggccgccgccatccccgccctgctggtgaccatcctgatcttcatggaccagcagatcaccgccgtgatcgtgaacagaaaggagcacaagctgaagaagggcgccggctaccacctggacctgttctgggtggccatcctgatggtgatctgcagcctgatggccctgccctggtacgtggccgccaccgtgatcagcatcgcccacatcgacagcctgaagatggagaccgagaccagcgcccccggcgagcagcccaagttcctgggcgtgagagagcagagagtgaccggcaccctggtgttcatcctgaccggcctgagcgtgttcatggcccccatcctgaagttcatccccatgcccgtgctgtacggcgtgttcctgtacatgggcgtggccagcctgaacggcgtgcagttcatggacagactgaagctgctgctgatgcccctgaagcaccagcccgacttcatctacctgagacacgtgcccctgagaagagtgcacctgttcaccttcctgcaggtgctgtgcctggccctgctgtggatcctgaagagcaccgtggccgccatcatcttccccgtgatgatcctggccctggtggccgtgagaaagggcatggactacctgttcagccagcacgacctgagcttcctggacgacgtgatccccgagaaggacaagaagaagaaggaggacgagaagaagaagaagaagaagaagggcagcctggacagcgacaacgacgacagcgactgcccctacagcgagaaggtgcccagcatcaagatccccatggacatcatggagcagcagcccttcctgagcgacagcaagcccagcgacagagagagaagccccaccttcctggagagacacaccagctgctag

SEQ ID NO: 100003 - DNA, 3108 bp, Artificial Sequence
  Description of Artificial Sequence: Synthetic coding sequence
atgagcaccgagaacgtggagggcaagcccagcaacctgggcgagagaggcagagccagaagcagcaccttcctgagagtggtgcagcccatgttcaaccacagcatcttcaccagcgccgtgagccccgccgccgagagaatcagattcatcctgggcgaggaggacgacagccccgcccccccccagctgttcaccgagctggacgagctgctggccgtggacggccaggagatggagtggaaggagaccgccagatggatcaagttcgaggagaaggtggagcagggcggcgagagatggagcaagccccacgtggccaccctgagcctgcacagcctgttcgagctgagaacctgcatggagaagggcagcatcatgctggacagagaggccagcagcctgccccagctggtggagatgatcgtggaccaccagatcgagaccggcctgctgaagcccgagctgaaggacaaggtgacctacaccctgctgagaaagcacagacaccagaccaagaagagcaacctgagaagcctggccgacatcggcaagaccgtgagcagcgccagcagaatgttcaccaaccccgacaacggcagccccgccatgacccacagaaacctgaccagcagcagcctgaacgacatcagcgacaagcccgagaaggaccagctgaagaacaagttcatgaagaagctgcccagagacgccgaggccagcaacgtgctggtgggcgaggtggacttcctggacacccccttcatcgccttcgtgagactgcagcaggccgtgatgctgggcgccctgaccgaggtgcccgtgcccaccagattcctgttcatcctgctgggccccaagggcaaggccaagagctaccacgagatcggcagagccatcgccaccctgatgagcgacgaggtgttccacgacatcgcctacaaggccaaggacagacacgacctgatcgccggcatcgacgagttcctggacgaggtgatcgtgctgccccccggcgagtgggaccccgccatcagaatcgagccccccaagagcctgcccagcagcgacaagagaaagaacatgtacagcggcggcgagaacgtgcagatgaacggcgacaccccccacgacggcggccacggcggcggcggccacggcgactgcgaggagctgcagagaaccggcagattctgcggcggcctgatcaaggacatcaagagaaaggcccccttcttcgccagcgacttctacgacgccctgaacatccaggccctgagcgccatcctgttcatctacctggccaccgtgaccaacgccatcaccttcggcggcctgctgggcgacgccaccgacaacatgcagggcgtgctggagagcttcctgggcaccgccgtgagcggcgccatcttctgcctgttcgccggccagcccctgaccatcctgagcagcaccggccccgtgctggtgttcgagagactgctgttcaacttcagcaaggacaacaacttcgactacctggagttcagactgtggatcggcctgtggagcgccttcctgtgcctgatcctggtggccaccgacgccagcttcctggtgcagtacttcaccagattcaccgaggagggcttcagcagcctgatcagcttcatcttcatctacgacgccttcaagaagatgatcaagctggccgactactaccccatcaacagcaacttcaaggtgggctacaacaccctgttcagctgcacctgcgtgccccccgaccccgccaacatcagcatcagcaacgacaccaccctggcccccgagtacctgcccaccatgagcagcaccgacatgtaccacaacaccaccttcgactgggccttcctgagcaagaaggagtgcagcaagtacggcggcaacctggtgggcaacaactgcaacttcgtgcccgacatcaccctgatgagcttcatcctgttcctgggcacctacaccagcagcatggccctgaagaagttcaagaccagcccctacttccccaccaccgccagaaagctgatcagcgacttcgccatcatcctgagcatcctgatcttctgcgtgatcgacgccctggtgggcgtggacacccccaagctgatcgtgcccagcgagttcaagcccaccagccccaacagaggctggttcgtgccccccttcggcgagaacccctggtgggtgtgcctggccgccgccatccccgccctgctggtgaccatcctgatcttcatggaccagcagatcaccgccgtgatcgtgaacagaaaggagcacaagctgaagaagggcgccggctaccacctggacctgttctgggtggccatcctgatggtgatctgcagcctgatggccctgccctggtacgtggccgccaccgtgatcagcatcgcccacatcgacagcctgaagatggagaccgagaccagcgcccccggcgagcagcccaagttcctgggcgtgagagagcagagagtgaccggcaccctggtgttcatcctgaccggcctgagcgtgttcatggcccccatcctgaagttcatccccatgcccgtgctgtacggcgtgttcctgtacatgggcgtggccagcctgaacggcgtgcagttcatggacagactgaagctgctgctgatgcccctgaagcaccagcccgacttcatctacctgagacacgtgcccctgagaagagtgcacctgttcaccttcctgcaggtgctgtgcctggccctgctgtggatcctgaagagcaccgtggccgccatcatcttccccgtgatgatcctggccctggtggccgtgagaaagggcatggactacctgttcagccagcacgacctgagcttcctggacgacgtgatccccgagaaggacaagaagaagaaggaggacgagaagaagaagaagaagaagaagggcagcctggacagcgacaacgacgacagcgactgcccctacagcgagaaggtgcccagcatcaagatccccatggacatcatggagcagcagcccttcctgagcgacagcaagcccagcgacagagagagaagccccaccttcctggagagacacaccagctgctag

SEQ ID NO: 100004 - DNA, 2988 bp, Artificial Sequence
  Description of Artificial Sequence: Synthetic coding sequence
atggaggacgaggccgtgctggacagaggcgccagcttcctgaagcacgtgtgcgacgaggaggaggtggagggccaccacaccatctacatcggcgtgcacgtgcccaagagctacagaagaagaagaagacacaagagaaagaccggccacaaggagaagaaggagaaggagagaatcagcgagaactacagcgacaagagcgacatcgagaacgccgacgagagcagcagcagcatcctgaagcccctgatcagccccgccgccgagagaatcagattcatcctgggcgaggaggacgacagccccgcccccccccagctgttcaccgagctggacgagctgctggccgtggacggccaggagatggagtggaaggagaccgccagatggatcaagttcgaggagaaggtggagcagggcggcgagagatggagcaagccccacgtggccaccctgagcctgcacagcctgttcgagctgagaacctgcatggagaagggcagcatcatgctggacagagaggccagcagcctgccccagctggtggagatgatcgtggaccaccagatcgagaccggcctgctgaagcccgagctgaaggacaaggtgacctacaccctgctgagaaagcacagacaccagaccaagaagagcaacctgagaagcctggccgacatcggcaagaccgtgagcagcgccagcagaatgttcaccaaccccgacaacggcagccccgccatgacccacagaaacctgaccagcagcagcctgaacgacatcagcgacaagcccgagaaggaccagctgaagaacaagttcatgaagaagctgcccagagacgccgaggccagcaacgtgctggtgggcgaggtggacttcctggacacccccttcatcgccttcgtgagactgcagcaggccgtgatgctgggcgccctgaccgaggtgcccgtgcccaccagattcctgttcatcctgctgggccccaagggcaaggccaagagctaccacgagatcggcagagccatcgccaccctgatgagcgacgaggtgttccacgacatcgcctacaaggccaaggacagacacgacctgatcgccggcatcgacgagttcctggacgaggtgatcgtgctgccccccggcgagtgggaccccgccatcagaatcgagccccccaagagcctgcccagcagcgacaagagaaagaacatgtacagcggcggcgagaacgtgcagatgaacggcgacaccccccacgacggcggccacggcggcggcggccacggcgactgcgaggagctgcagagaaccggcagattctgcggcggcctgatcaaggacatcaagagaaaggcccccttcttcgccagcgacttctacgacgccctgaacatccaggccctgagcgccatcctgttcatctacctggccaccgtgaccaacgccatcaccttcggcggcctgctgggcgacgccaccgacaacatgcagggcgtgctggagagcttcctgggcaccgccgtgagcggcgccatcttctgcctgttcgccggccagcccctgaccatcctgagcagcaccggccccgtgctggtgttcgagagactgctgttcaacttcagcaaggacaacaacttcgactacctggagttcagactgtggatcggcctgtggagcgccttcctgtgcctgatcctggtggccaccgacgccagcttcctggtgcagtacttcaccagattcaccgaggagggcttcagcagcctgatcagcttcatcttcatctacgacgccttcaagaagatgatcaagctggccgactactaccccatcaacagcaacttcaaggtgggctacaacaccctgttcagctgcacctgcgtgccccccgaccccgccaacatcagcatcagcaacgacaccaccctggcccccgagtacctgcccaccatgagcagcaccgacatgtaccacaacaccaccttcgactgggccttcctgagcaagaaggagtgcagcaagtacggcggcaacctggtgggcaacaactgcaacttcgtgcccgacatcaccctgatgagcttcatcctgttcctgggcacctacaccagcagcatggccctgaagaagttcaagaccagcccctacttccccaccaccgccagaaagctgatcagcgacttcgccatcatcctgagcatcctgatcttctgcgtgatcgacgccctggtgggcgtggacacccccaagctgatcgtgcccagcgagttcaagcccaccagccccaacagaggctggttcgtgccccccttcggcgagaacccctggtgggtgtgcctggccgccgccatccccgccctgctggtgaccatcctgatcttcatggaccagcagatcaccgccgtgatcgtgaacagaaaggagcacaagctgaagttcatccccatgcccgtgctgtacggcgtgttcctgtacatgggcgtggccagcctgaacggcgtgcagttcatggacagactgaagctgctgctgatgcccctgaagcaccagcccgacttcatctacctgagacacgtgcccctgagaagagtgcacctgttcaccttcctgcaggtgctgtgcctggccctgctgtggatcctgaagagcaccgtggccgccatcatcttccccgtgatgatcctggccctggtggccgtgagaaagggcatggactacctgttcagccagcacgacctgagcttcctggacgacgtgatccccgagaaggacaagaagaagaaggaggacgagaagaagaagaagaagaagaagggcagcctggacagcgacaacgacgacagcgactgcccctacagcgagaaggtgcccagcatcaagatccccatggacatcatggagcagcagcccttcctgagcgacagcaagcccagcgacagagagagaagccccaccttcctggagagacacaccagctgctag

SEQ ID NO: 100005 - DNA, 3285 bp, Artificial Sequence
  Description of Artificial Sequence: Synthetic coding sequence
atggaggacgaggccgtgctggacagaggcgccagcttcctgaagcacgtgtgcgacgaggaggaggtggagggccaccacaccatctacatcggcgtgcacgtgcccaagagctacagaagaagaagaagacacaagagaaagaccggccacaaggagaagaaggagaaggagagaatcagcgagaactacagcgacaagagcgacatcgagaacgccgacgagagcagcagcagcatcctgaagcccctgatcagccccgccgccgagagaatcagattcatcctgggcgaggaggacgacagccccgcccccccccagctgttcaccgagctggacgagctgctggccgtggacggccaggagatggagtggaaggagaccgccagatggatcaagttcgaggagaaggtggagcagggcggcgagagatggagcaagccccacgtggccaccctgagcctgcacagcctgttcgagctgagaacctgcatggagaagggcagcatcatgctggacagagaggccagcagcctgccccagctggtggagatgatcgtggaccaccagatcgagaccggcctgctgaagcccgagctgaaggacaaggtgacctacaccctgctgagaaagcacagacaccagaccaagaagagcaacctgagaagcctggccgacatcggcaagaccgtgagcagcgccagcagaatgttcaccaaccccgacaacggcagccccgccatgacccacagaaacctgaccagcagcagcctgaacgacatcagcgacaagcccgagaaggaccagctgaagaacaagttcatgaagaagctgcccagagacgccgaggccagcaacgtgctggtgggcgaggtggacttcctggacacccccttcatcgccttcgtgagactgcagcaggccgtgatgctgggcgccctgaccgaggtgcccgtgcccaccagattcctgttcatcctgctgggccccaagggcaaggccaagagctaccacgagatcggcagagccatcgccaccctgatgagcgacgaggtgttccacgacatcgcctacaaggccaaggacagacacgacctgatcgccggcatcgacgagttcctggacgaggtgatcgtgctgccccccggcgagtgggaccccgccatcagaatcgagccccccaagagcctgcccagcagcgacaagagaaagaacatgtacagcggcggcgagaacgtgcagatgaacggcgacaccccccacgacggcggccacggcggcggcggccacggcgactgcgaggagctgcagagaaccggcagattctgcggcggcctgatcaaggacatcaagagaaaggcccccttcttcgccagcgacttctacgacgccctgaacatccaggccctgagcgccatcctgttcatctacctggccaccgtgaccaacgccatcaccttcggcggcctgctgggcgacgccaccgacaacatgcagggcgtgctggagagcttcctgggcaccgccgtgagcggcgccatcttctgcctgttcgccggccagcccctgaccatcctgagcagcaccggccccgtgctggtgttcgagagactgctgttcaacttcagcaaggacaacaacttcgactacctggagttcagactgtggatcggcctgtggagcgccttcctgtgcctgatcctggtggccaccgacgccagcttcctggtgcagtacttcaccagattcaccgaggagggcttcagcagcctgatcagcttcatcttcatctacgacgccttcaagaagatgatcaagctggccgactactaccccatcaacagcaacttcaaggtgggctacaacaccctgttcagctgcacctgcgtgccccccgaccccgccaacatcagcatcagcaacgacaccaccctggcccccgagtacctgcccaccatgagcagcaccgacatgtaccacaacaccaccttcgactgggccttcctgagcaagaaggagtgcagcaagtacggcggcaacctggtgggcaacaactgcaacttcgtgcccgacatcaccctgatgagcttcatcctgttcctgggcacctacaccagcagcatggccctgaagaagttcaagaccagcccctacttccccaccaccgccagaaagctgatcagcgacttcgccatcatcctgagcatcctgatcttctgcgtgatcgacgccctggtgggcgtggacacccccaagctgatcgtgcccagcgagttcaagcccaccagccccaacagaggctggttcgtgccccccttcggcgagaacccctggtgggtgtgcctggccgccgccatccccgccctgctggtgaccatcctgatcttcatggaccagcagatcaccgccgtgatcgtgaacagaaaggagcacaagctgaagaagggcgccggctaccacctggacctgttctgggtggccatcctgatggtgatctgcagcctgatggccctgccctggtacgtggccgccaccgtgatcagcatcgcccacatcgacagcctgaagatggagaccgagaccagcgcccccggcgagcagcccaagttcctgggcgtgagagagcagagagtgaccggcaccctggtgttcatcctgaccggcctgagcgtgttcatggcccccatcctgaagttcatccccatgcccgtgctgtacggcgtgttcctgtacatgggcgtggccagcctgaacggcgtgcagttcatggacagactgaagctgctgctgatgcccctgaagcaccagcccgacttcatctacctgagacacgtgcccctgagaagagtgcacctgttcaccttcctgcaggtgctgtgcctggccctgctgtggatcctgaagagcaccgtggccgccatcatcttccccgtgatgatcctggccctggtggccgtgagaaagggcatggactacctgttcagccagcacgacctgagcttcctggacgacgtgatccccgagaaggacaagaagaagaaggaggacgagaagaagaagaagaagaagaagggcagcctggacagcgacaacgacgacgagaaggaccaccagcacagcctgaacgccacccaccacgccgacaagatccccttcctgcagagcctgggcatgcccagcccccccagaacccccgtgaaggtggtgccccagatcagaatcgagctggagcccgaggacaacgactacttctggagaagcaagggcaccgagaccaccctgtag

SEQ ID NO: 100006 - DNA, 3123 bp, Artificial Sequence
  Description of Artificial Sequence: Synthetic coding sequence
atgaaggtgaaggaggagaaggccggcgtgggcaagctggaccacaccaaccacagaagaagattccccgaccagaaggagtgcccccccatccacatcggcctgcccgtgcccacctacccccagagaaagaccgaccagaagggccacctgagcggcctgcagaaggtgcactggggcctgagacccgaccagccccagcaggagctgaccggccccggcagcggcgccagcagccaggacagcagcatggacctgatcagcagaaccagaagccccgccgccgagcagctgcaggacatcctgggcgaggaggacgaggcccccaaccccaccctgttcaccgagatggacaccctgcagcacgacggcgaccagatggagtggaaggagagcgccagatggatcaagttcgaggagaaggtggaggagggcggcgagagatggagcaagccccacgtgagcaccctgagcctgcacagcctgttcgagctgagaacctgcctgcagaccggcaccgtgctgctggacctggacagcggcagcctgccccagatcatcgacgacgtgatcgagaagcagatcgaggacggcctgctgagacccgagctgagagagagagtgagctacgtgctgctgagaagacacagacaccagaccaagaagcccatccacagaagcctggccgacatcggcaagagcgtgagcaccaccaacagaagccccgccagaagccccggcgccggccccagcctgcaccacagcaccgaggacctgagaatgagacagagcgccaactacggcagactgtgccacgcccagagcagaagcatgaacgacatcagcctgacccccaacaccgaccagagaaagaacaagttcatgaagaagatccccaaggacagcgaggccagcaacgtgctggtgggcgaggtggacttcctggaccagcccttcatcgccttcgtgagactgatccagagcgccatgctgggcggcgtgaccgaggtgcccgtgcccaccagattcctgttcatcctgctgggccccagcggcagagccaagagctacaacgagatcggcagagccatcgccaccctgatggtggacgacctgttcagcgacgtggcctacaaggccagaaacagagaggacctgatcgccggcatcgacgagttcctggacgaggtgatcgtgctgccccccggcgagtgggaccccaacatcagaatcgagccccccaagaaggtgcccagcgccgacaagagaaagagcgtgttcagcctggccgagctgggccagatgaacggcagcgtgggcggcggcggcggcgcccccggcggcggcaacggcggcggcggcggcggcggcagcggcggcggcgccggcagcggcggcgccggcggcaccagcagcggcgacgacggcgagatgcccgccatgcacgagatcggcgaggagctgatctggaccggcagattcttcggcggcctgtgcctggacatcaagagaaagctgccctggttccccagcgacttctacgacggcttccacatccagagcatcagcgccatcctgttcatctacctgggctgcatcaccaacgccatcaccttcggcggcctgctgggcgacgccaccgacaactaccagggcgtgatggagagcttcctgggcaccgccatggccggcagcctgttctgcctgttcagcggccagcccctgatcatcctgagcagcaccggccccatcctgatcttcgagaagctgctgttcgacttcagcaagggcaacggcctggactacatggagttcagactgtggatcggcctgcacagcgccgtgcagtgcctgatcctggtggccaccgacgccagcttcatcatcaagtacatcaccagattcaccgaggagggcttcagcaccctgatcagcttcatcttcatctacgacgccatcaagaagatgatcggcgccttcaagtactaccccatcaacatggacttcaagcccaacttcatcaccacctacaagtgcgagtgcgtggcccccgacaccgtgaacaccaccgtgttcaacgccagcgcccccctggcccccgacaccaacgccagcctgtacaacctgctgaacctgaccgccctggactggagcctgctgagcaagaaggagtgcctgagctacggcggcagactgctgggcaacagctgcaagttcatccccgacctggccctgatgagcttcatcctgttcttcggcacctacagcatgaccctgaccctgaagaagttcaagttcagcagatacttccccaccaaggtgagagccctggtggccgacttcagcatcgtgttcagcatcctgatgttctgcggcatcgacgcctgcttcggcctggagacccccaagctgcacgtgcccagcgtgatcaagcccaccagacccgacagaggctggttcgtggcccccttcggcaagaacccctggtgggtgtaccccgccagcatcctgcccgccctgctggtgaccatcctgatcttcatggaccagcagatcaccgccgtgatcgtgaacagaaaggagaacaagctgaagaaggccgccggctaccacctggacctgttctgggtgggcatcctgatggccctgtgcagcttcatgggcctgccctggtacgtggccgccaccgtgatcagcatcgcccacatcgacagcctgaagatggagaccgagaccagcgcccccggcgagcagccccagttcctgggcgtgagagagcagagagtgaccggcatcatcgtgttcatcctgaccggcatcagcgtgttcctggcccccatcctgaagatcctgggcctgatcatcgtgagaagactgctggacttcatcttcagccagcacgacctggcctggatcgacaacatcctgcccgagaaggagaagaaggagaccgacaagaagagaaagagaaagaagggcgcccacgaggactgcgacgaggagccccagttccccccccccagcgtgatcaagatccccatggagagcgtgcagagcgacccccagaacggcatccactgcatcgccagaaagagaagcagcagctggagctacagcctgtag

SEQ ID NO: 100007 - DNA, 3414 bp, Artificial Sequence
  Description of Artificial Sequence: Synthetic coding sequence
atgaaggtgaaggaggagaaggccggcgtgggcaagctggaccacaccaaccacagaagaagattccccgaccagaaggagtgcccccccatccacatcggcctgcccgtgcccacctacccccagagaaagaccgaccagaagggccacctgagcggcctgcagaaggtgcactggggcctgagacccgaccagccccagcaggagctgaccggccccggcagcggcgccagcagccaggacagcagcatggacctgatcagcagaaccagaagccccgccgccgagcagctgcaggacatcctgggcgaggaggacgaggcccccaaccccaccctgttcaccgagatggacaccctgcagcacgacggcgaccagatggagtggaaggagagcgccagatggatcaagttcgaggagaaggtggaggagggcggcgagagatggagcaagccccacgtgagcaccctgagcctgcacagcctgttcgagctgagaacctgcctgcagaccggcaccgtgctgctggacctggacagcggcagcctgccccagatcatcgacgacgtgatcgagaagcagatcgaggacggcctgctgagacccgagctgagagagagagtgagctacgtgctgctgagaagacacagacaccagaccaagaagcccatccacagaagcctggccgacatcggcaagagcgtgagcaccaccaacagaagccccgccagaagccccggcgccggccccagcctgcaccacagcaccgaggacctgagaatgagacagagcgccaactacggcagactgtgccacgcccagagcagaagcatgaacgacatcagcctgacccccaacaccgaccagagaaagaacaagttcatgaagaagatccccaaggacagcgaggccagcaacgtgctggtgggcgaggtggacttcctggaccagcccttcatcgccttcgtgagactgatccagagcgccatgctgggcggcgtgaccgaggtgcccgtgcccaccagattcctgttcatcctgctgggccccagcggcagagccaagagctacaacgagatcggcagagccatcgccaccctgatggtggacgacctgttcagcgacgtggcctacaaggccagaaacagagaggacctgatcgccggcatcgacgagttcctggacgaggtgatcgtgctgccccccggcgagtgggaccccaacatcagaatcgagccccccaagaaggtgcccagcgccgacaagagaaagagcgtgttcagcctggccgagctgggccagatgaacggcagcgtgggcggcggcggcggcgcccccggcggcggcaacggcggcggcggcggcggcggcagcggcggcggcgccggcagcggcggcgccggcggcaccagcagcggcgacgacggcgagatgcccgccatgcacgagatcggcgaggagctgatctggaccggcagattcttcggcggcctgtgcctggacatcaagagaaagctgccctggttccccagcgacttctacgacggcttccacatccagagcatcagcgccatcctgttcatctacctgggctgcatcaccaacgccatcaccttcggcggcctgctgggcgacgccaccgacaactaccagggcgtgatggagagcttcctgggcaccgccatggccggcagcctgttctgcctgttcagcggccagcccctgatcatcctgagcagcaccggccccatcctgatcttcgagaagctgctgttcgacttcagcaagggcaacggcctggactacatggagttcagactgtggatcggcctgcacagcgccgtgcagtgcctgatcctggtggccaccgacgccagcttcatcatcaagtacatcaccagattcaccgaggagggcttcagcaccctgatcagcttcatcttcatctacgacgccatcaagaagatgatcggcgccttcaagtactaccccatcaacatggacttcaagcccaacttcatcaccacctacaagtgcgagtgcgtggcccccgacaccgtgaacaccaccgtgttcaacgccagcgcccccctggcccccgacaccaacgccagcctgtacaacctgctgaacctgaccgccctggactggagcctgctgagcaagaaggagtgcctgagctacggcggcagactgctgggcaacagctgcaagttcatccccgacctggccctgatgagcttcatcctgttcttcggcacctacagcatgaccctgaccctgaagaagttcaagttcagcagatacttccccaccaaggtgagagccctggtggccgacttcagcatcgtgttcagcatcctgatgttctgcggcatcgacgcctgcttcggcctggagacccccaagctgcacgtgcccagcgtgatcaagcccaccagacccgacagaggctggttcgtggcccccttcggcaagaacccctggtgggtgtaccccgccagcatcctgcccgccctgctggtgaccatcctgatcttcatggaccagcagatcaccgccgtgatcgtgaacagaaaggagaacaagctgaagaaggccgccggctaccacctggacctgttctgggtgggcatcctgatggccctgtgcagcttcatgggcctgccctggtacgtggccgccaccgtgatcagcatcgcccacatcgacagcctgaagatggagaccgagaccagcgcccccggcgagcagccccagttcctgggcgtgagagagcagagagtgaccggcatcatcgtgttcatcctgaccggcatcagcgtgttcctggcccccatcctgaagtgcatccccctgcccgtgctgtacggcgtgttcctgtacatgggcgtggccagcctgaacggcatccagatgggcaccggcggcagcgagttcaagatccagaagaagctgacccccttctgggagagatgcaagctgttcctgatgcccgccaagcaccagcccgaccacgccttcctgagacacgtgcccctgagaagaatccacctgttcaccctggtgcagatcctgtgcctggccgtgctgtggatcctgaagagcaccgtggccgccatcatcttccccgtgatgatcctgggcctgatcatcgtgagaagactgctggacttcatcttcagccagcacgacctggcctggatcgacaacatcctgcccgagaaggagaagaaggagaccgacaagaagagaaagagaaagaagggcgcccacgaggactgcgacgaggagccccagttccccccccccagcgtgatcaagatccccatggagagcgtgcagagcgacccccagaacggcatccactgcatcgccagaaagagaagcagcagctggagctacagcctgtag

SEQ ID NO: 100008 - DNA, 3060 bp, Artificial Sequence
  Description of Artificial Sequence: Synthetic coding sequence
atgaaggtgaaggaggagaaggccggcgtgggcaagctggaccacaccaaccacagaagaagattccccgaccagaagggcagccccgccgccgagcagctgcaggacatcctgggcgaggaggacgaggcccccaaccccaccctgttcaccgagatggacaccctgcagcacgacggcgaccagatggagtggaaggagagcgccagatggatcaagttcgaggagaaggtggaggagggcggcgagagatggagcaagccccacgtgagcaccctgagcctgcacagcctgttcgagctgagaacctgcctgcagaccggcaccgtgctgctggacctggacagcggcagcctgccccagatcatcgacgacgtgatcgagaagcagatcgaggacggcctgctgagacccgagctgagagagagagtgagctacgtgctgctgagaagacacagacaccagaccaagaagcccatccacagaagcctggccgacatcggcaagagcgtgagcaccaccaacagaagccccgccagaagccccggcgccggccccagcctgcaccacagcaccgaggacctgagaatgagacagagcgccaactacggcagactgtgccacgcccagagcagaagcatgaacgacatcagcctgacccccaacaccgaccagagaaagaacaagttcatgaagaagatccccaaggacagcgaggccagcaacgtgctggtgggcgaggtggacttcctggaccagcccttcatcgccttcgtgagactgatccagagcgccatgctgggcggcgtgaccgaggtgcccgtgcccaccagattcctgttcatcctgctgggccccagcggcagagccaagagctacaacgagatcggcagagccatcgccaccctgatggtggacgacctgttcagcgacgtggcctacaaggccagaaacagagaggacctgatcgccggcatcgacgagttcctggacgaggtgatcgtgctgccccccggcgagtgggaccccaacatcagaatcgagccccccaagaaggtgcccagcgccgacaagagaaagagcgtgttcagcctggccgagctgggccagatgaacggcagcgtgggcggcggcggcggcgcccccggcggcggcaacggcggcggcggcggcggcggcagcggcggcggcgccggcagcggcggcgccggcggcaccagcagcggcgacgacggcgagatgcccgccatgcacgagatcggcgaggagctgatctggaccggcagattcttcggcggcctgtgcctggacatcaagagaaagctgccctggttccccagcgacttctacgacggcttccacatccagagcatcagcgccatcctgttcatctacctgggctgcatcaccaacgccatcaccttcggcggcctgctgggcgacgccaccgacaactaccagggcgtgatggagagcttcctgggcaccgccatggccggcagcctgttctgcctgttcagcggccagcccctgatcatcctgagcagcaccggccccatcctgatcttcgagaagctgctgttcgacttcagcaagggcaacggcctggactacatggagttcagactgtggatcggcctgcacagcgccgtgcagtgcctgatcctggtggccaccgacgccagcttcatcatcaagtacatcaccagattcaccgaggagggcttcagcaccctgatcagcttcatcttcatctacgacgccatcaagaagatgatcggcgccttcaagtactaccccatcaacatggacttcaagcccaacttcatcaccacctacaagtgcgagtgcgtggcccccgacaccgtgaacaccaccgtgttcaacgccagcgcccccctggcccccgacaccaacgccagcctgtacaacctgctgaacctgaccgccctggactggagcctgctgagcaagaaggagtgcctgagctacggcggcagactgctgggcaacagctgcaagttcatccccgacctggccctgatgagcttcatcctgttcttcggcacctacagcatgaccctgaccctgaagaagttcaagttcagcagatacttccccaccaagcccaccagacccgacagaggctggttcgtggcccccttcggcaagaacccctggtgggtgtaccccgccagcatcctgcccgccctgctggtgaccatcctgatcttcatggaccagcagatcaccgccgtgatcgtgaacagaaaggagaacaagctgaagaaggccgccggctaccacctggacctgttctgggtgggcatcctgatggccctgtgcagcttcatgggcctgccctggtacgtggccgccaccgtgatcagcatcgcccacatcgacagcctgaagatggagaccgagaccagcgcccccggcgagcagccccagttcctgggcgtgagagagcagagagtgaccggcatcatcgtgttcatcctgaccggcatcagcgtgttcctggcccccatcctgaagtgcatccccctgcccgtgctgtacggcgtgttcctgtacatgggcgtggccagcctgaacggcatccagttctgggagagatgcaagctgttcctgatgcccgccaagcaccagcccgaccacgccttcctgagacacgtgcccctgagaagaatccacctgttcaccctggtgcagatcctgtgcctggccgtgctgtggatcctgaagagcaccgtggccgccatcatcttccccgtgatgatcctgggcctgatcatcgtgagaagactgctggacttcatcttcagccagcacgacctggcctggatcgacaacatcctgcccgagaaggagaagaaggagaccgacaagaagagaaagagaaagaagggcgcccacgaggactgcgacgaggagccccagttccccccccccagcgtgatcaagatccccatggagagcgtgcagagcgacccccagaacggcatccactgcatcgccagaaagagaagcagcagctggagctacagcctgtag

SEQ ID NO: 100009 - DNA, 3060 bp, Artificial Sequence; identical to SEQ ID NO: 100008
  Description of Artificial Sequence: Synthetic coding sequence

SEQ ID NO: 100010 - DNA, 3123 bp, Artificial Sequence; identical to SEQ ID NO: 100006
  Description of Artificial Sequence: Synthetic coding sequence

SEQ ID NO: 100011 - DNA, 3414 bp, Artificial Sequence; identical to SEQ ID NO: 100007
  Description of Artificial Sequence: Synthetic coding sequence

SEQ ID NO: 100012 - DNA, 3366 bp, Artificial Sequence
  Description of Artificial Sequence: Synthetic coding sequence
atgaaggtgaaggaggagaaggccggcgtgggcaagctggaccacaccaaccacagaagaagattccccgaccagaaggagtgcccccccatccacatcggcctgcccgtgcccacctacccccagagaaagaccgaccagaagggccacctgagcggcctgcagaaggtgcactggggcctgagacccgaccagccccagcaggagctgaccggccccggcagcggcgccagcagccaggacagcagcatggacctgatcagcagaaccagaagccccgccgccgagcagctgcaggacatcctgggcgaggaggacgaggcccccaaccccaccctgttcaccgagatggacaccctgcagcacgacggcgaccagatggagtggaaggagagcgccagatggatcaagttcgaggagaaggtggaggagggcggcgagagatggagcaagccccacgtgagcaccctgagcctgcacagcctgttcgagctgagaacctgcctgcagaccggcaccgtgctgctggacctggacagcggcagcctgccccagatcatcgacgacgtgatcgagaagcagatcgaggacggcctgctgagacccgagctgagagagagagtgagctacgtgctgctgagaagacacagacaccagaccaagaagcccatccacagaagcctggccgacatcggcaagagcgtgagcaccaccaacagaagccccgccagaagccccggcgccggccccagcctgcaccacagcaccgaggacctgagaatgagacagagcgccaactacggcagactgtgccacgcccagagcagaagcatgaacgacatcagcctgacccccaacaccgaccagagaaagaacaagttcatgaagaagatccccaaggacagcgaggccagcaacgtgctggtgggcgaggtggacttcctggaccagcccttcatcgccttcgtgagactgatccagagcgccatgctgggcggcgtgaccgaggtgcccgtgcccaccagattcctgttcatcctgctgggccccagcggcagagccaagagctacaacgagatcggcagagccatcgccaccctgatggtggacgacctgttcagcgacgtggcctacaaggccagaaacagagaggacctgatcgccggcatcgacgagttcctggacgaggtgatcgtgctgccccccggcgagtgggaccccaacatcagaatcgagccccccaagaaggtgcccagcgccgacaagagaaagagcgtgttcagcctggccgagctgggccagatgaacggcagcgtgggcggcggcggcggcgcccccggcggcggcaacggcggcggcggcggcggcggcagcggcggcggcgccggcagcggcggcgccggcggcaccagcagcggcgacgacggcgagatgcccgccatgcacgagatcggcgaggagctgatctggaccggcagattcttcggcggcctgtgcctggacatcaagagaaagctgccctggttccccagcgacttctacgacggcttccacatccagagcatcagcgccatcctgttcatctacctgggctgcatcaccaacgccatcaccttcggcggcctgctgggcgacgccaccgacaactaccagggcgtgatggagagcttcctgggcaccgccatggccggcagcctgttctgcctgttcagcggccagcccctgatcatcctgagcagcaccggccccatcctgatcttcgagaagctgctgttcgacttcagcaagggcaacggcctggactacatggagttcagactgtggatcggcctgcacagcgccgtgcagtgcctgatcctggtggccaccgacgccagcttcatcatcaagtacatcaccagattcaccgaggagggcttcagcaccctgatcagcttcatcttcatctacgacgccatcaagaagatgatcggcgccttcaagtactaccccatcaacatggacttcaagcccaacttcatcaccacctacaagtgcgagtgcgtggcccccgacaccgtgaacaccaccgtgttcaacgccagcgcccccctggcccccgacaccaacgccagcctgtacaacctgctgaacctgaccgccctggactggagcctgctgagcaagaaggagtgcctgagctacggcggcagactgctgggcaacagctgcaagttcatccccgacctggccctgatgagcttcatcctgttcttcggcacctacagcatgaccctgaccctgaagaagttcaagttcagcagatacttccccaccaaggtgagagccctggtggccgacttcagcatcgtgttcagcatcctgatgttctgcggcatcgacgcctgcttcggcctggagacccccaagctgcacgtgcccagcgtgatcaagcccaccagacccgacagaggctggttcgtggcccccttcggcaagaacccctggtgggtgtaccccgccagcatcctgcccgccctgctggtgaccatcctgatcttcatggaccagcagatcaccgccgtgatcgtgaacagaaaggagaacaagctgaagaaggccgccggctaccacctggacctgttctgggtgggcatcctgatggccctgtgcagcttcatgggcctgccctggtacgtggccgccaccgtgatcagcatcgcccacatcgacagcctgaagatggagaccgagaccagcgcccccggcgagcagccccagttcctgggcgtgagagagcagagagtgaccggcatcatcgtgttcatcctgaccggcatcagcgtgttcctggcccccatcctgaagtgcatccccctgcccgtgctgtacggcgtgttcctgtacatgggcgtggccagcctgaacggcatccagttctgggagagatgcaagctgttcctgatgcccgccaagcaccagcccgaccacgccttcctgagacacgtgcccctgagaagaatccacctgttcaccctggtgcagatcctgtgcctggccgtgctgtggatcctgaagagcaccgtggccgccatcatcttccccgtgatgatcctgggcctgatcatcgtgagaagactgctggacttcatcttcagccagcacgacctggcctggatcgacaacatcctgcccgagaaggagaagaaggagaccgacaagaagagaaagagaaagaagggcgcccacgaggactgcgacgaggagccccagttccccccccccagcgtgatcaagatccccatggagagcgtgcagagcgacccccagaacggcatccactgcatcgccagaaagagaagcagcagctggagctacagcctgtag

SEQ ID NO: 100013 - DNA, 2982 bp, Artificial Sequence
  Description of Artificial Sequence: Synthetic coding sequence
atgaaggtgaaggaggagaaggccggcgtgggcaagctggaccacaccaaccacagaagaagattccccgaccagaaggagtgcccccccatccacatcggcctgcccgtgcccacctacccccagagaaagaccgaccagaagggccacctgagcggcctgcagaaggtgcactggggcctgagacccgaccagccccagcaggagctgaccggccccggcagcggcgccagcagccaggacagcagcatggacctgatcagcagaaccagaagccccgccgccgagcagctgcaggacatcctgggcgaggaggacgaggcccccaaccccaccctgttcaccgagatggacaccctgcagcacgacggcgaccagatggagtggaaggagagcgccagatggatcaagttcgaggagaaggtggaggagggcggcgagagatggagcaagccccacgtgagcaccctgagcctgcacagcctgttcgagctgagaacctgcctgcagaccggcaccgtgctgctggacctggacagcggcagcctgccccagatcatcgacgacgtgatcgagaagcagatcgaggacggcctgctgagacccgagctgagagagagagtgagctacgtgctgctgagaagacacagacaccagaccaagaagcccatccacagaagcctggccgacatcggcaagagcgtgagcaccaccaacagaagccccgccagaagccccggcgccggccccagcctgcaccacagcaccgaggacctgagaatgagacagagcgccaactacggcagactgtgccacgcccagagcagaagcatgaacgacatcagcctgacccccaacaccgaccagagaaagaacaagttcatgaagaagatccccaaggacagcgaggccagcaacgtgctggtgggcgaggtggacttcctggaccagcccttcatcgccttcgtgagactgatccagagcgccatgctgggcggcgtgaccgaggtgcccgtgcccaccagattcctgttcatcctgctgggccccagcggcagagccaagagctacaacgagatcggcagagccatcgccaccctgatggtggacgacctgttcagcgacgtggcctacaaggccagaaacagagaggacctgatcgccggcatcgacgagttcctggacgaggtgatcgtgctgccccccggcgagtgggaccccaacatcagaatcgagccccccaagaaggtgcccagcgccgacaagagaaagagcgtgttcagcctggccgagctgggccagatgaacggcagcgtgggcggcggcggcggcgcccccggcggcggcaacggcggcggcggcggcggcggcagcggcggcggcgccggcagcggcggcgccggcggcaccagcagcggcgacgacggcgagatgcccgccatgcacgagatcggcgaggagctgatctggaccggcagattcttcggcggcctgtgcctggacatcaagagaaagctgccctggttccccagcgacttctacgacggcttccacatccagagcatcagcgccatcctgttcatctacctgggctgcatcaccaacgccatcaccttcggcggcctgctgggcgacgccaccgacaactaccagggcgtgatggagagcttcctgggcaccgccatggccggcagcctgttctgcctgttcagcggccagcccctgatcatcctgagcagcaccggccccatcctgatcttcgagaagctgctgttcgacttcagcaagggcaacggcctggactacatggagttcagactgtggatcggcctgcacagcgccgtgcagtgcctgatcctggtggccaccgacgccagcttcatcatcaagtacatcaccagattcaccgaggagggcttcagcaccctgatcagcttcatcttcatctacgacgccatcaagaagatgatcggcgccttcaagtactaccccatcaacatggacttcaagcccaacttcatcaccacctacaagtgcgagtgcgtggcccccgacaccgtgaacaccaccgtgttcaacgccagcgcccccctggcccccgacaccaacgccagcctgtacaacctgctgaacctgaccgccctggactggagcctgctgagcaagaaggagtgcctgagctacggcggcagactgctgggcaacagctgcaagttcatccccgacctggccctgatgagcttcatcctgttcttcggcacctacagcatgaccctgaccctgaagaagttcaagttcagcagatacttccccaccaaggtgagagccctggtggccgacttcagcatcgtgttcagcatcctgatgttctgcggcatcgacgcctgcttcggcctggagacccccaagctgcacgtgcccagcgtgatcaagcccaccagacccgacagaggctggttcgtggcccccttcggcaagaacccctggtgggtgtaccccgccagcatcctgcccgccctgctggtgaccatcctgatcttcatggaccagcagatcaccgccgtgatcgtgaacagaaaggagaacaagctgaagggcaccgagagcaacagacaccacagactgcaccccgacggcaacctgtgcctgcccggcagccaccccaaggtgtacccccccgccggcgccgtgagaagcctgcccctgcacggcagaggcctgcccgagtggcaccccgtgctgggcaccctgcaggccctgcccgacgccagccaggcccccgccggcccctgcctgcccgccgccagagccgccgcccccgacccccccctgcaccccggcgccgaccccctgcccggcggcgccctggacccccagatccacggcggctgccaccacctgcccggccacgaccccggcccccaccacagaagcaaggccagcggcttccacctgttccccgccagacccggcctggactag

SEQ ID NO: 100014 - DNA, 2895 bp, Artificial Sequence
  Description of Artificial Sequence: Synthetic coding sequence
atgaaggtgaaggaggagaaggccggcgtgggcaagctggaccacaccaaccacagaagaagattccccgaccagaaggagtgcccccccatccacatcggcctgcccgtgcccacctacccccagagaaagaccgaccagaagggccacctgagcggcctgcagaaggtgcactggggcctgagacccgaccagccccagcaggagctgaccggccccggcagcggcgccagcagccaggacagcagcatggacctgatcagcagaaccagaagccccgccgccgagcagctgcaggacatcctgggcgaggaggacgaggcccccaaccccaccctgttcaccgagatggacaccctgcagcacgacggcgaccagatggagtggaaggagagcgccagatggatcaagttcgaggagaaggtggaggagggcggcgagagatggagcaagccccacgtgagcaccctgagcctgcacagcctgttcgagctgagaacctgcctgcagaccggcaccgtgctgctggacctggacagcggcagcctgccccagatcatcgacgacgtgatcgagaagcagatcgaggacggcctgctgagacccgagctgagagagagagtgagctacgtgctgctgagaagacacagacaccagaccaagaagcccatccacagaagcctggccgacatcggcaagagcgtgagcaccaccaacagaagccccgccagaagccccggcgccggccccagcctgcaccacagcaccgaggacctgagaatgagacagagcgccaactacggcagactgtgccacgcccagagcagaagcatgaacgacatcagcctgacccccaacaccgaccagagaaagaacaagttcatgaagaagatccccaaggacagcgaggccagcaacgtgctggtgggcgaggtggacttcctggaccagcccttcatcgccttcgtgagactgatccagagcgccatgctgggcggcgtgaccgaggtgcccgtgcccaccagattcctgttcatcctgctgggccccagcggcagagccaagagctacaacgagatcggcagagccatcgccaccctgatggtggacgacctgttcagcgacgtggcctacaaggccagaaacagagaggacctgatcgccggcatcgacgagttcctggacgaggtgatcgtgctgccccccggcgagtgggaccccaacatcagaatcgagccccccaagaaggtgcccagcgccgacaagagaaagagcgtgttcagcctggccgagctgggccagatgaacggcagcgtgggcggcggcggcggcgcccccggcggcggcaacggcggcggcggcggcggcggcagcggcggcggcgccggcagcggcggcgccggcggcaccagcagcggcgacgacggcgagatgcccgccatgcacgagatcggcgaggagctgatctggaccggcagattcttcggcggcctgtgcctggacatcaagagaaagctgccctggttccccagcgacttctacgacggcttccacatccagagcatcagcgccatcctgttcatctacctgggctgcatcaccaacgccatcaccttcggcggcctgctgggcgacgccaccgacaactaccagggcgtgatggagagcttcctgggcaccgccatggccggcagcctgttctgcctgttcagcggccagcccctgatcatcctgagcagcaccggccccatcctgatcttcgagaagctgctgttcgacttcagcaagggcaacggcctggactacatggagttcagactgtggatcggcctgcacagcgccgtgcagtgcctgatcctggtggccaccgacgccagcttcatcatcaagtacatcaccagattcaccgaggagggcttcagcaccctgatcagcttcatcttcatctacgacgccatcaagaagatgatcggcgccttcaagtactaccccatcaacatggacttcaagcccaacttcatcaccacctacaagtgcgagtgcgtggcccccgacaccgtgaacaccaccgtgttcaacgccagcgcccccctggcccccgacaccaacgccagcctgtacaacctgctgaacctgaccgccctggactggagcctgctgagcaagaaggagtgcctgagctacggcggcagactgctgggcaacagctgcaagttcatccccgacctggccctgatgagcttcatcctgttcttcggcacctacagcatgaccctgaccctgaagaagttcaagttcagcagatacttccccaccaagcccaccagacccgacagaggctggttcgtggcccccttcggcaagaacccctggtgggtgtaccccgccagcatcctgcccgccctgctggtgaccatcctgatcttcatggaccagcagatcaccgccgtgatcgtgaacagaaaggagaacaagctgaagggcaccgagagcaacagacaccacagactgcaccccgacggcaacctgtgcctgcccggcagccaccccaaggtgtacccccccgccggcgccgtgagaagcctgcccctgcacggcagaggcctgcccgagtggcaccccgtgctgggcaccctgcaggccctgcccgacgccagccaggcccccgccggcccctgcctgcccgccgccagagccgccgcccccgacccccccctgcaccccggcgccgaccccctgcccggcggcgccctggacccccagatccacggcggctgccaccacctgcccggccacgtgagcctgcaccacagaagctgggccagcagcagcttcgagggcttctggatcagcagcttccccagcaccacctggcccggcctgaccaccagctag

SEQ ID NO: 100015 - DNA, 390 bp, Artificial Sequence
  Description of Artificial Sequence: Synthetic coding sequence
atgaaggtgaaggaggagaaggccggcgtgggcaagctggaccacaccaaccacagaagaagattccccgaccagaaggagtgcccccccatccacatcggcctgcccgtgcccacctacccccagagaaagaccgaccagaagggccacctgagcggcctgcagaaggtgcactggggcctgagacccgaccagccccagcaggagctgaccggccccggcagcggcgccagcagccaggacagcagcatggacctgatcagcagaaccagaagccccgccgccgagcagctgcaggacatcctgggcgaggaggacgaggcccccaaccccaccctgttcaccgagatggacaccctgcagcacgacggcgaccagatggagtggtag

SEQ ID NO: 100016 - DNA, 438 bp, Artificial Sequence
  Description of Artificial Sequence: Synthetic coding sequence
atgaaggtgaaggaggagaaggccggcgtgggcaagctggaccacaccaaccacagaagaagattccccgaccagaaggagtgcccccccatccacatcggcctgcccgtgcccacctacccccagagaaagaccgaccagaagggccacctgagcggcctgcagaaggtgcactggggcctgagacccgaccagccccagcaggagctgaccggccccggcagcggcgccagcagccaggacagcagcatggacctgatcagcagaaccagaagccccgccgccgagcagctgcaggacatcctgggcgaggaggacgaggcccccaaccccaccctgttcaccgagatggacaccctgcagcacgacggcgaccagatggagtggaaggagagcgccagatggatcaagttcgaggagaaggtggaggagggctag

SEQ ID NO: 100017 - DNA, 3429 bp, Artificial Sequence
  Description of Artificial Sequence: Synthetic coding sequence
atgaaggtgaaggaggagaaggccggcgtgggcaagctggaccacaccaaccacagaagaagattccccgaccagaaggagtgcccccccatccacatcggcctgcccgtgcccacctacccccagagaaagaccgaccagaagggccacctgagcggcctgcagaaggtgcactggggcctgagacccgaccagccccagcaggagctgaccggccccggcagcggcgccagcagccaggacagcagcatggacctgatcagcagaaccagaagccccgccgccgagcagctgcaggacatcctgggcgaggaggacgaggcccccaaccccaccctgttcaccgagatggacaccctgcagcacgacggcgaccagatggagtggaaggagagcgccagatggatcaagttcgaggagaaggtggaggagggcggcgagagatggagcaagccccacgtgagcaccctgagcctgcacagcctgttcgagctgagaacctgcctgcagaccggcaccgtgctgctggacctggacagcggcagcctgccccagatcatcgacgacgtgatcgagaagcagatcgaggacggcctgctgagacccgagctgagagagagagtgagctacgtgctgctgagaagacacagacaccagaccaagaagcccatccacagaagcctggccgacatcggcaagagcgtgagcaccaccaacagaagccccgccagaagccccggcgccggccccagcctgcaccacagcaccgaggacctgagaatgagacagagcgccaactacggcagactgtgccacgcccagagcagaagcatgaacgacatcagcctgacccccaacaccgaccagagaaagaacaagttcatgaagaagatccccaaggacagcgaggccagcaacgtgctggtgggcgaggtggacttcctggaccagcccttcatcgccttcgtgagactgatccagagcgccatgctgggcggcgtgaccgaggtgcccgtgcccaccagattcctgttcatcctgctgggccccagcggcagagccaagagctacaacgagatcggcagagccatcgccaccctgatggtggacgacctgttcagcgacgtggcctacaaggccagaaacagagaggacctgatcgccggcatcgacgagttcctggacgaggtgatcgtgctgccccccggcgagtgggaccccaacatcagaatcgagccccccaagaaggtgcccagcgccgacaagagaaagagcgtgttcagcctggccgagctgggccagatgaacggcagcgtgggcggcggcggcggcgcccccggcggcggcaacggcggcggcggcggcggcggcagcggcggcggcgccggcagcggcggcgccggcggcaccagcagcggcgacgacggcgagatgcccgccatgcacgagatcggcgaggagctgatctggaccggcagattcttcggcggcctgtgcctggacatcaagagaaagctgccctggttccccagcgacttctacgacggcttccacatccagagcatcagcgccatcctgttcatctacctgggctgcatcaccaacgccatcaccttcggcggcctgctgggcgacgccaccgacaactaccagggcgtgatggagagcttcctgggcaccgccatggccggcagcctgttctgcctgttcagcggccagcccctgatcatcctgagcagcaccggccccatcctgatcttcgagaagctgctgttcgacttcagcaagggcaacggcctggactacatggagttcagactgtggatcggcctgcacagcgccgtgcagtgcctgatcctggtggccaccgacgccagcttcatcatcaagtacatcaccagattcaccgaggagggcttcagcaccctgatcagcttcatcttcatctacgacgccatcaagaagatgatcggcgccttcaagtactaccccatcaacatggacttcaagcccaacttcatcaccacctacaagtgcgagtgcgtggcccccgacaccgtgaacaccaccgtgttcaacgccagcgcccccctggcccccgacaccaacgccagcctgtacaacctgctgaacctgaccgccctggactggagcctgctgagcaagaaggagtgcctgagctacggcggcagactgctgggcaacagctgcaagttcatccccgacctggccctgatgagcttcatcctgttcttcggcacctacagcatgaccctgaccctgaagaagttcaagttcagcagatacttccccaccaaggtgagagccctggtggccgacttcagcatcgtgttcagcatcctgatgttctgcggcatcgacgcctgcttcggcctggagacccccaagctgcacgtgcccagcgtgatcaagcccaccagacccgacagaggctggttcgtggcccccttcggcaagaacccctggtgggtgtaccccgccagcatcctgcccgccctgctggtgaccatcctgatcttcatggaccagcagatcaccgccgtgatcgtgaacagaaaggagaacaagctgaagaaggccgccggctaccacctggacctgttctgggtgggcatcctgatggccctgtgcagcttcatgggcctgccctggtacgtggccgccaccgtgatcagcatcgcccacatcgacagcctgaagatggagaccgagaccagcgcccccggcgagcagccccagttcctgggcgtgagagagcagagagtgaccggcatcatcgtgttcatcctgaccggcatcagcgtgttcctggcccccatcctgaagtgcatccccctgcccgtgctgtacggcgtgttcctgtacatgggcgtggccagcctgaacggcatccagatgggcaccggcggcagcgagttcaagatccagaagaagctgacccccttctgggagagatgcaagctgttcctgatgcccgccaagcaccagcccgaccacgccttcctgagacacgtgcccctgagaagaatccacctgttcaccctggtgcagatcctgtgcctggccgtgctgtggatcctgaagagcaccgtggccgccatcatcttccccgtgatgagcctgagcaccaccgacctgggcctgatcatcgtgagaagactgctggacttcatcttcagccagcacgacctggcctggatcgacaacatcctgcccgagaaggagaagaaggagaccgacaagaagagaaagagaaagaagggcgcccacgaggactgcgacgaggagccccagttccccccccccagcgtgatcaagatccccatggagagcgtgcagagcgacccccagaacggcatccactgcatcgccagaaagagaagcagcagctggagctacagcctgtag

SEQ ID NO: 100018 - DNA, 3645 bp, Artificial Sequence
  Description of Artificial Sequence: Synthetic coding sequence
atggagagattcagactggagaagaagctgcccggccccgacgaggaggccgtggtggacctgggcaagaccagcagcaccgtgaacaccaagttcgagaaggaggagctggagagccacagagccgtgtacatcggcgtgcacgtgcccttcagcaaggagagcagaagaagacacagacacagaggccacaagcaccaccacagaagaagaaaggacaaggagagcgacaaggaggacggcagagagagccccagctacgacacccccagccagagagtgcagttcatcctgggcaccgaggacgacgacgaggagcacatcccccacgacctgttcaccgagatggacgagctgtgctacagagacggcgaggagtacgagtggaaggagaccgccagatggctgaagttcgaggaggacgtggaggacggcggcgacagatggagcaagccctacgtggccaccctgagcctgcacagcctgttcgagctgagaagctgcatcctgaacggcaccgtgatgctggacatgagagccagcaccctggacgagatcgccgacatggtgctggacaacatgatcgccagcggccagctggacgagagcatcagagagaacgtgagagaggccctgctgaagagacaccaccaccagaacgagaagagattcaccagcagaatccccctggtgagaagcttcgccgacatcggcaagaagcacagcgacccccacctgctggagagaaacggcgagggcctgagcgccagcagacacagcctgagaaccggcctgagcgccagcaacctgagcctgagaggcgagagccccctgagcctgctgctgggccacctgctgcccagcagcagagccggcacccccgccggcagcagatgcaccacccccgtgcccaccccccagaacagcccccccagcagccccagcatcagcagactgaccagcagaagcagccaggagagccagagacaggcccccgagctgctggtgagccccgccagcgacgacatccccaccgtggtgatccacccccccgaggaggacctggaggccgccctgaagggcgaggagcagaagaacgaggagaacgtggacctgacccccggcatcctggccagcccccagagcgcccccggcaacctggacaacagcaagagcggcgagatcaagggcaacggcagcggcggcagcagagagaacagcaccgtggacttcagcaaggtggacatgaacttcatgagaaagatccccaccggcgccgaggccagcaacgtgctggtgggcgaggtggacttcctggagagacccatcatcgccttcgtgagactggcccccgccgtgctgctgaccggcctgaccgaggtgcccgtgcccaccagattcctgttcctgctgctgggccccgccggcaaggccccccagtaccacgagatcggcagaagcatcgccaccctgatgaccgacgagatcttccacgacgtggcctacaaggccaaggacagaaacgacctgctgagcggcatcgacgagttcctggaccaggtgaccgtgctgccccccggcgagtgggaccccagcatcagaatcgagccccccaagagcgtgcccagccaggagaagagaaagatccccgtgttccacaacggcagcacccccaccctgggcgagacccccaaggaggccgcccaccacgccggccccgagctgcagagaaccggcagactgttcggcggcctgatcctggacatcaagagaaaggcccccttcttcctgagcgacttcaaggacgccctgagcctgcagtgcctggccagcatcctgttcctgtactgcgcctgcatgagccccgtgatcaccttcggcggcctgctgggcgaggccaccgagggcagaatcagcgccatcgagagcctgttcggcgccagcctgaccggcatcgcctacagcctgttcgccggccagcccctgaccatcctgggcagcaccggccccgtgctggtgttcgagaagatcctgtacaagttctgcagagactaccagctgagctacctgagcctgagaaccagcatcggcctgtggaccagcttcctgtgcatcgtgctggtggccaccgacgccagcagcctggtgtgctacatcaccagattcaccgaggaggccttcgccgccctgatctgcatcatcttcatctacgaggccctggagaagctgttcgacctgggcgagacctacgccttcaacatgcacaacaacctggacaagctgaccagctacagctgcgtgtgcaccgagccccccaaccccagcaacgagaccctggcccagtggaagaaggacaacatcaccgcccacaacatcagctggagaaacctgaccgtgagcgagtgcaagaagctgagaggcgtgttcctgggcagcgcctgcggccaccacggcccctacatccccgacgtgctgttctggtgcgtgatcctgttcttcaccaccttcttcctgagcagcttcctgaagcagttcaagaccaagagatacttccccaccaaggtgagaagcaccatcagcgacttcgccgtgttcctgaccatcgtgatcatggtgaccatcgactacctggtgggcgtgcccagccccaagctgcacgtgcccgagaagttcgagcccacccaccccgagagaggctggatcatcagccccctgggcgacaacccctggtggaccctgctgatcgccgccatccccgccctgctgtgcaccatcctgatcttcatggaccagcagatcaccgccgtgatcatcaacagaaaggagcacaagctgaagaagggcgccggctaccacctggacctgctgatggtgggcgtgatgctgggcgtgtgcagcgtgatgggcctgccctggttcgtggccgccaccgtgctgagcatcagccacgtgaacagcctgaaggtggagagcgagtgcagcgcccccggcgagcagcccaagttcctgggcatcagagagcagagagtgaccggcctgatgatcttcatcctgatgggcctgagcgtgttcatgaccagcgtgctgaagttcatccccatgcccgtgctgtacggcgtgttcctgtacatgggcgtgagcagcctgaagggcatccagctgttcgacagaatcaagctgttcggcatgcccgccaagcaccagcccgacctgatctacctgagatacgtgcccctgtggaaggtgcacatcttcaccgtgatccagctgacctgcctggtgctgctgtgggtgatcaaggtgagcgccgccgccgtggtgttccccatgatggtgctggccctggtgttcgtgagaaagctgatggacctgtgcttcaccaagagagagctgagctggctggacgacctgatgcccgagagcaagaagaagaaggaggacgacaagaagaagaaggagaaggaggaggccgagagaatgctgcaggacgacgacgacaccgtgcacctgcccttcgagggcggcagcctgctgcagatccccgtgaaggccctgaagtacagccccgacaagcccgtgagcgtgaagatcagcttcgaggacgagcccagaaagaagtacgtggacgccgagaccagcctgtag

SEQ ID NO: 100019 - DNA, 2403 bp, Artificial Sequence
  Description of Artificial Sequence: Synthetic coding sequence
atggaggtggtggaggccgagaagatcgtgctgctgaccagcgccagattcctgttcctgctgctgggccccgccggcaaggccccccagtaccacgagatcggcagaagcatcgccaccctgatgaccgacgagatcttccacgacgtggcctacaaggccaaggacagaaacgacctgctgagcggcatcgacgagttcctggaccaggtgaccgtgctgccccccggcgagtgggaccccagcatcagaatcgagccccccaagagcgtgcccagccaggagaagagaaagatccccgtgttccacaacggcagcacccccaccctgggcgagacccccaaggaggccgcccaccacgccggccccgagctgcagagaaccggcagactgttcggcggcctgatcctggacatcaagagaaaggcccccttcttcctgagcgacttcaaggacgccctgagcctgcagtgcctggccagcatcctgttcctgtactgcgcctgcatgagccccgtgatcaccttcggcggcctgctgggcgaggccaccgagggcagaatcagcgccatcgagagcctgttcggcgccagcctgaccggcatcgcctacagcctgttcgccggccagcccctgaccatcctgggcagcaccggccccgtgctggtgttcgagaagatcctgtacaagttctgcagagactaccagctgagctacctgagcctgagaaccagcatcggcctgtggaccagcttcctgtgcatcgtgctggtggccaccgacgccagcagcctggtgtgctacatcaccagattcaccgaggaggccttcgccgccctgatctgcatcatcttcatctacgaggccctggagaagctgttcgacctgggcgagacctacgccttcaacatgcacaacaacctggacaagctgaccagctacagctgcgtgtgcaccgagccccccaaccccagcaacgagaccctggcccagtggaagaaggacaacatcaccgcccacaacatcagctggagaaacctgaccgtgagcgagtgcaagaagctgagaggcgtgttcctgggcagcgcctgcggccaccacggcccctacatccccgacgtgctgttctggtgcgtgatcctgttcttcaccaccttcttcctgagcagcttcctgaagcagttcaagaccaagagatacttccccaccaaggtgagaagcaccatcagcgacttcgccgtgttcctgaccatcgtgatcatggtgaccatcgactacctggtgggcgtgcccagccccaagctgcacgtgcccgagaagttcgagcccacccaccccgagagaggctggatcatcagccccctgggcgacaacccctggtggaccctgctgatcgccgccatccccgccctgctgtgcaccatcctgatcttcatggaccagcagatcaccgccgtgatcatcaacagaaaggagcacaagctgaagaagggcgccggctaccacctggacctgctgatggtgggcgtgatgctgggcgtgtgcagcgtgatgggcctgccctggttcgtggccgccaccgtgctgagcatcagccacgtgaacagcctgaaggtggagagcgagtgcagcgcccccggcgagcagcccaagttcctgggcatcagagagcagagagtgaccggcctgatgatcttcatcctgatgggcctgagcgtgttcatgaccagcgtgctgaagttcatccccatgcccgtgctgtacggcgtgttcctgtacatgggcgtgagcagcctgaagggcatccagctgttcgacagaatcaagctgttcggcatgcccgccaagcaccagcccgacctgatctacctgagatacgtgcccctgtggaaggtgcacatcttcaccgtgatccagctgacctgcctggtgctgctgtgggtgatcaaggtgagcgccgccgccgtggtgttccccatgatggtgctggccctggtgttcgtgagaaagctgatggacctgtgcttcaccaagagagagctgagctggctggacgacctgatgcccgagagcaagaagaagaaggaggacgacaagaagaagaaggagaaggaggaggccgagagaatgctgcaggacgacgacgacaccgtgcacctgcccttcgagggcggcagcctgctgcagatccccgtgaaggccctgaagtacagcgtggaccccagcatcgtgaacatcagcgacgagatggccaagaccgcccagtggaaggccctgagcatgaacaccgagaacgccaaggtgaccagaagcaacatgagccccgacaagcccgtgagcgtgaagatcagcttcgaggacgagcccagaaagaagtacgtggacgccgagaccagcctgtag

SEQ ID NO: 100020 - DNA, 1725 bp, Artificial Sequence
  Description of Artificial Sequence: Synthetic coding sequence
atggaggccgacggcgccggcgagcagatgagacccctgctgaccagaggccccgacgaggaggccgtggtggacctgggcaagaccagcagcaccgtgaacaccaagttcgagaaggaggagctggagagccacagagccgtgtacatcggcgtgcacgtgcccttcagcaaggagagcagaagaagacacagacacagaggccacaagcaccaccacagaagaagaaaggacaaggagagcgacaaggaggacggcagagagagccccagctacgacacccccagccagagagtgcagttcatcctgggcaccgaggacgacgacgaggagcacatcccccacgacctgttcaccgagatggacgagctgtgctacagagacggcgaggagtacgagtggaaggagaccgccagatggctgaagttcgaggaggacgtggaggacggcggcgacagatggagcaagccctacgtggccaccctgagcctgcacagcctgttcgagctgagaagctgcatcctgaacggcaccgtgatgctggacatgagagccagcaccctggacgagatcgccgacatggtgctggacaacatgatcgccagcggccagctggacgagagcatcagagagaacgtgagagaggccctgctgaagagacaccaccaccagaacgagaagagattcaccagcagaatccccctggtgagaagcttcgccgacatcggcgagggcctgagcgccagcagacacagcctgagaaccggcctgagcgccagcaacctgagcctgagaggcgagagccccctgagcctgctgctgggccacctgctgcccagcagcagagccggcacccccgccggcagcagatgcaccacccccgtgcccaccccccagaacagcccccccagcagccccagcatcagcagactgaccagcagaagcagccaggagagccagagacaggcccccgagctgctggtgagccccgccagcgacgacatccccaccgtggtgatccacccccccgaggaggacctggaggccgccctgaagggcgaggagcagaagaacgaggagaacgtggacctgacccccggcatcctggccagcccccagagcgcccccggcaacctggacaacagcaagagcggcgagatcaagggcaacggcagcggcggcagcagagagaacagcaccgtggacttcagcaaggtggacatgaacttcatgagaaagatccccaccggcgccgaggccagcaacgtgctggtgggcgaggtggacttcctggagagacccatcatcgccttcgtgagactggcccccgccgtgctgctgaccggcctgaccgaggtgcccgtgcccaccagattcctgttcctgctgctgggccccgccggcaaggccccccagtaccacgagatcggcagaagcatcgccaccctgatgaccgacgagatcttccacgacgtggcctacaaggccaaggacagaaacgacctgctgagcggcatcgacgagttcctggaccaggtgaccgtgctgccccccggcgagtgggaccccagcatcagaatcgagccccccaagagcgtgcccagccaggagaagagaaagatccccgtgttccacaacggcagcacccccaccctgggcgagacccccaaggaggccgcccaccacgccggccccgagctgcagagaaccggcagagtgcagtag

SEQ ID NO: 100021 - DNA, 3273 bp, Artificial Sequence
  Description of Artificial Sequence: Synthetic coding sequence
atggagagattcagactggagaagaagctgcccggccccgacgaggaggccgtggtggacctgggcaagaccagcagcaccgtgaacaccaagttcgagaaggaggagctggagagccacagagccgtgtacatcggcgtgcacgtgcccttcagcaaggagagcagaagaagacacagacacagaggccacaagcaccaccacagaagaagaaaggacaaggagagcgacaaggaggacggcagagagagccccagctacgacacccccagccagagagtgcagttcatcctgggcaccgaggacgacgacgaggagcacatcccccacgacctgttcaccgagatggacgagctgtgctacagagacggcgaggagtacgagtggaaggagaccgccagatggctgaagttcgaggaggacgtggaggacggcggcgacagatggagcaagccctacgtggccaccctgagcctgcacagcctgttcgagctgagaagctgcatcctgaacggcaccgtgatgctggacatgagagccagcaccctggacgagatcgccgacatggtgctggacaacatgatcgccagcggccagctggacgagagcatcagagagaacgtgagagaggccctgctgaagagacaccaccaccagaacgagaagagattcaccagcagaatccccctggtgagaagcttcgccgacatcggcaagaagcacagcgacccccacctgctggagagaaacggcatcctggccagcccccagagcgcccccggcaacctggacaacagcaagagcggcgagatcaagggcaacggcagcggcggcagcagagagaacagcaccgtggacttcagcaaggtggacatgaacttcatgagaaagatccccaccggcgccgaggccagcaacgtgctggtgggcgaggtggacttcctggagagacccatcatcgccttcgtgagactggcccccgccgtgctgctgaccggcctgaccgaggtgcccgtgcccaccagattcctgttcctgctgctgggccccgccggcaaggccccccagtaccacgagatcggcagaagcatcgccaccctgatgaccgacgagatcttccacgacgtggcctacaaggccaaggacagaaacgacctgctgagcggcatcgacgagttcctggaccaggtgaccgtgctgccccccggcgagtgggaccccagcatcagaatcgagccccccaagagcgtgcccagccaggagaagagaaagatccccgtgttccacaacggcagcacccccaccctgggcgagacccccaaggaggccgcccaccacgccggccccgagctgcagagaaccggcagactgttcggcggcctgatcctggacatcaagagaaaggcccccttcttcctgagcgacttcaaggacgccctgagcctgcagtgcctggccagcatcctgttcctgtactgcgcctgcatgagccccgtgatcaccttcggcggcctgctgggcgaggccaccgagggcagaatcagcgccatcgagagcctgttcggcgccagcctgaccggcatcgcctacagcctgttcgccggccagcccctgaccatcctgggcagcaccggccccgtgctggtgttcgagaagatcctgtacaagttctgcagagactaccagctgagctacctgagcctgagaaccagcatcggcctgtggaccagcttcctgtgcatcgtgctggtggccaccgacgccagcagcctggtgtgctacatcaccagattcaccgaggaggccttcgccgccctgatctgcatcatcttcatctacgaggccctggagaagctgttcgacctgggcgagacctacgccttcaacatgcacaacaacctggacaagctgaccagctacagctgcgtgtgcaccgagccccccaaccccagcaacgagaccctggcccagtggaagaaggacaacatcaccgcccacaacatcagctggagaaacctgaccgtgagcgagtgcaagaagctgagaggcgtgttcctgggcagcgcctgcggccaccacggcccctacatccccgacgtgctgttctggtgcgtgatcctgttcttcaccaccttcttcctgagcagcttcctgaagcagttcaagaccaagagatacttccccaccaaggtgagaagcaccatcagcgacttcgccgtgttcctgaccatcgtgatcatggtgaccatcgactacctggtgggcgtgcccagccccaagctgcacgtgcccgagaagttcgagcccacccaccccgagagaggctggatcatcagccccctgggcgacaacccctggtggaccctgctgatcgccgccatccccgccctgctgtgcaccatcctgatcttcatggaccagcagatcaccgccgtgatcatcaacagaaaggagcacaagctgaagaagggcgccggctaccacctggacctgctgatggtgggcgtgatgctgggcgtgtgcagcgtgatgggcctgccctggttcgtggccgccaccgtgctgagcatcagccacgtgaacagcctgaaggtggagagcgagtgcagcgcccccggcgagcagcccaagttcctgggcatcagagagcagagagtgaccggcctgatgatcttcatcctgatgggcctgagcgtgttcatgaccagcgtgctgaagttcatccccatgcccgtgctgtacggcgtgttcctgtacatgggcgtgagcagcctgaagggcatccagctgttcgacagaatcaagctgttcggcatgcccgccaagcaccagcccgacctgatctacctgagatacgtgcccctgtggaaggtgcacatcttcaccgtgatccagctgacctgcctggtgctgctgtgggtgatcaaggtgagcgccgccgccgtggtgttccccatgatggtgctggccctggtgttcgtgagaaagctgatggacctgtgcttcaccaagagagagctgagctggctggacgacctgatgcccgagagcaagaagaagaaggaggacgacaagaagaagaaggagaaggaggaggccgagagaatgctgcaggacgacgacgacaccgtgcacctgcccttcgagggcggcagcctgctgcagatccccgtgaaggccctgaagtacagccccgacaagcccgtgagcgtgaagatcagcttcgaggacgagcccagaaagaagtacgtggacgccgagaccagcctgtag

SEQ ID NO: 100022 - DNA, 3408 bp, Artificial Sequence
  Description of Artificial Sequence: Synthetic coding sequence
atggaggccgacggcgccggcgagcagatgagacccctgctgaccagagtgaccagcagaggccccgacgaggaggccgtggtggacctgggcaagaccagcagcaccgtgaacaccaagttcgagaaggaggagctggagagccacagagccgtgtacatcggcgtgcacgtgcccttcagcaaggagagcagaagaagacacagacacagaggccacaagcaccaccacagaagaagaaaggacaaggagagcgacaaggaggacggcagagagagccccagctacgacacccccagccagagagtgcagttcatcctgggcaccgaggacgacgacgaggagcacatcccccacgacctgttcaccgagatggacgagctgtgctacagagacggcgaggagtacgagtggaaggagaccgccagatggctgaagttcgaggaggacgtggaggacggcggcgacagatggagcaagccctacgtggccaccctgagcctgcacagcctgttcgagctgagaagctgcatcctgaacggcaccgtgatgctggacatgagagccagcaccctggacgagatcgccgacatggtgctggacaacatgatcgccagcggccagctggacgagagcatcagagagaacgtgagagaggccctgctgaagagacaccaccaccagaacgagaagagattcaccagcagaatccccctggtgagaagcttcgccgacatcggcaagaagcacagcgacccccacctgctggagagaaacggcatcctggccagcccccagagcgcccccggcaacctggacaacagcaagagcggcgagatcaagggcaacggcagcggcggcagcagagagaacagcaccgtggacttcagcaaggtggacatgaacttcatgagaaagatccccaccggcgccgaggccagcaacgtgctggtgggcgaggtggacttcctggagagacccatcatcgccttcgtgagactggcccccgccgtgctgctgaccggcctgaccgaggtgcccgtgcccaccagattcctgttcctgctgctgggccccgccggcaaggccccccagtaccacgagatcggcagaagcatcgccaccctgatgaccgacgagatcttccacgacgtggcctacaaggccaaggacagaaacgacctgctgagcggcatcgacgagttcctggaccaggtgaccgtgctgccccccggcgagtgggaccccagcatcagaatcgagccccccaagagcgtgcccagccaggagaagagaaagatccccgtgttccacaacggcagcacccccaccctgggcgagacccccaaggaggccgcccaccacgccggccccgagctgcagagaaccggcagactgttcggcggcctgatcctggacatcaagagaaaggcccccttcttcctgagcgacttcaaggacgccctgagcctgcagtgcctggccagcatcctgttcctgtactgcgcctgcatgagccccgtgatcaccttcggcggcctgctgggcgaggccaccgagggcagaatcagcgccatcgagagcctgttcggcgccagcctgaccggcatcgcctacagcctgttcgccggccagcccctgaccatcctgggcagcaccggccccgtgctggtgttcgagaagatcctgtacaagttctgcagagactaccagctgagctacctgagcctgagaaccagcatcggcctgtggaccagcttcctgtgcatcgtgctggtggccaccgacgccagcagcctggtgtgctacatcaccagattcaccgaggaggccttcgccgccctgatctgcatcatcttcatctacgaggccctggagaagctgttcgacctgggcgagacctacgccttcaacatgcacaacaacctggacaagctgaccagctacagctgcgtgtgcaccgagccccccaaccccagcaacgagaccctggcccagtggaagaaggacaacatcaccgcccacaacatcagctggagaaacctgaccgtgagcgagtgcaagaagctgagaggcgtgttcctgggcagcgcctgcggccaccacggcccctacatccccgacgtgctgttctggtgcgtgatcctgttcttcaccaccttcttcctgagcagcttcctgaagcagttcaagaccaagagatacttccccaccaaggtgagaagcaccatcagcgacttcgccgtgttcctgaccatcgtgatcatggtgaccatcgactacctggtgggcgtgcccagccccaagctgcacgtgcccgagaagttcgagcccacccaccccgagagaggctggatcatcagccccctgggcgacaacccctggtggaccctgctgatcgccgccatccccgccctgctgtgcaccatcctgatcttcatggaccagcagatcaccgccgtgatcatcaacagaaaggagcacaagctgaagaagggcgccggctaccacctggacctgctgatggtgggcgtgatgctgggcgtgtgcagcgtgatgggcctgccctggttcgtggccgccaccgtgctgagcatcagccacgtgaacagcctgaaggtggagagcgagtgcagcgcccccggcgagcagcccaagttcctgggcatcagagagcagagagtgaccggcctgatgatcttcatcctgatgggcctgagcgtgttcatgaccagcgtgctgaagttcatccccatgcccgtgctgtacggcgtgttcctgtacatgggcgtgagcagcctgaagggcatccagctgttcgacagaatcaagctgttcggcatgcccgccaagcaccagcccgacctgatctacctgagatacgtgcccctgtggaaggtgcacatcttcaccgtgatccagctgacctgcctggtgctgctgtgggtgatcaaggtgagcgccgccgccgtggtgttccccatgatggtgctggccctggtgttcgtgagaaagctgatggacctgtgcttcaccaagagagagctgagctggctggacgacctgatgcccgagagcaagaagaagaaggaggacgacaagaagaagaaggagaaggaggaggccgagagaatgctgcaggacgacgacgacaccgtgcacctgcccttcgagggcggcagcctgctgcagatccccgtgaaggccctgaagtacagcgtggaccccagcatcgtgaacatcagcgacgagatggccaagaccgcccagtggaaggccctgagcatgaacaccgagaacgccaaggtgaccagaagcaacatgagccccgacaagcccgtgagcgtgaagatcagcttcgaggacgagcccagaaagaagtacgtggacgccgagaccagcctgtag

SEQ ID NO: 100023 - DNA, 3288 bp, Artificial Sequence
  Description of Artificial Sequence: Synthetic coding sequence
atggaggccgacggcgccggcgagcagatgagacccctgctgaccagaggccccgacgaggaggccgtggtggacctgggcaagaccagcagcaccgtgaacaccaagttcgagaaggaggagctggagagccacagagccgtgtacatcggcgtgcacgtgcccttcagcaaggagagcagaagaagacacagacacagaggccacaagcaccaccacagaagaagaaaggacaaggagagcgacaaggaggacggcagagagagccccagctacgacacccccagccagagagtgcagttcatcctgggcaccgaggacgacgacgaggagcacatcccccacgacctgttcaccgagatggacgagctgtgctacagagacggcgaggagtacgagtggaaggagaccgccagatggctgaagttcgaggaggacgtggaggacggcggcgacagatggagcaagccctacgtggccaccctgagcctgcacagcctgttcgagctgagaagctgcatcctgaacggcaccgtgatgctggacatgagagccagcaccctggacgagatcgccgacatggtgctggacaacatgatcgccagcggccagctggacgagagcatcagagagaacgtgagagaggccctgctgaagagacaccaccaccagaacgagaagagattcaccagcagaatccccctggtgagaagcttcgccgacatcggcaagaagcacagcgacccccacctgctggagagaaacggcatcctggccagcccccagagcgcccccggcaacctggacaacagcaagagcggcgagatcaagggcaacggcagcggcggcagcagagagaacagcaccgtggacttcagcaaggtggacatgaacttcatgagaaagatccccaccggcgccgaggccagcaacgtgctggtgggcgaggtggacttcctggagagacccatcatcgccttcgtgagactggcccccgccgtgctgctgaccggcctgaccgaggtgcccgtgcccaccagattcctgttcctgctgctgggccccgccggcaaggccccccagtaccacgagatcggcagaagcatcgccaccctgatgaccgacgagatcttccacgacgtggcctacaaggccaaggacagaaacgacctgctgagcggcatcgacgagttcctggaccaggtgaccgtgctgccccccggcgagtgggaccccagcatcagaatcgagccccccaagagcgtgcccagccaggagaagagaaagatccccgtgttccacaacggcagcacccccaccctgggcgagacccccaaggaggccgcccaccacgccggccccgagctgcagagaaccggcagactgttcggcggcctgatcctggacatcaagagaaaggcccccttcttcctgagcgacttcaaggacgccctgagcctgcagtgcctggccagcatcctgttcctgtactgcgcctgcatgagccccgtgatcaccttcggcggcctgctgggcgaggccaccgagggcagaatcagcgccatcgagagcctgttcggcgccagcctgaccggcatcgcctacagcctgttcgccggccagcccctgaccatcctgggcagcaccggccccgtgctggtgttcgagaagatcctgtacaagttctgcagagactaccagctgagctacctgagcctgagaaccagcatcggcctgtggaccagcttcctgtgcatcgtgctggtggccaccgacgccagcagcctggtgtgctacatcaccagattcaccgaggaggccttcgccgccctgatctgcatcatcttcatctacgaggccctggagaagctgttcgacctgggcgagacctacgccttcaacatgcacaacaacctggacaagctgaccagctacagctgcgtgtgcaccgagccccccaaccccagcaacgagaccctggcccagtggaagaaggacaacatcaccgcccacaacatcagctggagaaacctgaccgtgagcgagtgcaagaagctgagaggcgtgttcctgggcagcgcctgcggccaccacggcccctacatccccgacgtgctgttctggtgcgtgatcctgttcttcaccaccttcttcctgagcagcttcctgaagcagttcaagaccaagagatacttccccaccaaggtgagaagcaccatcagcgacttcgccgtgttcctgaccatcgtgatcatggtgaccatcgactacctggtgggcgtgcccagccccaagctgcacgtgcccgagaagttcgagcccacccaccccgagagaggctggatcatcagccccctgggcgacaacccctggtggaccctgctgatcgccgccatccccgccctgctgtgcaccatcctgatcttcatggaccagcagatcaccgccgtgatcatcaacagaaaggagcacaagctgaagaagggcgccggctaccacctggacctgctgatggtgggcgtgatgctgggcgtgtgcagcgtgatgggcctgccctggttcgtggccgccaccgtgctgagcatcagccacgtgaacagcctgaaggtggagagcgagtgcagcgcccccggcgagcagcccaagttcctgggcatcagagagcagagagtgaccggcctgatgatcttcatcctgatgggcctgagcgtgttcatgaccagcgtgctgaagttcatccccatgcccgtgctgtacggcgtgttcctgtacatgggcgtgagcagcctgaagggcatccagctgttcgacagaatcaagctgttcggcatgcccgccaagcaccagcccgacctgatctacctgagatacgtgcccctgtggaaggtgcacatcttcaccgtgatccagctgacctgcctggtgctgctgtgggtgatcaaggtgagcgccgccgccgtggtgttccccatgatggtgctggccctggtgttcgtgagaaagctgatggacctgtgcttcaccaagagagagctgagctggctggacgacctgatgcccgagagcaagaagaagaaggaggacgacaagaagaagaaggagaaggaggaggccgagagaatgctgcaggacgacgacgacaccgtgcacctgcccttcgagggcggcagcctgctgcagatccccgtgaaggccctgaagtacagccccgacaagcccgtgagcgtgaagatcagcttcgaggacgagcccagaaagaagtacgtggacgccgagaccagcctgtag

SEQ ID NO: 100024 - DNA, 1392 bp, Artificial Sequence
  Description of Artificial Sequence: Synthetic coding sequence
atggaggccgacggcgccggcgagcagatgagacccctgctgaccagaggccccgacgaggaggccgtggtggacctgggcaagaccagcagcaccgtgaacaccaagttcgagaaggaggagctggagagccacagagccgtgtacatcggcgtgcacgtgcccttcagcaaggagagcagaagaagacacagacacagaggccacaagcaccaccacagaagaagaaaggacaaggagagcgacaaggaggacggcagagagagccccagctacgacacccccagccagagagtgcagttcatcctgggcaccgaggacgacgacgaggagcacatcccccacgacctgttcaccgagatggacgagctgtgctacagagacggcgaggagtacgagtggaaggagaccgccagatggctgaagttcgaggaggacgtggaggacggcggcgacagatggagcaagccctacgtggccaccctgagcctgcacagcctgttcgagctgagaagctgcatcctgaacggcaccgtgatgctggacatgagagccagcaccctggacgagatcgccgacatggtgctggacaacatgatcgccagcggccagctggacgagagcatcagagagaacgtgagagaggccctgctgaagagacaccaccaccagaacgagaagagattcaccagcagaatccccctggtgagaagcttcgccgacatcggcaagaagcacagcgacccccacctgctggagagaaacggcatcctggccagcccccagagcgcccccggcaacctggacaacagcaagagcggcgagatcaagggcaacggcagcggcggcagcagagagaacagcaccgtggacttcagcaaggtggacatgaacttcatgagaaagatccccaccggcgccgaggccagcaacgtgctggtgggcgaggtggacttcctggagagacccatcatcgccttcgtgagactggcccccgccgtgctgctgaccggcctgaccgaggtgcccgtgcccaccagattcctgttcctgctgctgggccccgccggcaaggccccccagtaccacgagatcggcagaagcatcgccaccctgatgaccgacgagatcttccacgacgtggcctacaaggccaaggacagaaacgacctgctgagcggcatcgacgagttcctggaccaggtgaccgtgctgccccccggcgagtgggaccccagcatcagaatcgagccccccaagagcgtgcccagccaggagaagagaaagatccccgtgttccacaacggcagcacccccaccctgggcgagacccccaaggaggccgcccaccacgccggccccgagctgcagagaaccggcagagtgcagtag

SEQ ID NO: 100025 - DNA, 1725 bp, Artificial Sequence; identical to SEQ ID NO: 100020
  Description of Artificial Sequence: Synthetic coding sequence

SEQ ID NO: 100026 - DNA, 3741 bp, Artificial Sequence
  Description of Artificial Sequence: Synthetic coding sequence
atggaggccgacggcgccggcgagcagatgagacccctgctgaccagagtgaccagcagaggccccgacgaggaggccgtggtggacctgggcaagaccagcagcaccgtgaacaccaagttcgagaaggaggagctggagagccacagagccgtgtacatcggcgtgcacgtgcccttcagcaaggagagcagaagaagacacagacacagaggccacaagcaccaccacagaagaagaaaggacaaggagagcgacaaggaggacggcagagagagccccagctacgacacccccagccagagagtgcagttcatcctgggcaccgaggacgacgacgaggagcacatcccccacgacctgttcaccgagatggacgagctgtgctacagagacggcgaggagtacgagtggaaggagaccgccagatggctgaagttcgaggaggacgtggaggacggcggcgacagatggagcaagccctacgtggccaccctgagcctgcacagcctgttcgagctgagaagctgcatcctgaacggcaccgtgatgctggacatgagagccagcaccctggacgagatcgccgacatggtgctggacaacatgatcgccagcggccagctggacgagagcatcagagagaacgtgagagaggccctgctgaagagacaccaccaccagaacgagaagagattcaccagcagaatccccctggtgagaagcttcgccgacatcggcgagggcctgagcgccagcagacacagcctgagaaccggcctgagcgccagcaacctgagcctgagaggcgagagccccctgagcctgctgctgggccacctgctgcccagcagcagagccggcacccccgccggcagcagatgcaccacccccgtgcccaccccccagaacagcccccccagcagccccagcatcagcagactgaccagcagaagcagccaggagagccagagacaggcccccgagctgctggtgagccccgccagcgacgacatccccaccgtggtgatccacccccccgaggaggacctggaggccgccctgaagggcgaggagcagaagaacgaggagaacgtggacctgacccccggcatcctggccagcccccagagcgcccccggcaacctggacaacagcaagagcggcgagatcaagggcaacggcagcggcggcagcagagagaacagcaccgtggacttcagcaaggtggacatgaacttcatgagaaagatccccaccggcgccgaggccagcaacgtgctggtgggcgaggtggacttcctggagagacccatcatcgccttcgtgagactggcccccgccgtgctgctgaccggcctgaccgaggtgcccgtgcccaccagattcctgttcctgctgctgggccccgccggcaaggccccccagtaccacgagatcggcagaagcatcgccaccctgatgaccgacgagatcttccacgacgtggcctacaaggccaaggacagaaacgacctgctgagcggcatcgacgagttcctggaccaggtgaccgtgctgccccccggcgagtgggaccccagcatcagaatcgagccccccaagagcgtgcccagccaggagaagagaaagatccccgtgttccacaacggcagcacccccaccctgggcgagacccccaaggaggccgcccaccacgccggccccgagctgcagagaaccggcagactgttcggcggcctgatcctggacatcaagagaaaggcccccttcttcctgagcgacttcaaggacgccctgagcctgcagtgcctggccagcatcctgttcctgtactgcgcctgcatgagccccgtgatcaccttcggcggcctgctgggcgaggccaccgagggcagaatcagcgccatcgagagcctgttcggcgccagcctgaccggcatcgcctacagcctgttcgccggccagcccctgaccatcctgggcagcaccggccccgtgctggtgttcgagaagatcctgtacaagttctgcagagactaccagctgagctacctgagcctgagaaccagcatcggcctgtggaccagcttcctgtgcatcgtgctggtggccaccgacgccagcagcctggtgtgctacatcaccagattcaccgaggaggccttcgccgccctgatctgcatcatcttcatctacgaggccctggagaagctgttcgacctgggcgagacctacgccttcaacatgcacaacaacctggacaagctgaccagctacagctgcgtgtgcaccgagccccccaaccccagcaacgagaccctggcccagtggaagaaggacaacatcaccgcccacaacatcagctggagaaacctgaccgtgagcgagtgcaagaagctgagaggcgtgttcctgggcagcgcctgcggccaccacggcccctacatccccgacgtgctgttctggtgcgtgatcctgttcttcaccaccttcttcctgagcagcttcctgaagcagttcaagaccaagagatacttccccaccaaggtgagaagcaccatcagcgacttcgccgtgttcctgaccatcgtgatcatggtgaccatcgactacctggtgggcgtgcccagccccaagctgcacgtgcccgagaagttcgagcccacccaccccgagagaggctggatcatcagccccctgggcgacaacccctggtggaccctgctgatcgccgccatccccgccctgctgtgcaccatcctgatcttcatggaccagcagatcaccgccgtgatcatcaacagaaaggagcacaagctgaagaagggcgccggctaccacctggacctgctgatggtgggcgtgatgctgggcgtgtgcagcgtgatgggcctgccctggttcgtggccgccaccgtgctgagcatcagccacgtgaacagcctgaaggtggagagcgagtgcagcgcccccggcgagcagcccaagttcctgggcatcagagagcagagagtgaccggcctgatgatcttcatcctgatgggcctgagcgtgttcatgaccagcgtgctgaagttcatccccatgcccgtgctgtacggcgtgttcctgtacatgggcgtgagcagcctgaagggcatccagctgttcgacagaatcaagctgttcggcatgcccgccaagcaccagcccgacctgatctacctgagatacgtgcccctgtggaaggtgcacatcttcaccgtgatccagctgacctgcctggtgctgctgtgggtgatcaaggtgagcgccgccgccgtggtgttccccatgatggtgctggccctggtgttcgtgagaaagctgatggacctgtgcttcaccaagagagagctgagctggctggacgacctgatgcccgagagcaagaagaagaaggaggacgacaagaagaagaaggagaaggaggaggccgagagaatgctgcaggacgacgacgacaccgtgcacctgcccttcgagggcggcagcctgctgcagatccccgtgaaggccctgaagtacagcgtggaccccagcatcgtgaacatcagcgacgagatggccaagaccgcccagtggaaggccctgagcatgaacaccgagaacgccaaggtgaccagaagcaacatgagccccgacaagcccgtgagcgtgaagatcagcttcgaggacgagcccagaaagaagtacgtggacgccgagaccagcctgtag

SEQ ID NO: 100027 - DNA, 3780 bp, Artificial Sequence
  Description of Artificial Sequence: Synthetic coding sequence
atggaggccgacggcgccggcgagcagatgagacccctgctgaccagagtgaccagcagaggccccgacgaggaggccgtggtggacctgggcaagaccagcagcaccgtgaacaccaagttcgagaaggaggagctggagagccacagagccgtgtacatcggcgtgcacgtgcccttcagcaaggagagcagaagaagacacagacacagaggccacaagcaccaccacagaagaagaaaggacaaggagagcgacaaggaggacggcagagagagccccagctacgacacccccagccagagagtgcagttcatcctgggcaccgaggacgacgacgaggagcacatcccccacgacctgttcaccgagatggacgagctgtgctacagagacggcgaggagtacgagtggaaggagaccgccagatggctgaagttcgaggaggacgtggaggacggcggcgacagatggagcaagccctacgtggccaccctgagcctgcacagcctgttcgagctgagaagctgcatcctgaacggcaccgtgatgctggacatgagagccagcaccctggacgagatcgccgacatggtgctggacaacatgatcgccagcggccagctggacgagagcatcagagagaacgtgagagaggccctgctgaagagacaccaccaccagaacgagaagagattcaccagcagaatccccctggtgagaagcttcgccgacatcggcaagaagcacagcgacccccacctgctggagagaaacggcgagggcctgagcgccagcagacacagcctgagaaccggcctgagcgccagcaacctgagcctgagaggcgagagccccctgagcctgctgctgggccacctgctgcccagcagcagagccggcacccccgccggcagcagatgcaccacccccgtgcccaccccccagaacagcccccccagcagccccagcatcagcagactgaccagcagaagcagccaggagagccagagacaggcccccgagctgctggtgagccccgccagcgacgacatccccaccgtggtgatccacccccccgaggaggacctggaggccgccctgaagggcgaggagcagaagaacgaggagaacgtggacctgacccccggcatcctggccagcccccagagcgcccccggcaacctggacaacagcaagagcggcgagatcaagggcaacggcagcggcggcagcagagagaacagcaccgtggacttcagcaaggtggacatgaacttcatgagaaagatccccaccggcgccgaggccagcaacgtgctggtgggcgaggtggacttcctggagagacccatcatcgccttcgtgagactggcccccgccgtgctgctgaccggcctgaccgaggtgcccgtgcccaccagattcctgttcctgctgctgggccccgccggcaaggccccccagtaccacgagatcggcagaagcatcgccaccctgatgaccgacgagatcttccacgacgtggcctacaaggccaaggacagaaacgacctgctgagcggcatcgacgagttcctggaccaggtgaccgtgctgccccccggcgagtgggaccccagcatcagaatcgagccccccaagagcgtgcccagccaggagaagagaaagatccccgtgttccacaacggcagcacccccaccctgggcgagacccccaaggaggccgcccaccacgccggccccgagctgcagagaaccggcagactgttcggcggcctgatcctggacatcaagagaaaggcccccttcttcctgagcgacttcaaggacgccctgagcctgcagtgcctggccagcatcctgttcctgtactgcgcctgcatgagccccgtgatcaccttcggcggcctgctgggcgaggccaccgagggcagaatcagcgccatcgagagcctgttcggcgccagcctgaccggcatcgcctacagcctgttcgccggccagcccctgaccatcctgggcagcaccggccccgtgctggtgttcgagaagatcctgtacaagttctgcagagactaccagctgagctacctgagcctgagaaccagcatcggcctgtggaccagcttcctgtgcatcgtgctggtggccaccgacgccagcagcctggtgtgctacatcaccagattcaccgaggaggccttcgccgccctgatctgcatcatcttcatctacgaggccctggagaagctgttcgacctgggcgagacctacgccttcaacatgcacaacaacctggacaagctgaccagctacagctgcgtgtgcaccgagccccccaaccccagcaacgagaccctggcccagtggaagaaggacaacatcaccgcccacaacatcagctggagaaacctgaccgtgagcgagtgcaagaagctgagaggcgtgttcctgggcagcgcctgcggccaccacggcccctacatccccgacgtgctgttctggtgcgtgatcctgttcttcaccaccttcttcctgagcagcttcctgaagcagttcaagaccaagagatacttccccaccaaggtgagaagcaccatcagcgacttcgccgtgttcctgaccatcgtgatcatggtgaccatcgactacctggtgggcgtgcccagccccaagctgcacgtgcccgagaagttcgagcccacccaccccgagagaggctggatcatcagccccctgggcgacaacccctggtggaccctgctgatcgccgccatccccgccctgctgtgcaccatcctgatcttcatggaccagcagatcaccgccgtgatcatcaacagaaaggagcacaagctgaagaagggcgccggctaccacctggacctgctgatggtgggcgtgatgctgggcgtgtgcagcgtgatgggcctgccctggttcgtggccgccaccgtgctgagcatcagccacgtgaacagcctgaaggtggagagcgagtgcagcgcccccggcgagcagcccaagttcctgggcatcagagagcagagagtgaccggcctgatgatcttcatcctgatgggcctgagcgtgttcatgaccagcgtgctgaagttcatccccatgcccgtgctgtacggcgtgttcctgtacatgggcgtgagcagcctgaagggcatccagctgttcgacagaatcaagctgttcggcatgcccgccaagcaccagcccgacctgatctacctgagatacgtgcccctgtggaaggtgcacatcttcaccgtgatccagctgacctgcctggtgctgctgtgggtgatcaaggtgagcgccgccgccgtggtgttccccatgatggtgctggccctggtgttcgtgagaaagctgatggacctgtgcttcaccaagagagagctgagctggctggacgacctgatgcccgagagcaagaagaagaaggaggacgacaagaagaagaaggagaaggaggaggccgagagaatgctgcaggacgacgacgacaccgtgcacctgcccttcgagggcggcagcctgctgcagatccccgtgaaggccctgaagtacagcgtggaccccagcatcgtgaacatcagcgacgagatggccaagaccgcccagtggaaggccctgagcatgaacaccgagaacgccaaggtgaccagaagcaacatgagccccgacaagcccgtgagcgtgaagatcagcttcgaggacgagcccagaaagaagtacgtggacgccgagaccagcctgtag

SEQ ID NO: 100028 - DNA, 3396 bp, Artificial Sequence
  Description of Artificial Sequence: Synthetic coding sequence
atggaggccgacggcgccggcgagcagatgagacccctgctgaccagaggccccgacgaggaggccgtggtggacctgggcaagaccagcagcaccgtgaacaccaagttcgagaaggaggagctggagagccacagagccgtgtacatcggcgtgcacgtgcccttcagcaaggagagcagaagaagacacagacacagaggccacaagcaccaccacagaagaagaaaggacaaggagagcgacaaggaggacggcagagagagccccagctacgacacccccagccagagagtgcagttcatcctgggcaccgaggacgacgacgaggagcacatcccccacgacctgttcaccgagatggacgagctgtgctacagagacggcgaggagtacgagtggaaggagaccgccagatggctgaagttcgaggaggacgtggaggacggcggcgacagatggagcaagccctacgtggccaccctgagcctgcacagcctgttcgagctgagaagctgcatcctgaacggcaccgtgatgctggacatgagagccagcaccctggacgagatcgccgacatggtgctggacaacatgatcgccagcggccagctggacgagagcatcagagagaacgtgagagaggccctgctgaagagacaccaccaccagaacgagaagagattcaccagcagaatccccctggtgagaagcttcgccgacatcggcaagaagcacagcgacccccacctgctggagagaaacggcatcctggccagcccccagagcgcccccggcaacctggacaacagcaagagcggcgagatcaagggcaacggcagcggcggcagcagagagaacagcaccgtggacttcagcaaggtggacatgaacttcatgagaaagatccccaccggcgccgaggccagcaacgtgctggtgggcgaggtggacttcctggagagacccatcatcgccttcgtgagactggcccccgccgtgctgctgaccggcctgaccgaggtgcccgtgcccaccagattcctgttcctgctgctgggccccgccggcaaggccccccagtaccacgagatcggcagaagcatcgccaccctgatgaccgacgagatcttccacgacgtggcctacaaggccaaggacagaaacgacctgctgagcggcatcgacgagttcctggaccaggtgaccgtgctgccccccggcgagtgggaccccagcatcagaatcgagccccccaagagcgtgcccagccaggagaagagaaagatccccgtgttccacaacggcagcacccccaccctgggcgagacccccaaggaggccgcccaccacgccggccccgagctgcagagaaccggcagactgttcggcggcctgatcctggacatcaagagaaaggcccccttcttcctgagcgacttcaaggacgccctgagcctgcagtgcctggccagcatcctgttcctgtactgcgcctgcatgagccccgtgatcaccttcggcggcctgctgggcgaggccaccgagggcagaatcagcgccatcgagagcctgttcggcgccagcctgaccggcatcgcctacagcctgttcgccggccagcccctgaccatcctgggcagcaccggccccgtgctggtgttcgagaagatcctgtacaagttctgcagagactaccagctgagctacctgagcctgagaaccagcatcggcctgtggaccagcttcctgtgcatcgtgctggtggccaccgacgccagcagcctggtgtgctacatcaccagattcaccgaggaggccttcgccgccctgatctgcatcatcttcatctacgaggccctggagaagctgttcgacctgggcgagacctacgccttcaacatgcacaacaacctggacaagctgaccagctacagctgcgtgtgcaccgagccccccaaccccagcaacgagaccctggcccagtggaagaaggacaacatcaccgcccacaacatcagctggagaaacctgaccgtgagcgagtgcaagaagctgagaggcgtgttcctgggcagcgcctgcggccaccacggcccctacatccccgacgtgctgttctggtgcgtgatcctgttcttcaccaccttcttcctgagcagcttcctgaagcagttcaagaccaagagatacttccccaccaaggtgagaagcaccatcagcgacttcgccgtgttcctgaccatcgtgatcatggtgaccatcgactacctggtgggcgtgcccagccccaagctgcacgtgcccgagaagttcgagcccacccaccccgagagaggctggatcatcagccccctgggcgacaacccctggtggaccctgctgatcgccgccatccccgccctgctgtgcaccatcctgatcttcatggaccagcagatcaccgccgtgatcatcaacagaaaggagcacaagctgaagaagggcgccggctaccacctggacctgctgatggtgggcgtgatgctgggcgtgtgcagcgtgatgggcctgccctggttcgtggccgccaccgtgctgagcatcagccacgtgaacagcctgaaggtggagagcgagtgcagcgcccccggcgagcagcccaagttcctgggcatcagagagcagagagtgaccggcctgatgatcttcatcctgatgggcctgagcgtgttcatgaccagcgtgctgaagttcatccccatgcccgtgctgtacggcgtgttcctgtacatgggcgtgagcagcctgaagggcatccagctgttcgacagaatcaagctgttcggcatgcccgccaagcaccagcccgacctgatctacctgagatacgtgcccctgtggaaggtgcacatcttcaccgtgatccagctgacctgcctggtgctgctgtgggtgatcaaggtgagcgccgccgccgtggtgttccccatgatggtgctggccctggtgttcgtgagaaagctgatggacctgtgcttcaccaagagagagctgagctggctggacgacctgatgcccgagagcaagaagaagaaggaggacgacaagaagaagaaggagaaggaggaggccgagagaatgctgcaggacgacgacgacaccgtgcacctgcccttcgagggcggcagcctgctgcagatccccgtgaaggccctgaagtacagcgtggaccccagcatcgtgaacatcagcgacgagatggccaagaccgcccagtggaaggccctgagcatgaacaccgagaacgccaaggtgaccagaagcaacatgagccccgacaagcccgtgagcgtgaagatcagcttcgaggacgagcccagaaagaagtacgtggacgccgagaccagcctgtag

SEQ ID NO: 100029 - DNA, 1392 bp, Artificial Sequence; identical to SEQ ID NO: 100024
  Description of Artificial Sequence: Synthetic coding sequence

SEQ ID NO: 100030 - DNA, 3135 bp, Artificial Sequence; identical to SEQ ID NO: 99992
  Description of Artificial Sequence: Synthetic coding sequence

SEQ ID NO: 100031 - DNA, 3216 bp, Artificial Sequence
  Description of Artificial Sequence: Synthetic coding sequence
atgttcaacaagaacaacagcaacaagctgagaagcacccccagatacagaagaggcgaccccggctacctgaacttcaccgagctgggccccctgaagcccgagcagaaggaccagtggagccagcacagacccgacgaggaggccgtggtggaccagggcggcaccagcaccatcctgaacatccactacgagaaggaggagctggagggccacagaaccctgtacgtgggcgtgagaatgcccctgggcagacagagccacagacaccacagaacccacggccagaagcacagaagaagaggcagaggcaagggcgccagccagggcgaggagggcctggaggccctggcccacgacacccccagccagagagtgcagttcatcctgggcaccgaggaggacgaggagcacgtgccccacgagctgttcaccgagctggacgagatctgcatgaaggagggcgaggacgccgagtggaaggagaccgccagatggctgaagttcgaggaggacgtggaggacggcggcgagagatggagcaagccctacgtggccaccctgagcctgcacagcctgttcgagctgagaagctgcctgatcaacggcaccgtgctgctggacatgcacgccaacagcatcgaggagatcagcgacctgatcctggaccagcaggagctgagcagcgacctgaacgacagcatgagagtgaaggtgagagaggccctgctgaagaagcaccaccaccagaacgagaagaagagaaacaacctgatccccatcgtgagaagcttcgccgaggtgggcaagaagcagagcgacccccacctgatggacaagcacggccagaccgtgagcccccagagcgtgcccaccaccaacctggaggtgaagaacggcgtgaactgcgagcacagccccgtggacctgagcaaggtggacctgcacttcatgaagaagatccccaccggcgccgaggccagcaacgtgctggtgggcgaggtggacatcctggacagacccatcgtggccttcgtgagactgagccccgccgtgctgctgagcggcctgaccgaggtgcccatccccaccagattcctgttcatcctgctgggccccgtgggcaagggccagcagtaccacgagatcggcagaagcatggccaccatcatgaccgacgagatcttccacgacgtggcctacaaggccaaggagagagacgacctgctggccggcatcgacgagttcctggaccaggtgaccgtgctgccccccggcgagtgggaccccagcatcagaatcgagccccccaagaacgtgcccagccaggagaagagaaagatgcccggcgtgcccaacggcaacgtgtgccacatcgagcaggagccccacggcggccacagcggccccgagctgcagagaaccggcagactgttcggcggcctggtgctggacatcaagagaaaggccccctggtactggagcgactacagagacgccctgagcctgcagtgcctggccagcttcctgttcctgtactgcgcctgcatgagccccgtgatcaccttcggcggcctgctgggcgaggccaccgagggcagaatcagcgccatcgagagcctgttcggcgccagcatgaccggcatcgcctacagcctgttcgccggccaggccctgaccatcctgggcagcaccggccccgtgctggtgttcgagaagatcctgttcaagttctgcaaggactacgccctgagctacctgagcctgagagcctgcatcggcctgtggaccgccttcctgtgcatcgtgctggtggccaccgacgccagcagcctggtgtgctacatcaccagattcaccgaggaggccttcgccagcctgatctgcatcatcttcatctacgaggccatcgagaagctgatccacctggccgagacctaccccatccacatgcacagccagctggaccacctgagcctgtactactgcagatgcaccctgcccgagaaccccaacaaccacaccctgcagtactggaaggaccacaacatcgtgaccgccgaggtgcactgggccaacctgaccgtgagcgagtgccaggagatgcacggcgagttcatgggcagcgcctgcggccaccacggcccctacacccccgacgtgctgttctggagctgcatcctgttcttcaccaccttcatcctgagcagcaccctgaagaccttcaagaccagcagatacttccccaccagagtgagaagcatggtgagcgacttcgccgtgttcctgaccatcttcaccatggtgatcatcgacttcctgatcggcgtgcccagccccaagctgcaggtgcccagcgtgttcaagcccaccagagacgacagaggctggatcatcaaccccatcggccccaacccctggtggaccgtgatcgccgccatcatccccgccctgctgtgcaccatcctgatcttcatggaccagcagatcaccgccgtgatcatcaacagaaaggagcacaagctgaagaagggctgcggctaccacctggacctgctgatggtggccatcatgctgggcgtgtgcagcatcatgggcctgccctggttcgtggccgccaccgtgctgagcatcacccacgtgaacagcctgaagctggagagcgagtgcagcgcccccggcgagcagcccaagttcctgggcatcagagagcagagagtgaccggcctgatgatcttcgtgctgatgggctgcagcgtgttcatgaccgccatcctgaagttcatccccatgcccgtgctgtacggcgtgttcctgtacatgggcgtgagcagcctgcagggcatccagttcttcgacagactgaagctgttcggcatgcccgccaagcaccagcccgacttcatctacctgagacacgtgcccctgagaaaggtgcacctgttcaccctgatccagctgacctgcctggtgctgctgtgggtgatcaaggccagccccgccgccatcgtgttccccatgatggtgctggccctggtgttcgtgagaaaggtgatggacctgtgcttcagcaagagagagctgagctggctggacgacctgatgcccgagagcaagaagaagaagctggacgacgccaagaagaaggccaaggaggaggaggtgatcgtgctggcccccaccgtgtacctgggcgccagcaactacagaacctag

SEQ ID NO: 100032 - DNA, 2244 bp, Artificial Sequence; identical to SEQ ID NO: 99991
  Description of Artificial Sequence: Synthetic coding sequence

SEQ ID NO: 100033 - DNA, 3282 bp, Artificial Sequence
  Description of Artificial Sequence: Synthetic coding sequence
atgcccgccgccggcagcaacgagcccgacggcgtgctgagctaccagagacccgacgaggaggccgtggtggaccagggcggcaccagcaccatcctgaacatccactacgagaaggaggagctggagggccacagaaccctgtacgtgggcgtgagaatgcccctgggcagacagagccacagacaccacagaacccacggccagaagcacagaagaagaggcagaggcaagggcgccagccagggcgaggagggcctggaggccctggcccacgacacccccagccagagagtgcagttcatcctgggcaccgaggaggacgaggagcacgtgccccacgagctgttcaccgagctggacgagatctgcatgaaggagggcgaggacgccgagtggaaggagaccgccagatggctgaagttcgaggaggacgtggaggacggcggcgagagatggagcaagccctacgtggccaccctgagcctgcacagcctgttcgagctgagaagctgcctgatcaacggcaccgtgctgctggacatgcacgccaacagcatcgaggagatcagcgacctgatcctggaccagcaggagctgagcagcgacctgaacgacagcatgagagtgaaggtgagagaggccctgctgaagaagcaccaccaccagaacgagaagaagagaaacaacctgatccccatcgtgagaagcttcgccgaggtgggcaagaagcagagcgacccccacctgatggacaagcacggccagaccgtgagcccccagagcgtgcccaccaccaacctggaggtgaagaacggcgtgaactgcgagcacagccccgtggacctgagcaaggtggacctgcacttcatgaagaagatccccaccggcgccgaggccagcaacgtgctggtgggcgaggtggacatcctggacagacccatcgtggccttcgtgagactgagccccgccgtgctgctgagcggcctgaccgaggtgcccatccccaccagattcctgttcatcctgctgggccccgtgggcaagggccagcagtaccacgagatcggcagaagcatggccaccatcatgaccgacgagatcttccacgacgtggcctacaaggccaaggagagagacgacctgctggccggcatcgacgagttcctggaccaggtgaccgtgctgccccccggcgagtgggaccccagcatcagaatcgagccccccaagaacgtgcccagccaggagaagagaaagatgcccggcgtgcccaacggcaacgtgtgccacatcgagcaggagccccacggcggccacagcggccccgagctgcagagaaccggcagactgttcggcggcctggtgctggacatcaagagaaaggccccctggtactggagcgactacagagacgccctgagcctgcagtgcctggccagcttcctgttcctgtactgcgcctgcatgagccccgtgatcaccttcggcggcctgctgggcgaggccaccgagggcagaatcagcgccatcgagagcctgttcggcgccagcatgaccggcatcgcctacagcctgttcgccggccaggccctgaccatcctgggcagcaccggccccgtgctggtgttcgagaagatcctgttcaagttctgcaaggactacgccctgagctacctgagcctgagagcctgcatcggcctgtggaccgccttcctgtgcatcgtgctggtggccaccgacgccagcagcctggtgtgctacatcaccagattcaccgaggaggccttcgccagcctgatctgcatcatcttcatctacgaggccatcgagaagctgatccacctggccgagacctaccccatccacatgcacagccagctggaccacctgagcctgtactactgcagatgcaccctgcccgagaaccccaacaaccacaccctgcagtactggaaggaccacaacatcgtgaccgccgaggtgcactgggccaacctgaccgtgagcgagtgccaggagatgcacggcgagttcatgggcagcgcctgcggccaccacggcccctacacccccgacgtgctgttctggagctgcatcctgttcttcaccaccttcatcctgagcagcaccctgaagaccttcaagaccagcagatacttccccaccagagtgagaagcatggtgagcgacttcgccgtgttcctgaccatcttcaccatggtgatcatcgacttcctgatcggcgtgcccagccccaagctgcaggtgcccagcgtgttcaagcccaccagagacgacagaggctggatcatcaaccccatcggccccaacccctggtggaccgtgatcgccgccatcatccccgccctgctgtgcaccatcctgatcttcatggaccagcagatcaccgccgtgatcatcaacagaaaggagcacaagctgaagaagggctgcggctaccacctggacctgctgatggtggccatcatgctgggcgtgtgcagcatcatgggcctgccctggttcgtggccgccaccgtgctgagcatcacccacgtgaacagcctgaagctggagagcgagtgcagcgcccccggcgagcagcccaagttcctgggcatcagagagcagagagtgaccggcctgatgatcttcgtgctgatgggctgcagcgtgttcatgaccgccatcctgaagttcatccccatgcccgtgctgtacggcgtgttcctgtacatgggcgtgagcagcctgcagggcatccagttcttcgacagactgaagctgttcggcatgcccgccaagcaccagcccgacttcatctacctgagacacgtgcccctgagaaaggtgcacctgttcaccctgatccagctgacctgcctggtgctgctgtgggtgatcaaggccagccccgccgccatcgtgttccccatgatggtgctggccctggtgttcgtgagaaaggtgatggacctgtgcttcagcaagagagagctgagctggctggacgacctgatgcccgagagcaagaagaagaagctggacgacgccaagaagaaggccaaggaggaggaggaggccgagaagatgctggagatcggcggcgacaagttccccctggagagcagaaagctgctgagcagccccggcaagaacatcagctgcagatgcgaccccagcgagatcaacatcagcgacgagatgcccaagaccaccgtgtggaaggccctgagcatgaacagcggcaacgccaaggagaagagcctgttcaactag

SEQ ID NO: 100034 - DNA, 1917 bp, Artificial Sequence
  Description of Artificial Sequence: Synthetic coding sequence
atgcccctgggcagacagagccacagacaccacagaacccacggccagaagcacagaagaagaggcagaggcaagggcgccagccagggcgaggagggcctggaggccctggcccacgacacccccagccagagagtgcagttcatcctgggcaccgaggaggacgaggagcacgtgccccacgagctgttcaccgagctggacgagatctgcatgaaggagggcgaggacgccgagtggaaggagaccgccagatggctgaagttcgaggaggacgtggaggacggcggcgagagatggagcaagccctacgtggccaccctgagcctgcacagcctgttcgagctgagaagctgcctgatcaacggcaccgtgctgctggacatgcacgccaacagcatcgaggagatcagcgacctgatcctggaccagcaggagctgagcagcgacctgaacgacagcatgagagtgaaggtgagagaggccctgctgaagaagcaccaccaccagaacgagaagaagagaaacaacctgatccccatcgtgagaagcttcgccgaggtgggcaagaagcagagcgacccccacctgatggacaagcacggccagaccgtgagcccccagagcgtgcccaccaccaacctggaggtgaagaacggcgtgaactgcgagcacagccccgtggacctgagcaaggtggacctgcacttcatgaagaagatccccaccggcgccgaggccagcaacgtgctggtgggcgaggtggacatcctggacagacccatcgtggccttcgtgagactgagccccgccgtgctgctgagcggcctgaccgaggtgcccatccccaccagattcctgttcatcctgctgggccccgtgggcaagggccagcagtaccacgagatcggcagaagcatggccaccatcatgaccgacgagatcttccacgacgtggcctacaaggccaaggagagagacgacctgctggccggcatcgacgagttcctggaccaggtgaccgtgctgccccccggcgagtgggaccccagcatcagaatcgagccccccaagaacgtgcccagccaggagaagagaaagatgcccggcgtgcccaacggcaacgtgtgccacatcgagcaggagccccacggcggccacagcggccccgagctgcagagaaccggcagactgttcggcggcctggtgctggacatcaagagaaaggccccctggtactggagcgactacagagacgccctgagcctgcagtgcctggccagcttcctgttcctgtactgcgcctgcatgagccccgtgatcaccttcggcggcctgctgggcgaggccaccgagggcagaatcagcgccatcgagagcctgttcggcgccagcatgaccggcatcgcctacagcctgttcgccggccaggccctgaccatcctgggcagcaccggccccgtgctggtgttcgagaagatcctgttcaagttctgcaaggactacgccctgagctacctgagcctgagagcctgcatcggcctgtggaccgccttcctgtgcatcgtgctggtggccaccgacgccagcagcctggtgtgctacatcaccagattcaccgaggaggccttcgccagcctgatctgcatcatcttcatctacgaggccatcgagaagctgatccacctggccgagacctaccccatccacatgcacagccagctggaccacctgagcctgtactactgcagatgcaccctgcccgagaaccccaacaaccacaccctgcagtactggaaggaccacaacatcgtgaccgccgaggtgcactgggccaacctgaccgtgagcgtgagcctgggcgccgccagatgccccagcatcgtgaccaccggcctgggcggcaccagcaagtag

SEQ ID NO: 100035 - DNA, 2976 bp, Artificial Sequence
  Description of Artificial Sequence: Synthetic coding sequence
atgcccctgggcagacagagccacagacaccacagaacccacggccagaagcacagaagaagaggcagaggcaagggcgccagccagggcgaggagggcctggaggccctggcccacgacacccccagccagagagtgcagttcatcctgggcaccgaggaggacgaggagcacgtgccccacgagctgttcaccgagctggacgagatctgcatgaaggagggcgaggacgccgagtggaaggagaccgccagatggctgaagttcgaggaggacgtggaggacggcggcgagagatggagcaagccctacgtggccaccctgagcctgcacagcctgttcgagctgagaagctgcctgatcaacggcaccgtgctgctggacatgcacgccaacagcatcgaggagatcagcgacctgatcctggaccagcaggagctgagcagcgacctgaacgacagcatgagagtgaaggtgagagaggccctgctgaagaagcaccaccaccagaacgagaagaagagaaacaacctgatccccatcgtgagaagcttcgccgaggtgggcaagaagcagagcgacccccacctgatggacaagcacggccagaccgtgagcccccagagcgtgcccaccaccaacctggaggtgaagaacggcgtgaactgcgagcacagccccgtggacctgagcaaggtggacctgcacttcatgaagaagatccccaccggcgccgaggccagcaacgtgctggtgggcgaggtggacatcctggacagacccatcgtggccttcgtgagactgagccccgccgtgctgctgagcggcctgaccgaggtgcccatccccaccagattcctgttcatcctgctgggccccgtgggcaagggccagcagtaccacgagatcggcagaagcatggccaccatcatgaccgacgagatcttccacgacgtggcctacaaggccaaggagagagacgacctgctggccggcatcgacgagttcctggaccaggtgaccgtgctgccccccggcgagtgggaccccagcatcagaatcgagccccccaagaacgtgcccagccaggagaagagaaagatgcccggcgtgcccaacggcaacgtgtgccacatcgagcaggagccccacggcggccacagcggccccgagctgcagagaaccggcagactgttcggcggcctggtgctggacatcaagagaaaggccccctggtactggagcgactacagagacgccctgagcctgcagtgcctggccagcttcctgttcctgtactgcgcctgcatgagccccgtgatcaccttcggcggcctgctgggcgaggccaccgagggcagaatcagcgccatcgagagcctgttcggcgccagcatgaccggcatcgcctacagcctgttcgccggccaggccctgaccatcctgggcagcaccggccccgtgctggtgttcgagaagatcctgttcaagttctgcaaggactacgccctgagctacctgagcctgagagcctgcatcggcctgtggaccgccttcctgtgcatcgtgctggtggccaccgacgccagcagcctggtgtgctacatcaccagattcaccgaggaggccttcgccagcctgatctgcatcatcttcatctacgaggccatcgagaagctgatccacctggccgagacctaccccatccacatgcacagccagctggaccacctgagcctgtactactgcagatgcaccctgcccgagaaccccaacaaccacaccctgcagtactggaaggaccacaacatcgtgaccgccgaggtgcactgggccaacctgaccgtgagcgagtgccaggagatgcacggcgagttcatgggcagcgcctgcggccaccacggcccctacacccccgacgtgctgttctggagctgcatcctgttcttcaccaccttcatcctgagcagcaccctgaagaccttcaagaccagcagatacttccccaccagagtgagaagcatggtgagcgacttcgccgtgttcctgaccatcttcaccatggtgatcatcgacttcctgatcggcgtgcccagccccaagctgcaggtgcccagcgtgttcaagcccaccagagacgacagaggctggatcatcaaccccatcggccccaacccctggtggaccgtgatcgccgccatcatccccgccctgctgtgcaccatcctgatcttcatggaccagcagatcaccgccgtgatcatcaacagaaaggagcacaagctgaagaagggctgcggctaccacctggacctgctgatggtggccatcatgctgggcgtgtgcagcatcatgggcctgccctggttcgtggccgccaccgtgctgagcatcacccacgtgaacagcctgaagctggagagcgagtgcagcgcccccggcgagcagcccaagttcctgggcatcagagagcagagagtgaccggcctgatgatcttcgtgctgatgggctgcagcgtgttcatgaccgccatcctgaagttcatccccatgcccgtgctgtacggcgtgttcctgtacatgggcgtgagcagcctgcagggcatccagttcttcgacagactgaagctgttcggcatgcccgccaagcaccagcccgacttcatctacctgagacacgtgcccctgagaaaggtgcacctgttcaccctgatccagctgacctgcctggtgctgctgtgggtgatcaaggccagccccgccgccatcgtgttccccatgatggtgctggccctggtgttcgtgagaaaggtgatggacctgtgcttcagcaagagagagctgagctggctggacgacctgatgcccgagagcaagaagaagaagctggacgacgccaagaagaaggccaaggaggaggaggtgatcgtgctggcccccaccgtgtacctgggcgccagcaactacagaacctag

SEQ ID NO: 100036 - DNA, 3321 bp, Artificial Sequence
  Description of Artificial Sequence: Synthetic coding sequence
atggagatcaaggaccagggcgcccagatggagcccctgctgcccaccagaaacgacgaggaggccgtggtggacagaggcggcaccagaagcatcctgaagacccacttcgagaaggaggacctggagggccacagaaccctgttcatcggcgtgcacgtgcccctgggcggcagaaagagccacagaagacacagacacagaggccacaagcacagaaagagagacagagagagagacagcggcctggaggacggcagagagagccccagcttcgacacccccagccagagagtgcagttcatcctgggcaccgaggacgacgacgaggagcacatcccccacgacctgttcaccgagctggacgagatctgctggagagagggcgaggacgccgagtggagagagaccgccagatggctgaagttcgaggaggacgtggaggacggcggcgagagatggagcaagccctacgtggccaccctgagcctgcacagcctgttcgagctgagaagctgcatcctgaacggcaccgtgctgctggacatgcacgccaacaccctggaggagatcgccgacatggtgctggaccagcaggtgagcagcggccagctgaacgaggacgtgagacacagagtgcacgaggccctgatgaagcagcaccaccaccagaaccagaagaagctgaccaacagaatccccatcgtgagaagcttcgccgacatcggcaagaagcagagcgagcccaacagcatggacaagaacgccggccaggtggtgagcccccagagcgcccccgcctgcgtggagaacaagaacgacgtgagcagagagaacagcaccgtggacttcagcaaggtggacctgcacttcatgaagaagatcccccccggcgccgaggccagcaacatcctggtgggcgagctggagttcctggacagaaccgtggtggccttcgtgagactgagccccgccgtgctgctgcagggcctggccgaggtgcccatccccaccagattcctgttcatcctgctgggccccctgggcaagggccagcagtaccacgagatcggcagaagcatcgccaccctgatgaccgacgaggtgttccacgacgtggcctacaaggccaaggacagaaacgacctggtgagcggcatcgacgagttcctggaccaggtgaccgtgctgccccccggcgagtgggaccccagcatcagaatcgagccccccaagaacgtgcccagccaggagaagagaaagatccccgccgtgcccaacggcaccgccgcccacggcgaggccgagccccacggcggccacagcggccccgagctgcagagaaccggcagaatcttcggcggcctgatcctggacatcaagagaaaggccccctacttctggagcgacttcagagacgccttcagcctgcagtgcctggccagcttcctgttcctgtactgcgcctgcatgagccccgtgatcaccttcggcggcctgctgggcgaggccaccgagggcagaatcagcgccatcgagagcctgttcggcgccagcatgaccggcatcgcctacagcctgttcggcggccagcccctgaccatcctgggcagcaccggccccgtgctggtgttcgagaagatcctgttcaagttctgcaaggagtacggcctgagctacctgagcctgagagccagcatcggcctgtggaccgccaccctgtgcatcatcctggtggccaccgacgccagcagcctggtgtgctacatcaccagattcaccgaggaggccttcgccagcctgatctgcatcatcttcatctacgaggccctggagaagctgttcgagctgagcgaggcctaccccatcaacatgcacaacgacctggagctgctgacccagtacagctgcaactgcgtggagccccacaaccccagcaacggcaccctgaaggagtggagagagagcaacatcagcgccagcgacatcatctgggagaacctgaccgtgagcgagtgcaagagcctgcacggcgagtacgtgggcagagcctgcggccacgaccacccctacgtgcccgacgtgctgttctggagcgtgatcctgttcttcagcaccgtgaccctgagcgccaccctgaagcagttcaagaccagcagatacttccccaccaaggtgagaagcatcgtgagcgacttcgccgtgttcctgaccatcctgtgcatggtgctgatcgactacgccatcggcatccccagccccaagctgcaggtgcccagcgtgttcaagcccaccagagacgacagaggctggttcgtgacccccctgggccccaacccctggtggaccgtgatcgccgccatcatccccgccctgctgtgcaccatcctgatcttcatggaccagcagatcaccgccgtgatcatcaacagaaaggagcacaagctgaagaagggctgcggctaccacctggacctgctgatggtggccgtgatgctgggcgtgtgcagcatcatgggcctgccctggttcgtggccgccaccgtgctgagcatcacccacgtgaacagcctgaagctggagagcgagtgcagcgcccccggcgagcagcccaagttcctgggcatcagagagcagagagtgaccggcctgatgatcttcatcctgatgggcagcagcgtgttcatgaccagcatcctgaagttcatccccatgcccgtgctgtacggcgtgttcctgtacatgggcgccagcagcctgaagggcatccagttcttcgacagaatcaagctgttctggatgcccgccaagcaccagcccgacttcatctacctgagacacgtgcccctgagaaaggtgcacctgttcaccatcatccagatgagctgcctgggcctgctgtggatcatcaaggtgagcagagccgccatcgtgttccccatgatggtgctggccctggtgttcgtgagaaagctgatggacctgctgttcaccaagagagagctgagctggctggacgacctgatgcccgagagcaagaagaagaagctggaggacgccgagaaggaggaggagcagagcatgctggccatggaggacgagggcaccgtgcagctgcccctggagggccactacagagacgaccccagcgtgatcaacatcagcgacgagatgagcaagaccgccctgtggagaaacctgctgatcaccgccgacaacagcaaggacaaggagagcagcttccccagcaagagcatcgagagcagaaaggagaagaaggccgacagcggcaagggcgtggacagagagacctgcctgtag

SEQ ID NO: 100037 - DNA, 3300 bp, Artificial Sequence
  Description of Artificial Sequence: Synthetic coding sequence
atgcagagcctgggcgtgagcggcaacagaaaggtgatgcagagcggcacctgcgagcccttccagagcctgagccaccagagaaacgacgaggaggccgtggtggacagaggcggcaccagaagcatcctgaagacccacttcgagaaggaggacctggagggccacagaaccctgttcatcggcgtgcacgtgcccctgggcggcagaaagagccacagaagacacagacacagaggccacaagcacagaaagagagacagagagagagacagcggcctggaggacggcagagagagccccagcttcgacacccccagccagagagtgcagttcatcctgggcaccgaggacgacgacgaggagcacatcccccacgacctgttcaccgagctggacgagatctgctggagagagggcgaggacgccgagtggagagagaccgccagatggctgaagttcgaggaggacgtggaggacggcggcgagagatggagcaagccctacgtggccaccctgagcctgcacagcctgttcgagctgagaagctgcatcctgaacggcaccgtgctgctggacatgcacgccaacaccctggaggagatcgccgacatggtgctggaccagcaggtgagcagcggccagctgaacgaggacgtgagacacagagtgcacgaggccctgatgaagcagcaccaccaccagaaccagaagaagctgaccaacagaatccccatcgtgagaagcttcgccgacatcggcaagaagcagagcgagcccaacagcatggacaagaacgccggccaggtggtgagcccccagagcgcccccgcctgcgtggagaacaagaacgacgtgagcagagagaacagcaccgtggacttcagcaaggtggacctgcacttcatgaagaagatcccccccggcgccgaggccagcaacatcctggtgggcgagctggagttcctggacagaaccgtggtggccttcgtgagactgagccccgccgtgctgctgcagggcctggccgaggtgcccatccccaccagattcctgttcatcctgctgggccccctgggcaagggccagcagtaccacgagatcggcagaagcatcgccaccctgatgaccgacgaggtgttccacgacgtggcctacaaggccaaggacagaaacgacctggtgagcggcatcgacgagttcctggaccaggtgaccgtgctgccccccggcgagtgggaccccagcatcagaatcgagccccccaagaacgtgcccagccaggagaagagaaagatccccgccgtgcccaacggcaccgccgcccacggcgaggccgagccccacggcggccacagcggccccgagctgcagagaaccggcagaatcttcggcggcctgatcctggacatcaagagaaaggccccctacttctggagcgacttcagagacgccttcagcctgcagtgcctggccagcttcctgttcctgtactgcgcctgcatgagccccgtgatcaccttcggcggcctgctgggcgaggccaccgagggcagaatcagcgccatcgagagcctgttcggcgccagcatgaccggcatcgcctacagcctgttcggcggccagcccctgaccatcctgggcagcaccggccccgtgctggtgttcgagaagatcctgttcaagttctgcaaggagtacggcctgagctacctgagcctgagagccagcatcggcctgtggaccgccaccctgtgcatcatcctggtggccaccgacgccagcagcctggtgtgctacatcaccagattcaccgaggaggccttcgccagcctgatctgcatcatcttcatctacgaggccctggagaagctgttcgagctgagcgaggcctaccccatcaacatgcacaacgacctggagctgctgacccagtacagctgcaactgcgtggagccccacaaccccagcaacggcaccctgaaggagtggagagagagcaacatcagcgccagcgacatcatctgggagaacctgaccgtgagcgagtgcaagagcctgcacggcgagtacgtgggcagagcctgcggccacgaccacccctacgtgcccgacgtgctgttctggagcgtgatcctgttcttcagcaccgtgaccctgagcgccaccctgaagcagttcaagaccagcagatacttccccaccaaggtgagaagcatcgtgagcgacttcgccgtgttcctgaccatcctgtgcatggtgctgatcgactacgccatcggcatccccagccccaagctgcaggtgcccagcgtgttcaagcccaccagagacgacagaggctggttcgtgacccccctgggccccaacccctggtggaccgtgatcgccgccatcatccccgccctgctgtgcaccatcctgatcttcatggaccagcagatcaccgccgtgatcatcaacagaaaggagcacaagctgaagaagggctgcggctaccacctggacctgctgatggtggccgtgatgctgggcgtgtgcagcatcatgggcctgccctggttcgtggccgccaccgtgctgagcatcacccacgtgaacagcctgaagctggagagcgagtgcagcgcccccggcgagcagcccaagttcctgggcatcagagagcagagagtgaccggcctgatgatcttcatcctgatgggcagcagcgtgttcatgaccagcatcctgaagttcatccccatgcccgtgctgtacggcgtgttcctgtacatgggcgccagcagcctgaagggcatccagttcttcgacagaatcaagctgttctggatgcccgccaagcaccagcccgacttcatctacctgagacacgtgcccctgagaaaggtgcacctgttcaccatcatccagatgagctgcctgggcctgctgtggatcatcaaggtgagcagagccgccatcgtgttccccatgatggtgctggccctggtgttcgtgagaaagctgatggacctgctgttcaccaagagagagctgagctggctggacgacctgatgcccgagagcaagaagaagaagctggaggacgccgagaaggaggaggagcagagcatgctggccatggaggacgagggcaccgtgcagctgcccctggagggccactacagagacgaccccagcgtgatcaacatcagcgacgagatgagcaagaccgccctgtggagaaacctgctgatcaccgccgacaacagcaaggacaaggagagcagcttccccagcaagagcagccccagctag

SEQ ID NO: 100038 - DNA, 3354 bp, Artificial Sequence
  Description of Artificial Sequence: Synthetic coding sequence
atggagatcaaggaccagggcgcccagatggagcccctgctgcccaccagaaacgacgaggaggccgtggtggacagaggcggcaccagaagcatcctgaagacccacttcgagaaggaggacctggagggccacagaaccctgttcatcggcgtgcacgtgcccctgggcggcagaaagagccacagaagacacagacacagaggccacaagcacagaaagagagacagagagagagacagcggcctggaggacggcagagagagccccagcttcgacacccccagccagagagtgcagttcatcctgggcaccgaggacgacgacgaggagcacatcccccacgacctgttcaccgagctggacgagatctgctggagagagggcgaggacgccgagtggagagagaccgccagatggctgaagttcgaggaggacgtggaggacggcggcgagagatggagcaagccctacgtggccaccctgagcctgcacagcctgttcgagctgagaagctgcatcctgaacggcaccgtgctgctggacatgcacgccaacaccctggaggagatcgccgacatggtgctggaccagcaggtgagcagcggccagctgaacgaggacgtgagacacagagtgcacgaggccctgatgaagcagcaccaccaccagaaccagaagaagctgaccaacagaatccccatcgtgagaagcttcgccgacatcggcaagaagcagagcgagcccaacagcatggacaagaacggccaggtggtgagcccccagagcgcccccgcctgcgtggagaacaagaacgacgtgagcagagagaacagcaccgtggacttcagcaagggcctgggcggccagcagaagggccacaccagcccctgcggcatgaagcagagacacgagaagggccccccccaccagcaggagagagaggtggacctgcacttcatgaagaagatcccccccggcgccgaggccagcaacatcctggtgggcgagctggagttcctggacagaaccgtggtggccttcgtgagactgagccccgccgtgctgctgcagggcctggccgaggtgcccatccccaccagattcctgttcatcctgctgggccccctgggcaagggccagcagtaccacgagatcggcagaagcatcgccaccctgatgaccgacgaggtgttccacgacgtggcctacaaggccaaggacagaaacgacctggtgagcggcatcgacgagttcctggaccaggtgaccgtgctgccccccggcgagtgggaccccagcatcagaatcgagccccccaagaacgtgcccagccaggagaagagaaagatccccgccgtgcccaacggcaccgccgcccacggcgaggccgagccccacggcggccacagcggccccgagctgcagagaaccggcagaatcttcggcggcctgatcctggacatcaagagaaaggccccctacttctggagcgacttcagagacgccttcagcctgcagtgcctggccagcttcctgttcctgtactgcgcctgcatgagccccgtgatcaccttcggcggcctgctgggcgaggccaccgagggcagaatcagcgccatcgagagcctgttcggcgccagcatgaccggcatcgcctacagcctgttcggcggccagcccctgaccatcctgggcagcaccggccccgtgctggtgttcgagaagatcctgttcaagttctgcaaggagtacggcctgagctacctgagcctgagagccagcatcggcctgtggaccgccaccctgtgcatcatcctggtggccaccgacgccagcagcctggtgtgctacatcaccagattcaccgaggaggccttcgccagcctgatctgcatcatcttcatctacgaggccctggagaagctgttcgagctgagcgaggcctaccccatcaacatgcacaacgacctggagctgctgacccagtacagctgcaactgcgtggagccccacaaccccagcaacggcaccctgaaggagtggagagagagcaacatcagcgccagcgacatcatctgggagaacctgaccgtgagcgagtgcaagagcctgcacggcgagtacgtgggcagagcctgcggccacgaccacccctacgtgcccgacgtgctgttctggagcgtgatcctgttcttcagcaccgtgaccctgagcgccaccctgaagcagttcaagaccagcagatacttccccaccaaggtgagaagcatcgtgagcgacttcgccgtgttcctgaccatcctgtgcatggtgctgatcgactacgccatcggcatccccagccccaagctgcaggtgcccagcgtgttcaagcccaccagagacgacagaggctggttcgtgacccccctgggccccaacccctggtggaccgtgatcgccgccatcatccccgccctgctgtgcaccatcctgatcttcatggaccagcagatcaccgccgtgatcatcaacagaaaggagcacaagctgaagaagggctgcggctaccacctggacctgctgatggtggccgtgatgctgggcgtgtgcagcatcatgggcctgccctggttcgtggccgccaccgtgctgagcatcacccacgtgaacagcctgaagctggagagcgagtgcagcgcccccggcgagcagcccaagttcctgggcatcagagagcagagagtgaccggcctgatgatcttcatcctgatgggcagcagcgtgttcatgaccagcatcctgaagttcatccccatgcccgtgctgtacggcgtgttcctgtacatgggcgccagcagcctgaagggcatccagttcttcgacagaatcaagctgttctggatgcccgccaagcaccagcccgacttcatctacctgagacacgtgcccctgagaaaggtgcacctgttcaccatcatccagatgagctgcctgggcctgctgtggatcatcaaggtgagcagagccgccatcgtgttccccatgatggtgctggccctggtgttcgtgagaaagctgatggacctgctgttcaccaagagagagctgagctggctggacgacctgatgcccgagagcaagaagaagaagctggaggacgccgagaaggaggaggagcagagcatgctggccatggaggacgagggcaccgtgcagctgcccctggagggccactacagagacgaccccagcgtgatcaacatcagcgacgagatgagcaagaccgccctgtggagaaacctgctgatcaccgccgacaacagcaaggacaaggagagcagcttccccagcaagagcagccccagctag

SEQ ID NO: 100039 - DNA, 3267 bp, Artificial Sequence
  Description of Artificial Sequence: Synthetic coding sequence
atggagatcaaggaccagggcgcccagatggagcccctgctgcccaccagaaacgacgaggaggccgtggtggacagaggcggcaccagaagcatcctgaagacccacttcgagaaggaggacctggagggccacagaaccctgttcatcggcgtgcacgtgcccctgggcggcagaaagagccacagaagacacagacacagaggccacaagcacagaaagagagacagagagagagacagcggcctggaggacggcagagagagccccagcttcgacacccccagccagagagtgcagttcatcctgggcaccgaggacgacgacgaggagcacatcccccacgacctgttcaccgagctggacgagatctgctggagagagggcgaggacgccgagtggagagagaccgccagatggctgaagttcgaggaggacgtggaggacggcggcgagagatggagcaagccctacgtggccaccctgagcctgcacagcctgttcgagctgagaagctgcatcctgaacggcaccgtgctgctggacatgcacgccaacaccctggaggagatcgccgacatggtgctggaccagcaggtgagcagcggccagctgaacgaggacgtgagacacagagtgcacgaggccctgatgaagcagcaccaccaccagaaccagaagaagctgaccaacagaatccccatcgtgagaagcttcgccgacatcggcaagaagcagagcgagcccaacagcatggacaagaacgccggccaggtggtgagcccccagagcgcccccgcctgcgtggagaacaagaacgacgtgagcagagagaacagcaccgtggacttcagcaaggtggacctgcacttcatgaagaagatcccccccggcgccgaggccagcaacatcctggtgggcgagctggagttcctggacagaaccgtggtggccttcgtgagactgagccccgccgtgctgctgcagggcctggccgaggtgcccatccccaccagattcctgttcatcctgctgggccccctgggcaagggccagcagtaccacgagatcggcagaagcatcgccaccctgatgaccgacgaggtgttccacgacgtggcctacaaggccaaggacagaaacgacctggtgagcggcatcgacgagttcctggaccaggtgaccgtgctgccccccggcgagtgggaccccagcatcagaatcgagccccccaagaacgtgcccagccaggagaagagaaagatccccgccgtgcccaacggcaccgccgcccacggcgaggccgagccccacggcggccacagcggccccgagctgcagagaaccggcagaatcttcggcggcctgatcctggacatcaagagaaaggccccctacttctggagcgacttcagagacgccttcagcctgcagtgcctggccagcttcctgttcctgtactgcgcctgcatgagccccgtgatcaccttcggcggcctgctgggcgaggccaccgagggcagaatcagcgccatcgagagcctgttcggcgccagcatgaccggcatcgcctacagcctgttcggcggccagcccctgaccatcctgggcagcaccggccccgtgctggtgttcgagaagatcctgttcaagttctgcaaggagtacggcctgagctacctgagcctgagagccagcatcggcctgtggaccgccaccctgtgcatcatcctggtggccaccgacgccagcagcctggtgtgctacatcaccagattcaccgaggaggccttcgccagcctgatctgcatcatcttcatctacgaggccctggagaagctgttcgagctgagcgaggcctaccccatcaacatgcacaacgacctggagctgctgacccagtacagctgcaactgcgtggagccccacaaccccagcaacggcaccctgaaggagtggagagagagcaacatcagcgccagcgacatcatctgggagaacctgaccgtgagcgagtgcaagagcctgcacggcgagtacgtgggcagagcctgcggccacgaccacccctacgtgcccgacgtgctgttctggagcgtgatcctgttcttcagcaccgtgaccctgagcgccaccctgaagcagttcaagaccagcagatacttccccaccaaggtgagaagcatcgtgagcgacttcgccgtgttcctgaccatcctgtgcatggtgctgatcgactacgccatcggcatccccagccccaagctgcaggtgcccagcgtgttcaagcccaccagagacgacagaggctggttcgtgacccccctgggccccaacccctggtggaccgtgatcgccgccatcatccccgccctgctgtgcaccatcctgatcttcatggaccagcagatcaccgccgtgatcatcaacagaaaggagcacaagctgaagaagggctgcggctaccacctggacctgctgatggtggccgtgatgctgggcgtgtgcagcatcatgggcctgccctggttcgtggccgccaccgtgctgagcatcacccacgtgaacagcctgaagctggagagcgagtgcagcgcccccggcgagcagcccaagttcctgggcatcagagagcagagagtgaccggcctgatgatcttcatcctgatgggcagcagcgtgttcatgaccagcatcctgaagttcatccccatgcccgtgctgtacggcgtgttcctgtacatgggcgccagcagcctgaagggcatccagttcttcgacagaatcaagctgttctggatgcccgccaagcaccagcccgacttcatctacctgagacacgtgcccctgagaaaggtgcacctgttcaccatcatccagatgagctgcctgggcctgctgtggatcatcaaggtgagcagagccgccatcgtgttccccatgatggtgctggccctggtgttcgtgagaaagctgatggacctgctgttcaccaagagagagctgagctggctggacgacctgatgcccgagagcaagaagaagaagctggaggacgccgagaaggaggaggagcagagcatgctggccatggaggacgagggcaccgtgcagctgcccctggagggccactacagagacgaccccagcgtgatcaacatcagcgacgagatgagcaagaccgccctgtggagaaacctgctgatcaccgccgacaacagcaaggacaaggagagcagcttccccagcaagagcagccccagctag

SEQ ID NO: 100040 - DNA, 3165 bp, Artificial Sequence
  Description of Artificial Sequence: Synthetic coding sequence
atggagatcaaggaccagggcgcccagatggagcccctgctgcccaccagaaacgacgaggaggccgtggtggacagaggcggcaccagaagcatcctgaagacccacttcgagaaggaggacctggagggccacagaaccctgttcatcggcgtgcacgtgcccctgggcggcagaaagagccacagaagacacagacacagaggccacaagcacagaaagagagacagagagagagacagcggcctggaggacggcagagagagccccagcttcgacacccccagccagagagtgcagttcatcctgggcaccgaggacgacgacgaggagcacatcccccacgacctgttcaccgagctggacgagatctgctggagagagggcgaggacgccgagtggagagagaccgccagatggctgaagttcgaggaggacgtggaggacggcggcgagagatggagcaagccctacgtggccaccctgagcctgcacagcctgttcgagctgagaagctgcatcctgaacggcaccgtgctgctggacatgcacgccaacaccctggaggagatcgccgacatggtgctggaccagcaggtgagcagcggccagctgaacgaggacgtgagacacagagtgcacgaggccctgatgaagcagcaccaccaccagaaccagaagaagctgaccaacagaatccccatcgtgagaagcttcgccgacatcggcaagaagcagagcgagcccaacagcatggacaagaacgccggccaggtggtgagcccccagagcgcccccgcctgcgtggagaacaagaacgacgtgagcagagagaacagcaccgtggacttcagcaagggcctgggcggccagcagaagggccacaccagcccctgcggcatgaagcagagacacgagaagggccccccccaccagcaggagagagaggtggacctgcacttcatgaagaagatcccccccggcgccgaggccagcaacatcctggtgggcgagctggagttcctggacagaaccgtggtggccttcgtgagactgagccccgccgtgctgctgcagggcctggccgaggtgcccatccccaccagattcctgttcatcctgctgggccccctgggcaagggccagcagtaccacgagatcggcagaagcatcgccaccctgatgaccgacgaggtgttccacgacgtggcctacaaggccaaggacagaaacgacctggtgagcggcatcgacgagttcctggaccaggtgaccgtgctgccccccggcgagtgggaccccagcatcagaatcgagccccccaagaacgtgcccagccaggagaagagaaagatccccgccgtgcccaacggcaccgccgcccacggcgaggccgagccccacggcggccacagcggccccgagctgcagagaaccggcagaatcttcggcggcctgatcctggacatcaagagaaaggccccctacttctggagcgacttcagagacgccttcagcctgcagtgcctggccagcttcctgttcctgtactgcgcctgcatgagccccgtgatcaccttcggcggcctgctgggcgaggccaccgagggcagaatcagcgccatcgagagcctgttcggcgccagcatgaccggcatcgcctacagcctgttcggcggccagcccctgaccatcctgggcagcaccggccccgtgctggtgttcgagaagatcctgttcaagttctgcaaggagtacggcctgagctacctgagcctgagagccagcatcggcctgtggaccgccaccctgtgcatcatcctggtggccaccgacgccagcagcctggtgtgctacatcaccagattcaccgaggaggccttcgccagcctgatctgcatcatcttcatctacgaggccctggagaagctgttcgagctgagcgaggcctaccccatcaacatgcacaacgacctggagctgctgacccagtacagctgcaactgcgtggagccccacaaccccagcaacggcaccctgaaggagtggagagagagcaacatcagcgccagcgacatcatctgggagaacctgaccgtgagcgagtgcaagagcctgcacggcgagtacgtgggcagagcctgcggccacgaccacccctacgtgcccgacgtgctgttctggagcgtgatcctgttcttcagcaccgtgaccctgagcgccaccctgaagcagttcaagaccagcagatacttccccaccaaggtgagaagcatcgtgagcgacttcgccgtgttcctgaccatcctgtgcatggtgctgatcgactacgccatcggcatccccagccccaagctgcaggtgcccagcgtgttcaagcccaccagagacgacagaggctggttcgtgacccccctgggccccaacccctggtggaccgtgatcgccgccatcatccccgccctgctgtgcaccatcctgatcttcatggaccagcagatcaccgccgtgatcatcaacagaaaggagcacaagctgaagaagggctgcggctaccacctggacctgctgatggtggccgtgatgctgggcgtgtgcagcatcatgggcctgccctggttcgtggccgccaccgtgctgagcatcacccacgtgaacagcctgaagctggagagcgagtgcagcgcccccggcgagcagcccaagttcctgggcatcagagagcagagagtgaccggcctgatgatcttcatcctgatgggcagcagcgtgttcatgaccagcatcctgaagttcatccccatgcccgtgctgtacggcgtgttcctgtacatgggcgccagcagcctgaagggcatccagttcttcgacagaatcaagctgttctggatgcccgccaagcaccagcccgacttcatctacctgagacacgtgcccctgagaaaggtgcacctgttcaccatcatccagatgagctgcctgggcctgctgtggatcatcaaggtgagcagagccgccatcgtgttccccatgatggtgctggccctggtgttcgtgagaaagctgatggacctgctgttcaccaagagagagctgagctggctggacgacctgatgcccgagagcaagaagaagaagctggaggacgccgagaaggagcactag

SEQ ID NO: 100041 - DNA, 3357 bp, Artificial Sequence
  Description of Artificial Sequence: Synthetic coding sequence
atggagatcaaggaccagggcgcccagatggagcccctgctgcccaccagaaacgacgaggaggccgtggtggacagaggcggcaccagaagcatcctgaagacccacttcgagaaggaggacctggagggccacagaaccctgttcatcggcgtgcacgtgcccctgggcggcagaaagagccacagaagacacagacacagaggccacaagcacagaaagagagacagagagagagacagcggcctggaggacggcagagagagccccagcttcgacacccccagccagagagtgcagttcatcctgggcaccgaggacgacgacgaggagcacatcccccacgacctgttcaccgagctggacgagatctgctggagagagggcgaggacgccgagtggagagagaccgccagatggctgaagttcgaggaggacgtggaggacggcggcgagagatggagcaagccctacgtggccaccctgagcctgcacagcctgttcgagctgagaagctgcatcctgaacggcaccgtgctgctggacatgcacgccaacaccctggaggagatcgccgacatggtgctggaccagcaggtgagcagcggccagctgaacgaggacgtgagacacagagtgcacgaggccctgatgaagcagcaccaccaccagaaccagaagaagctgaccaacagaatccccatcgtgagaagcttcgccgacatcggcaagaagcagagcgagcccaacagcatggacaagaacgccggccaggtggtgagcccccagagcgcccccgcctgcgtggagaacaagaacgacgtgagcagagagaacagcaccgtggacttcagcaagggcctgggcggccagcagaagggccacaccagcccctgcggcatgaagcagagacacgagaagggccccccccaccagcaggagagagaggtggacctgcacttcatgaagaagatcccccccggcgccgaggccagcaacatcctggtgggcgagctggagttcctggacagaaccgtggtggccttcgtgagactgagccccgccgtgctgctgcagggcctggccgaggtgcccatccccaccagattcctgttcatcctgctgggccccctgggcaagggccagcagtaccacgagatcggcagaagcatcgccaccctgatgaccgacgaggtgttccacgacgtggcctacaaggccaaggacagaaacgacctggtgagcggcatcgacgagttcctggaccaggtgaccgtgctgccccccggcgagtgggaccccagcatcagaatcgagccccccaagaacgtgcccagccaggagaagagaaagatccccgccgtgcccaacggcaccgccgcccacggcgaggccgagccccacggcggccacagcggccccgagctgcagagaaccggcagaatcttcggcggcctgatcctggacatcaagagaaaggccccctacttctggagcgacttcagagacgccttcagcctgcagtgcctggccagcttcctgttcctgtactgcgcctgcatgagccccgtgatcaccttcggcggcctgctgggcgaggccaccgagggcagaatcagcgccatcgagagcctgttcggcgccagcatgaccggcatcgcctacagcctgttcggcggccagcccctgaccatcctgggcagcaccggccccgtgctggtgttcgagaagatcctgttcaagttctgcaaggagtacggcctgagctacctgagcctgagagccagcatcggcctgtggaccgccaccctgtgcatcatcctggtggccaccgacgccagcagcctggtgtgctacatcaccagattcaccgaggaggccttcgccagcctgatctgcatcatcttcatctacgaggccctggagaagctgttcgagctgagcgaggcctaccccatcaacatgcacaacgacctggagctgctgacccagtacagctgcaactgcgtggagccccacaaccccagcaacggcaccctgaaggagtggagagagagcaacatcagcgccagcgacatcatctgggagaacctgaccgtgagcgagtgcaagagcctgcacggcgagtacgtgggcagagcctgcggccacgaccacccctacgtgcccgacgtgctgttctggagcgtgatcctgttcttcagcaccgtgaccctgagcgccaccctgaagcagttcaagaccagcagatacttccccaccaaggtgagaagcatcgtgagcgacttcgccgtgttcctgaccatcctgtgcatggtgctgatcgactacgccatcggcatccccagccccaagctgcaggtgcccagcgtgttcaagcccaccagagacgacagaggctggttcgtgacccccctgggccccaacccctggtggaccgtgatcgccgccatcatccccgccctgctgtgcaccatcctgatcttcatggaccagcagatcaccgccgtgatcatcaacagaaaggagcacaagctgaagaagggctgcggctaccacctggacctgctgatggtggccgtgatgctgggcgtgtgcagcatcatgggcctgccctggttcgtggccgccaccgtgctgagcatcacccacgtgaacagcctgaagctggagagcgagtgcagcgcccccggcgagcagcccaagttcctgggcatcagagagcagagagtgaccggcctgatgatcttcatcctgatgggcagcagcgtgttcatgaccagcatcctgaagttcatccccatgcccgtgctgtacggcgtgttcctgtacatgggcgccagcagcctgaagggcatccagttcttcgacagaatcaagctgttctggatgcccgccaagcaccagcccgacttcatctacctgagacacgtgcccctgagaaaggtgcacctgttcaccatcatccagatgagctgcctgggcctgctgtggatcatcaaggtgagcagagccgccatcgtgttccccatgatggtgctggccctggtgttcgtgagaaagctgatggacctgctgttcaccaagagagagctgagctggctggacgacctgatgcccgagagcaagaagaagaagctggaggacgccgagaaggaggaggagcagagcatgctggccatggaggacgagggcaccgtgcagctgcccctggagggccactacagagacgaccccagcgtgatcaacatcagcgacgagatgagcaagaccgccctgtggagaaacctgctgatcaccgccgacaacagcaaggacaaggagagcagcttccccagcaagagcagccccagctag

SEQ ID NO: 100042 - DNA, 3318 bp, Artificial Sequence
  Description of Artificial Sequence: Synthetic coding sequence
atggagatcaaggaccagggcgcccagatggagcccctgctgcccaccagaaacgacgaggaggccgtggtggacagaggcggcaccagaagcatcctgaagacccacttcgagaaggaggacctggagggccacagaaccctgttcatcggcgtgcacgtgcccctgggcggcagaaagagccacagaagacacagacacagaggccacaagcacagaaagagagacagagagagagacagcggcctggaggacggcagagagagccccagcttcgacacccccagccagagagtgcagttcatcctgggcaccgaggacgacgacgaggagcacatcccccacgacctgttcaccgagctggacgagatctgctggagagagggcgaggacgccgagtggagagagaccgccagatggctgaagttcgaggaggacgtggaggacggcggcgagagatggagcaagccctacgtggccaccctgagcctgcacagcctgttcgagctgagaagctgcatcctgaacggcaccgtgctgctggacatgcacgccaacaccctggaggagatcgccgacatggtgctggaccagcaggtgagcagcggccagctgaacgaggacgtgagacacagagtgcacgaggccctgatgaagcagcaccaccaccagaaccagaagaagctgaccaacagaatccccatcgtgagaagcttcgccgacatcggcaagaagcagagcgagcccaacagcatggacaagaacggccaggtggtgagcccccagagcgcccccgcctgcgtggagaacaagaacgacgtgagcagagagaacagcaccgtggacttcagcaaggtggacctgcacttcatgaagaagatcccccccggcgccgaggccagcaacatcctggtgggcgagctggagttcctggacagaaccgtggtggccttcgtgagactgagccccgccgtgctgctgcagggcctggccgaggtgcccatccccaccagattcctgttcatcctgctgggccccctgggcaagggccagcagtaccacgagatcggcagaagcatcgccaccctgatgaccgacgaggtgttccacgacgtggcctacaaggccaaggacagaaacgacctggtgagcggcatcgacgagttcctggaccaggtgaccgtgctgccccccggcgagtgggaccccagcatcagaatcgagccccccaagaacgtgcccagccaggagaagagaaagatccccgccgtgcccaacggcaccgccgcccacggcgaggccgagccccacggcggccacagcggccccgagctgcagagaaccggcagaatcttcggcggcctgatcctggacatcaagagaaaggccccctacttctggagcgacttcagagacgccttcagcctgcagtgcctggccagcttcctgttcctgtactgcgcctgcatgagccccgtgatcaccttcggcggcctgctgggcgaggccaccgagggcagaatcagcgccatcgagagcctgttcggcgccagcatgaccggcatcgcctacagcctgttcggcggccagcccctgaccatcctgggcagcaccggccccgtgctggtgttcgagaagatcctgttcaagttctgcaaggagtacggcctgagctacctgagcctgagagccagcatcggcctgtggaccgccaccctgtgcatcatcctggtggccaccgacgccagcagcctggtgtgctacatcaccagattcaccgaggaggccttcgccagcctgatctgcatcatcttcatctacgaggccctggagaagctgttcgagctgagcgaggcctaccccatcaacatgcacaacgacctggagctgctgacccagtacagctgcaactgcgtggagccccacaaccccagcaacggcaccctgaaggagtggagagagagcaacatcagcgccagcgacatcatctgggagaacctgaccgtgagcgagtgcaagagcctgcacggcgagtacgtgggcagagcctgcggccacgaccacccctacgtgcccgacgtgctgttctggagcgtgatcctgttcttcagcaccgtgaccctgagcgccaccctgaagcagttcaagaccagcagatacttccccaccaaggtgagaagcatcgtgagcgacttcgccgtgttcctgaccatcctgtgcatggtgctgatcgactacgccatcggcatccccagccccaagctgcaggtgcccagcgtgttcaagcccaccagagacgacagaggctggttcgtgacccccctgggccccaacccctggtggaccgtgatcgccgccatcatccccgccctgctgtgcaccatcctgatcttcatggaccagcagatcaccgccgtgatcatcaacagaaaggagcacaagctgaagaagggctgcggctaccacctggacctgctgatggtggccgtgatgctgggcgtgtgcagcatcatgggcctgccctggttcgtggccgccaccgtgctgagcatcacccacgtgaacagcctgaagctggagagcgagtgcagcgcccccggcgagcagcccaagttcctgggcatcagagagcagagagtgaccggcctgatgatcttcatcctgatgggcagcagcgtgttcatgaccagcatcctgaagttcatccccatgcccgtgctgtacggcgtgttcctgtacatgggcgccagcagcctgaagggcatccagttcttcgacagaatcaagctgttctggatgcccgccaagcaccagcccgacttcatctacctgagacacgtgcccctgagaaaggtgcacctgttcaccatcatccagatgagctgcctgggcctgctgtggatcatcaaggtgagcagagccgccatcgtgttccccatgatggtgctggccctggtgttcgtgagaaagctgatggacctgctgttcaccaagagagagctgagctggctggacgacctgatgcccgagagcaagaagaagaagctggaggacgccgagaaggaggaggagcagagcatgctggccatggaggacgagggcaccgtgcagctgcccctggagggccactacagagacgaccccagcgtgatcaacatcagcgacgagatgagcaagaccgccctgtggagaaacctgctgatcaccgccgacaacagcaaggacaaggagagcagcttccccagcaagagcatcgagagcagaaaggagaagaaggccgacagcggcaagggcgtggacagagagacctgcctgtag

SEQ ID NO: 100043 - DNA, 1227 bp, Artificial Sequence
  Description of Artificial Sequence: Synthetic coding sequence
atggagatcaaggaccagggcgcccagatggagcccctgctgcccaccagaaacgacgaggaggccgtggtggacagaggcggcaccagaagcatcctgaagacccacttcgagaaggaggacctggagggccacagaaccctgttcatcggcgtgcacgtgcccctgggcggcagaaagagccacagaagacacagacacagaggccacaagcacagaaagagagacagagagagagacagcggcctggaggacggcagagagagccccagcttcgacacccccagccagagagtgcagttcatcctgggcaccgaggacgacgacgaggagcacatcccccacgacctgttcaccgagctggacgagatctgctggagagagggcgaggacgccgagtggagagagaccgccagatggctgaagttcgaggaggacgtggaggacggcggcgagagatggagcaagccctacgtggccaccctgagcctgcacagcctgttcgagctgagaagctgcatcctgaacggcaccgtgctgctggacatgcacgccaacaccctggaggagatcgccgacatggtgctggaccagcaggtgagcagcggccagctgaacgaggacgtgagacacagagtgcacgaggccctgatgaagcagcaccaccaccagaaccagaagaagctgaccaacagaatccccatcgtgagaagcttcgccgacatcggcaagaagcagagcgagcccaacagcatggacaagaacgccggccaggtggtgagcccccagagcgcccccgcctgcgtggagaacaagaacgacgtgagcagagagaacagcaccgtggacttcagcaagggcctgggcggccagcagaagggccacaccagcccctgcggcatgaagcagagacacgagaagggccccccccaccagcaggagagagaggtggacctgcacttcatgaagaagatcccccccggcgccgaggccagcaacatcctggtgggcgagctggagttcctggacagaaccgtggtggccttcgtgagactgagccccgccgtgctgctgcagggcctggccgaggtgcccatccccaccagatacttcatgatgctgcccatcaagctgaagatcgtgatgacctggtaccaggagctgatgagcttctggatcagactgctgttcagcctgctggagaacggcatccaggccttcgagtag

SEQ ID NO: 100044 - DNA, 2676 bp, Artificial Sequence
  Description of Artificial Sequence: Synthetic coding sequence
atgagccaggtgggcggcagaggcgacagatgcacccaggaggtgcagggcctggtgcacggcgccggcgacctgagcgccagcctggccgagaacagccccaccatgagccagaacggctacttcgaggacagcagctactacaagtgcgacaccgacgacaccttcgaggccagagaggagatcctgggcgacgaggccttcgacaccgccaacagcagcatcgtgagcggcgagagcatcagattcttcgtgaacgtgaacctggagatgcaggccaccaacaccgagaacgaggccaccagcggcggctgcgtgctgctgcacaccagcagaaagtacctgaagctgaagaacttcaaggaggagatcagagcccacagagacctggacggcttcctggcccaggccagcatcgtgctgaacgagaccgccaccagcctggacaacgtgctgagaaccatgctgagaagattcgccagagaccccgacaacaacgagcccaactgcaacctggacctgctgatggccatgctgttcaccgacgccggcgcccccatgagaggcaaggtgcacctgctgagcgacaccatccagggcgtgaccgccaccgtgaccggcgtgagataccagcagagctggctgtgcatcatctgcaccatgaaggccctgcagaagagacacgtgtgcatcagcagactggtgagaccccagaactggggcgagaacagctgcgaggtgagattcgtgatcctggtgctggccccccccaagatgaagagcaccaagaccgccatggaggtggccagaaccttcgccaccatgttcagcgacatcgccttcagacagaagctgctggagaccagaaccgaggaggagttcaaggaggccctggtgcaccagagacagctgctgaccatggtgagccacggccccgtggcccccagaaccaaggagagaagcaccgtgagcctgcccgcccacagacaccccgagccccccaagtgcaaggacttcgtgcccttcggcaagggcatcagagaggacatcgccagaagattccccctgtaccccctggacttcaccgacggcatcatcggcaagaacaaggccgtgggcaagtacatcaccaccaccctgttcctgtacttcgcctgcctgctgcccaccatcgccttcggcagcctgaacgacgagaacaccgacggcgccatcgacgtgcagaagaccatcgccggccagagcatcggcggcctgctgtacgccctgttcagcggccagcccctggtgatcctgctgaccaccgcccccctggccctgtacatccaggtgatcagagtgatctgcgacgactacgacctggacttcaacagcttctacgcctggaccggcctgtggaacagcttcttcctggccctgtacgccttcttcaacctgagcctggtgatgagcctgttcaagagaagcaccgaggagatcatcgccctgttcatcagcatcaccttcgtgctggacgccgtgaagggcaccgtgaagatcttctggaagtactactacggccactacctggacgactaccacaccaagagaaccagcagcctggtgagcctgagcggcctgggcgccagcctgaacgccagcctgcacaccgccctgaacgccagcttcctggccagccccaccgagctgcccagcgccacccacagcggccaggccaccgccgtgctgagcctgctgatcatgctgggcaccctgtggctgggctacaccctgtaccagttcaagaagagcccctacctgcacccctgcgtgagagagatcctgagcgactgcgccctgcccatcgccgtgctggccttcagcctgatcagcagccacggcttcagagagatcgagatgagcaagttcagatacaaccccagcgagagccccttcgccatggcccagatccagagcctgagcctgagagccgtgagcggcgccatgggcctgggcttcctgctgagcatgctgttcttcatcgagcagaacctggtggccgccctggtgaacgcccccgagaacagactggtgaagggcaccgcctaccactgggacctgctgctgctggccatcatcaacaccggcctgagcctgttcggcctgccctggatccacgccgcctacccccacagccccctgcacgtgagagccctggccctggtggaggagagagtggagaacggccacatctacgacaccatcgtgaacgtgaaggagaccagactgaccagcctgggcgccagcgtgctggtgggcctgagcctgctgctgctgcccgtgcccctgcagtggatccccaagcccgtgctgtacggcctgttcctgtacatcgccctgaccagcctggacggcaaccagctggtgcagagagtggccctgctgctgaaggagcagaccgcctacccccccacccactacatcagaagagtgccccagagaaagatccactacttcaccggcctgcaggtgctgcagctgctgctgctgtgcgccttcggcatgagcagcctgccctacatgaagatgatcttccccctgatcatgatcgccatgatccccatcagatacatcctgctgcccagaatcatcgaggccaagtacctggacgtgatggacgccgagcacagaccctag

SEQ ID NO: 100045 - DNA, 2757 bp, Artificial Sequence
  Description of Artificial Sequence: Synthetic coding sequence
atgggcgtgtacggcccccaggacagaagcgagagcgagaagagagacgtgcagagagacccccccccctggcaccccagaagagagggcgagagacccgccagagccagaagcctgcccctggccgccgccggccagggcttcctgagaaagacctggatcagcgagcacgagaacagccccaccatgagccagaacggctacttcgaggacagcagctactacaagtgcgacaccgacgacaccttcgaggccagagaggagatcctgggcgacgaggccttcgacaccgccaacagcagcatcgtgagcggcgagagcatcagattcttcgtgaacgtgaacctggagatgcaggccaccaacaccgagaacgaggccaccagcggcggctgcgtgctgctgcacaccagcagaaagtacctgaagctgaagaacttcaaggaggagatcagagcccacagagacctggacggcttcctggcccaggccagcatcgtgctgaacgagaccgccaccagcctggacaacgtgctgagaaccatgctgagaagattcgccagagaccccgacaacaacgagcccaactgcaacctggacctgctgatggccatgctgttcaccgacgccggcgcccccatgagaggcaaggtgcacctgctgagcgacaccatccagggcgtgaccgccaccgtgaccggcgtgagataccagcagagctggctgtgcatcatctgcaccatgaaggccctgcagaagagacacgtgtgcatcagcagactggtgagaccccagaactggggcgagaacagctgcgaggtgagattcgtgatcctggtgctggccccccccaagatgaagagcaccaagaccgccatggaggtggccagaaccttcgccaccatgttcagcgacatcgccttcagacagaagctgctggagaccagaaccgaggaggagttcaaggaggccctggtgcaccagagacagctgctgaccatggtgagccacggccccgtggcccccagaaccaaggagagaagcaccgtgagcctgcccgcccacagacaccccgagccccccaagtgcaaggacttcgtgcccttcggcaagggcatcagagaggacatcgccagaagattccccctgtaccccctggacttcaccgacggcatcatcggcaagaacaaggccgtgggcaagtacatcaccaccaccctgttcctgtacttcgcctgcctgctgcccaccatcgccttcggcagcctgaacgacgagaacaccgacggcgccatcgacgtgcagaagaccatcgccggccagagcatcggcggcctgctgtacgccctgttcagcggccagcccctggtgatcctgctgaccaccgcccccctggccctgtacatccaggtgatcagagtgatctgcgacgactacgacctggacttcaacagcttctacgcctggaccggcctgtggaacagcttcttcctggccctgtacgccttcttcaacctgagcctggtgatgagcctgttcaagagaagcaccgaggagatcatcgccctgttcatcagcatcaccttcgtgctggacgccgtgaagggcaccgtgaagatcttctggaagtactactacggccactacctggacgactaccacaccaagagaaccagcagcctggtgagcctgagcggcctgggcgccagcctgaacgccagcctgcacaccgccctgaacgccagcttcctggccagccccaccgagctgcccagcgccacccacagcggccaggccaccgccgtgctgagcctgctgatcatgctgggcaccctgtggctgggctacaccctgtaccagttcaagaagagcccctacctgcacccctgcgtgagagagatcctgagcgactgcgccctgcccatcgccgtgctggccttcagcctgatcagcagccacggcttcagagagatcgagatgagcaagttcagatacaaccccagcgagagccccttcgccatggcccagatccagagcctgagcctgagagccgtgagcggcgccatgggcctgggcttcctgctgagcatgctgttcttcatcgagcagaacctggtggccgccctggtgaacgcccccgagaacagactggtgaagggcaccgcctaccactgggacctgctgctgctggccatcatcaacaccggcctgagcctgttcggcctgccctggatccacgccgcctacccccacagccccctgcacgtgagagccctggccctggtggaggagagagtggagaacggccacatctacgacaccatcgtgaacgtgaaggagaccagactgaccagcctgggcgccagcgtgctggtgggcctgagcctgctgctgctgcccgtgcccctgcagtggatccccaagcccgtgctgtacggcctgttcctgtacatcgccctgaccagcctggacggcaaccagctggtgcagagagtggccctgctgctgaaggagcagaccgcctacccccccacccactacatcagaagagtgccccagagaaagatccactacttcaccggcctgcaggtgctgcagctgctgctgctgtgcgccttcggcatgagcagcctgccctacatgaagatgatcttccccctgatcatgatcgccatgatccccatcagatacatcctgctgcccagaatcatcgaggccaagtacctggacgtgatggacgccgagcacagaccctag

SEQ ID NO: 100046 - DNA, 951 bp, Artificial Sequence
  Description of Artificial Sequence: Synthetic coding sequence
atggccgccgccaccagaagagtgttccacctgcagccctgcgagaacagccccaccatgagccagaacggctacttcgaggacagcagctactacaagtgcgacaccgacgacaccttcgaggccagagaggagatcctgggcgacgaggccttcgacaccgccaacagcagcatcgtgagcggcgagagcatcagattcttcgtgaacgtgaacctggagatgcaggccaccaacaccgagaacgaggccaccagcggcggctgcgtgctgctgcacaccagcagaaagtacctgaagctgaagaacttcaaggaggagatcagagcccacagagacctggacggcttcctggcccaggccagcatcgtgctgaacgagaccgccaccagcctggacaacgtgctgagaaccatgctgagaagattcgccagagaccccgacaacaacgagcccaactgcaacctggacctgctgatggccatgctgttcaccgacgccggcgcccccatgagaggcaaggtgcacctgctgagcgacaccatccagggcgtgaccgccaccgtgaccggcgtgagataccagcagagctggctgtgcatcatctgcaccatgaaggccctgcagaagagacacgtgtgcatcagcagactggtgagaccccagaactggggcgagaacagctgcgaggtgagattcgtgatcctggtgctggccccccccaagatgaagagcaccaagaccgccatggaggtggccagaaccttcgccaccatgttcagcgacatcgccttcagacagaagctgctggagaccagaaccgaggaggagttcaaggaggccctggtgcaccagagacagctgctgaccatggtgagccacggccccgtggcccccagaaccaaggagagaagcaccgtgagcctgcccgcccacagacaccccgagtag

SEQ ID NO: 100047 - DNA, 2628 bp, Artificial Sequence
  Description of Artificial Sequence: Synthetic coding sequence
atggccgccgccaccagaagagtgttccacctgcagccctgcgagaacagccccaccatgagccagaacggctacttcgaggacagcagctactacaagtgcgacaccgacgacaccttcgaggccagagaggagatcctgggcgacgaggccttcgacaccgccaacagcagcatcgtgagcggcgagagcatcagattcttcgtgaacgtgaacctggagatgcaggccaccaacaccgagaacgaggccaccagcggcggctgcgtgctgctgcacaccagcagaaagtacctgaagctgaagaacttcaaggaggagatcagagcccacagagacctggacggcttcctggcccaggccagcatcgtgctgaacgagaccgccaccagcctggacaacgtgctgagaaccatgctgagaagattcgccagagaccccgacaacaacgagcccaactgcaacctggacctgctgatggccatgctgttcaccgacgccggcgcccccatgagaggcaaggtgcacctgctgagcgacaccatccagggcgtgaccgccaccgtgaccggcgtgagataccagcagagctggctgtgcatcatctgcaccatgaaggccctgcagaagagacacgtgtgcatcagcagactggtgagaccccagaactggggcgagaacagctgcgaggtgagattcgtgatcctggtgctggccccccccaagatgaagagcaccaagaccgccatggaggtggccagaaccttcgccaccatgttcagcgacatcgccttcagacagaagctgctggagaccagaaccgaggaggagttcaaggaggccctggtgcaccagagacagctgctgaccatggtgagccacggccccgtggcccccagaaccaaggagagaagcaccgtgagcctgcccgcccacagacaccccgagccccccaagtgcaaggacttcgtgcccttcggcaagggcatcagagaggacatcgccagaagattccccctgtaccccctggacttcaccgacggcatcatcggcaagaacaaggccgtgggcaagtacatcaccaccaccctgttcctgtacttcgcctgcctgctgcccaccatcgccttcggcagcctgaacgacgagaacaccgacggcgccatcgacgtgcagaagaccatcgccggccagagcatcggcggcctgctgtacgccctgttcagcggccagcccctggtgatcctgctgaccaccgcccccctggccctgtacatccaggtgatcagagtgatctgcgacgactacgacctggacttcaacagcttctacgcctggaccggcctgtggaacagcttcttcctggccctgtacgccttcttcaacctgagcctggtgatgagcctgttcaagagaagcaccgaggagatcatcgccctgttcatcagcatcaccttcgtgctggacgccgtgaagggcaccgtgaagatcttctggaagtactactacggccactacctggacgactaccacaccaagagaaccagcagcctggtgagcctgagcggcctgggcgccagcctgaacgccagcctgcacaccgccctgaacgccagcttcctggccagccccaccgagctgcccagcgccacccacagcggccaggccaccgccgtgctgagcctgctgatcatgctgggcaccctgtggctgggctacaccctgtaccagttcaagaagagcccctacctgcacccctgcgtgagagagatcctgagcgactgcgccctgcccatcgccgtgctggccttcagcctgatcagcagccacggcttcagagagatcgagatgagcaagttcagatacaaccccagcgagagccccttcgccatggcccagatccagagcctgagcctgagagccgtgagcggcgccatgggcctgggcttcctgctgagcatgctgttcttcatcgagcagaacctggtggccgccctggtgaacgcccccgagaacagactggtgaagggcaccgcctaccactgggacctgctgctgctggccatcatcaacaccggcctgagcctgttcggcctgccctggatccacgccgcctacccccacagccccctgcacgtgagagccctggccctggtggaggagagagtggagaacggccacatctacgacaccatcgtgaacgtgaaggagaccagactgaccagcctgggcgccagcgtgctggtgggcctgagcctgctgctgctgcccgtgcccctgcagtggatccccaagcccgtgctgtacggcctgttcctgtacatcgccctgaccagcctggacggcaaccagctggtgcagagagtggccctgctgctgaaggagcagaccgcctacccccccacccactacatcagaagagtgccccagagaaagatccactacttcaccggcctgcaggtgctgcagctgctgctgctgtgcgccttcggcatgagcagcctgccctacatgaagatgatcttccccctgatcatgatcgccatgatccccatcagatacatcctgctgcccagaatcatcgaggccaagtacctggacgtgatggacgccgagcacagaccctag

SEQ ID NO: 100048 - DNA, 1113 bp, Artificial Sequence
  Description of Artificial Sequence: Synthetic coding sequence
atgaccctggccagcagactgagcaccgccgccaacaccggccagatcgacgacccccaggagcagcacagagtgatcagcagcaacctggccctgatccaggtgcaggccaccgtggtgggcctgctggccgccgtggccgccctgctgctgggcgtggtgagcagagaggaggtggacgtggccaaggtggagctgctgtgcgccagcagcgtgctgaccgccttcctggccgccttcgccctgggcgtgctgatggtgtgcatcgtgatcggcgccagaaagctgggcgtgaaccccgacaacatcgccacccccatcgccgccagcctgggcgacctgatcaccctgagcatcctggccctggtgagcagcttcttctacagacacaaggacagcagatacctgacccccctggtgtgcctgagcttcgccgccctgacccccgtgtgggtgctgatcgccaagcagagcccccccatcgtgaagatcctgaagttcggctggttccccatcatcctggccatggtgatcagcagcttcggcggcctgatcctgagcaagaccgtgagcaagcagcagtacaagggcatggccatcttcacccccgtgatctgcggcgtgggcggcaacctggtggccatccagaccagcagaatcagcacctacctgcacatgtggagcgcccccggcgtgctgcccctgcagatgaagaagttctggcccaacccctgcagcaccttctgcaccagcgagatcaacagcatgagcgccagagtgctgctgctgctggtggtgcccggccacctgatcttcttctacatcatctacctggtggagggccagagcgtgatcaacagccagaccttcgtggtgctgtacctgctggccggcctgatccaggtgaccatcctgctgtacctggccgaggtgatggtgagactgacctggcaccaggccctggaccccgacaaccactgcatcccctacctgaccggcctgggcgacctgctgggcaccggcctgctggccctgtgcttcttcaccgactggctgctgaagagcaaggccgagctgggcggcatcagcgagctggccagcggccccccctag

SEQ ID NO: 100049 - DNA, 1542 bp, Artificial Sequence
  Description of Artificial Sequence: Synthetic coding sequence
atgagcagcaagcccgagcccaaggacgtgcaccagctgaacggcaccggccccagcgccagcccctgcagcagcgacggccccggcagagagcccctggccggcaccagcgagttcctgggccccgacggcgccggcgtggaggtggtgatcgagagcagagccaacgccaagggcgtgagagaggaggacgccctgctggagaacggcagccagagcaacgagagcgacgacgtgagcaccgacagaggccccgccccccccagccccctgaaggagaccagcttcagcatcggcctgcaggtgctgttccccttcctgctggccggcttcggcaccgtggccgccggcatggtgctggacatcgtgcagcactgggaggtgttccagaaggtgaccgaggtgttcatcctggtgcccgccctgctgggcctgaagggcaacctggagatgaccctggccagcagactgagcaccgccgccaacatcggccacatggacacccccaaggagctgtggagaatgatcaccggcaacatggccctgatccaggtgcaggccaccgtggtgggcttcctggccagcatcgccgccgtggtgttcggctggatccccgacggccacttcagcatcccccacgccttcctgctgtgcgccagcagcgtggccaccgccttcatcgccagcctggtgctgggcatgatcatgatcggcgtgatcatcggcagcagaaagatcggcatcaaccccgacaacgtggccacccccatcgccgccagcctgggcgacctgatcaccctggccctgctgagcggcatcagctggggcctgtacctggagctgaaccactggagatacatctaccccctggtgtgcgccttcttcgtggccctgctgcccgtgtgggtggtgctggccagaagaagccccgccaccagagaggtgctgtacagcggctgggagcccgtgatcatcgccatggccatcagcagcgtgggcggcctgatcctggacaagaccgtgagcgaccccaacttcgccggcatggccgtgttcacccccgtgatcaacggcgtgggcggcaacctggtggccgtgcaggccagcagaatcagcaccttcctgcacatgaacggcatgcccggcgagaacagcgagcaggcccccagaagatgccccagcccctgcaccaccttcttcagccccgacgtgaacagcagaagcgccagagtgctgttcctgctggtggtgcccggccacctggtgttcctgtacaccatcagctgcatgcagggcggccacaccaccctgaccctgatcttcatcatcttctacatgaccgccgccctgctgcaggtgctgatcctgctgtacatcgccgactggatggtgcactggatgtggggcagaggcctggaccccgacaacttcagcatcccctacctgaccgccctgggcgacctgctgggcaccggcctgctggccctgagcttccacgtgctgtggctgatcggcgacagagacaccgacgtgggcgactag

SEQ ID NO: 100050 - DNA, 1722 bp, Artificial Sequence
  Description of Artificial Sequence: Synthetic coding sequence
atgaccaacagcaagggcagaagcatcaccgacaagaccagcggcggccccagcagcggcggcggcttcgtggactggaccctgagactgaacaccatccagagcgacaagttcctgaacctgctgctgagcatggtgcccgtgatctaccagaagaaccaggaggacagacacaagaaggccaacggcatctggcaggacggcctgagcaccgccgtgcagaccttcagcaacagaagcgagcagcacatggagtaccacagcttcagcgagcagagcttccacgccaacaacggccacgccagcagcagctgcagccagaagtacgacgactacgccaactacaactactgcgacggcagagagaccagcgagaccaccgccatgctgcaggacgaggacatcagcagcgacggcgacgaggacgccatcgtggaggtgacccccaagctgcccaaggagagcagcggcatcatggccctgcagatcctggtgcccttcctgctggccggcttcggcaccgtgagcgccggcatggtgctggacatcgtgcagcactgggaggtgttcagaaaggtgaccgaggtgttcatcctggtgcccgccctgctgggcctgaagggcaacctggagatgaccctggccagcagactgagcaccgccgtgaacatcggcaagatggacagccccatcgagaagtggaacctgatcatcggcaacctggccctgaagcaggtgcaggccaccgtggtgggcttcctggccgccgtggccgccatcatcctgggctggatccccgagggcaagtactacctggaccacagcatcctgctgtgcagcagcagcgtggccaccgccttcatcgccagcctgctgcagggcatcatcatggtgggcgtgatcgtgggcagcaagaagaccggcatcaaccccgacaacgtggccacccccatcgccgccagcttcggcgacctgatcaccctggccatcctggcctggatcagccagggcctgtacagctgcctggagacctactactacatcagccccctggtgggcgtgttcttcctggccctgacccccatctggatcatcatcgccgccaagcaccccgccaccagaaccgtgctgcacagcggctgggagcccgtgatcaccgccatggtgatcagcagcatcggcggcctgatcctggacaccaccgtgagcgaccccaacctggtgggcatcgtggtgtacacccccgtgatcaacggcatcggcggcaacctggtggccatccaggccagcagaatcagcacctacctgcacctgcacagcatccccggcgagctgcccgacgagcccaagggctgctactaccccttcagaaccttcttcggccccggcgtgaacaacaagagcgcccaggtgctgctgctgctggtgatccccggccacctgatcttcctgtacaccatccacctgatgaagagcggccacaccagcctgaccatcatcttcatcgtggtgtacctgttcggcgccgtgctgcaggtgttcaccctgctgtggatcgccgactggatggtgcaccacttctggagaaagggcaaggaccccgacagcttcagcatcccctacctgaccgccctgggcgacctgctgggcaccgccctgctggccctgagcttccacttcctgtggctgatcggcgacagagacggcgacgtgggcgactag

SEQ ID NO: 100051 - DNA, 369 bp, Artificial Sequence
  Description of Artificial Sequence: Synthetic coding sequence
atgaccaacagcaagggcagaagcatcaccgacaagaccagcggcggccccagcagcggcggcggcttcgtggactggaccctgagactgaacaccatccagagcgacaagttcctgaacctgctgctgagcatggtgcccgtgatctaccagaagaaccaggaggacagacacaagaaggccaacggcatctggcaggacggcctgagcaccgccgtgcagaccttcagcaacagaagcgagcagcacatggagtaccacagcttcagcgagcagagcttccacgccaacaacggccacgccagcagcagctgcagccagaagtacgacgactacgccaactacaactactgcgacggcagagagtag

SEQ ID NO: 100052 - DNA, 432 bp, Artificial Sequence
  Description of Artificial Sequence: Synthetic coding sequence
atgaccaacagcaagggcagaagcatcaccgacaagaccagcggcggccccagcagcggcggcggcttcgtggactggaccctgagactgaacaccatccagagcgacaagttcctgaacctgctgctgagcatggtgcccgtgatctaccagaagaaccaggaggacagacacaagaaggccaacggcatctggcaggacggcctgagcaccgccgtgcagaccttcagcaacagaagcgagcagcacatggagtaccacagcttcagcgagcagagcttccacgccaacaacggccacgccagcagcagctgcagccagaagtacgacgactacgccaactacaactactgcgacggcagagagaccagcgagaccaccgccatgctgcaggacgaggacatcagcagcgacggcgacgaggacgcctag

SEQ ID NO: 100053 - DNA, 141 bp, Artificial Sequence
  Description of Artificial Sequence: Synthetic coding sequence
atgaccaacagcaagggcagaagcatcaccgacaagaccagcggcggccccagcagcggcggcggcttcgtggactggaccctgagactgaacaccatccagagcgacaagttcctgaacctgctgctgagcatggtgtag

SEQ ID NO: 100054 - DNA, 219 bp, Artificial Sequence
  Description of Artificial Sequence: Synthetic coding sequence
atgaccaacagcaagggcagaagcatcaccgacaagaccagcggcggccccagcagcggcggcggcttcgtggactggaccctgagactgaacaccatccagagcgacaagttcctgaacctgctgctgagcatggtgcccgtgatctaccagaagaaccaggaggacagacacaagaaggccaacggcatctggcaggacggcctgagcaccgcctag

SEQ ID NO: 100055 - DNA, 39 bp, Artificial Sequence
  Description of Artificial Sequence: Synthetic coding sequence
atgaccaacagcaagggcagaagcatcaccgacaagtag

SEQ ID NO: 100056 - DNA, 231 bp, Artificial Sequence
  Description of Artificial Sequence: Synthetic coding sequence
atgaccaacagcaagggcagaagcatcaccgacaagaccagcggcggccccagcagcggcggcggcttcgtggactggaccctgagactgaacaccatccagagcgacaagttcctgaacctgctgctgagcatggtgcccgtgatctaccagaagaaccaggaggacagacacaagaaggccaacggcatctggcaggacggcctgagcaccgccgtgcagaccttctag

SEQ ID NO: 100057 - DNA, 285 bp, Artificial Sequence
  Description of Artificial Sequence: Synthetic coding sequence
atgaccaacagcaagggcagaagcatcaccgacaagaccagcggcggccccagcagcggcggcggcttcgtggactggaccctgagactgaacaccatccagagcgacaagttcctgaacctgctgctgagcatggtgcccgtgatctaccagaagaaccaggaggacagacacaagaaggccaacggcatctggcaggacggcctgagcaccgccgtgcagaccttcagcaacagaagcgagcagcacatggagtaccacagcttcagcgagcagagcttctag

SEQ ID NO: 100058 - DNA, 1524 bp, Artificial Sequence
  Description of Artificial Sequence: Synthetic coding sequence
atggacggcaccgagaccagacagagaagactggacagctgcggcaagcccggcgagctgggcctgccccaccccctgagcaccggcggcctgcccgtggccagcgaggacggcgccctgagagcccccgagagccagagcgtgacccccaagcccctggagaccgagcccagcagagagaccacctggagcatcggcctgcaggtgaccgtgcccttcatgttcgccggcctgggcctgagctgggccggcatgctgctggactacttccagcactggcccgtgttcgtggaggtgaaggacctgctgaccctggtgccccccctggtgggcctgaagggcaacctggagatgaccctggccagcagactgagcaccgccgccaacaccggccagatcgacgacccccaggagcagcacagagtgatcagcagcaacctggccctgatccaggtgcaggccaccgtggtgggcctgctggccgccgtggccgccctgctgctgggcgtggtgagcagagaggaggtggacgtggccaaggtggagctgctgtgcgccagcagcgtgctgaccgccttcctggccgccttcgccctgggcgtgctgatggtgtgcatcgtgatcggcgccagaaagctgggcgtgaaccccgacaacatcgccacccccatcgccgccagcctgggcgacctgatcaccctgagcatcctggccctggtgagcagcttcttctacagacacaaggacagcagatacctgacccccctggtgtgcctgagcttcgccgccctgacccccgtgtgggtgctgatcgccaagcagagcccccccatcgtgaagatcctgaagttcggctggttccccatcatcctggccatggtgatcagcagcttcggcggcctgatcctgagcaagaccgtgagcaagcagcagtacaagggcatggccatcttcacccccgtgatctgcggcgtgggcggcaacctggtggccatccagaccagcagaatcagcacctacctgcacatgtggagcgcccccggcgtgctgcccctgcagatgaagaagttctggcccaacccctgcagcaccttctgcaccagcgagatcaacagcatgagcgccagagtgctgctgctgctggtggtgcccggccacctgatcttcttctacatcatctacctggtggagggccagagcgtgatcaacagccagaccttcgtggtgctgtacctgctggccggcctgatccaggtgaccatcctgctgtacctggccgaggtgatggtgagactgacctggcaccaggccctggaccccgacaaccactgcatcccctacctgaccggcctgggcgacctgctgggcagcagcagcgtgggccacaccgccgccgtgcccagaagatgcaccgccagccccggctggggcctgatccagcccttcatctgcacccagcacctgatcgtgagcctgctgagcttctacttccccttctgcctgctggccaagaccagcatctag

SEQ ID NO: 100059 - DNA, 1416 bp, Artificial Sequence
  Description of Artificial Sequence: Synthetic coding sequence
atggacggcaccgagaccagacagagaagactggacagctgcggcaagcccggcgagctgggcctgccccaccccctgagcaccggcggcctgcccgtggccagcgaggacggcgccctgagagcccccgagagccagagcgtgacccccaagcccctggagaccgagcccagcagagagaccacctggagcatcggcctgcaggtgaccgtgcccttcatgttcgccggcctgggcctgagctgggccggcatgctgctggactacttccaggccaacaccggccagatcgacgacccccaggagcagcacagagtgatcagcagcaacctggccctgatccaggtgcaggccaccgtggtgggcctgctggccgccgtggccgccctgctgctgggcgtggtgagcagagaggaggtggacgtggccaaggtggagctgctgtgcgccagcagcgtgctgaccgccttcctggccgccttcgccctgggcgtgctgatggtgtgcatcgtgatcggcgccagaaagctgggcgtgaaccccgacaacatcgccacccccatcgccgccagcctgggcgacctgatcaccctgagcatcctggccctggtgagcagcttcttctacagacacaaggacagcagatacctgacccccctggtgtgcctgagcttcgccgccctgacccccgtgtgggtgctgatcgccaagcagagcccccccatcgtgaagatcctgaagttcggctggttccccatcatcctggccatggtgatcagcagcttcggcggcctgatcctgagcaagaccgtgagcaagcagcagtacaagggcatggccatcttcacccccgtgatctgcggcgtgggcggcaacctggtggccatccagaccagcagaatcagcacctacctgcacatgtggagcgcccccggcgtgctgcccctgcagatgaagaagttctggcccaacccctgcagcaccttctgcaccagcgagatcaacagcatgagcgccagagtgctgctgctgctggtggtgcccggccacctgatcttcttctacatcatctacctggtggagggccagagcgtgatcaacagccagaccttcgtggtgctgtacctgctggccggcctgatccaggtgaccatcctgctgtacctggccgaggtgatggtgagactgacctggcaccaggccctggaccccgacaaccactgcatcccctacctgaccggcctgggcgacctgctgggcagcagcagcgtgggccacaccgccgccgtgcccagaagatgcaccgccagccccggctggggcctgatccagcccttcatctgcacccagcacctgatcgtgagcctgctgagcttctacttccccttctgcctgctggccaagaccagcatctag

SEQ ID NO: 100060 - DNA, 1464 bp, Artificial Sequence
  Description of Artificial Sequence: Synthetic coding sequence
atggacggcaccgagaccagacagagaagactggacagctgcggcaagcccggcgagctgggcctgccccaccccctgagcaccggcggcctgcccgtggccagcgaggacggcgccctgagagcccccgagagccagagcgtgacccccaagcccctggagaccgagcccagcagagagaccacctggagcatcggcctgcaggtgaccgtgcccttcatgttcgccggcctgggcctgagctgggccggcatgctgctggactacttccagcactggcccgtgttcgtggaggtgaaggacctgctgaccctggtgccccccctggtgggcctgaagggcaacctggagatgaccctggccagcagactgagcaccgccgccaacaccggccagatcgacgacccccaggagcagcacagagtgatcagcagcaacctggccctgatccaggtgcaggccaccgtggtgggcctgctggccgccgtggccgccctgctgctgggcgtggtgagcagagaggaggtggacgtggccaaggtggagctgctgtgcgccagcagcgtgctgaccgccttcctggccgccttcgccctgggcgtgctgatggtgtgcatcgtgatcggcgccagaaagctgggcgtgaaccccgacaacatcgccacccccatcgccgccagcctgggcgacctgatcaccctgagcatcctggccctggtgagcagcttcttctacagacacaaggacagcagatacctgacccccctggtgtgcctgagcttcgccgccctgacccccgtgtgggtgctgatcgccaagcagagcccccccatcgtgaagatcctgaagttcggctggttccccatcatcctggccatggtgatcagcagcttcggcggcctgatcctgagcaagaccgtgagcaagcagcagtacaagggcatggccatcttcacccccgtgatctgcggcgtgggcggcaacctggtggccatccagaccagcagaatcagcacctacctgcacatgtggagcgcccccggcgtgctgcccctgcagatgaagaagttctggcccaacccctgcagcaccttctgcaccagcgagatcaacagcatgagcgccagagtgctgctgctgctggtggtgcccggccacctgatcttcttctacatcatctacctggtggagggccagagcgtgatcaacagccagaccttcgtggtgctgtacctgctggccggcctgatccaggtgaccatcctgctgtacctggccgaggtgatggtgagactgacctggcaccaggccctggaccccgacaaccactgcatcccctacctgaccggcctgggcgacctgctgggcaccggcctgctggccctgtgcttcttcaccgactggctgctgaagagcaaggccgagctgggcggcatcagcgagctggccagcggccccccctag

SEQ ID NO: 100061 - DNA, 1386 bp, Artificial Sequence
  Description of Artificial Sequence: Synthetic coding sequence
atggtggtgacccagctgaacctggagttctgcttccagggcaagaagctgagaggcttcagctgcgagctgaccagaagcccccacggcgtgctgcccgagagcttcttcaccatcatgtgccaggtggtggtgcccatcctgctgagcggcctgtgcatgatgaccgccggcctggtgatgaacaccatccagcactggcccgtgttcgtggaggtgaaggacctgctgaccctggtgccccccctggtgggcctgaagggcaacctggagatgaccctggccagcagactgagcaccgccgccaacaccggccagatcgacgacccccaggagcagcacagagtgatcagcagcaacctggccctgatccaggtgcaggccaccgtggtgggcctgctggccgccgtggccgccctgctgctgggcgtggtgagcagagaggaggtggacgtggccaaggtggagctgctgtgcgccagcagcgtgctgaccgccttcctggccgccttcgccctgggcgtgctgatggtgtgcatcgtgatcggcgccagaaagctgggcgtgaaccccgacaacatcgccacccccatcgccgccagcctgggcgacctgatcaccctgagcatcctggccctggtgagcagcttcttctacagacacaaggacagcagatacctgacccccctggtgtgcctgagcttcgccgccctgacccccgtgtgggtgctgatcgccaagcagagcccccccatcgtgaagatcctgaagttcggctggttccccatcatcctggccatggtgatcagcagcttcggcggcctgatcctgagcaagaccgtgagcaagcagcagtacaagggcatggccatcttcacccccgtgatctgcggcgtgggcggcaacctggtggccatccagaccagcagaatcagcacctacctgcacatgtggagcgcccccggcgtgctgcccctgcagatgaagaagttctggcccaacccctgcagcaccttctgcaccagcgagatcaacagcatgagcgccagagtgctgctgctgctggtggtgcccggccacctgatcttcttctacatcatctacctggtggagggccagagcgtgatcaacagccagaccttcgtggtgctgtacctgctggccggcctgatccaggtgaccatcctgctgtacctggccgaggtgatggtgagactgacctggcaccaggccctggaccccgacaaccactgcatcccctacctgaccggcctgggcgacctgctgggcaccggcctgctggccctgtgcttcttcaccgactggctgctgaagagcaaggccgagctgggcggcatcagcgagctggccagcggccccccctag

SEQ ID NO: 100062 - DNA, 1437 bp, Artificial Sequence
  Description of Artificial Sequence: Synthetic coding sequence
atggacggcaccgagaccagacagagaagactggacagctgcggcaagcccggcgagctgggcctgccccaccccctgagcaccggcggcctgcccgtggccagcgaggacggcgccctgagagcccccgagagccagagcgtgacccccaagcccctggagaccgagcccagcagagtgaccgtgcccttcatgttcgccggcctgggcctgagctgggccggcatgctgctggactacttccagcactggcccgtgttcgtggaggtgaaggacctgctgaccctggtgccccccctggtgggcctgaagggcaacctggagatgaccctggccagcagactgagcaccgccgccaacaccggccagatcgacgacccccaggagcagcacagagtgatcagcagcaacctggccctgatccaggtgcaggccaccgtggtgggcctgctggccgccgtggccgccctgctgctgggcgtggtgagcagagaggaggtggacgtggccaaggtggagctgctgtgcgccagcagcgtgctgaccgccttcctggccgccttcgccctgggcgtgctgatggtgtgcatcgtgatcggcgccagaaagctgggcgtgaaccccgacaacatcgccacccccatcgccgccagcctgggcgacctgatcaccctgagcatcctggccctggtgagcagcttcttctacagacacaaggacagcagatacctgacccccctggtgtgcctgagcttcgccgccctgacccccgtgtgggtgctgatcgccaagcagagcccccccatcgtgaagatcctgaagttcggctggttccccatcatcctggccatggtgatcagcagcttcggcggcctgatcctgagcaagaccgtgagcaagcagcagtacaagggcatggccatcttcacccccgtgatctgcggcgtgggcggcaacctggtggccatccagaccagcagaatcagcacctacctgcacatgtggagcgcccccggcgtgctgcccctgcagatgaagaagttctggcccaacccctgcagcaccttctgcaccagcgagatcaacagcatgagcgccagagtgctgctgctgctggtggtgcccggccacctgatcttcttctacatcatctacctggtggagggccagagcgtgatcaacagccagaccttcgtggtgctgtacctgctggccggcctgatccaggtgaccatcctgctgtacctggccgaggtgatggtgagactgacctggcaccaggccctggaccccgacaaccactgcatcccctacctgaccggcctgggcgacctgctgggcaccggcctgctggccctgtgcttcttcaccgactggctgctgaagagcaaggccgagctgggcggcatcagcgagctggccagcggccccccctag

SEQ ID NO: 100063 - DNA, 459 bp, Artificial Sequence
  Description of Artificial Sequence: Synthetic coding sequence
atggacggcaccgagaccagacagagaagactggacagctgcggcaagcccggcgagctgggcctgccccaccccctgagcaccggcggcctgcccgtggccagcgaggacggcgccctgagagcccccgagagccagagcgtgacccccaagcccctggagaccgagcccagcagagagaccacctggagcatcggcctgcaggtgaccgtgcccttcatgttcgccggcctgggcctgagctgggccggcatgctgctggactacttccagcactggcccgtgttcgtggaggtgaaggacctgctgaccctggtgccccccctggtgggcctgaagggcaacctggagatgaccctggccagcagactgagcaccgccgccaacaccggccagatcgacgacccccaggagcagcacagagtgatcagcagcaacctggccctgatccaggtgtag

SEQ ID NO: 100064 - DNA, 459 bp, Artificial Sequence; identical to SEQ ID NO: 100063
  Description of Artificial Sequence: Synthetic coding sequence

SEQ ID NO: 100065 - DNA, 261 bp, Artificial Sequence
  Description of Artificial Sequence: Synthetic coding sequence
atggacggcaccgagaccagacagagaagactggacagctgcggcaagcccggcgagctgggcctgccccaccccctgagcaccggcggcctgcccgtggccagcgaggacggcgccctgagagcccccgagagccagagcgtgacccccaagcccctggagaccgagcccagcagagagaccacctggagcatcggcctgcaggtgaccgtgcccttcatgttcgccggcctgggcctgagctgggccggcatgctgtag

SEQ ID NO: 100066 - DNA, 606 bp, Artificial Sequence
  Description of Artificial Sequence: Synthetic coding sequence
atggacggcaccgagaccagacagagaagactggacagctgcggcaagcccggcgagctgggcctgccccaccccctgagcaccggcggcctgcccgtggccagcgaggacggcgccctgagagcccccgagagccagagcgtgacccccaagcccctggagaccgagcccagcagagagaccacctggagcatcggcctgcaggtgaccgtgcccttcatgttcgccggcctgggcctgagctgggccggcatgctgctggactacttccagcactggcccgtgttcgtggaggtgaaggacctgctgaccctggtgccccccctggtgggcctgaagggcaacctggagatgaccctggccagcagactgagcaccgccgccaacaccggccagatcgacgacccccaggagcagcacagagtgatcagcagcaacctggccctgatccaggtgcaggccaccgtggtgggcctgctggccgccgtggccgccctgctgctgggcgtggtgagcagagaggaggtggacgtggccaaggtggagctgctgtgcgccagcagcgtgctgaccgccttcctggccgccttcgccctgggcgagtag

SEQ ID NO: 100067 - DNA, 414 bp, Artificial Sequence
  Description of Artificial Sequence: Synthetic coding sequence
atggacggcaccgagaccagacagagaagactggacagctgcggcaagcccggcgagctgggcctgccccaccccctgagcaccggcggcctgcccgtggccagcgaggacggcgccctgagagcccccgagagccagagcgtgacccccaagcccctggagaccgagcccagcagagagaccacctggagcatcggcctgcaggtgaccgtgcccttcatgttcgccggcctgggcctgagctgggccggcatgctgctggactacttccaggccaacaccggccagatcgacgacccccaggagcagcacagagtgatcagcagcaacctggccctgatccaggtgcaggccaccgtggtgggcctgctggccgccgtggccgccctgctgctgggcgtggtgagcagatag

SEQ ID NO: 100068 - DNA, 459 bp, Artificial Sequence; identical to SEQ ID NO: 100063
  Description of Artificial Sequence: Synthetic coding sequence

SEQ ID NO: 100069 - DNA, 1680 bp, Artificial Sequence
  Description of Artificial Sequence: Synthetic coding sequence
atggcccccaccctgcagcaggcctacagaagaagatggtggatggcctgcaccgccgtgctggagaacctgttcttcagcgccgtgctgctgggctggggcagcctgctgatcatcctgaagaacgagggcttctacagcagcacctgccccgccgagagcagcaccaacaccacccaggacgagcagagaagatggcccggctgcgaccagcaggacgagatgctgaacctgggcttcaccatcggcagcttcgtgctgagcgccaccaccctgcccctgggcatcctgatggacagattcggccccagacccgtgagactggtgggcagcgcctgcttcaccgccagctgcaccctgatggccctggccagcagagacgtggaggccctgagccccctgatcttcctggccctgagcctgaacggcttcggcggcatctgcctgaccttcaccagcctgaccctgcccaacatgttcggcaacctgagaagcaccctgatggccctgatgatcggcagctacgccagcagcgccatcaccttccccggcatcaagctgatctacgacgccggcgtggccttcgtggtgatcatgttcacctggagcggcctggcctgcctgatcttcctgaactgcaccctgaactggcccatcgaggccttccccgcccccgaggaggtgaactacaccaagaagatcaagctgagcggcctggccctggaccacaaggtgaccggcgacctgttctacacccacgtgaccaccatgggccagagactgagccagaaggcccccagcctggaggacggcagcgacgccttcatgagcccccaggacgtgagaggcaccagcgagaacctgcccgagagaagcgtgcccctgagaaagagcctgtgcagccccaccttcctgtggagcctgctgaccatgggcatgacccagctgagaatcatcttctacatggccgccgtgaacaagatgctggagtacctggtgaccggcggccaggagcacgagaccaacgagcagcagcagaaggtggccgagaccgtgggcttctacagcagcgtgttcggcgccatgcagctgctgtgcctgctgacctgccccctgatcggctacatcatggactggagaatcaaggactgcgtggacgcccccacccagggcaccgtgctgggcgacgccagagacggcgtggccaccaagagcatcagacccagatactgcaagatccagaagctgaccaacgccatcagcgccttcaccctgaccaacctgctgctggtgggcttcggcatcacctgcctgatcaacaacctgcacctgcagttcgtgaccttcgtgctgcacaccatcgtgagaggcttcttccacagcgcctgcggcagcctgtacgccgccgtgttccccagcaaccacttcggcaccctgaccggcctgcagagcctgatcagcgccgtgttcgccctgctgcagcagcccctgttcatggccatggtgggccccctgaagggcgagcccttctgggtgaacctgggcctgctgctgttcagcctgctgggcttcctgctgcccagctacctgttctactacagagccagactgcagcaggagtacgccgccaacggcatgggccccctgaaggtgctgagcggcagcgaggtgaccgcctag

SEQ ID NO: 100070 - DNA, 1680 bp, Artificial Sequence; identical to SEQ ID NO: 100069
  Description of Artificial Sequence: Synthetic coding sequence

SEQ ID NO: 100071 - DNA, 333 bp, Artificial Sequence
  Description of Artificial Sequence: Synthetic coding sequence
atggcccccaccctgcagcaggcctacagaagaagatggtggatggcctgcaccgccgtgctggagaacctgttcttcagcgccgtgctgctgggctggggcagcctgctgatcatcctgaagaacgagggcttctacagcagcacctgccccgccgagagcagcaccaacaccacccaggacgagcagagaagatggcccggctgcgaccagcaggacgagatgctgaacctgggcttcaccatcggcagcttcgtgctgagcgccaccaccctgcccctgggcatcctgatggacagattcggccccagacccgtgagactggtgggctag

SEQ ID NO: 100072 - DNA, 1710 bp, Artificial Sequence
  Description of Artificial Sequence: Synthetic coding sequence
atggcccccaccctggccaccgcccacagaagaagatggtggatggcctgcaccgccgtgctggagaacctgctgttcagcgccgtgctgctgggctggggcagcctgctgatcatgctgaagagcgagggcttctacagctacctgtgcaccgagcccgagaacgtgaccaacggcaccgtgggcggcaccgccgagcccggccacgaggaggtgagctggatgaacggctggctgagctgccaggcccaggacgagatgctgaacctggccttcaccgtgggcagcttcctgctgagcgccatcaccctgcccctgggcatcgtgatggacaagtacggccccagaaagctgagactgctgggcagcgcctgcttcgccgtgagctgcctgctgatcgcctacggcgccagcaagcccaacgccctgagcgtgctgatcttcatcgccctggccctgaacggcttcggcggcatgtgcatgaccttcaccagcctgaccctgcccaacatgttcggcgacctgagaagcaccttcatcgccctgatgatcggcagctacgccagcagcgccgtgaccttccccggcatcaagctgatctacgacgccggcgtgagcttcatcgtggtgctggtggtgtgggccggctgcagcggcctggtgttcctgaactgcttcttcaactggcccctggagcccttccccggccccgaggacatggactacagcgtgaagatcaagttcagctggctgggcttcgaccacaagatcaccggcaagcagttctacaagcaggtgaccaccgtgggcagaagactgagcgtgggcagcagcatgagaagcgccaaggagcaggtggccctgcaggagggccacaagctgtgcctgagcaccgtggacctggaggtgaagtgccagcccgacgccgccgtggcccccagcttcatgcacagcgtgttcagccccatcctgctgctgagcctggtgaccatgtgcgtgacccagctgagactgatcttctacatgggcgccatgaacaacatcctgaagttcctggtgagcggcgaccagaagaccgtgggcctgtacaccagcatcttcggcgtgctgcagctgctgtgcctgctgaccgcccccgtgatcggctacatcatggactggagactgaaggagtgcgaggacgccagcgaggagcccgaggagaaggacgccaaccagggcgagaagaagaagaagaagagagacagacagatccagaagatcaccaacgccatgagagccttcgccttcaccaacctgctgctggtgggcttcggcgtgacctgcctgatccccaacctgcccctgcagatcctgagcttcatcctgcacaccatcgtgagaggcttcatccacagcgccgtgggcggcctgtacgccgccgtgtaccccagcacccagttcggcagcctgaccggcctgcagagcctgatcagcgccctgttcgccctgctgcagcagcccctgttcctggccatgatgggccccctgcagggcgaccccctgtgggtgaacgtgggcctgctgctgctgagcctgctgggcttctgcctgcccctgtacctgatctgctacagaagacagctggagagacagctgcagcagagacaggaggacgacaagctgttcctgaagatcaacggcagcagcaaccaggaggccttcgtgtag

SEQ ID NO: 100073 - DNA, 1722 bp, Artificial Sequence
  Description of Artificial Sequence: Synthetic coding sequence
atggcccccaccctggccaccgcccacagaagaagatggtggatggcctgcaccgccgtgctggagaacctgctgttcagcgccgtgctgctgggctggggcagcctgctgatcatgctgaagagcgagggcttctacagctacctgtgcaccgagcccgagaacgtgaccaacggcaccgtgggcggcaccgccgagcccggccacgaggaggtgagctggatgaacggctggctgagctgccaggcccaggacgagatgctgaacctggccttcaccgtgggcagcttcctgctgagcgccatcaccctgcccctgggcatcgtgatggacaagtacggccccagaaagctgagactgctgggcagcgcctgcttcgccgtgagctgcctgctgatcgcctacggcgccagcaagcccaacgccctgagcgtgctgatcttcatcgccctggccctgaacggcttcggcggcatgtgcatgaccttcaccagcctgaccctgcccaacatgttcggcgacctgagaagcaccttcatcgccctgatgatcggcagctacgccagcagcgccgtgaccttccccggcatcaagctgatctacgacgccggcgtgagcttcatcgtggtgctggtggtgtgggccggctgcagcggcctggtgttcctgaactgcttcttcaactggcccctggagcccttccccggccccgaggacatggactacagcgtgaagatcaagttcagctggctgggcttcgaccacaagatcaccggcaagcagttctacaagcaggtgaccaccgtgggcagaagactgagcgtgggcagcagcatgagaagcgccaaggagcaggtggccctgcaggagggccacaagctgtgcctgagcaccgtggacctggaggtgaagtgccagcccgacgccgccgtggcccccagcttcatgcacagcgtgttcagccccatcctgctgctgagcctggtgaccatgtgcgtgacccagctgagactgatcttctacatgggcgccatgaacaacatcctgaagttcctggtgagcggcgaccagaagaccgccagcagcaccgtgggcctgtacaccagcatcttcggcgtgctgcagctgctgtgcctgctgaccgcccccgtgatcggctacatcatggactggagactgaaggagtgcgaggacgccagcgaggagcccgaggagaaggacgccaaccagggcgagaagaagaagaagaagagagacagacagatccagaagatcaccaacgccatgagagccttcgccttcaccaacctgctgctggtgggcttcggcgtgacctgcctgatccccaacctgcccctgcagatcctgagcttcatcctgcacaccatcgtgagaggcttcatccacagcgccgtgggcggcctgtacgccgccgtgtaccccagcacccagttcggcagcctgaccggcctgcagagcctgatcagcgccctgttcgccctgctgcagcagcccctgttcctggccatgatgggccccctgcagggcgaccccctgtgggtgaacgtgggcctgctgctgctgagcctgctgggcttctgcctgcccctgtacctgatctgctacagaagacagctggagagacagctgcagcagagacaggaggacgacaagctgttcctgaagatcaacggcagcagcaaccaggaggccttcgtgtag

SEQ ID NO: 100074 - DNA, 1299 bp, Artificial Sequence
  Description of Artificial Sequence: Synthetic coding sequence
atgacctacggcagcccccaggccaacgccagccccagcgacgccgtggccctggaccacggcgaggtgagcagaagacagcagcaggagctgcccaacatgttcggcgacctgagaagcaccttcatcgccctgatgatcggcagctacgccagcagcgccgtgaccttccccggcatcaagctgatctacgacgccggcgtgagcttcatcgtggtgctggtggtgtgggccggctgcagcggcctggtgttcctgaactgcttcttcaactggcccctggagcccttccccggccccgaggacatggactacagcgtgaagatcaagttcagctggctgggcttcgaccacaagatcaccggcaagcagttctacaagcaggtgaccaccgtgggcagaagactgagcgtgggcagcagcatgagaagcgccaaggagcaggtggccctgcaggagggccacaagctgtgcctgagcaccgtggacctggaggtgaagtgccagcccgacgccgccgtggcccccagcttcatgcacagcgtgttcagccccatcctgctgctgagcctggtgaccatgtgcgtgacccagctgagactgatcttctacatgggcgccatgaacaacatcctgaagttcctggtgagcggcgaccagaagaccgtgggcctgtacaccagcatcttcggcgtgctgcagctgctgtgcctgctgaccgcccccgtgatcggctacatcatggactggagactgaaggagtgcgaggacgccagcgaggagcccgaggagaaggacgccaaccagggcgagaagaagaagaagaagagagacagacagatccagaagatcaccaacgccatgagagccttcgccttcaccaacctgctgctggtgggcttcggcgtgacctgcctgatccccaacctgcccctgcagatcctgagcttcatcctgcacaccatcgtgagaggcttcatccacagcgccgtgggcggcctgtacgccgccgtgtaccccagcacccagttcggcagcctgaccggcctgcagagcctgatcagcgccctgttcgccctgctgcagcagcccctgttcctggccatgatgggccccctgcagggcgaccccctgtgggtgaacgtgggcctgctgctgctgagcctgctgggcttctgcctgcccctgtacctgatctgctacagaagacagctggagagacagctgcagcagagacaggaggacgacaagctgttcctgaagatcaacggcagcagcaaccaggaggccttcgtgtag

SEQ ID NO: 100075 - DNA, 1341 bp, Artificial Sequence
  Description of Artificial Sequence: Synthetic coding sequence
atgaccagcaaggagatcatcctgggcctgtgcctgctgagcctggtgctgagcatgatcctgatggtgatcatcagatacatcagcagagtgctggtgtggatcctgaccatcctggtgatcctgggcagcctgggcggcaccggcgtgctgtggtggctgtacgccaagcagagaagaagccccaaggagaccgtgacccccgagcagctgcagatcgccgaggacaacctgagagccctgctgatctacgccatcagcgccaccgtgttcaccgtgatcctgttcctgatcatgctggtgatgagaaagagagtggccctgaccatcgccctgttccacgtggccggcaaggtgttcatccacctgcccctgctggtgttccagcccttctggaccttcttcgccctggtgctgttctgggtgtactggatcatgaccctgctgttcctgggcaccaccggcagccccgtgcagaacgagcagggcttcgtggagttcaagatcagcggccccctgcagtacatgtggtggtaccacgtggtgggcctgatctggatcagcgagttcatcctggcctgccagcagatgaccgtggccggcgccgtggtgacctactacttcaccagagacaagagaaacctgcccttcacccccatcctggccagcgtgaacagactgatcagataccacctgggcaccgtggccaagggcagcttcatcatcaccctggtgaagatccccagaatgatcctgatgtacatccacagccagctgaagggcaaggagaacgcctgcgccagatgcgtgctgaagagctgcatctgctgcctgtggtgcctggagaagtgcctgaactacctgaaccagaacgcctacaccgccaccgccatcaacagcaccaacttctgcaccagcgccaaggacgccttcgtgatcctggtggagaacgccctgagagtggccaccatcaacaccgtgggcgacttcatgctgttcctgggcaaggtgctgatcgtgtgcagcaccggcctggccggcatcatgctgctgaactaccagcaggactacaccgtgtgggtgctgcccctgatcatcgtgtgcctgttcgccttcctggtggcccactgcttcctgagcatctacgagatggtggtggacgtgctgttcctgtgcttcgccatcgacaccaagtacaacgacggcagccccggcagagagttctacatggacaaggtgctgatggagttcgtggagaacagcagaaaggccatgaaggaggccggcaagggcggcgtggccgacagcagagagctgaagcccatgctgaagaagagatag

SEQ ID NO: 100076 - DNA, 1974 bp, Artificial Sequence
  Description of Artificial Sequence: Synthetic coding sequence
atgggctgctgcagcagcgccagcagcgccgcccagagcagcaagagagagtggaagcccctggaggacagaagctgcaccgacatcccctggctgctgctgttcatcctgttctgcatcggcatgggcttcatctgcggcttcagcatcgccaccggcgccgccgccagactggtgagcggctacgacagctacggcaacatctgcggccagaagaacaccaagctggaggccatccccaacagcggcatggaccacacccagagaaagtacgtgttcttcctggacccctgcaacctggacctgatcaacagaaagatcaagagcgtggccctgtgcgtggccgcctgccccagacaggagctgaagaccctgagcgacgtgcagaagttcgccgagatcaacggcagcgccctgtgcagctacaacctgaagcccagcgagtacaccaccagccccaagagcagcgtgctgtgccccaagctgcccgtgcccgccagcgcccccatccccttcttccacagatgcgcccccgtgaacatcagctgctacgccaagttcgccgaggccctgatcaccttcgtgagcgacaacagcgtgctgcacagactgatcagcggcgtgatgaccagcaaggagatcatcctgggcctgtgcctgctgagcctggtgctgagcatgatcctgatggtgatcatcagatacatcagcagagtgctggtgtggatcctgaccatcctggtgatcctgggcagcctgggcggcaccggcgtgctgtggtggctgtacgccaagcagagaagaagccccaaggagaccgtgacccccgagcagctgcagatcgccgaggacaacctgagagccctgctgatctacgccatcagcgccaccgtgttcaccgtgatcctgttcctgatcatgctggtgatgagaaagagagtggccctgaccatcgccctgttccacgtggccggcaaggtgttcatccacctgcccctgctggtgttccagcccttctggaccttcttcgccctggtgctgttctgggtgtactggatcatgaccctgctgttcctgggcaccaccggcagccccgtgcagaacgagcagggcttcgtggagttcaagatcagcggccccctgcagtacatgtggtggtaccacgtggtgggcctgatctggatcagcgagttcatcctggcctgccagcagatgaccgtggccggcgccgtggtgacctactacttcaccagagacaagagaaacctgcccttcacccccatcctggccagcgtgaacagactgatcagataccacctgggcaccgtggccaagggcagcttcatcatcaccctggtgaagatccccagaatgatcctgatgtacatccacagccagctgaagggcaaggagaacgcctgcgccagatgcgtgctgaagagctgcatctgctgcctgtggtgcctggagaagtgcctgaactacctgaaccagaacgcctacaccgccaccgccatcaacagcaccaacttctgcaccagcgccaaggacgccttcgtgatcctggtggagaacgccctgagagtggccaccatcaacaccgtgggcgacttcatgctgttcctgggcaaggtgctgatcgtgtgcagcaccggcctggccggcatcatgctgctgaactaccagcaggactacaccgtgtgggtgctgcccctgatcatcgtgtgcctgttcgccttcctggtggcccactgcttcctgagcatctacgagatggtggtggacgtgctgttcctgtgcttcgccatcgacaccaagtacaacgacggcagccccggcagagagttctacatggacaaggtgctgatggagttcgtggagaacagcagaaaggccatgaaggaggccggcaagggcggcgtggccgacagcagagagctgaagcccatggccagcggcgccagcagcgcctag

SEQ ID NO: 100077 - DNA, 1959 bp, Artificial Sequence
  Description of Artificial Sequence: Synthetic coding sequence
atgggctgctgcagcagcgccagcagcgccgcccagagcagcaagagagagtggaagcccctggaggacagaagctgcaccgacatcccctggctgctgctgttcatcctgttctgcatcggcatgggcttcatctgcggcttcagcatcgccaccggcgccgccgccagactggtgagcggctacgacagctacggcaacatctgcggccagaagaacaccaagctggaggccatccccaacagcggcatggaccacacccagagaaagtacgtgttcttcctggacccctgcaacctggacctgatcaacagaaagatcaagagcgtggccctgtgcgtggccgcctgccccagacaggagctgaagaccctgagcgacgtgcagaagttcgccgagatcaacggcagcgccctgtgcagctacaacctgaagcccagcgagtacaccaccagccccaagagcagcgtgctgtgccccaagctgcccgtgcccgccagcgcccccatccccttcttccacagatgcgcccccgtgaacatcagctgctacgccaagttcgccgaggccctgatcaccttcgtgagcgacaacagcgtgctgcacagactgatcagcggcgtgatgaccagcaaggagatcatcctgggcctgtgcctgctgagcctggtgctgagcatgatcctgatggtgatcatcagatacatcagcagagtgctggtgtggatcctgaccatcctggtgatcctgggcagcctgggcggcaccggcgtgctgtggtggctgtacgccaagcagagaagaagccccaaggagaccgtgacccccgagcagctgcagatcgccgaggacaacctgagagccctgctgatctacgccatcagcgccaccgtgttcaccgtgatcctgttcctgatcatgctggtgatgagaaagagagtggccctgaccatcgccctgttccacgtggccggcaaggtgttcatccacctgcccctgctggtgttccagcccttctggaccttcttcgccctggtgctgttctgggtgtactggatcatgaccctgctgttcctgggcaccaccggcagccccgtgcagaacgagcagggcttcgtggagttcaagatcagcggccccctgcagtacatgtggtggtaccacgtggtgggcctgatctggatcagcgagttcatcctggcctgccagcagatgaccgtggccggcgccgtggtgacctactacttcaccagagacaagagaaacctgcccttcacccccatcctggccagcgtgaacagactgatcagataccacctgggcaccgtggccaagggcagcttcatcatcaccctggtgaagatccccagaatgatcctgatgtacatccacagccagctgaagggcaaggagaacgcctgcgccagatgcgtgctgaagagctgcatctgctgcctgtggtgcctggagaagtgcctgaactacctgaaccagaacgcctacaccgccaccgccatcaacagcaccaacttctgcaccagcgccaaggacgccttcgtgatcctggtggagaacgccctgagagtggccaccatcaacaccgtgggcgacttcatgctgttcctgggcaaggtgctgatcgtgtgcagcaccggcctggccggcatcatgctgctgaactaccagcaggactacaccgtgtgggtgctgcccctgatcatcgtgtgcctgttcgccttcctggtggcccactgcttcctgagcatctacgagatggtggtggacgtgctgttcctgtgcttcgccatcgacaccaagtacaacgacggcagccccggcagagagttctacatggacaaggtgctgatggagttcgtggagaacagcagaaaggccatgaaggaggccggcaagggcggcgtggccgacagcagagagctgaagcccatgatcaagtag

SEQ ID NO: 100078 - DNA, 1965 bp, Artificial Sequence
  Description of Artificial Sequence: Synthetic coding sequence
atgggctgctgcagcagcgccagcagcgccgcccagagcagcaagagagagtggaagcccctggaggacagaagctgcaccgacatcccctggctgctgctgttcatcctgttctgcatcggcatgggcttcatctgcggcttcagcatcgccaccggcgccgccgccagactggtgagcggctacgacagctacggcaacatctgcggccagaagaacaccaagctggaggccatccccaacagcggcatggaccacacccagagaaagtacgtgttcttcctggacccctgcaacctggacctgatcaacagaaagatcaagagcgtggccctgtgcgtggccgcctgccccagacaggagctgaagaccctgagcgacgtgcagaagttcgccgagatcaacggcagcgccctgtgcagctacaacctgaagcccagcgagtacaccaccagccccaagagcagcgtgctgtgccccaagctgcccgtgcccgccagcgcccccatccccttcttccacagatgcgcccccgtgaacatcagctgctacgccaagttcgccgaggccctgatcaccttcgtgagcgacaacagcgtgctgcacagactgatcagcggcgtgatgaccagcaaggagatcatcctgggcctgtgcctgctgagcctggtgctgagcatgatcctgatggtgatcatcagatacatcagcagagtgctggtgtggatcctgaccatcctggtgatcctgggcagcctgggcggcaccggcgtgctgtggtggctgtacgccaagcagagaagaagccccaaggagaccgtgacccccgagcagctgcagatcgccgaggacaacctgagagccctgctgatctacgccatcagcgccaccgtgttcaccgtgatcctgttcctgatcatgctggtgatgagaaagagagtggccctgaccatcgccctgttccacgtggccggcaaggtgttcatccacctgcccctgctggtgttccagcccttctggaccttcttcgccctggtgctgttctgggtgtactggatcatgaccctgctgttcctgggcaccaccggcagccccgtgcagaacgagcagggcttcgtggagttcaagatcagcggccccctgcagtacatgtggtggtaccacgtggtgggcctgatctggatcagcgagttcatcctggcctgccagcagatgaccgtggccggcgccgtggtgacctactacttcaccagagacaagagaaacctgcccttcacccccatcctggccagcgtgaacagactgatcagataccacctgggcaccgtggccaagggcagcttcatcatcaccctggtgaagatccccagaatgatcctgatgtacatccacagccagctgaagggcaaggagaacgcctgcgccagatgcgtgctgaagagctgcatctgctgcctgtggtgcctggagaagtgcctgaactacctgaaccagaacgcctacaccgccaccgccatcaacagcaccaacttctgcaccagcgccaaggacgccttcgtgatcctggtggagaacgccctgagagtggccaccatcaacaccgtgggcgacttcatgctgttcctgggcaaggtgctgatcgtgtgcagcaccggcctggccggcatcatgctgctgaactaccagcaggactacaccgtgtgggtgctgcccctgatcatcgtgtgcctgttcgccttcctggtggcccactgcttcctgagcatctacgagatggtggtggacgtgctgttcctgtgcttcgccatcgacaccaagtacaacgacggcagccccggcagagagttctacatggacaaggtgctgatggagttcgtggagaacagcagaaaggccatgaaggaggccggcaagggcggcgtggccgacagcagagagctgaagcccatgctgaagaagagatag

SEQ ID NO: 100079 - DNA, 1974 bp, Artificial Sequence; identical to SEQ ID NO: 100076
  Description of Artificial Sequence: Synthetic coding sequence

SEQ ID NO: 100080 - DNA, 2121 bp, Artificial Sequence
  Description of Artificial Sequence: Synthetic coding sequence
atgggcgacgagagaccccactactacggcaagcacggcaccccccagaagtacgaccccaccttcaagggccccatctacaacagaggctgcaccgacatcatctgctgcgtgttcctgctgctggccatcgtgggctacgtggccgtgggcatcatcgcctggacccacggcgaccccagaaaggtgatctaccccaccgacagcagaggcgagttctgcggccagaagggcaccaagaacgagaacaagccctacctgttctacttcaacatcgtgaagtgcgccagccccctggtgctgctggagttccagtgccccaccccccagatctgcgtggagaagtgccccgacagatacctgacctacctgaacgccagaagcagcagagacttcgagtactacaagcagttctgcgtgcccggcttcaagaacaacaagggcgtggccgaggtgctgcaggacggcgactgccccgccgtgctgatccccagcaagcccctggccagaagatgcttccccgccatccacgcctacaagggcgtgctgatggtgggcaacgagaccacctacgaggacggccacggcagcagaaagaacatcaccgacctggtggagggcgccaagaaggccaacggcgtgctggaggccagacagctggccatgagaatcttcgaggactacaccgtgagctggtactggatcatcatcggcctggtgatcgccatggccatgagcctgctgttcatcatcctgctgagattcctggccggcatcatggtgtgggtgatgatcatcatggtgatcctggtgctgggctacggcatcttccactgctacatggagtacagcagactgagaggcgaggccggcagcgacgtgagcctggtggacctgggcttccagaccgacttcagagtgtacctgcacctgagacagacctggctggccttcatgatcatcctgagcatcctggaggtgatcatcatcctgctgctgatcttcctgagaaagagaatcctgatcgccatcgccctgatcaaggaggccagcagagccgtgggctacgtgatgtgcagcctgctgtaccccctggtgaccttcttcctgctgtgcctgtgcatcgcctactgggccagcaccgccgtgttcctgagcaccagcaacgaggccgtgtacaagatcttcgacgacagcccctgccccttcaccgccaagacctgcaaccccgagaccttccccagcagcaacgagagcagacagtgccccaacgccagatgccagttcgccttctacggcggcgagagcggctaccacagagccctgctgggcctgcagatcttcaacgccttcatgttcttctggctggccaacttcgtgctggccctgggccaggtgaccctggccggcgccttcgccagctactactgggccctgagaaagcccgacgacctgcccgccttccccctgttcagcgccttcggcagagccctgagataccacaccggcagcctggccttcggcgccctgatcctggccatcgtgcagatcatcagagtgatcctggagtacctggaccagagactgaaggccgccgagaacaagttcgccaagtgcctgatgacctgcctgaagtgctgcttctggtgcctggagaagttcatcaagttcctgaacagaaacgcctacatcatgatcgccatctacggcaccaacttctgcaccagcgccagaaacgccttcttcctgctgatgagaaacatcatcagagtggccgtgctggacaaggtgaccgacttcctgttcctgctgggcaagctgctgatcgtgggcagcgtgggcatcctggccttcttcttcttcacccacagaatcagaatcgtgcaggacaccgccccccccctgaactactactgggtgcccatcctgaccgtgatcgtgggcagctacctgatcgcccacggcttcttcagcgtgtacggcatgtgcgtggacaccctgttcctgtgcttcctggaggacctggagagaaacgacggcagcgccgagagaccctacttcatgagcagcaccctgaagaagctgctgaacaagaccaacaagaaggccgccgagagctag

SEQ ID NO: 100081 - DNA, 2121 bp, Artificial Sequence
  Description of Artificial Sequence: Synthetic coding sequence
atgggcgacgagagaccccactactacggcaagcacggcaccccccagaagtacgaccccaccttcaagggccccatctacaacagaggctgcaccgacatcatctgctgcgtgttcctgctgctggccatcgtgggctacgtggccgtgggcatcatcgcctggacccacggcgaccccagaaaggtgatctaccccaccgacagcagaggcgagttctgcggccagaagggcaccaagaacgagaacaagccctacctgttctacttcaacatcgtgaagtgcgccagccccctggtgctgctggagttccagtgccccaccccccagatctgcgtggagaagtgccccgacagatacctgacctacctgaacgccagaagcagcagagacttcgagtactacaagcagttctgcgtgcccggcttcaagaacaacaagggcgtggccgaggtgctgcaggacggcgactgccccgccgtgctgatccccagcaagcccctggccagaagatgcttccccgccatccacgcctacaagggcgtgctgatggtgggcaacgagaccacctacgaggacggccacggcagcagaaagaacatcaccgacctggtggagggcgccaagaaggccaacggcgtgctggaggccagacagctggccatgagaatcttcgaggactacaccgtgagctggtactggatcatcatcggcctggtgatcgccatggccatgagcctgctgttcatcatcctgctgagattcctggccggcatcatggtgtgggtgatgatcatcatggtgatcctggtgctgggctacggcatcttccactgctacatggagtacagcagactgagaggcgaggccggcagcgacgtgagcctggtggacctgggcttccagaccgacttcagagtgtacctgcacctgagacagacctggctggccttcatgatcatcctgagcatcctggaggtgatcatcatcctgctgctgatcttcctgagaaagagaatcctgatcgccatcgccctgatcaaggaggccagcagagccgtgggctacgtgatgtgcagcctgctgtaccccctggtgaccttcttcctgctgtgcctgtgcatcgcctactgggccagcaccgccgtgttcctgagcaccagcaacgaggccgtgtacaagatcttcgacgacagcccctgccccttcaccgccaagacctgcaaccccgagaccttccccagcagcaacgagagcagacagtgccccaacgccagatgccagttcgccttctacggcggcgagagcggctaccacagagccctgctgggcctgcagatcttcaacgccttcatgttcttctggctggccaacttcgtgctggccctgggccaggtgaccctggccggcgccttcgccagctactactgggccctgagaaagcccgacgacctgcccgccttccccctgttcagcgccttcggcagagccctgagataccacaccggcagcctggccttcggcgccctgatcctggccatcgtgcagatcatcagagtgatcctggagtacctggaccagagactgaaggccgccgagaacaagttcgccaagtgcctgatgacctgcctgaagtgctgcttctggtgcctggagaagttcatcaagttcctgaacagaaacgcctacatcatgatcgccatctacggcaccaacttctgcaccagcgccagaaacgccttcttcctgctgatgagaaacatcatcagagtggccgtgctggacaaggtgaccgacttcctgttcctgctgggcaagctgctgatcgtgggcagcgtgggcatcctggccttcttcttcttcacccacagaatcagaatcgtgcaggacaccgccccccccctgaactactactgggtgcccatcctgaccgtgatcgtgggcagctacctgatcgcccacggcttcttcagcgtgtacggcatgtgcgtggacaccctgttcctgtgcttctgcgaggacctggagagaaacgacggcagccaggagagaccctacttcatgagccccgagctgagagacatcctgctgaagggcagcgccgaggagggcaagagatag

SEQ ID NO: 100082 - DNA, 2115 bp, Artificial Sequence
  Description of Artificial Sequence: Synthetic coding sequence
atggaggacgagagaaagaacggcgcctacggcaccccccagaagtacgaccccaccttcaagggccccatctacaacagaggctgcaccgacatcatctgctgcgtgttcctgctgctggccatcgtgggctacgtggccgtgggcatcatcgcctggacccacggcgaccccagaaaggtgatctaccccaccgacagcagaggcgagttctgcggccagaagggcaccaagaacgagaacaagccctacctgttctacttcaacatcgtgaagtgcgccagccccctggtgctgctggagttccagtgccccaccccccagatctgcgtggagaagtgccccgacagatacctgacctacctgaacgccagaagcagcagagacttcgagtactacaagcagttctgcgtgcccggcttcaagaacaacaagggcgtggccgaggtgctgcaggacggcgactgccccgccgtgctgatccccagcaagcccctggccagaagatgcttccccgccatccacgcctacaagggcgtgctgatggtgggcaacgagaccacctacgaggacggccacggcagcagaaagaacatcaccgacctggtggagggcgccaagaaggccaacggcgtgctggaggccagacagctggccatgagaatcttcgaggactacaccgtgagctggtactggatcatcatcggcctggtgatcgccatggccatgagcctgctgttcatcatcctgctgagattcctggccggcatcatggtgtgggtgatgatcatcatggtgatcctggtgctgggctacggcatcttccactgctacatggagtacagcagactgagaggcgaggccggcagcgacgtgagcctggtggacctgggcttccagaccgacttcagagtgtacctgcacctgagacagacctggctggccttcatgatcatcctgagcatcctggaggtgatcatcatcctgctgctgatcttcctgagaaagagaatcctgatcgccatcgccctgatcaaggaggccagcagagccgtgggctacgtgatgtgcagcctgctgtaccccctggtgaccttcttcctgctgtgcctgtgcatcgcctactgggccagcaccgccgtgttcctgagcaccagcaacgaggccgtgtacaagatcttcgacgacagcccctgccccttcaccgccaagacctgcaaccccgagaccttccccagcagcaacgagagcagacagtgccccaacgccagatgccagttcgccttctacggcggcgagagcggctaccacagagccctgctgggcctgcagatcttcaacgccttcatgttcttctggctggccaacttcgtgctggccctgggccaggtgaccctggccggcgccttcgccagctactactgggccctgagaaagcccgacgacctgcccgccttccccctgttcagcgccttcggcagagccctgagataccacaccggcagcctggccttcggcgccctgatcctggccatcgtgcagatcatcagagtgatcctggagtacctggaccagagactgaaggccgccgagaacaagttcgccaagtgcctgatgacctgcctgaagtgctgcttctggtgcctggagaagttcatcaagttcctgaacagaaacgcctacatcatgatcgccatctacggcaccaacttctgcaccagcgccagaaacgccttcttcctgctgatgagaaacatcatcagagtggccgtgctggacaaggtgaccgacttcctgttcctgctgggcaagctgctgatcgtgggcagcgtgggcatcctggccttcttcttcttcacccacagaatcagaatcgtgcaggacaccgccccccccctgaactactactgggtgcccatcctgaccgtgatcgtgggcagctacctgatcgcccacggcttcttcagcgtgtacggcatgtgcgtggacaccctgttcctgtgcttcctggaggacctggagagaaacgacggcagcgccgagagaccctacttcatgagcagcaccctgaagaagctgctgaacaagaccaacaagaaggccgccgagagctag

SEQ ID NO: 100083 - DNA, 1248 bp, Artificial Sequence; identical to SEQ ID NO: 98917
  Description of Artificial Sequence: Synthetic coding sequence

SEQ ID NO: 100084 - DNA, 2007 bp, Artificial Sequence
  Description of Artificial Sequence: Synthetic coding sequence
atgggcggcaagcagagagacgaggacgacgaggcctacggcaagcccgtgaagtacgaccccagcttcagaggccccatcaagaacagaagctgcaccgacgtgatctgctgcgtgctgttcctgctgttcatcctgggctacatcgtggtgggcatcgtggcctggctgtacggcgaccccagacaggtgctgtaccccagaaacagcaccggcgcctactgcggcatgggcgagaacaaggacaagccctacctgctgtacttcaacatcttcagctgcatcctgagcagcaacatcatcagcgtggccgagaacggcctgcagtgccccaccccccagaccgtgatcaccagcctgcagcaggagctgtgccccagcttcctgctgcccagcgcccccgccctgggcagatgcttcccctggaccaacgtgaccccccccgccctgcccggcatcaccaacgacaccaccatccagcagggcatcagcggcctgatcgacagcctgaacgccagagacatcagcgtgaagatcttcgaggacttcgcccagagctggtactggatcctggtggccctgggcgtggccctggtgctgagcctgctgttcatcctgctgctgagactggtggccggccccctggtgctggtgctgatcctgggcgtgctgggcgtgctggcctacggcatctactactgctgggaggagtacagagtgctgagagacaagggcgccagcatcagccagctgggcttcaccaccaacctgagcgcctaccagagcgtgcaggagacctggctggccgccctgatcgtgctggccgtgctggaggccatcctgctgctgatgctgatcttcctgagacagagaatcagaatcgccatcgccctgctgaaggaggccagcaaggccgtgggccagatgatgagcaccatgttctaccccctggtgaccttcgtgctgctgctgatctgcatcgcctactgggccatgaccgccctgtacctggccaccagcggccagccccagtacgtgctgtgggccagcaacatcagcagccccggctgcgagaaggtgcccatcaacaccagctgcaaccccaccgcccacctggtgaacagcagctgccccggcctgatgtgcgtgttccagggctacagcagcaagggcctgatccagagaagcgtgttcaacctgcagatctacggcgtgctgggcctgttctggaccctgaactgggtgctggccctgggccagtgcgtgctggccggcgccttcgccagcttctactgggccttccacaagccccaggacatccccaccttccccctgatcagcgccttcatcagaaccctgagataccacaccggcagcctggccttcggcgccctgatcctgaccctggtgcagatcgccagagtgatcctggagtacatcgaccacaagctgagaggcgtgcagaaccccgtggccagatgcatcatgtgctgcttcaagtgctgcctgtggtgcctggagaagttcatcaagttcctgaacagaaacgcctacatcatgatcgccatctacggcaagaacttctgcgtgagcgccaagaacgccttcatgctgctgatgagaaacatcgtgagagtggtggtgctggacaaggtgaccgacctgctgctgttcttcggcaagctgctggtggtgggcggcgtgggcgtgctgagcttcttcttcttcagcggcagaatccccggcctgggcaaggacttcaagagcccccacctgaactactactggctgcccatcatgaccagcatcctgggcgcctacgtgatcgccagcggcttcttcagcgtgttcggcatgtgcgtggacaccctgttcctgtgcttcctggaggacctggagagaaacaacggcagcctggacagaccctactacatgagcaagagcctgctgaagatcctgggcaagaagaacgaggccccccccgacaacaagaagagaaagaagtag

SEQ ID NO: 100085 - DNA, 2133 bp, Artificial Sequence; identical to SEQ ID NO: 81460
  Description of Artificial Sequence: Synthetic coding sequence

SEQ ID NO: 100086 - DNA, 1236 bp, Artificial Sequence
  Description of Artificial Sequence: Synthetic coding sequence
tgaagagacgaggacgacgaggcctacggcaagcccgtgaagtacgaccccagcttcagaggccccatcaagaacagaagctgcaccgacgtgatctgctgcgtgctgttcctgctgttcatcctgggctacatcgtggtgggcatcgtggcctggctgtacggcgaccccagacaggtgctgtaccccagaaacagcaccggcgcctactgcggcatgggcgagaacaaggacaagccctacctgctgtacttcaacatcttcagctgcatcctgagcagcaacatcatcagcgtggccgagaacggcctgcagtgccccaccccccaggtgtgcgtgagcagctgccccgaggacccctggaccgtgggcaagaacgagttcagccagaccgtgggcgaggtgttctacaccaagaacagaaacttctgcctgcccggcgtgccctggaacatgaccgtgatcaccagcctgcagcaggagctgtgccccagcttcctgctgcccagcgcccccgccctgggcagatgcttcccctggaccaacgtgaccccccccgccctgcccggcatcaccaacgacaccaccatccagcagggcatcagcggcctgatcgacagcctgaacgccagagacatcagcgtgaagatcttcgaggacttcgcccagagctggtactggatcctggtggccgtgggccagatgatgagcaccatgttctaccccctggtgaccttcgtgctgctgctgatctgcatcgcctactgggccatgaccgccctgtacctggccaccagcggccagccccagtacgtgctgtgggccagcaacatcagcagccccggctgcgagaaggtgcccatcaacaccagctgcaaccccaccgcccacctggtgaacagcagctgccccggcctgatgtgcgtgttccagggctacagcagcaagggcctgatccagagaagcgtgttcaacctgcagatctacggcgtgctgggcctgttctggaccctgaactgggtgctggccctgggccagtgcgtgctggccggcgccttcgccagcttctactgggccttccacaagccccaggacatccccaccttccccctgatcagcgccttcatcagaaccctgagataccacaccggcagcctggccttcggcgccctgatcctgaccctggtgcagatcgccagagtgatcctggagtacatcgaccacaagctgagatag

SEQ ID NO: 100087 - DNA, 1236 bp, Artificial Sequence
  Description of Artificial Sequence: Synthetic coding sequence
tgaagagacgaggacgacgaggcctacggcaagcccgtgaagtacgaccccagcttcagaggccccatcaagaacagaagctgcaccgacgtgatctgctgcgtgctgttcctgctgttcatcctgggctacatcgtggtgggcatcgtggcctggctgtacggcgaccccagacaggtgctgtaccccagaaacagcaccggcgcctactgcggcatgggcgagaacaaggacaagccctacctgctgtacttcaacatcttcagctgcatcctgagcagcaacatcatcagcgtggccgagaacggcctgcagtgccccaccccccaggtgtgcgtgagcagctgccccgaggacccctggaccgtgggcaagaacgagttcagccagaccgtgggcgaggtgttctacaccaagaacagaaacttctgcctgcccggcgtgccctggaacatgaccgtgatcaccagcctgcagcaggagctgtgccccagcttcctgctgcccagcgcccccgccctgggcagatgcttcccctggaccaacatcaccccccccgccctgcccggcatcaccaacgacaccaccatccagcagggcatcagcggcctgatcgacagcctgaacgccagagacatcagcgtgaagatcttcgaggacttcgcccagagctggtactggatcctggtggccgtgggccagatgatgagcaccatgttctaccccctggtgaccttcgtgctgctgctgatctgcatcgcctactgggccatgaccgccctgtacctggccaccagcggccagccccagtacgtgctgtgggccagcaacatcagcagccccggctgcgagaaggtgcccatcaacaccagctgcaaccccaccgcccacctggtgaacagcagctgccccggcctgatgtgcgtgttccagggctacagcagcaagggcctgatccagagaagcgtgttcaacctgcagatctacggcgtgctgggcctgttctggaccctgaactgggtgctggccctgggccagtgcgtgctggccggcgccttcgccagcttctactgggccttccacaagccccaggacatccccaccttccccctgatcagcgccttcatcagaaccctgagataccacaccggcagcctggccttcggcgccctgatcctgaccctggtgcagatcgccagagtgatcctggagtacatcgaccacaagctgagatag

SEQ ID NO: 100088 - DNA, 2133 bp, Artificial Sequence
  Description of Artificial Sequence: Synthetic coding sequence
atgggcggcaagcagagagacgaggacgacgaggcctacggcaagcccgtgaagtacgaccccagcttcagaggccccatcaagaacagaagctgcaccgacgtgatctgctgcgtgctgttcctgctgttcatcctgggctacatcgtggtgggcatcgtggcctggctgtacggcgaccccagacaggtgctgtaccccagaaacagcaccggcgcctactgcggcatgggcgagaacaaggacaagccctacctgctgtacttcaacatcttcagctgcatcctgagcagcaacatcatcagcgtggccgagaacggcctgcagtgccccaccccccaggtgtgcgtgagcagctgccccgaggacccctggaccgtgggcaagaacgagttcagccagaccgtgggcgaggtgttctacaccaagaacagaaacttctgcctgcccggcgtgccctggaacatgaccgtgatcaccagcctgcagcaggagctgtgccccagcttcctgctgcccagcgcccccgccctgggcagatgcttcccctggaccaacatcaccccccccgccctgcccggcatcaccaacgacaccaccatccagcagggcatcagcggcctgatcgacagcctgaacgccagagacatcagcgtgaagatcttcgaggacttcgcccagagctggtactggatcctggtggccctgggcgtggccctggtgctgagcctgctgttcatcctgctgctgagactggtggccggccccctggtgctggtgctgatcctgggcgtgctgggcgtgctggcctacggcatctactactgctgggaggagtacagagtgctgagagacaagggcgccagcatcagccagctgggcttcaccaccaacctgagcgcctaccagagcgtgcaggagacctggctggccgccctgatcgtgctggccgtgctggaggccatcctgctgctggtgctgatcttcctgagacagagaatcagaatcgccatcgccctgctgaaggaggccagcaaggccgtgggccagatgatgagcaccatgttctaccccctggtgaccttcgtgctgctgctgatctgcatcgcctactgggccatgaccgccctgtacctggccaccagcggccagccccagtacgtgctgtgggccagcaacatcagcagccccggctgcgagaaggtgcccatcaacaccagctgcaaccccaccgcccacctggtgaacagcagctgccccggcctgatgtgcgtgttccagggctacagcagcaagggcctgatccagagaagcgtgttcaacctgcagatctacggcgtgctgggcctgttctggaccctgaactgggtgctggccctgggccagtgcgtgctggccggcgccttcgccagcttctactgggccttccacaagccccaggacatccccaccttccccctgatcagcgccttcatcagaaccctgagataccacaccggcagcctggccttcggcgccctgatcctgaccctggtgcagatcgccagagtgatcctggagtacatcgaccacaagctgagaggcgtgcagaaccccgtggccagatgcatcatgtgctgcttcaagtgctgcctgtggtgcctggagaagttcatcaagttcctgaacagaaacgcctacatcatgatcgccatctacggcaagaacttctgcgtgagcgccaagaacgccttcatgctgctgatgagaaacatcgtgagagtggtggtgctggacaaggtgaccgacctgctgctgttcttcggcaagctgctggtggtgggcggcgtgggcgtgctgagcttcttcttcttcagcggcagaatccccggcctgggcaaggacttcaagagcccccacctgaactactactggctgcccatcatgaccagcatcctgggcgcctacgtgatcgccagcggcttcttcagcgtgttcggcatgtgcgtggacaccctgttcctgtgcttcctggaggacctggagagaaacaacggcagcctggacagaccctactacatgagcaagagcctgctgaagatcctgggcaagaagaacgaggccccccccgacaacaagaagagaaagaagtag

SEQ ID NO: 100089 - DNA, 2133 bp, Artificial Sequence; identical to SEQ ID NO: 100088
  Description of Artificial Sequence: Synthetic coding sequence

SEQ ID NO: 100090 - DNA, 2133 bp, Artificial Sequence; identical to SEQ ID NO: 81460
  Description of Artificial Sequence: Synthetic coding sequence

SEQ ID NO: 100091 - DNA, 1236 bp, Artificial Sequence; identical to SEQ ID NO: 100086
  Description of Artificial Sequence: Synthetic coding sequence

SEQ ID NO: 100092 - DNA, 1236 bp, Artificial Sequence; identical to SEQ ID NO: 100086
  Description of Artificial Sequence: Synthetic coding sequence

SEQ ID NO: 100093 - DNA, 1236 bp, Artificial Sequence; identical to SEQ ID NO: 100087
  Description of Artificial Sequence: Synthetic coding sequence

SEQ ID NO: 100094 - DNA, 2133 bp, Artificial Sequence; identical to SEQ ID NO: 100088
  Description of Artificial Sequence: Synthetic coding sequence

SEQ ID NO: 100095 - DNA, 1236 bp, Artificial Sequence; identical to SEQ ID NO: 100087
  Description of Artificial Sequence: Synthetic coding sequence

SEQ ID NO: 100096 - DNA, 2133 bp, Artificial Sequence; identical to SEQ ID NO: 81460
  Description of Artificial Sequence: Synthetic coding sequence

SEQ ID NO: 100097 - DNA, 1236 bp, Artificial Sequence; identical to SEQ ID NO: 100086
  Description of Artificial Sequence: Synthetic coding sequence

SEQ ID NO: 100098 - DNA, 1905 bp, Artificial Sequence
  Description of Artificial Sequence: Synthetic coding sequence
atgggcgagaacaaggacaagccctacctgctgtacttcaacatcttcagctgcatcctgagcagcaacatcatcagcgtggccgagaacggcctgcagtgccccaccccccaggtgtgcgtgagcagctgccccgaggacccctggaccgtgggcaagaacgagttcagccagaccgtgggcgaggtgttctacaccaagaacagaaacttctgcctgcccggcgtgccctggaacatgaccgtgatcaccagcctgcagcaggagctgtgccccagcttcctgctgcccagcgcccccgccctgggcagatgcttcccctggaccaacgtgaccccccccgccctgcccggcatcaccaacgacaccaccatccagcagggcatcagcggcctgatcgacagcctgaacgccagagacatcagcgtgaagatcttcgaggacttcgcccagagctggtactggatcctggtggccctgggcgtggccctggtgctgagcctgctgttcatcctgctgctgagactggtggccggccccctggtgctggtgctgatcctgggcgtgctgggcgtgctggcctacggcatctactactgctgggaggagtacagagtgctgagagacaagggcgccagcatcagccagctgggcttcaccaccaacctgagcgcctaccagagcgtgcaggagacctggctggccgccctgatcgtgctggccgtgctggaggccatcctgctgctgatgctgatcttcctgagacagagaatcagaatcgccatcgccctgctgaaggaggccagcaaggccgtgggccagatgatgagcaccatgttctaccccctggtgaccttcgtgctgctgctgatctgcatcgcctactgggccatgaccgccctgtacctggccaccagcggccagccccagtacgtgctgtgggccagcaacatcagcagccccggctgcgagaaggtgcccatcaacaccagctgcaaccccaccgcccacctggtgaacagcagctgccccggcctgatgtgcgtgttccagggctacagcagcaagggcctgatccagagaagcgtgttcaacctgcagatctacggcgtgctgggcctgttctggaccctgaactgggtgctggccctgggccagtgcgtgctggccggcgccttcgccagcttctactgggccttccacaagccccaggacatccccaccttccccctgatcagcgccttcatcagaaccctgagataccacaccggcagcctggccttcggcgccctgatcctgaccctggtgcagatcgccagagtgatcctggagtacatcgaccacaagctgagaggcgtgcagaaccccgtggccagatgcatcatgtgctgcttcaagtgctgcctgtggtgcctggagaagttcatcaagttcctgaacagaaacgcctacatcatgatcgccatctacggcaagaacttctgcgtgagcgccaagaacgccttcatgctgctgatgagaaacatcgtgagagtggtggtgctggacaaggtgaccgacctgctgctgttcttcggcaagctgctggtggtgggcggcgtgggcgtgctgagcttcttcttcttcagcggcagaatccccggcctgggcaaggacttcaagagcccccacctgaactactactggctgcccatcatgaccagcatcctgggcgcctacgtgatcgccagcggcttcttcagcgtgttcggcatgtgcgtggacaccctgttcctgtgcttcctggaggacctggagagaaacaacggcagcctggacagaccctactacatgagcaagagcctgctgaagatcctgggcaagaagaacgaggccccccccgacaacaagaagagaaagaagtag

SEQ ID NO: 100099 - DNA, 1905 bp, Artificial Sequence; identical to SEQ ID NO: 100098
  Description of Artificial Sequence: Synthetic coding sequence

SEQ ID NO: 100100 - DNA, 1905 bp, Artificial Sequence
  Description of Artificial Sequence: Synthetic coding sequence
atgggcgagaacaaggacaagccctacctgctgtacttcaacatcttcagctgcatcctgagcagcaacatcatcagcgtggccgagaacggcctgcagtgccccaccccccaggtgtgcgtgagcagctgccccgaggacccctggaccgtgggcaagaacgagttcagccagaccgtgggcgaggtgttctacaccaagaacagaaacttctgcctgcccggcgtgccctggaacatgaccgtgatcaccagcctgcagcaggagctgtgccccagcttcctgctgcccagcgcccccgccctgggcagatgcttcccctggaccaacatcaccccccccgccctgcccggcatcaccaacgacaccaccatccagcagggcatcagcggcctgatcgacagcctgaacgccagagacatcagcgtgaagatcttcgaggacttcgcccagagctggtactggatcctggtggccctgggcgtggccctggtgctgagcctgctgttcatcctgctgctgagactggtggccggccccctggtgctggtgctgatcctgggcgtgctgggcgtgctggcctacggcatctactactgctgggaggagtacagagtgctgagagacaagggcgccagcatcagccagctgggcttcaccaccaacctgagcgcctaccagagcgtgcaggagacctggctggccgccctgatcgtgctggccgtgctggaggccatcctgctgctggtgctgatcttcctgagacagagaatcagaatcgccatcgccctgctgaaggaggccagcaaggccgtgggccagatgatgagcaccatgttctaccccctggtgaccttcgtgctgctgctgatctgcatcgcctactgggccatgaccgccctgtacctggccaccagcggccagccccagtacgtgctgtgggccagcaacatcagcagccccggctgcgagaaggtgcccatcaacaccagctgcaaccccaccgcccacctggtgaacagcagctgccccggcctgatgtgcgtgttccagggctacagcagcaagggcctgatccagagaagcgtgttcaacctgcagatctacggcgtgctgggcctgttctggaccctgaactgggtgctggccctgggccagtgcgtgctggccggcgccttcgccagcttctactgggccttccacaagccccaggacatccccaccttccccctgatcagcgccttcatcagaaccctgagataccacaccggcagcctggccttcggcgccctgatcctgaccctggtgcagatcgccagagtgatcctggagtacatcgaccacaagctgagaggcgtgcagaaccccgtggccagatgcatcatgtgctgcttcaagtgctgcctgtggtgcctggagaagttcatcaagttcctgaacagaaacgcctacatcatgatcgccatctacggcaagaacttctgcgtgagcgccaagaacgccttcatgctgctgatgagaaacatcgtgagagtggtggtgctggacaaggtgaccgacctgctgctgttcttcggcaagctgctggtggtgggcggcgtgggcgtgctgagcttcttcttcttcagcggcagaatccccggcctgggcaaggacttcaagagcccccacctgaactactactggctgcccatcatgaccagcatcctgggcgcctacgtgatcgccagcggcttcttcagcgtgttcggcatgtgcgtggacaccctgttcctgtgcttcctggaggacctggagagaaacaacggcagcctggacagaccctactacatgagcaagagcctgctgaagatcctgggcaagaagaacgaggccccccccgacaacaagaagagaaagaagtag

SEQ ID NO: 100101 - DNA, 2007 bp, Artificial Sequence
  Description of Artificial Sequence: Synthetic coding sequence
atgggcggcaagcagagagacgaggacgacgaggcctacggcaagcccgtgaagtacgaccccagcttcagaggccccatcaagaacagaagctgcaccgacgtgatctgctgcgtgctgttcctgctgttcatcctgggctacatcgtggtgggcatcgtggcctggctgtacggcgaccccagacaggtgctgtaccccagaaacagcaccggcgcctactgcggcatgggcgagaacaaggacaagccctacctgctgtacttcaacatcttcagctgcatcctgagcagcaacatcatcagcgtggccgagaacggcctgcagtgccccaccccccagaccgtgatcaccagcctgcagcaggagctgtgccccagcttcctgctgcccagcgcccccgccctgggcagatgcttcccctggaccaacatcaccccccccgccctgcccggcatcaccaacgacaccaccatccagcagggcatcagcggcctgatcgacagcctgaacgccagagacatcagcgtgaagatcttcgaggacttcgcccagagctggtactggatcctggtggccctgggcgtggccctggtgctgagcctgctgttcatcctgctgctgagactggtggccggccccctggtgctggtgctgatcctgggcgtgctgggcgtgctggcctacggcatctactactgctgggaggagtacagagtgctgagagacaagggcgccagcatcagccagctgggcttcaccaccaacctgagcgcctaccagagcgtgcaggagacctggctggccgccctgatcgtgctggccgtgctggaggccatcctgctgctggtgctgatcttcctgagacagagaatcagaatcgccatcgccctgctgaaggaggccagcaaggccgtgggccagatgatgagcaccatgttctaccccctggtgaccttcgtgctgctgctgatctgcatcgcctactgggccatgaccgccctgtacctggccaccagcggccagccccagtacgtgctgtgggccagcaacatcagcagccccggctgcgagaaggtgcccatcaacaccagctgcaaccccaccgcccacctggtgaacagcagctgccccggcctgatgtgcgtgttccagggctacagcagcaagggcctgatccagagaagcgtgttcaacctgcagatctacggcgtgctgggcctgttctggaccctgaactgggtgctggccctgggccagtgcgtgctggccggcgccttcgccagcttctactgggccttccacaagccccaggacatccccaccttccccctgatcagcgccttcatcagaaccctgagataccacaccggcagcctggccttcggcgccctgatcctgaccctggtgcagatcgccagagtgatcctggagtacatcgaccacaagctgagaggcgtgcagaaccccgtggccagatgcatcatgtgctgcttcaagtgctgcctgtggtgcctggagaagttcatcaagttcctgaacagaaacgcctacatcatgatcgccatctacggcaagaacttctgcgtgagcgccaagaacgccttcatgctgctgatgagaaacatcgtgagagtggtggtgctggacaaggtgaccgacctgctgctgttcttcggcaagctgctggtggtgggcggcgtgggcgtgctgagcttcttcttcttcagcggcagaatccccggcctgggcaaggacttcaagagcccccacctgaactactactggctgcccatcatgaccagcatcctgggcgcctacgtgatcgccagcggcttcttcagcgtgttcggcatgtgcgtggacaccctgttcctgtgcttcctggaggacctggagagaaacaacggcagcctggacagaccctactacatgagcaagagcctgctgaagatcctgggcaagaagaacgaggccccccccgacaacaagaagagaaagaagtag

SEQ ID NO: 100102 - DNA, 1905 bp, Artificial Sequence; identical to SEQ ID NO: 100098
  Description of Artificial Sequence: Synthetic coding sequence

SEQ ID NO: 100103 - DNA, 1905 bp, Artificial Sequence; identical to SEQ ID NO: 100098
  Description of Artificial Sequence: Synthetic coding sequence

SEQ ID NO: 100104 - DNA, 2007 bp, Artificial Sequence; identical to SEQ ID NO: 100084
  Description of Artificial Sequence: Synthetic coding sequence

SEQ ID NO: 100105 - DNA, 2007 bp, Artificial Sequence; identical to SEQ ID NO: 100084
  Description of Artificial Sequence: Synthetic coding sequence

SEQ ID NO: 100106 - DNA, 2007 bp, Artificial Sequence; identical to SEQ ID NO: 100101
  Description of Artificial Sequence: Synthetic coding sequence

SEQ ID NO: 100107 - DNA, 1905 bp, Artificial Sequence; identical to SEQ ID NO: 100100
  Description of Artificial Sequence: Synthetic coding sequence

SEQ ID NO: 100108 - DNA, 2007 bp, Artificial Sequence; identical to SEQ ID NO: 100084
  Description of Artificial Sequence: Synthetic coding sequence

SEQ ID NO: 100109 - DNA, 2007 bp, Artificial Sequence; identical to SEQ ID NO: 100101
  Description of Artificial Sequence: Synthetic coding sequence

SEQ ID NO: 100110 - DNA, 1905 bp, Artificial Sequence; identical to SEQ ID NO: 100100
  Description of Artificial Sequence: Synthetic coding sequence

SEQ ID NO: 100111 - DNA, 2247 bp, Artificial Sequence
  Description of Artificial Sequence: Synthetic coding sequence
atgatccccgccgccagcagcaccccccccggcgacgccctgttccccagcgtggccccccaggacttctggagaagccaggtgaccggctacagcggcagcgtgaccagacacctgagccacagagccaacaacttcaagagacaccccaagagaagaaagtgcatcagacccagccccccccccccccccaacaccccctgccccctggagctggtggacttcggcgacctgcacccccagagaagcttcagagagctgctgttcaacggctgcatcctgttcggcatcgagttcagctacgccatggagaccgcctacgtgacccccgtgctgctgcagatgggcctgcccgaccagctgtacagcctggtgtggttcatcagccccatcctgggcttcctgctgcagcccctgctgggcgcctggagcgacagatgcaccagcagattcggcagaagaagacccttcatcctggtgctggccatcggcgccctgctgggcctgagcctgctgctgaacggcagagacatcggcatcgccctggccgacgtgaccggcaaccacaagtggggcctgctgctgaccgtgtgcggcgtggtgctgatggacttcagcgccgacagcgccgacaaccccagccacgcctacatgatggacgtgtgcagccccgccgaccaggacagaggcctgaacatccacgccctgctggccggcctgggcggcggcttcggctacgtggtgggcggcatccactgggacaagaccggcttcggcagagccctgggcggccagctgagagtgatctacctgttcaccgccgtgaccctgagcgtgaccaccgtgctgaccctggtgagcatccccgagagacccctgagaccccccagcgagaagagagccgccatgaagagccccagcctgcccctgccccccagcccccccgtgctgcccgaggagggccccggcgacagcctgcccagccacaccgccaccaacttcagcagccccatcagcccccccagccccctgacccccaagtacggcagcttcatcagcagagacagcagcctgaccggcatcagcgagttcgccagcagcttcggcaccgccaacatcgacagcgtgctgatcgactgcttcaccggcggccacgacagctacctggccatccccggcagcgtgcccagaccccccatcagcgtgagcttccccagagcccccgacggcttctacagacaggacagaggcctgctggagggcagagagggcgccctgaccagcggctgcgacggcgacatcctgagagtgggcagcctggacaccagcaagcccagaagcagcggcatcctgaagagaccccagaccctggccatccccgacgccgccggcggcggcggccccgagaccagcagaagaagaaacgtgaccttcagccagcaggtggccaacatcctgctgaacggcgtgaagtacgagagcgagctgaccggcagcagcgagagagccgagcagcccctgagcgtgggcagactgtgcagcaccatctgcaacatgcccaaggccctgagaaccctgtgcgtgaaccacttcctgggctggctgagcttcgagggcatgctgctgttctacaccgacttcatgggcgaggtggtgttccagggcgaccccaaggccccccacaccagcgaggcctaccagaagtacaacagcggcgtgaccatgggctgctggggcatgtgcatctacgccttcagcgccgccttctacagcgccatcctggagaagctggaggagttcctgagcgtgagaaccctgtacttcatcgcctacctggccttcggcctgggcaccggcctggccaccctgagcagaaacctgtacgtggtgctgagcctgtgcatcacctacggcatcctgttcagcaccctgtgcaccctgccctacagcctgctgtgcgactactaccagagcaagaagttcgccggcagcagcgccgacggcaccagaagaggcatgggcgtggacatcagcctgctgagctgccagtacttcctggcccagatcctggtgagcctggtgctgggccccctgaccagcgccgtgggcagcgccaacggcgtgatgtacttcagcagcctggtgagcttcctgggctgcctgtacagcagcctgttcgtgatctacgagatcccccccagcgacgccgccgacgaggagcacagacccctgctgctgaacgtgtag

SEQ ID NO: 100112 - DNA, 2349 bp, Artificial Sequence
  Description of Artificial Sequence: Synthetic coding sequence
atgctgcagcagcccggccccagacccggcagacagcagcccagcggcgacagagacgcctgcagactgcacccccagggcagaccccccgccctgcccaccatgatccccgccgccagcagcaccccccccggcgacgccctgttccccagcgtggccccccaggacttctggagaagccaggtgaccggctacagcggcagcgtgaccagacacctgagccacagagccaacaacttcaagagacaccccaagagaagaaagtgcatcagacccagccccccccccccccccaacaccccctgccccctggagctggtggacttcggcgacctgcacccccagagaagcttcagagagctgctgttcaacggctgcatcctgttcggcatcgagttcagctacgccatggagaccgcctacgtgacccccgtgctgctgcagatgggcctgcccgaccagctgtacagcctggtgtggttcatcagccccatcctgggcttcctgctgcagcccctgctgggcgcctggagcgacagatgcaccagcagattcggcagaagaagacccttcatcctggtgctggccatcggcgccctgctgggcctgagcctgctgctgaacggcagagacatcggcatcgccctggccgacgtgaccggcaaccacaagtggggcctgctgctgaccgtgtgcggcgtggtgctgatggacttcagcgccgacagcgccgacaaccccagccacgcctacatgatggacgtgtgcagccccgccgaccaggacagaggcctgaacatccacgccctgctggccggcctgggcggcggcttcggctacgtggtgggcggcatccactgggacaagaccggcttcggcagagccctgggcggccagctgagagtgatctacctgttcaccgccgtgaccctgagcgtgaccaccgtgctgaccctggtgagcatccccgagagacccctgagaccccccagcgagaagagagccgccatgaagagccccagcctgcccctgccccccagcccccccgtgctgcccgaggagggccccggcgacagcctgcccagccacaccgccaccaacttcagcagccccatcagcccccccagccccctgacccccaagtacggcagcttcatcagcagagacagcagcctgaccggcatcagcgagttcgccagcagcttcggcaccgccaacatcgacagcgtgctgatcgactgcttcaccggcggccacgacagctacctggccatccccggcagcgtgcccagaccccccatcagcgtgagcttccccagagcccccgacggcttctacagacaggacagaggcctgctggagggcagagagggcgccctgaccagcggctgcgacggcgacatcctgagagtgggcagcctggacaccagcaagcccagaagcagcggcatcctgaagagaccccagaccctggccatccccgacgccgccggcggcggcggccccgagaccagcagaagaagaaacgtgaccttcagccagcaggtggccaacatcctgctgaacggcgtgaagtacgagagcgagctgaccggcagcagcgagagagccgagcagcccctgagcgtgggcagactgtgcagcaccatctgcaacatgcccaaggccctgagaaccctgtgcgtgaaccacttcctgggctggctgagcttcgagggcatgctgctgttctacaccgacttcatgggcgaggtggtgttccagggcgaccccaaggccccccacaccagcgaggcctaccagaagtacaacagcggcgtgaccatgggctgctggggcatgtgcatctacgccttcagcgccgccttctacagcgccatcctggagaagctggaggagttcctgagcgtgagaaccctgtacttcatcgcctacctggccttcggcctgggcaccggcctggccaccctgagcagaaacctgtacgtggtgctgagcctgtgcatcacctacggcatcctgttcagcaccctgtgcaccctgccctacagcctgctgtgcgactactaccagagcaagaagttcgccggcagcagcgccgacggcaccagaagaggcatgggcgtggacatcagcctgctgagctgccagtacttcctggcccagatcctggtgagcctggtgctgggccccctgaccagcgccgtgggcagcgccaacggcgtgatgtacttcagcagcctggtgagcttcctgggctgcctgtacagcagcctgttcgtgatctacgagatcccccccagcgacgccgccgacgaggagcacagacccctgctgctgaacgtgtag

SEQ ID NO: 100113 - DNA, 2247 bp, Artificial Sequence; identical to SEQ ID NO: 100111
  Description of Artificial Sequence: Synthetic coding sequence

SEQ ID NO: 100114 - DNA, 1593 bp, Artificial Sequence
  Description of Artificial Sequence: Synthetic coding sequence
atgggcagcaacagcggccaggccggcagacacatctacaagagcctggccgacgacggccccttcgacagcgtggagccccccaagagacccaccagcagactgatcatgcacagcatggccatgttcggcagagagttctgctacgccgtggaggccgcctacgtgacccccgtgctgctgagcgtgggcctgcccagcagcctgtacagcatcgtgtggttcctgagccccatcctgggcttcctgctgcagcccgtggtgggcagcgccagcgaccactgcagaagcagatggggcagaagaagaccctacatcctgaccctgggcgtgatgatgctggtgggcatggccctgtacctgaacggcgccaccgtggtggccgccctgatcgccaaccccagaagaaagctggtgtgggccatcagcgtgaccatgatcggcgtggtgctgttcgacttcgccgccgacttcatcgacggccccatcaaggcctacctgttcgacgtgtgcagccaccaggacaaggagaagggcctgcactaccacgccctgttcaccggcttcggcggcgccctgggctacctgctgggcgccatcgactgggcccacctggagctgggcagactgctgggcaccgagttccaggtgatgttcttcttcagcgccctggtgctgaccctgtgcttcaccgtgcacctgtgcagcatcagcgaggcccccctgaccgaggtggccaagggcatccccccccagcagaccccccaggacccccccctgagcagcgacggcatgtacgagtacggcagcatcgagaaggtgaagaacggctacgtgaaccccgagctggccatgcagggcgccaagaacaagaaccacgccgagcagaccagaagagccatgaccctgaagagcctgctgagagccctggtgaacatgcccccccactacagatacctgtgcatcagccacctgatcggctggaccgccttcctgagcaacatgctgttcttcaccgacttcatgggccagatcgtgtacagaggcgacccctacagcgcccacaacagcaccgagttcctgatctacgagagaggcgtggaggtgggctgctggggcctgtgcatcaacagcgtgttcagcagcctgtacagctacttccagaaggtgctggtgagctacatcggcctgaagggcctgtacttcaccggctacctgctgttcggcctgggcaccggcttcatcggcctgttccccaacgtgtacagcaccctggtgctgtgcagcctgttcggcgtgatgagcagcaccctgtacaccgtgcccttcaacctgatcaccgagtaccacagagaggaggagaaggagagacagcaggcccccggcggcgaccccgacaacagcgtgagaggcaagggcatggactgcgccaccctgacctgcatggtgcagctggcccagatcctggtgggcggcggcctgggcttcctggtgaacaccgccggcaccgtggtggtggtggtgatcaccgccagcgccgtggccctgatcggctgctgcttcgtggccctgttcgtgagatacgtggactag

SEQ ID NO: 100115 - DNA, 1416 bp, Artificial Sequence
  Description of Artificial Sequence: Synthetic coding sequence
atgggcagcaacagcggccaggccggcagacacatctacaagagcctggccgacgacggccccttcgacagcgtggagccccccaagagacccaccagcagactgatcatgcacagcatggccatgttcggcagagagttctgctacgccgtggaggccgcctacgtgacccccgtgctgctgagcgtgggcctgcccagcagcctgtacagcatcgtgtggttcctgagccccatcctgggcttcctgctgcagcccgtggtgggcagcgccagcgaccactgcagaagcagatggggcagaagaagaccctacatcctgaccctgggcgtgatgatgctggtgggcatggccctgtacctgaacggcgccaccgtggtggccggcttcggcggcgccctgggctacctgctgggcgccatcgactgggcccacctggagctgggcagactgctgggcaccgagttccaggtgatgttcttcttcagcgccctggtgctgaccctgtgcttcaccgtgcacctgtgcagcatcagcgaggcccccctgaccgaggtggccaagggcatccccccccagcagaccccccaggacccccccctgagcagcgacggcatgtacgagtacggcagcatcgagaaggtgaagaacggctacgtgaaccccgagctggccatgcagggcgccaagaacaagaaccacgccgagcagaccagaagagccatgaccctgaagagcctgctgagagccctggtgaacatgcccccccactacagatacctgtgcatcagccacctgatcggctggaccgccttcctgagcaacatgctgttcttcaccgacttcatgggccagatcgtgtacagaggcgacccctacagcgcccacaacagcaccgagttcctgatctacgagagaggcgtggaggtgggctgctggggcctgtgcatcaacagcgtgttcagcagcctgtacagctacttccagaaggtgctggtgagctacatcggcctgaagggcctgtacttcaccggctacctgctgttcggcctgggcaccggcttcatcggcctgttccccaacgtgtacagcaccctggtgctgtgcagcctgttcggcgtgatgagcagcaccctgtacaccgtgcccttcaacctgatcaccgagtaccacagagaggaggagaaggagagacagcaggcccccggcggcgaccccgacaacagcgtgagaggcaagggcatggactgcgccaccctgacctgcatggtgcagctggcccagatcctggtgggcggcggcctgggcttcctggtgaacaccgccggcaccgtggtggtggtggtgatcaccgccagcgccgtggccctgatcggctgctgcttcgtggccctgttcgtgagatacgtggactag

SEQ ID NO: 100116 - DNA, 897 bp, Artificial Sequence
  Description of Artificial Sequence: Synthetic coding sequence
atgggcagcaacagcggccaggccggcagacacatctacaagagcctggccgacgacggccccttcgacagcgtggagccccccaagagacccaccagcagactgatcatgcacagcatggccatgttcggcagagagttctgctacgccgtggaggccgcctacgtgacccccgtgctgctgagcgtgggcctgcccagcagcctgtacagcatcgtgtggttcctgagccccatcctgggcttcctgctgcagcccgtggtgggcagcgccagcgaccactgcagaagcagatggggcagaagaagaccctacatcctgaccctgggcgtgatgatgctggtgggcatggccctgtacctgaacggcgccaccgtggtggccgccctgatcgccaaccccagaagaaagctggtgtgggccatcagcgtgaccatgatcggcgtggtgctgttcgacttcgccgccgacttcatcgacggccccatcaaggcctacctgttcgacgtgtgcagccaccaggacaaggagaagggcctgcactaccacgccctgttcaccggcaccagaagagccatgaccctgaagagcctgctgagagccctggtgaacatgcccccccactacagatacctgtgcatcagccacctgatcggctggaccgccttcctgagcaacatgctgttcttcaccgacttcatgggccagatcgtgtacagaggcgacccctacagcgcccacaacagcaccgagttcctgatctacgagagaggcgtggaggtgggctgctggggcctgtgcatcaacagcgtgttcagcagcctgtacagctgcaagagcttcagcctgctgagaatgagcagcaagagcttctggagcagcaccacctggatctag

SEQ ID NO: 100117 - DNA, 1383 bp, Artificial Sequence
  Description of Artificial Sequence: Synthetic coding sequence
atgggcagcaacagcggccaggccggcagacacatctacaagagcctggccgacgacggccccttcgacagcgtggagccccccaagagacccaccagcagactgatcatgcacagcatggccatgttcggcagagagttctgctacgccgtggaggccgcctacgtgacccccgtgctgctgagcgtgggcctgcccagcagcctgtacagcatcgtgtggttcctgagccccatcctgggcttcctgctgcagcccgtggtgggcagcgccagcgaccactgcagaagcagatggggcagaagaagaccctacatcctgaccctgggcgtgatgatgctggtgggcatggccctgtacctgaacggcgccaccgtggtggccgccctgatcgccaaccccagaagaaagctggtgtgggccatcagcgtgaccatgatcggcgtggtgctgttcgacttcgccgccgacttcatcgacggccccatcaaggcctacctgttcgacgtgtgcagccaccaggacaaggagaagggcctgcactaccacgccctgttcaccggcttcggcggcgccctgggctacctgctgggcgccatcgactgggcccacctggagctgggcagactgctgggcaccgagttccaggtgatgttcttcttcagcgccctggtgctgaccctgtgcttcaccgtgcacctgtgcagcatcagcgaggcccccctgaccgaggtggccaagggcatccccccccagcagaccccccaggacccccccctgagcagcgacggcatgtacgagtacggcagcatcgagaaggtgaagaacggctacgtgaaccccgagctggccatgcagggcgccaagaacaagaaccacgccgagcagaccagaagagccatgaccctgaagagcctgctgagagccctggtgaacatgcccccccactacagatacctgtgcatcagccacctgatcggctggaccgccttcctgagcaacatgctgttcttcaccgacttcatgggccagatcgtgtacagaggcgacccctacagcgcccacaacagcaccgagttcctgatctacgagagaggcgtggaggtgggctgctggggcctgtgcatcaacagcgtgttcagcagcctgtacagctacttccagaaggtgctggtgagctacatcggcctgaagggcctgtacttcaccggctacctgctgttcggcctgggcaccggcttcatcggcctgttccccaacgtgtacagcaccctggtgctgtgcagcctgttcggcgtgatgagcagcaccctgtacaccgtgcccttcaacctgatcaccgagtaccacagagaggaggagaaggaggtgtgctgccactag

SEQ ID NO: 100118 - DNA, 732 bp, Artificial Sequence
  Description of Artificial Sequence: Synthetic coding sequence
atgggcagcaacagcggccaggccggcagacacatctacaagagcctggccgacgacggccccttcgacagcgtggagccccccaagagacccaccagcagactgatcatgcacagcatggccatgttcggcagagagttctgctacgccgtggaggccgcctacgtgacccccgtgctgctgagcgtgggcctgcccagcagcctgtacagcatcgtgtggttcctgagccccatcctgggcttcctgctgcagcccgtggtgggcagcgccagcgaccactgcagaagcagatggggcagaagaagaccctacatcctgaccctgggcgtgatgatgctggtgggcatggccctgtacctgaacggcgccaccgtggtggccgccctgatcgccaaccccagaagaaagctggtgtgggccatcagcgtgaccatgatcggcgtggtgctgttcgacttcgccgccgacttcatcgacggccccatcaaggcctacctgttcgacgtgtgcagccaccaggacaaggagaagggcctgcactaccacgccctgttcaccgacagccagggcaacgacatcaaggtgaccgccgagagcaccggcgagcacgccagcagcctgcccctgcccctgcaccagcccccccactggatggacagcctgcccgtgcagcacgccgtgctgcacagattccacggccccgactgcgtgcccagaggcagcctgtag

SEQ ID NO: 100119 - DNA, 741 bp, Artificial Sequence
  Description of Artificial Sequence: Synthetic coding sequence
atggccctgtacctgaacggcgccaccgtggtggccggcttcggcggcgccctgggctacctgctgggcgccatcgactgggcccacctggagctgggcagactgctgggcaccgagttccaggtgatgttcttcttcagcgccctggtgctgaccctgtgcttcaccgtgcacctgtgcagcatcagcgaggcccccctgaccgaggtggccaagggcatccccccccagcagaccccccaggacccccccctgagcagcgacggcatgtacgagtacggcagcatcgagaaggtgaagaacggctacgtgaaccccgagctggccatgcagggcgccaagaacaagaaccacgccgagcagaccagaagagccatgaccctgaagagcctgctgagagccctggtgaacatgcccccccactacagatacctgtgcatcagccacctgatcggctggaccgccttcctgagcaacatgctgttcttcaccgacttcatgggccagatcgtgtacagaggcgacccctacagcgcccacaacagcaccgagttcctgatctacgagagaggcgtggaggtgggctgctggggcctgtgcatcaacagcgtgttcagcagcctgtacagctacttccagaaggtgctggtgagctacatcggcctgaagggcctgtacttcaccggctacctgctgttcggcctgggcaccggcttcatcggcctgttccccaacgtgtag

SEQ ID NO: 100120 - DNA, 1662 bp, Artificial Sequence
  Description of Artificial Sequence: Synthetic coding sequence
atggtgcagagactgtgggtgagcagactgctgagacacagaaaggcccagctgctgctggtgaacctgctgaccttcggcctggaggtgtgcctggccgccggcatcacctacgtgccccccctgctgctggaggtgggcgtggaggagaagttcatgaccatggtgctgggcatcggccccgtgctgggcctggtgtgcgtgcccctgctgggcagcgccagcgaccactggagaggcagatacggcagaagaagacccttcatctgggccctgagcctgggcatcctgctgagcctgttcctgatccccagagccggctggctggccggcctgctgtgccccgaccccagacccctggagctggccctgctgatcctgggcgtgggcctgctggacttctgcggccaggtgtgcttcacccccctggaggccctgctgagcgacctgttcagagaccccgaccactgcagacaggcctacagcgtgtacgccttcatgatcagcctgggcggctgcctgggctacctgctgcccgccatcgactgggacaccagcgccctggccccctacctgggcacccaggaggagtgcctgttcggcctgctgaccctgatcttcctgacctgcgtggccgccaccctgctggtggccgaggaggccgccctgggccccaccgagcccgccgagggcctgagcgcccccagcctgagcccccactgctgcccctgcagagccagactggccttcagaaacctgggcgccctgctgcccagactgcaccagctgtgctgcagaatgcccagaaccctgagaagactgttcgtggccgagctgtgcagctggatggccctgatgaccttcaccctgttctacaccgacttcgtgggcgagggcctgtaccagggcgtgcccagagccgagcccggcaccgaggccagaagacactacgacgagggcgtgagaatgggcagcctgggcctgttcctgcagtgcgccatcagcctggtgttcagcctggtgatggacagactggtgcagagattcggcaccagagccgtgtacctggccagcgtggccgccttccccgtggccgccggcgccacctgcctgagccacagcgtggccgtggtgaccgccagcgccgccctgaccggcttcaccttcagcgccctgcagatcctgccctacaccctggccagcctgtaccacagagagaagcaggtgttcctgcccaagtacagaggcgacaccggcggcgccagcagcgaggacagcctgatgaccagcttcctgcccggccccaagcccggcgcccccttccccaacggccacgtgggcgccggcggcagcggcctgctgccccccccccccgccctgtgcggcgccagcgcctgcgacgtgagcgtgagagtggtggtgggcgagcccaccgaggccagagtggtgcccggcagaggcatctgcctggacctggccatcctggacagcgccttcctgctgagccaggtggcccccagcctgttcatgggcagcatcgtgcagctgagccagagcgtgaccgcctacatggtgagcgccgccggcctgggcctggtggccatctacttcgccacccaggtggtgttcgacaagagcgacctggccaagtacagcgcctag

SEQ ID NO: 100121 - DNA, 1293 bp, Artificial Sequence
  Description of Artificial Sequence: Synthetic coding sequence
atggagggcagcgccagcccccccgagaagcccagagccagacccgccgccgccgtgctgtgcagaggccccgtggagcccctggtgttcctggccaacttcgccctggtgctgcagggccccctgaccacccagtacctgtggcacagattcagcgccgacctgggctacaacggcaccagacagagaggcggctgcagcaacagaagcgccgaccccaccatgcaggaggtggagaccctgaccagccactggaccctgtacatgaacgtgggcggcttcctggtgggcctgttcagcagcaccctgctgggcgcctggagcgacagcgtgggcagaagacccctgctggtgctggccagcctgggcctgctgctgcaggccctggtgagcgtgttcgtggtgcagctgcagctgcacgtgggctacttcgtgctgggcagaatcctgtgcgccctgctgggcgacttcggcggcctgctggccgccagcttcgccagcgtggccgacgtgagcagcagcagaagcagaaccttcagaatggccctgctggaggccagcatcggcgtggccggcatgctggccagcctgctgggcggccactggctgagagcccagggctacgccaaccccttctggctggccctggccctgctgatcgccatgaccctgtacgccgccttctgcttcggcgagaccctgaaggagcccaagagcaccagactgttcaccttcagacaccacagaagcatcgtgcagctgtacgtggcccccgcccccgagaagagcagaaagcacctggccctgtacagcctggccatcttcgtggtgatcaccgtgcacttcggcgcccaggacatcctgaccctgtacgagctgagcacccccctgtgctgggacagcaagctgatcggctacggcagcgccgcccagcacctgccctacctgaccagcctgctggccctgaagctgctgcagtactgcctggccgacgcctgggtggccgagatcggcctggccttcaacatcctgggcatggtggtgttcgccttcgccaccatcacccccctgatgttcaccggcgccctgttcagcgccgtggcctgcgtgaacagcctggccatgctgaccgccagcggcttcaacagcctgtaccccgccaccctgaacttcatgaagggcttccccttcctgctgggcgccggcctgctgctgatccccgccgtgctgatcggcatgctggagaaggccgacccccacctggagttccagcagttcccccagagcccctag

SEQ ID NO: 100122 - DNA, 1380 bp, Artificial Sequence
  Description of Artificial Sequence: Synthetic coding sequence
atggagggcagcgccagcccccccgagaagcccagagccagacccgccgccgccgtgctgtgcagaggccccgtggagcccctggtgttcctggccaacttcgccctggtgctgcagggccccctgaccacccagtacctgtggcacagattcagcgccgacctgggctacaacggcaccagacagagaggcggctgcagcaacagaagcgccgaccccaccatgcaggaggtggagaccctgaccagccactggaccctgtacatgaacgtgggcggcttcctggtgggcctgttcagcagcaccctgctgggcgcctggagcgacagcgtgggcagaagacccctgctggtgctggccagcctgggcctgctgctgcaggccctggtgagcgtgttcgtggtgcagctgcagctgcacgtgggctacttcgtgctgggcagaatcctgtgcgccctgctgggcgacttcggcggcctgctggccgccagcttcgccagcgtggccgacgtgagcagcagcagaagcagaaccttcagaatggccctgctggaggccagcatcggcgtggccggcatgctggccagcctgctgggcggccactggctgagagcccagggctacgccaaccccttctggctggccctggccctgctgatcgccatgaccctgtacgccgccttctgcttcggcgagaccctgaaggagcccaagagcaccagactgttcaccttcagacaccacagaagcatcgtgcagctgtacgtggcccccgcccccgagaagagcagaaagcacctggccctgtacagcctggccatcttcgtggtgatcaccgtgcacttcggcgcccaggacatcctgaccctgtacgagctgagcacccccctgtgctgggacagcaagctgatcggctacggcagcgccgcccagcacctgccctacctgaccagcctgctggccctgaagctgctgcagtactgcctggccgacgcctgggtggccgagatcggcctggccttcaacatcctgggcatggtggtgttcgccttcgccaccatcacccccctgatgttcaccggctacggcctgctgttcctgagcctggtgatcacccccgtgatcagagccaagctgagcaagctggtgagagagaccgagcagggcgccctgttcagcgccgtggcctgcgtgaacagcctggccatgctgaccgccagcggcatcttcaacagcctgtaccccgccaccctgaacttcatgaagggcttccccttcctgctgggcgccggcctgctgctgatccccgccgtgctgatcggcatgctggagaaggccgacccccacctggagttccagcagttcccccagagcccctag

SEQ ID NO: 100123 - DNA, 1428 bp, Artificial Sequence
  Description of Artificial Sequence: Synthetic coding sequence
atgagccccgaggtgacctgccccagaagaggccacctgcccagattccaccccagaacctgggtggagcccgtggtggccagcagccaggtggccgccagcctgtacgacgccggcctgctgctggtggtgaaggccagctacggcaccggcggcagcagcaaccacagcgccagccccagccccagaggcgccctggaggaccagcagcagagagccatcagcaacttctacatcatctacaacctggtggtgggcctgagccccctgctgagcgcctacggcctgggctggctgagcgacagataccacagaaagatcagcatctgcatgagcctgctgggcttcctgctgagcagactgggcctgctgctgaaggtgctgctggactggcccgtggaggtgctgtacggcgccgccgccctgaacggcctgttcggcggcttcagcgccttctggagcggcgtgatggccctgggcagcctgggcagcagcgagggcagaagaagcgtgagactgatcctgatcgacctgatgctgggcctggccggcttctgcggcagcatggccagcggccacctgttcaagcagatggccggccacagcggccagggcctgatcctgaccgcctgcagcgtgagctgcgccagcttcgccctgctgtacagcctgctggtgctgaaggtgcccgagagcgtggccaagcccagccaggagctgcccgccgtggacaccgtgagcggcaccgtgggcacctacagaaccctggaccccgaccagctggaccagcagtacgccgtgggccacccccccagccccggcaaggccaagccccacaagaccaccatcgccctgctgttcgtgggcgccatcatctacgacctggccgtggtgggcaccgtggacgtgatccccctgttcgtgctgagagagcccctgggctggaaccaggtgcaggtgggctacggcatggccgccggctacaccatcttcatcaccagcttcctgggcgtgctggtgttcagcagatgcttcagagacaccaccatgatcatgatcggcatggtgagcttcggcagcggcgccctgctgctggccttcgtgaaggagacctacatgttctacatcgccagagccgtgatgctgttcgccctgatccccgtgaccaccatcagaagcgccatgagcaagctgatcaagggcagcagctacggcaaggtgttcgtgatcctgcagctgagcctggccctgaccggcgtggtgaccagcaccctgtacaacaagatctaccagctgaccatggacatgttcgtgggcagctgcttcgccctgagcagcttcctgagcttcctggccatcatccccatcagcatcgtggcctacaagcaggtgcccctgagcccctacggcgacatcatcgagaagtag

SEQ ID NO: 100124 - DNA, 1713 bp, Artificial Sequence
  Description of Artificial Sequence: Synthetic coding sequence
atggaggcccccgaggagcccgcccccgtgagaggcggccccgaggccaccctggaggtgagaggcagcagatgcctgagactgagcgccttcagagaggagctgagagccctgctggtgctggccggccccgccttcctggtgcagctgatggtgttcctgatcagcttcatcagcagcgtgttctgcggccacctgggcaagctggagctggacgccgtgaccctggccatcgccgtgatcaacgtgaccggcgtgagcgtgggcttcggcctgagcagcgcctgcgacaccctgatcagccagacctacggcagccagaacctgaagcacgtgggcgtgatcctgcagagaagcgccctggtgctgctgctgtgctgcttcccctgctgggccctgttcctgaacacccagcacatcctgctgctgttcagacaggaccccgacgtgagcagactgacccagacctacgtgaccatcttcatccccgccctgcccgccaccttcctgtacatgctgcaggtgaagtacctgctgaaccagggcatcgtgctgccccagatcgtgaccggcgtggccgccaacctggtgaacgccctggccaactacctgttcctgcaccagctgcacctgggcgtgatcggcagcgccctggccaacctgatcagccagtacaccctggccctgctgctgttcctgtacatcctgggcaagaagctgcaccaggccacctggggcggctggagcctggagtgcctgcaggactgggccagcttcctgagactggccatccccagcatgctgatgctgtgcatggagtggtgggcctacgaggtgggcagcttcctgagcggcatcctgggcatggtggagctgggcgcccagagcatcgtgtacgagctggccatcatcgtgtacatggtgcccgccggcttcagcgtggccgccagcgtgagagtgggcaacgccctgggcgccggcgacatggagcaggccagaaagagcagcaccgtgagcctgctgatcaccgtgctgttcgccgtggccttcagcgtgctgctgctgagctgcaaggaccacgtgggctacatcttcaccaccgacagagacatcatcaacctggtggcccaggtggtgcccatctacgccgtgagccacctgttcgaggccctggcctgcaccagcggcggcgtgctgagaggcagcggcaaccagaaggtgggcgccatcgtgaacaccatcggctactacgtggtgggcctgcccatcggcatcgccctgatgttcgccaccaccctgggcgtgatgggcctgtggagcggcatcatcatctgcaccgtgttccaggccgtgtgcttcctgggcttcatcatccagctgaactggaagaaggcctgccagcaggcccaggtgcacgccaacctgaaggtgaacaacgtgcccagaagcggcaacagcgccctgccccaggaccccctgcaccccggctgccccgagaacctggagggcatcctgaccaacgacgtgggcaagaccggcgagccccagagcgaccagcagatgagacaggaggagcccctgcccgagcacccccaggacggcgccaagctgagcagaaagcagctggtgctgagaagaggcctgctgctgctgggcgtgttcctgatcctgctggtgggcatcctggtgagattctacgtgagaatccagtag

SEQ ID NO: 100125 - DNA, 1761 bp, Artificial Sequence
  Description of Artificial Sequence: Synthetic coding sequence
atggaggcccccgaggagcccgcccccgtgagaggcggccccgaggccaccctggaggtgagaggcagcagatgcctgagactgagcgccttcagagaggagctgagagccctgctggtgctggccggccccgccttcctggtgcagctgatggtgttcctgatcagcttcatcagcagcgtgttctgcggccacctgggcaagctggagctggacgccgtgaccctggccatcgccgtgatcaacgtgaccggcgtgagcgtgggcttcggcctgagcagcgcctgcgacaccctgatcagccagacctacggcagccagaacctgaagcacgtgggcgtgatcctgcagagaagcgccctggtgctgctgctgtgctgcttcccctgctgggccctgttcctgaacacccagcacatcctgctgctgttcagacaggaccccgacgtgagcagactgacccagacctacgtgaccatcttcatccccgccctgcccgccaccttcctgtacatgctgcaggtgaagtacctgctgaaccagggcatcgtgctgccccagatcgtgaccggcgtggccgccaacctggtgaacgccctggccaactacctgttcctgcaccagctgcacctgggcgtgatcggcagcgccctggccaacctgatcagccagtacaccctggccctgctgctgttcctgtacatcctgggcaagaagctgcaccaggccacctggggcggctggagcctggagtgcctgcaggactgggccagcttcctgagactggccatccccagcatgctgatgctgtgcatggagtggtgggcctacgaggtgggcagcttcctgagcggcatcctgggcatggtggagctgggcgcccagagcatcgtgtacgagctggccatcatcgtgtacatggtgcccgccggcttcagcgtggccgccagcgtgagagtgggcaacgccctgggcgccggcgacatggagcaggccagaaagagcagcaccgtgagcctgctgatcaccgtgctgttcgccgtggccttcagcgtgctgctgctgagctgcaaggaccacgtgggctacatcttcaccaccgacagagacatcatcaacctggtggcccaggtggtgcccatctacgccgtgagccacctgttcgaggccctggcctgcaccagcggcggcgtgctgagaggcagcggcaaccagaaggtgggcgccatcgtgaacaccatcggctactacgtggtgggcctgcccatcggcatcgccctgatgttcgccaccaccctgggcgtgatgggcctgtggagcggcatcatcatctgcaccgtgttccaggccgtgtgcttcctgggcttcatcatccagctgaactggaagaaggcctgccagcaggcccaggtgcacgccaacctgaaggtgaacaacgtgcccagaagcggcaacagcgccctgccccaggaccccctgcaccccggctgccccgagaacctggagggcatcctgaccaacgacgtgggcaagaccggcgagccccagagcgaccagcagatgagacaggaggagcccctgcccgagcacccccaggacggcgccaagctgagcagaaagcagctggtgctgagaagaggcctgctgctgctgggcgtgttcctgatcctgctggccggcgtgagatggtgcgaccacagcagcctgcagcccagaaccctgggcctgcaggccatcctgctgtgccagccccccgagtag

SEQ ID NO: 100126 - DNA, 849 bp, Artificial Sequence
  Description of Artificial Sequence: Synthetic coding sequence
atggtggagctgggcgcccagagcatcgtgtacgagctggccatcatcgtgtacatggtgcccgccggcttcagcgtggccgccagcgtgagagtgggcaacgccctgggcgccggcgacatggagcaggccagaaagagcagcaccgtgagcctgctgatcaccgtgctgttcgccgtggccttcagcgtgctgctgctgagctgcaaggaccacgtgggctacatcttcaccaccgacagagacatcatcaacctggtggcccaggtggtgcccatctacgccgtgagccacctgttcgaggccctggcctgcaccagcggcggcgtgctgagaggcagcggcaaccagaaggtgggcgccatcgtgaacaccatcggctactacgtggtgggcctgcccatcggcatcgccctgatgttcgccaccaccctgggcgtgatgggcctgtggagcggcatcatcatctgcaccgtgttccaggccgtgtgcttcctgggcttcatcatccagctgaactggaagaaggcctgccagcaggcccaggtgcacgccaacctgaaggtgaacaacgtgcccagaagcggcaacagcgccctgccccaggaccccctgcaccccggctgccccgagaacctggagggcatcctgaccaacgacgtgggcaagaccggcgagccccagagcgaccagcagatgagacaggaggagcccctgcccgagcacccccaggacggcgccaagctgagcagaaagcagctggtgctgagaagaggcctgctgctgctgggcgtgttcctgatcctgctggtgggcatcctggtgagattctacgtgagaatccagtag

SEQ ID NO: 100127 - DNA, 1332 bp, Artificial Sequence
  Description of Artificial Sequence: Synthetic coding sequence
atggaggcccccgaggagcccgcccccgtgagaggcggccccgaggccaccctggaggtgagaggcagcagatgcctgagactgagcgccttcagagaggagctgagagccctgctggtgctggccggccccgccttcctggtgcagctgatggtgttcctgatcagcttcatcagcagcgtgttctgcggccacctgggcaagctggagctggacgccgtgaccctggccatcgccacctacggcagccagaacctgaagcacgtgggcgtgatcctgcagagaagcgccctggtgctgctgctgtgctgcttcccctgctgggccctgttcctgaacacccagcacatcctgctgctgttcagacaggaccccgacgtgagcagactgacccagacctacgtgaccatcttcatccccgccctgcccgccaccttcctgtacatgctgcaggtgaagtacctgctgaaccagggcatcgtgctgccccagatcgtgaccggcgtggccgccaacctggtgaacgccctggccaactacctgttcctgcaccagctgcacctgggcgtgatcggcagcgccctggccaacctgatcagccagtacaccctggccctgctgctgttcctgtacatcctgggcaagaagctgcaccaggccacctggggcggctggagcctggagtgcctgcaggactgggccagcttcctgagactggccatccccagcatgctgatgctgtgcatggagtggtgggcctacgaggtgggcagcttcctgagcggcatcctgggcatggtggagctgggcgcccagagcatcgtgtacgagctggccatcatcgtgtacatggtgcccgccggcttcagcgtggccgccagcgtgagagtgggcaacgccctgggcgccggcgacatggagcaggccagaaagagcagcaccgtgagcctgctgatcaccgtgctgttcgccgtggccttcagcgtgctgctgctgagctgcaaggaccacgtgggctacatcttcaccaccgacagagacatcatcaacctggtggcccaggtggtgcccatctacgccgtgagccacctgttcgaggccctggcctgcaccagcggcggcgtgctgagaggcagcggcaaccagaaggtgggcgccatcgtgaacaccatcggctactacgtggtgggcctgcccatcggcatcgccctgatgttcgccaccaccctgggcgtgatgggcagcggcaccagacagttcgagagcaagcagagagccagcgagtgggagttctgcagccccagcggcagcgccagccccagagtgccctag

SEQ ID NO: 100128 - DNA, 738 bp, Artificial Sequence
  Description of Artificial Sequence: Synthetic coding sequence
atgctgatgctgtgcatggagtggtgggcctacgaggtgggcagcttcctgagcggcatcctgggcatggtggagctgggcgcccagagcatcgtgtacgagctggccatcatcgtgtacatggtgcccgccggcttcagcgtggccgccagcgtgagagtgggcaacgccctgggcgccggcgacatggagcaggccagaaagagcagcaccgtgagcctgctgatcaccgtgctgttcgccgtggccttcagcgtgctgctgctgagctgcaaggaccacgtgggctacatcttcaccaccgacagagacatcatcaacctggtggcccaggtggtgcccatctacgccgtgagccacctgttcgaggccctggcctgcaccagcggcggcgtgctgagaggcagcggcaaccagaaggtgggcgccatcgtgaacaccatcggctactacgtggtgggcctgcccatcggcatcgccctgatgttcgccaccaccctgggcgtgatgggctgccccgagaacctggagggcatcctgaccaacgacgtgggcaagaccggcgagccccagagcgaccagcagatgagacaggaggagcccctgcccgagcacccccaggacggcgccaagctgagcagaaagcagctggtgctgagaagaggcctgctgctgctgggcgtgttcctgatcctgctggtgggcatcctggtgagattctacgtgagaatccagtag

SEQ ID NO: 100129 - DNA, 1761 bp, Artificial Sequence; identical to SEQ ID NO: 100125
  Description of Artificial Sequence: Synthetic coding sequence

SEQ ID NO: 100130 - DNA, 735 bp, Artificial Sequence
  Description of Artificial Sequence: Synthetic coding sequence
atggaggcccccgaggagcccgcccccgtgagaggcggccccgaggccaccctggaggtgagaggcagcagatgcctgagactgagcgccttcagagaggagctgagagccctgctggtgctggccggccccgccttcctggtgcagctgatggtgttcctgatcagcttcatcagcagcgtgttctgcggccacctgggcaagctggagctggacgccgtgaccctggccatcgccgtgatcaacgtgaccggcgtgagcgtgggcttcggcctgagcagcgcctgcgacaccctgatcagccagacctacggcagccagaacctgaagcacgtgggcgtgatcctgcagagaagcgccctggtgctgctgctgtgctgcttcccctgctgggccctgttcctgaacacccagcacatcctgctgctgttcagacaggaccccgacgtgagcagactgacccagacctacgtgaccatcttcatccccgccctgcccgccaccttcctgtacatgctgcaggtgaagtacctgctgaaccagagactgtgcaccggcaagctggacttccccgtgcaccccggcagcacccccctgagcctgcaccccagagagaagaccgccagcagctacatgggcagactggtgcccagagtgcccgccggcctgggcctgctgcccccccccggccacccccagcacgcccacgccgtgcacggcgtggtgggcctgtag

SEQ ID NO: 100131 - DNA, 1809 bp, Artificial Sequence
  Description of Artificial Sequence: Synthetic coding sequence
atggacagcctgcaggacaccgtggccctggaccacggcggctgctgccccgccctgagcagactggtgcccagaggcttcggcaccgagatgtggaccctgttcgccctgagcggccccctgttcctgttccaggtgctgaccttcatgatctacatcgtgagcaccgtgttctgcggccacctgggcaaggtggagctggccagcgtgaccctggccgtggccttcgtgaacgtgtgcggcgtgagcgtgggcgtgggcctgagcagcgcctgcgacaccctgatgagccagagcttcggcagccccaacaagaagcacgtgggcgtgatcctgcagagaggcgccctggtgctgctgctgtgctgcctgccctgctgggccctgttcctgaacacccagcacatcctgctgctgttcagacaggaccccgacgtgagcagactgacccaggactacgtgatgatcttcatccccggcctgcccgtgatcttcctgtacaacctgctggccaagtacctgcagaaccagggctggctgaagggccaggaggaggagagccccttccagacccccggcctgagcatcctgcaccccagccacagccacctgagcagagccagcttccacctgttccagaagatcacctggccccaggtgctgagcggcgtggtgggcaactgcgtgaacggcgtggccaactacgccctggtgagcgtgctgaacctgggcgtgagaggcagcgcctacgccaacatcatcagccagttcgcccagaccgtgttcctgctgctgtacatcgtgctgaagaagctgcacctggagacctgggccggctggagcagccagtgcctgcaggactggggccccttcttcagcctggccgtgcccagcatgctgatgatctgcgtggagtggtgggcctacgagatcggcagcttcctgatgggcctgctgagcgtggtggacctgagcgcccaggccgtgatctacgaggtggccaccgtgacctacatgatccccctgggcctgagcatcggcgtgtgcgtgagagtgggcatggccctgggcgccgccgacaccgtgcaggccaagagaagcgccgtgagcggcgtgctgagcatcgtgggcatcagcctggtgctgggcaccctgatcagcatcctgaagaaccagctgggccacatcttcaccaacgacgaggacgtgatcgccctggtgagccaggtgctgcccgtgtacagcgtgttccacgtgttcgaggccatctgctgcgtgtacggcggcgtgctgagaggcaccggcaagcaggccttcggcgccgccgtgaacgccatcacctactacatcatcggcctgcccctgggcatcctgctgaccttcgtggtgagaatgagaatcatgggcctgtggctgggcatgctggcctgcgtgttcctggccaccgccgccttcgtggcctacaccgccagactggactggaagctggccgccgaggaggccaagaagcacagcggcagacagcagcagcagagagccgagagcaccgccaccagacccggccccgagaaggccgtgctgagcagcgtggccaccggcagcagccccggcatcaccctgaccacctacagcagaagcgagtgccacgtggacttcttcagaacccccgaggaggcccacgccctgagcgcccccaccagcagactgagcgtgaagcagctggtgatcagaagaggcgccgccctgggcgccgccagcgccaccctgatggtgggcctgaccgtgagaatcctggccaccagacactag

SEQ ID NO: 100132 - DNA, 1743 bp, Artificial Sequence
  Description of Artificial Sequence: Synthetic coding sequence
atggacagcctgcaggacaccgtggccctggaccacggcggctgctgccccgccctgagcagactggtgcccagaggcttcggcaccgagatgtggaccctgttcgccctgagcggccccctgttcctgttccaggtgctgaccttcatgatctacatcgtgagcaccgtgttctgcggccacctgggcaaggtggagctggccagcgtgaccctggccgtggccttcgtgaacgtgtgcggcgtgagcgtgggcgtgggcctgagcagcgcctgcgacaccctgatgagccagagcttcggcagccccaacaagaagcacgtgggcgtgatcctgcagagaggcgccctggtgctgctgctgtgctgcctgccctgctgggccctgttcctgaacacccagcacatcctgctgctgttcagacaggaccccgacgtgagcagactgacccaggactacgtgatgatcttcatccccggcctgcccgtgatcttcctgtacaacctgctggccaagtacctgcagaaccagaagatcacctggccccaggtgctgagcggcgtggtgggcaactgcgtgaacggcgtggccaactacgccctggtgagcgtgctgaacctgggcgtgagaggcagcgcctacgccaacatcatcagccagttcgcccagaccgtgttcctgctgctgtacatcgtgctgaagaagctgcacctggagacctgggccggctggagcagccagtgcctgcaggactggggccccttcttcagcctggccgtgcccagcatgctgatgatctgcgtggagtggtgggcctacgagatcggcagcttcctgatgggcctgctgagcgtggtggacctgagcgcccaggccgtgatctacgaggtggccaccgtgacctacatgagacacagccacagactggcctacgccgcccacgtgaccagaatccccctgggcctgagcatcggcgtgtgcgtgagagtgggcatggccctgggcgccgccgacaccgtgcaggccaagagaagcgccgtgagcggcgtgctgagcatcgtgggcatcagcctggtgctgggcaccctgatcagcatcctgaagaaccagctgggccacatcttcaccaacgacgaggacgtgatcgccctggtgagccaggtgctgcccgtgtacagcgtgttccacgtgttcgaggccatctgctgcgtgtacggcggcgtgctgagaggcaccggcaagcaggccttcggcgccgccgtgaacgccatcacctactacatcatcggcctgcccctgggcatcctgctgaccttcgtggtgagaatgagaatcatgggcctgtggctgggcatgctggcctgcgtgttcctggccaccgccgccttcgtggcctacaccgccagactggactggaagctggccgccgaggaggccaagaagcacagcggcagacagcagcagcagagagccgagagcaccgccaccagacccggccccgagaaggccgtgctgagcagcgtggccaccggcagcagccccggcatcaccctgaccacctacagcagaagcgagtgccacgtggacttcttcagaacccccgaggaggcccacgccctgagcgcccccaccagcagactgagcgtgaagcagctggtgatcagaagaggcgccgccctgggcgccgccagcgccaccctgatggtgggcctgaccgtgagaatcctggccaccagacactag

SEQ ID NO: 100133 - DNA, 1092 bp, Artificial Sequence
  Description of Artificial Sequence: Synthetic coding sequence
atggacagcctgcaggacaccgtggccctggaccacggcggctgctgccccgccctgagcagactggtgcccagaggcttcggcaccgagatgtggaccctgttcgccctgagcggccccctgttcctgttccaggtgctgaccttcatgatctacatcgtgagcaccgtgttctgcggccacctgggcaaggtggagctggccagcgtgaccctggccgtggccttcgtgaacgtgtgcggcgtgagcgtgggcgtgggcctgagcagcgcctgcgacaccctgatgagccagagcttcggcagccccaacaagaagcacgtgggcgtgatcctgcagagaggcgccctggtgctgctgctgtgctgcctgccctgctgggccctgttcctgaacacccagcacatcctgctgctgttcagacaggaccccgacgtgagcagactgacccaggactacgtgatgatcttcatccccggcctgcccgtgatcttcctgtacaacctgctggccaagtacctgcagaaccagaagatcacctggccccaggtgctgagcggcgtggtgggcaactgcgtgaacggcgtggccaactacgccctggtgagcgtgctgaacctgggcgtgagaggcagcgcctacgccaacatcatcagccagttcgcccagaccgtgttcctgctgctgtacatcgtgctgaagaagctgcacctggagacctgggccggctggagcagccagtgcctgcaggactggggccccttcttcagcctggccgtgcccagcatgctgatgatctgcgtggagtggtgggcctacgagatcggcagcttcctgatgggcctgctgagcgtggtggacctgagcgcccaggccgtgatctacgaggtggccaccgtgacctacatgatccccctgggcctgagcatcggcgtgtgcgtgagagtgggcatggccctgggcgccgccgacaccgtgcaggccaagagaagcgccgtgagcggcgtgctgagcatcgtgggcatcagcctggtgctgggcaccctgatcagcatcctgaagaaccagctgggccacatcttcaccaactag

SEQ ID NO: 100134 - DNA, 891 bp, Artificial Sequence
  Description of Artificial Sequence: Synthetic coding sequence
atgatctacatcgtgagcaccgtgttctgcggccacctgggcaaggtggagctggccagcgtgaccctggccgtggccttcgtgaacgtgtgcggcgtgagcgtgggcgtgggcctgagcagcgcctgcgacaccctgatgagccagagcttcggcagccccaacaagaagcacgtgggcgtgatcctgcagagaggcgccctggtgctgctgctgtgctgcctgccctgctgggccctgttcctgaacacccagcacatcctgctgctgttcagacaggaccccgacgtgagcagactgacccaggactacgtgatgatcttcatccccggcctgcccgtgatcttcctgtacaacctgctggccaagtacctgcagaaccagaagatcacctggccccaggtgctgagcggcgtggtgggcaactgcgtgaacggcgtggccaactacgccctggtgagcgtgctgaacctgggcgtgagaggcagcgcctacgccaacatcatcagccagttcgcccagaccgtgttcctgctgctgtacatcgtgctgaagaagctgcacctggagacctgggccggctggagcagccagtgcctgcaggactggggccccttcttcagcctggccgtgcccagcatgctgatgatctgcgtggagtggtgggcctacgagatcggcagcttcctgatgggcctgctgagcgtggtggacctgagcgcccaggccgtgatctacgaggtggccaccgtgacctacatgatccccctgggcctgagcatcggcgtgtgcgtgagagtgggcatggccctgggcgccgccgacaccgtgcaggccaagagaagcgccgtgagcggcgtgctgagcatcgccagaagcgacccctggtag

SEQ ID NO: 100135 - DNA, 531 bp, Artificial Sequence
  Description of Artificial Sequence: Synthetic coding sequence
atgaaggccagcggcaccctgagagagtacaaggtggtgggcagatgcctgcccacccccaagtgccacaccccccccctgtacagaatgagaatcttcgcccccaaccacgtggtggccaagagcagattctggtacttcgtgagccagctgaagaagatgaagaagagcagcggcgagatcgtgtactgcggccaggtgttcgagaagagccccctgagagtgaagaacttcggcatctggctgagatacgacagcagaagcggcacccacaacatgtacagagagtacagagacctgaccaccgccggcgccgtgacccagtgctacagagacatgggcgccagacacagagccagagcccacagcatccagatcatgaaggtggaggagatcgccgccagcaagtgcagaagacccgccgtgaagcagttccacgacagcaagatcaagttccccctgccccacagagtgctgagaagacagcacaagcccagattcaccaccaagagacccaacaccttcttctag

SEQ ID NO: 100136 - DNA, 1995 bp, Artificial Sequence
  Description of Artificial Sequence: Synthetic coding sequence
atggacagcagcacctggagccccaagaccaccgccgtgaccagacccgtggagacccacgagctgatcagaaacgccgccgacatcagcatcatcgtgatctacttcgtggtggtgatggccgtgggcctgtgggccatgttcagcaccaacagaggcaccgtgggcggcttcttcctggccggcagaagcatggtgtggtggcccatcggcgccagcctgttcgccagcaacatcggcagcggccacttcgtgggcctggccggcaccggcgccgccagcggcatcgccatcggcggcttcgagtggaacgccctggtgctggtggtggtgctgggctggctgttcgtgcccatctacatcaaggccggcgtggtgaccatgcccgagtacctgagaaagagattcggcggccagagaatccaggtgtacctgagcctgctgagcctgctgctgtacatcttcaccaagatcagcgccgacatcttcagcggcgccatcttcatcaacctggccctgggcctgaacctgtacctggccatcttcctgctgctggccatcaccgccctgtacaccatcaccggcggcctggccgccgtgatctacaccgacaccctgcagaccgtgatcatgctggtgggcagcctgatcctgaccggcttcgccttccacgaggtgggcggctacgacgccttcatggagaagtacatgaaggccatccccaccatcgtgagcgacggcaacaccaccttccaggagaagtgctacacccccagagccgacagcttccacatcttcagagaccccctgaccggcgacctgccctggcccggcttcatcttcggcatgagcatcctgaccctgtggtactggtgcaccgaccaggtgatcgtgcagagatgcctgagcgccaagaacatgagccacgtgaagggcggctgcatcctgtgcggctacctgaagctgatgcccatgttcatcatggtgatgcccggcatgatcagcagaatcctgtacaccgagaagatcgcctgcgtggtgcccagcgagtgcgagaagtactgcggcaccaaggtgggctgcaccaacatcgcctaccccaccctggtggtggagctgatgcccaacggcctgagaggcctgatgctgagcgtgatgctggccagcctgatgagcagcctgaccagcatcttcaacagcgccagcaccctgttcaccatggacatctacgccaaggtgagaaagagagccagcgagaaggagctgatgatcgccggcagactgttcatcctggtgctgatcggcatcagcatcgcctgggtgcccatcgtgcagagcgcccagagcggccagctgttcgactacatccagagcatcaccagctacctgggcccccccatcgccgccgtgttcctgctggccatcttctggaagagagtgaacgagcccggcgccttctggggcctgatcctgggcctgctgatcggcatcagcagaatgatcaccgagttcgcctacggcaccggcagctgcatggagcccagcaactgccccaccatcatctgcggcgtgcactacctgtacttcgccatcatcctgttcgccatcagcttcatcaccatcgtggtgatcagcctgctgaccaagcccatccccgacgtgcacctgtacagactgtgctggagcctgagaaacagcaaggaggagagaatcgacctggacgccgaggaggagaacatccaggagggccccaaggagaccatcgagatcgagacccaggtgcccgagaagaagaagggcatcttcagaagagcctacgacctgttctgcggcctggagcagcacggcgcccccaagatgaccgaggaggaggagaaggccatgaagatgaagatgaccgacaccagcgagaagcccctgtggagaaccgtgctgaacgtgaacggcatcatcctggtgaccgtggccgtgttctgccacgcctacttcgcctag

SEQ ID NO: 100137 - DNA, 1614 bp, Artificial Sequence
  Description of Artificial Sequence: Synthetic coding sequence
atgcccgagtacctgagaaagagattcggcggccagagaatccaggtgtacctgagcctgctgagcctgctgctgtacatcttcaccaagatcagcgccgacatcttcagcggcgccatcttcatcaacctggccctgggcctgaacctgtacctggccatcttcctgctgctggccatcaccgccctgtacaccatcaccggcggcctggccgccgtgatctacaccgacaccctgcagaccgtgatcatgctggtgggcagcctgatcctgaccggcttcgccttccacgaggtgggcggctacgacgccttcatggagaagtacatgaaggccatccccaccatcgtgagcgacggcaacaccaccttccaggagaagtgctacacccccagagccgacagcttccacatcttcagagaccccctgaccggcgacctgccctggcccggcttcatcttcggcatgagcatcctgaccctgtggtactggtgcaccgaccaggtgatcgtgcagagatgcctgagcgccaagaacatgagccacgtgaagggcggctgcatcctgtgcggctacctgaagctgatgcccatgttcatcatggtgatgcccggcatgatcagcagaatcctgtacaccgagaagatcgcctgcgtggtgcccagcgagtgcgagaagtactgcggcaccaaggtgggctgcaccaacatcgcctaccccaccctggtggtggagctgatgcccaacggcctgagaggcctgatgctgagcgtgatgctggccagcctgatgagcagcctgaccagcatcttcaacagcgccagcaccctgttcaccatggacatctacgccaaggtgagaaagagagccagcgagaaggagctgatgatcgccggcagactgttcatcctggtgctgatcggcatcagcatcgcctgggtgcccatcgtgcagagcgcccagagcggccagctgttcgactacatccagagcatcaccagctacctgggcccccccatcgccgccgtgttcctgctggccatcttctggaagagagtgaacgagcccggcgccttctggggcctgatcctgggcctgctgatcggcatcagcagaatgatcaccgagttcgcctacggcaccggcagctgcatggagcccagcaactgccccaccatcatctgcggcgtgcactacctgtacttcgccatcatcctgttcgccatcagcttcatcaccatcgtggtgatcagcctgctgaccaagcccatccccgacgtgcacctgtacagactgtgctggagcctgagaaacagcaaggaggagagaatcgacctggacgccgaggaggagaacatccaggagggccccaaggagaccatcgagatcgagacccaggtgcccgagaagaagaagggcatcttcagaagagcctacgacctgttctgcggcctggagcagcacggcgcccccaagatgaccgaggaggaggagaaggccatgaagatgaagatgaccgacaccagcgagaagcccctgtggagaaccgtgctgaacgtgaacggcatcatcctggtgaccgtggccgtgttctgccacgcctacttcgcctag

SEQ ID NO: 100138 - DNA, 1191 bp, Artificial Sequence
  Description of Artificial Sequence: Synthetic coding sequence
atggaggtgaagaacttcgccgtgtgggactacgtggtgttcgccgccctgttcttcatcagcagcggcatcggcgtgttcttcgccatcaaggagagaaagaaggccaccagcagagagttcctggtgggcggcagacagatgagcttcggccccgtgggcctgagcctgaccgccagcttcatgagcgccgtgaccgtgctgggcacccccagcgaggtgtacagattcggcgccagcttcctggtgttcttcatcgcctacctgttcgtgatcctgctgaccagcgagctgttcctgcccgtgttctacagaagcggcatcaccagcacctacgagtacctgcagctgagattcaacaagcccgtgagatacgccgccaccgtgatctacatcgtgcagaccatcctgtacaccggcgtggtggtgtacgcccccgccctggccctgaaccaggtgaccggcttcgacctgtggggcagcgtgttcgccaccggcatcgtgtgcaccttctactgcaccctgggcggcctgaaggccgtggtgtggaccgacgccttccagatggtggtgatgatcgtgggcttcctgaccgtgctgatccagggcagcacccacgccggcggcttccacaacgtgctggagcagagcaccaacggcagcagactgcacatcttcgacttcgacgtggaccccctgagaagacacaccttctggaccatcaccgtgggcggcaccttcacctggctgggcatctacggcgtgaaccagagcaccatccagagatgcatcagctgcaagaccgagaagcacgccaagctggccctgtacttcaacctgctgggcctgtggatcatcctggtgtgcgccgtgttcagcggcctgatcatgtacagccacttcaaggactgcgacccctggaccagcggcatcatcagcgcccccgaccagctgatgccctacttcgtgatggagatcttcgccaccatgcccggcctgcccggcctgttcgtggcctgcgccttcagcggcaccctgagcaccgtggccagcagcatcaacgccctggccaccgtgaccttcgaggacttcgtgaagagctgcttcccccacctgagcgacaagctgagcacctggatcagcaagggcctgtgcagatacagctggtggaccttctacagcatcagctag

SEQ ID NO: 100139 - DNA, 1857 bp, Artificial Sequence
  Description of Artificial Sequence: Synthetic coding sequence
atggaggtgaagaacttcgccgtgtgggactacgtggtgttcgccgccctgttcttcatcagcagcggcatcggcgtgttcttcgccatcaaggagagaaagaaggccaccagcagagagttcctggtgggcggcagacagatgagcttcggccccgtgggcctgagcctgaccgccagcttcatgagcgccgtgaccgtgctgggcacccccagcgaggtgtacagattcggcgccagcttcctggtgttcttcatcgcctacctgttcgtgatcctgctgaccagcgagctgttcctgcccgtgttctacagaagcggcatcaccagcacctacgagtacctgcagctgagattcaacaagcccgtgagatacgccgccaccgtgatctacatcgtgcagaccatcctgtacaccggcgtggtggtgtacgcccccgccctggccctgaaccaggtgaccggcttcgacctgtggggcagcgtgttcgccaccggcatcgtgtgcaccttctactgcaccctgggcggcctgaaggccgtggtgtggaccgacgccttccagatggtggtgatgatcgtgggcttcctgaccgtgctgatccagggcagcacccacgccggcggcttccacaacgtgctggagcagagcaccaacggcagcagactgcacatcttcgacttcgacgtggaccccctgagaagacacaccttctggaccatcaccgtgggcggcaccttcacctggctgggcatctacggcgtgaaccagagcaccatccagagatgcatcagctgcaagaccgagaagcacgccaagctggccctgtacttcaacctgctgggcctgtggatcatcctggtgtgcgccgtgttcagcggcctgatcatgtacagccacttcaaggactgcgacccctggaccagcggcatcatcagcgcccccgaccagctgatgccctacttcgtgatggagatcttcgccaccatgcccggcctgcccggcctgttcgtggcctgcgccttcagcggcaccctgagcaccgtggccagcagcatcaacgccctggccaccgtgaccttcgaggacttcgtgaagagctgcttcccccacctgagcgacaagctgagcacctggatcagcaagggcctgtgcctgctgttcggcgtgatgtgcaccagcatggccgtggccgccagcgtgatgggcggcgtggtgcaggccagcctgagcatccacggcatgtgcggcggccccatgctgggcctgttcagcctgggcatcgtgttccccttcgtgaactggaagggcgccctgggcggcctgctgaccggcatcaccctgagcttctgggtggccatcggcgccttcatctaccccgcccccgccagcaagacctggcccctgcccctgagcaccgaccagtgcatcaagagcaacgtgaccgccaccggcccccccgtgctgagcagcagacccggcatcgccgacacctggtacagcatcagctacctgtactacagcgccgtgggctgcctgggctgcatcgtggccggcgtgatcatcagcctgatcaccggcagacagagaggcgaggacatccagcccctgctgatcagacccgtgtgcaacctgttctgcttctggagcaagaagtacaagaccctgtgctggtgcggcgtgcagcacgacagcggcaccgagcaggagaacctggagaacggcagcgccagaaagcagggcgccgagagcgtgctgcagaacggcctgagaagagagagcctggtgcacgtgcccggctacgaccccaaggacaagagctacaacaacatggccttcgagaccacccacttctag

SEQ ID NO: 100140 - DNA, 834 bp, Artificial Sequence
  Description of Artificial Sequence: Synthetic coding sequence
atggtggtgatgatcgtgggcttcctgaccgtgctgatccagggcagcacccacgccggcggcttccacaacgtgctggagcagagcaccaacggcagcagactgcacatcttcgacttcgacgtggaccccctgagaagacacaccttctggaccatcaccgtgggcggcaccttcacctggctgggcatctacggcgtgaaccagagcaccatccagagatgcatcagctgcaagaccgagaagcacgccaagctggccctgtacttcaacctgctgggcctgtggatcatcctggtgtgcgccgtgttcagcggcctgatcatgtacagccacttcaaggactgcgacccctggaccagcggcatcatcagcgcccccgaccagctgatgccctacttcgtgatggagatcttcgccaccatgcccggcctgcccggcctgttcgtggcctgcgccttcagcggcaccctgagcaccgtggccagcagcatcaacgccctggccaccgtgaccttcgaggacttcgtgaagagctgcttcccccacctgagcgacaagctgagcacctggatcagcaagggcctgtgcagaagcctgatctggagagacgtgtacctgtacggctgcggctgcatctgccacggcagatgctgcgccggcttcccccagcacagcagacacgtgtggagaaccaacgccggcctgatcctgcccggcaacagagtgcccttctgcgagctggagggctgcaccagaagaagcagctactggaaccacctggtgatcctgggcggccactggggcctgcacctgccctgcaccagcctgtag

SEQ ID NO: 100141 - DNA, 2019 bp, Artificial Sequence
  Description of Artificial Sequence: Synthetic coding sequence
atggaggagcacaccgaggccggcagcgcccccgagatgggcgcccagaaggccctgatcgacaaccccgccgacatcctggtgatcgccgcctacttcctgctggtgatcggcgtgggcctgtggagcatgtgcagaaccaacagaggcaccgtgggcggctacttcctggccggcagaagcatggtgtggtggcccgtgggcgccagcctgttcgccagcaacatcggcagcggccacttcgtgggcctggccggcaccggcgccgccagcggcctggccgtggccggcttcgagtggaacgccctgttcgtggtgctgctgctgggctggctgttcgcccccgtgtacctgaccgccggcgtgatcaccatgccccagtacctgagaaagagattcggcggcagaagaatcagactgtacctgagcgtgctgagcctgttcctgtacatcttcaccaagatcagcgtggacatgttcagcggcgccgtgttcatccagcaggccctgggctggaacatctacgccagcgtgatcgccctgctgggcatcaccatgatctacaccgtgaccggcggcctggccgccctgatgtacaccgacaccgtgcagaccttcgtgatcctgggcggcgcctgcatcctgatgggctacgccttccacgaggtgggcggctacagcggcctgttcgacaagtacctgggcgccgccaccagcctgaccgtgagcgaggaccccgccgtgggcaacatcagcagcttctgctacagacccagacccgacagctaccacctgctgagacaccccgtgaccggcgacctgccctggcccgccctgctgctgggcctgaccatcgtgagcggctggtactggtgcagcgaccaggtgatcgtgcagagatgcctggccggcaagagcctgacccacatcaaggccggctgcatcctgtgcggctacctgaagctgacccccatgttcctgatggtgatgcccggcatgatcagcagaatcctgtaccccgacgaggtggcctgcgtggtgcccgaggtgtgcagaagagtgtgcggcaccgaggtgggctgcagcaacatcgcctaccccagactggtggtgaagctgatgcccaacggcctgagaggcctgatgctggccgtgatgctggccgccctgatgagcagcctggccagcatcttcaacagcagcagcaccctgttcaccatggacatctacaccagactgagacccagagccggcgacagagagctgctgctggtgggcagactgtgggtggtgttcatcgtggtggtgagcgtggcctggctgcccgtggtgcaggccgcccagggcggccagctgttcgactacatccaggccgtgagcagctacctggccccccccgtgagcgccgtgttcgtgctggccctgttcgtgcccagagtgaacgagcagggcgccttctggggcctgatcggcggcctgctgatgggcctggccagactgatccccgagttcagcttcggcagcggcagctgcgtgcagcccagcgcctgccccgccttcctgtgcggcgtgcactacctgtacttcgccatcgtgctgttcttctgcagcggcctgctgaccctgaccgtgagcctgtgcaccgcccccatccccagaaagcacctgcacagactggtgttcagcctgagacacagcaaggaggagagagaggacctggacgccgacgagcagcagggcagcagcctgcccgtgcagaacggctgccccgagagcgccatggagatgaacgagccccaggcccccgcccccagcctgttcagacagtgcctgctgtggttctgcggcatgagcagaggcggcgtgggcagccccccccccctgacccaggaggaggccgccgccgccgccagaagactggaggacatcagcgaggaccccagctgggccagagtggtgaacctgaacgccctgctgatgatggccgtggccgtgttcctgtggggcttctacgcctag

SEQ ID NO: 100142 - DNA, 1377 bp, Artificial Sequence
  Description of Artificial Sequence: Synthetic coding sequence
atggaggagcacaccgaggccggcagcgcccccgagatgggcgcccagaaggccctgatcgacaaccccgccgacatcctggtgatcgccgcctacttcctgctggtgatcggcgtgggcctgtggagcatgtgcagaaccaacagaggcaccgtgggcggctacttcctggccggcagaagcatggtgtggtggcccgtgggcgccagcctgttcgccagcaacatcggcagcggccacttcgtgggcctggccggcaccggcgccgccagcggcctggccgtggccggcttcgagtggaacgccctgttcgtggtgctgctgctgggctggctgttcgcccccgtgtacctgaccgccggcgtgatcaccatgccccagtacctgagaaagagattcggcggcagaagaatcagactgtacctgagcgtgctgagcctgttcctgtacatcttcaccaagatcagcgtggacatgttcagcggcgccgtgttcatccagcaggccctgggctggaacatctacgccagcgtgatcgccctgctgggcatcaccatgatctacaccgtgaccggcggcctggccgccctgatgtacaccgacaccgtgcagaccttcgtgatcctgggcggcgcctgcatcctgatgggctacgccttccacgaggtgggcggctacagcggcctgttcgacaagtacctgggcgccgccaccagcctgaccgtgagcgaggaccccgccgtgggcaacatcagcagcttctgctacagacccagacccgacagctaccacctgctgagacaccccgtgaccggcgacctgccctggcccgccctgctgctgggcctgaccatcgtgagcggctggtactggtgcagcgaccaggtgatcgtgcagagatgcctggccggcaagagcctgacccacatcaaggccggctgcatcctgtgcggctacctgaagctgacccccatgttcctgatggtgatgcccggcatgatcagcagaatcctgtaccccgacgaggtggcctgcgtggtgcccgaggtgtgcagaagagtgtgcggcaccgaggtgggctgcagcaacatcgcctaccccagactggtggtgaagctgatgcccaacggcagactgctgggcacccacagaggccccgccgacggccccggcacccccgacagcagagtgctgctgagactgggccagctgtgcgccgccctgggcgtgcccagcttccccctgagaagagccctgcccctgctgagacactgcgccgtgctgctgctgtggcccccccacccccacggcctgcccgtgcacagagcccacccccagaaggccccccccccccccggcctgcagagccccgcctag

SEQ ID NO: 100143 - DNA, 2157 bp, Artificial Sequence
  Description of Artificial Sequence: Synthetic coding sequence
atgagagccgtgctggacaccgccgacatcgccatcgtggccctgtacttcatcctggtgatgtgcatcggcttcttcgccatgtggaagagcaacagaagcaccgtgagcggctacttcctggccggcagaagcatgacctgggtgaccatcggcgccagcctgttcgtgagcaacatcggcagcgagcacttcatcggcctggccggcagcggcgccgccagcggcttcgccgtgggcgcctgggagttcaacgccctgctgctgctgcagctgctgggctgggtgttcatccccatctacatcagaagcggcgtgtacaccatgcccgagtacctgagcaagagattcggcggccacagaatccaggtgtacttcgccgccctgagcctgatcctgtacatcttcaccaagctgagcgtggacctgtacagcggcgccctgttcatccaggagagcctgggctggaacctgtacgtgagcgtgatcctgctgatcggcatgaccgccctgctgaccgtgaccggcggcctggtggccgtgatctacaccgacaccctgcaggccctgctgatgatcatcggcgccctgaccctgatgatcatcagcatcatggagatcggcggcttcgaggaggtgaagagaagatacatgctggccagccccgacgtgaccagcatcctgctgacctacaacctgagcaacaccaacagctgcaacgtgagccccaagaaggaggccctgaagatgctgagaaaccccaccgacgaggacgtgccctggcccggcttcatcctgggccagacccccgccagcgtgtggtactggtgcgccgaccaggtgatcgtgcagagagtgctggccgccaagaacatcgcccacgccaagggcagcaccctgatggccggcttcctgaagctgctgcccatgttcatcatcgtggtgcccggcatgatcagcagaatcctgttcaccgacgacatcgcctgcatcaaccccgagcactgcatgctggtgtgcggcagcagagccggctgcagcaacatcgcctaccccagactggtgatgaagctggtgcccgtgggcctgagaggcctgatgatggccgtgatgatcgccgccctgatgagcgacctggacagcatcttcaacagcgccagcaccatcttcaccctggacgtgtacaagctgatcagaaagagcgccagcagcagagagctgatgatcgtgggcagaatcttcgtggccttcatggtggtgatcagcatcgcctgggtgcccatcatcgtggagatgcagggcggccagatgtacctgtacatccaggaggtggccgactacctgaccccccccgtggccgccctgttcctgctggccatcttctggaagagatgcaacgagcagggcgccttctacggcggcatggccggcttcgtgctgggcgccgtgagactgatcctggccttcgcctacagagcccccgagtgcgaccagcccgacaacagacccggcttcatcaaggacatccactacatgtacgtggccaccggcctgttctgggtgaccggcctgatcaccgtgatcgtgagcctgctgacccccccccccaccaaggagcagatcagaaccaccaccttctggagcaagaagaacctggtggtgaaggagaactgcagccccaaggaggagccctaccagatgcaggagaagagcatcctgagatgcagcgagaacaacgagaccatcaaccacatcatccccaacggcaagagcgaggacagcatcaagggcctgcagcccgaggacgtgaacctgctggtgacctgcagagaggagggcaaccccgtggccagcctgggccacagcgaggccgagacccccgtggacgcctacagcaacggccaggccgccctgatgggcgagaaggagagaaagaaggagaccgacgacggcggcagatactggaagttcatcgactggttctgcggcttcaagagcaagagcctgagcaagagaagcctgagagacctgatggaggaggaggccgtgtgcctgcagatgctggaggagaccagacaggtgaaggtgatcctgaacatcggcctgttcgccgtgtgcagcctgggcatcttcatgttcgtgtacttcagcctgtag

SEQ ID NO: 100144 - DNA, 504 bp, Artificial Sequence
  Description of Artificial Sequence: Synthetic coding sequence
atggaggccggcggcttcctggacagcctgatctacggcgcctgcgtggtgttcaccctgggcatgttcagcgccggcctgagcgacctgagacacatgagaatgaccagaagcgtggacaacgtgcagttcctgcccttcctgaccaccgaggtgaacaacctgggctggctgagctacggcgccctgaagggcgacggcatcctgatcgtggtgaacaccgtgggcgccgccctgcagaccctgtacatcctggcctacctgcactactgccccagaaaggccaaggtgatccagaccaagagcacccagtgcctgagctaccccctgaccatcgccaccctgctgaccagcgccagctggtgcctgtacggcttcagactgagagacccctacatcatggtgagcaacttccccggcatcgtgaccagcttcatcagattctggctgttctggaagtacccccaggagcaggacagaaactactggctgctgcagacctag

SEQ ID NO: 100145 - DNA, 501 bp, Artificial Sequence
  Description of Artificial Sequence: Synthetic coding sequence
atgagaggcctgcacccctggcacgtgctgagaagacccctgggcccccaggcccacgccaacgaccccgagtgcggccagagacccgtgcccgccctgagccaccacggcagccagagagtggtgctgctgcagaccgccaccctgctgggcgtgctgctgctgggctacggctacttctggctgctggtgcccaaccccgaggccagactgcagcagctgggcctgttctgcagcgtgttcaccatcagcatgtacctgagccccctggccgacctggccaaggtgatccagaccaagagcacccagtgcctgagctaccccctgaccatcgccaccctgctgaccagcgccagctggtgcctgtacggcttcagactgagagacccctacatcatggtgagcaacttccccggcatcgtgaccagcttcatcagattctggctgttctggaagtacccccaggagcaggacagaaactactggctgctgcagacctag

SEQ ID NO: 100146 - DNA, 666 bp, Artificial Sequence
  Description of Artificial Sequence: Synthetic coding sequence
atggaggccggcggcttcctggacagcctgatctacggcgcctgcgtggtgttcaccctgggcatgttcagcgccggcctgagcgacctgagacacatgagaatgaccagaagcgtggacaacgtgcagttcctgcccttcctgaccaccgaggtgaacaacctgggctggctgagctacggcgccctgaagggcgacggcatcctgatcgtggtgaacaccgtgggcgccgccctgcagaccctgtacatcctggcctacctgcactactgccccagaaagagagtggtgctgctgcagaccgccaccctgctgggcgtgctgctgctgggctacggctacttctggctgctggtgcccaaccccgaggccagactgcagcagctgggcctgttctgcagcgtgttcaccatcagcatgtacctgagccccctggccgacctggccaaggtgatccagaccaagagcacccagtgcctgagctaccccctgaccatcgccaccctgctgaccagcgccagctggtgcctgtacggcttcagactgagagacccctacatcatggtgagcaacttccccggcatcgtgaccagcttcatcagattctggctgttctggaagtacccccaggagcaggacagaaactactggctgctgcagacctag

SEQ ID NO: 100147 - DNA, 471 bp, Artificial Sequence
  Description of Artificial Sequence: Synthetic coding sequence
atggaggagctgggcccccaggcccacgccaacgaccccgagtgcggccagagacccgtgcccgccctgagccaccacggcagccagagagtggtgctgctgcagaccgccaccctgctgggcgtgctgctgctgggctacggctacttctggctgctggtgcccaaccccgaggccagactgcagcagctgggcctgttctgcagcgtgttcaccatcagcatgtacctgagccccctggccgacctggccaaggtgatccagaccaagagcacccagtgcctgagctaccccctgaccatcgccaccctgctgaccagcgccagctggtgcctgtacggcttcagactgagagacccctacatcatggtgagcaacttccccggcatcgtgaccagcttcatcagattctggctgttctggaagtacccccaggagcaggacagaaactactggctgctgcagacctag

SEQ ID NO: 100148 - DNA, 1929 bp, Artificial Sequence
  Description of Artificial Sequence: Synthetic coding sequence
atggacaagctgaagtgccccagcttcttcaagtgcagagagaaggagaaggtgagcgccagcagcgagaacttccacgtgggcgagaacgacgagaaccaggacagaggcaactggagcaagaagagcgactacctgctgagcatgatcggctacgccgtgggcctgggcaacgtgtggagattcccctacctgacctacagcaacggcggcggcgccttcctgatcccctacgccatcatgctggccctggccggcctgcccctgttcttcctggagtgcagcctgggccagttcgccagcctgggccccgtgagcgtgtggagaatcctgcccctgttccagggcgtgggcatcaccatggtgctgatcagcatcttcgtgaccatctactacaacgtgatcatcgcctacagcctgtactacatgttcgccagcttccagagcgagctgccctggaagaactgcagcagctggagcgacaagaactgcagcagaagccccatcgtgacccactgcaacgtgagcaccgtgaacaagggcatccaggagatcatccagatgaacaagagctgggtggacatcaacaacttcacctgcatcaacggcagcgagatctaccagcccggccagctgcccagcgagcagtactggaacaaggtggccctgcagagaagcagcggcatgaacgagaccggcgtgatcgtgtggtacctggccctgtgcctgctgctggcctggctgatcgtgggcgccgccctgttcaagggcatcaagagcagcggcaaggtggtgtacttcaccgccctgttcccctacgtggtgctgctgatcctgctggtgagaggcgccaccctggagggcgccagcaagggcatcagctactacatcggcgcccagagcaacttcaccaagctgaaggaggccgaggtgtggaaggacgccgccacccagatcttctacagcctgagcgtggcctggggcggcctggtggccctgagcagctacaacaagttcaagaacaactgcttcagcgacgccatcgtggtgtgcctgaccaactgcctgaccagcgtgttcgccggcttcgccatcttcagcatcctgggccacatggcccacatcagcggcaaggaggtgagccaggtggtgaagagcggcttcgacctggccttcatcgcctaccccgaggccctggcccagctgcccggcggccccttctggagcatcctgttcttcttcatgctgctgaccctgggcctggacagccagttcgccagcatcgagaccatcaccaccaccatccaggacctgttccccaaggtgatgaagaagatgagagtgcccatcaccctgggctgctgcctggtgctgttcctgctgggcctggtgtgcgtgacccaggccggcatctactgggtgcacctgatcgaccacttctgcgccggctggggcatcctgatcgccgccatcctggagctggtgggcatcatctggatctacggcggcaacagattcatcgaggacaccgagatgatgatcggcgccaagagatggatcttctggctgtggtggagagcctgctggttcgtgatcacccccatcctgctgatcgccatcttcatctggagcctggtgcagttccacagacccaactacggcgccatcccctaccccgactggggcgtggccctgggctggtgcatgatcgtgttctgcatcatctggatccccatcatggccatcatcaagatcatccaggccaagggcaacatcttccagagactgatcagctgctgcagacccgccagcaactggggcccctacctggagcagcacagaggcgagagatacaaggacatggtggaccccaagaaggaggccgaccacgagatccccaccgtgagcggcagcagaaagcccgagtag

SEQ ID NO: 100149 - DNA, 1539 bp, Artificial Sequence
  Description of Artificial Sequence: Synthetic coding sequence
atgggcgtgcagtggtggagccacacccagggcgaggtggccgtgggcctgggcctgggcgacagctacctgaccccctgcccctgccccggcgtgggctacgccgtgatcctgatcgccctgtacgtgggcttctactacaacgtgatcatcgcctggagcctgtactacctgttcagcagcttcaccctgaacctgccctggaccgactgcggccacacctggaacagccccaactgcaccgaccccaagctgctgaacggcagcgtgctgggcaaccacaccaagtacagcaagtacaagttcacccccgccgccgagttctacgagagaggcgtgctgcacctgcacgagagcagcggcatccacgacatcggcctgccccagtggcagctgctgctgtgcctgatggtggtggtgatcgtgctgtacttcagcctgtggaagggcgtgaagaccagcggcaaggtggtgtggatcaccgccaccctgccctacttcgtgctgttcgtgctgctggtgcacggcgtgaccctgcccggcgccagcaacggcatcaacgcctacctgcacatcgacttctacagactgaaggaggccaccgtgtggatcgacgccgccacccagatcttcttcagcctgggcgccggcttcggcgtgctgatcgccttcgccagctacaacaagttcgacaacaactgctacagagacgccctgctgaccagcagcatcaactgcatcaccagcttcgtgagcggcttcgccatcttcagcatcctgggctacatggcccacgagcacaaggtgaacatcgaggacgtggccaccgagggcgccggcctggtgttcatcctgtaccccgaggccatcagcaccctgagcggcagcaccttctgggccgtggtgttcttcgtgatgctgctggccctgggcctggacagcagcatgggcggcatggaggccgtgatcaccggcctggccgacgacttccaggtgctgaagagacacagaaagctgttcaccttcggcgtgaccttcagcaccttcctgctggccctgttctgcatcaccaagggcggcatctacgtgctgaccctgctggacaccttcgccgccggcaccagcatcctgttcgccgtgctgatggaggccatcggcgtgagctggttctacggcgtggacagattcagcaacgacatccagcagatgatgggcttcagacccggcctgtactggagactgtgctggaagttcgtgagccccgccttcctgctgttcgtggtggtggtgagcatcatcaacttcaagcccctgacctacgacgactacatcttccccccctgggccaactgggtgggctggggcatcgccctgagcagcatggtgctggtgcccatctacgtgatctacaagttcctgagcacccagggcagcctgtgggagagactggcctacggcatcacccccgagaacgagcaccacctggtggcccagagagacatcagacagttccagctgcagcactggctggccatctag

SEQ ID NO: 100150 - DNA, 1845 bp, Artificial Sequence
  Description of Artificial Sequence: Synthetic coding sequence
atggacggcaaggtggccgtgcaggagtgcggcccccccgccgtgagctgggtgcccgaggagggcgagaagctggaccaggaggacgaggaccaggtgaaggacagaggccagtggaccaacaagatggagttcgtgctgagcgtggccggcgagatcatcggcctgggcaacgtgtggagattcccctacctgtgctacaagaacggcggcggcgccttcttcatcccctacttcatcttcttcttcgtgtgcggcatccccgtgttcttcctggaggtggccctgggccagtacaccagccagggcagcgtgaccgcctggagaaagatctgccccctgttccagggcatcggcctggccagcgtggtgatcgagagctacctgaacgtgtactacatcatcatcctggcctgggccctgttctacctgttcagcagcttcaccagcgagctgccctggaccacctgcaacaacttctggaacaccgagcactgcaccgacttcctgaaccacagcggcgccggcaccgtgacccccttcgagaacttcaccagccccgtgatggagttctgggagagaagagtgctgggcatcaccagcggcatccacgacctgggcagcctgagatgggagctggccctgtgcctgctgctggcctgggtgatctgctacttctgcatctggaagggcgtgaagagcaccggcaaggtggtgtacttcaccgccaccttcccctacctgatgctggtgatcctgctgatcagaggcgtgaccctgcccggcgcctaccagggcatcatctactacctgaagcccgacctgttcagactgaaggacccccaggtgtggatggacgccggcacccagatcttcttcagcttcgccatctgccagggctgcctgaccgccctgggcagctacaacaagtaccacaacaactgctacaaggactgcatcgccctgtgcttcctgaacagcgccaccagcttcgtggccggcttcgtggtgttcagcatcctgggcttcatgagccaggagcagggcgtgcccatcagcgaggtggccgagagcggccccggcctggccttcatcgccttccccaaggccgtgaccatgatgcccctgagccagctgtggagctgcctgttcttcatcatgctgatcttcctgggcctggacagccagttcgtgtgcgtggagtgcctggtgaccgccagcatcgacatgttccccagacagctgagaaagagcggcagaagagagctgctgatcctgaccatcgccgtgatgtgctacctgatcggcctgttcctggtgaccgagggcggcatgtacatcttccagctgttcgactactacgccagcagcggcatctgcctgctgttcctgagcctgttcgaggtggtgtgcatcagctgggtgtacggcgccgacagattctacgacaacatcgaggacatgatcggctacagaccctggcccctggtgaagatcagctggctgttcctgacccccggcctgtgcctggccaccttcctgttcagcctgagcaagtacacccccctgaagtacaacaacgtgtacgtgtaccccccctggggctacagcatcggctggttcctggccctgagcagcatggtgtgcgtgcccctgttcgtggtgatcaccctgctgaagaccagaggccccttcagaaagagactgagacagctgatcacccccgacagcagcctgccccagcccaagcagcacccctgcctggacggcagcgccggcagaaacttcggccccagccccaccagagagggcctgatcgccggcgagaaggagacccacctgtag

SEQ ID NO: 100151 - DNA, 1845 bp, Artificial Sequence; identical to SEQ ID NO: 100150
  Description of Artificial Sequence: Synthetic coding sequence

SEQ ID NO: 100152 - DNA, 1845 bp, Artificial Sequence; identical to SEQ ID NO: 100150
  Description of Artificial Sequence: Synthetic coding sequence

SEQ ID NO: 100153 - DNA, 1845 bp, Artificial Sequence; identical to SEQ ID NO: 100150
  Description of Artificial Sequence: Synthetic coding sequence

SEQ ID NO: 100154 - DNA, 1845 bp, Artificial Sequence; identical to SEQ ID NO: 100150
  Description of Artificial Sequence: Synthetic coding sequence

SEQ ID NO: 100155 - DNA, 441 bp, Artificial Sequence
  Description of Artificial Sequence: Synthetic coding sequence
atggacggcaaggtggccgtgcaggagtgcggcccccccgccgtgagctgggtgcccgaggagggcgagaagctggaccaggaggacgaggaccaggtgaaggacagaggccagtggaccaacaagatggagttcgtgctgagcgtggccggcgagatcatcggcctgggcaacgtgtggagattcccctacctgtgctacaagaacggcggcggcgccttcttcatcccctacttcatcttcttcttcgtgtgcggcatccccgtgttcttcctggaggtggccctgggccagtacaccagccagggcagcgtgaccgcctggagaaagatctgccccctgttccagggcatcggcctggccagcgtggtgatcgagagctacctgaacgtgtactacatcatcatcctggcctgggccctgttctacctgttcagctag

SEQ ID NO: 100156 - DNA, 1908 bp, Artificial Sequence
  Description of Artificial Sequence: Synthetic coding sequence
atggccaagaagagcgccgagaacggcatctacagcgtgagcggcgacgagaagaagggccccctgatcgcccccggccccgacggcgcccccgccaagggcgacggccccgtgggcctgggcacccccggcggcagactggccgtgccccccagagagacctggaccagacagatggacttcatcatgagctgcgtgggcttcgccgtgggcctgggcaacgtgtggagattcccctacctgtgctacaagaacggcggcggcgtgttcctgatcccctacgtgctgatcgccctggtgggcggcatccccatcttcttcctggagatcagcctgggccagttcatgaaggccggcagcatcaacgtgtggaacatctgccccctgttcaagggcctgggctacgccagcatggtgatcgtgttctactgcaacacctactacatcatggtgctggcctggggcttctactacctggtgaagagcttcaccaccaccctgccctgggccacctgcggccacacctggaacacccccgactgcgtggagatcttcagacacgaggactgcgccaacgccagcctggccaacctgacctgcgaccagctggccgacagaagaagccccgtgatcgagttctgggagaacaaggtgctgagactgagcggcggcctggaggtgcccggcgccctgaactgggaggtgaccctgtgcctgctggcctgctgggtgctggtgtacttctgcgtgtggaagggcgtgaagagcaccggcaagatcgtgtacttcaccgccaccttcccctacgtggtgctggtggtgctgctggtgagaggcgtgctgctgcccggcgccctggacggcatcatctactacctgaagcccgactggagcaagctgggcagcccccaggtgtggatcgacgccggcacccagatcttcttcagctacgccatcggcctgggcgccctgaccgccctgggcagctacaacagattcaacaacaactgctacaaggacgccatcatcctggccctgatcaacagcggcaccagcttcttcgccggcttcgtggtgttcagcatcctgggcttcatggccgccgagcagggcgtgcacatcagcaaggtggccgagagcggccccggcctggccttcatcgcctaccccagagccgtgaccctgatgcccgtggcccccctgtgggccgccctgttcttcttcatgctgctgctgctgggcctggacagccagttcgtgggcgtggagggcttcatcaccggcctgctggacctgctgcccgccagctactacttcagattccagagagagatcagcgtggccctgtgctgcgccctgtgcttcgtgatcgacctgagcatggtgaccgacggcggcatgtacgtgttccagctgttcgactactacagcgccagcggcaccaccctgctgtggcaggccttctgggagtgcgtggtggtggcctgggtgtacggcgccgacagattcatggacgacatcgcctgcatgatcggctacagaccctgcccctggatgaagtggtgctggagcttcttcacccccctggtgtgcatgggcatcttcatcttcaacgtggtgtactacgagcccctggtgtacaacaacacctacgtgtacccctggtggggcgaggccatgggctgggccttcgccctgagcagcatgctgtgcgtgcccctgcacctgctgggctgcctgctgagagccaagggcaccatggccgagagatggcagcacctgacccagcccatctggggcctgcaccacctggagtacagagcccaggacgccgacgtgagaggcctgaccaccctgacccccgtgagcgagagcagcaaggtggtggtggtggagagcgtgatgtag

SEQ ID NO: 100157 - DNA, 2190 bp, Artificial Sequence
  Description of Artificial Sequence: Synthetic coding sequence
atgctgcccaccctgcagatccagggccccgccgccttcgcccccggcgacagaggccccggcagacactgccccttccccgtgcccatcacccccaccggcgccctgctgcccgtgagcgacagctgcgacagcctggtggacctggtgtggcccagcgtgacctacctggccctgggcacccagagcagagtgtggccccaccccctgggcgcccccggccaggccggcgagagccccgagcagagaagacagtgcctggagctgtgggacatggccagcagcctgggcgacaaggtgcccagagccgcctgcggcaagagaggccagaccgtgtggcagctgcacctggcctgcctgtgcctggcccagttccacagcccccccgcccagcccccccccctgagcagaagaggcggcggccccgaccccgaccccatcagcagaagcctgcccggcccccccacccccgccctgcccacccacagctacagcagccacagccccagagcccccagactgctgagccccctgagaagagcccccagaggcagccccgccccccacagacacgccagcctgcagaccaacgaggcccccagagagctgccccactgcacctggcccggcctgcccggcagaagcctggcccccagcttcctgtggagagagccctggctgggcggccagtggggccccctgaacatccccgccagaaagggcgacagaagaagatgggagtggggctgcgagggcggcggcgccaccgccagcgccgagcagcccggcccccagatcgtgtacttcaccgccaccttcccctacgtggtgctggtggtgctgctggtgagaggcgtgctgctgcccggcgccctggacggcatcatctactacctgaagcccgactggagcaagctgggcagcccccaggtgtggatcgacgccggcacccagatcttcttcagctacgccatcggcctgggcgccctgaccgccctgggcagctacaacagattcaacaacaactgctacaaggacgccatcatcctggccctgatcaacagcggcaccagcttcttcgccggcttcgtggtgttcagcatcctgggcttcatggccgccgagcagggcgtgcacatcagcaaggtggccgagagcggccccggcctggccttcatcgcctaccccagagccgtgaccctgatgcccgtggcccccctgtgggccgccctgttcttcttcatgctgctgctgctgggcctggacagccaggtgtgcatgggcctgtgggacagagagcccggcggcggcagaagagagggctgcagacagggcaagggctggagaagatgcggcgccagacccgagctgccctggccccagttcgtgggcgtggagggcttcatcaccggcctgctggacctgctgcccgccagctactacttcagattccagagagagatcagcgtggccctgtgctgcgccctgtgcttcgtgatcgacctgagcatggtgaccgacgtgagcggcgtgggcggcctgcccgtgaccagcggcggcagactgcccagcagcctgaccggcctgtgcccccagggcggcatgtacgtgttccagctgttcgactactacagcgccagcggcaccaccctgctgtggcaggccttctgggagtgcgtggtggtggcctgggtgtacggcagaagctggctgagagccggcctgggcgacggcggcggcgagggcagaagccccgcctggcccgccagccccagaggcgccgacagattcatggacgacatcgcctgcatgatcggctacagaccctgcccctggatgaagtggtgctggagcttcttcacccccctggtgtgcatgggcatcttcatcttcaacgtggtgtactacgagcccctggtgtacaacaacacctacgtgtacccctggtggggcgaggccatgggctgggccttcgccctgagcagcatgctgtgcgtgcccctgcacctgctgggctgcctgctgagagccaagggcaccatggccgagagatggcagcacctgacccagcccatctggggcctgcaccacctggagtacagagcccaggacgccgacgtgagaggcctgaccaccctgacccccgtgagcgagagcagcaaggtggtggtggtggagagcgtgatgtag

SEQ ID NO: 100158 - DNA, 471 bp, Artificial Sequence
  Description of Artificial Sequence: Synthetic coding sequence
ctgctgcacagccccacctggagctggagctgctgctggtgcgtggagtgctgctgcctggccccctggatggccagcttcaccatcagcagcctgaccggccagagctggggccccctgagccccggccagctgcagcccctgcagcagcagctgctgcagtgggaccagctgctgtgctggctgagaggcctgctgcaccccggcctgcacggctgcagagccggcagagcccacctgcagggcggcagagtgagagagatcagcgtggccctgtgctgcgccctgtgcttcgtgatcgacctgagcatggtgaccgacggcggcatgtacgtgttccagctgttcgactactacagcgccagcggcaccaccctgctgtggcaggccttctgggagtgcgtggtggtggcctgggtgtacggcgccgacagattcatggacgacatcgcctgcatgatcggctactag

SEQ ID NO: 100159 - DNA, 339 bp, Artificial Sequence
  Description of Artificial Sequence: Synthetic coding sequence
tgattcagacacgaggactgcgccaacgccagcctggccaacctgacctgcgaccagctggccgacagaagaagccccgtgatcgagttctgggagaacaaggtgctgagactgagcggcggcctggaggtgcccggcgccctgaactgggaggtgaccctgtgcctgctggcctgctgggtgctggtgtacttctgcgtgtggaagggcgtgaagagcaccggcaaggtgcccctggaggcctgcagcggcgagggcggcagcgccctgggcgccggctgcctgtgccaggcccacctgtggcagagagaggtgaccagacagagcctggccctgtag

SEQ ID NO: 100160 - DNA, 1563 bp, Artificial Sequence
  Description of Artificial Sequence: Synthetic coding sequence
atgaaggccggcagcatcaacgtgtggaacatctgccccctgttcaagggcctgggctacgccagcatggtgatcgtgttctactgcaacacctactacatcatggtgctggcctggggcttctactacctggtgaagagcttcaccaccaccctgccctgggccacctgcggccacacctggaacacccccgactgcgtggagatcttcagacacgaggactgcgccaacgccagcctggccaacctgacctgcgaccagctggccgacagaagaagccccgtgatcgagttctgggagaacaaggtgctgagactgagcggcggcctggaggtgcccggcgccctgaactgggaggtgaccctgtgcctgctggcctgctgggtgctggtgtacttctgcgtgtggaagggcgtgaagagcaccggcaagatcgtgtacttcaccgccaccttcccctacgtggtgctggtggtgctgctggtgagaggcgtgctgctgcccggcgccctggacggcatcatctactacctgaagcccgactggagcaagctgggcagcccccaggtgtggatcgacgccggcacccagatcttcttcagctacgccatcggcctgggcgccctgaccgccctgggcagctacaacagattcaacaacaactgctacaaggacgccatcatcctggccctgatcaacagcggcaccagcttcttcgccggcttcgtggtgttcagcatcctgggcttcatggccgccgagcagggcgtgcacatcagcaaggtggccgagagcggccccggcctggccttcatcgcctaccccagagccgtgaccctgatgcccgtggcccccctgtgggccgccctgttcttcttcatgctgctgctgctgggcctggacagccagttcgtgggcgtggagggcttcatcaccggcctgctggacctgctgcccgccagctactacttcagattccagagagagatcagcgtggccctgtgctgcgccctgtgcttcgtgatcgacctgagcatggtgaccgacggcggcatgtacgtgttccagctgttcgactactacagcgccagcggcaccaccctgctgtggcaggccttctgggagtgcgtggtggtggcctgggtgtacggcgccgacagattcatggacgacatcgcctgcatgatcggctacagaccctgcccctggatgaagtggtgctggagcttcttcacccccctggtgtgcatgggcatcttcatcttcaacgtggtgtactacgagcccctggtgtacaacaacacctacgtgtacccctggtggggcgaggccatgggctgggccttcgccctgagcagcatgctgtgcgtgcccctgcacctgctgggctgcctgctgagagccaagggcaccatggccgagagatggcagcacctgacccagcccatctggggcctgcaccacctggagtacagagcccaggacgccgacgtgagaggcctgaccaccctgacccccgtgagcgagagcagcaaggtggtggtggtggagagcgtgatgtag

SEQ ID NO: 100161 - DNA, 525 bp, Artificial Sequence
  Description of Artificial Sequence: Synthetic coding sequence
tgaatcgacgccggcacccagatcttcttcagctacgccatcggcctgggcgccctgaccgccctgggcagctacaacagattcaacaacaactgctacaacggcaccagcttcttcgccggcttcgtggtgttcagcatcctgggcttcatggccgccgagcagggcgtgcacatcagcaaggtggccgagagcggccccggcctggccttcatcgcctaccccagagccgtgaccctgatgcccgtggcccccctgtgggccgccctgttcttcttcatgctgctgctgctgggcctggacagccagttcgtgggcgtggagggcttcatcaccggcctgctggacctgctgcccgccagctactacttcagattccagagagagatcagcgtggccctgtgctgcgccctgtgcttcgtgatcgacctgagcatggtgaccgacggcggcatgtacgtgttccagctgttcgactactacagcgccagcggcaccaccctgctgtggcaggccttctggtag

SEQ ID NO: 100162 - DNA, 270 bp, Artificial Sequence
  Description of Artificial Sequence: Synthetic coding sequence
ggcagacaccaccccggcagccaccagcagtgggaccagctgctgtgctggctgagaggcctgctgcaccccggcctgcacggctgcagagccggcagagcccacctgcagggcggcagagtgagagccggccccggcctgcacagactgcccgccggctgccacgccgacgccagcggccccaccctgggctgccccgtgctgctgcacgccgtggccgcctggagcagacagcccggcgtggagggcttcatcaccggcctgctgtag

SEQ ID NO: 100163 - DNA, 1863 bp, Artificial Sequence
  Description of Artificial Sequence: Synthetic coding sequence
atgagcaagagcaagtgcagcgtgggcctgatgagcagcgtggtggcccccgccaaggagcccaacgccgtgggccccaaggaggtggagctgatcctggtgaaggagcagaacggcgtgcagctgaccagcagcaccctgaccaaccccagacagagccccgtggaggcccaggacagagagacctggggcaagaagatcgacttcctgctgagcgtgatcggcttcgccgtggacctggccaacgtgtggagattcccctacctgtgctacaagaacggcggcggcgccttcctggtgccctacctgctgttcatggtgatcgccggcatgcccctgttctacatggagctggccctgggccagttcaacagagagggcgccgccggcgtgtggaagatctgccccatcctgaagggcgtgggcttcaccgtgatcctgatcagcctgtacgtgggcttcttctacaacgtgatcatcgcctgggccctgcactacctgttcagcagcttcaccaccgagctgccctggatccactgcaacaacagctggaacagccccaactgcagcgacgcccaccccggcgacagcagcggcgacagcagcggcctgaacgacaccttcggcaccacccccgccgccgagtacttcgagagaggcgtgctgcacctgcaccagagccacggcatcgacgacctgggcccccccagatggcagctgaccgcctgcctggtgctggtgatcgtgctgctgtacttcagcctgtggaagggcgtgaagaccagcggcaaggtggtgtggatcaccgccaccatgccctacgtggtgctgaccgccctgctgctgagaggcgtgaccctgcccggcgccatcgacggcatcagagcctacctgagcgtggacttctacagactgtgcgaggccagcgtgtggatcgacgccgccacccaggtgtgcttcagcctgggcgtgggcttcggcgtgctgatcgccttcagcagctacaacaagttcaccaacaactgctacagagacgccatcgtgaccaccagcatcaacagcctgaccagcttcagcagcggcttcgtggtgttcagcttcctgggctacatggcccagaagcacagcgtgcccatcggcgacgtggccaaggacggccccggcctgatcttcatcatctaccccgaggccatcgccaccctgcccctgagcagcgcctgggccgtggtgttcttcatcatgctgctgaccctgggcatcgacagcgccatgggcggcatggagagcgtgatcaccggcctgatcgacgagttccagctgctgcacagacacagagagctgttcaccctgttcatcgtgctggccaccttcctgctgagcctgttctgcgtgaccaacggcggcatctacgtgttcaccctgctggaccacttcgccgccggcaccagcatcctgttcggcgtgctgatcgaggccatcggcgtggcctggttctacggcgtgggccagttcagcgacgacatccagcagatgaccggccagagacccagcctgtactggagactgtgctggaagctggtgagcccctgcttcctgctgttcgtggtggtggtgagcatcgtgaccttcagacccccccactacggcgcctacatcttccccgactgggccaacgccctgggctgggtgatcgccaccagcagcatggccatggtgcccatctacgccgcctacaagttctgcagcctgcccggcagcttcagagagaagctggcctacgccatcgcccccgagaaggacagagagctggtggacagaggcgaggtgagacagttcaccctgagacactggctgaaggtgtag

SEQ ID NO: 100164 - DNA, 1863 bp, Artificial Sequence; identical to SEQ ID NO: 100163
  Description of Artificial Sequence: Synthetic coding sequence

SEQ ID NO: 100165 - DNA, 1800 bp, Artificial Sequence
  Description of Artificial Sequence: Synthetic coding sequence
atggccaccaacggcagcaaggtggccgacggccagatcagcaccgaggtgagcgaggcccccgtggccaacgacaagcccaagaccctggtggtgaaggtgcagaagaaggccgccgacctgcccgacagagacacctggaagggcagattcgacttcctgatgagctgcgtgggctacgccatcggcctgggcaacgtgtggagattcccctacctgtgcggcaagaacggcggcggcgccttcctgatcccctacttcctgaccctgatcttcgccggcgtgcccctgttcctgctggagtgcagcctgggccagtacaccagcatcggcggcctgggcgtgtggaagctggcccccatgttcaagggcgtgggcctggccgccgccgtgctgagcttctggctgaacatctactacatcgtgatcatcagctgggccatctactacctgtacaacagcttcaccaccaccctgccctggaagcagtgcgacaacccctggaacaccgacagatgcttcagcaactacagcatggtgaacaccaccaacatgaccagcgccgtggtggagttctgggagagaaacatgcaccagatgaccgacggcctggacaagcccggccagatcagatggcccctggccatcaccctggccatcgcctggatcctggtgtacttctgcatctggaagggcgtgggctggaccggcaaggtggtgtacttcagcgccacctacccctacatcatgctgatcatcctgttcttcagaggcgtgaccctgcccggcgccaaggagggcatcctgttctacatcacccccaacttcagaaagctgagcgacagcgaggtgtggctggacgccgccacccagatcttcttcagctacggcctgggcctgggcagcctgatcgccctgggcagctacaacagcttccacaacaacgtgtacagagacagcatcatcgtgtgctgcatcaacagctgcaccagcatgttcgccggcttcgtgatcttcagcatcgtgggcttcatggcccacgtgaccaagagaagcatcgccgacgtggccgccagcggccccggcctggccttcctggcctaccccgaggccgtgacccagctgcccatcagccccctgtgggccatcctgttcttcagcatgctgctgatgctgggcatcgacagccagttctgcaccgtggagggcttcatcaccgccctggtggacgagtaccccagactgctgagaaacagaagagagctgttcatcgccgccgtgtgcatcatcagctacctgatcggcctgagcaacatcacccagggcggcatctacgtgttcaagctgttcgactactacagcgccagcggcatgagcctgctgttcctggtgttcttcgagtgcgtgagcatcagctggttctacggcgtgaacagattctacgacaacatccaggagatggtgggcagcagaccctgcatctggtggaagctgtgctggagcttcttcacccccatcatcgtggccggcgtgttcatcttcagcgccgtgcagatgacccccctgaccatgggcaactacgtgttccccaagtggggccagggcgtgggctggctgatggccctgagcagcatggtgctgatccccggctacatggcctacatgttcctgaccctgaagggcagcctgaagcagagaatccaggtgatggtgcagcccagcgaggacatcgtgagacccgagaacggccccgagcagccccaggccggcagcagcaccagcaaggaggcctacatctag

SEQ ID NO: 100166 - DNA, 120 bp, Artificial Sequence
  Description of Artificial Sequence: Synthetic coding sequence
atggccaccaacggcagcaaggtggccgacggccagatcagcaccgaggtgagcgaggcccccgtggccaacgacaagcccaagaccctggtggtgaaggtgcagaagaaggccgcctag

SEQ ID NO: 100167 - DNA, 1266 bp, Artificial Sequence
  Description of Artificial Sequence: Synthetic coding sequence
atggtgaacaccaccaacatgaccagcgccgtggtggagttctgggagagaaacatgcaccagatgaccgacggcctggacaagcccggccagatcagatggcccctggccatcaccctggccatcgcctggatcctggtgtacttctgcatctggaagggcgtgggctggaccggcaaggtggtgtacttcagcgccacctacccctacatcatgctgatcatcctgttcttcagaggcgtgaccctgcccggcgccaaggagggcatcctgttctacatcacccccaacttcagaaagctgagcgacagcgaggtgtggctggacgccgccacccagatcttcttcagctacggcctgggcctgggcagcctgatcgccctgggcagctacaacagcttccacaacaacgtgtacagagacagcatcatcgtgtgctgcatcaacagctgcaccagcatgttcgccggcttcgtgatcttcagcatcgtgggcttcatggcccacgtgaccaagagaagcatcgccgacgtggccgccagcggccccggcctggccttcctggcctaccccgaggccgtgacccagctgcccatcagccccctgtgggccatcctgttcttcagcatgctgctgatgctgggcatcgacagccagttctgcaccgtggagggcttcatcaccgccctggtggacgagtaccccagactgctgagaaacagaagagagctgttcatcgccgccgtgtgcatcatcagctacctgatcggcctgagcaacatcacccagggcggcatctacgtgttcaagctgttcgactactacagcgccagcggcatgagcctgctgttcctggtgttcttcgagtgcgtgagcatcagctggttctacggcgtgaacagattctacgacaacatccaggagatggtgggcagcagaccctgcatctggtggaagctgtgctggagcttcttcacccccatcatcgtggccggcgtgttcatcttcagcgccgtgcagatgacccccctgaccatgggcaactacgtgttccccaagtggggccagggcgtgggctggctgatggccctgagcagcatggtgctgatccccggctacatggcctacatgttcctgaccctgaagggcagcctgaagcagagaatccaggtgatggtgcagcccagcgaggacatcgtgagacccgagaacggccccgagcagccccaggccggcagcagcaccagcaaggaggcctacatctag

SEQ ID NO: 100168 - DNA, 1899 bp, Artificial Sequence
  Description of Artificial Sequence: Synthetic coding sequence
atgaccgccgagaaggccctgcccctgggcaacggcaaggccgccgaggaggccagagagagcgaggcccccggcggcggctgcagcagcggcggcgccgcccccgccagacaccccagagtgaagagagacaaggccgtgcacgagagaggccactggaacaacaaggtggagttcgtgctgagcgtggccggcgagatcatcggcctgggcaacgtgtggagattcccctacctgtgctacaagaacggcggcggcgccttcctgatcccctacgtggtgttcttcatctgctgcggcatccccgtgttcttcctggagaccgccctgggccagttcaccagcgagggcggcatcacctgctggagaaaggtgtgccccctgttcgagggcatcggctacgccacccaggtgatcgaggcccacctgaacgtgtactacatcatcatcctggcctgggccatcttctacctgagcaactgcttcaccaccgagctgccctgggccacctgcggccacgagtggaacaccgagaactgcgtggagttccagaagctgaacgtgagcaactacagccacgtgagcctgcagaacgccaccagccccgtgatggagttctgggagcacagagtgctggccatcagcgacggcatcgagcacatcggcaacctgagatgggagctggccctgtgcctgctggccgcctggaccatctgctacttctgcatctggaagggcaccaagagcaccggcaaggtggtgtacgtgaccgccaccttcccctacatcatgctgctgatcctgctgatcagaggcgtgaccctgcccggcgccagcgagggcatcaagttctacctgtaccccgacctgagcagactgagcgacccccaggtgtgggtggacgccggcacccagatcttcttcagctacgccatctgcctgggctgcctgaccgccctgggcagctacaacaactacaacaacaactgctacagagactgcatcatgctgtgctgcctgaacagcggcaccagcttcgtggccggcttcgccatcttcagcgtgctgggcttcatggcctacgagcagggcgtgcccatcgccgaggtggccgagagcggccccggcctggccttcatcgcctaccccaaggccgtgaccatgatgcccctgagccccctgtgggccaccctgttcttcatgatgctgatcttcctgggcctggacagccagttcgtgtgcgtggagagcctggtgaccgccgtggtggacatgtaccccaaggtgttcagaagaggctacagaagagagctgctgatcctggccctgagcgtgatcagctacttcctgggcctggtgatgctgaccgagggcggcatgtacatcttccagctgttcgacagctacgccgccagcggcatgtgcctgctgttcgtggccatcttcgagtgcatctgcatcggctgggtgtacggcagcaacagattctacgacaacatcgaggacatgatcggctacagaccccccagcctgatcaagtggtgctggatgatcatgacccccggcatctgcgccggcatcttcatcttcttcctgatcaagtacaagcccctgaagtacaacaacatctacacctaccccgcctggggctacggcatcggctggctgatggccctgagcagcatgctgtgcatccccctgtggatctgcatcaccgtgtggaagaccgagggcaccctgcccgagaagctgcagaagctgaccacccccagcaccgacctgaagatgagaggcaagctgggcgtgagccccagaatggtgaccgtgaacgactgcgacgccaagctgaagagcgacggcaccatcgccgccatcaccgagaaggagacccacttctag

SEQ ID NO: 100169 - DNA, 627 bp, Artificial Sequence
  Description of Artificial Sequence: Synthetic coding sequence
atgaccgccgagaaggccctgcccctgggcaacggcaaggccgccgaggaggccagagagagcgaggcccccggcggcggctgcagcagcggcggcgccgcccccgccagacaccccagagtgaagagagacaaggccgtgcacgagagaggccactggaacaacaaggtggagttcgtgctgagcgtggccggcgagatcatcggcctgggcaacgtgtggagattcccctacctgtgctacaagaacggcggcggcgccttcctgatcccctacgtggtgttcttcatctgctgcggcatccccgtgttcttcctggagaccgccctgggccagttcaccagcgagggcggcatcacctgctggagaaaggtgtgccccctgttcgagggcatcggctacgccacccaggtgatcgaggcccacctgaacgtgtactacatcatcatcctggcctgggccatcttctacctgagcaactgcttcaccaccgagctgccctgggccacctgcggccacgagtggaacaccgagaactgcgtggagttccagaagctgaacgtgagcaactacagccacgtgagcctgcagaacgccaccagccccgtgatggagttctgggagtag

SEQ ID NO: 100170 - DNA, 2394 bp, Artificial Sequence
  Description of Artificial Sequence: Synthetic coding sequence
atggactgcagcgcccccaaggagatgaacaagctgcccgccaacagccccgaggccgccgccgcccagggccaccccgacggcccctgcgcccccagaaccagccccgagcaggagctgcccgccgccgccgccccccccccccccagagtgcccagaagcgccagcaccggcgcccagaccttccagagcgccgacgccagagcctgcgaggccgagagacccggcgtgggcagctgcaagctgagcagccccagagcccaggccgccagcgccgccctgagagacctgagagaggcccagggcgcccaggccagccccccccccggcagcagcggccccggcaacgccctgcactgcaagatccccttcctgagaggccccgagggcgacgccaacgtgagcgtgggcaagggcaccctggagagaaacaacacccccgtggtgggctgggtgaacatgagccagagcaccgtggtgctggccaccgacggcatcaccagcgtgctgcccggcagcgtggccaccgtggccacccaggaggacgagcagggcgacgagaacaaggccagaggcaactggagcagcaagctggacttcatcctgagcatggtgggctacgccgtgggcctgggcaacgtgtggagattcccctacctggccttccagaacggcggcggcgccttcctgatcccctacctgatgatgctggccctggccggcctgcccatcttcttcctggaggtgagcctgggccagttcgccagccagggccccgtgagcgtgtggaaggccatccccgccctgcagggctgcggcatcgccatgctgatcatcagcgtgctgatcgccatctactacaacgtgatcatctgctacaccctgttctacctgttcgccagcttcgtgagcgtgctgccctggggcagctgcaacaacccctggaacacccccgagtgcaaggacaagaccaagctgctgctggacagctgcgtgatcagcgaccaccccaagatccagatcaagaacagcaccttctgcatgaccgcctaccccaacgtgaccatggtgaacttcaccagccaggccaacaagaccttcgtgagcggcagcgaggagtacttcaagtacttcgtgctgaagatcagcgccggcatcgagtaccccggcgagatcagatggcccctggccctgtgcctgttcctggcctgggtgatcgtgtacgccagcctggccaagggcatcaagaccagcggcaaggtggtgtacttcaccgccaccttcccctacgtggtgctggtgatcctgctgatcagaggcgtgaccctgcccggcgccggcgccggcatctggtacttcatcacccccaagtgggagaagctgaccgacgccaccgtgtggaaggacgccgccacccagatcttcttcagcctgagcgccgcctggggcggcctgatcaccctgagcagctacaacaagttccacaacaactgctacagagacaccctgatcgtgacctgcaccaacagcgccaccagcatcttcgccggcttcgtgatcttcagcgtgatcggcttcatggccaacgagagaaaggtgaacatcgagaacgtggccgaccagggccccggcatcgccttcgtggtgtaccccgaggccctgaccagactgcccctgagccccttctgggccatcatcttcttcctgatgctgctgaccctgggcctggacaccatgttcgccaccatcgagaccatcgtgaccagcatcagcgacgagttccccaagtacctgagaacccacaagcccgtgttcaccctgggctgctgcatctgcttcttcatcatgggcttccccatgatcacccagggcggcatctacatgttccagctggtggacacctacgccgccagctacgccctggtgatcatcgccatcttcgagctggtgggcatcagctacgtgtacggcctgcagagattctgcgaggacatcgagatgatgatcggcttccagcccaacatcttctggaaggtgtgctgggccttcgtgacccccaccatcctgaccttcatcctgtgcttcagcttctaccagtgggagcccatgacctacggcagctacagataccccaactggagcatggtgctgggctggctgatgctggcctgcagcgtgatctggatccccatcatgttcgtgatcaagatgcacctggcccccggcagattcatcgagagactgaagctggtgtgcagcccccagcccgactggggccccttcctggcccagcacagaggcgagagatacaagaacatgatcgaccccctgggcaccagcagcctgggcctgaagctgcccgtgaaggacctggagctgggcacccagtgctag

SEQ ID NO: 100171 - DNA, 1959 bp, Artificial Sequence
  Description of Artificial Sequence: Synthetic coding sequence
atgagcggcggcgacaccagagccgccatcgccagacccagaatggccgccgcccacggccccgtggcccccagcagccccgagcagaacggcgccgtgcccagcgaggccaccaagagagaccagaacctgaagagaggcaactggggcaaccagatcgagttcgtgctgaccagcgtgggctacgccgtgggcctgggcaacgtgtggagattcccctacctgtgctacagaaacggcggcggcgccttcatgttcccctacttcatcatgctgatcttctgcggcatccccctgttcttcatggagctgagcttcggccagttcgccagccagggctgcctgggcgtgtggagaatcagccccatgttcaagggcgtgggctacggcatgatggtggtgagcacctacatcggcatctactacaacgtggtgatctgcatcgccttctactacttcttcagcagcatgacccacgtgctgccctgggcctactgcaacaacccctggaacacccacgactgcgccggcgtgctggacgccagcaacctgaccaacggcagcagacccgccgccctgcccagcaacctgagccacctgctgaaccacagcctgcagagaaccagccccagcgaggagtactggagactgtacgtgctgaagctgagcgacgacatcggcaacttcggcgaggtgagactgcccctgctgggctgcctgggcgtgagctggctggtggtgttcctgtgcctgatcagaggcgtgaagagcagcggcaaggtggtgtacttcaccgccaccttcccctacgtggtgctgaccatcctgttcgtgagaggcgtgaccctggagggcgccttcgacggcatcatgtactacctgaccccccagtgggacaagatcctggaggccaaggtgtggggcgacgccgccagccagatcttctacagcctgggctgcgcctggggcggcctgatcaccatggccagctacaacaagttccacaacaactgctacagagacagcgtgatcatcagcatcaccaactgcgccaccagcgtgtacgccggcttcgtgatcttcagcatcctgggcttcatggccaaccacctgggcgtggacgtgagcagagtggccgaccacggccccggcctggccttcgtggcctaccccgaggccctgaccctgctgcccatcagccccctgtggagcctgctgttcttcttcatgctgatcctgctgggcctgggcacccagttctgcctgctggagaccctggtgaccgccatcgtggacgaggtgggcaacgagtggatcctgcagaagaagacctacgtgaccctgggcgtggccgtggccggcttcctgctgggcatccccctgaccagccaggccggcatctactggctgctgctgatggacaactacgccgccagcttcagcctggtggtgatcagctgcatcatgtgcgtggccatcatgtacatctacggccacagaaactacttccaggacatccagatgatgctgggcttccccccccccctgttcttccagatctgctggagattcgtgagccccgccatcatcttcttcatcctggtgttcaccgtgatccagtaccagcccatcacctacaaccactaccagtaccccggctgggccgtggccatcggcttcctgatggccctgagcagcgtgctgtgcatccccctgtacgccatgttcagactgtgcagaaccgacggcgacaccctgctgcagagactgaagaacgccaccaagcccagcagagactggggccccgccctgctggagcacagaaccggcagatacgcccccaccatcgcccccagccccgaggacggcttcgaggtgcagcccctgcaccccgacaaggcccagatccccatcgtgggcagcaacggcagcagcagactgcaggacagcagaatctag

SEQ ID NO: 100172 - DNA, 2121 bp, Artificial Sequence
  Description of Artificial Sequence: Synthetic coding sequence
atgagcggcggcgacaccagagccgccatcgccagacccagaatggccgccgcccacggccccgtggcccccagcagccccgagcaggtgaccctgctgcccgtgcagagaagcttcttcctgccccccttcagcggcgccacccccagcaccagcctggccgagagcgtgctgaaggtgtggcacggcgcctacaacagcggcctgctgccccagctgatggcccagcacagcctggccatggcccagaacggcgccgtgcccagcgaggccaccaagagagaccagaacctgaagagaggcaactggggcaaccagatcgagttcgtgctgaccagcgtgggctacgccgtgggcctgggcaacgtgtggagattcccctacctgtgctacagaaacggcggcggcgccttcatgttcccctacttcatcatgctgatcttctgcggcatccccctgttcttcatggagctgagcttcggccagttcgccagccagggctgcctgggcgtgtggagaatcagccccatgttcaagggcgtgggctacggcatgatggtggtgagcacctacatcggcatctactacaacgtggtgatctgcatcgccttctactacttcttcagcagcatgacccacgtgctgccctgggcctactgcaacaacccctggaacacccacgactgcgccggcgtgctggacgccagcaacctgaccaacggcagcagacccgccgccctgcccagcaacctgagccacctgctgaaccacagcctgcagagaaccagccccagcgaggagtactggagactgtacgtgctgaagctgagcgacgacatcggcaacttcggcgaggtgagactgcccctgctgggctgcctgggcgtgagctggctggtggtgttcctgtgcctgatcagaggcgtgaagagcagcggcaaggtggtgtacttcaccgccaccttcccctacgtggtgctgaccatcctgttcgtgagaggcgtgaccctggagggcgccttcgacggcatcatgtactacctgaccccccagtgggacaagatcctggaggccaaggtgtggggcgacgccgccagccagatcttctacagcctgggctgcgcctggggcggcctgatcaccatggccagctacaacaagttccacaacaactgctacagagacagcgtgatcatcagcatcaccaactgcgccaccagcgtgtacgccggcttcgtgatcttcagcatcctgggcttcatggccaaccacctgggcgtggacgtgagcagagtggccgaccacggccccggcctggccttcgtggcctaccccgaggccctgaccctgctgcccatcagccccctgtggagcctgctgttcttcttcatgctgatcctgctgggcctgggcacccagttctgcctgctggagaccctggtgaccgccatcgtggacgaggtgggcaacgagtggatcctgcagaagaagacctacgtgaccctgggcgtggccgtggccggcttcctgctgggcatccccctgaccagccaggccggcatctactggctgctgctgatggacaactacgccgccagcttcagcctggtggtgatcagctgcatcatgtgcgtggccatcatgtacatctacggccacagaaactacttccaggacatccagatgatgctgggcttccccccccccctgttcttccagatctgctggagattcgtgagccccgccatcatcttcttcatcctggtgttcaccgtgatccagtaccagcccatcacctacaaccactaccagtaccccggctgggccgtggccatcggcttcctgatggccctgagcagcgtgctgtgcatccccctgtacgccatgttcagactgtgcagaaccgacggcgacaccctgctgcagagactgaagaacgccaccaagcccagcagagactggggccccgccctgctggagcacagaaccggcagatacgcccccaccatcgcccccagccccgaggacggcttcgaggtgcagcccctgcaccccgacaaggcccagatccccatcgtgggcagcaacggcagcagcagactgcaggacagcagaatctag

SEQ ID NO: 100173 - DNA, 1725 bp, Artificial Sequence
  Description of Artificial Sequence: Synthetic coding sequence
atgttcccctacttcatcatgctgatcttctgcggcatccccctgttcttcatggagctgagcttcggccagttcgccagccagggctgcctgggcgtgtggagaatcagccccatgttcaagggcgtgggctacggcatgatggtggtgagcacctacatcggcatctactacaacgtggtgatctgcatcgccttctactacttcttcagcagcatgacccacgtgctgccctgggcctactgcaacaacccctggaacacccacgactgcgccggcgtgctggacgccagcaacctgaccaacggcagcagacccgccgccctgcccagcaacctgagccacctgctgaaccacagcctgcagagaaccagccccagcgaggagtactggagactgtacgtgctgaagctgagcgacgacatcggcaacttcggcgaggtgagactgcccctgctgggctgcctgggcgtgagctggctggtggtgttcctgtgcctgatcagaggcgtgaagagcagcggcaaggtggtgtacttcaccgccaccttcccctacgtggtgctgaccatcctgttcgtgagaggcgtgaccctggagggcgccttcgacggcatcatgtactacctgaccccccagtgggacaagatcctggaggccaaggtgtggggcgacgccgccagccagatcttctacagcctgggctgcgcctggggcggcctgatcaccatggccagctacaacaagttccacaacaactgctacagagacagcgtgatcatcagcatcaccaactgcgccaccagcgtgtacgccggcttcgtgatcttcagcatcctgggcttcatggccaaccacctgggcgtggacgtgagcagagtggccgaccacggccccggcctggccttcgtggcctaccccgaggccctgaccctgctgcccatcagccccctgtggagcctgctgttcttcttcatgctgatcctgctgggcctgggcacccagttctgcctgctggagaccctggtgaccgccatcgtggacgaggtgggcaacgagtggatcctgcagaagaagacctacgtgaccctgggcgtggccgtggccggcttcctgctgggcatccccctgaccagccaggccggcatctactggctgctgctgatggacaactacgccgccagcttcagcctggtggtgatcagctgcatcatgtgcgtggccatcatgtacatctacggccacagaaactacttccaggacatccagatgatgctgggcttccccccccccctgttcttccagatctgctggagattcgtgagccccgccatcatcttcctgcaggcccaggtgcacagaagactgccccagaaccccctgcacttcgccagcctgcccgagagaaacgtgctgctgcaccagctgccccagagaggcggcgtgcccgagcacgacccccccaccccccccagccccgccagaacctacggcccccaggtgagagtgagagaggtgcccagagccagaagacagagaagccccaaccccgcccccctgtgggccccccccagccccaagccccacccctgcagcgccgccggccccctgggctgggactgccccttcagaaactgccagagcctggccctgagcagcgccagactgctggccgacagcgacgccggcggccccgagaccagacagtgggagcccggcccctag

SEQ ID NO: 100174 - DNA, 1902 bp, Artificial Sequence
  Description of Artificial Sequence: Synthetic coding sequence
atggtgggcaagggcgccaagggcatgctgaacggcgccgtgcccagcgaggccaccaagagagaccagaacctgaagagaggcaactggggcaaccagatcgagttcgtgctgaccagcgtgggctacgccgtgggcctgggcaacgtgtggagattcccctacctgtgctacagaaacggcggcggcgccttcatgttcccctacttcatcatgctgatcttctgcggcatccccctgttcttcatggagctgagcttcggccagttcgccagccagggctgcctgggcgtgtggagaatcagccccatgttcaagggcgtgggctacggcatgatggtggtgagcacctacatcggcatctactacaacgtggtgatctgcatcgccttctactacttcttcagcagcatgacccacgtgctgccctgggcctactgcaacaacccctggaacacccacgactgcgccggcgtgctggacgccagcaacctgaccaacggcagcagacccgccgccctgcccagcaacctgagccacctgctgaaccacagcctgcagagaaccagccccagcgaggagtactggagactgtacgtgctgaagctgagcgacgacatcggcaacttcggcgaggtgagactgcccctgctgggctgcctgggcgtgagctggctggtggtgttcctgtgcctgatcagaggcgtgaagagcagcggcaaggtggtgtacttcaccgccaccttcccctacgtggtgctgaccatcctgttcgtgagaggcgtgaccctggagggcgccttcgacggcatcatgtactacctgaccccccagtgggacaagatcctggaggccaaggtgtggggcgacgccgccagccagatcttctacagcctgggctgcgcctggggcggcctgatcaccatggccagctacaacaagttccacaacaactgctacagagacagcgtgatcatcagcatcaccaactgcgccaccagcgtgtacgccggcttcgtgatcttcagcatcctgggcttcatggccaaccacctgggcgtggacgtgagcagagtggccgaccacggccccggcctggccttcgtggcctaccccgaggccctgaccctgctgcccatcagccccctgtggagcctgctgttcttcttcatgctgatcctgctgggcctgggcacccagttctgcctgctggagaccctggtgaccgccatcgtggacgaggtgggcaacgagtggatcctgcagaagaagacctacgtgaccctgggcgtggccgtggccggcttcctgctgggcatccccctgaccagccaggccggcatctactggctgctgctgatggacaactacgccgccagcttcagcctggtggtgatcagctgcatcatgtgcgtggccatcatgtacatctacggccacagaaactacttccaggacatccagatgatgctgggcttccccccccccctgttcttccagatctgctggagattcgtgagccccgccatcatcttcttcatcctggtgttcaccgtgatccagtaccagcccatcacctacaaccactaccagtaccccggctgggccgtggccatcggcttcctgatggccctgagcagcgtgctgtgcatccccctgtacgccatgttcagactgtgcagaaccgacggcgacaccctgctgcagagactgaagaacgccaccaagcccagcagagactggggccccgccctgctggagcacagaaccggcagatacgcccccaccatcgcccccagccccgaggacggcttcgaggtgcagcccctgcaccccgacaaggcccagatccccatcgtgggcagcaacggcagcagcagactgcaggacagcagaatctag

SEQ ID NO: 100175 - DNA, 1569 bp, Artificial Sequence
  Description of Artificial Sequence: Synthetic coding sequence
atgatggtggtgagcacctacatcggcatctactacaacgtggtgatctgcatcgccttctactacttcttcagcagcatgacccacgtgctgccctgggcctactgcaacaacccctggaacacccacgactgcgccggcgtgctggacgccagcaacctgaccaacggcagcagacccgccgccctgcccagcaacctgagccacctgctgaaccacagcctgcagagaaccagccccagcgaggagtactggagactgtacgtgctgaagctgagcgacgacatcggcaacttcggcgaggtgagactgcccctgctgggctgcctgggcgtgagctggctggtggtgttcctgtgcctgatcagaggcgtgaagagcagcggcaaggtggtgtacttcaccgccaccttcccctacgtggtgctgaccatcctgttcgtgagaggcgtgaccctggagggcgccttcgacggcatcatgtactacctgaccccccagtgggacaagatcctggaggccaaggtgtggggcgacgccgccagccagatcttctacagcctgggctgcgcctggggcggcctgatcaccatggccagctacaacaagttccacaacaactgctacagagacagcgtgatcatcagcatcaccaactgcgccaccagcgtgtacgccggcttcgtgatcttcagcatcctgggcttcatggccaaccacctgggcgtggacgtgagcagagtggccgaccacggccccggcctggccttcgtggcctaccccgaggccctgaccctgctgcccatcagccccctgtggagcctgctgttcttcttcatgctgatcctgctgggcctgggcacccagttctgcctgctggagaccctggtgaccgccatcgtggacgaggtgggcaacgagtggatcctgcagaagaagacctacgtgaccctgggcgtggccgtggccggcttcctgctgggcatccccctgaccagccaggccggcatctactggctgctgctgatggacaactacgccgccagcttcagcctggtggtgatcagctgcatcatgtgcgtggccatcatgtacatctacggccacagaaactacttccaggacatccagatgatgctgggcttccccccccccctgttcttccagatctgctggagattcgtgagccccgccatcatcttcttcatcctggtgttcaccgtgatccagtaccagcccatcacctacaaccactaccagtaccccggctgggccgtggccatcggcttcctgatggccctgagcagcgtgctgtgcatccccctgtacgccatgttcagactgtgcagaaccgacggcgacaccctgctgcagagactgaagaacgccaccaagcccagcagagactggggccccgccctgctggagcacagaaccggcagatacgcccccaccatcgcccccagccccgaggacggcttcgaggtgcagcccctgcaccccgacaaggcccagatccccatcgtgggcagcaacggcagcagcagactgcaggacagcagaatctag

SEQ ID NO: 100176 - DNA, 405 bp, Artificial Sequence
  Description of Artificial Sequence: Synthetic coding sequence
atgagcggcggcgacaccagagccgccatcgccagacccagaatggccgccgcccacggccccgtggcccccagcagccccgagcagaacggcgccgtgcccagcgaggccaccaagagagaccagaacctgaagagaggcaactggggcaaccagatcgagttcgtgctgaccagcgtgggctacgccgtgggcctgggcaacgtgtggagattcccctacctgtgctacagaaacggcggcggcgccttcatgttcccctacttcatcatgctgatcttctgcggcatccccctgttcttcatggagctgagcttcggccagttcgccagccagggctgcctgggcgtgtggagaatcagccccatgttcaagggcgtgggctacggcatgatggtggtgtag

SEQ ID NO: 100177 - DNA, 1161 bp, Artificial Sequence
  Description of Artificial Sequence: Synthetic coding sequence
atgttcccctacttcatcatgctgatcttctgcggcatccccctgttcttcatggagctgagcttcggccagttcgccagccagggctgcctgggcgtgtggagaatcagccccatgttcaagggcgtgggctacggcatgatggtggtgagcacctacatcggcatctactacaacgtggtgatctgcatcgccttctactacttcttcagcagcatgacccacgtgctgccctgggcctactgcaacaacccctggaacacccacgactgcgccggcgtgctggacgccagcaacctgaccaacggcagcagacccgccgccctgcccagcaacctgagccacctgctgaaccacagcctgcagagaaccagccccagcgaggagtactggagactgtacgtgctgaagctgagcgacgacatcggcaacttcggcgaggtgagactgcccctgctgggctgcctgggcgtgagctggctggtggtgttcctgtgcctgatcagaggcgtgaagagcagcggcaaggtggtgtacttcaccgccaccttcccctacgtggtgctgaccatcctgttcgtgagaggcgtgaccctggagggcgccttcgacggcatcatgtactacctgaccccccagtgggacaagatcctggaggccaaggtgtggggcgacgccgccagccagatcttctacagcctgggctgcgcctggggcggcctgatcaccatggccagctacaacaagttccacaacaactgctacagagacagcgtgatcatcagcatcaccaactgcgccaccagcgtgtacgccggcttcgtgatcttcagcatcctgggcttcatggccaaccacctgggcgtggacgtgagcagagtggccgaccacggccccggcctggccttcgtggcctaccccgaggccctgaccctgctgcccatcagccccctgtggagcctgctgttcttcttcatgctgatcctgctgggcctgggcacccagttctgcctgctggagaccctggtgaccgccatcgtggacgaggtgggcaacgagtggatcctgcagaagaagacctacgtgaccctgggcgtggccgtggccggcttcctgctgggcatccccctgaccagccaggccagcatcggctgctgctag

SEQ ID NO: 100178 - DNA, 1050 bp, Artificial Sequence
  Description of Artificial Sequence: Synthetic coding sequence
atgggcgacatgggcgacccccccaagaagaagagactgatcagcctgtgcgtgggctgcggcaaccagatccacgaccagtacatcctgagagtgagccccgacctggagtggcacgccgcctgcctgaagtgcgccgagtgcaaccagtacctggacgagagctgcacctgcttcgtgagagacggcaagacctactgcaagagagactacatcagactgtacggcatcaagtgcgccaagtgcagcatcggcttcagcaagaacgacttcgtgatgagagccagaagcaaggtgtaccacatcgagtgcttcagatgcgtggcctgcagcagacagctgatccccggcgacgagttcgccctgagagaggacggcctgttctgcagagccgaccacgacgtggtggagagagccagcctgggcgccggcgaccccctgagccccctgcaccccgccagacccctgcagatggccgccgagcccatcagcgccagacagcccgccctgagaccccacgtgcacaagcagcccgagaagaccaccagagtgagaaccgtgctgaacgagaagcagctgcacaccctgagaacctgctacgccgccaaccccagacccgacgccctgatgaaggagcagctggtggagatgaccggcctgagccccagagtgatcagagtgtggttccagaacaagagatgcaaggacaagaagagaagcatcatgatgaagcagctgcagcagcagcagcccaacgacaagaccaacatccagggcatgaccggcacccccatggtggccgccagccccgagagacacgacggcggcctgcaggccaaccccgtggaggtgcagagctaccagcccccctggaaggtgctgagcgacttcgccctgcagagcgacatcgaccagcccgccttccagcagctggtgaacttcagcgagggcggccccggcagcaacagcaccggcagcgaggtggccagcatgagcagccagctgcccgacacccccaacagcatggtggccagccccatcgaggcctag

SEQ ID NO: 100179 - DNA, 2283 bp, Artificial Sequence
  Description of Artificial Sequence: Synthetic coding sequence
atgctgagcgacgaccacgtgaacgagatcatcatccaggtggagaacgtgagcagcggcgtgcagagccaccccagcagcaaccagatcttccaggagaaggtgctgctggacagcagcatcaacatggtgctgagcatcagcgacatcgacgtgatcgacagccagaccgtgagcaagagaaacgaccagaagggcaaccaggtgctgagattcagcaccagcctgaacgagagcatgagccagaccctgcacagcctggagtgcatgggcatcgacacccccggcagcagccacgagaccgtgcagggccagaagctgatcgccagcctgatccccatgaccagcagagacagaatcaaggccatcagaaaccagcccagaaccatggaggagaagagaaacctgagaaagatcgtggacaaggagaagagcaagcagacccacagaatcctgcagctgaactgctgcatccagtgcctgaacagcatcagcagagcctacagaagaagcaagaacagcctgagcgagatcctgaacagcatcagcctgtggcagaagaccctgaagatcatcggcggcaagttcggcaccagcgtgctgagctacttcaacttcctgagatggctgctgaagttcaacatcttcagcttcatcctgaacttcagcttcatcatcatcccccagttcaccgtggccaagaagaacaccctgcagttcaccggcctggagttcttcaccggcgtgggctacttcagagacaccgtgatgtactacggcttctacaccaacagcaccatccagcacggcaacagcggcgccagctacaacatgcagctggcctacatcttcaccatcggcgcctgcctgaccacctgcttcttcagcctgctgttcagcatggccaagtacttcagaaacaacttcatcaacccccacatctacagcggcggcatcaccaagctgatcttctgctgggacttcaccgtgacccacgagaaggccgtgaagctgaagcagaagaacctgagcaccgagatcagagagaacctgagcgagctgagacaggagaacagcaagctgaccttcaaccagctgctgaccagattcagcgcctacatggtggcctgggtggtgagcaccggcgtggccatcgcctgctgcgccgccgtgtactacctggccgagtacaacctggagttcctgaagacccacagcaaccccggcgccgtgctgctgctgcccttcgtggtgagctgcatcaacctggccgtgccctgcatctacagcatgttcagactggtggagagatacgagatgcccagacacgaggtgtacgtgctgctgatcagaaacatcttcctgaagatcagcatcatcggcatcctgtgctactactggctgaacaccgtggccctgagcggcgaggagtgctgggagaccctgatcggccaggacatctacagactgctgctgatggacttcgtgttcagcctggtgaacagcttcctgggcgagttcctgagaagaatcatcggcatgcagctgatcaccagcctgggcctgcaggagttcgacatcgccagaaacgtgctggagctgatctacgcccagaccctggtgtggatcggcatcttcttctgccccctgctgcccttcatccagatgatcatgctgttcatcatgttctacagcaagaacatcagcctgatgatgaacttccagccccccagcaaggcctggagagccagccagatgatgaccttcttcatcttcctgctgttcttccccagcttcaccggcgtgctgtgcaccctggccatcaccatctggagactgaagcccagcgccgactgcggccccttcagaggcctgcccctgttcatccacagcatctacagctggatcgacaccctgagcaccagacccggctacctgtgggtggtgtggatctacagaaacctgatcggcagcgtgcacttcttcttcatcctgaccctgatcgtgctgatcatcacctacctgtactggcagatcaccgagggcagaaagatcatgatcagactgctgcacgagcagatcatcaacgagggcaaggacaagatgttcctgatcgagaagctgatcaagctgcaggacatggagaagaaggccaaccccagcagcctggtgctggagagaagagaggtggagcagcagggcttcctgcacctgggcgagcacgacggcagcctggacctgagaagcagaagaagcgtgcaggagggcaaccccagagcctag

SEQ ID NO: 100180 - DNA, 1854 bp, Artificial Sequence
  Description of Artificial Sequence: Synthetic coding sequence
atgctgctggccagaatgaacccccaggtgcagcccgagaacaacggcgccgacaccggccccgagcagcccctgagagccagaaagaccgccgagctgctggtggtgaaggagagaaacggcgtgcagtgcctgctggcccccagagacggcgacgcccagcccagagagacctggggcaagaagatcgacttcctgctgagcgtggtgggcttcgccgtggacctggccaacgtgtggagattcccctacctgtgctacaagaacggcggcggcgccttcctgatcccctacaccctgttcctgatcatcgccggcatgcccctgttctacatggagctggccctgggccagtacaacagagagggcgccgccaccgtgtggaagatctgccccttcttcaagggcgtgggctacgccgtgatcctgatcgccctgtacgtgggcttctactacaacgtgatcatcgcctggagcctgtactacctgttcagcagcttcaccctgaacctgccctggaccgactgcggccacacctggaacagccccaactgcaccgaccccaagctgctgaacggcagcgtgctgggcaaccacaccaagtacagcaagtacaagttcacccccgccgccgagttctacgagagaggcgtgctgcacctgcacgagagcagcggcatccacgacatcggcctgccccagtggcagctgctgctgtgcctgatggtggtggtgatcgtgctgtacttcagcctgtggaagggcgtgaagaccagcggcaaggtggtgtggatcaccgccaccctgccctacttcgtgctgttcgtgctgctggtgcacggcgtgaccctgcccggcgccagcaacggcatcaacgcctacctgcacatcgacttctacagactgaaggaggccaccgtgtggatcgacgccgccacccagatcttcttcagcctgggcgccggcttcggcgtgctgatcgccttcgccagctacaacaagttcgacaacaactgctacagagacgccctgctgaccagcagcatcaactgcatcaccagcttcgtgagcggcttcgccatcttcagcatcctgggctacatggcccacgagcacaaggtgaacatcgaggacgtggccaccgagggcgccggcctggtgttcatcctgtaccccgaggccatcagcaccctgagcggcagcaccttctgggccgtggtgttcttcgtgatgctgctggccctgggcctggacagcagcatgggcggcatggaggccgtgatcaccggcctggccgacgacttccaggtgctgaagagacacagaaagctgttcaccttcggcgtgaccttcagcaccttcctgctggccctgttctgcatcaccaagggcggcatctacgtgctgaccctgctggacaccttcgccgccggcaccagcatcctgttcgccgtgctgatggaggccatcggcgtgagctggttctacggcgtggacagattcagcaacgacatccagcagatgatgggcttcagacccggcctgtactggagactgtgctggaagttcgtgagccccgccttcctgctgttcgtggtggtggtgagcatcatcaacttcaagcccctgacctacgacgactacatcttccccccctgggccaactgggtgggctggggcatcgccctgagcagcatggtgctggtgcccatctacgtgatctacaagttcctgagcacccagggcagcctgtgggagagactggcctacggcatcacccccgagaacgagcaccacctggtggcccagagagacatcagacagttccagctgcagcactggctggccatctag

SEQ ID NO: 100181 - DNA, 1854 bp, Artificial Sequence; identical to SEQ ID NO: 100180
  Description of Artificial Sequence: Synthetic coding sequence

SEQ ID NO: 100182 - DNA, 996 bp, Artificial Sequence
  Description of Artificial Sequence: Synthetic coding sequence
atggtggtggtgatcgtgctgtacttcagcctgtggaagggcgtgaagaccagcggcaaggtgtggatcgacgccgccacccagatcttcttcagcctgggcgccggcttcggcgtgctgatcgccttcgccagctacaacaagttcgacaacaactgctacagagacgccctgctgaccagcagcatcaactgcatcaccagcttcgtgagcggcttcgccatcttcagcatcctgggctacatggcccacgagcacaaggtgaacatcgaggacgtggccaccgagggcgccggcctggtgttcatcctgtaccccgaggccatcagcaccctgagcggcagcaccttctgggccgtggtgttcttcgtgatgctgctggccctgggcctggacagcagcatgggcggcatggaggccgtgatcaccggcctggccgacgacttccaggtgctgaagagacacagaaagctgttcaccttcggcgtgaccttcagcaccttcctgctggccctgttctgcatcaccaagggcggcatctacgtgctgaccctgctggacaccttcgccgccggcaccagcatcctgttcgccgtgctgatggaggccatcggcgtgagctggttctacggcgtggacagattcagcaacgacatccagcagatgatgggcttcagacccggcctgtactggagactgtgctggaagttcgtgagccccgccttcctgctgttcgtggtggtggtgagcatcatcaacttcaagcccctgacctacgacgactacatcttccccccctgggccaactgggtgggctggggcatcgccctgagcagcatggtgctggtgcccatctacgtgatctacaagttcctgagcacccagggcagcctgtgggagagactggcctacggcatcacccccgagaacgagcaccacctggtggcccagagagacatcagacagttccagctgcagcactggctggccatctag

SEQ ID NO: 100183 - DNA, 1893 bp, Artificial Sequence
  Description of Artificial Sequence: Synthetic coding sequence
atggagaccacccccctgaacagccagaagcagctgagcgcctgcgaggacggcgaggactgccaggagaacggcgtgctgcagaaggtggtgcccacccccggcgacaaggtggagagcggccagatcagcaacggctacagcgccgtgcccagccccggcgccggcgacgacaccagacacagcatccccgccaccaccaccaccctggtggccgagctgcaccagggcgagagagagacctggggcaagaaggtggacttcctgctgagcgtgatcggctacgccgtggacctgggcaacgtgtggagattcccctacatctgctaccagaacggcggcggcgccttcctgctgccctacaccatcatggccatcttcggcggcatccccctgttctacatggagctggccctgggccagtaccacagaaacggctgcatcagcatctggagaaagatctgccccatcttcaagggcatcggctacgccatctgcatcatcgccttctacatcgccagctactacaacaccatcatggcctgggccctgtactacctgatcagcagcttcaccgaccagctgccctggaccagctgcaagaacagctggaacaccggcaactgcaccaactacttcagcgaggacaacatcacctggaccctgcacagcaccagccccgccgaggagttctacaccagacacgtgctgcagatccacagaagcaagggcctgcaggacctgggcggcatcagctggcagctggccctgtgcatcatgctgatcttcaccgtgatctacttcagcatctggaagggcgtgaagaccagcggcaaggtggtgtgggtgaccgccaccttcccctacatcatcctgagcgtgctgctggtgagaggcgccaccctgcccggcgcctggagaggcgtgctgttctacctgaagcccaactggcagaagctgctggagaccggcgtgtggatcgacgccgccgcccagatcttcttcagcctgggccccggcttcggcgtgctgctggccttcgccagctacaacaagttcaacaacaactgctaccaggacgccctggtgaccagcgtggtgaactgcatgaccagcttcgtgagcggcttcgtgatcttcaccgtgctgggctacatggccgagatgagaaacgaggacgtgagcgaggtggccaaggacgccggccccagcctgctgttcatcacctacgccgaggccatcgccaacatgcccgccagcaccttcttcgccatcatcttcttcctgatgctgatcaccctgggcctggacagcaccttcgccggcctggagggcgtgatcaccgccgtgctggacgagttcccccacgtgtgggccaagagaagagagagattcgtgctggccgtggtgatcacctgcttcttcggcagcctggtgaccctgaccttcggcggcgcctacgtggtgaagctgctggaggagtacgccaccggccccgccgtgctgaccgtggccctgatcgaggccgtggccgtgagctggttctacggcatcacccagttctgcagagacgtgaaggagatgctgggcttcagccccggctggttctggagaatctgctgggtggccatcagccccctgttcctgctgttcatcatctgcagcttcctgatgagccccccccagctgagactgttccagtacaactacccctactggagcatcatcctgggctactgcatcggcaccagcagcttcatctgcatccccacctacatcgcctacagactgatcatcacccccggcaccttcaaggagagaatcatcaagagcatcacccccgagacccccaccgagatcccctgcggcgacatcagactgaacgccgtgtag

SEQ ID NO: 100184 - DNA, 2019 bp, Artificial Sequence
  Description of Artificial Sequence: Synthetic coding sequence
atgagccagagcagaagagtgaaccccgacgacagagagctgggcggcgacccccagatccaggcccccagagaccagctgggcagcctggccgacggccaccagtgccacctgctgaccagcagaatggagaccacccccctgaacagccagaagcagctgagcgcctgcgaggacggcgaggactgccaggagaacggcgtgctgcagaaggtggtgcccacccccggcgacaaggtggagagcggccagatcagcaacggctacagcgccgtgcccagccccggcgccggcgacgacaccagacacagcatccccgccaccaccaccaccctggtggccgagctgcaccagggcgagagagagacctggggcaagaaggtggacttcctgctgagcgtgatcggctacgccgtggacctgggcaacgtgtggagattcccctacatctgctaccagaacggcggcggcgccttcctgctgccctacaccatcatggccatcttcggcggcatccccctgttctacatggagctggccctgggccagtaccacagaaacggctgcatcagcatctggagaaagatctgccccatcttcaagggcatcggctacgccatctgcatcatcgccttctacatcgccagctactacaacaccatcatggcctgggccctgtactacctgatcagcagcttcaccgaccagctgccctggaccagctgcaagaacagctggaacaccggcaactgcaccaactacttcagcgaggacaacatcacctggaccctgcacagcaccagccccgccgaggagttctacaccagacacgtgctgcagatccacagaagcaagggcctgcaggacctgggcggcatcagctggcagctggccctgtgcatcatgctgatcttcaccgtgatctacttcagcatctggaagggcgtgaagaccagcggcaaggtggtgtgggtgaccgccaccttcccctacatcatcctgagcgtgctgctggtgagaggcgccaccctgcccggcgcctggagaggcgtgctgttctacctgaagcccaactggcagaagctgctggagaccggcgtgtggatcgacgccgccgcccagatcttcttcagcctgggccccggcttcggcgtgctgctggccttcgccagctacaacaagttcaacaacaactgctaccaggacgccctggtgaccagcgtggtgaactgcatgaccagcttcgtgagcggcttcgtgatcttcaccgtgctgggctacatggccgagatgagaaacgaggacgtgagcgaggtggccaaggacgccggccccagcctgctgttcatcacctacgccgaggccatcgccaacatgcccgccagcaccttcttcgccatcatcttcttcctgatgctgatcaccctgggcctggacagcaccttcgccggcctggagggcgtgatcaccgccgtgctggacgagttcccccacgtgtgggccaagagaagagagagattcgtgctggccgtggtgatcacctgcttcttcggcagcctggtgaccctgaccttcggcggcgcctacgtggtgaagctgctggaggagtacgccaccggccccgccgtgctgaccgtggccctgatcgaggccgtggccgtgagctggttctacggcatcacccagttctgcagagacgtgaaggagatgctgggcttcagccccggctggttctggagaatctgctgggtggccatcagccccctgttcctgctgttcatcatctgcagcttcctgatgagccccccccagctgagactgttccagtacaactacccctactggagcatcatcctgggctactgcatcggcaccagcagcttcatctgcatccccacctacatcgcctacagactgatcatcacccccggcaccttcaaggagagaatcatcaagagcatcacccccgagacccccaccgagatcccctgcggcgacatcagactgaacgccgtgtag

SEQ ID NO: 100185 - DNA, 1893 bp, Artificial Sequence; identical to SEQ ID NO: 100183
  Description of Artificial Sequence: Synthetic coding sequence

SEQ ID NO: 100186 - DNA, 1863 bp, Artificial Sequence
  Description of Artificial Sequence: Synthetic coding sequence
atggccaccaaggagaagctgcagtgcctgaaggacttccacaaggacatcctgaagcccagccccggcaagagccccggcaccagacccgaggacgaggccgagggcaagcccccccagagagagaagtggagcagcaagatcgacttcgtgctgagcgtggccggcggcttcgtgggcctgggcaacgtgtggagattcccctacctgtgctacaagaacggcggcggcgccttcctgatcccctacttcatcttcctgttcggcagcggcctgcccgtgttcttcctggagatcatcatcggccagtacaccagcgagggcggcatcacctgctgggagaagatctgccccctgttcagcggcatcggctacgccagcgtggtgatcgtgagcctgctgaacgtgtactacatcgtgatcctggcctgggccacctactacctgttccagagcttccagaaggagctgccctgggcccactgcaaccacagctggaacaccccccactgcatggaggacaccatgagaaagaacaagagcgtgtggatcaccatcagcagcaccaacttcaccagccccgtgatcgagttctgggagagaaacgtgctgagcctgagccccggcatcgaccaccccggcagcctgaagtgggacctggccctgtgcctgctgctggtgtggctggtgtgcttcttctgcatctggaagggcgtgagaagcaccggcaaggtggtgtacttcaccgccaccttccccttcgccatgctgctggtgctgctggtgagaggcctgaccctgcccggcgccggcgccggcatcaagttctacctgtaccccgacatcaccagactggaggacccccaggtgtggatcgacgccggcacccagatcttcttcagctacgccatctgcctgggcgccatgaccagcctgggcagctacaacaagtacaagtacaacagctacagagactgcatgctgctgggctgcctgaacagcggcaccagcttcgtgagcggcttcgccatcttcagcatcctgggcttcatggcccaggagcagggcgtggacatcgccgacgtggccgagagcggccccggcctggccttcatcgcctaccccaaggccgtgaccatgatgcccctgcccaccttctggagcatcctgttcttcatcatgctgctgctgctgggcctggacagccagttcgtggaggtggagggccagatcaccagcctggtggacctgtaccccagcttcctgagaaagggctacagaagagagatcttcatcgccttcgtgtgcagcatcagctacctgctgggcctgaccatggtgaccgagggcggcatgtacgtgttccagctgttcgactactacgccgccagcggcgtgtgcctgctgtgggtggccttcttcgagtgcttcgtgatcgcctggatctacggcggcgacaacctgtacgacggcatcgaggacatgatcggctacagacccggcccctggatgaagtacagctgggccgtgatcacccccgtgctgtgcgtgggctgcttcatcttcagcctggtgaagtacgtgcccctgacctacaacaagacctacgtgtaccccaactgggccatcggcctgggctggagcctggccctgagcagcatgctgtgcgtgcccctggtgatcgtgatcagactgtgccagaccgagggccccttcctggtgagagtgaagtacctgctgacccccagagagcccaacagatgggccgtggagagagagggcgccaccccctacaacagcagaaccgtgatgaacggcgccctggtgaagcccacccacatcatcgtggagaccatgatgtag

SEQ ID NO: 100187 - DNA, 603 bp, Artificial Sequence
  Description of Artificial Sequence: Synthetic coding sequence
atggccaccaaggagaagctgcagtgcctgaaggacttccacaaggacatcctgaagcccagccccggcaagagccccggcaccagacccgaggacgaggccgagggcaagcccccccagagagagaagtggagcagcaagatcgacttcgtgctgagcgtggccggcggcttcgtgggcctgggcaacgtgtggagattcccctacctgtgctacaagaacggcggcggcgccttcctgatcccctacttcatcttcctgttcggcagcggcctgcccgtgttcttcctggagatcatcatcggccagtacaccagcgagggcggcatcacctgctgggagaagatctgccccctgttcagcggcatcggctacgccagcgtggtgatcgtgagcctgctgaacgtgtactacatcgtgatcctggcctgggccacctactacctgttccagagcttccagaaggagctgccctgggcccactgcaaccacagctggaacaccccccactgcatggaggacaccatgagaaagaacaagagcgtgtggatcaccatcagcagcaccaacttcaccagccccgtgatcgagttctgggagtag

SEQ ID NO: 100188 - DNA, 1080 bp, Artificial Sequence
  Description of Artificial Sequence: Synthetic coding sequence
atggccaccaaggagaagctgcagtgcctgaaggacttccacaaggacatcctgaagcccagccccggcaagagccccggcaccagacccgaggacgaggccgagggcaagcccccccagagagagaagtggagcagcaagatcgacttcgtgctgagcgtggccggcggcttcgtgggcctgggcaacgtgtggagattcccctacctgtgctacaagaacggcggcggcgccttcctgatcccctacttcatcttcctgttcggcagcggcctgcccgtgttcttcctggagatcatcatcggccagtacaccagcgagggcggcatcacctgctgggagaagatctgccccctgttcagcggcatcggctacgccagcgtggtgatcgtgagcctgctgaacgtgtactacatcgtgatcctggcctgggccacctactacctgttccagagcttccagaaggagctgccctgggcccactgcaaccacagctggaacaccccccactgcatggaggacaccatgagaaagaacaagagcgtgtggatcaccatcagcagcaccaacttcaccagccccgtgatcgagttctgggagagaaacgtgctgagcctgagccccggcatcgaccaccccggcagcctgaagtgggacctggccctgtgcctgctgctggtgtggctggtgtgcttcttctgcatctggaagggcgtgagaagcaccggcaaggtggtgtacttcaccgccaccttccccttcgccatgctgctggtgctgctggtgagaggcctgaccctgcccggcgccggcgccggcatcaagttctacctgtaccccgacatcaccagactggaggacccccaggtgtggatcgacgccggcacccagatcttcttcagctacgccatctgcctgggcgccatgaccagcctgggcagctacaacaagtacaagtacaacagctacagaagctggcccggcctgcactgcctgcccaagagctgcgacaacgacgccgccgcccacatcctggtgcacagcttcttctactacgccagcctggcctggaccggctag

SEQ ID NO: 100189 - DNA, 330 bp, Artificial Sequence
  Description of Artificial Sequence: Synthetic coding sequence
atggccaccaaggagaagctgcagtgcctgaaggacttccacaaggacatcctgaagcccagccccggcaagagccccggcaccagacccgaggacgaggccgagggcaagcccccccagagagagaagtggagcagcaagatcgacttcgtgctgagcgtggccggcggcttcgtgggcctgggcaacgtgtggagattcccctacctgtgctacaagaacggcggcggcgccttcctgatcccctacttcatcttcctgttcggcagcggcctgcccgtgttcttcctggagatcatcatcggccagtacaccagcgagggcggctag

SEQ ID NO: 100190 - DNA, 1863 bp, Artificial Sequence; identical to SEQ ID NO: 100186
  Description of Artificial Sequence: Synthetic coding sequence

SEQ ID NO: 100191 - DNA, 1080 bp, Artificial Sequence; identical to SEQ ID NO: 100188
  Description of Artificial Sequence: Synthetic coding sequence

SEQ ID NO: 100192 - DNA, 1905 bp, Artificial Sequence
  Description of Artificial Sequence: Synthetic coding sequence
atggtgagactggtgctgcccaaccccggcctggacgccagaatccccagcctggccgagctggagaccatcgagcaggaggaggccagcagcagacccaagtgggacaacaaggcccagtacatgctgacctgcctgggcttctgcgtgggcctgggcaacgtgtggagattcccctacctgtgccagagccacggcggcggcgccttcatgatccccttcctgatcctgctggtgctggagggcatccccctgctgtacctggagttcgccatcggccagagactgagaagaggcagcctgggcgtgtggagcagcatccaccccgccctgaagggcctgggcctggccagcatgctgaccagcttcatggtgggcctgtactacaacaccatcatcagctggatcatgtggtacctgttcaacagcttccaggagcccctgccctggagcgactgccccctgaacgagaaccagaccggctacgtggacgagtgcgccagaagcagccccgtggactacttctggtacagagagaccctgaacatcagcaccagcatcagcgacagcggcagcatccagtggtggatgctgctgtgcctggcctgcgcctggagcgtgctgtacatgtgcaccatcagaggcatcgagaccaccggcaaggccgtgtacatcaccagcaccctgccctacgtggtgctgaccatcttcctgatcagaggcctgaccctgaagggcgccaccaacggcatcgtgttcctgttcacccccaacgtgaccgagctggcccagcccgacacctggctggacgccggcgcccaggtgttcttcagcttcagcctggccttcggcggcctgatcagcttcagcagctacaacagcgtgcacaacaactgcgagaaggacagcgtgatcgtgagcatcatcaacggcttcaccagcgtgtacgtggccatcgtggtgtacagcgtgatcggcttcagagccacccagagatacgacgactgcttcagcaccaacatcctgaccctgatcaacggcttcgacctgcccgagggcaacgtgacccaggagaacttcgtggacatgcagcagagatgcaacgccagcgaccccgccgcctacgcccagctggtgttccagacctgcgacatcaacgccttcctgagcgaggccgtggagggcaccggcctggccttcatcgtgttcaccgaggccatcaccaagatgcccctgagccccctgtggagcgtgctgttcttcatcatgctgttctgcctgggcctgagcagcatgttcggcaacatggagggcgtggtggtgcccctgcaggacctgagagtgatcccccccaagtggcccaaggaggtgctgaccggcctgatctgcctgggcaccttcctgatcggcttcatcttcaccctgaacagcggccagtactggctgagcctgctggacagctacgccggcagcatccccctgctgatcatcgccttctgcgagatgttcagcgtggtgtacgtgtacggcgtggacagattcaacaaggacatcgagttcatgatcggccacaagcccaacatcttctggcaggtgacctggagagtggtgagccccctgctgatgctgatcatcttcctgttcttcttcgtggtggaggtgagccaggagctgacctacagcatctgggaccccggctacgaggagttccccaagagccagaagatcagctaccccaactgggtgtacgtggtggtggtgatcgtggccggcgtgcccagcctgaccatccccggctacgccatctacaagctgatcagaaaccactgccagaagcccggcgaccaccagggcctggtgagcaccctgagcaccgccagcatgaacggcgacctgaagtactag

SEQ ID NO: 100193 - DNA, 1668 bp, Artificial Sequence
  Description of Artificial Sequence: Synthetic coding sequence
atggagaaggccagacccctgtgggccaacagcctgcagttcgtgttcgcctgcatcagctacgccgtgggcctgggcaacgtgtggagattcccctacctgtgccagatgtacggcggcggcagcttcctggtgccctacatcatcatgctgatcgtggagggcatgcccctgctgtacctggagctggccgtgggccagagaatgagacagggcagcatcggcgcctggagaaccatcagcccctacctgagcggcgtgggcgtggccagcgtggtggtgagcttcttcctgagcatgtactacaacgtgatcaacgcctgggccttctggtacctgttccacagcttccaggaccccctgccctggagcgtgtgccccctgaacggcaaccacaccggctacgacgaggagtgcgagaaggccagcagcacccagtacttctggtacagaaagaccctgaacatcagccccagcctgcaggagaacggcggcgtgcagtgggagcccgccctgtgcctgctgctggcctggctggtggtgtacctgtgcatcctgagaggcaccgagagcaccggcaagatcgagcagctggccaaccccaaggcctggatcaacgccgccacccagatcttcttcagcctgggcctgggcttcggcagcctgatcgccttcgccagctacaacgagcccagcaacaactgccagaagcacgccatcatcgtgagcctgatcaacagcttcaccagcatcttcgccagcatcgtgaccttcagcatctacggcttcaaggccaccttcaactacgagaactgcctgaagaaggtgagcctgctgctgaccaacaccttcgacctggaggacggcttcctgaccgccagcaacctggagcaggtgaagggctacctggccagcgcctaccccagcaagtacagcgagatgttcccccagatcaagaactgcagcctggagagcgagctggacaccgccgtgcagggcaccggcctggccttcatcgtgtacaccgaggccatcaagaacatggaggtgagccagctgtggagcgtgctgtacttcttcatgctgctgatgctgggcatcggcagcatgctgggcaacaccgccgccatcctgacccccctgaccgacagcaagatcatcagcagccacctgcccaaggaggccatcagcggcctggtgtgcctggtgaactgcgccatcggcatggtgttcaccatggaggccggcaactactggttcgacatcttcaacgactacgccgccaccctgagcctgctgctgatcgtgctggtggagaccatcgccgtgtgctacgtgtacggcctgagaagattcgagagcgacctgaaggccatgaccggcagagccgtgagctggtactggaaggtgatgtgggccggcgtgagccccctgctgatcgtgagcctgttcgtgttctacctgagcgactacatcctgaccggcaccctgaagtaccaggcctgggacgccagccagggccagctggtgaccaaggactaccccgcctacgccctggccgtgatcggcctgctggtggccagcagcaccatgtgcatccccctggccgccctgggcaccttcgtgcagagaagactgaagagaggcgacgccgaccccgtggcctag

SEQ ID NO: 100194 - DNA, 1779 bp, Artificial Sequence
  Description of Artificial Sequence: Synthetic coding sequence
atggagaaggccagacccctgtgggccaacagcctgcagttcgtgttcgcctgcatcagctacgccgtgggcctgggcaacgtgtggagattcccctacctgtgccagatgtacggcggcggcagcttcctggtgccctacatcatcatgctgatcgtggagggcatgcccctgctgtacctggagctggccgtgggccagagaatgagacagggcagcatcggcgcctggagaaccatcagcccctacctgagcggcgtgggcgtggccagcgtggtggtgagcttcttcctgagcatgtactacaacgtgatcaacgcctgggccttctggtacctgttccacagcttccaggaccccctgccctggagcgtgtgccccctgaacggcaaccacaccggctacgacgaggagtgcgagaaggccagcagcacccagtacttctggtacagaaagaccctgaacatcagccccagcctgcaggagaacggcggcgtgcagtgggagcccgccctgtgcctgctgctggcctggctggtggtgtacctgtgcatcctgagaggcaccgagagcaccggcaaggtggtgtacttcaccgccagcctgccctactgcgtgctgatcatctacctgatcagaggcctgaccctgcacggcgccaccaacggcctgatgtacatgttcacccccaagatcgagcagctggccaaccccaaggcctggatcaacgccgccacccagatcttcttcagcctgggcctgggcttcggcagcctgatcgccttcgccagctacaacgagcccagcaacaactgccagaagcacgccatcatcgtgagcctgatcaacagcttcaccagcatcttcgccagcatcgtgaccttcagcatctacggcttcaaggccaccttcaactacgagaactgcctgaagaaggtgagcctgctgctgaccaacaccttcgacctggaggacggcttcctgaccgccagcaacctggagcaggtgaagggctacctggccagcgcctaccccagcaagtacagcgagatgttcccccagatcaagaactgcagcctggagagcgagctggacaccgccgtgcagggcaccggcctggccttcatcgtgtacaccgaggccatcaagaacatggaggtgagccagctgtggagcgtgctgtacttcttcatgctgctgatgctgggcatcggcagcatgctgggcaacaccgccgccatcctgacccccctgaccgacagcaagatcatcagcagccacctgcccaaggaggccatcagcggcctggtgtgcctggtgaactgcgccatcggcatggtgttcaccatggaggccggcaactactggttcgacatcttcaacgactacgccgccaccctgagcctgctgctgatcgtgctggtggagaccatcgccgtgtgctacgtgtacggcctgagaagattcgagagcgacctgaaggccatgaccggcagagccgtgagctggtactggaaggtgatgtgggccggcgtgagccccctgctgatcgtgagcctgttcgtgttctacctgagcgactacatcctgaccggcaccctgaagtaccaggcctgggacgccagccagggccagctggtgaccaaggactaccccgcctacgccctggccgtgatcggcctgctggtggccagcagcaccatgtgcatccccctggccgccctgggcaccttcgtgcagagaagactgaagagaggcgacgccgaccccgtggcctag

SEQ ID NO: 100195 - DNA, 1644 bp, Artificial Sequence
  Description of Artificial Sequence: Synthetic coding sequence
atggagaaggccagacccctgtgggccaacagcctgcagttcgtgttcgcctgcatcagctacgccgtgggcctgggcaacgtgtggagattcccctacctgtgccagatgtacggcggcggcagcttcctggtgccctacatcatcatgctgatcgtggagggcatgcccctgctgtacctggagctggccgtgggccagagaatgagacagggcagcatcggcgcctggagaaccatcagcccctacctgagcggcgtgggcgtggccagcgtggtggtgagcttcttcctgagcatgtactacaacgtgatcaacgcctgggccttctggtacctgttccacagcttccaggaccccctgccctggagcgtgtgccccctgaacggcaaccacaccggctacgacgaggagtgcgagaaggccagcagcacccagtacttctggtacagaaagaccctgaacatcagccccagcctgcaggagaacggcggcgtgcagtgggagcccgccctgtgcctgctgctggcctggctggtggtgtacctgtgcatcctgagaggcaccgagagcaccggcaaggtggtgtacttcaccgccagcctgccctactgcgtgctgatcatctacctgatcagaggcctgaccctgcacggcgccaccaacggcctgatgtacatgttcacccccaagatcgagcagctggccaaccccaaggcctggatcaacgccgccacccagatcttcttcagcctgggcctgggcttcggcagcctgatcgccttcgccagctacaacgagcccagcaacaactgccagaagcacgccatcatcgtgagcctgatcaacagcttcaccagcatcttcgccagcatcgtgaccttcagcatctacggcttcaaggccaccttcaactacgagaactgcctgaagaaggtgagcctgctgctgaccaacaccttcgacctggaggacggcttcctgaccgccagcaacctggagcaggtgaagggctacctggccagcgcctaccccagcaagtacagcgagatgttcccccagatcaagaactgcagcctggagagcgagctggacaccgccgtgcagggcaccggcctggccttcatcgtgtacaccgaggccatcaagaacatggaggtgagccagctgtggagcgtgctgtacttcttcatgctgctgatgctgggcatcggcagcatgctgggcaacaccgccgccatcctgacccccctgaccgacagcaagatcatcagcagccacctgcccaaggaggccatcagcggcctggtgtgcctggtgaactgcgccatcggcatggtgttcaccatggaggccggcaactactggttcgacatcttcaacgactacgccgccaccctgagcctgctgctgatcgtgctggtggagaccatcgccgtgtgctacgtgtacggcctgagaagattcgagagcgacctgaaggccatgaccggcagagccgtgagctggtactggaaggtgatgtgggccggcgtgagccccctgctgatcgtgagcctgttcgtgttctacctgagcgactacatcctgaccggcaccctgaagtaccaggcctgggacgccagccaggacgacaagctgtag

SEQ ID NO: 100196 - DNA, 1194 bp, Artificial Sequence
  Description of Artificial Sequence: Synthetic coding sequence
atggcccacgcccccgagcccgaccccgccgcctgcgacctgggcgacgagagacccaagtgggacaacaaggcccagtacctgctgagctgcaccggcttcgccgtgggcctgggcaacatctggagattcccctacctgtgccagacctacggcggcggcgccttcctgatcccctacgtgatcgccctggtgttcgagggcatccccatcttccacgtggagctggccatcggccagagactgagaaagggcagcgtgggcgtgtggaccgccatcagcccctacctgagcggcgtgggcctgggctgcgtgaccctgagcttcctgatcagcctgtactacaacaccatcgtggcctgggtgctgtggtacctgctgaacagcttccagcaccccctgccctggagcagctgcccccccgacctgaacagaaccggcttcgtggaggagtgccagggcagcagcgccgtgagctacttctggtacagacagaccctgaacatcaccgccgacatcaacgacagcggcagcatccagtggtggctgctgatctgcctggccgccagctgggccgtggtgtacatgtgcgtgatcagaggcatcgagaccaccggcaaggtgatctacttcaccgccctgttcccctacctggtgctgaccatcttcctgatcagaggcctgaccctgcccggcgccaccaagggcctgatctacctgttcacccccaacaaccccagagtgtggctggacgccgccacccagatcttcttcagcctgagcctggccttcggcggccacatcgccttcgccagctacaacagccccagaaacgactgccagaaggacgccgtggtgatcgccctggtgaacagaatgaccagcctgtacgccagcatcgccgtgttcagcgtgctgggcgccagcggccccggcctggccttcgtggtgttcaccgagaccgacctgcacatgcccggcgcccccgtgtgggccatgctgttcttcggcatgctgttcaccctgggcctgagcaccatgttcggcaccgtggaggccgtgatcacccccctgctggacagcggcaactactggctggagatcttcgacaacttcgccgccagccccaacctgctgatgctggccttcctggaggtggtgggcgtggtgtacgtgtacggcatgaagagatag

SEQ ID NO: 100197 - DNA, 1887 bp, Artificial Sequence
  Description of Artificial Sequence: Synthetic coding sequence
atggcccacgcccccgagcccgaccccgccgcctgcgacctgggcgacgagagacccaagtgggacaacaaggcccagtacctgctgagctgcaccggcttcgccgtgggcctgggcaacatctggagattcccctacctgtgccagacctacggcggcggcgccttcctgatcccctacgtgatcgccctggtgttcgagggcatccccatcttccacgtggagctggccatcggccagagactgagaaagggcagcgtgggcgtgtggaccgccatcagcccctacctgagcggcgtgggcctgggctgcgtgaccctgagcttcctgatcagcctgtactacaacaccatcgtggcctgggtgctgtggtacctgctgaacagcttccagcaccccctgccctggagcagctgcccccccgacctgaacagaaccggcttcgtggaggagtgccagggcagcagcgccgtgagctacttctggtacagacagaccctgaacatcaccgccgacatcaacgacagcggcagcatccagtggtggctgctgatctgcctggccgccagctgggccgtggtgtacatgtgcgtgatcagaggcatcgagaccaccggcaaggtgatctacttcaccgccctgttcccctacctggtgctgaccatcttcctgatcagaggcctgaccctgcccggcgccaccaagggcctgatctacctgttcacccccaacatgcacatcctgcagaaccccagagtgtggctggacgccgccacccagatcttcttcagcctgagcctggccttcggcggccacatcgccttcgccagctacaacagccccagaaacgactgccagaaggacgccgtggtgatcgccctggtgaacagaatgaccagcctgtacgccagcatcgccgtgttcagcgtgctgggcttcaaggccaccaacgactacgagcactgcctggacagaaacatcctgagcctgatcaacgacttcgacttccccgagcagagcatcagcagagacgactaccccgccgtgctgatgcacctgaacgccacctggcccaagagagtggcccagctgcccctgaaggcctgcctgctggaggacttcctggacaagagcgccagcggccccggcctggccttcgtggtgttcaccgagaccgacctgcacatgcccggcgcccccgtgtgggccatgctgttcttcggcatgctgttcaccctgggcctgagcaccatgttcggcaccgtggaggccgtgatcacccccctgctggacgtgggcgtgctgcccagatgggtgcccaaggaggccctgaccggcctggtgtgcctggtgtgcttcctgagcgccacctgcttcaccctgcagagcggcaactactggctggagatcttcgacaacttcgccgccagccccaacctgctgatgctggccttcctggaggtggtgggcgtggtgtacgtgtacggcatgaagagattctgcgacgacatcgcctggatgaccggcagaagacccagcccctactggagactgacctggagagtggtgagccccctgctgctgaccatcttcgtggcctacatcatcctgctgttctggaagcccctgagatacaaggcctggaaccccaagtacgagctgttccccagcagacaggagaagctgtaccccggctgggccagagccgcctgcgtgctgctgagcctgctgcccgtgctgtgggtgcccgtggccgccctggcccagctgctgaccagaagaagaagaacctggagagacagagacgccagacccgacaccgacatgagacccgacaccgacaccagacccgacaccgacatgagacccgacaccgacatgagatag

SEQ ID NO: 100198 - DNA, 1548 bp, Artificial Sequence
  Description of Artificial Sequence: Synthetic coding sequence
atggaggccagagagcccggcagacccacccccacctaccacctggtgcccaacaccagccagagccaggtggaggaggacgtgagcagccccccccagagaagcagcgagaccatgcagctgaagaaggagatcagcctgctgaacggcgtgagcctggtggtgggcaacatgatcggcagcggcatcttcgtgagccccaagggcgtgctggtgcacaccgccagctacggcatgagcctgatcgtgtgggccatcggcggcctgttcagcgtggtgggcgccctgtgctacgccgagctgggcaccaccatcaccaagagcggcgccagctacgcctacatcctggaggccttcggcggcttcatcgccttcatcagactgtgggtgagcctgctggtggtggagcccaccggccaggccatcatcgccatcaccttcgccaactacatcatccagcccagcttccccagctgcgaccccccctacctggcctgcagactgctggccgccgcctgcatctgcctgctgaccttcgtgaactgcgcctacgtgaagtggggcaccagagtgcaggacaccttcacctacgccaaggtggtggccctgatcgccatcatcgtgatgggcctggtgaagctgtgccagggccacagcgagcacttccaggacgccttcgagggcagcagctgggacatgggcaacctgagcctggccctgtacagcgccctgttcagctacagcggctgggacaccctgaacttcgtgaccgaggagatcaagaaccccgagagaaacctgcccctggccatcggcatcagcatgcccatcgtgaccctgatctacatcctgaccaacgtggcctactacaccgtgctgaacatcagcgacgtgctgagcagcgacgccgtggccgtgaccttcgccgaccagaccttcggcatgttcagctggaccatccccatcgccgtggccctgagctgcttcggcggcctgaacgccagcatcttcgccagcagcagactgttcttcgtgggcagcagagagggccacctgcccgacctgctgagcatgatccacatcgagagattcacccccatccccgccctgctgttcaactgcaccatggccctgatctacctgatcgtggaggacgtgttccagctgatcaactacttcagcttcagctactggttcttcgtgggcctgagcgtggtgggccagctgtacctgagatggaaggagcccaagagacccagacccctgaagctgagcgtgttcttccccatcgtgttctgcatctgcagcgtgttcctggtgatcgtgcccctgttcaccgacaccatcaacagcctgatcggcatcggcatcgccctgagcggcgtgcccttctacttcatgggcgtgtacctgcccgagagcagaagacccctgttcatcagaaacgtgctggccgccatcaccagaggcacccagcagctgtgcttctgcgtgctgaccgagctggacgtggccgaggagaagaaggacgagagaaagaccgactag

SEQ ID NO: 100199 - DNA, 1524 bp, Artificial Sequence
  Description of Artificial Sequence: Synthetic coding sequence
atggccggcgccggccccaagagaagagccctggccgcccccgccgccgaggagaaggaggaggccagagagaagatgctggccgccaagagcgccgacggcagcgcccccgccggcgagggcgagggcgtgaccctgcagagaaacatcaccctgctgaacggcgtggccatcatcgtgggcaccatcatcggcagcggcatcttcgtgacccccaccggcgtgctgaaggaggccggcagccccggcctggccctggtggtgtgggccgcctgcggcgtgttcagcatcgtgggcgccctgtgctacgccgagctgggcaccaccatcagcaagagcggcggcgactacgcctacatgctggaggtgtacggcagcctgcccgccttcctgaagctgtggatcgagctgctgatcatcagacccagcagccagtacatcgtggccctggtgttcgccacctacctgctgaagcccctgttccccacctgccccgtgcccgaggaggccgccaagctggtggcctgcctgtgcgtgctgctgctgaccgccgtgaactgctacagcgtgaaggccgccaccagagtgcaggacgccttcgccgccgccaagctgctggccctggccctgatcatcctgctgggcttcgtgcagatcggcaagggcgacgtgagcaacctggaccccaacttcagcttcgagggcaccaagctggacgtgggcaacatcgtgctggccctgtacagcggcctgttcgcctacggcggctggaactacctgaacttcgtgaccgaggagatgatcaacccctacagaaacctgcccctggccatcatcatcagcctgcccatcgtgaccctggtgtacgtgctgaccaacctggcctacttcaccaccctgagcaccgagcagatgctgagcagcgaggccgtggccgtggacttcggcaactaccacctgggcgtgatgagctggatcatccccgtgttcgtgggcctgagctgcttcggcagcgtgaacggcagcctgttcaccagcagcagactgttcttcgtgggcagcagagagggccacctgcccagcatcctgagcatgatccacccccagctgctgacccccgtgcccagcctggtgttcacctgcgtgatgaccctgctgtacgccttcagcaaggacatcttcagcgtgatcaacttcttcagcttcttcaactggctgtgcgtggccctggccatcatcggcatgatctggctgagacacagaaagcccgagctggagagacccatcaaggtgaacctggccctgcccgtgttcttcatcctggcctgcctgttcctgatcgccgtgagcttctggaagacccccgtggagtgcggcatcggcttcaccatcatcctgagcggcctgcccgtgtacttcttcggcgtgtggtggaagaacaagcccaagtggctgctgcagggcatcttcagcaccaccgtgctgtgccagaagctgatgcaggtggtgccccaggagacctag

SEQ ID NO: 100200 - DNA, 846 bp, Artificial Sequence
  Description of Artificial Sequence: Synthetic coding sequence
atgagccacggcacctactacgagtgcgagcccagaggcggccagcagcccctggagttcagcggcggcagagccggccccggcgagctgggcgacatgtgcgagcacgaggccagcatcgacctgagcgcctacatcgagagcggcgaggagcagctgctgagcgacctgttcgccgtgaagcccgcccccgaggccagaggcctgaagggccccggcacccccgccttcccccactacctgccccccgaccccagacccttcgcctaccccccccacaccttcggccccgacagaaaggccctgggccccggcatctacagcagccccggcagctacgaccccagagccgtggccgtgaaggaggagcccagaggccccgagggcagcagagccgccagcagaggcagctacaaccccctgcagtaccaggtggcccactgcggccagaccgccatgcacctgccccccaccctggccgcccccggccagcccctgagagtgctgaaggcccccctggccaccgccgcccccccctgcagccccctgctgaaggcccccagccccgccggccccctgcacaagggcaagaaggccgtgaacaaggacagcctggagtacagactgagaagagagagaaacaacatcgccgtgagaaagagcagagacaaggccaagagaagaatcctggagacccagcagaaggtgctggagtacatggccgagaacgagagactgagaagcagagtggagcagctgacccaggagctggacaccctgagaaacctgttcagacagatccccgaggccgccaacctgatcaagggcgtgggcggctgcagctag

SEQ ID NO: 100201 - DNA, 1608 bp, Artificial Sequence
  Description of Artificial Sequence: Synthetic coding sequence
atggaggagggcgccagacacagaaacaacaccgagaagaagcaccccggcggcggcgagagcgacgccagccccgaggccggcagcggcggcggcggcgtggccctgaagaaggagatcggcctggtgagcgcctgcggcatcatcgtgggcaacatcatcggcagcggcatcttcgtgagccccaagggcgtgctggagaacgccggcagcgtgggcctggccctgatcgtgtggatcgtgaccggcttcatcaccgtggtgggcgccctgtgctacgccgagctgggcgtgaccatccccaagagcggcggcgactacagctacgtgaaggacatcttcggcggcctggccggcttcctgagactgtggatcgccgtgctggtgatctaccccaccaaccaggccgtgatcgccctgaccttcagcaactacgtgctgcagcccctgttccccacctgcttcccccccgagagcggcctgagactgctggccgccatctgcctgctgctgctgacctgggtgaactgcagcagcgtgagatgggccaccagagtgcaggacatcttcaccgccggcaagctgctggccctggccctgatcatcatcatgggcatcgtgcagatctgcaagggcgagtacttctggctggagcccaagaacgccttcgagaacttccaggagcccgacatcggcctggtggccctggccttcctgcagggcagcttcgcctacggcggctggaacttcctgaactacgtgaccgaggagctggtggacccctacaagaacctgcccagagccatcttcatcagcatccccctggtgaccttcgtgtacgtgttcgccaacgtggcctacgtgaccgccatgagcccccaggagctgctggccagcaacgccgtggccgtgaccttcggcgagaagctgctgggcgtgatggcctggatcatgcccatcagcgtggccctgagcaccttcggcggcgtgaacggcagcctgttcaccagcagcagactgttcttcgccggcgccagagagggccacctgcccagcgtgctggccatgatccacgtgaagagatgcacccccatccccgccctgctgttcacctgcatcagcaccctgctgatgctggtgaccagcgacatgtacaccctgatcaactacgtgggcttcatcaactacctgttctacggcgtgaccgtggccggccagatcgtgctgagatggaagaagcccgacatccccagacccatcaagatcaacctgctgttccccatcatctacctgctgttctgggccttcctgctggtgttcagcctgtggagcgagcccgtggtgtgcggcatcggcctggccatcatgctgaccggcgtgcccgtgtacttcctgggcgtgtactggcagcacaagcccaagtgcttcagcgacttcatcgagctgctgaccctggtgagccagaagatgtgcgtggtggtgtaccccgaggtggagagaggcagcggcaccgaggaggccaacgaggacatggaggagcagcagcagcccatgtaccagcccacccccaccaaggacaaggacgtggccggccagccccagccctag

SEQ ID NO: 100202 - DNA, 633 bp, Artificial Sequence
  Description of Artificial Sequence: Synthetic coding sequence
atgggcatcgtgcagatctgcaagggcgagtacttctggctggagcccaagaacgccttcgagaacttccaggagcccgacatcggcctggtggccctggccttcctgcagggcagcttcgcctacggcggctggaacttcctgaactacgtgaccgaggagctggtggacccctacaagaacctgcccagagccatcttcatcagcatccccctggtgaccttcgtgtacgtgttcgccaacgtggcctacgtgaccgccatgagcccccaggagctgctggccagcaacgccgtggccgtgaccttcggcgagaagctgctgggcgtgatggcctggatcatgcccatcagcgtggccctgagcaccttcggcggcgtgaacggcagcctgcacctgctgagcgccgtgctgagatggagccccagaggcccccccagccagtgcgtgggccacgaccccagagaggccctgcaccccaaccccagccccgccctgcacatgcacctgcaccccgccgacgccggccaccagagacacgtgcacacccaccagctgtgcggcctgcaccagctgcccctgctgtggggccacggctgctggaccgacagccccagcctggaggaggcctag

SEQ ID NO: 100203 - DNA, 693 bp, Artificial Sequence
  Description of Artificial Sequence: Synthetic coding sequence
tgatgcctgcaggagcacagccagcccagccagctgctgtgcaccctgctgctgtgctggtgcgtgctgggcagagagagacccttcagaaaggcccagagcaccagcagccccctggagggcgtgcccagattcctgaagagactgctgctgacctgggtgaactgcagcagcgtgagatgggccaccagagtgcaggacatcttcaccgccggcaagctgctggccctggccctgatcatcatcatgggcatcgtgcagatctgcaagggcgagtacttctggctggagcccaagaacgccttcgagaacttccaggagcccgacatcggcctggtggccctggccttcctgcagggcagcttcgcctacggcggctggaacttcctgaactacgtgaccgaggagctggtggacccctacaagctgttcttcgccggcgccagagagggccacctgcccagcgtgctggccatgatccacgtgaagagatgcacccccatccccgccctgctgttcacctgcatcagcaccctgctgatgctggtgaccagcgacatgtacaccctgatcaactacgtgggcttcatcaactacctgttctacggcgtgaccgtggccggccagatcgtgctgagatggaagaagcccgacatccccagacccatcaagcccctgccctaccagggctag

SEQ ID NO: 100204 - DNA, 936 bp, Artificial Sequence
  Description of Artificial Sequence: Synthetic coding sequence
atgggccagctgttccagtgcgccgtgggccaccccggcagcagacacctgcacagctgggaggcccccggcctgggccccgactaccaccacggcgactgcaccgacatgcagagaaacctgcccagagccatcttcatcagcatccccctggtgaccttcgtgtacgtgttcgccaacgtggcctacgtgaccgccatgagcccccaggagctgctggccagcaacgccgtggccgtgaccttcggcgagaagctgctgggcgtgatggcctggatcatgcccatcagcgtggccctgagcaccttcggcggcgtgaacggcagcctgttcaccagcagcagactgttcttcgccggcgccagagagggccacctgcccagcgtgctggccatgatccacgtgaagagatgcacccccatccccgccctgctgttcacctgcatcagcaccctgctgatgctggtgaccagcgacatgtacaccctgatcaactacgtgggcttcatcaactacctgttctacggcgtgaccgtggccggccagatcgtgctgagatggaagaagcccgacatccccagacccatcaagatcaacctgctgttccccatcatctacctgctgttctgggccttcctgctggtgttcagcctgtggagcgagcccgtggtgtgcggcatcggcctggccatcatgctgaccggcgtgcccgtgtacttcctgggcgtgtactggcagcacaagcccaagtgcttcagcgacttcatcgagctgctgaccctggtgagccagaagatgtgcgtggtggtgtaccccgaggtggagagaggcagcggcaccgaggaggccaacgaggacatggaggagcagcagcagcccatgtaccagcccacccccaccaaggacaaggacgtggccggccagccccagccctag

SEQ ID NO: 100205 - DNA, 999 bp, Artificial Sequence
  Description of Artificial Sequence: Synthetic coding sequence
atgggcatcgtgcagatctgcaagggcgagtacttctggctggagcccaagaacgccttcgagaacttccaggagcccgacatcggcctggtggccctggccttcctgcagggcagcttcgcctacggcggctggaacttcctgaactacgtgaccgaggagctggtggacccctacaagaacctgcccagagccatcttcatcagcatccccctggtgaccttcgtgtacgtgttcgccaacgtggcctacgtgaccgccatgagcccccaggagctgctggccagcaacgccgtggccgtgaccttcggcgagaagctgctgggcgtgatggcctggatcatgcccatcagcgtggccctgagcaccttcggcggcgtgaacggcagcctgttcaccagcagcagactgttcttcgccggcgccagagagggccacctgcccagcgtgctggccatgatccacgtgaagagatgcacccccatccccgccctgctgttcacctgcatcagcaccctgctgatgctggtgaccagcgacatgtacaccctgatcaactacgtgggcttcatcaactacctgttctacggcgtgaccgtggccggccagatcgtgctgagatggaagaagcccgacatccccagacccatcaagatcaacctgctgttccccatcatctacctgctgttctgggccttcctgctggtgttcagcctgtggagcgagcccgtggtgtgcggcatcggcctggccatcatgctgaccggcgtgcccgtgtacttcctgggcgtgtactggcagcacaagcccaagtgcttcagcgacttcatcgagctgctgaccctggtgagccagaagatgtgcgtggtggtgtaccccgaggtggagagaggcagcggcaccgaggaggccaacgaggacatggaggagcagcagcagcccatgtaccagcccacccccaccaaggacaaggacgtggccggccagccccagccctag

SEQ ID NO: 100206 - DNA, 285 bp, Artificial Sequence
  Description of Artificial Sequence: Synthetic coding sequence
atggaggagggcgccagacacagaaacaacaccgagaagaagcaccccggcggcggcgagagcgacgccagccccgaggccggcagcggcggcggcggcgtggccctgaagaaggagatcggcctggtgagcgcctgcggcatcatcgtgggcaacatcatcggcagcggcatcttcgtgagccccaagggcgtgctggagaacgccggcagcgtgggcctggccctgatcgtgtggatcgtgaccggcttcatcaccgtggtgggcgccctgtgctacgcctag

SEQ ID NO: 100207 - DNA, 237 bp, Artificial Sequence
  Description of Artificial Sequence: Synthetic coding sequence
atggaggagggcgccagacacagaaacaacaccgagaagaagcaccccggcggcggcgagagcgacgccagccccgaggccggcagcggcggcggcggcgtggccctgaagaaggagatcggcctggtgagcgcctgcggcatcatcgtgggcaacatcatcggcagcggcatcttcgtgagccccaagggcgtgctggagaacgccggcagcgtgggcctggccctgatcgtgtag

SEQ ID NO: 100208 - DNA, 1293 bp, Artificial Sequence
  Description of Artificial Sequence: Synthetic coding sequence
atgggccagtacggccaggagctgagctggaagtgcctggtgaaggccgtgtgcctgcaggagcacagccagcccagccagctgctgtgcaccctgctgctgtgctggtgcgtgctgggcagagagagacccttcagaaaggcccagagcaccagcagccccctggagggcgtgcccagattcctgaagagactgctgctgacctgggtgaactgcagcagcgtgagatgggccaccagagtgcaggacatcttcaccgccggcaagctgctggccctggccctgatcatcatcatgggcatcgtgcagatctgcaagggcgagtacttctggctggagcccaagaacgccttcgagaacttccaggagcccgacatcggcctggtggccctggccttcctgcagggcagcttcgcctacggcggctggaacttcctgaactacgtgaccgaggagctggtggacccctacaagaacctgcccagagccatcttcatcagcatccccctggtgaccttcgtgtacgtgttcgccaacgtggcctacgtgaccgccatgagcccccaggagctgctggccagcaacgccgtggccgtgaccttcggcgagaagctgctgggcgtgatggcctggatcatgcccatcagcgtggccctgagcaccttcggcggcgtgaacggcagcctgttcaccagcagcagactgttcttcgccggcgccagagagggccacctgcccagcgtgctggccatgatccacgtgaagagatgcacccccatccccgccctgctgttcacctgcatcagcaccctgctgatgctggtgaccagcgacatgtacaccctgatcaactacgtgggcttcatcaactacctgttctacggcgtgaccgtggccggccagatcgtgctgagatggaagaagcccgacatccccagacccatcaagatcaacctgctgttccccatcatctacctgctgttctgggccttcctgctggtgttcagcctgtggagcgagcccgtggtgtgcggcatcggcctggccatcatgctgaccggcgtgcccgtgtacttcctgggcgtgtactggcagcacaagcccaagtgcttcagcgacttcatcgagctgctgaccctggtgagccagaagatgtgcgtggtggtgtaccccgaggtggagagaggcagcggcaccgaggaggccaacgaggacatggaggagcagcagcagcccatgtaccagcccacccccaccaaggacaaggacgtggccggccagccccagccctag

SEQ ID NO: 100209 - DNA, 1968 bp, Artificial Sequence
  Description of Artificial Sequence: Synthetic coding sequence
atggtgctgtacaccacccccttccccaacagctgcctgagcgccctgcactgcgtgagctgggccctgatcttcccctgctactggctggtggacagactggccgccagcttcatccccaccacctacgagaagagacagagagccgacgacccctgctgcctgcagctgctgtgcaccgccctgttcacccccatctacctggccctgctggtggccagcctgcccttcgccttcctgggcttcctgttctggagccccctgcagagcgccagaagaccctacatctacagcagactggaggacaagggcctggccggcggcgccgccctgctgagcgagtggaagggcaccggccccggcaagagcttctgcttcgccaccgccaacgtgtgcctgctgcccgacagcctggccagagtgaacaacctgttcaacacccaggccagagccaaggagatcggccagagaatcagaaacggcgccgccagaccccagatcaagatctacatcgacagccccaccaacaccagcatcagcgccgccagcttcagcagcctggtgagcccccagggcggcgacggcgtggccagagccgtgcccggcagcatcaagagaaccgccagcgtggagtacaagggcgacggcggcagacaccccggcgacgaggccgccaacggccccgccagcggcgaccccgtggacagcagcagccccgaggacgcctgcatcgtgagaatcggcggcgaggagggcggcagaccccccgaggccgacgaccccgtgcccggcggccaggccagaaacggcgccggcggcggccccagaggccagacccccaaccacaaccagcaggacggcgacagcggcagcctgggcagccccagcgccagcagagagagcctggtgaagggcagagccggccccgacaccagcgccagcggcgagcccggcgccaacagcaagctgctgtacaaggccagcgtggtgaagaaggccgccgccagaagaagaagacaccccgacgaggccttcgaccacgaggtgagcgccttcttccccgccaacctggacttcctgtgcctgcaggaggtgttcgacaagagagccgccaccaagctgaaggagcagctgcacggctacttcgagtacatcctgtacgacgtgggcgtgtacggctgccagggctgctgcagcttcaagtgcctgaacagcggcctgctgttcgccagcagataccccatcatggacgtggcctaccactgctaccccaacaagtgcaacgacgacgccctggccagcaagggcgccctgttcctgaaggtgcaggtgggcagcaccccccaggaccagagaatcgtgggctacatcgcctgcacccacctgcacgccccccaggaggacagcgccatcagatgcggccagctggacctgctgcaggactggctggccgacttcagaaagagcaccagcagcagcagcgccgccaaccccgaggagctggtggccttcgacgtggtgtgcggcgacttcaacttcgacaactgcagcagcgacgacaagctggagcagcagcacagcctgttcacccactacagagacccctgcagactgggccccggcgaggagaagccctgggccatcggcaccctgctggacaccaacggcctgtacgacgaggacgtgtgcacccccgacaacctgcagaaggtgctggagagcgaggagggcagaagagagtacctggccttccccaccagcaagagcagcggccagaagggcagaaaggagctgctgaagggcaacggcagaagaatcgactacatgctgcacgccgaggagggcctgtgccccgactggaaggccgaggtggaggagttcagcttcatcacccagctgagcggcctgaccgaccacctgcccgtggccatgagactgatggtgagcagcggcgaggaggaggcctag

SEQ ID NO: 100210 - DNA, 690 bp, Artificial Sequence
  Description of Artificial Sequence: Synthetic coding sequence
atggaggccagagagcccggcagacccacccccacctaccacctggtgcccaacaccagccagagccaggtggaggaggacgtgagcagccccccccagagaagcagcgagaccatgcagctgaagaaggagatcagcctgctgaacggcgtgagcctggtggtgggcaacatgatcggcagcggcatcttcgtgagccccaagggcgtgctggtgcacaccgccagctacggcatgagcctgatcgtgtgggccatcggcggcctgttcagcgtggtgggcgccctgtgctacgccgagctgggcaccaccatcaccaagagcggcgccagctacgcctacatcctggaggccttcggcggcttcatcgccttcatcagactgtgggtgagcctgctggtggtggagcccaccggccaggccatcatcgccatcaccttcgccaactacatcatccagcccagcttccccagctgcgaccccccctacctggcctgcagactgctggccgccgcctgcatctgcctgctgaccttcgtgaactgcgcctacgtgaagtggggcaccagagtgcaggacaccttcacctacgccaaggtggtggccctgatcgccatcatcgtgatgggcctggtgaagctgtgccaggagatctgcccctggcccctgggcttcctgtgccagctgtag

SEQ ID NO: 100211 - DNA, 1536 bp, Artificial Sequence
  Description of Artificial Sequence: Synthetic coding sequence
atggtggacagcaccgagtacgaggtggccagccagcccgaggtggagaccagccccctgggcgacggcgccagccccggccccgagcaggtgaagctgaagaaggagatcagcctgctgaacggcgtgtgcctgatcgtgggcaacatgatcggcagcggcatcttcgtgagccccaagggcgtgctgatctacagcgccagcttcggcctgagcctggtgatctgggccgtgggcggcctgttcagcgtgttcggcgccctgtgctacgccgagctgggcaccaccatcaagaagagcggcgccagctacgcctacatcctggaggccttcggcggcttcctggccttcatcagactgtggaccagcctgctgatcatcgagcccaccagccaggccatcatcgccatcaccttcgccaactacatggtgcagcccctgttccccagctgcttcgccccctacgccgccagcagactgctggccgccgcctgcatctgcctgctgaccttcatcaactgcgcctacgtgaagtggggcaccctggtgcaggacatcttcacctacgccaaggtgctggccctgatcgccgtgatcgtggccggcatcgtgagactgggccagggcgccagcacccacttcgagaacagcttcgagggcagcagcttcgccgtgggcgacatcgccctggccctgtacagcgccctgttcagctacagcggctgggacaccctgaactacgtgaccgaggagatcaagaaccccgagagaaacctgcccctgagcatcggcatcagcatgcccatcgtgaccatcatctacatcctgaccaacgtggcctactacaccgtgctggacatgagagacatcctggccagcgacgccgtggccgtgaccttcgccgaccagatcttcggcatcttcaactggatcatccccctgagcgtggccctgagctgcttcggcggcctgaacgccagcatcgtggccgccagcagactgttcttcgtgggcagcagagagggccacctgcccgacgccatctgcatgatccacgtggagagattcacccccgtgcccagcctgctgttcaacggcatcatggccctgatctacctgtgcgtggaggacatcttccagctgatcaactactacagcttcagctactggttcttcgtgggcctgagcatcgtgggccagctgtacctgagatggaaggagcccgacagacccagacccctgaagctgagcgtgttcttccccatcgtgttctgcctgtgcaccatcttcctggtggccgtgcccctgtacagcgacaccatcaacagcctgatcggcatcgccatcgccctgagcggcctgcccttctacttcctgatcatcagagtgcccgagcacaagagacccctgtacctgagaagaatcgtgggcagcgccaccagatacctgcaggtgctgtgcatgagcgtggccgccgagatggacctggaggacggcggcgagatgcccaagcagagagaccccaagagcaactag

SEQ ID NO: 100212 - DNA, 1536 bp, Artificial Sequence; identical to SEQ ID NO: 100211
  Description of Artificial Sequence: Synthetic coding sequence

SEQ ID NO: 100213 - DNA, 1536 bp, Artificial Sequence; identical to SEQ ID NO: 100211
  Description of Artificial Sequence: Synthetic coding sequence

SEQ ID NO: 100214 - DNA, 1536 bp, Artificial Sequence; identical to SEQ ID NO: 100211
  Description of Artificial Sequence: Synthetic coding sequence

SEQ ID NO: 100215 - DNA, 1455 bp, Artificial Sequence
  Description of Artificial Sequence: Synthetic coding sequence
atggtggacagcaccgagtacgaggtggccagccagcccgaggtggagaccagccccctgggcgacggcgccagccccggccccgagcaggtgaagctgaagaaggagatctacagcgccagcttcggcctgagcctggtgatctgggccgtgggcggcctgttcagcgtgttcggcgccctgtgctacgccgagctgggcaccaccatcaagaagagcggcgccagctacgcctacatcctggaggccttcggcggcttcctggccttcatcagactgtggaccagcctgctgatcatcgagcccaccagccaggccatcatcgccatcaccttcgccaactacatggtgcagcccctgttccccagctgcttcgccccctacgccgccagcagactgctggccgccgcctgcatctgcctgctgaccttcatcaactgcgcctacgtgaagtggggcaccctggtgcaggacatcttcacctacgccaaggtgctggccctgatcgccgtgatcgtggccggcatcgtgagactgggccagggcgccagcacccacttcgagaacagcttcgagggcagcagcttcgccgtgggcgacatcgccctggccctgtacagcgccctgttcagctacagcggctgggacaccctgaactacgtgaccgaggagatcaagaaccccgagagaaacctgcccctgagcatcggcatcagcatgcccatcgtgaccatcatctacatcctgaccaacgtggcctactacaccgtgctggacatgagagacatcctggccagcgacgccgtggccgtgaccttcgccgaccagatcttcggcatcttcaactggatcatccccctgagcgtggccctgagctgcttcggcggcctgaacgccagcatcgtggccgccagcagactgttcttcgtgggcagcagagagggccacctgcccgacgccatctgcatgatccacgtggagagattcacccccgtgcccagcctgctgttcaacggcatcatggccctgatctacctgtgcgtggaggacatcttccagctgatcaactactacagcttcagctactggttcttcgtgggcctgagcatcgtgggccagctgtacctgagatggaaggagcccgacagacccagacccctgaagctgagcgtgttcttccccatcgtgttctgcctgtgcaccatcttcctggtggccgtgcccctgtacagcgacaccatcaacagcctgatcggcatcgccatcgccctgagcggcctgcccttctacttcctgatcatcagagtgcccgagcacaagagacccctgtacctgagaagaatcgtgggcagcgccaccagatacctgcaggtgctgtgcatgagcgtggccgccgagatggacctggaggacggcggcgagatgcccaagcagagagaccccaagagcaactag

SEQ ID NO: 100216 - DNA, 426 bp, Artificial Sequence
  Description of Artificial Sequence: Synthetic coding sequence
atggtggacagcaccgagtacgaggtggccagccagcccgaggtggagaccagccccctgggcgacggcgccagccccggccccgagcaggtgaagctgaagaaggagatcagcctgctgaacggcgtgtgcctgatcgtgggcaacatgatcggcagcggcatcttcgtgagccccaagggcgtgctgatctacagcgccagcttcggcctgagcctggtgatctgggccgtgggcggcctgttcagcgtgttcggcgccctgtgctacgccgagctgggcaccaccatcaagaagagcggcgccagctacgcctacatcctggaggccttcggcggcttcctggccttcatcagactgtggaccagcctgctgatcatcgagcccaccagccaggccatcatcgccatcaccttcgccaactag

SEQ ID NO: 100217 - DNA, 135 bp, Artificial Sequence
  Description of Artificial Sequence: Synthetic coding sequence
atggtggacagcaccgagtacgaggtggccagccagcccgaggtggagaccagccccctgggcgacggcgccagccccggccccgagcaggtgaagctgaagaaggagatcagcctgctgaacggcgtgtgctag

SEQ ID NO: 100218 - DNA, 495 bp, Artificial Sequence
  Description of Artificial Sequence: Synthetic coding sequence
atggtggacagcaccgagtacgaggtggccagccagcccgaggtggagaccagccccctgggcgacggcgccagccccggccccgagcaggtgaagctgaagaaggagatcagcctgctgaacggcgtgtgcctgatcgtgggcaacatgatcggcagcggcatcttcgtgagccccaagggcgtgctgatctacagcgccagcttcggcctgagcctggtgatctgggccgtgggcggcctgttcagcgtgttcggcgccctgtgctacgccgagctgggcaccaccatcaagaagagcggcgccagctacgcctacatcctggaggccttcggcggcttcctggccttcatcagactgtggaccagcctgctgatcatcgagcccaccagccaggccatcatcgccatcaccttcgccaactacatggtgcagcccctgttccccagctgcttcgccccctacgccgccagcagactgctggccgccgcctag

SEQ ID NO: 100219 - DNA, 369 bp, Artificial Sequence
  Description of Artificial Sequence: Synthetic coding sequence
atggtggacagcaccgagtacgaggtggccagccagcccgaggtggagaccagccccctgggcgacggcgccagccccggccccgagcaggtgaagctgaagaaggagatcagcctgctgaacggcgtgtgcctgatcgtgggcaacatgatcggcagcggcatcttcgtgagccccaagggcgtgctgatctacagcgccagcttcggcctgagcctggtgatctgggccgtgggcggcctgttcagcgtgttcggcgccctgtgctacgccgagctgggcaccaccatcaagaagagcggcgccagctacgcctacatcctggaggccttcggcggcttcctggccttcatcagactgtggacctag

SEQ ID NO: 100220 - DNA, 1536 bp, Artificial Sequence; identical to SEQ ID NO: 100211
  Description of Artificial Sequence: Synthetic coding sequence

SEQ ID NO: 100221 - DNA, 348 bp, Artificial Sequence
  Description of Artificial Sequence: Synthetic coding sequence
atggtggacagcaccgagtacgaggtggccagccagcccgaggtggagaccagccccctgggcgacggcgccagccccggccccgagcaggtgaagctgaagaaggagatcagcctgctgaacggcgtgtgcctgatcgtgggcaacatgatcggcagcggcatcttcgtgagccccaagggcgtgctgatctacagcgccagcttcggcctgagcctggtgatctgggccgtgggcggcctgttcagcgtgttcggcgccctgtgctacgccgagctgggcaccaccatcaagaagagcggcgccagctacgcctacatcctggaggccttcggcggcttcctgtag

SEQ ID NO: 100222 - DNA, 93 bp, Artificial Sequence
  Description of Artificial Sequence: Synthetic coding sequence
atggtggacagcaccgagtacgaggtggccagccagcccgaggtggagaccagccccctgggcgacggcgccagccccggccccgagcagtag

SEQ ID NO: 100223 - DNA, 933 bp, Artificial Sequence
  Description of Artificial Sequence: Synthetic coding sequence
atggtggacagcaccgagtacgaggtggccagccagcccgaggtggagaccagccccctgggcgacggcgccagccccggccccgagcaggtgaagctgaagaaggagatcagcctgctgaacggcgtgtgcctgatcgtgggcaacatgatcggcagcggcatcttcgtgagccccaagggcgtgctgatctacagcgccagcttcggcctgagcctggtgatctgggccgtgggcggcctgttcagcgtgttcggcgccctgtgctacgccgagctgggcaccaccatcaagaagagcggcgccagctacgcctacatcctggaggccttcggcggcttcctggccttcatcagactgtggaccagcctgctgatcatcgagcccaccagccaggccatcatcgccatcaccttcgccaactacatggtgcagcccctgttccccagctgcttcgccccctacgccgccagcagactgctggccgccgcctgcatctgcctgctgaccttcatcaactgcgcctacgtgaagtggggcaccctggtgcaggacatcttcacctacgccaaggtgctggccctgatcgccgtgatcgtggccggcatcgtgagactgggccagggcgccagcacccacttcgagaacagcttcgagggcagcagcttcgccgtgggcgacatcgccctggccctgtacagcgccctgttcagctacagcggctgggacaccctgaactacgtgaccgaggagatcaagaaccccgagagaaacctgcccctgagcatcggcatcagcatgcccatcgtgaccatcatctacatcctgaccaacgtggcctactacaccgtgctggacatgagagacatcctggccagcgacgccgtggccgtggccttcctgtgcggcctgaagagaagacccagcccctag

SEQ ID NO: 100224 - DNA, 321 bp, Artificial Sequence
  Description of Artificial Sequence: Synthetic coding sequence
atggtggacagcaccgagtacgaggtggccagccagcccgaggtggagaccagccccctgggcgacggcgccagccccggccccgagcaggtgaagctgaagaaggagatcagcctgctgaacggcgtgtgcctgatcgtgggcaacatgatcggcagcggcatcttcgtgagccccaagggcgtgctgatctacagcgccagcttcggcctgagcctggtgatctgggccgtgggcggcctgttcagcgtgttcggcgccctgtgctacgccgagctgggcaccaccatcaagaagagcggcgccagctacgcctactag

SEQ ID NO: 100225 - DNA, 351 bp, Artificial Sequence
  Description of Artificial Sequence: Synthetic coding sequence
atggtggacagcaccgagtacgaggtggccagccagcccgaggtggagaccagccccctgggcgacggcgccagccccggccccgagcaggtgaagctgaagaaggagatcagcctgctgaacggcgtgtgcctgatcgtgggcaacatgatcggcagcggcatcttcgtgagccccaagggcgtgctgatctacagcgccagcttcggcctgagcctggtgatctgggccgtgggcggcctgttcagcgtgttcggcgccctgtgctacgccgagctgggcaccaccatcaagaagagcggcgccagctacgcctacatcctggaggccttcggcggcttcctggcctag

SEQ ID NO: 100226 - DNA, 1890 bp, Artificial Sequence
  Description of Artificial Sequence: Synthetic coding sequence
atgggctgcaaggtgctgctgaacatcggccagcagatgctgagaagaaaggtggtggactgcagcagagaggagaccagactgagcagatgcctgaacaccttcgacctggtggccctgggcgtgggcagcaccctgggcgccggcgtgtacgtgctggccggcgccgtggccagagagaacgccggccccgccatcgtgatcagcttcctgatcgccgccctggccagcgtgctggccggcctgtgctacggcgagttcggcgccagagtgcccaagaccggcagcgcctacctgtacagctacgtgaccgtgggcgagctgtgggccttcatcaccggctggaacctgatcctgagctacatcatcggcaccagcagcgtggccagagcctggagcgccaccttcgacgagctgatcggcagacccatcggcgagttcagcagaacccacatgaccctgaacgcccccggcgtgctggccgagaaccccgacatcttcgccgtgatcatcatcctgatcctgaccggcctgctgaccctgggcgtgaaggagagcgccatggtgaacaagatcttcacctgcatcaacgtgctggtgctgggcttcatcatggtgagcggcttcgtgaagggcagcgtgaagaactggcagctgaccgaggaggacttcggcaacaccagcggcagactgtgcctgaacaacgacaccaaggagggcaagcccggcgtgggcggcttcatgcccttcggcttcagcggcgtgctgagcggcgccgccacctgcttctacgccttcgtgggcttcgactgcatcgccaccaccggcgaggaggtgaagaacccccagaaggccatccccgtgggcatcgtggccagcctgctgatctgcttcatcgcctacttcggcgtgagcgccgccctgaccctgatgatgccctacttctgcctggacaacaacagccccctgcccgacgccttcaagcacgtgggctgggagggcgccaagtacgccgtggccgtgggcagcctgtgcgccctgagcgccagcctgctgggcagcatgttccccatgcccagagtgatctacgccatggccgaggacggcctgctgttcaagttcctggccaacgtgaacgacagaaccaagacccccatcatcgccaccctggccagcggcgccgtggccgccgtgatggccttcctgttcgacctgaaggacctggtggacctgatgagcatcggcaccctgctggcctacagcctggtggccgcctgcgtgctggtgctgagataccagcccgagcagcccaacctggtgtaccagatggccagcaccagcgacgagctggaccccgccgaccagaacgagctggccagcaccaacgacagccagctgggcttcctgcccgaggccgagatgttcagcctgaagaccatcctgagccccaagaacatggagcccagcaagatcagcggcctgatcgtgaacatcagcaccagcctgatcgccgtgctgatcatcaccttctgcatcgtgaccgtgctgggcagagaggccctgaccaagggcgccctgtgggccgtgttcctgctggccggcagcgccctgctgtgcgccgtggtgaccggcgtgatctggagacagcccgagagcaagaccaagctgagcttcaaggtgcccttcctgcccgtgctgcccatcctgagcatcttcgtgaacgtgtacctgatgatgcagctggaccagggcacctgggtgagattcgccgtgtggatgctgatcggcttcatcatctacttcggctacggcctgtggcacagcgaggaggccagcctggacgccgaccaggccagaacccccgacggcaacctggaccagtgcaagtag

SEQ ID NO: 100227 - DNA, 366 bp, Artificial Sequence
  Description of Artificial Sequence: Synthetic coding sequence
atgggctgcaaggtgctgctgaacatcggccagcagatgctgagaagaaaggtggtggactgcagcagagaggagaccagactgagcagatgcctgaacaccttcgacctggtggccctgggcgtgggcagcaccctgggcgccggcgtgtacgtgctggccggcgccgtggccagagagaacgccggccccgccatcgtgatcagcttcctgatcgccgccctggccagcgtgctggccggcctgtgctacggcgagttcggcgccagagtgcccaagaccggcagcgcctacctgtacagctacgtgaccgtgggcgagctgtgggccttcatcaccggctggaacctgatcctgagctactag

SEQ ID NO: 100228 - DNA, 2097 bp, Artificial Sequence
  Description of Artificial Sequence: Synthetic coding sequence
atgaagatcgagaccagcggctacaacagcgacaagctgatctgcagaggcttcatcggcacccccgccccccccgtgtgcgacagcaagttcctgctgagccccagcagcgacgtgagaatgatcccctgcagagccgccctgaccttcgccagatgcctgatcagaagaaagatcgtgaccctggacagcctggaggacaccaagctgtgcagatgcctgagcaccatggacctgatcgccctgggcgtgggcagcaccctgggcgccggcgtgtacgtgctggccggcgaggtggccaaggccgacagcggccccagcatcgtggtgagcttcctgatcgccgccctggccagcgtgatggccggcctgtgctacgccgagttcggcgccagagtgcccaagaccggcagcgcctacctgtacacctacgtgaccgtgggcgagctgtgggccttcatcaccggctggaacctgatcctgagctacgtgatcggcaccagcagcgtggccagagcctggagcggcaccttcgacgagctgctgagcaagcagatcggccagttcctgagaacctacttcagaatgaactacaccggcctggccgagtaccccgacttcttcgccgtgtgcctgatcctgctgctggccggcctgctgagcttcggcgtgaaggagagcgcctgggtgaacaaggtgttcaccgccgtgaacatcctggtgctgctgttcgtgatggtggccggcttcgtgaagggcaacgtggccaactggaagatcagcgaggagttcctgaagaacatcagcgccagcgccagagagccccccagcgagaacggcaccagcatctacggcgccggcggcttcatgccctacggcttcaccggcaccctggccggcgccgccacctgcttctacgccttcgtgggcttcgactgcatcgccaccaccggcgaggaggtgagaaacccccagaaggccatccccatcggcatcgtgaccagcctgctggtgtgcttcatggcctacttcggcgtgagcgccgccctgaccctgatgatgccctactacctgctggacgagaagagccccctgcccgtggccttcgagtacgtgggctggggccccgccaagtacgtggtggccgccggcagcctgtgcgccctgagcaccagcctgctgggcagcatcttccccatgcccagagtgatctacgccatggccgaggacggcctgctgttcaagtgcctggcccagatcaacagcaagaccaagacccccatcatcgccaccctgagcagcggcgccgtggccgccctgatggccttcctgttcgacctgaaggccctggtggacatgatgagcatcggcaccctgatggcctacagcctggtggccgcctgcgtgctgatcctgagataccagcccggcctgagctacgaccagcccaagtgcagccccgagaaggacggcctgggcagcagccccagagtgaccagcaagagcgagagccaggtgaccatgctgcagagacagggcttcagcatgagaaccctgttctgccccagcctgctgcccacccagcagagcgccagcctggtgagcttcctggtgggcttcctggccttcctggtgctgggcctgagcgtgctgaccacctacggcgtgcacgccatcaccagactggaggcctggagcctggccctgctggccctgttcctggtgctgttcgtggccatcgtgctgaccatctggagacagccccagaaccagcagaaggtggccttcatggtgcccttcctgcccttcctgcccgccttcagcatcctggtgaacatctacctgatggtgcagctgagcgccgacacctgggtgagattcagcatctggatggccatcggcttcctgatctacttcagctacggcatcagacacagcctggagggccacctgagagacgagaacaacgaggaggacgcctaccccgacaacgtgcacgccgccgccgaggagaagagcgccatccaggccaacgaccaccaccccagaaacctgagcagccccttcatcttccacgagaagaccagcgagttctag

SEQ ID NO: 100229 - DNA, 2094 bp, Artificial Sequence
  Description of Artificial Sequence: Synthetic coding sequence
atgaagatcgagaccagcggctacaacagcgacaagctgatctgcagaggcttcatcggcacccccgccccccccgtgtgcgacagcaagttcctgctgagccccagcagcgacgtgagaatgatcccctgcagagccgccctgaccttcgccagatgcctgatcagaagaaagatcgtgaccctggacagcctggaggacaccaagctgtgcagatgcctgagcaccatggacctgatcgccctgggcgtgggcagcaccctgggcgccggcgtgtacgtgctggccggcgaggtggccaaggccgacagcggccccagcatcgtggtgagcttcctgatcgccgccctggccagcgtgatggccggcctgtgctacgccgagttcggcgccagagtgcccaagaccggcagcgcctacctgtacacctacgtgaccgtgggcgagctgtgggccttcatcaccggctggaacctgatcctgagctacgtgatcggcaccagcagcgtggccagagcctggagcggcaccttcgacgagctgctgagcaagcagatcggccagttcctgagaacctacttcagaatgaactacaccggcctggccgagtaccccgacttcttcgccgtgtgcctgatcctgctgctggccggcctgctgagcttcggcgtgaaggagagcgcctgggtgaacaaggtgttcaccgccgtgaacatcctggtgctgctgttcgtgatggtggccggcttcgtgaagggcaacgtggccaactggaagatcagcgaggagttcctgaagaacatcagcgccagcgccagagagccccccagcgagaacggcaccagcatctacggcgccggcggcttcatgccctacggcttcaccggcaccctggccggcgccgccacctgcttctacgccttcgtgggcttcgactgcatcgccaccaccggcgaggaggtgagaaacccccagaaggccatccccatcggcatcgtgaccagcctgctggtgtgcttcatggcctacttcggcgtgagcgccgccctgaccctgatgatgccctactacctgctggacgagaagagccccctgcccgtggccttcgagtacgtgggctggggccccgccaagtacgtggtggccgccggcagcctgtgcgccctgagcaccagcctgctgggcagcatgttccccctgcccagaatcctgttcgccatggccagagacggcctgctgttcagattcctggccagagtgagcaagagacagagccccgtggccgccaccctgaccgccggcgtgatcagcgccctgatggccttcctgttcgacctgaaggccctggtggacatgatgagcatcggcaccctgatggcctacagcctggtggccgcctgcgtgctgatcctgagataccagcccggcctgagctacgaccagcccaagtgcagccccgagaaggacggcctgggcagcagccccagagtgaccagcaagagcgagagccaggtgaccatgctgcagagacagggcttcagcatgagaaccctgttctgccccagcctgctgcccacccagcagagcgccagcctggtgagcttcctggtgggcttcctggccttcctggtgctgggcctgagcgtgctgaccacctacggcgtgcacgccatcaccagactggaggcctggagcctggccctgctggccctgttcctggtgctgttcgtggccatcgtgctgaccatctggagacagccccagaaccagcagaaggtggccttcatggtgcccttcctgcccttcctgcccgccttcagcatcctggtgaacatctacctgatggtgcagctgagcgccgacacctgggtgagattcagcatctggatggccatcggcttcctgatctacttcagctacggcatcagacacagcctggagggccacctgagagacgagaacaacgaggaggacgcctaccccgacaacgtgcacgccgccgccgaggagaagagcgccatccaggccaacgaccaccaccccagaaacctgagcagccccttcatcttccacgagaagaccagcgagttctag

SEQ ID NO: 100230 - DNA, 2094 bp, Artificial Sequence; identical to SEQ ID NO: 100229
  Description of Artificial Sequence: Synthetic coding sequence

SEQ ID NO: 100231 - DNA, 1977 bp, Artificial Sequence
  Description of Artificial Sequence: Synthetic coding sequence
atgatcccctgcagagccgccctgaccttcgccagatgcctgatcagaagaaagatcgtgaccctggacagcctggaggacaccaagctgtgcagatgcctgagcaccatggacctgatcgccctgggcgtgggcagcaccctgggcgccggcgtgtacgtgctggccggcgaggtggccaaggccgacagcggccccagcatcgtggtgagcttcctgatcgccgccctggccagcgtgatggccggcctgtgctacgccgagttcggcgccagagtgcccaagaccggcagcgcctacctgtacacctacgtgaccgtgggcgagctgtgggccttcatcaccggctggaacctgatcctgagctacgtgatcggcaccagcagcgtggccagagcctggagcggcaccttcgacgagctgctgagcaagcagatcggccagttcctgagaacctacttcagaatgaactacaccggcctggccgagtaccccgacttcttcgccgtgtgcctgatcctgctgctggccggcctgctgagcttcggcgtgaaggagagcgcctgggtgaacaaggtgttcaccgccgtgaacatcctggtgctgctgttcgtgatggtggccggcttcgtgaagggcaacgtggccaactggaagatcagcgaggagttcctgaagaacatcagcgccagcgccagagagccccccagcgagaacggcaccagcatctacggcgccggcggcttcatgccctacggcttcaccggcaccctggccggcgccgccacctgcttctacgccttcgtgggcttcgactgcatcgccaccaccggcgaggaggtgagaaacccccagaaggccatccccatcggcatcgtgaccagcctgctggtgtgcttcatggcctacttcggcgtgagcgccgccctgaccctgatgatgccctactacctgctggacgagaagagccccctgcccgtggccttcgagtacgtgggctggggccccgccaagtacgtggtggccgccggcagcctgtgcgccctgagcaccagcctgctgggcagcatcttccccatgcccagagtgatctacgccatggccgaggacggcctgctgttcaagtgcctggcccagatcaacagcaagaccaagacccccatcatcgccaccctgagcagcggcgccgtggccgccctgatggccttcctgttcgacctgaaggccctggtggacatgatgagcatcggcaccctgatggcctacagcctggtggccgcctgcgtgctgatcctgagataccagcccggcctgagctacgaccagcccaagtgcagccccgagaaggacggcctgggcagcagccccagagtgaccagcaagagcgagagccaggtgaccatgctgcagagacagggcttcagcatgagaaccctgttctgccccagcctgctgcccacccagcagagcgccagcctggtgagcttcctggtgggcttcctggccttcctggtgctgggcctgagcgtgctgaccacctacggcgtgcacgccatcaccagactggaggcctggagcctggccctgctggccctgttcctggtgctgttcgtggccatcgtgctgaccatctggagacagccccagaaccagcagaaggtggccttcatggtgcccttcctgcccttcctgcccgccttcagcatcctggtgaacatctacctgatggtgcagctgagcgccgacacctgggtgagattcagcatctggatggccatcggcttcctgatctacttcagctacggcatcagacacagcctggagggccacctgagagacgagaacaacgaggaggacgcctaccccgacaacgtgcacgccgccgccgaggagaagagcgccatccaggccaacgaccaccaccccagaaacctgagcagccccttcatcttccacgagaagaccagcgagttctag

SEQ ID NO: 100232 - DNA, 1977 bp, Artificial Sequence; identical to SEQ ID NO: 100231
  Description of Artificial Sequence: Synthetic coding sequence

SEQ ID NO: 100233 - DNA, 1464 bp, Artificial Sequence
  Description of Artificial Sequence: Synthetic coding sequence
atgggcgacaccggcctgagaaagagaagagaggacgagaagagcatccagagccaggagcccaagaccaccagcctgcagaaggagctgggcctgatcagcggcatcagcatcatcgtgggcaccatcatcggcagcggcatcttcgtgagccccaagagcgtgctgagcaacaccgaggccgtgggcccctgcctgatcatctgggccgcctgcggcgtgctggccaccctgggcgccctgtgcttcgccgagctgggcaccatgatcaccaagagcggcggcgagtacccctacctgatggaggcctacggccccatccccgcctacctgttcagctgggccagcctgatcgtgatcaagcccaccagcttcgccatcatctgcctgagcttcagcgagtacgtgtgcgcccccttctacgtgggctgcaagcccccccagatcgtggtgaagtgcctggccgccgccgccatcctgttcatcagcaccgtgaacagcctgagcgtgagactgggcagctacgtgcagaacatcttcaccgccgccaagctggtgatcgtggccatcatcatcatcagcggcctggtgctgctggcccagggcaacaccaagaacttcgacaacagcttcgagggcgcccagctgagcgtgggcgccatcagcctggccttctacaacggcctgtgggcctacgacggctggaaccagctgaactacatcaccgaggagctgagaaacccctacagaaacctgcccctggccatcatcatcggcatccccctggtgaccgcctgctacatcctgatgaacgtgagctacttcaccgtgatgaccgccaccgagctgctgcagagccaggccgtggccgtgaccttcggcgacagagtgctgtaccccgccagctggatcgtgcccctgttcgtggccttcagcaccatcggcgccgccaacggcacctgcttcaccgccggcagactgatctacgtggccggcagagagggccacatgctgaaggtgctgagctacatcagcgtgagaagactgacccccgcccccgccatcatcttctacggcatcatcgccaccatctacatcatccccggcgacatcaacagcctggtgaactacttcagcttcgccgcctggctgttctacggcctgaccatcctgggcctgatcgtgatgagattcaccagaaaggagctggagagacccatcaaggtgcccgtggtgatccccgtgctgatgaccctgatcagcgtgttcctggtgctggcccccatcatcagcaagcccacctgggagtacctgtactgcgtgctgttcatcctgagcggcctgctgttctacttcctgttcgtgcactacaagttcggctgggcccagaagatcagcaagcccatcaccatgcacctgcagatgctgatggaggtggtgccccccgaggaggaccccgagtag

SEQ ID NO: 100234 - DNA, 1464 bp, Artificial Sequence; identical to SEQ ID NO: 100233
  Description of Artificial Sequence: Synthetic coding sequence

SEQ ID NO: 100235 - DNA, 1908 bp, Artificial Sequence
  Description of Artificial Sequence: Synthetic coding sequence
atggccagaggcctgcccaccatcgccagcctggccagactgtgccagaagctgaacagactgaagcccctggaggacagcaccatggagaccagcctgagaagatgcctgagcaccctggacctgaccctgctgggcgtgggcggcatggtgggcagcggcctgtacgtgctgaccggcgccgtggccaaggaggtggccggccccgccgtgctgctgagcttcggcgtggccgccgtggccagcctgctggccgccctgtgctacgccgagttcggcgccagagtgcccagaaccggcagcgcctacctgttcacctacgtgagcatgggcgagctgtgggccttcctgatcggctggaacgtgctgctggagtacatcatcggcggcgccgccgtggccagagcctggagcggctacctggacagcatgttcagccacagcatcagaaacttcaccgagacccacgtgggcagctggcaggtgcccctgctgggccactaccccgacttcctggccgccggcatcatcctgctggccagcgccttcgtgagctgcggcgccagagtgagcagctggctgaaccacaccttcagcgccatcagcctgctggtgatcctgttcatcgtgatcctgggcttcatcctggcccagccccacaactggagcgccgacgagggcggcttcgcccccttcggcttcagcggcgtgatggccggcaccgccagctgcttctacgccttcgtgggcttcgacgtgatcgccgccagcagcgaggaggcccagaaccccagaagaagcgtgcccctggccatcgccatcagcctggccatcgccgccggcgcctacatcctggtgagcaccgtgctgaccctgatggtgccctggcacagcctggaccccgacagcgccctggccgacgccttctaccagagaggctacagatgggccggcttcatcgtggccgccggcagcatctgcgccatgaacaccgtgctgctgagcctgctgttcagcctgcccagaatcgtgtacgccatggccgccgacggcctgttcttccaggtgttcgcccacgtgcaccccagaacccaggtgcccgtggccggcaccctggccttcggcctgctgaccgccttcctggccctgctgctggacctggagagcctggtgcagttcctgagcctgggcaccctgctggcctacaccttcgtggccaccagcatcatcgtgctgagattccagaagagcagcccccccagcagccccggccccgccagccccggccccctgaccaagcagcagagcagcttcagcgaccacctgcagctggtgggcaccgtgcacgccagcgtgcccgagcccggcgagctgaagcccgccctgagaccctacctgggcttcctggacggctacagccccggcgccgtggtgacctgggccctgggcgtgatgctggccagcgccatcaccatcggctgcgtgctggtgttcggcaacagcaccctgcacctgccccactggggctacatcctgctgctgctgctgaccagcgtgatgttcctgctgagcctgctggtgctgggcgcccaccagcagcagtacagagaggacctgttccagatccccatggtgcccctgatccccgccctgagcatcgtgctgaacatctgcctgatgctgaagctgagctacctgacctgggtgagattcagcatctggctgctgatgggcctggccgtgtacttcggctacggcatcagacacagcaaggagaaccagagagagctgcccggcctgaacagcacccactacgtggtgttccccagaggcagcctggaggagaccgtgcaggccatgcagccccccagccaggcccccgcccaggaccccggccacatggagtag

SEQ ID NO: 100236 - DNA, 1908 bp, Artificial Sequence; identical to SEQ ID NO: 100235
  Description of Artificial Sequence: Synthetic coding sequence

SEQ ID NO: 100237 - DNA, 249 bp, Artificial Sequence
  Description of Artificial Sequence: Synthetic coding sequence
atggccagaggcctgcccaccatcgccagcctggccagactgtgccagaagctgaacagactgaagcccctggaggacagcaccatggagaccagcctgagaagatgcctgagcaccctggacctgaccctgctgggcgtgggcggcatggtgggcagcggcctgtacgtgctgaccggcgccgtggccaaggaggtggccggccccgccgtgctgctgagcttcggcgtggccgccgtggccagctag

SEQ ID NO: 100238 - DNA, 2922 bp, Artificial Sequence
  Description of Artificial Sequence: Synthetic coding sequence
atgtacaacatgagaagactgagcctgagccccaccttcagcatgggcttccacctgctggtgaccgtgagcctgctgttcagccacgtggaccacgtgatcgccgagaccgagatggagggcgagggcaacgagaccggcgagtgcaccggcagctactactgcaagaagggcgtgatcctgcccatctgggagccccaggaccccagcttcggcgacaagatcgccagagccaccgtgtacttcgtggccatggtgtacatgttcctgggcgtgagcatcatcgccgacagattcatgagcagcatcgaggtgatcaccagccaggagaaggagatcaccatcaagaagcccaacggcgagaccaccaagaccaccgtgagaatctggaacgagaccgtgagcaacctgaccctgatggccctgggcagcagcgcccccgagatcctgctgagcgtgatcgaggtgtgcggccacaacttcaccgccggcgacctgggccccagcaccatcgtgggcagcgccgccttcaacatgttcatcatcatcgccctgtgcgtgtacgtggtgcccgacggcgagaccagaaagatcaagcacctgagagtgttcttcgtgaccgccgcctggagcatcttcgcctacacctggctgtacatcatcctgagcgtgatcagccccggcgtggtggaggtgtgggagggcctgctgaccttcttcttcttccccatctgcgtggtgttcgcctgggtggccgacagaagactgctgttctacaagtacgtgtacaagagatacagagccggcaagcagagaggcatgatcatcgagcacgagggcgacagacccagcagcaagaccgagatcgagatggacggcaaggtggtgaacagccacgtggagaacttcctggacggcgccctggtgctggaggtggacgagagagaccaggacgacgaggaggccagaagagagatggccagaatcctgaaggagctgaagcagaagcaccccgacaaggagatcgagcagctgatcgagctggccaactaccaggtgctgagccagcagcagaagagcagagccttctacagaatccaggccaccagactgatgaccggcgccggcaacatcctgaagagacacgccgccgaccaggccagaaaggccgtgagcatgcacgaggtgaacaccgaggtgaccgagaacgaccccgtgagcaagatcttcttcgagcagggcacctaccagtgcctggagaactgcggcaccgtggccctgaccatcatcagaagaggcggcgacctgaccaacaccgtgttcgtggacttcagaaccgaggacggcaccgccaacgccggcagcgactacgagttcaccgagggcaccgtggtgttcaagcccggcgacacccagaaggagatcagagtgggcatcatcgacgacgacatcttcgaggaggacgagaacttcctggtgcacctgagcaacgtgaaggtgagcagcgaggccagcgaggacggcatcctggaggccaaccacgtgagcaccctggcctgcctgggcagccccagcaccgccaccgtgaccatcttcgacgacgaccacgccggcatcttcaccttcgaggagcccgtgacccacgtgagcgagagcatcggcatcatggaggtgaaggtgctgagaaccagcggcgccagaggcaacgtgatcgtgccctacaagaccatcgagggcaccgccagaggcggcggcgaggacttcgaggacacctgcggcgagctggagttccagaacgacgagatcgtgaagaccatcagcgtgaaggtgatcgacgacgaggagtacgagaagaacaagaccttcttcctggagatcggcgagcccagactggtggagatgagcgagaagaaggccctgctgctgaacgagctgggcggcttcaccatcaccggcaagtacctgttcggccagcccgtgttcagaaaggtgcacgccagagagcaccccatcctgagcaccgtgatcaccatcgccgacgagtacgacgacaagcagcccctgaccagcaaggaggaggaggagagaagaatcgccgagatgggcagacccatcctgggcgagcacaccaagctggaggtgatcatcgaggagagctacgagttcaagagcaccgtggacaagctgatcaagaagaccaacctggccctggtggtgggcaccaacagctggagagagcagttcatcgaggccatcaccgtgagcgccggcgaggacgacgacgacgacgagtgcggcgaggagaagctgcccagctgcttcgactacgtgatgcacttcctgaccgtgttctggaaggtgctgttcgccttcgtgccccccaccgagtactggaacggctgggcctgcttcatcgtgagcatcctgatgatcggcctgctgaccgccttcatcggcgacctggccagccacttcggctgcaccatcggcctgaaggacagcgtgaccgccgtggtgttcgtggccctgggcaccagcgtgcccgacaccttcgccagcaaggtggccgccacccaggaccagtacgccgacgccagcatcggcaacgtgaccggcagcaacgccgtgaacgtgttcctgggcatcggcgtggcctggagcatcgccgccatctaccacgccgccaacggcgagcagttcaaggtgagccccggcaccctggccttcagcgtgaccctgttcaccatcttcgccttcatcaacgtgggcgtgctgctgtacagaagaagacccgagatcggcggcgagctgggcggccccagaaccgccaagctgctgaccagctgcctgttcgtgctgctgtggctgctgtacatcttcttcagcagcctggaggcctactgccacatcaagggcttctag

SEQ ID NO: 100239 - DNA, 2922 bp, Artificial Sequence; identical to SEQ ID NO: 100238
  Description of Artificial Sequence: Synthetic coding sequence

SEQ ID NO: 100240 - DNA, 2814 bp, Artificial Sequence
  Description of Artificial Sequence: Synthetic coding sequence
atgtacaacatgagaagactgagcctgagccccaccttcagcatgggcttccacctgctggtgaccgtgagcctgctgttcagccacgtggaccacgtgatcgccgagaccgagatggagggcgagggcaacgagaccggcgagtgcaccggcagctactactgcaagaagggcgtgatcctgcccatctgggagccccaggaccccagcttcggcgacaagatcgccagagccaccgtgtacttcgtggccatggtgtacatgttcctgggcgtgagcatcatcgccgacagattcatgagcagcatcgaggtgatcaccagccaggagaaggagatcaccatcaagaagcccaacggcgagaccaccaagaccaccgtgagaatctggaacgagaccgtgagcaacctgaccctgatggccctgggcagcagcgcccccgagatcctgctgagcgtgatcgaggtgtgcggccacaacttcaccgccggcgacctgggccccagcaccatcgtgggcagcgccgccttcaacatgttcatcatcatcgccctgtgcgtgtacgtggtgcccgacggcgagaccagaaagatcaagcacctgagagtgttcttcgtgaccgccgcctggagcatcttcgcctacacctggctgtacatcatcctgagcgtgatcagccccggcgtggtggaggtgtgggagggcctgctgaccttcttcttcttccccatctgcgtggtgttcgcctgggtggccgacagaagactgctgttctacaagtacgtgtacaagagatacagagccggcaagcagagaggcatgatcatcgagcacgagggcgacagacccagcagcaagaccgagatcgagatggacggcaaggtggtgaacagccacgtggagaacttcctggacggcgccctggtgctggaggtggacgagagagaccaggacgacgaggaggccagaagagagatggccagaatcctgaaggagctgaagcagaagcaccccgacaaggagatcgagcagctgatcgagctggccaactaccaggtgctgagccagcagcagaagagcagagccttctacagaatccaggccaccagactgatgaccggcgccggcaacatcctgaagagacacgccgccgaccaggccagaaaggccgtgagcatgcacgaggtgaacaccgaggtgaccgagaacgaccccgtgagcaagatcttcttcgagcagggcacctaccagtgcctggagaactgcggcaccgtggccctgaccatcatcagaagaggcggcgacctgaccaacaccgtgttcgtggacttcagaaccgaggacggcaccgccaacgccggcagcgactacgagttcaccgagggcaccgtggtgttcaagcccggcgacacccagaaggagatcagagtgggcatcatcgacgacgacatcttcgaggaggacgagaacttcctggtgcacctgagcaacgtgaaggtgagcagcgaggccagcgaggacggcatcctggaggccaaccacgtgagcaccctggcctgcctgggcagccccagcaccgccaccgtgaccatcttcgacgacgaccacgccggcatcttcaccttcgaggagcccgtgacccacgtgagcgagagcatcggcatcatggaggtgaaggtgctgagaaccagcggcgccagaggcaacgtgatcgtgccctacaagaccatcgagggcaccgccagaggcggcggcgaggacttcgaggacacctgcggcgagctggagttccagaacgacgagatcgtgaagatcatcaccatcagaatcttcgacagagaggagtacgagaaggagtgcagcttcagcctggtgctggaggagcccaagtggatcagaagaggcatgaagggcggcttcaccatcaccgacgagtacgacgacaagcagcccctgaccagcaaggaggaggaggagagaagaatcgccgagatgggcagacccatcctgggcgagcacaccaagctggaggtgatcatcgaggagagctacgagttcaagagcaccgtggacaagctgatcaagaagaccaacctggccctggtggtgggcaccaacagctggagagagcagttcatcgaggccatcaccgtgagcgccggcgaggacgacgacgacgacgagtgcggcgaggagaagctgcccagctgcttcgactacgtgatgcacttcctgaccgtgttctggaaggtgctgttcgccttcgtgccccccaccgagtactggaacggctgggcctgcttcatcgtgagcatcctgatgatcggcctgctgaccgccttcatcggcgacctggccagccacttcggctgcaccatcggcctgaaggacagcgtgaccgccgtggtgttcgtggccctgggcaccagcgtgcccgacaccttcgccagcaaggtggccgccacccaggaccagtacgccgacgccagcatcggcaacgtgaccggcagcaacgccgtgaacgtgttcctgggcatcggcgtggcctggagcatcgccgccatctaccacgccgccaacggcgagcagttcaaggtgagccccggcaccctggccttcagcgtgaccctgttcaccatcttcgccttcatcaacgtgggcgtgctgctgtacagaagaagacccgagatcggcggcgagctgggcggccccagaaccgccaagctgctgaccagctgcctgttcgtgctgctgtggctgctgtacatcttcttcagcagcctggaggcctactgccacatcaagggcttctag

SEQ ID NO: 100241 - DNA, 2922 bp, Artificial Sequence; identical to SEQ ID NO: 100238
  Description of Artificial Sequence: Synthetic coding sequence

SEQ ID NO: 100242 - DNA, 2814 bp, Artificial Sequence; identical to SEQ ID NO: 100240
  Description of Artificial Sequence: Synthetic coding sequence

SEQ ID NO: 100243 - DNA, 2907 bp, Artificial Sequence
  Description of Artificial Sequence: Synthetic coding sequence
atgtacaacatgagaagactgagcctgagccccaccttcagcatgggcttccacctgctggtgaccgtgagcctgctgttcagccacgtggaccacgtgatcgccgagaccgagatggagggcgagggcaacgagaccggcgagtgcaccggcagctactactgcaagaagggcgtgatcctgcccatctgggagccccaggaccccagcttcggcgacaagatcgccagagccaccgtgtacttcgtggccatggtgtacatgttcctgggcgtgagcatcatcgccgacagattcatgagcagcatcgaggtgatcaccagccaggagaaggagatcaccatcaagaagcccaacggcgagaccaccaagaccaccgtgagaatctggaacgagaccgtgagcaacctgaccctgatggccctgggcagcagcgcccccgagatcctgctgagcgtgatcgaggtgtgcggccacaacttcaccgccggcgacctgggccccagcaccatcgtgggcagcgccgccttcaacatgttcatcatcatcgccctgtgcgtgtacgtggtgcccgacggcgagaccagaaagatcaagcacctgagagtgttcttcgtgaccgccgcctggagcatcttcgcctacacctggctgtacatcatcctgagcgtgatcagccccggcgtggtggaggtgtgggagggcctgctgaccttcttcttcttccccatctgcgtggtgttcgcctgggtggccgacagaagactgctgttctacaagtacgtgtacaagagatacagagccggcaagcagagaggcatgatcatcgagcacgagggcgacagacccagcagcaagaccgagatcgagatggacggcaaggtggtgaacagccacgtggagaacttcctggacggcgccctggtgctggaggtggacgagagagaccaggacgacgaggaggccagaagagagatggccagaatcctgaaggagctgaagcagaagcaccccgacaaggagatcgagcagctgatcgagctggccaactaccaggtgctgagccagcagcagaagagcagagccttctacagaatccaggccaccagactgatgaccggcgccggcaacatcctgaagagacacgccgccgaccaggccagaaaggccgtgagcatgcacgaggtgaacaccgaggtgaccgagaacgaccccgtgagcaagatcttcttcgagcagggcacctaccagtgcctggagaactgcggcaccgtggccctgaccatcatcagaagaggcggcgacctgaccaacaccgtgttcgtggacttcagaaccgaggacggcaccgccaacgccggcagcgactacgagttcaccgagggcaccgtggtgttcaagcccggcgacacccagaaggagatcagagtgggcatcatcgacgacgacatcttcgaggaggacgagaacttcctggtgcacctgagcaacgtgaaggtgagcagcgaggccagcgaggacggcatcctggaggccaaccacgtgagcaccctggcctgcctgggcagccccagcaccgccaccgtgaccatcttcgacgacgaccacgccggcatcttcaccttcgaggagcccgtgacccacgtgagcgagagcatcggcatcatggaggtgaaggtgctgagaaccagcggcgccagaggcaacgtgatcgtgccctacaagaccatcgagggcaccgccagaggcggcggcgaggacttcgaggacacctgcggcgagctggagttccagaacgacgagatcgtgaagaccatcagcgtgaaggtgatcgacgacgaggagtacgagaagaacaagaccttcttcctggagatcggcgagcccagactggtggagatgagcgagaagaaggccctgctgctgaacgagctgggcggcttcaccatcaccggccagcccgtgttcagaaaggtgcacgccagagagcaccccatcctgagcaccgtgatcaccatcgccgacgagtacgacgacaagcagcccctgaccagcaaggaggaggaggagagaagaatcgccgagatgggcagacccatcctgggcgagcacaccaagctggaggtgatcatcgaggagagctacgagttcaagagcaccgtggacaagctgatcaagaagaccaacctggccctggtggtgggcaccaacagctggagagagcagttcatcgaggccatcaccgtgagcgccggcgaggacgacgacgacgacgagtgcggcgaggagaagctgcccagctgcttcgactacgtgatgcacttcctgaccgtgttctggaaggtgctgttcgccttcgtgccccccaccgagtactggaacggctgggcctgcttcatcgtgagcatcctgatgatcggcctgctgaccgccttcatcggcgacctggccagccacttcggctgcaccatcggcctgaaggacagcgtgaccgccgtggtgttcgtggccctgggcaccagcgtgcccgacaccttcgccagcaaggtggccgccacccaggaccagtacgccgacgccagcatcggcaacgtgaccggcagcaacgccgtgaacgtgttcctgggcatcggcgtggcctggagcatcgccgccatctaccacgccgccaacggcgagcagttcaaggtgagccccggcaccctggccttcagcgtgaccctgttcaccatcttcgccttcatcaacgtgggcgtgctgctgtacagaagaagacccgagatcggcggcgagctgggcggccccagaaccgccaagctgctgaccagctgcctgttcgtgctgctgtggctgctgtacatcttcttcagcagcctggaggcctactgccacatcaagggcttctag

SEQ ID NO: 100244 - DNA, 2814 bp, Artificial Sequence; identical to SEQ ID NO: 100240
  Description of Artificial Sequence: Synthetic coding sequence

SEQ ID NO: 100245 - DNA, 2814 bp, Artificial Sequence; identical to SEQ ID NO: 100240
  Description of Artificial Sequence: Synthetic coding sequence

SEQ ID NO: 100246 - DNA, 1995 bp, Artificial Sequence
  Description of Artificial Sequence: Synthetic coding sequence
atgagaagactgagcctgagccccaccttcagcatgggcttccacctgctggtgaccgtgagcctgctgttcagccacgtggaccacgtgatcgccgagaccgagatggagggcgagggcaacgagaccggcgagtgcaccggcagctactactgcaagaagggcgtgatcctgcccatctgggagccccaggaccccagcttcggcgacaagatcgccagagccaccgtgtacttcgtggccatggtgtacatgttcctgggcgtgagcatcatcgccgacagattcatgagcagcatcgaggtgatcaccagccaggagaaggagatcaccatcaagaagcccaacggcgagaccaccaagaccaccgtgagaatctggaacgagaccgtgagcaacctgaccctgatggccctgggcagcagcgcccccgagatcctgctgagcgtgatcgaggtgtgcggccacaacttcaccgccggcgacctgggccccagcaccatcgtgggcagcgccgccttcaacatgttcatcatcatcgccctgtgcgtgtacgtggtgcccgacggcgagaccagaaagatcaagcacctgagagtgttcttcgtgaccgccgcctggagcatcttcgcctacacctggctgtacatcatcctgagcgtgatcagccccggcgtggtggaggtgtgggagggcctgctgaccttcttcttcttccccatctgcgtggtgttcgcctgggtggccgacagaagactgctgttctacaagtacgtgtacaagagatacagagccggcaagcagagaggcatgatcatcgagcacgagggcgacagacccagcagcaagaccgagatcgagatggacggcaaggtggtgaacagccacgtggagaacttcctggacggcgccctggtgctggaggtggacgagagagaccaggacgacgaggaggccagaagagagatggccagaatcctgaaggagctgaagcagaagcaccccgacaaggagatcgagcagctgatcgagctggccaactaccaggtgctgagccagcagcagaagagcagagccttctacagaatccaggccaccagactgatgaccggcgccggcaacatcctgaagagacacgccgccgaccaggccagaaaggccgtgagcatgcacgaggtgaacaccgaggtgaccgagaacgaccccgtgagcaagatcttcttcgagcagggcacctaccagtgcctggagaactgcggcaccgtggccctgaccatcatcagaagaggcggcgacctgaccaacaccgtgttcgtggacttcagaaccgaggacggcaccgccaacgccggcagcgactacgagttcaccgagggcaccgtggtgttcaagcccggcgacacccagaaggagatcagagtgggcatcatcgacgacgacatcttcgaggaggacgagaacttcctggtgcacctgagcaacgtgaaggtgagcagcgaggccagcgaggacggcatcctggaggccaaccacgtgagcaccctggcctgcctgggcagccccagcaccgccaccgtgaccatcttcgacgacgaccacgccggcatcttcaccttcgaggagcccgtgacccacgtgagcgagagcatcggcatcatggaggtgaaggtgctgagaaccagcggcgccagaggcaacgtgatcgtgccctacaagaccatcgagggcaccgccagaggcggcggcgaggacttcgaggacacctgcggcgagctggagttccagaacgacgagatcgtgaagaccatcagcgtgaaggtgatcgacgacgaggagtacgagaagaacaagaccttcttcctggagatcggcgagcccagactggtggagatgagcgagaagaagggcagaagcctgcccctggagtacctgaccgtgagaaacatgagaaagagcgccgtgagccccctgtgcctgagaaaccagaacggctag

SEQ ID NO: 100247 - DNA, 2898 bp, Artificial Sequence
  Description of Artificial Sequence: Synthetic coding sequence
atgtacaacatgagaagactgagcctgagccccaccttcagcatgggcttccacctgctggtgaccgtgagcctgctgttcagccacgtggaccacgtgatcgccgagaccgagatggagggcgagggcaacgagaccggcgagtgcaccggcagctactactgcaagaagggcgtgatcctgcccatctgggagccccaggaccccagcttcggcgacaagatcgccagagccaccgtgtacttcgtggccatggtgtacatgttcctgggcgtgagcatcatcgccgacagattcatgagcagcatcgaggtgatcaccagccaggagaaggagatcaccatcaagaagcccaacggcgagaccaccaagaccaccgtgagaatctggaacgagaccgtgagcaacctgaccctgatggccctgggcagcagcgcccccgagatcctgctgagcgtgatcgaggtgtgcggccacaacttcaccgccggcgacctgggccccagcaccatcgtgggcagcgccgccttcaacatgttcatcatcatcgccctgtgcgtgtacgtggtgcccgacggcgagaccagaaagatcaagcacctgagagtgttcttcgtgaccgccgcctggagcatcttcgcctacacctggctgtacatcatcctgagcgtgatcagccccggcgtggtggaggtgtgggagggcctgctgaccttcttcttcttccccatctgcgtggtgttcgcctgggtggccgacagaagactgctgttctacaagtacgtgtacaagagatacagagccggcaagcagagaggcatgatcatcgagcacgagggcgacagacccagcagcaagaccgagatcgagatggacggcaaggtggtgaacagccacgtggagaacttcctggacggcgccctggtgctggaggtggacgagagagaccaggacgacgaggaggccagaagagagatggccagaatcctgaaggagctgaagcagaagcaccccgacaaggagatcgagcagctgatcgagctggccaactaccaggtgctgagccagcagcagaagagcagagccttctacagaatccaggccaccagactgatgaccggcgccggcaacatcctgaagagacacgccgccgaccaggccagaaaggccgtgagcatgcacgaggtgaacaccgaggtgaccgagaacgaccccgtgagcaagatcttcttcgagcagggcacctaccagtgcctggagaactgcggcaccgtggccctgaccatcatcagaagaggcggcgacctgaccaacaccgtgttcgtggacttcagaaccgaggacggcaccgccaacgccggcagcgactacgagttcaccgagggcaccgtggtgttcaagcccggcgacacccagaaggagatcagagtgggcatcatcgacgacgacatcttcgaggaggacgagaacttcctggtgcacctgagcaacgtgaaggtgagcagcgaggccagcgaggacggcatcctggaggccaaccacgtgagcaccctggcctgcctgggcagccccagcaccgccaccgtgaccatcttcgacgacgaccacgccggcatcttcaccttcgaggagcccgtgacccacgtgagcgagagcatcggcatcatggaggtgaaggtgctgagaaccagcggcgccagaggcaacgtgatcgtgccctacaagaccatcgagggcaccgccagaggcggcggcgaggacttcgaggacacctgcggcgagctggagttccagaacgacgagatcgtgaagatcatcaccatcagaatcttcgacagagaggagtacgagaaggagtgcagcttcagcctggtgctggaggagcccaagtggatcagaagaggcatgaagggcggcttcaccatcaccggcaagtacctgttcggccagcccgtgttcagaaaggtgcacgccagagagcaccccatcctgagcaccgtgatcaccatcgccgacgagtacgacgacaagcagcccctgaccagcaaggaggaggaggagagaagaatcgccgagatgggcagacccatcctgggcgagcacaccaagctggaggtgatcatcgaggagagctacgagttcaagagcaccgtggacaagctgatcaagaagaccaacctggccctggtggtgggcaccaacagctggagagagcagttcatcgaggccatcaccgtgagcgccggcgaggacgacgacgacgacgagtgcggcgaggagaagctgcccagctgcttcgactacgtgatgcacttcctgaccgtgttctggaaggtgctgttcgccttcgtgccccccaccgagtactggaacggctgggcctgcttcatcgtgagcatcctgatgatcggcctgctgaccgccttcatcggcgacctggccagccacttcggctgcaccatcggcctgaaggacagcgtgaccgccgtggtgttcgtggccctgggcaccagcgtgcccgacaccttcgccagcaaggtggccgccacccaggaccagtacgccgacgccagcatcggcaacgtgaccggcagcaacgccgtgaacgtgttcctgggcatcggcgtggcctggagcatcgccgccatctaccacgccgccaacggcgagcagttcaaggtgagccccggcaccctggccttcagcgtgaccctgttcaccatcttcgccttcatcaacgtgggcgtgctgctgtacagaagaagacccgagatcggcggcgagctgggcggccccagaaccgccaagctgctgaccagctgcctgttcgtgctgctgtggctgctgtacatcttcttcagcagcctggaggcctactgccacatcaagggcttctag

SEQ ID NO: 100248 - DNA, 222 bp, Artificial Sequence
  Description of Artificial Sequence: Synthetic coding sequence
atgtacaacatgagaagactgagcctgagccccaccttcagcatgggcttccacctgctggtgaccgtgagcctgctgttcagccacgtggaccacgtgatcgccgagaccgagatggagggcgagggcaacgagaccggcgagtgcaccggcagctactactgcaagaagggcgtgatcctgcccatctgggagccccaggaccccagcttcggcgactag

SEQ ID NO: 100249 - DNA, 264 bp, Artificial Sequence
  Description of Artificial Sequence: Synthetic coding sequence
atgtacaacatgagaagactgagcctgagccccaccttcagcatgggcttccacctgctggtgaccgtgagcctgctgttcagccacgtggaccacgtgatcgccgagaccgagatggagggcgagggcaacgagaccggcgagtgcaccggcagctactactgcaagaagggcgtgatcctgcccatctgggagccccaggaccccagcttcggcgacaagatcgccagagccaccgtgtacttcgtggccatggtgtactag

SEQ ID NO: 100250 - DNA, 264 bp, Artificial Sequence; identical to SEQ ID NO: 100249
  Description of Artificial Sequence: Synthetic coding sequence

SEQ ID NO: 100251 - DNA, 2883 bp, Artificial Sequence
  Description of Artificial Sequence: Synthetic coding sequence
atgtacaacatgagaagactgagcctgagccccaccttcagcatgggcttccacctgctggtgaccgtgagcctgctgttcagccacgtggaccacgtgatcgccgagaccgagatggagggcgagggcaacgagaccggcgagtgcaccggcagctactactgcaagaagggcgtgatcctgcccatctgggagccccaggaccccagcttcggcgacaagatcgccagagccaccgtgtacttcgtggccatggtgtacatgttcctgggcgtgagcatcatcgccgacagattcatgagcagcatcgaggtgatcaccagccaggagaaggagatcaccatcaagaagcccaacggcgagaccaccaagaccaccgtgagaatctggaacgagaccgtgagcaacctgaccctgatggccctgggcagcagcgcccccgagatcctgctgagcgtgatcgaggtgtgcggccacaacttcaccgccggcgacctgggccccagcaccatcgtgggcagcgccgccttcaacatgttcatcatcatcgccctgtgcgtgtacgtggtgcccgacggcgagaccagaaagatcaagcacctgagagtgttcttcgtgaccgccgcctggagcatcttcgcctacacctggctgtacatcatcctgagcgtgatcagccccggcgtggtggaggtgtgggagggcctgctgaccttcttcttcttccccatctgcgtggtgttcgcctgggtggccgacagaagactgctgttctacaagtacgtgtacaagagatacagagccggcaagcagagaggcatgatcatcgagcacgagggcgacagacccagcagcaagaccgagatcgagatggacggcaaggtggtgaacagccacgtggagaacttcctggacggcgccctggtgctggaggtggacgagagagaccaggacgacgaggaggccagaagagagatggccagaatcctgaaggagctgaagcagaagcaccccgacaaggagatcgagcagctgatcgagctggccaactaccaggtgctgagccagcagcagaagagcagagccttctacagaatccaggccaccagactgatgaccggcgccggcaacatcctgaagagacacgccgccgaccaggccagaaaggccgtgagcatgcacgaggtgaacaccgaggtgaccgagaacgaccccgtgagcaagatcttcttcgagcagggcacctaccagtgcctggagaactgcggcaccgtggccctgaccatcatcagaagaggcggcgacctgaccaacaccgtgttcgtggacttcagaaccgaggacggcaccgccaacgccggcagcgactacgagttcaccgagggcaccgtggtgttcaagcccggcgacacccagaaggagatcagagtgggcatcatcgacgacgacatcttcgaggaggacgagaacttcctggtgcacctgagcaacgtgaaggtgagcagcgaggccagcgaggacggcatcctggaggccaaccacgtgagcaccctggcctgcctgggcagccccagcaccgccaccgtgaccatcttcgacgacgaccacgccggcatcttcaccttcgaggagcccgtgacccacgtgagcgagagcatcggcatcatggaggtgaaggtgctgagaaccagcggcgccagaggcaacgtgatcgtgccctacaagaccatcgagggcaccgccagaggcggcggcgaggacttcgaggacacctgcggcgagctggagttccagaacgacgagatcgtgaagatcatcaccatcagaatcttcgacagagaggagtacgagaaggagtgcagcttcagcctggtgctggaggagcccaagtggatcagaagaggcatgaaggagggcttctggctgagcagccagcccgtgttcagaaaggtgcacgccagagagcaccccatcctgagcaccgtgatcaccatcgccgacgagtacgacgacaagcagcccctgaccagcaaggaggaggaggagagaagaatcgccgagatgggcagacccatcctgggcgagcacaccaagctggaggtgatcatcgaggagagctacgagttcaagagcaccgtggacaagctgatcaagaagaccaacctggccctggtggtgggcaccaacagctggagagagcagttcatcgaggccatcaccgtgagcgccggcgaggacgacgacgacgacgagtgcggcgaggagaagctgcccagctgcttcgactacgtgatgcacttcctgaccgtgttctggaaggtgctgttcgccttcgtgccccccaccgagtactggaacggctgggcctgcttcatcgtgagcatcctgatgatcggcctgctgaccgccttcatcggcgacctggccagccacttcggctgcaccatcggcctgaaggacagcgtgaccgccgtggtgttcgtggccctgggcaccagcgtgcccgacaccttcgccagcaaggtggccgccacccaggaccagtacgccgacgccagcatcggcaacgtgaccggcagcaacgccgtgaacgtgttcctgggcatcggcgtggcctggagcatcgccgccatctaccacgccgccaacggcgagcagttcaaggtgagccccggcaccctggccttcagcgtgaccctgttcaccatcttcgccttcatcaacgtgggcgtgctgctgtacagaagaagacccgagatcggcggcgagctgggcggccccagaaccgccaagctgctgaccagctgcctgttcgtgctgctgtggctgctgtacatcttcttcagcagcctggaggcctactgccacatcaagggcttctag

SEQ ID NO: 100252 - DNA, 2814 bp, Artificial Sequence
  Description of Artificial Sequence: Synthetic coding sequence
atgtacaacatgagaagactgagcctgagccccaccttcagcatgggcttccacctgctggtgaccgtgagcctgctgttcagccacgtggaccacgtgatcgccgagaccgagatggagggcgagggcaacgagaccggcgagtgcaccggcagctactactgcaagaagggcgtgatcctgcccatctgggagccccaggaccccagcttcggcgacaagatcgccagagccaccgtgtacttcgtggccatggtgtacatgttcctgggcgtgagcatcatcgccgacagattcatgagcagcatcgaggtgatcaccagccaggagaaggagatcaccatcaagaagcccaacggcgagaccaccaagaccaccgtgagaatctggaacgagaccgtgagcaacctgaccctgatggccctgggcagcagcgcccccgagatcctgctgagcgtgatcgaggtgtgcggccacaacttcaccgccggcgacctgggccccagcaccatcgtgggcagcgccgccttcaacatgttcatcatcatcgccctgtgcgtgtacgtggtgcccgacggcgagaccagaaagatcaagcacctgagagtgttcttcgtgaccgccgcctggagcatcttcgcctacacctggctgtacatcatcctgagcgtgatcagccccggcgtggtggaggtgtgggagggcctgctgaccttcttcttcttccccatctgcgtggtgttcgcctgggtggccgacagaagactgctgttctacaagtacgtgtacaagagatacagagccggcaagcagagaggcatgatcatcgagcacgagggcgacagacccagcagcaagaccgagatcgagatggacggcaaggtggtgaacagccacgtggagaacttcctggacggcgccctggtgctggaggtggacgagagagaccaggacgacgaggaggccagaagagagatggccagaatcctgaaggagctgaagcagaagcaccccgacaaggagatcgagcagctgatcgagctggccaactaccaggtgctgagccagcagcagaagagcagagccttctacagaatccaggccaccagactgatgaccggcgccggcaacatcctgaagagacacgccgccgaccaggccagaaaggccgtgagcatgcacgaggtgaacaccgaggtgaccgagaacgaccccgtgagcaagatcttcttcgagcagggcacctaccagtgcctggagaactgcggcaccgtggccctgaccatcatcagaagaggcggcgacctgaccaacaccgtgttcgtggacttcagaaccgaggacggcaccgccaacgccggcagcgactacgagttcaccgagggcaccgtggtgttcaagcccggcgacacccagaaggagatcagagtgggcatcatcgacgacgacatcttcgaggaggacgagaacttcctggtgcacctgagcaacgtgaaggtgagcagcgaggccagcgaggacggcatcctggaggccaaccacgtgagcaccctggcctgcctgggcagccccagcaccgccaccgtgaccatcttcgacgacgaccacgccggcatcttcaccttcgaggagcccgtgacccacgtgagcgagagcatcggcatcatggaggtgaaggtgctgagaaccagcggcgccagaggcaacgtgatcgtgccctacaagaccatcgagggcaccgccagaggcggcggcgaggacttcgaggacacctgcggcgagctggagttccagaacgacgagatcgtgaagatcatcaccatcagaatcttcgacagagaggagtacgagaaggagtgcagcttcagcctggtgctggaggagcccaagtggatcagaagaggcatgaaggagggcttctgcttcaccgacgagtacgacgacaagcagcccctgaccagcaaggaggaggaggagagaagaatcgccgagatgggcagacccatcctgggcgagcacaccaagctggaggtgatcatcgaggagagctacgagttcaagagcaccgtggacaagctgatcaagaagaccaacctggccctggtggtgggcaccaacagctggagagagcagttcatcgaggccatcaccgtgagcgccggcgaggacgacgacgacgacgagtgcggcgaggagaagctgcccagctgcttcgactacgtgatgcacttcctgaccgtgttctggaaggtgctgttcgccttcgtgccccccaccgagtactggaacggctgggcctgcttcatcgtgagcatcctgatgatcggcctgctgaccgccttcatcggcgacctggccagccacttcggctgcaccatcggcctgaaggacagcgtgaccgccgtggtgttcgtggccctgggcaccagcgtgcccgacaccttcgccagcaaggtggccgccacccaggaccagtacgccgacgccagcatcggcaacgtgaccggcagcaacgccgtgaacgtgttcctgggcatcggcgtggcctggagcatcgccgccatctaccacgccgccaacggcgagcagttcaaggtgagccccggcaccctggccttcagcgtgaccctgttcaccatcttcgccttcatcaacgtgggcgtgctgctgtacagaagaagacccgagatcggcggcgagctgggcggccccagaaccgccaagctgctgaccagctgcctgttcgtgctgctgtggctgctgtacatcttcttcagcagcctggaggcctactgccacatcaagggcttctag

SEQ ID NO: 100253 - DNA, 417 bp, Artificial Sequence
  Description of Artificial Sequence: Synthetic coding sequence
atgtacaacatgagaagactgagcctgagccccaccttcagcatgggcttccacctgctggtgaccgtgagcctgctgttcagccacgtggaccacgtgatcgccgagaccgagatggagggcgagggcaacgagaccggcgagtgcaccggcagctactactgcaagaagggcgtgatcctgcccatctgggagccccaggaccccagcttcggcgacaagatcgccagagccaccgtgtacttcgtggccatggtgtacatgttcctgggcgtgagcatcatcgccgacagattcatgagcagcatcgaggtgatcaccagccaggagaaggagatcaccatcaagaagcccaacggcgagaccaccaagaccaccgtgagaatctggaacgagaccgtgagcaacctgacctag

SEQ ID NO: 100254 - DNA, 2907 bp, Artificial Sequence; identical to SEQ ID NO: 100243
  Description of Artificial Sequence: Synthetic coding sequence

SEQ ID NO: 100255 - DNA, 2766 bp, Artificial Sequence
  Description of Artificial Sequence: Synthetic coding sequence
atggcccccctggccctggtgggcgtgaccctgctgctggccgcccccccctgcagcggcgccgccacccccacccccagcctgccccccccccccgccaacgacagcgacaccagcaccggcggctgccagggcagctacagatgccagcccggcgtgctgctgcccgtgtgggagcccgacgaccccagcctgggcgacaaggccgccagagccgtggtgtacttcgtggccatggtgtacatgttcctgggcgtgagcatcatcgccgacagattcatggccgccatcgaggtgatcaccagcaaggagaaggagatcaccatcaccaaggccaacggcgagaccagcgtgggcaccgtgagaatctggaacgagaccgtgagcaacctgaccctgatggccctgggcagcagcgcccccgagatcctgctgagcgtgatcgaggtgtgcggccacaacttccaggccggcgagctgggccccggcaccatcgtgggcagcgccgccttcaacatgttcgtggtgatcgccgtgtgcatctacgtgatccccgccggcgagagcagaaagatcaagcacctgagagtgttcttcgtgaccgccagctggagcatcttcgcctacgtgtggctgtacctgatcctggccgtgttcagccccggcgtggtgcaggtgtgggaggccctgctgaccctggtgttcttccccgtgtgcgtggtgttcgcctggatggccgacaagagactgctgttctacaagtacgtgtacaagagatacagaaccgaccccagaagcggcatcatcatcggcgccgagggcgacccccccaagagcatcgagctggacggcaccttcgtgggcgccgaggcccccggcgagctgggcggcctgggccccggccccgccgaggccagagagctggacgccagcagaagagaggtgatccagatcctgaaggacctgaagcagaagcaccccgacaaggacctggagcagctggtgggcatcgccaactactacgccctgctgcaccagcagaagagcagagccttctacagaatccaggccaccagactgatgaccggcgccggcaacgtgctgagaagacacgccgccgacgccagcagaagagccgcccccgccgagggcgccggcgaggacgaggacgacggcgccagcagaatcttcttcgagcccagcctgtaccactgcctggagaactgcggcagcgtgctgctgagcgtgacctgccagggcggcgagggcaacagcaccttctacgtggactacagaaccgaggacggcagcgccaaggccggcagcgactacgagtacagcgagggcaccctggtgttcaagcccggcgagacccagaaggagctgagaatcggcatcatcgacgacgacatcttcgaggaggacgagcacttcttcgtgagactgctgaacctgagagtgggcgacgcccagggcatgttcgagcccgacggcggcggcagacccaagggcagactggtggcccccctgctggccaccgtgaccatcctggacgacgaccacgccggcatcttcagcttccaggacagactgctgcacgtgagcgagtgcatgggcaccgtggacgtgagagtggtgagaagcagcggcgccagaggcaccgtgagactgccctacagaaccgtggacggcaccgccagaggcggcggcgtgcactacgaggacgcctgcggcgagctggagttcggcgacgacgagaccatgaagaccctgcaggtgaagatcgtggacgacgaggagtacgagaagaaggacaacttcttcatcgagctgggccagccccagtggctgaagagaggcatcagcgccctgctgctgaaccagggcgacggcgacagaaagctgaccgccgaggaggaggaggccagaagaatcgccgagatgggcaagcccgtgctgggcgagaactgcagactggaggtgatcatcgaggagagctacgacttcaagaacaccgtggacaagctgatcaagaagaccaacctggccctggtgatcggcacccacagctggagagagcagttcctggaggccatcaccgtgagcgccggcgacgaggaggaggaggaggacggcagcagagaggagagactgcccagctgcttcgactacgtgatgcacttcctgaccgtgttctggaaggtgctgttcgcctgcgtgccccccaccgagtactgccacggctgggcctgcttcggcgtgagcatcctggtgatcggcctgctgaccgccctgatcggcgacctggccagccacttcggctgcaccgtgggcctgaaggacagcgtgaacgccgtggtgttcgtggccctgggcaccagcatccccgacaccttcgccagcaaggtggccgccctgcaggaccagtgcgccgacgccagcatcggcaacgtgaccggcagcaacgccgtgaacgtgttcctgggcctgggcgtggcctggagcgtggccgccgtgtactgggccgtgcagggcagacccttcgaggtgagaaccggcaccctggccttcagcgtgaccctgttcaccgtgttcgccttcgtgggcatcgccgtgctgctgtacagaagaagaccccacatcggcggcgagctgggcggccccagaggccccaagctggccaccaccgccctgttcctgggcctgtggctgctgtacatcctgttcgccagcctggaggcctactgccacatcagaggcttctag

SEQ ID NO: 100256 - DNA, 2478 bp, Artificial Sequence
  Description of Artificial Sequence: Synthetic coding sequence
atgttcgtggtgatcgccgtgtgcatctacgtgatccccgccggcgagagcagaaagatcaagcacctgagagtgttcttcgtgaccgccagctggagcatcttcgcctacgtgtggctgtacctgatcctggccgtgttcagccccggcgtggtgcaggtgtgggaggccctgctgaccctggtgttcttccccgtgtgcgtggtgttcgcctggatggccgacaagagactgctgttctacaagtacgtgtacaagagatacagaaccgaccccagaagcggcatcatcatcggcgccgagggcgacccccccaagagcatcgagctggacggcaccttcgtgggcgccgaggcccccggcgagctgggcggcctgggccccggccccgccgaggccagagagctggacgccagcagaagagaggtgatccagatcctgaaggacctgaagcagaagcaccccgacaaggacctggagcagctggtgggcatcgccaactactacgccctgctgcaccagcagaagagcagagccttctacagaatccaggccaccagactgatgaccggcgccggcaacgtgctgagaagacacgccgccgacgccagcagaagagccgcccccgccgagggcgccggcgaggacgaggacgacggcgccagcagaatcttcttcgagcccagcctgtaccactgcctggagaactgcggcagcgtgctgctgagcgtgacctgccagggcggcgagggcaacagcaccttctacgtggactacagaaccgaggacggcagcgccaaggccggcagcgactacgagtacagcgagggcaccctggtgttcaagcccggcgagacccagaaggagctgagaatcggcatcatcgacgacgacatcttcgaggaggacgagcacttcttcgtgagactgctgaacctgagagtgggcgacgcccagggcatgttcgagcccgacggcggcggcagacccaagggcagactggtggcccccctgctggccaccgtgaccatcctggacgacgaccacgccggcatcttcagcttccaggacagactgctgcacgtgagcgagtgcatgggcaccgtggacgtgagagtggtgagaagcagcggcgccagaggcaccgtgagactgccctacagaaccgtggacggcaccgccagaggcggcggcgtgcactacgaggacgcctgcggcgagctggagttcggcgacgacgagaccatgaagaccctgcaggtgaagatcgtggacgacgaggagtacgagaagaaggacaacttcttcatcgagctgggccagccccagtggctgaagagaggcatcagcgccctgctgctgaaccagggcgacggcgacagaaagctgaccgccgaggaggaggaggccagaagaatcgccgagatgggcaagcccgtgctgggcgagaactgcagactggaggtgatcatcgaggagagctacgacttcaagaacaccgtggacaagctgatcaagaagaccaacctggccctggtgatcggcacccacagctggagagagcagttcctggaggccatcaccgtgagcgccggcgacgaggaggaggaggaggacggcagcagagaggagagactgcccagctgcttcgactacgtgatgcacttcctgaccgtgttctggaaggtgctgttcgcctgcgtgccccccaccgagtactgccacggctgggcctgcttcggcgtgagcatcctggtgatcggcctgctgaccgccctgatcggcgacctggccagccacttcggctgcaccgtgggcctgaaggacagcgtgaacgccgtggtgttcgtggccctgggcaccagcatccccggcaacaccctgggcgacttcggcggcgtgggcagccagatgagccaggccggcgccacccaggaccccgccaagatgagacacgtgagacagcagggcggcggcgccgccggccccgtgagaagaagagtgcacagacagagagacagactgcagagaggcgagagagtgccctggcccggcagaagactggtgtgcggcagaagagtgctgggcggcgccggcccccccctgagaggcgcccactggcacgccggcctgctgagacacgccctgcacagactgagactgagaggccactgcagagccgccgtgcccgcccccgccgcccacagaagaagagccggcagacccgccagaacccaggccagacaccacagagccctgcccggccccctggcccccgtgcaccccctgagacagcccggcggcgtgctgccccaccccggcctgctgggccccagagccgagaccagaccccacagaccccccggcgccagagacagcgccgcccccgccctgggcccctggagccccttcccccccagactgggcctgctgagctgggacagcgccagcctgctgagacccctgccctggctgtag

SEQ ID NO: 100257 - DNA, 1155 bp, Artificial Sequence
  Description of Artificial Sequence: Synthetic coding sequence
atgggcaccgtggacgtgagagtggtgagaagcagcggcgccagaggcaccgtgagactgccctacagaaccgtggacggcaccgccagaggcggcggcgtgcactacgaggacgcctgcggcgagctggagttcggcgacgacgagaccatgaagaccctgcaggtgaagatcgtggacgacgaggagtacgagaagaaggacaacttcttcatcgagctgggccagccccagtggctgaagagaggcatcagcgccctgctgctgaaccagggcgacggcgacagaaagctgaccgccgaggaggaggaggccagaagaatcgccgagatgggcaagcccgtgctgggcgagaactgcagactggaggtgatcatcgaggagagctacgacttcaagaacaccgtggacaagctgatcaagaagaccaacctggccctggtgatcggcacccacagctggagagagcagttcctggaggccatcaccgtgagcgccggcgacgaggaggaggaggaggacggcagcagagaggagagactgcccagctgcttcgactacgtgatgcacttcctgaccgtgttctggaaggtgctgttcgcctgcgtgccccccaccgagtactgccacggctgggcctgcttcggcgtgagcatcctggtgatcggcctgctgaccgccctgatcggcgacctggccagccacttcggctgcaccgtgggcctgaaggacagcgtgaacgccgtggtgttcgtggccctgggcaccagcatccccgacaccttcgccagcaaggtggccgccctgcaggaccagtgcgccgacgccagcatcggcaacgtgaccggcagcaacgccgtgaacgtgttcctgggcctgggcgtggcctggagcgtggccgccgtgtactgggccgtgcagggcagacccttcgaggtgagaaccggcaccctggccttcagcgtgaccctgttcaccgtgttcgccttcgtgggcatcgccgtgctgctgtacagaagaagaccccacatcggcggcgagctgggcggccccagaggccccaagctggccaccaccgccctgttcctgggcctgtggctgctgtacatcctgttcgccagcctggaggcctactgccacatcagaggcttctag

SEQ ID NO: 100258 - DNA, 2034 bp, Artificial Sequence
  Description of Artificial Sequence: Synthetic coding sequence
atggccgacaagagactgctgttctacaagtacgtgtacaagagatacagaaccgaccccagaagcggcatcatcatcggcgccgagggcgacccccccaagagcatcgagctggacggcaccttcgtgggcgccgaggcccccggcgagctgggcggcctgggccccggccccgccgaggccagagagctggacgccagcagaagagaggtgatccagatcctgaaggacctgaagcagaagcaccccgacaaggacctggagcagctggtgggcatcgccaactactacgccctgctgcaccagcagaagagcagagccttctacagaatccaggccaccagactgatgaccggcgccggcaacgtgctgagaagacacgccgccgacgccagcagaagagccgcccccgccgagggcgccggcgaggacgaggacgacggcgccagcagaatcttcttcgagcccagcctgtaccactgcctggagaactgcggcagcgtgctgctgagcgtgacctgccagggcggcgagggcaacagcaccttctacgtggactacagaaccgaggacggcagcgccaaggccggcagcgactacgagtacagcgagggcaccctggtgttcaagcccggcgagacccagaaggagctgagaatcggcatcatcgacgacgacatcttcgaggaggacgagcacttcttcgtgagactgctgaacctgagagtgggcgacgcccagggcatgttcgagcccgacggcggcggcagacccaagggcagactggtggcccccctgctggccaccgtgaccatcctggacgacgaccacgccggcatcttcagcttccaggacagactgctgcacgtgagcgagtgcatgggcaccgtggacgtgagagtggtgagaagcagcggcgccagaggcaccgtgagactgccctacagaaccgtggacggcaccgccagaggcggcggcgtgcactacgaggacgcctgcggcgagctggagttcggcgacgacgagaccatgaagaccctgcaggtgaagatcgtggacgacgaggagtacgagaagaaggacaacttcttcatcgagctgggccagccccagtggctgaagagaggcatcagcgccctgctgctgaaccagggcgacggcgacagaaagctgaccgccgaggaggaggaggccagaagaatcgccgagatgggcaagcccgtgctgggcgagaactgcagactggaggtgatcatcgaggagagctacgacttcaagaacaccgtggacaagctgatcaagaagaccaacctggccctggtgatcggcacccacagctggagagagcagttcctggaggccatcaccgtgagcgccggcgacgaggaggaggaggaggacggcagcagagaggagagactgcccagctgcttcgactacgtgatgcacttcctgaccgtgttctggaaggtgctgttcgcctgcgtgccccccaccgagtactgccacggctgggcctgcttcggcgtgagcatcctggtgatcggcctgctgaccgccctgatcggcgacctggccagccacttcggctgcaccgtgggcctgaaggacagcgtgaacgccgtggtgttcgtggccctgggcaccagcatccccgacaccttcgccagcaaggtggccgccctgcaggaccagtgcgccgacgccagcatcggcaacgtgaccggcagcaacgccgtgaacgtgttcctgggcctgggcgtggcctggagcgtggccgccgtgtactgggccgtgcagggcagacccttcgaggtgagaaccggcaccctggccttcagcgtgaccctgttcaccgtgttcgccttcgtgggcatcgccgtgctgctgtacagaagaagaccccacatcggcggcgagctgggcggccccagaggccccaagctggccaccaccgccctgttcctgggcctgtggctgctgtacatcctgttcgccagcctggaggcctactgccacatcagaggcttctag

SEQ ID NO: 100259 - DNA, 2448 bp, Artificial Sequence
  Description of Artificial Sequence: Synthetic coding sequence
atggtgctgagaagcggcatctgcggcctgagcccccacagaatcttccccagcctgctggtggtggtggccctggtgggcctgctgcccgtgctgagaagccacggcctgcagctgagccccaccgccagcaccatcagaagcagcgagccccccagagagagaagcatcggcgacgtgaccaccgccccccccgaggtgacccccgagagcagacccgtgaaccacagcgtgaccgaccacggcatgaagcccagaaaggccttccccgtgctgggcatcgactacacccacgtgagaacccccttcgagatcagcctgtggatcctgctggcctgcctgatgaagatcggcttccacgtgatccccaccatcagcagcatcgtgcccgagagctgcctgctgatcgtggtgggcctgctggtgggcggcctgatcaagggcgtgggcgagaccccccccttcctgcagagcgacgtgttcttcctgttcctgctgccccccatcatcctggacgccggctacttcctgcccctgagacagttcaccgagaacctgggcaccatcctgatcttcgccgtggtgggcaccctgtggaacgccttcttcctgggcggcctgatgtacgccgtgtgcctggtgggcggcgagcagatcaacaacatcggcctgctggacaacctgctgttcggcagcatcatcagcgccgtggaccccgtggccgtgctggccgtgttcgaggagatccacatcaacgagctgctgcacatcctggtgttcggcgagagcctgctgaacgacgccgtgaccgtggtgctgtaccacctgttcgaggagttcgccaactacgagcacgtgggcatcgtggacatcttcctgggcttcctgagcttcttcgtggtggccctgggcggcgtgctggtgggcgtggtgtacggcgtgatcgccgccttcaccagcagattcaccagccacatcagagtgatcgagcccctgttcgtgttcctgtacagctacatggcctacctgagcgccgagctgttccacctgagcggcatcatggccctgatcgccagcggcgtggtgatgagaccctacgtggaggccaacatcagccacaagagccacaccaccatcaagtacttcctgaagatgtggagcagcgtgagcgagaccctgatcttcatcttcctgggcgtgagcaccgtggccggcagccaccactggaactggaccttcgtgatcagcaccctgctgttctgcctgatcgccagagtgctgggcgtgctgggcctgacctggttcatcaacaagttcagaatcgtgaagctgacccccaaggaccagttcatcatcgcctacggcggcctgagaggcgccatcgccttcagcctgggctacctgctggacaagaagcacttccccatgtgcgacctgttcctgaccgccatcatcaccgtgatcttcttcaccgtgttcgtgcagggcatgaccatcagacccctggtggacctgctggccgtgaagaagaagcaggagaccaagagaagcatcaacgaggagatccacacccagttcctggaccacctgctgaccggcatcgaggacatctgcggccactacggccaccaccactggaaggacaagctgaacagattcaacaagaagtacgtgaagaagtgcctgatcgccggcgagagaagcaaggagccccagctgatcgccttctaccacaagatggagatgaagcaggccatcgagctggtggagagcggcggcatgggcaagatccccagcgccgtgagcaccgtgagcatgcagaacatccaccccaagagcctgcccagcgagagaatcctgcccgccctgagcaaggacaaggaggaggagatcagaaagatcctgagaaacaacctgcagaagaccagacagagactgagaagctacaacagacacaccctggtggccgacccctacgaggaggcctggaaccagatgctgctgagaagacagaaggccagacagctggagcagaagatcaacaactacctgaccgtgcccgcccacaagctggacagccccaccatgagcagagccagaatcggcagcgaccccctggcctacgagcccaaggaggacctgcccgtgatcaccatcgaccccgccagcccccagagccccgagagcgtggacctggtgaacgaggagctgaagggcaaggtgctgggcctgagcagagaccccgccaaggtggccgaggaggacgaggacgacgacggcggcatcatgatgagaagcaaggagaccagcagccccggcaccgacgacgtgttcacccccgcccccagcgacagccccagcagccagagaatccagagatgcctgagcgaccccggcccccaccccgagcccggcgagggcgagcccttcttccccaagggccagtag

SEQ ID NO: 100260 - DNA, 408 bp, Artificial Sequence
  Description of Artificial Sequence: Synthetic coding sequence
atggtgctgagaagcggcatctgcggcctgagcccccacagaatcttccccagcctgctggtggtggtggccctggtgggcctgctgcccgtgctgagaagccacggcctgcagctgagccccaccgccagcaccatcagaagcagcgagccccccagagagagaagcatcggcgacgtgaccaccgccccccccgaggtgacccccgagagcagacccgtgaaccacagcgtgaccgaccacggcatgaagcccagaaaggccttccccgtgctgggcatcgactacacccacgtgagaacccccttcgagatcagcctgtggatcctgctggcctgcctgatgaagatcggcttcccctgcgacccccactacctgaagcacagacccggcgagctgcccgcctag

SEQ ID NO: 100261 - DNA, 1668 bp, Artificial Sequence
  Description of Artificial Sequence: Synthetic coding sequence
atggtgctgagaagcggcatctgcggcctgagcccccacagaatcttccccagcctgctggtggtggtggccctggtgggcctgctgcccgtgctgagaagccacggcctgcagctgagccccaccgccagcaccatcagaagcagcgagccccccagagagagaagcatcggcgacgtgaccaccgccccccccgaggtgacccccgagagcagacccgtgaaccacagcgtgaccgaccacggcatgaagcccagaaaggccttccccgtgctgggcatcgactacacccacgtgagaacccccttcgagatcagcctgtggatcctgctggcctgcctgatgaagatcggcttccacgtgatccccaccatcagcagcatcgtgcccgagagctgcctgctgatcgtggtgggcctgctggtgggcggcctgatcaagggcgtgggcgagaccccccccttcctgcagagcgacgtgttcttcctgttcctgctgccccccatcatcctggacgccggctacttcctgcccctgagacagttcaccgagaacctgggcaccatcctgatcttcgccgtggtgggcaccctgtggaacgccttcttcctgggcggcctgatgtacgccgtgtgcctggtgggcggcgagcagatcaacaacatcggcctgctggacaacctgctgttcggcagcatcatcagcgccgtggaccccgtggccgtgctggccgtgttcgaggagatccacatcaacgagctgctgcacatcctggtgttcggcgagagcctgctgaacgacgccgtgaccgtggtgctgtaccacctgttcgaggagttcgccaactacgagcacgtgggcatcgtggacatcttcctgggcttcctgagcttcttcgtggtggccctgggcggcgtgctggtgggcgtggtgtacggcgtgatcgccgccttcaccagcagattcaccagccacatcagagtgatcgagcccctgttcgtgttcctgtacagctacatggcctacctgagcgccgagctgttccacctgagcggcatcatggccctgatcgccagcggcgtggtgatgagaccctacgtggaggccaacatcagccacaagagccacaccaccatcaagtacttcctgaagatgtggagcagcgtgagcgagaccctgatcttcatcttcctgggcgtgagcaccgtggccggcagccaccactggaactggaccttcgtgatcagcaccctgctgttctgcctgatcgccagagtgctgggcgtgctgggcctgacctggttcatcaacaagttcagaatcgtgaagctgacccccaaggaccagttcatcatcgcctacggcggcctgagaggcgccatcgccttcagcctgggctacctgctggacaagaagcacttccccatgtgcgacctgttcctgaccgccatcatcaccgtgatcttcttcaccgtgttcgtgcaggtgctgggccagggcagagccggcccctgcctgggcgacccccacagactgttcccctggaaggagagaaaggcctgcgacctgaagtgcgacagcagccccagcagcaccaccaacctgctgtgcgacctgggcagagccaccccccccttctgggccagcgtgagcagcatcgtgaagtag

SEQ ID NO: 100262 - DNA, 960 bp, Artificial Sequence
  Description of Artificial Sequence: Synthetic coding sequence
atgaccatcagacccctggtggacctgctggccgtgaagaagaagcaggagaccaagagaagcatcaacgaggagatccacacccagttcctggaccacctgctgaccggcatcgaggacatctgcggccactacggccaccaccactggaaggacaagctgaacagattcaacaagaagtacgtgaagaagtgcctgatcgccggcgagagaagcaaggagccccagctgatcgccttctaccacaagatggagatgaagcaggccatcgagctggtggagagcggcggcatgggcaagatccccagcgccgtgagcaccgtgagcatgcagaacatccaccccaagagcctgcccagcgagagaatcctgcccgccctgagcaaggacaaggaggaggagatcagaaagatcctgagaaacaacctgcagaagaccagacagagactgagaagctacaacagacacaccctggtggccgacccctacgaggaggcctggaaccagatgctgctgagaagacagaaggccagacagctggagcagaagatcaacaactacctgaccgtgcccgcccacaagctggacagccccaccatgagcagagccagaatcggcagcgaccccctggcctacgagcccaaggaggacctgcccgtgatcaccatcgaccccgccagcccccagagccccgagagcgtggacctggtgaacgaggagctgaagggcaaggtgctgggcctgagcagagaccccgccaaggtggccgaggaggacgaggacgacgacggcggcatcatgatgagaagcaaggagaccagcagccccggcaccgacgacgtgttcacccccgcccccagcgacagccccagcagccagagaatccagagatgcctgagcgaccccggcccccaccccgagcccggcgagggcgagcccttcttccccaagggccagtag

SEQ ID NO: 100263 - DNA, 675 bp, Artificial Sequence
  Description of Artificial Sequence: Synthetic coding sequence
atggagatgaagcaggccatcgagctggtggagagcggcggcatgggcaagatccccagcgccgtgagcaccgtgagcatgcagaacatccaccccaagagcctgcccagcgagagaatcctgcccgccctgagcaaggacaaggaggaggagatcagaaagatcctgagaaacaacctgcagaagaccagacagagactgagaagctacaacagacacaccctggtggccgacccctacgaggaggcctggaaccagatgctgctgagaagacagaaggccagacagctggagcagaagatcaacaactacctgaccgtgcccgcccacaagctggacagccccaccatgagcagagccagaatcggcagcgaccccctggcctacgagcccaaggaggacctgcccgtgatcaccatcgaccccgccagcccccagagccccgagagcgtggacctggtgaacgaggagctgaagggcaaggtgctgggcctgagcagagaccccgccaaggtggccgaggaggacgaggacgacgacggcggcatcatgatgagaagcaaggagaccagcagccccggcaccgacgacgtgttcacccccgcccccagcgacagccccagcagccagagaatccagagatgcctgagcgaccccggcccccaccccgagtag

SEQ ID NO: 100264 - DNA, 1431 bp, Artificial Sequence
  Description of Artificial Sequence: Synthetic coding sequence
atggcctacctgagcgccgagctgttccacctgagcggcatcatggccctgatcgccagcggcgtggtgatgagaccctacgtggaggccaacatcagccacaagagccacaccaccatcaagtacttcctgaagatgtggagcagcgtgagcgagaccctgatcttcatcttcctgggcgtgagcaccgtggccggcagccaccactggaactggaccttcgtgatcagcaccctgctgttctgcctgatcgccagagtgctgggcgtgctgggcctgacctggttcatcaacaagttcagaatcgtgaagctgacccccaaggaccagttcatcatcgcctacggcggcctgagaggcgccatcgccttcagcctgggctacctgctggacaagaagcacttccccatgtgcgacctgttcctgaccgccatcatcaccgtgatcttcttcaccgtgttcgtgcagggcatgaccatcagacccctggtggacctgctggccgtgaagaagaagcaggagaccaagagaagcatcaacgaggagatccacacccagttcctggaccacctgctgaccggcatcgaggacatctgcggccactacggccaccaccactggaaggacaagctgaacagattcaacaagaagtacgtgaagaagtgcctgatcgccggcgagagaagcaaggagccccagctgatcgccttctaccacaagatggagatgaagcaggccatcgagctggtggagagcggcggcatgggcaagatccccagcgccgtgagcaccgtgagcatgcagaacatccaccccaagagcctgcccagcgagagaatcctgcccgccctgagcaaggacaaggaggaggagatcagaaagatcctgagaaacaacctgcagaagaccagacagagactgagaagctacaacagacacaccctggtggccgacccctacgaggaggcctggaaccagatgctgctgagaagacagaaggccagacagctggagcagaagatcaacaactacctgaccgtgcccgcccacaagctggacagccccaccatgagcagagccagaatcggcagcgaccccctggcctacgagcccaaggaggacctgcccgtgatcaccatcgaccccgccagcccccagagccccgagagcgtggacctggtgaacgaggagctgaagggcaaggtgctgggcctgagcagagaccccgccaaggtggccgaggaggacgaggacgacgacggcggcatcatgatgagaagcaaggagaccagcagccccggcaccgacgacgtgttcacccccgcccccagcgacagccccagcagccagagaatccagagatgcctgagcgaccccggcccccaccccgagcccggcgagggcgagcccttcttccccaagggccagtag

SEQ ID NO: 100265 - DNA, 1626 bp, Artificial Sequence; identical to SEQ ID NO: 85598
  Description of Artificial Sequence: Synthetic coding sequence

SEQ ID NO: 100266 - DNA, 2505 bp, Artificial Sequence
  Description of Artificial Sequence: Synthetic coding sequence
atgtggggcctgggcgccagaggccccgacagaggcctgctgctggccctggccctgggcggcctggccagagccggcggcgtggaggtggagcccggcggcgcccacggcgagagcggcggcttccaggtggtgaccttcgagtgggcccacgtgcaggacccctacgtgatcgccctgtggatcctggtggccagcctggccaagatcggcttccacctgagccacaaggtgaccagcgtggtgcccgagagcgccctgctgatcgtgctgggcctggtgctgggcggcatcgtgtgggccgccgaccacatcgccagcttcaccctgacccccaccgtgttcttcttctacctgctgccccccatcgtgctggacgccggctacttcatgcccaacagactgttcttcggcaacctgggcaccatcctgctgtacgccgtggtgggcaccgtgtggaacgccgccaccaccggcctgagcctgtacggcgtgttcctgagcggcctgatgggcgacctgcagatcggcctgctggacttcctgctgttcggcagcctgatggccgccgtggaccccgtggccgtgctggccgtgttcgaggaggtgcacgtgaacgaggtgctgttcatcatcgtgttcggcgagagcctgctgaacgacgccgtgaccgtggtgctgtacaacgtgttcgagagcttcgtggccctgggcggcgacaacgtgaccggcgtggactgcgtgaagggcatcgtgagcttcttcgtggtgagcctgggcggcaccctggtgggcgtggtgttcgccttcctgctgagcctggtgaccagattcaccaagcacgtgagaatcatcgagcccggcttcgtgttcatcatcagctacctgagctacctgaccagcgagatgctgagcctgagcgccatcctggccatcaccttctgcggcatctgctgccagaagtacgtgaaggccaacatcagcgagcagagcgccaccaccgtgagatacaccatgaagatgctggccagcagcgccgagaccatcatcttcatgttcctgggcatcagcgccgtgaaccccttcatctggacctggaacaccgccttcgtgctgctgaccctggtgttcatcagcgtgtacagagccatcggcgtggtgctgcagacctggctgctgaacagatacagaatggtgcagctggagcccatcgaccaggtggtgctgagctacggcggcctgagaggcgccgtggccttcgccctggtggtgctgctggacggcgacaaggtgaaggagaagaacctgttcgtgagcaccaccatcatcgtggtgttcttcaccgtgatcttccagggcctgaccatcaagcccctggtgcagtggctgaaggtgaagagaagcgagcacagagagcccagactgaacgagaagctgcacggcagagccttcgaccacatcctgagcgccatcgaggacatcagcggccagatcggccacaactacctgagagacaagtggagccacttcgacagaaagttcctgagcagagtgctgatgagaagaagcgcccagaagagcagagacagaatcctgaacgtgttccacgagctgaacctgaaggacgccatcagctacgtggccgagggcgagagaagaggcagcctggccttcatcagaagccccagcaccgacaacgtggtgaacgtggacttcacccccagaagcagcaccgtggaggccagcgtgagctacctgctgagagagaacgtgagcgccgtgtgcctggacatgcagagcctggagcagagaagaagaagcatcagagacgccgaggacatggtgacccaccacaccctgcagcagtacctgtacaagcccagacaggagtacaagcacctgtacagcagacacgagctgacccccaccgaggacgagaagcaggacagagagatcttccacagaaccatgagaaagagactggagagcttcaagagcaccaagctgggcctgaaccagaacaagaaggccgccaagctgtacaagagagagagagcccagaagagaagaaacagcagcatccccaacggcaagctgcccatggagagccccgcccagaacttcaccatcaaggagaaggacctggagctgagcgacaccgaggagccccccaactacgacgaggagatgagcggcggcatcgagttcctggccagcgtgaccaaggacaccgccagcgacagccccgccggcatcgacaaccccgtgttcagccccgacgaggccctggacagaagcctgctggccagactgcccccctggctgagccccggcgagaccgtggtgcccagccagagagccagaacccagatcccctacagccccggcaccttctgcagactgatgcccttcagactgagcagcaagagcgtggacagcttcctgcaggccgacggccccgaggagagaccccccgccgccctgcccgagagcacccacatgtag

SEQ ID NO: 100267 - DNA, 1077 bp, Artificial Sequence
  Description of Artificial Sequence: Synthetic coding sequence
atgagcgccgacgccgccgccggcgcccccctgcccagactgtgctgcctggagaagggccccaacggctacggcttccacctgcacggcgagaagggcaagctgggccagtacatcagactggtggagcccggcagccccgccgagaaggccggcctgctggccggcgacagactggtggaggtgaacggcgagaacgtggagaaggagacccaccagcaggtggtgagcagaatcagagccgccctgaacgccgtgagactgctggtggtggaccccgagaccgacgagcagctgcagaagctgggcgtgcaggtgagagaggagctgctgagagcccaggaggcccccggccaggccgagccccccgccgccgccgaggtgcagggcgccggcaacgagaacgagcccagagaggccgacaagagccaccccgagcagagagagctgagacccagactgtgcaccatgaagaagggccccagcggctacggcttcaacctgcacagcgacaagagcaagcccggccagttcatcagaagcgtggaccccgacagccccgccgaggccagcggcctgagagcccaggacagaatcgtggaggtgaacggcgtgtgcatggagggcaagcagcacggcgacgtggtgagcgccatcagagccggcggcgacgagaccaagctgctggtggtggacagagagaccgacgagttcttcaagaagtgcagagtgatccccagccaggagcacctgaacggccccctgcccgtgcccttcaccaacggcgagatccagaaggagaacagcagagaggccctggccgaggccgccctggagagccccagacccgccctggtgagaagcgccagcagcgacaccagcgaggagctgaacagccaggacagcccccccaagcaggacagcaccgcccccagcagcaccagcagcagcgaccccatcctggacttcaacatcagcctggccatggccaaggagagagcccaccagaagagaagcagcaagagagccccccagatggactggagcaagaagaacgagctgttcagcaacctgtag

SEQ ID NO: 100268 - DNA, 822 bp, Artificial Sequence
  Description of Artificial Sequence: Synthetic coding sequence
atgagcgccgacgccgccgccggcgcccccctgcccagactgtgctgcctggagaaggagacccaccagcaggtggtgagcagaatcagagccgccctgaacgccgtgagactgctggtggtggaccccgagaccgacgagcagctgcagaagctgggcgtgcaggtgagagaggagctgctgagagcccaggaggcccccggccaggccgagccccccgccgccgccgaggtgcagggcgccggcaacgagaacgagcccagagaggccgacaagagccaccccgagcagagagagctgagacccagactgtgcaccatgaagaagggccccagcggctacggcttcaacctgcacagcgacaagagcaagcccggccagttcatcagaagcgtggaccccgacagccccgccgaggccagcggcctgagagcccaggacagaatcgtggaggtgaacggcgtgtgcatggagggcaagcagcacggcgacgtggtgagcgccatcagagccggcggcgacggcagcggcggcggcaaccagagaggcgccgagttccccagacagccccccaagaccggcctgcacagcgccctggtgtacctgctgctgagaccccaccccagactgcagcacctgcccggccacggccagagagagggcccccccgagacccagcagcagaccggccccgccgacggcctggagcaggagaagagaaccctgcagcagcccctgagcgccctgctgccccccagcgactggcagggcagagccagcatccccccccacctgttccccagcccccagctgctgccctag

SEQ ID NO: 100269 - DNA, 1014 bp, Artificial Sequence
  Description of Artificial Sequence: Synthetic coding sequence
atggccgcccccgagcccctgagacccagactgtgcagactggtgagaggcgagcagggctacggcttccacctgcacggcgagaagggcagaagaggccagttcatcagaagagtggagcccggcagccccgccgaggccgccgccctgagagccggcgacagactggtggaggtgaacggcgtgaacgtggagggcgagacccaccaccaggtggtgcagagaatcaaggccgtggagggccagaccagactgctggtggtggaccaggagaccgacgaggagctgagaagaagacagctgacctgcaccgaggagatggcccagagaggcctgccccccgcccacgacccctgggagcccaagcccgactgggcccacaccggcagccacagcagcgaggccggcaagaaggacgtgagcggccccctgagagagctgagacccagactgtgccacctgagaaagggcccccagggctacggcttcaacctgcacagcgacaagagcagacccggccagtacatcagaagcgtggaccccggcagccccgccgccagaagcggcctgagagcccaggacagactgatcgaggtgaacggccagaacgtggagggcctgagacacgccgaggtggtggccagcatcaaggccagagaggacgaggccagactgctggtggtggaccccgagaccgacgagcacttcaagagactgagagtgacccccaccgaggagcacgtggagggccccctgcccagccccgtgaccaacggcaccagccccgcccagctgaacggcggcagcgcctgcagcagcagaagcgacctgcccggcagcgacaaggacaccgaggacggcagcgcctggaagcaggaccccttccaggagagcggcctgcacctgagccccaccgccgccgaggccaaggagaaggccagagccatgagagtgaacaagagagccccccagatggactggaacagaaagagagagatcttcagcaacttctag

SEQ ID NO: 100270 - DNA, 981 bp, Artificial Sequence
  Description of Artificial Sequence: Synthetic coding sequence
atggccgcccccgagcccctgagacccagactgtgcagactggtgagaggcgagcagggctacggcttccacctgcacggcgagaagggcagaagaggccagttcatcagaagagtggagcccggcagccccgccgaggccgccgccctgagagccggcgacagactggtggaggtgaacggcgtgaacgtggagggcgagacccaccaccaggtggtgcagagaatcaaggccgtggagggccagaccagactgctggtggtggaccaggagaccgacgaggagctgagaagaagacagctgacctgcaccgaggagatggcccagagaggcctgccccccgcccacgacccctgggagcccaagcccgactgggcccacaccggcagccacagcagcgaggccggcaagaaggacgtgagcggccccctgagagagctgagacccagactgtgccacctgagaaagggcccccagggctacggcttcaacctgcacagcgacaagagcagacccggccagtacatcagaagcgtggaccccggcagccccgccgccagaagcggcctgagagcccaggacagactgatcgaggtgaacggccagaacgtggagggcctgagacacgccgaggtggtggccagcatcaaggccagagaggacgaggccagactgctggtggtggaccccgagaccgacgagcacttcaagagactgagagtgacccccaccgaggagcacgtggagggccccctgcccagccccgtgaccaacggcaccagccccgcccagctgaacggcggcagcgcctgcagcagcagaagcgacctgcccggcagcgacaaggacaccgaggagagcggcctgcacctgagccccaccgccgccgaggccaaggagaaggccagagccatgagagtgaacaagagagccccccagatggactggaacagaaagagagagatcttcagcaacttctag

SEQ ID NO: 100271 - DNA, 2397 bp, Artificial Sequence
  Description of Artificial Sequence: Synthetic coding sequence
atggccctgcagatgttcgtgacctacagcccctggaactgcctgctgctgctggtggccctggagtgcagcgaggccagcagcgacctgaacgagagcgccaacagcaccgcccagtacgccagcaacgcctggttcgccgccgccagcagcgagcccgaggagggcatcagcgtgttcgagctggactacgactacgtgcagatcccctacgaggtgaccctgtggatcctgctggccagcctggccaagatcggcttccacctgtaccacagactgcccggcctgatgcccgagagctgcctgctgatcctggtgggcgccctggtgggcggcatcatcttcggcaccgaccacaagagcccccccgtgatggacagcagcatctacttcctgtacctgctgccccccatcgtgctggagggcggctacttcatgcccaccagacccttcttcgagaacatcggcagcatcctgtggtgggccgtgctgggcgccctgatcaacgccctgggcatcggcctgagcctgtacctgatctgccaggtgaaggccttcggcctgggcgacgtgaacctgctgcagaacctgctgttcggcagcctgatcagcgccgtggaccccgtggccgtgctggccgtgttcgaggaggccagagtgaacgagcagctgtacatgatgatcttcggcgaggccctgctgaacgacggcatcaccgtggtgctgtacaacatgctgatcgccttcaccaagatgcacaagttcgaggacatcgagaccgtggacatcctggccggctgcgccagattcatcgtggtgggcctgggcggcgtgctgttcggcatcgtgttcggcttcatcagcgccttcatcaccagattcacccagaacatcagcgccatcgagcccctgatcgtgttcatgttcagctacctgagctacctggccgccgagaccctgtacctgagcggcatcctggccatcaccgcctgcgccgtgaccatgaagaagtacgtggaggagaacgtgagccagaccagctacaccaccatcaagtacttcatgaagatgctgagcagcgtgagcgagaccctgatcttcatcttcatgggcgtgagcaccgtgggcaagaaccacgagtggaactgggccttcatctgcttcaccctggccttctgccagatctggagagccatcagcgtgttcgccctgttctacatcagcaaccagttcagaaccttccccttcagcatcaaggaccagtgcatcatcttctacagcggcgtgagaggcgccggcagcttcagcctggccttcctgctgcccctgagcctgttccccagaaagaagatgttcgtgaccgccaccctggtggtgatctacttcaccgtgttcatccagggcatcaccgtgggccccctggtgagatacctggacgtgaagaagaccaacaagaaggagagcatcaacgaggagctgcacatcagactgatggaccacctgaaggccggcatcgaggacgtgtgcggccactggagccactaccaggtgagagacaagttcaagaagttcgaccacagatacctgagaaagatcctgatcagaaagaacctgcccaagagcagcatcgtgagcctgtacaagaagctggagatgaagcaggccatcgagatggtggagaccggcatcctgagcagcaccgccttcagcatcccccaccaggcccagagaatccagggcatcaagagactgagccccgaggacgtggagagcatcagagacatcctgaccagcaacatgtaccaggtgagacagagaaccctgagctacaacaagtacaacctgaagccccagaccagcgagaagcaggccaaggagatcctgatcagaagacagaacaccctgagagagagcatgagaaagggccacagcctgccctggggcaagcccgccggcaccaagaacatcagatacctgagctacccctacggcaacccccagagcgccggcagagacaccagagccgccggcttcagcgacgacgacagcagcgaccccggcagccccagcatcaccttcagcgcctgcagcagaatcggcagcctgcagaagcaggaggcccaggagatcatccccatgaagagcctgcacagaggcagaaaggccttcagcttcggctaccagagaaacaccagccaggaggagtacctgggcggcgtgagaagagtggccctgagacccaagcccctgttccacgccgtggacgaggagggcgagagcggcggcgagagcgagggcaaggccagcctggtggaggtgagaagcagatggaccgccgaccacggccacggcagagaccaccacagaagccacagccccctgctgcagaagaagtag

SEQ ID NO: 100272 - DNA, 2691 bp, Artificial Sequence
  Description of Artificial Sequence: Synthetic coding sequence
atgctgagagccgccctgagcctgctggccctgcccctggccggcgccgccgaggagcccacccagaagcccgagagccccggcgagcccccccccggcctggagctgttcagatggcagtggcacgaggtggaggccccctacctggtggccctgtggatcctggtggccagcctggccaagatcgtgttccacctgagcagaaaggtgaccagcctggtgcccgagagctgcctgctgatcctgctgggcctggtgctgggcggcatcgtgctggccgtggccaagaaggccgagtaccagctggagcccggcaccttcttcctgttcctgctgccccccatcgtgctggacagcggctacttcatgcccagcagactgttcttcgacaacctgggcgccatcctgacctacgccgtggtgggcaccctgtggaacgccttcaccaccggcgccgccctgtggggcctgcagcaggccggcctggtggcccccagagtgcaggccggcctgctggacttcctgctgttcggcagcctgatcagcgccgtggaccccgtggccgtgctggccgtgttcgaggaggtgcacgtgaacgagaccctgttcatcatcgtgttcggcgagagcctgctgaacgacgccgtgaccgtggtgctgtacaaggtgtgcaacagcttcgtggagatgggcagcgccaacgtgcaggccaccgactacctgaagggcgtggccagcctgttcgtggtgagcctgggcggcgccgccgtgggcctggtgttcgccttcctgctggccctgaccaccagattcaccaagagagtgagaatcatcgagcccctgctggtgttcctgctggcctacgccgcctacctgaccgccgagatggccagcctgagcgccatcctggccgtgaccatgtgcggcctgggctgcaagaagtacgtggaggccaacatcagccacaagagcagaaccaccgtgaagtacaccatgaagaccctggccagctgcgccgagaccgtgatcttcatgctgctgggcatcagcgccgtggacagcagcaagtgggcctgggacagcggcctggtgctgggcaccctgatcttcatcctgttcttcagagccctgggcgtggtgctgcagacctgggtgctgaaccagttcagactggtgcccctggacaagatcgaccaggtggtgatgagctacggcggcctgagaggcgccgtggccttcgccctggtgatcctgctggacagaaccaaggtgcccgccaaggactacttcgtggccaccaccatcgtggtggtgttcttcaccgtgatcgtgcagggcctgaccatcaagcccctggtgaagtggctgaaggtgaagagaagcgagcaccacaagcccaccctgaaccaggagctgcacgagcacaccttcgaccacatcctggccgccgtggaggacgtggtgggccaccacggctaccactactggagagacagatgggagcagttcgacaagaagtacctgagccagctgctgatgagaagaagcgcctacagaatcagagaccagatctgggacgtgtactacagactgaacatcagagacgccatcagcttcgtggaccagggcggccacgtgctgagcagcaccggcctgaccctgcccagcatgcccagcagaaacagcgtggccgagaccagcgtgaccaacctgctgagagagagcggcagcggcgcctgcctggacctgcaggtgatcgacaccgtgagaagcggcagagacagagaggacgccgtgatgcaccacctgctgtgcggcggcctgtacaagcccagaagaagatacaaggccagctgcagcagacacttcatcagcgaggacgcccaggagagacaggacaaggaggtgttccagcagaacatgaagagaagactggagagcttcaagagcaccaagcacaacatctgcttcaccaagagcaagcccagacccagaaagaccggcagaagaaagaaggacggcgtggccaacgccgaggccaccaacggcaagcacagaggcctgggcttccaggacaccgccgccgtgatcctgaccgtggagagcgaggaggaggaggaggagagcgacagcagcgagaccgagaaggaggacgacgagggcatcatcttcgtggccagagccaccagcgaggtgctgcaggagggcaaggtgagcggcagcctggaggtgtgccccagccccagaatcatcccccccagccccacctgcgccgagaaggagctgccctggaagagcggccagggcgacctggccgtgtacgtgagcagcgagaccaccaagatcgtgcccgtggacatgcagaccggctggaaccagagcatcagcagcctggagagcctggccagccccccctgcaaccaggcccccatcctgacctgcctgcccccccaccccagaggcaccgaggagccccaggtgcccctgcacctgcccagcgaccccagaagcagcttcgccttcccccccagcctggccaaggccggcagaagcagaagcgagagcagcgccgacctgccccagcagcaggagctgcagcccctgatgggccacaaggaccacacccacctgagccccggcaccgccaccagccactggtgcatccagttcaacagaggcagcagactgtag

SEQ ID NO: 100273 - DNA, 1308 bp, Artificial Sequence
  Description of Artificial Sequence: Synthetic coding sequence
atgagaagaagcgcctacagaatcagagaccagatctgggacgtgtactacagactgaacatcagagacgccatcagcttcgtggaccagggcggccacgtgctgagcagcaccggcctgaccctgcccagcatgcccagcagaaacagcgtggccgagaccagcgtgaccaacctgctgagagagagcggcagcggcgcctgcctggacctgcaggtgatcgacaccgtgagaagcggcagagacagagaggacgccgtgatgcaccacctgctgtgcggcggcctgtacaagcccagaagaagaatcgagctgagaaccgagccctgcggcatgctgctgaagaccttcctgcagaccgacatggaccaggccttcctgggcaccaagcccgccgccgtggccaccagcagccagagaatgagaagaagcggcagaaccagaagaagcagcagcagaatgaagagaagactggagagcttcaagagcaccaagcacaacatctgcttcaccaagagcaagcccagacccagaaagaccggcagaagaaagaaggacggcgtggccaacgccgaggccaccaacggcaagcacagaggcctgggcttccaggacaccgccgccgtgatcctgaccgtggagagcgaggaggaggaggaggagagcgacagcagcgagaccgagaaggaggacgacgagggcatcatcttcgtggccagagccaccagcgaggtgctgcaggagggcaaggtgagcggcagcctggaggtgtgccccagccccagaatcatcccccccagccccacctgcgccgagaaggagctgccctggaagagcggccagggcgacctggccgtgtacgtgagcagcgagaccaccaagatcgtgcccgtggacatgcagaccggctggaaccagagcatcagcagcctggagagcctggccagccccccctgcaaccaggcccccatcctgacctgcctgcccccccaccccagaggcaccgaggagccccaggtgcccctgcacctgcccagcgaccccagaagcagcttcgccttcccccccagcctggccaaggccggcctggccgtgagagccgccctgaccagccccagcagcagaagctgcagccccagctgggccaccagaaccacccccatcagcgcccaggcccccctgccccccaccggcgccagcagcagcaccgaggccgccggctgcagcagcagacccagaggcggcgccggcggcggcatccccgtgggcagcgccccctgggtgatgggcagagccctggagacctag

SEQ ID NO: 100274 - DNA, 2106 bp, Artificial Sequence
  Description of Artificial Sequence: Synthetic coding sequence
atggccagaagaggctggagaagagcccccctgagaagaggcgtgggcagcagccccagagccagaagactgatgagacccctgtggctgctgctggccgtgggcgtgttcgactgggccggcgccagcgacggcggcggcggcgaggccagagccatggacgaggagatcgtgagcgagaagcaggccgaggagagccacagacaggacagcgccaacctgctgatcttcatcctgctgctgaccctgaccatcctgaccatctggctgttcaagcacagaagagccagattcctgcacgagaccggcctggccatgatctacggcctgctggtgggcctggtgctgagatacggcatccacgtgcccagcgacgtgaacaacgtgaccctgagctgcgaggtgcagagcagccccaccaccctgctggtgaacgtgagcggcaagttctacgagtacatgctgaagggcgagatcagcagccacgagctgaacaacgtgcaggacaacgagatgctgagaaaggtgaccttcgaccccgaggtgttcttcaacatcctgctgccccccatcatcttctacgccggctacagcctgaagagaagacacttcttcagaaacctgggcagcatcctggcctacgccttcctgggcaccgccatcagctgcttcgtgatcggcagcatcatgtacggctgcgtgaccctgatgaaggtgaccggccagctggccggcgacttctacttcaccgactgcctgctgttcggcgccatcgtgagcgccaccgaccccgtgaccgtgctggccatcttccacgagctgcaggtggacgtggagctgtacgccctgctgttcggcgagagcgtgctgaacgacgccgtggccatcgtgctgagcagcagcatcgtggcctaccagcccgccggcgacaacagccacaccttcgacgtgaccgccatgttcaagagcatcggcatcttcctgggcatcttcagcggcagcttcgccatgggcgccgccaccggcgtggtgaccgccctggtgaccaagttcaccaagctgagagagttccagctgctggagaccggcctgttcttcctgatgagctggagcaccttcctgctggccgaggcctggggcttcaccggcgtggtggccgtgctgttctgcggcatcacccaggcccactacacctacaacaacctgagcaccgagagccagcacagaaccaagcagctgttcgagctgctgaacttcctggccgagaacttcatcttcagctacatgggcctgaccctgttcaccttccagaaccacgtgttcaaccccaccttcgtggtgggcgccttcgtggccatcttcctgggcagagccgccaacatctaccccctgagcctgctgctgaacctgggcagaagaagcaagatcggcagcaacttccagcacatgatgatgttcgccggcctgagaggcgccatggccttcgccctggccatcagagacaccgccacctacgccagacagatgatgttcagcaccaccctgctgatcgtgttcttcaccgtgtgggtgttcggcggcggcaccaccgccatgctgagctgcctgcacatcagagtgggcgtggacagcgaccaggagcacctgggcgtgcccgagaacgagagaagaaccaccaaggccgagagcgcctggctgttcagaatgtggtacaacttcgaccacaactacctgaagcccctgctgacccacagcggcccccccctgaccaccaccctgcccgcctgctgcggccccatcgccagatgcctgaccagcccccaggcctacgagaaccaggagcagctgaaggacgacgacagcgacctgatcctgaacgacggcgacatcagcctgacctacggcgacagcaccgtgaacaccgagcccgccaccagcagcgcccccagaagattcatgggcaacagcagcgaggacgccctggacagagagctggccttcggcgaccacgagctggtgatcagaggcaccagactggtgctgcccatggacgacagcgagccccccctgaacctgctggacaacaccagacacggccccgcctag

SEQ ID NO: 100275 - DNA, 2010 bp, Artificial Sequence
  Description of Artificial Sequence: Synthetic coding sequence
atggccagaagaggctggagaagagcccccctgagaagaggcgtgggcagcagccccagagccagaagactgatgagacccctgtggctgctgctggccgtgggcgtgttcgactgggccggcgccagcgacggcggcggcggcgaggccagagccatggacgaggagatcgtgagcgagaagcaggccgaggagagccacagacaggacagcgccaacctgctgatcttcatcctgctgctgaccctgaccatcctgaccatctggctgttcaagcacagaagagccagattcctgcacgagaccggcctggccatgatctacggcctgctggtgggcctggtgctgagatacggcatccacgtgcccagcgacgtgaacaacgtgaccctgagctgcgaggtgcagagcagccccaccaccctgctggtgaccttcgaccccgaggtgttcttcaacatcctgctgccccccatcatcttctacgccggctacagcctgaagagaagacacttcttcagaaacctgggcagcatcctggcctacgccttcctgggcaccgccatcagctgcttcgtgatcggcagcatcatgtacggctgcgtgaccctgatgaaggtgaccggccagctggccggcgacttctacttcaccgactgcctgctgttcggcgccatcgtgagcgccaccgaccccgtgaccgtgctggccatcttccacgagctgcaggtggacgtggagctgtacgccctgctgttcggcgagagcgtgctgaacgacgccgtggccatcgtgctgagcagcagcatcgtggcctaccagcccgccggcgacaacagccacaccttcgacgtgaccgccatgttcaagagcatcggcatcttcctgggcatcttcagcggcagcttcgccatgggcgccgccaccggcgtggtgaccgccctggtgaccaagttcaccaagctgagagagttccagctgctggagaccggcctgttcttcctgatgagctggagcaccttcctgctggccgaggcctggggcttcaccggcgtggtggccgtgctgttctgcggcatcacccaggcccactacacctacaacaacctgagcaccgagagccagcacagaaccaagcagctgttcgagctgctgaacttcctggccgagaacttcatcttcagctacatgggcctgaccctgttcaccttccagaaccacgtgttcaaccccaccttcgtggtgggcgccttcgtggccatcttcctgggcagagccgccaacatctaccccctgagcctgctgctgaacctgggcagaagaagcaagatcggcagcaacttccagcacatgatgatgttcgccggcctgagaggcgccatggccttcgccctggccatcagagacaccgccacctacgccagacagatgatgttcagcaccaccctgctgatcgtgttcttcaccgtgtgggtgttcggcggcggcaccaccgccatgctgagctgcctgcacatcagagtgggcgtggacagcgaccaggagcacctgggcgtgcccgagaacgagagaagaaccaccaaggccgagagcgcctggctgttcagaatgtggtacaacttcgaccacaactacctgaagcccctgctgacccacagcggcccccccctgaccaccaccctgcccgcctgctgcggccccatcgccagatgcctgaccagcccccaggcctacgagaaccaggagcagctgaaggacgacgacagcgacctgatcctgaacgacggcgacatcagcctgacctacggcgacagcaccgtgaacaccgagcccgccaccagcagcgcccccagaagattcatgggcaacagcagcgaggacgccctggacagagagctggccttcggcgaccacgagctggtgatcagaggcaccagactggtgctgcccatggacgacagcgagccccccctgaacctgctggacaacaccagacacggccccgcctag

SEQ ID NO: 100276 - DNA, 1950 bp, Artificial Sequence
  Description of Artificial Sequence: Synthetic coding sequence
atggacgaggagatcgtgagcgagaagcaggccgaggagagccacagacaggacagcgccaacctgctgatcttcatcctgctgctgaccctgaccatcctgaccatctggctgttcaagcacagaagagccagattcctgcacgagaccggcctggccatgatctacggcctgctggtgggcctggtgctgagatacggcatccacgtgcccagcgacgtgaacaacgtgaccctgagctgcgaggtgcagagcagccccaccaccctgctggtgaacgtgagcggcaagttctacgagtacatgctgaagggcgagatcagcagccacgagctgaacaacgtgcaggacaacgagatgctgagaaaggtgaccttcgaccccgaggtgttcttcaacatcctgctgccccccatcatcttctacgccggctacagcctgaagagaagacacttcttcagaaacctgggcagcatcctggcctacgccttcctgggcaccgccatcagctgcttcgtgatcggcagcatcatgtacggctgcgtgaccctgatgaaggtgaccggccagctggccggcgacttctacttcaccgactgcctgctgttcggcgccatcgtgagcgccaccgaccccgtgaccgtgctggccatcttccacgagctgcaggtggacgtggagctgtacgccctgctgttcggcgagagcgtgctgaacgacgccgtggccatcgtgctgagcagcagcatcgtggcctaccagcccgccggcgacaacagccacaccttcgacgtgaccgccatgttcaagagcatcggcatcttcctgggcatcttcagcggcagcttcgccatgggcgccgccaccggcgtggtgaccgccctggtgaccaagttcaccaagctgagagagttccagctgctggagaccggcctgttcttcctgatgagctggagcaccttcctgctggccgaggcctggggcttcaccggcgtggtggccgtgctgttctgcggcatcacccaggcccactacacctacaacaacctgagcaccgagagccagcacagaaccaagcagctgttcgagctgctgaacttcctggccgagaacttcatcttcagctacatgggcctgaccctgttcaccttccagaaccacgtgttcaaccccaccttcgtggtgggcgccttcgtggccatcttcctgggcagagccgccaacatctaccccctgagcctgctgctgaacctgggcagaagaagcaagatcggcagcaacttccagcacatgatgatgttcgccggcctgagaggcgccatggccttcgccctggccatcagagacaccgccacctacgccagacagatgatgttcagcaccaccctgctgatcgtgttcttcaccgtgtgggtgttcggcggcggcaccaccgccatgctgagctgcctgcacatcagagtgggcgtggacagcgaccaggagcacctgggcgtgcccgagaacgagagaagaaccaccaaggccgagagcgcctggctgttcagaatgtggtacaacttcgaccacaactacctgaagcccctgctgacccacagcggcccccccctgaccaccaccctgcccgcctgctgcggccccatcgccagatgcctgaccagcccccaggcctacgagaaccaggagcagctgaaggacgacgacagcgacctgatcctgaacgacggcgacatcagcctgacctacggcgacagcaccgtgaacaccgagcccgccaccagcagcgcccccagaagattcatgggcaacagcagcgaggacgccctggacagagagctggccttcggcgaccacgagctggtgatcagaggcaccagactggtgctgcccatggacgacagcgagccccccctgaacctgctggacaacaccagacacggccccgcctag

SEQ ID NO: 100277 - DNA, 2178 bp, Artificial Sequence
  Description of Artificial Sequence: Synthetic coding sequence
atggagcccggcgacgccgccagacccggcagcggcagagccaccggcgcccccccccccagactgctgctgctgcccctgctgctgggctggggcctgagagtggccgccgccgccagcgccagcagcagcggcgccgccgccgaggacagcagcgccatggaggagctggccaccgagaaggaggccgaggagagccacagacaggacagcgtgagcctgctgaccttcatcctgctgctgaccctgaccatcctgaccatctggctgttcaagcacagaagagtgagattcctgcacgagaccggcctggccatgatctacggcctgatcgtgggcgtgatcctgagatacggcacccccgccaccagcggcagagacaagagcctgagctgcacccaggaggacagagccttcagcaccctgctggtgaacgtgagcggcaagttcttcgagtacaccctgaagggcgagatcagccccggcaagatcaacagcgtggagcagaacgacatgctgagaaaggtgaccttcgaccccgaggtgttcttcaacatcctgctgccccccatcatcttccacgccggctacagcctgaagaagagacacttcttcagaaacctgggcagcatcctggcctacgccttcctgggcaccgccgtgagctgcttcatcatcggcaacctgatgtacggcgtggtgaagctgatgaagatcatgggccagctgagcgacaagttctactacaccgactgcctgttcttcggcgccatcatcagcgccaccgaccccgtgaccgtgctggccatcttcaacgagctgcacgccgacgtggacctgtacgccctgctgttcggcgagagcgtgctgaacgacgccgtggccatcgtgctgagcagcagcatcgtggcctaccagcccgccggcctgaacacccacgccttcgacgccgccgccttcttcaagagcgtgggcatcttcctgggcatcttcagcggcagcttcaccatgggcgccgtgaccggcgtgaacgccaacgtgaccaagttcaccaagctgcactgcttccccctgctggagaccgccctgttcttcctgatgagctggagcaccttcctgctggccgaggcctgcggcttcaccggcgtggtggccgtgctgttctgcggcatcacccaggcccactacacctacaacaacctgagcgtggagagcagaagcagaaccaagcagctgttcgaggtgctgcacttcctggccgagaacttcatcttcagctacatgggcctggccctgttcaccttccagaagcacgtgttcagccccatcttcatcatcggcgccttcgtggccatcttcctgggcagagccgcccacatctaccccctgagcttcttcctgaacctgggcagaagacacaagatcggctggaacttccagcacatgatgatgttcagcggcctgagaggcgccatggccttcgccctggccatcagagacaccgccagctacgccagacagatgatgttcaccaccaccctgctgatcgtgttcttcaccgtgtggatcatcggcggcggcaccacccccatgctgagctggctgaacatcagagtgggcgtggaggagcccagcgaggaggaccagaacgagcaccactggcagtacttcagagtgggcgtggaccccgaccaggaccccccccccaacaacgacagcttccaggtgctgcagggcgacggccccgacagcgccagaggcaacagaaccaagcaggagagcgcctggatcttcagactgtggtacagcttcgaccacaactacctgaagcccatcctgacccacagcggcccccccctgaccaccaccctgcccgcctggtgcggcctgctggccagatgcctgaccagcccccaggtgtacgacaaccaggagcccctgagagaggaggacagcgacttcatcctgaccgagggcgacctgaccctgacctacggcgacagcaccgtgaccgccaacggcagcagcagcagccacaccgccagcaccagcctggagggcagcagaagaaccaagagcagcagcgaggaggtgctggagagagacctgggcatgggcgaccagaaggtgagcagcagaggcaccagactggtgttccccctggaggacaacgcctag

SEQ ID NO: 100278 - DNA, 1746 bp, Artificial Sequence
  Description of Artificial Sequence: Synthetic coding sequence
atgggcgagaagatggccgaggaggagagattccccaacaccacccacgagggcttcaacgtgaccctgcacaccaccctggtggtgaccaccaagctggtgctgcccacccccggcaagcccatcctgcccgtgcagaccggcgagcaggcccagcaggaggagcagagcagcggcatgaccatcttcttcagcctgctggtgctggccatctgcatcatcctggtgcacctgctgatcagatacagactgcacttcctgcccgagagcgtggccgtggtgagcctgggcatcctgatgggcgccgtgatcaagatcatcgagttcaagaagctggccaactggaaggaggaggagatgttcagacccaacatgttcttcctgctgctgctgccccccatcatcttcgagagcggctacagcctgcacaagggcaacttcttccagaacatcggcagcatcaccctgttcgccgtgttcggcaccgccatcagcgccttcgtggtgggcggcggcatctacttcctgggccaggccgacgtgatcagcaagctgaacatgaccgacagcttcgccttcggcagcctgatcagcgccgtggaccccgtggccaccatcgccatcttcaacgccctgcacgtggaccccgtgctgaacatgctggtgttcggcgagagcatcctgaacgacgccgtgagcatcgtgctgaccaacaccgccgagggcctgaccagaaagaacatgagcgacgtgagcggctggcagaccttcctgcaggccctggactacttcctgaagatgttcttcggcagcgccgccctgggcaccctgaccggcctgatcagcgccctggtgctgaagcacatcgacctgagaaagacccccagcctggagttcggcatgatgatcatcttcgcctacctgccctacggcctggccgagggcatcagcctgagcggcatcatggccatcctgttcagcggcatcgtgatgagccactacacccaccacaacctgagccccgtgacccagatcctgatgcagcagaccctgagaaccgtggccttcctgtgcgagacctgcgtgttcgccttcctgggcctgagcatcttcagcttcccccacaagttcgagatcagcttcgtgatctggtgcatcgtgctggtgctgttcggcagagccgtgaacatcttccccctgagctacctgctgaacttcttcagagaccacaagatcacccccaagatgatgttcatcatgtggttcagcggcctgagaggcgccatcccctacgccctgagcctgcacctggacctggagcccatggagaagagacagctgatcggcaccaccaccatcgtgatcgtgctgttcaccatcctgctgctgggcggcagcaccatgcccctgatcagactgatggacatcgaggacgccaaggcccacagaagaaacaagaaggacgtgaacctgagcaagaccgagaagatgggcaacaccgtggagagcgagcacctgagcgagctgaccgaggaggagtacgaggcccactacatcagaagacaggacctgaagggcttcgtgtggctggacgccaagtacctgaaccccttcttcaccagaagactgacccaggaggacctgcaccacggcagaatccagatgaagaccctgaccaacaagtggtacgaggaggtgagacagggccccagcggcagcgaggacgacgagcaggagctgctgtag

SEQ ID NO: 100279 - DNA, 1794 bp, Artificial Sequence
  Description of Artificial Sequence: Synthetic coding sequence
atgggcgagaagatggccgaggaggagagattccccaacaccacccacgagggcttcaacgtgaccctgcacaccaccctggtggtgaccaccaagctggtgctgcccacccccggcaagcccatcctgcccgtgcagaccggcgagcaggcccagcaggaggagcagagcagcggcatgaccatcttcttcagcctgctggtgctggccatctgcatcatcctggtgcacctgctgatcagatacagactgcacttcctgcccgagagcgtggccgtggtgagcctgggcatcctgatgggcgccgtgatcaagatcatcgagttcaagaagctggccaactggaaggaggaggagatgttcagacccaacatgttcttcctgctgctgctgccccccatcatcttcgagagcggctacagcctgcacaagggcaacttcttccagaacatcggcagcatcaccctgttcgccgtgttcggcaccgccatcagcgccttcgtggtgggcggcggcatctacttcctgggccagggcttcttcttcgtgtgcgtgtgcgtgttcgtgtgcttcatcctgcaggccgacgtgatcagcaagctgaacatgaccgacagcttcgccttcggcagcctgatcagcgccgtggaccccgtggccaccatcgccatcttcaacgccctgcacgtggaccccgtgctgaacatgctggtgttcggcgagagcatcctgaacgacgccgtgagcatcgtgctgaccaacaccgccgagggcctgaccagaaagaacatgagcgacgtgagcggctggcagaccttcctgcaggccctggactacttcctgaagatgttcttcggcagcgccgccctgggcaccctgaccggcctgatcagcgccctggtgctgaagcacatcgacctgagaaagacccccagcctggagttcggcatgatgatcatcttcgcctacctgccctacggcctggccgagggcatcagcctgagcggcatcatggccatcctgttcagcggcatcgtgatgagccactacacccaccacaacctgagccccgtgacccagatcctgatgcagcagaccctgagaaccgtggccttcctgtgcgagacctgcgtgttcgccttcctgggcctgagcatcttcagcttcccccacaagttcgagatcagcttcgtgatctggtgcatcgtgctggtgctgttcggcagagccgtgaacatcttccccctgagctacctgctgaacttcttcagagaccacaagatcacccccaagatgatgttcatcatgtggttcagcggcctgagaggcgccatcccctacgccctgagcctgcacctggacctggagcccatggagaagagacagctgatcggcaccaccaccatcgtgatcgtgctgttcaccatcctgctgctgggcggcagcaccatgcccctgatcagactgatggacatcgaggacgccaaggcccacagaagaaacaagaaggacgtgaacctgagcaagaccgagaagatgggcaacaccgtggagagcgagcacctgagcgagctgaccgaggaggagtacgaggcccactacatcagaagacaggacctgaagggcttcgtgtggctggacgccaagtacctgaaccccttcttcaccagaagactgacccaggaggacctgcaccacggcagaatccagatgaagaccctgaccaacaagtggtacgaggaggtgagacagggccccagcggcagcgaggacgacgagcaggagctgctgtag

SEQ ID NO: 100280 - DNA, 1089 bp, Artificial Sequence
  Description of Artificial Sequence: Synthetic coding sequence
atgctggtgttcggcgagagcatcctgaacgacgccgtgagcatcgtgctgaccaacaccgccgagggcctgaccagaaagaacatgagcgacgtgagcggctggcagaccttcctgcaggccctggactacttcctgaagatgttcttcggcagcgccgccctgggcaccctgaccggcctgatcagcgccctggtgctgaagcacatcgacctgagaaagacccccagcctggagttcggcatgatgatcatcttcgcctacctgccctacggcctggccgagggcatcagcctgagcggcatcatggccatcctgttcagcggcatcgtgatgagccactacacccaccacaacctgagccccgtgacccagatcctgatgcagcagaccctgagaaccgtggccttcctgtgcgagacctgcgtgttcgccttcctgggcctgagcatcttcagcttcccccacaagttcgagatcagcttcgtgatctggtgcatcgtgctggtgctgttcggcagagccgtgaacatcttccccctgagctacctgctgaacttcttcagagaccacaagatcacccccaagatgatgttcatcatgtggttcagcggcctgagaggcgccatcccctacgccctgagcctgcacctggacctggagcccatggagaagagacagctgatcggcaccaccaccatcgtgatcgtgctgttcaccatcctgctgctgggcggcagcaccatgcccctgatcagactgatggacatcgaggacgccaaggcccacagaagaaacaagaaggacgtgaacctgagcaagaccgagaagatgggcaacaccgtggagagcgagcacctgagcgagctgaccgaggaggagtacgaggcccactacatcagaagacaggacctgaagggcttcgtgtggctggacgccaagtacctgaaccccttcttcaccagaagactgacccaggaggacctgcaccacggcagaatccagatgaagaccctgaccaacaagtggtacgaggaggtgagacagggccccagcggcagcgaggacgacgagcaggagctgctgtag

SEQ ID NO: 100281 - DNA, 846 bp, Artificial Sequence
  Description of Artificial Sequence: Synthetic coding sequence
atgatgatcatcttcgcctacctgccctacggcctggccgagggcatcagcctgagcggcatcatggccatcctgttcagcggcatcgtgatgagccactacacccaccacaacctgagccccgtgacccagatcctgatgcagcagaccctgagaaccgtggccttcctgtgcgagacctgcgtgttcgccttcctgggcctgagcatcttcagcttcccccacaagttcgagatcagcttcgtgatctggtgcatcgtgctggtgctgttcggcagagccgtgaacatcttccccctgagctacctgctgaacttcttcagagaccacaagatcacccccaagatgatgttcatcatgtggttcagcggcctgagaggcgccatcccctacgccctgagcctgcacctggacctggagcccatggagaagagacagctgatcggcaccaccaccatcgtgatcgtgctgttcaccatcctgctgctgggcggcagcaccatgcccctgatcagactgatggacatcgaggacgccaaggcccacagaagaaacaagaaggacgtgaacctgagcaagaccgagaagatgggcaacaccgtggagagcgagcacctgagcgagctgaccgaggaggagtacgaggcccactacatcagaagacaggacctgaagggcttcgtgtggctggacgccaagtacctgaaccccttcttcaccagaagactgacccaggaggacctgcaccacggcagaatccagatgaagaccctgaccaacaagtggtacgaggaggtgagacagggccccagcggcagcgaggacgacgagcaggagctgctgtag

SEQ ID NO: 100282 - DNA, 1938 bp, Artificial Sequence
  Description of Artificial Sequence: Synthetic coding sequence
atggagagacagagcagagtgatgagcgagaaggacgagtaccagttccagcaccagggcgccgtggagctgctggtgttcaacttcctgctgatcctgaccatcctgaccatctggctgttcaagaaccacagattcagattcctgcacgagaccggcggcgccatggtgtacggcctgatcatgggcctgatcctgagatacgccaccgcccccaccgacatcgagagcggcaccgtgtacgactgcgtgaagctgaccttcagccccagcaccctgctggtgaacatcaccgaccaggtgtacgagtacaagtacaagagagagatcagccagcacaacatcaacccccaccagggcaacgccatcctggagaagatgaccttcgaccccgagatcttcttcaacgtgctgctgccccccatcatcttccacgccggctacagcctgaagaagagacacttcttccagaacctgggcagcatcctgacctacgccttcctgggcaccgccatcagctgcatcgtgatcggcctgatcatgtacggcttcgtgaaggccatgatccacgccggccagctgaagaacggcgacttccacttcaccgactgcctgttcttcggcagcctgatgagcgccaccgaccccgtgaccgtgctggccatcttccacgagctgcacgtggaccccgacctgtacaccctgctgttcggcgagagcgtgctgaacgacgccgtggccatcgtgctgacctacagcatcagcatctacagccccaaggagaaccccaacgccttcgacgccgccgccttcttccagagcgtgggcaacttcctgggcatcttcgccggcagcttcgccatgggcagcgcctacgccatcatcaccgccctgctgaccaagttcaccaagctgtgcgagttccccatgctggagaccggcctgttcttcctgctgagctggagcgccttcctgagcgccgaggccgccggcctgaccggcatcgtggccgtgctgttctgcggcgtgacccaggcccactacacctacaacaacctgagcagcgacagcaagatcagaaccaagcagctgttcgagttcatgaacttcctggccgagaacgtgatcttctgctacatgggcctggccctgttcaccttccagaaccacatcttcaacgccctgttcatcctgggcgccttcctggccatcttcgtggccagagcctgcaacatctaccccctgagcttcctgctgaacctgggcagaaagcagaagatcccctggaacttccagcacatgatgatgttcagcggcctgagaggcgccatcgccttcgccctggccatcagaaacaccgagagccagcccaagcagatgatgttcaccaccaccctgctgctggtgttcttcaccgtgtgggtgttcggcggcggcaccacccccatgctgacctggctgcagatcagagtgggcgtggacctggacgagaacctgaaggaggaccccagcagccagcaccaggaggccaacaacctggacaagaacatgaccaaggccgagagcgccagactgttcagaatgtggtacagcttcgaccacaagtacctgaagcccatcctgacccacagcggcccccccctgaccaccaccctgcccgagtggtgcggccccatcagcagactgctgaccagcccccaggcctacggcgagcagctgaaggaggacgacgtggagtgcatcgtgaaccaggacgagctggccatcaactaccaggagcaggccagcagcccctgcagcccccccgccagactgggcctggaccagaaggccagcccccagacccccggcaaggagaacatctacgagggcgacctgggcctgggcggctacgagctgaagctggagcagaccctgggccagagccagctgaactag

SEQ ID NO: 100283 - DNA, 978 bp, Artificial Sequence
  Description of Artificial Sequence: Synthetic coding sequence
ctgagactgcagagcagctgggagcagatgaccttcgaccccgagatcttcttcaacgtgctgctgccccccatcatcttccacgccggctacagcctgaagaagagacacttcttccagaacctgggcagcatcctgacctacgccttcctgggcaccgccatcagctgcatcgtgatcggcctgatcatgtacggcttcgtgaaggccatgatccacgccggccagctgaagaacggcgacttccacttcaccgactgcctgttcttcggcagcctgatgagcgccaccgaccccgtgaccgtgctggccatcttccacgagctgcacgtggaccccgacctgtacaccctgctgttcggcgagagcgtgctgaacgacgccgtggccatcgtgctgacctacagcatcagcatctacagccccaaggagaaccccaacgccttcgacgccgccgccttcttccagagcgtgggcaacttcctgggcatcttcgccggcagcttcgccatgggcagcgcctacgccatcatcaccgccctgctgaccaagttcaccaagctgtgcgagttccccatgctggagaccggcctgttcttcctgctgagctggagcgccttcctgagcgccgaggccgccggcctgaccggcatcgtggccgtgctgttctgcggcgtgacccaggcccactacacctacaacaacctgagcagcgacagcaagatcagaaccaagcagctgttcgagttcatgaacttcctggccgagaacgtgatcttctgctacatgggcctggccctgttcaccttccagaaccacatcttcaacgccctgttcatcctgggcgccttcgtgagcatcttcctggccagagcccacaccgagctgaagaacctgctgttcttcctggccagcttcctgtgctacttcagccacagaagcaagggcctgcccatggccggctgcgccctgccctag

SEQ ID NO: 100284 - DNA, 3534 bp, Artificial Sequence
  Description of Artificial Sequence: Synthetic coding sequence
atggccggcatcttcaaggagttcttcttcagcaccgaggacctgcccgaggtgatcctgaccctgagcctgatcagcagcatcggcgccttcctgaacagacacctggaggacttccccatccccgtgcccgtgatcctgttcctgctgggctgcagcttcgaggtgctgagcttcaccagcagccaggtgcagagatacgccaacgccatccagtggatgagccccgacctgttcttcagaatcttcacccccgtggtgttcttcaccaccgccttcgacatggacacctacatgctgcagaagctgttctggcagatcctgctgatcagcatccccggcttcctggtgaactacatcctggtgctgtggcacctggccagcgtgaaccagctgctgctgaagcccacccagtggctgctgttcagcgccatcctggtgagcagcgaccccatgctgaccgccgccgccatcagagacctgggcctgagcagaagcctgatcagcctgatcaacggcgagagcctgatgaccagcgtgatcagcctgatcaccttcaccagcatcatggacttcgaccagagactgcagagcaagagaaaccacaccctggccgaggagatcgtgggcggcatctgcagctacatcatcgccagcttcctgttcggcatcctgagcagcaagctgatccagttctggatgagcaccgtgttcggcgacgacgtgaaccacatcagcctgatcttcagcatcctgtacctgatcttctacatctgcgagctggtgggcatgagcggcatcttcaccctggccatcgtgggcctgctgctgaacagcaccagcttcaaggccgccatcgaggagaccctgctgctggagttctggaccttcctgagcagaatcgccttcctgatggtgttcaccttcttcggcctgctgatccccgcccacacctacctgtacatcgagttcgtggacatctactacagcctgaacatctacctgaccctgatcgtgctgagattcctgaccctgctgctgatcagccccgtgctgagcagagtgggccacgagttcagctggagatggatcttcatcatggtgtgcagcgagatgaagggcatgcccaacatcaacatggccctgctgctggcctacagcgacctgtacttcggcagcgacaaggagaagagccagatcctgttccacggcgtgctggtgtgcctgatcaccctggtggtgaacagattcatcctgcccgtggccgtgaccatcctgggcctgagagacgccaccagcaccaagtacaagagcgtgtgctgcaccttccagcacttccaggagctgaccaagagcgccgccagcgccctgaagttcgacaaggacctggccaacgccgactggaacatgatcgagaaggccatcaccctggagaacccctacatgctgaacgaggaggagaccaccgagcaccagaaggtgaagtgcccccactgcaacaaggagatcgacgagatcttcaacaccgaggccatggagctggccaacagaagactgctgagcgcccagatcgccagctaccagagacagtacagaaacgagatcctgagccagagcgccgtgcaggtgctggtgggcgccgccgagagcttcggcgagaagaagggcaagtgcatgagcctggacaccatcaagaactacagcgagagccagaagaccgtgaccttcgccagaaagctgctgctgaactgggtgtacaacaccagaaaggagaaggagggccccagcaagtacttcttcttcagaatctgccacaccatcgtgttcaccgaggagttcgagcacgtgggctacctggtgatcctgatgaacatcttccccttcatcatcagctggatcagccagctgaacgtgatctaccacagcgagctgaagcacaccaactactgcttcctgaccctgtacatcctggaggccctgctgaagatcgccgccatgagaaaggacttcttcagccacgcctggaacatcttcgagctggccatcaccctgatcggcatcctgcacgtgatcctgatcgagatcgacaccatcaagtacatcttcaacgagaccgaggtgatcgtgttcatcaaggtggtgcagttcttcagaatcctgagaatcttcaagctgatcgcccccaagctgctgcagatcatcgacaagagaatgagccaccagaagaccttctggtacggcatcctgaagggctacgtgcagggcgaggccgacatcatgaccatcatcgaccagatcaccagcagcaagcagatcaagcagatgctgctgaagcaggtgatcagaaacatggagcacgccatcaaggagctgggctacctggagtacgaccaccccgagatcgccgtgaccgtgaagaccaaggaggagatcaacgtgatgctgaacatggccaccgagatcctgaaggccttcggcctgaagggcatcatcagcaagaccgagggcgccggcatcaacaagctgatcatggccaagaagaaggaggtgctggacagccagagcatcatcagacccctgaccgtggaggaggtgctgtaccacatcccctggctggacaagaacaaggactacatcaacttcatccaggagaaggccaaggtggtgaccttcgactgcggcaacgacatcttcgaggagggcgacgagcccaagggcatctacatcatcatcagcggcatggtgaagctggagaagagcaagcccggcctgggcatcgaccagatggtggagagcaaggagaaggacttccccatcatcgacaccgactacatgctgagcggcgagatcatcggcgagatcaactgcctgaccaacgagcccatgaagtacagcgccacctgcaagaccgtggtggagacctgcttcatccccaagacccacctgtacgacgccttcgagcagtgcagccccctgatcaagcagaagatgtggctgaagctgggcctggccatcaccgccagaaagatcagagagcacctgagctacgaggactggaactacaacatgcagctgaagctgagcaacatctacgtggtggacatccccatgagcaccaagaccgacatctacgacgagaacctgatctacgtgatcctgatccacggcgccgtggaggactgcctgctgagaaagacctacagagcccccttcctgatccccatcacctgccaccagatccagagcatcgaggacttcaccaaggtggtgatcatccagacccccatcaacatgaagaccttcagaagaaacatcagaaagttcgtgcccaagcacaagagctacctgacccccggcctgatcggcagcgtgggcaccctggaggagggcatccaggaggagagaaacgtgaaggaggacggcgcccacagcgccgccaccgccagaagcccccagccctgcagcctgctgggcaccaagttcaactgcaaggagagccccagaatcaacctgagaaaggtgagaaaggagtag

SEQ ID NO: 100285 - DNA, 3390 bp, Artificial Sequence
  Description of Artificial Sequence: Synthetic coding sequence
atggccggcatcttcaaggagttcttcttcagcaccgaggacctgcccgaggtgatcctgaccctgagcctgatcagcagcatcggcgccttcctgaacagacacctggaggacttccccatccccgtgcccgtgatcctgttcctgctgggctgcagcttcgaggtgctgagcttcaccagcagccaggtgcagagatacgccaacgccatccagtggatgagccccgacctgttcttcagaatcttcacccccgtggtgttcttcaccaccgccttcgacatggacacctacatgctgcagaagctgttctggcagatcctgctgatcagcatccccggcttcctggtgaactacatcctggtgctgtggcacctggccagcgtgaaccagctgctgctgaagcccacccagtggctgctgttcagcgccatcctggtgagcagcgaccccatgctgaccgccgccgccatcagagacctgggcctgagcagaagcctgatcagcctgatcaacggcgagagcctgatgaccagcgtgatcagcctgatcaccttcaccagcatcatggacttcgaccagagactgcagagcaagagaaaccacaccctggccgaggagatcgtgggcggcatctgcagctacatcatcgccagcttcctgttcggcatcctgagcagcaagctgatccagttctggatgagcaccgtgttcggcgacgacgtgaaccacatcagcctgatcttcagcatcctgtacctgatcttctacatctgcgagctggtgggcatgagcggcatcttcaccctggccatcgtgggcctgctgctgaacagcaccagcttcaaggccgccatcgaggagaccctgctgctggagttcctgaccctgctgctgatcagccccgtgctgagcagagtgggccacgagttcagctggagatggatcttcatcatggtgtgcagcgagatgaagggcatgcccaacatcaacatggccctgctgctggcctacagcgacctgtacttcggcagcgacaaggagaagagccagatcctgttccacggcgtgctggtgtgcctgatcaccctggtggtgaacagattcatcctgcccgtggccgtgaccatcctgggcctgagagacgccaccagcaccaagtacaagagcgtgtgctgcaccttccagcacttccaggagctgaccaagagcgccgccagcgccctgaagttcgacaaggacctggccaacgccgactggaacatgatcgagaaggccatcaccctggagaacccctacatgctgaacgaggaggagaccaccgagcaccagaaggtgaagtgcccccactgcaacaaggagatcgacgagatcttcaacaccgaggccatggagctggccaacagaagactgctgagcgcccagatcgccagctaccagagacagtacagaaacgagatcctgagccagagcgccgtgcaggtgctggtgggcgccgccgagagcttcggcgagaagaagggcaagtgcatgagcctggacaccatcaagaactacagcgagagccagaagaccgtgaccttcgccagaaagctgctgctgaactgggtgtacaacaccagaaaggagaaggagggccccagcaagtacttcttcttcagaatctgccacaccatcgtgttcaccgaggagttcgagcacgtgggctacctggtgatcctgatgaacatcttccccttcatcatcagctggatcagccagctgaacgtgatctaccacagcgagctgaagcacaccaactactgcttcctgaccctgtacatcctggaggccctgctgaagatcgccgccatgagaaaggacttcttcagccacgcctggaacatcttcgagctggccatcaccctgatcggcatcctgcacgtgatcctgatcgagatcgacaccatcaagtacatcttcaacgagaccgaggtgatcgtgttcatcaaggtggtgcagttcttcagaatcctgagaatcttcaagctgatcgcccccaagctgctgcagatcatcgacaagagaatgagccaccagaagaccttctggtacggcatcctgaagggctacgtgcagggcgaggccgacatcatgaccatcatcgaccagatcaccagcagcaagcagatcaagcagatgctgctgaagcaggtgatcagaaacatggagcacgccatcaaggagctgggctacctggagtacgaccaccccgagatcgccgtgaccgtgaagaccaaggaggagatcaacgtgatgctgaacatggccaccgagatcctgaaggccttcggcctgaagggcatcatcagcaagaccgagggcgccggcatcaacaagctgatcatggccaagaagaaggaggtgctggacagccagagcatcatcagacccctgaccgtggaggaggtgctgtaccacatcccctggctggacaagaacaaggactacatcaacttcatccaggagaaggccaaggtggtgaccttcgactgcggcaacgacatcttcgaggagggcgacgagcccaagggcatctacatcatcatcagcggcatggtgaagctggagaagagcaagcccggcctgggcatcgaccagatggtggagagcaaggagaaggacttccccatcatcgacaccgactacatgctgagcggcgagatcatcggcgagatcaactgcctgaccaacgagcccatgaagtacagcgccacctgcaagaccgtggtggagacctgcttcatccccaagacccacctgtacgacgccttcgagcagtgcagccccctgatcaagcagaagatgtggctgaagctgggcctggccatcaccgccagaaagatcagagagcacctgagctacgaggactggaactacaacatgcagctgaagctgagcaacatctacgtggtggacatccccatgagcaccaagaccgacatctacgacgagaacctgatctacgtgatcctgatccacggcgccgtggaggactgcctgctgagaaagacctacagagcccccttcctgatccccatcacctgccaccagatccagagcatcgaggacttcaccaaggtggtgatcatccagacccccatcaacatgaagaccttcagaagaaacatcagaaagttcgtgcccaagcacaagagctacctgacccccggcctgatcggcagcgtgggcaccctggaggagggcatccaggaggagagaaacgtgaaggaggacggcgcccacagcgccgccaccgccagaagcccccagccctgcagcctgctgggcaccaagttcaactgcaaggagagccccagaatcaacctgagaaaggtgagaaaggagtag

SEQ ID NO: 100286 - DNA, 2079 bp, Artificial Sequence
  Description of Artificial Sequence: Synthetic coding sequence
atgcagggcaagaagcccggcggcagcagcggcggcggcagaagcggcgagctgcagggcgacgaggcccagagaaacaagaagaagaagaagaaggtgagctgcttcagcaacatcaagatcttcctggtgagcgagtgcgccctgatgctggcccagggcaccgtgggcgcctacctggtgagcgtgctgaccaccctggagagaagattcaacctgcagagcgccgacgtgggcgtgatcgccagcagcttcgagatcggcaacctggccctgatcctgttcgtgagctacttcggcgccagaggccacagacccagactgatcggctgcggcggcatcgtgatggccctgggcgccctgctgagcgccctgcccgagttcctgacccaccagtacaagtacgaggccggcgagatcagatggggcgccgagggcagagacgtgtgcgccgccaacggcagcggcggcgacgagggccccgaccccgacctgatctgcagaaacagaaccgccaccaacatgatgtacctgctgctgatcggcgcccaggtgctgctgggcatcggcgccacccccgtgcagcccctgggcgtgagctacatcgacgaccacgtgagaagaaaggacagcagcctgtacatcggcatcctgttcaccatgctggtgttcggccccgcctgcggcttcatcctgggcagcttctgcaccaagatctacgtggacgccgtgttcatcgacaccagcaacctggacatcacccccgacgaccccagatggatcggcgcctggtggggcggcttcctgctgtgcggcgccctgctgttcttcagcagcctgctgatgttcggcttcccccagagcctgcccccccacagcgagcccgccatggagagcgagcaggccatgctgagcgagagagagtacgagagacccaagcccagcaacggcgtgctgagacaccccctggagcccgacagcagcgccagctgcttccagcagctgagagtgatccccaaggtgaccaagcacctgctgagcaaccccgtgttcacctgcatcatcctggccgcctgcatggagatcgccgtggtggccggcttcgccgccttcctgggcaagtacctggagcagcagttcaacctgaccaccagcagcgccaaccagctgctgggcatgaccgccatcccctgcgcctgcctgggcatcttcctgggcggcctgctggtgaagaagctgagcctgagcgccctgggcgccatcagaatggccatgctggtgaacctggtgagcaccgcctgctacgtgagcttcctgttcctgggctgcgacaccggccccgtggccggcgtgaccgtgccctacggcaacagcaccgcccccggcagcgccctggacccctacagcccctgcaacaacaactgcgagtgccagaccgacagcttcacccccgtgtgcggcgccgacggcatcacctacctgagcgcctgcttcgccggctgcaacagcaccaacctgaccggctgcgcctgcctgaccaccgtgcccgccgagaacgccaccgtggtgcccggcaagtgccccagccccggctgccaggaggccttcctgaccttcctgtgcgtgatgtgcatctgcagcctgatcggcgccatggcccagacccccagcgtgatcatcctgatcagaaccgtgagccccgagctgaagagctacgccctgggcgtgctgttcctgctgctgagactgctgggcttcatccccccccccctgatcttcggcgccggcatcgacagcacctgcctgttctggagcaccttctgcggcgagcagggcgcctgcgtgctgtacgacaacgtggtgtacagatacctgtacgtgagcatcgccatcgccctgaagagcttcgccttcatcctgtacaccaccacctggcagtgcctgagaaagaactacaagagatacatcaagaaccacgagggcggcctgagcaccagcaccgagtaccaggacatcgagaccgagaagacctgccccgagagccacagccccagcgaggacagcttcgtgagaagctag

SEQ ID NO: 100287 - DNA, 2076 bp, Artificial Sequence
  Description of Artificial Sequence: Synthetic coding sequence
atggaccagaaccagcacctgaacaagaccgccgaggcccagcccagcgagaacaagaagaccagatactgcaacggcctgaagatgttcctggccgccctgagcctgagcttcatcgccaagaccctgggcgccatcatcatgaagagcagcatcatccacatcgagagaagattcgagatcagcagcagcctggtgggcttcatcgacggcagcttcgagatcggcaacctgctggtgatcgtgttcgtgagctacttcggcagcaagctgcacagacccaagctgatcggcatcggctgcttcatcatgggcatcggcggcgtgctgaccgccctgccccacttcttcatgggctactacagatacagcaaggagaccaacatcaacagcagcgagaacagcaccagcaccctgagcacctgcctgatcaaccagatcctgagcctgaacagagccagccccgagatcgtgggcaagggctgcctgaaggagagcggcagctacatgtggatctacgtgttcatgggcaacatgctgagaggcatcggcgagacccccatcgtgcccctgggcctgagctacatcgacgacttcgccaaggagggccacagcagcctgtacctgggcatcctgaacgccatcgccatgatcggccccatcatcggcttcaccctgggcagcctgttcagcaagatgtacgtggacatcggctacgtggacctgagcaccatcagaatcacccccaccgacagcagatgggtgggcgcctggtggctgaacttcctggtgagcggcctgttcagcatcatcagcagcatccccttcttcttcctgccccagacccccaacaagccccagaaggagagaaaggccagcctgagcctgcacgtgctggagaccaacgacgagaaggaccagaccgccaacctgaccaaccagggcaagaacatcaccaagaacgtgaccggcttcttccagagcttcaagagcatcctgaccaaccccctgtacgtgatgttcgtgctgctgaccctgctgcaggtgagcagctacatcggcgccttcacctacgtgttcaagtacgtggagcagcagtacggccagcccagcagcaaggccaacatcctgctgggcgtgatcaccatccccatcttcgccagcggcatgttcctgggcggctacatcatcaagaagttcaagctgaacaccgtgggcatcgccaagttcagctgcttcaccgccgtgatgagcctgagcttctacctgctgtacttcttcatcctgtgcgagaacaagagcgtggccggcctgaccatgacctacgacggcaacaaccccgtgaccagccacagagacgtgcccctgagctactgcaacagcgactgcaactgcgacgagagccagtgggagcccgtgtgcggcaacaacggcatcacctacatcagcccctgcctggccggctgcaagagcagcagcggcaacaagaagcccatcgtgttctacaactgcagctgcctggaggtgaccggcctgcagaacagaaactacagcgcccacctgggcgagtgccccagagacgacgcctgcaccagaaagttctacttcttcgtggccatccaggtgctgaacctgttcttcagcgccctgggcggcaccagccacgtgatgctgatcgtgaagatcgtgcagcccgagctgaagagcctggccctgggcttccacagcatggtgatcagagccctgggcggcatcctggcccccatctacttcggcgccctgatcgacaccacctgcatcaagtggagcaccaacaactgcggcaccagaggcagctgcagaacctacaacagcaccagcttcagcagagtgtacctgggcctgagcagcatgctgagagtgagcagcctggtgctgtacatcatcctgatctacgccatgaagaagaagtaccaggagaaggacatcaacgccagcgagaacggcagcgtgatggacgaggccaacctggagagcctgaacaagaacaagcacttcgtgcccagcgccggcgccgacagcgagacccactgctag

SEQ ID NO: 100288 - DNA, 2109 bp, Artificial Sequence
  Description of Artificial Sequence: Synthetic coding sequence
atggaccagcaccagcacctgaacaagaccgccgagagcgccagcagcgagaagaagaagaccagaagatgcaacggcttcaagatgttcctggccgccctgagcttcagctacatcgccaaggccctgggcggcatcatcatgaagatcagcatcacccagatcgagagaagattcgacatcagcagcagcctggccggcctgatcgacggcagcttcgagatcggcaacctgctggtgatcgtgttcgtgagctacttcggcagcaagctgcacagacccaagctgatcggcatcggctgcctgctgatgggcaccggcagcatcctgaccagcctgccccacttcttcatgggctactacagatacagcaaggagacccacatcaaccccagcgagaacagcaccagcagcctgagcacctgcctgatcaaccagaccctgagcttcaacggcaccagccccgagatcgtggagaaggactgcgtgaaggagagcggcagccacatgtggatctacgtgttcatgggcaacatgctgagaggcatcggcgagacccccatcgtgcccctgggcatcagctacatcgacgacttcgccaaggagggccacagcagcctgtacctgggcagcctgaacgccatcggcatgatcggccccgtgatcggcttcgccctgggcagcctgttcgccaagatgtacgtggacatcggctacgtggacctgagcaccatcagaatcacccccaaggacagcagatgggtgggcgcctggtggctgggcttcctggtgagcggcctgttcagcatcatcagcagcatccccttcttcttcctgcccaagaaccccaacaagccccagaaggagagaaagatcagcctgagcctgcacgtgctgaagaccaacgacgacagaaaccagaccgccaacctgaccaaccagggcaagaacgtgaccaagaacgtgaccggcttcttccagagcctgaagagcatcctgaccaaccccctgtacgtgatcttcctgctgctgaccctgctgcaggtgagcagcttcatcggcagcttcacctacgtgttcaagtacatggagcagcagtacggccagagcgccagccacgccaacttcctgctgggcatcatcaccatccccaccgtggccaccggcatgttcctgggcggcttcatcatcaagaagttcaagctgagcctggtgggcatcgccaagttcagcttcctgaccagcatgatcagcttcctgttccagctgctgtacttccccctgatctgcgagagcaagagcgtggccggcctgaccctgacctacgacggcaacaacagcgtggccagccacgtggacgtgcccctgagctactgcaacagcgagtgcaactgcgacgagagccagtgggagcccgtgtgcggcaacaacggcatcacctacctgagcccctgcctggccggctgcaagagcagcagcggcatcaagaagcacaccgtgttctacaactgcagctgcgtggaggtgaccggcctgcagaacagaaactacagcgcccacctgggcgagtgccccagagacaacacctgcaccagaaagttcttcatctacgtggccatccaggtgatcaacagcctgttcagcgccaccggcggcaccaccttcatcctgctgaccgtgaagatcgtgcagcccgagctgaaggccctggccatgggcttccagagcatggtgatcagaaccctgggcggcatcctggcccccatctacttcggcgccctgatcgacaagacctgcatgaagtggagcaccaacagctgcggcgcccagggcgcctgcagaatctacaacagcgtgttcttcggcagagtgtacctgggcctgagcatcgccctgagattccccgccctggtgctgtacatcgtgttcatcttcgccatgaagaagaagttccagggcaaggacaccaaggccagcgacaacgagagaaaggtgatggacgaggccaacctggagttcctgaacaacggcgagcacttcgtgcccagcgccggcaccgacagcaagacctgcaacctggacatgcaggacaacgccgccgccaactag

SEQ ID NO: 100289 - DNA, 2109 bp, Artificial Sequence; identical to SEQ ID NO: 100288
  Description of Artificial Sequence: Synthetic coding sequence

SEQ ID NO: 100290 - DNA, 2247 bp, Artificial Sequence
  Description of Artificial Sequence: Synthetic coding sequence
atggaccagcaccagcacctgaacaagaccgccgagagcgccagcagcgagaagaagaagaccagaagatgcaacggcttcaagatgttcctggccgccctgagcttcagctacatcgccaaggccctgggcggcatcatcatgaagatcagcatcacccagatcgagagaagattcgacatcagcagcagcctggccggcctgatcgacggcagcttcgagatcggcaacctgctggtgatcgtgttcgtgagctacttcggcagcaagctgcacagacccaagctgatcggcatcggctgcctgctgatgggcaccggcagcatcctgaccagcctgccccacttcttcatgggctactacagatacagcaaggagacccacatcaaccccagcgagaacagcaccagcagcctgagcacctgcctgatcaaccagaccctgagcttcaacggcaccagccccgagatcgtggagaaggactgcgtgaaggagagcggcagccacatgtggatctacgtgttcatgggcaacatgctgagaggcatcggcgagacccccatcgtgcccctgggcatcagctacatcgacgacttcgccaaggagggccacagcagcctgtacctgggcagcctgaacgccatcggcatgatcggccccgtgatcggcttcgccctgggcagcctgttcgccaagatgtacgtggacatcggctacgtggacctgagcaccatcagaatcacccccaaggacagcagatgggtgggcgcctggtggctgggcttcctggtgagcggcctgttcagcatcatcagcagcatccccttcttcttcctgcccaagaaccccaacaagccccagaaggagagaaagatcagcctgagcctgcacgtgctgaagaccaacgacgacagaaaccagaccgccaacctgaccaaccagggcaagaacgtgaccaagaacgtgaccggcttcttccagagcctgaagagcatcctgaccaaccccctgtacgtgatcttcctgctgctgaccctgctgcaggtgagcagcttcatcggcagcttcacctacgtgttcaagtacatggagcagcagtacggccagagcgccagccacgccaacttcctgctgggcatcatcaccatccccaccgtggccaccggcatgttcctgggcggcttcatcatcaagaagttcaagctgagcctggtgggcatcgccaagttcagcttcctgaccagcatgatcagcttcctgttccagctgctgtacttccccctgatctgcgagagcaagagcgtggccggcctgaccctgacctacgacggcaacaacagcgtggccagccacgtggacgtgcccctgagctactgcaacagcgagtgcaactgcgacgagagccagtgggagcccgtgtgcggcaacaacggcatcacctacctgagcccctgcctggccggctgcaagagcagcagcggcatcaagaagcacaccgtgttctacaactgcagctgcgtggaggtgaccggcctgcagaacagaaactacagcgcccacctgggcgagtgccccagagacaacacctgcaccagaaagttcttcatctacgtggccatccaggtgatcaacagcctgttcagcgccaccggcggcaccaccttcatcctgctgaccgtgaagatcgtgcagcccgagctgaaggccctggccatgggcttccagagcatggtgatcagaaccctgggcggcatcctggcccccatctacttcggcgccctgatcgacaagacctgcatgaagtggagcaccaacagctgcggcgcccagggcgcctgcagaatctacaacagcgtgttcttcggcatcgtgcagcccgagctgaaggccctggccatcggcttccacagcatgatcatgagaagcctgggcggcatcctggtgcccatctacttcggcgccctgatcgacaccacctgcatgaagtggagcaccaacagctgcggcgccagaggcgcctgcagaatctacaacagcacctacctgggcagagccttcttcggcctgaaggtggccctgatcttccccgtgctggtgctgctgaccgtgttcatcttcgtggtgagaaagaagagccacggcaaggacaccaaggtgctggagaacgagagacaggtgatggacgaggccaacctggagttcctgaacgacagcgagcacttcgtgcccagcgccgaggagcagtag

SEQ ID NO: 100291 - DNA, 2139 bp, Artificial Sequence
  Description of Artificial Sequence: Synthetic coding sequence
atggacaccagcagcaaggagaacatccagctgttctgcaagaccagcgtgcagcccgtgggcagacccagcttcaagaccgagtaccccagcagcgaggagaagcagccctgctgcggcgagctgaaggtgttcctgtgcgccctgagcttcgtgtacttcgccaaggccctggccgagggctacctgaagagcaccatcacccagatcgagagaagattcgacatccccagcagcctggtgggcgtgatcgacggcagcttcgagatcggcaacctgctggtgatcaccttcgtgagctacttcggcgccaagctgcacagacccaagatcatcggcgccggctgcgtgatcatgggcgtgggcaccctgctgatcgccatgccccagttcttcatggagcagtacaagtacgagagatacagccccagcagcaacagcaccctgagcatcagcccctgcctgctggagagcagcagccagctgcccgtgagcgtgatggagaagagcaagagcaagatcagcaacgagtgcgaggtggacaccagcagcagcatgtggatctacgtgttcctgggcaacctgctgagaggcatcggcgagacccccatccagcccctgggcatcgcctacctggacgacttcgccagcgaggacaacgccgccttctacatcggctgcgtgcagaccgtggccatcatcggccccatcttcggcttcctgctgggcagcctgtgcgccaagctgtacgtggacatcggcttcgtgaacctggaccacatcaccatcacccccaaggacccccagtgggtgggcgcctggtggctgggctacctgatcgccggcatcatcagcctgctggccgccgtgcccttctggtacctgcccaagagcctgcccagaagccagagcagagaggacagcaacagcagcagcgagaagagcaagttcatcatcgacgaccacaccgactaccagaccccccagggcgagaacgccaagatcatggagatggccagagacttcctgcccagcctgaagaacctgttcggcaaccccgtgtacttcctgtacctgtgcaccagcaccgtgcagttcaacagcctgttcggcatggtgacctacaagcccaagtacatcgagcagcagtacggccagagcagcagcagagccaacttcgtgatcggcctgatcaacatccccgccgtggccctgggcatcttcagcggcggcatcgtgatgaagaagttcagaatcagcgtgtgcggcgccgccaagctgtacctgggcagcagcgtgttcggctacctgctgttcctgagcctgttcgccctgggctgcgagaacagcgacgtggccggcctgaccgtgagctaccagggcaccaagcccgtgagctaccacgagagagccctgttcagcgactgcaacagcagatgcaagtgcagcgagaccaagtgggagcccatgtgcggcgagaacggcatcacctacgtgagcgcctgcctggccggctgccagaccagcaacagaagcggcaagaacatcatcttctacaactgcacctgcgtgggcatcgccgccagcaagagcggcaacagcagcggcatcgtgggcagatgccagaaggacaacggctgcccccagatgttcctgtacttcctggtgatcagcgtgatcaccagctacaccctgagcctgggcggcatccccggctacatcctgctgctgagatgcatcaagccccagctgaagagcttcgccctgggcatctacaccctggccatcagagtgctggccggcatccccgcccccgtgtacttcggcgtgctgatcgacaccagctgcctgaagtggggcttcaagagatgcggcagcagaggcagctgcagactgtacgacagcaacgtgttcagacacatctacctgggcctgaccgtgatcctgggcaccgtgagcatcctgctgagcatcgccgtgctgttcatcctgaagaagaactacgtgagcaagcacagaagcttcatcaccaagagagagagaaccatggtgagcaccagattccagaaggagaactacaccaccagcgaccacctgctgcagcccaactactggcccggcaaggagacccagctgtag

SEQ ID NO: 100292 - DNA, 2193 bp, Artificial Sequence
  Description of Artificial Sequence: Synthetic coding sequence
atggacaccagcagcaaggagaacatccagctgttctgcaagaccagcgtgcagcccgtgggcagacccagcttcaagaccgagtaccccagcagcgaggagaagcagccctgctgcggcgagctgaaggtgttcctgtgcgccctgagcttcgtgtacttcgccaaggccctggccgagggctacctgaagagcaccatcacccagatcgagagaagattcgacatccccagcagcctggtgggcgtgatcgacggcagcttcgagatcggcaacctgctggtgatcaccttcgtgagctacttcggcgccaagctgcacagacccaagatcatcggcgccggctgcgtgatcatgggcgtgggcaccctgctgatcgccatgccccagttcttcatggagcagtacaagtacgagagatacagccccagcagcaacagcaccctgagcatcagcccctgcctgctggagagcagcagccagctgcccgtgagcgtgatggagaagagcaagagcaagatcagcaacgagtgcgaggtggacaccagcagcagcatgtggatctacgtgttcctgggcaacctgctgagaggcatcggcgagacccccatccagcccctgggcatcgcctacctggacgacttcgccagcgaggacaacgccgccttctacatcggctgcgtgcagaccgtggccatcatcggccccatcttcggcttcctgctgggcagcctgtgcgccaagctgtacgtggacatcggcttcgtgaacctggaccacatcaccatcacccccaaggacccccagtgggtgggcgcctggtggctgggctacctgatcgccggcatcatcagcctgctggccgccgtgcccttctggtacctgcccaagagcctgcccagaagccagagcagagaggacagcaacagcagcagcgagaagagcaagttcatcatcgacgaccacaccgactaccagaccccccagggcgagaacgccaagatcatggagatggccagagacttcctgcccagcctgaagaacctgttcggcaaccccgtgtacttcctgtacctgtgcaccagcaccgtgcagttcaacagcctgttcggcatggtgacctacaagcccaagtacatcgagcagcagtacggccagagcagcagcagagccaacttcgtgatcggcctgatcaacatccccgccgtggccctgggcatcttcagcggcggcatcgtgatgaagaagttcagaatcagcgtgtgcggcgccgccaagctgtacctgggcagcagcgtgttcggctacctgctgttcctgagcctgttcgccctgggctgcgagaacagcgacgtggccggcctgaccgtgagctaccagggcaccaagcccgtgagctaccacgagagagccctgttcagcgactgcaacagcagatgcaagtgcagcgagaccaagtgggagcccatgtgcggcgagaacggcatcacctacgtgagcgcctgcctggccggctgccagaccagcaacagaagcggcaagaacatcatcttctacaactgcacctgcgtgggcatcgccgccagcaagagcggcaacagcagcggcatcgtgggcagatgccagaaggacaacggctgcccccagatgttcctgtacttcctggtgatcagcgtgatcaccagctacaccctgagcctgggcggcatccccggctacatcctgctgctgagatgcatcaagccccagctgaagagcttcgccctgggcatctacaccctggccatcagagtgctggccggcatccccgcccccgtgtacttcggcgtgctgatcgacaccagctgcctgaagtggggcttcaagagatgcggcagcagaggcagctgcagactgtacgacagcaacgtgttcagataccagatcaagagcatccccgccagccactgctacagcatccccgacctgcacaacgccaccgacaccaacaagttcagctgccacttcaccgcctgcaagacctacatcagcggcaccaactgcgacaccggccacagcgtgaacagccccaagcactgcagcaccttccacttcaaggagaagctgtgcttcaagacccagaagttctacaaccaggagagaaagaacaacggcgtgtacaagatccccaagggcaagctgcactacaagtag

SEQ ID NO: 100293 - DNA, 1992 bp, Artificial Sequence
  Description of Artificial Sequence: Synthetic coding sequence
atggacaccagcagcaaggagaacatccagctgttctgcaagaccagcgtgcagcccgtgggcagacccagcttcaagaccgagtaccccagcagcgaggagaagcagccctgctgcggcgagctgaaggtgttcctgtgcgccctgagcttcgtgtacttcgccaaggccctggccgagggctacctgaagagcaccatcacccagatcgagagaagattcgacatccccagcagcctggtgggcgtgatcgacggcagcttcgagatcggcaacctgctggtgatcaccttcgtgagctacttcggcgccaagctgcacagacccaagatcatcggcgccggctgcgtgatcatgggcgtgggcaccctgctgatcgccatgccccagttcttcatggagcagtacaagtacgagagatacagccccagcagcaacagcaccctgagcatcagcccctgcctgctggagagcagcagccagctgcccgtgagcgtgatggagaagagcaagagcaagatcagcaacggctgcgtgcagaccgtggccatcatcggccccatcttcggcttcctgctgggcagcctgtgcgccaagctgtacgtggacatcggcttcgtgaacctggaccacatcaccatcacccccaaggacccccagtgggtgggcgcctggtggctgggctacctgatcgccggcatcatcagcctgctggccgccgtgcccttctggtacctgcccaagagcctgcccagaagccagagcagagaggacagcaacagcagcagcgagaagagcaagttcatcatcgacgaccacaccgactaccagaccccccagggcgagaacgccaagatcatggagatggccagagacttcctgcccagcctgaagaacctgttcggcaaccccgtgtacttcctgtacctgtgcaccagcaccgtgcagttcaacagcctgttcggcatggtgacctacaagcccaagtacatcgagcagcagtacggccagagcagcagcagagccaacttcgtgatcggcctgatcaacatccccgccgtggccctgggcatcttcagcggcggcatcgtgatgaagaagttcagaatcagcgtgtgcggcgccgccaagctgtacctgggcagcagcgtgttcggctacctgctgttcctgagcctgttcgccctgggctgcgagaacagcgacgtggccggcctgaccgtgagctaccagggcaccaagcccgtgagctaccacgagagagccctgttcagcgactgcaacagcagatgcaagtgcagcgagaccaagtgggagcccatgtgcggcgagaacggcatcacctacgtgagcgcctgcctggccggctgccagaccagcaacagaagcggcaagaacatcatcttctacaactgcacctgcgtgggcatcgccgccagcaagagcggcaacagcagcggcatcgtgggcagatgccagaaggacaacggctgcccccagatgttcctgtacttcctggtgatcagcgtgatcaccagctacaccctgagcctgggcggcatccccggctacatcctgctgctgagatgcatcaagccccagctgaagagcttcgccctgggcatctacaccctggccatcagagtgctggccggcatccccgcccccgtgtacttcggcgtgctgatcgacaccagctgcctgaagtggggcttcaagagatgcggcagcagaggcagctgcagactgtacgacagcaacgtgttcagacacatctacctgggcctgaccgtgatcctgggcaccgtgagcatcctgctgagcatcgccgtgctgttcatcctgaagaagaactacgtgagcaagcacagaagcttcatcaccaagagagagagaaccatggtgagcaccagattccagaaggagaactacaccaccagcgaccacctgctgcagcccaactactggcccggcaaggagacccagctgtag

SEQ ID NO: 100294 - DNA, 1839 bp, Artificial Sequence
  Description of Artificial Sequence: Synthetic coding sequence
atgggcgtgggcaccctgctgatcgccatgccccagttcttcatggagcagtacaagtacgagagatacagccccagcagcaacagcaccctgagcatcagcccctgcctgctggagagcagcagccagctgcccgtgagcgtgatggagaagagcaagagcaagatcagcaacgagtgcgaggtggacaccagcagcagcatgtggatctacgtgttcctgggcaacctgctgagaggcatcggcgagacccccatccagcccctgggcatcgcctacctggacgacttcgccagcgaggacaacgccgccttctacatcggctgcgtgcagaccgtggccatcatcggccccatcttcggcttcctgctgggcagcctgtgcgccaagctgtacgtggacatcggcttcgtgaacctggaccacatcaccatcacccccaaggacccccagtgggtgggcgcctggtggctgggctacctgatcgccggcatcatcagcctgctggccgccgtgcccttctggtacctgcccaagagcctgcccagaagccagagcagagaggacagcaacagcagcagcgagaagagcaagttcatcatcgacgaccacaccgactaccagaccccccagggcgagaacgccaagatcatggagatggccagagacttcctgcccagcctgaagaacctgttcggcaaccccgtgtacttcctgtacctgtgcaccagcaccgtgcagttcaacagcctgttcggcatggtgacctacaagcccaagtacatcgagcagcagtacggccagagcagcagcagagccaacttcgtgatcggcctgatcaacatccccgccgtggccctgggcatcttcagcggcggcatcgtgatgaagaagttcagaatcagcgtgtgcggcgccgccaagctgtacctgggcagcagcgtgttcggctacctgctgttcctgagcctgttcgccctgggctgcgagaacagcgacgtggccggcctgaccgtgagctaccagggcaccaagcccgtgagctaccacgagagagccctgttcagcgactgcaacagcagatgcaagtgcagcgagaccaagtgggagcccatgtgcggcgagaacggcatcacctacgtgagcgcctgcctggccggctgccagaccagcaacagaagcggcaagaacatcatcttctacaactgcacctgcgtgggcatcgccgccagcaagagcggcaacagcagcggcatcgtgggcagatgccagaaggacaacggctgcccccagatgttcctgtacttcctggtgatcagcgtgatcaccagctacaccctgagcctgggcggcatccccggctacatcctgctgctgagatgcatcaagccccagctgaagagcttcgccctgggcatctacaccctggccatcagagtgctggccggcatccccgcccccgtgtacttcggcgtgctgatcgacaccagctgcctgaagtggggcttcaagagatgcggcagcagaggcagctgcagactgtacgacagcaacgtgttcagataccagatcaagagcatccccgccagccactgctacagcatccccgacctgcacaacgccaccgacaccaacaagttcagctgccacttcaccgcctgcaagacctacatcagcggcaccaactgcgacaccggccacagcgtgaacagccccaagcactgcagcaccttccacttcaaggagaagctgtgcttcaagacccagaagttctacaaccaggagagaaagaacaacggcgtgtacaagatccccaagggcaagctgcactacaagtag

SEQ ID NO: 100295 - DNA, 2193 bp, Artificial Sequence; identical to SEQ ID NO: 100292
  Description of Artificial Sequence: Synthetic coding sequence

SEQ ID NO: 100296 - DNA, 1932 bp, Artificial Sequence
  Description of Artificial Sequence: Synthetic coding sequence
atgggcctgctgcccaagctgggcgccagccagggcagcgacaccagcaccagcagagccggcagatgcgccagaagcgtgttcggcaacatcaaggtgttcgtgctgtgccagggcctgctgcagctgtgccagctgctgtacagcgcctacttcaagagcagcctgaccaccatcgagaagagattcggcctgagcagcagcagcagcggcctgatcagcagcctgaacgagatcagcaacgccatcctgatcatcttcgtgagctacttcggcagcagagtgcacagacccagactgatcggcatcggcggcctgttcctggccgccggcgccttcatcctgaccctgccccacttcctgagcgagccctaccagtacaccctggccagcaccggcaacaacagcagactgcaggccgagctgtgccagaagcactggcaggacctgccccccagcaagtgccacagcaccacccagaacccccagaaggagaccagcagcatgtggggcctgatggtggtggcccagctgctggccggcatcggcaccgtgcccatccagcccttcggcatcagctacgtggacgacttcagcgagcccagcaacagccccctgtacatcagcatcctgttcgccatcagcgtgttcggccccgccttcggctacctgctgggcagcgtgatgctgcagatcttcgtggactacggcagagtgaacaccgccgccgtgaacctggtgcccggcgaccccagatggatcggcgcctggtggctgggcctgctgatcagcagcgccctgctggtgctgaccagcttccccttcttcttcttccccagagccatgcccatcggcgccaagagagcccccgccaccgccgacgaggccagaaagctggaggaggccaagagcagaggcagcctggtggacttcatcaagagattcccctgcatcttcctgagactgctgatgaacagcctgttcgtgctggtggtgctggcccagtgcaccttcagcagcgtgatcgccggcctgagcaccttcctgaacaagttcctggagaagcagtacggcaccagcgccgcctacgccaacttcctgatcggcgccgtgaacctgcccgccgccgccctgggcatgctgttcggcggcatcctgatgaagagattcgtgttcagcctgcaggccatccccagaatcgccaccaccatcatcaccatcagcatgatcctgtgcgtgcccctgttcttcatgggctgcagcacccccaccgtggccgaggtgtacccccccagcaccagcagcagcatccacccccagagccccgcctgcagaagagactgcagctgccccgacagcatcttccaccccgtgtgcggcgacaacggcatcgagtacctgagcccctgccacgccggctgcagcaacatcaacatgagcagcgccaccagcaagcagctgatctacctgaactgcagctgcgtgaccggcggcagcgccagcgccaagaccggcagctgccccgtgccctgcgcccacttcctgctgcccgccatcttcctgatcagcttcgtgagcctgatcgcctgcatcagccacaaccccctgtacatgatggtgctgagagtggtgaaccaggaggagaagagcttcgccatcggcgtgcagttcctgctgatgagactgctggcctggctgcccagccccgccctgtacggcctgaccatcgaccacagctgcatcagatggaacagcctgtgcctgggcagaagaggcgcctgcgcctactacgacaacgacgccctgagagacagatacctgggcctgcagatgggctacaaggccctgggcatgctgctgctgtgcttcatcagctggagagtgaagaagaacaaggagtacaacgtgcagaaggccgccggcctgatctag

SEQ ID NO: 100297 - DNA, 1248 bp, Artificial Sequence
  Description of Artificial Sequence: Synthetic coding sequence
atgggcctgctgcccaagctgggcgccagccagggcagcgacaccagcaccagcagagccggcagatgcgccagaagcgtgttcggcaacatcaaggtgttcgtgctgtgccagggcctgctgcagctgtgccagctgctgtacagcgcctacttcaagagcagcctgaccaccatcgagaagagattcggcctgagcagcagcagcagcggcctgatcagcagcctgaacgagatcagcaacgccatcctgatcatcttcgtgagctacttcggcagcagagtgcacagacccagactgatcggcatcggcggcctgttcctggccgccggcgccttcatcctgaccctgccccacttcctgagcgagccctaccagtacaccctggccagcaccggcaacaacagcagactgcaggccgagctgtgccagaagcactggcaggacctgccccccagcaagtgccacagcaccacccagaacccccagaaggagaccagcagcatgtggggcctgatggtggtggcccagctgctggccggcatcggcaccgtgcccatccagcccttcggcatcagctacgtggacgacttcagcgagcccagcaacagccccctgtacatcagcatcctgttcgccatcagcgtgttcggccccgccttcggctacctgctgggcagcgtgatgctgcagatcttcgtggactacggcagagtgaacaccgccgccgtgaacctggtgcccggcgaccccagatggatcggcgcctggtggctgggcctgctgatcagcagcgccctgctggtgctgaccagcttccccttcttcttcttccccagagccatgcccatcggcgccaagagagcccccgccaccgccgacgaggccagaaagctggaggaggccaagagcagaggcagcctggtggacttcatcaagagattcccctgcatcttcctgagactgctgatgaacagcctgttcgtgctggtggtgctggcccagtgcaccttcagcagcgtgatcgccggcctgagcaccttcctgaacaagttcctggagaagcagtacggcaccagcgccgcctacgccaacttcctgatcgcccaccaggtgctgtacatcagaagcctgctgcccgccgccggcaccgccagagcccagatcctgagcagcaccagaagcgtggagaccatggagagcagcaccagccccctggccatgcccgccgccgccaccagcacctag

SEQ ID NO: 100298 - DNA, 2133 bp, Artificial Sequence
  Description of Artificial Sequence: Synthetic coding sequence
atgcagggcaagaagcccggcggcagcagcggcggcggcagaagcggcgagctgcagggcgacgaggcccagagaaacaagaagaagaagaagaaggtgagctgcttcagcaacatcaagatcttcctggtgagcgagtgcgccctgatgctggcccagggcaccgtgggcgcctacctggtgagcgtgctgaccaccctggagagaagattcaacctgcagagcgccgacgtgggcgtgatcgccagcagcttcgagatcggcaacctggccctgatcctgttcgtgagctacttcggcgccagaggccacagacccagactgatcggctgcggcggcatcgtgatggccctgggcgccctgctgagcgccctgcccgagttcctgacccaccagtacaagtacgaggccggcgagatcagatggggcgccgagggcagagacgtgtgcgccgccaacggcagcggcggcgacgagggccccgaccccgacctgatctgcagaaacagaaccgccaccaacatgatgtacctgctgctgatcggcgcccaggtgctgctgggcatcggcgccacccccgtgcagcccctgggcgtgagctacatcgacgaccacgtgagaagaaaggacagcagcctgtacatcggcatcctgttcaccatgctggtgttcggccccgcctgcggcttcatcctgggcagcttctgcaccaagatctacgtggacgccgtgttcatcgacaccagcaacctggacatcacccccgacgaccccagatggatcggcgcctggtggggcggcttcctgctgtgcggcgccctgctgttcttcagcagcctgctgatgttcggcttcccccagagcctgcccccccacagcgagcccgccatggagagcgagcaggccatgctgagcgagagagagtacgagagacccaagcccagcaacggcgtgctgagacaccccctggagcccgacagcagcgccagctgcttccagcagctgagagtgatccccaaggtgaccaagcacctgctgagcaaccccgtgttcacctgcatcatcctggccgcctgcatggagatcgccgtggtggccggcttcgccgccttcctgggcaagtacctggagcagcagttcaacctgaccaccagcagcgccaaccagctgctgggcatgaccgccatcccctgcgcctgcctgggcatcttcctgggcggcctgctggtgaagaagctgagcctgagcgccctgggcgccatcagaatggccatgctggtgaacctggtgagcaccgcctgctacgtgagcttcctgttcctgggctgcgacaccggccccgtggccggcgtgaccgtgccctacggcaacagcaccgcccccggcagcgccctggacccctacagcccctgcaacaacaactgcgagtgccagaccgacagcttcacccccgtgtgcggcgccgacggcatcacctacctgagcgcctgcttcgccggctgcaacagcaccaacctgaccggctgcgcctgcctgaccaccgtgcccgccgagaacgccaccgtggtgcccggcaagtgccccagccccggctgccaggaggccttcctgaccttcctgtgcgtgatgtgcatctgcagcctgatcggcgccatggcccagacccccagcgtgatcatcctgatcagaaccgtgagccccgagctgaagagctacgccctgggcgtgctgttcctgctgctgagactgctgggcttcatccccccccccctgatcttcggcgccggcatcgacagcacctgcctgttctggagcaccttctgcggcgagcagggcgcctgcgtgctgtacgacaacgtggtgtacagatacctgtacgtgagcatcgccatcgccctgaagagcttcgccttcatcctgtacaccaccacctggcagtgcctgagaaagaactacaagagatacatcaagaaccacgagggcggcctgagcaccagcgagttcttcgccagcaccctgaccctggacaacctgggcagagaccccgtgcccgccaaccagacccacagaaccaagttcatctacaacctggaggaccacgagtggtgcgagaacatggagagcgtgctgtag

SEQ ID NO: 100299 - DNA, 1356 bp, Artificial Sequence
  Description of Artificial Sequence: Synthetic coding sequence
atgagagagatcgtgcacatccagatcggccagtgcggcaaccagatcggcgccaagttctgggagatgatcggcgaggagcacggcatcgacctggccggcagcgacagaggcgccagcgccctgcagctggagagaatcagcgtgtactacaacgaggcctacggcagaaagtacgtgcccagagccgtgctggtggacctggagcccggcaccatggacagcatcagaagcagcaagctgggcgccctgttccagcccgacagcttcgtgcacggcaacagcggcgccggcaacaactgggccaagggccactacaccgagggcgccgagctgatcgagaacgtgctggaggtggtgagacacgagagcgagagctgcgactgcctgcagggcttccagatcgtgcacagcctgggcggcggcaccggcagcggcatgggcaccctgctgatgaacaagatcagagaggagtaccccgacagaatcatgaacagcttcagcgtgatgcccagccccaaggtgagcgacaccgtggtggagccctacaacgccgtgctgagcatccaccagctgatcgagaacgccgacgcctgcttctgcatcgacaacgaggccctgtacgacatctgcttcagaaccctgaagctgaccacccccacctacggcgacctgaaccacctggtgagcctgaccatgagcggcatcaccaccagcctgagattccccggccagctgaacgccgacctgagaaagctggccgtgaacatggtgcccttccccagactgcacttcttcatgcccggcttcgcccccctgaccgcccagggcagccagcagtacagagccctgagcgtggccgagctgacccagcagatgttcgacgccagaaacaccatggccgcctgcgacctgagaagaggcagatacctgaccgtggcctgcatcttcagaggcaagatgagcaccaaggaggtggaccagcagctgctgagcgtgcagaccagaaacagcagctgcttcgtggagtggatccccaacaacgtgaaggtggccgtgtgcgacatcccccccagaggcctgagcatggccgccaccttcatcggcaacaacaccgccatccaggagatcttcaacagagtgagcgagcacttcagcgccatgttcaagagaaaggccttcgtgcactggtacaccagcgagggcatggacatcaacgagttcggcgaggccgagaacaacatccacgacctggtgagcgagtaccagcagttccaggacgccaaggccgtgctggaggaggacgaggaggtgaccgaggaggccgagatggagcccgaggacaagggccactag

SEQ ID NO: 100300 - DNA, 1749 bp, Artificial Sequence
  Description of Artificial Sequence: Synthetic coding sequence
atgcccctgcaccagctgggcgacaagcccctgaccttccccagccccaacagcgccatggagaacggcctggaccacaccccccccagcagaagagccagccccggcacccccctgagccccggcagcctgagaagcgccgcccacagccccctggacaccagcaagcagcccctgtgccagctgtgggccgagaagcacggcgccagaggcacccacgaggtgagatacgtgagcgccggccagagcgtggcctgcggctggtgggccttcgcccccccctgcctgcaggtgctgaacacccccaagggcatcctgttcttcctgtgcgccgccgccttcctgcagggcatgaccgtgaacggcttcatcaacaccgtgatcaccagcctggagagaagatacgacctgcacagctaccagagcggcctgatcgccagcagctacgacatcgccgcctgcctgtgcctgaccttcgtgagctacttcggcggcagcggccacaagcccagatggctgggctggggcgtgctgctgatgggcaccggcagcctggtgttcgccctgccccacttcaccgccggcagatacgaggtggagctggacgccggcgtgagaacctgccccgccaaccccggcgccgtgtgcgccgacagcaccagcggcctgagcagataccagctggtgttcatgctgggccagttcctgcacggcgtgggcgccacccccctgtacaccctgggcgtgacctacctgggcatgagcaccttcagccccaagttcctggagagccagttcagcctgagcgccagcgaggccgccaccctgttcggctacctggtggtgcccgccggcggcggcggcaccttcctgggcggcttcttcgtgaacaagctgagactgagaggcagcgccgtgatcaagttctgcctgttctgcaccgtggtgagcctgctgggcatcctggtgttcagcctgcactgccccagcgtgcccatggccggcgtgaccgccagctacggcggcagcctgctgcccgagggccacctgaacctgaccgccccctgcaacgccgcctgcagctgccagcccgagcactacagccccgtgtgcggcagcgacggcctgatgtacttcagcctgtgccacgccggctgccccgccgccaccgagaccaacgtggacggccagaaggtgtacagagactgcagctgcatcccccagaacctgagcagcggcttcggccacgccaccgccggcaagtgcaccagcacctgccagagaaagcccctgctgctggtgttcatcttcgtggtgatcttcttcaccttcctgagcagcatccccgccctgaccgccaccctgagatgcgtgagagacccccagagaagcttcgccctgggcatccagtggatcgtggtgagaatcctgggcggcatccccggccccatcgccttcggctgggtgatcgacaaggcctgcctgctgtggcaggaccagtgcggccagcagggcagctgcctggtgtaccagaacagcgccatgagcagatacatcctgatcatgggcctgctgtacaaggtgctgggcgtgctgttcttcgccatcgccagcagcagagccgccagcgaccacagacccagaccccccggccacggcggccacagcgccttccccgacgacagaaccgtgcccctgggcgacgccatcaccagagagctgctgttcgacctgcagcccagcacctag

SEQ ID NO: 100301 - DNA, 2169 bp, Artificial Sequence
  Description of Artificial Sequence: Synthetic coding sequence
atgcccctgcaccagctgggcgacaagcccctgaccttccccagccccaacagcgccatggagaacggcctggaccacaccccccccagcagaagagccagccccggcacccccctgagccccggcagcctgagaagcgccgcccacagccccctggacaccagcaagcagcccctgtgccagctgtgggccgagaagcacggcgccagaggcacccacgaggtgagatacgtgagcgccggccagagcgtggcctgcggctggtgggccttcgcccccccctgcctgcaggtgctgaacacccccaagggcatcctgttcttcctgtgcgccgccgccttcctgcagggcatgaccgtgaacggcttcatcaacaccgtgatcaccagcctggagagaagatacgacctgcacagctaccagagcggcctgatcgccagcagctacgacatcgccgcctgcctgtgcctgaccttcgtgagctacttcggcggcagcggccacaagcccagatggctgggctggggcgtgctgctgatgggcaccggcagcctggtgttcgccctgccccacttcaccgccggcagatacgaggtggagctggacgccggcgtgagaacctgccccgccaaccccggcgccgtgtgcgccgacagcaccagcggcctgagcagataccagctggtgttcatgctgggccagttcctgcacggcgtgggcgccacccccctgtacaccctgggcgtgacctacctggacgagaacgtgaagagcagctgcagccccgtgtacatcgccatcttctacaccgccgccatcctgggccccgccgccggctacctgatcggcggcgccctgctgaacatctacaccgagatgggcagaagaaccgagctgaccaccgagagccccctgtgggtgggcgcctggtgggtgggcttcctgggcagcggcgccgccgccttcttcaccgccgtgcccatcctgggctaccccagacagctgcccggcagccagagatacgccgtgatgagagccgccgagatgcaccagctgaaggacagcagcagaggcgaggccagcaaccccgacttcggcaagaccatcagagacctgcccctgagcatctggctgctgctgaagaaccccaccttcatcctgctgtgcctggccggcgccaccgaggccaccctgatcaccggcatgagcaccttcagccccaagttcctggagagccagttcagcctgagcgccagcgaggccgccaccctgttcggctacctggtggtgcccgccggcggcggcggcaccttcctgggcggcttcttcgtgaacaagctgagactgagaggcagcgccgtgatcaagttctgcctgttctgcaccgtggtgagcctgctgggcatcctggtgttcagcctgcactgccccagcgtgcccatggccggcgtgaccgccagctacggcggcagcctgctgcccgagggccacctgaacctgaccgccccctgcaacgccgcctgcagctgccagcccgagcactacagccccgtgtgcggcagcgacggcctgatgtacttcagcctgtgccacgccggctgccccgccgccaccgagaccaacgtggacggccagaaggtgtacagagactgcagctgcatcccccagaacctgagcagcggcttcggccacgccaccgccggcaagtgcaccagcacctgccagagaaagcccctgctgctggtgttcatcttcgtggtgatcttcttcaccttcctgagcagcatccccgccctgaccgccaccctgagatgcgtgagagacccccagagaagcttcgccctgggcatccagtggatcgtggtgagaatcctgggcggcatccccggccccatcgccttcggctgggtgatcgacaaggcctgcctgctgtggcaggaccagtgcggccagcagggcagctgcctggtgtaccagaacagcgccatgagcagatacatcctgatcatgggcctgctgtacaaggtgctgggcgtgctgttcttcgccatcgcctgcttcctgtacaagcccctgagcgagagcagcgacggcctggagacctgcctgcccagccagagcagcgcccccgacagcgccaccgacagccagctgcagagcagcgtgtag

SEQ ID NO: 100302 - DNA, 2169 bp, Artificial Sequence
  Description of Artificial Sequence: Synthetic coding sequence
atgcccctgcaccagctgggcgacaagcccctgaccttccccagccccaacagcgccatggagaacggcctggaccacaccccccccagcagaagagccagccccggcacccccctgagccccggcagcctgagaagcgccgcccacagccccctggacaccagcaagcagcccctgtgccagctgtgggccgagaagcacggcgccagaggcacccacgaggtgagatacgtgagcgccggccagagcgtggcctgcggctggtgggccttcgcccccccctgcctgcaggtgctgaacacccccaagggcatcctgttcttcctgtgcgccgccgccttcctgcagggcatgaccgtgaacggcttcatcaacaccgtgatcaccagcctggagagaagatacgacctgcacagctaccagagcggcctgatcgccagcagctacgacatcgccgcctgcctgtgcctgaccttcgtgagctacttcggcggcagcggccacaagcccagatggctgggctggggcgtgctgctgatgggcaccggcagcctggtgttcgccctgccccacttcaccgccggcagatacgaggtggagctggacgccggcgtgagaacctgccccgccaaccccggcgccgtgtgcgccgacagcaccagcggcctgagcagataccagctggtgttcatgctgggccagttcctgcacggcgtgggcgccacccccctgtacaccctgggcgtgacctacctggacgagaacgtgaagagcagctgcagccccgtgtacatcgccatcttctacaccgccgccatcctgggccccgccgccggctacctgatcggcggcgccctgctgaacatctacaccgagatgggcagaagaaccgagctgaccaccgagagccccctgtgggtgggcgcctggtgggtgggcttcctgggcagcggcgccgccgccttcttcaccgccgtgcccatcctgggctaccccagacagctgcccggcagccagagatacgccgtgatgagagccgccgagatgcaccagctgaaggacagcagcagaggcgaggccagcaaccccgacttcggcaagaccatcagagacctgcccctgagcatctggctgctgctgaagaaccccaccttcatcctgctgtgcctggccggcgccaccgaggccaccctgatcaccggcatgagcaccttcagccccaagttcctggagagccagttcagcctgagcgccagcgaggccgccaccctgttcggctacctggtggtgcccgccggcggcggcggcaccttcctgggcggcttcttcgtgaacaagctgagactgagaggcagcgccgtgatcaagttctgcctgttctgcaccgtggtgagcctgctgggcatcctggtgttcagcctgcactgccccagcgtgcccatggccggcgtgaccgccagctacggcggcagcctgctgcccgagggccacctgaacctgaccgccccctgcaacgccgcctgcagctgccagcccgagcactacagccccgtgtgcggcagcgacggcctgatgtacttcagcctgtgccacgccggctgccccgccgccaccgagaccaacgtggacggccagaaggtgtacagagactgcagctgcatcccccagaacctgagcagcggcttcggccacgccaccgccggcaagtgcaccagcaccttcctgtacatcccccagcagcacagctgcaccaacggcaacagcaccaccggcgccctgcaggagacccccagaagcaagagagcctgcagatgcgtgagagacccccagagaagcttcgccctgggcatccagtggatcgtggtgagaatcctgggcggcatccccggccccatcgccttcggctgggtgatcgacaaggcctgcctgctgtggcaggaccagtgcggccagcagggcagctgcctggtgtaccagaacagcgccatgagcagatacatcctgatcatgggcctgctgtacaaggtgctgggcgtgctgttcttcgccatcgcctgcttcctgtacaagcccctgagcgagagcagcgacggcctggagacctgcctgcccagccagagcagcgcccccgacagcgccaccgacagccagctgcagagcagcgtgtag

SEQ ID NO: 100303 - DNA, 456 bp, Artificial Sequence
  Description of Artificial Sequence: Synthetic coding sequence
accaccgccctgtgcgccgccagaaccgccagctgcaccagccactgcgccacccagggcgccctgcagcccagaagaagaatgtggaccgccagaagatgcgtgagagacccccagagaagcttcgccctgggcatccagtggatcgtggtgagaatcctgggcggcatccccggccccatcgccttcggctgggtgatcgacaaggcctgcctgctgtggcaggaccagtgcggccagcagggcagctgcctggtgtaccagaacagcgccatgagcagatacatcctgatcatgggcctgctgtacaaggtgctgggcgtgctgttcttcgccatcgcctgcttcctgtacaagcccctgagcgagagcagcgacggcctggagacctgcctgcccagccagagcagcgcccccgacagcgccaccgacagccagctgcagagcagcgtgtag

SEQ ID NO: 100304 - DNA, 1863 bp, Artificial Sequence
  Description of Artificial Sequence: Synthetic coding sequence
atgcccctgcaccagctgggcgacaagcccctgaccttccccagccccaacagcgccatggagaacggcctggaccacaccccccccagcagaagagccagccccggcacccccctgagccccggcagcctgagaagcgccgcccacagccccctggacaccagcaagcagcccctgtgccagctgtgggccgagaagcacggcgccagaggcacccacgaggtgagatacgtgagcgccggccagagcgtggcctgcggctggtgggccttcgcccccccctgcctgcaggtgctgaacacccccaagggcatcctgttcttcctgtgcgccgccgccttcctgcagggcatgaccgtgaacggcttcatcaacaccgtgatcaccagcctggagagaagatacgacctgcacagctaccagagcggcctgatcgccagcagctacgacatcgccgcctgcctgtgcctgaccttcgtgagctacttcggcggcagcggccacaagcccagatggctgggctggggcgtgctgctgatgggcaccggcagcctggtgttcgccctgccccacttcaccgccggcagatacgaggtggagctggacgccggcgtgagaacctgccccgccaaccccggcgccgtgtgcgccgacagcaccagcggcctgagcagataccagctggtgttcatgctgggccagttcctgcacggcgtgggcgccacccccctgtacaccctgggcgtgacctacctggacgagaacgtgaagagcagctgcagccccgtgtacatcgccatcttctacaccgccgccatcctgggccccgccgccggctacctgatcggcggcgccctgctgaacatctacaccgagatgggcagaagaaccgagctgaccaccgagagccccctgtgggtgggcgcctggtgggtgggcttcctgggcagcggcgccgccgccttcttcaccgccgtgcccatcctgggctaccccagacagctgcccggcagccagagatacgccgtgatgagagccgccgagatgcaccagctgaaggacagcagcagaggcgaggccagcaaccccgacttcggcaagaccatcagagacctgcccctgagcatctggctgctgctgaagaaccccaccttcatcctgctgtgcctggccggcgccaccgaggccaccctgatcaccggcatgagcaccttcagccccaagttcctggagagccagttcagcctgagcgccagcgaggccgccaccctgttcggctacctggtggtgcccgccggcggcggcggcaccttcctgggcggcttcttcgtgaacaagctgagactgagaggcagcgccgtgatcaagttctgcctgttctgcaccgtggtgagcctgctgggcatcctggtgttcagcctgcactgccccagcgtgcccatggccggcgtgaccgccagctacggcggcagcctgctgcccgagggccacctgaacctgaccgccccctgcaacgccgcctgcagctgccagcccgagcactacagccccgtgtgcggcagcgacggcctgatgtacttcagcctgtgccacgccggctgccccgccgccaccgagaccaacgtggacggccagaaggtgagcggcgccgccgcctacagaccctgcccccccctggaccccggcaagggccccccctgcctgcccctggtgatcggcgccatcgtgggcctgcccagatgcaccgagaccgtggccgtgagcctgagaatcttccccctggtgctggccatgcccctgcagggcaacgccctgcagctggtgagagagagccccagcttctggttcagctacagcctgtag

SEQ ID NO: 100305 - DNA, 2160 bp, Artificial Sequence
  Description of Artificial Sequence: Synthetic coding sequence
atgttcgtgggcgtggccagacacagcggcagccaggacgaggtgagcagaggcgtggagcccctggaggccgccagagcccagcccgccaaggacagaagagccaagggcacccccaagagcagcaagcccggcaagaagcacagatacctgagactgctgcccgaggccctgatcagattcggcggcttcagaaagagaaagaaggccaagagcagcgtgagcaagaagcccggcgaggtggacgacagcctggagcagccctgcggcctgggctgcctggtgagcacctgctgcgagtgctgcaacaacatcagatgcttcatgatcttctactgcatcctgctgatctgccagggcgtggtgttcggcctgatcgacgtgagcatcggcgacttccagaaggagtaccagctgaagaccatcgagaagctggccctggagaagagctacgacatcagcagcggcctggtggccatcttcatcgccttctacggcgacagaaagaaggtgatctggttcgtggccagcagcttcctgatcggcctgggcagcctgctgtgcgccttccccagcatcaacgaggagaacaagcagagcaaggtgggcatcgaggacatctgcgaggagatcaaggtggtgagcggctgccagagcagcggcatcagcttccagagcaagtacctgagcttcttcatcctgggccagaccgtgcagggcatcgccggcatgcccctgtacatcctgggcatcaccttcatcgacgagaacgtggccacccacagcgccggcatctacctgggcatcgccgagtgcaccagcatgatcggctacgccctgggctacgtgctgggcgcccccctggtgaaggtgcccgagaacaccaccagcgccaccaacaccaccgtgaacaacggcagccccgagtggctgtggacctggtggatcaacttcctgttcgccgccgtggtggcctggtgcaccctgatccccctgagctgcttccccaacaacatgcccggcagcaccagaatcaaggccagaaagagaaagcagctgcacttcttcgacagcagactgaaggacctgaagctgggcaccaacatcaaggacctgtgcgccgccctgtggatcctgatgaagaaccccgtgctgatctgcctggccctgagcaaggccaccgagtacctggtgatcatcggcgccagcgagttcctgcccatctacctggagaaccagttcatcctgacccccaccgtggccaccaccctggccggcctggtgctgatccccggcggcgccctgggccagctgctgggcggcgtgatcgtgagcaccctggagatgagctgcaaggccctgatgagattcatcatggtgaccagcgtgatcagcctgatcctgctggtgttcatcatcttcgtgagatgcaaccccgtgcagttcgccggcatcaacgaggactacgacggcaccggcaagctgggcaacctgaccgccccctgcaacgagaagtgcagatgcagcagcagcatctacagcagcatctgcggcagagacgacatcgagtacttcagcccctgcttcgccggctgcacctacagcaaggcccagaaccagaagaagatgtactacaactgcagctgcatcaaggagggcctgatcaccgccgacgccgagggcgacttcatcgacgccagacccggcaagtgcgacgccaagtgctacaagctgcccctgttcatcgccttcatcttcagcaccctgatcttcagcggcttcagcggcgtgcccatcgtgctggccatgaccagagtggtgcccgacaagctgagaagcctggccctgggcgtgagctacgtgatcctgagaatcttcggcaccatccccggccccagcatcttcaagatgagcggcgagaccagctgcatcctgagagacgtgaacaagtgcggccacaccggcagatgctggatctacaacaagaccaagatggccttcctgctggtgggcatctgcttcctgtgcaagctgtgcaccatcatcttcaccaccatcgccttcttcatctacaagagaagactgaacgagaacaccgacttccccgacgtgaccgtgaagaaccccaaggtgaagaagaaggaggagaccgacctgtag

SEQ ID NO: 100306 - DNA, 1401 bp, Artificial Sequence
  Description of Artificial Sequence: Synthetic coding sequence
atgttcgtgggcgtggccagacacagcggcagccaggacgaggtgagcagaggcgtggagcccctggaggccgccagagcccagcccgccaaggacagaagagccaagggcacccccaagagcagcaagcccggcaagaagcacagatacctgagactgctgcccgaggccctgatcagattcggcggcttcagaaagagaaagaaggccaagagcagcgtgagcaagaagcccggcgaggtggacgacagcctggagcagccctgcggcctgggctgcctggtgagcacctgctgcgagtgctgcaacaacatcagatgcttcatgatcttctactgcatcctgctgatctgccagggcgtggtgttcggcctgatcgacgtgagcatcggcgacttccagaaggagtaccagctgaagaccatcgagaagctggccctggagaagagctacgacatcagcagcggcctggtggccatcttcatcgccttctacggcgacagaaagaaggtgatctggttcgtggccagcagcttcctgatcggcctgggcagcctgctgtgcgccttccccagcatcaacgaggagaacaagcagagcaaggtgggcatcgagggcatcgccgagtgcaccagcatgatcggctacgccctgggctacgtgctgggcgcccccctggtgaaggtgcccgagaacaccaccagcgccaccaagaccggcaagctgggcaacctgaccgccccctgcaacgagaagtgcagatgcagcagcagcatctacagcagcatctgcggcagagacgacatcgagtacttcagcccctgcttcgccggctgcacctacagcaaggcccagaaccagaagaagatgtactacaactgcagctgcatcaaggagggcctgatcaccgccgacgccgagggcgacttcatcgacgccagacccggcaagtgcgacgccaagtgctacaagctgcccctgttcatcgccttcatcttcagcaccctgatcttcagcggcttcagcggcgtgcccatcgtgctggccatgaccagagtggtgcccgacaagctgagaagcctggccctgggcgtgagctacgtgatcctgagaatcttcggcaccatccccggccccagcatcttcaagatgagcggcgagaccagctgcatcctgagagacgtgaacaagtgcggccacaccggcagatgctggatctacaacaagaccaagatggccttcctgctggtgggcatctgcttcctgtgcaagctgtgcaccatcatcttcaccaccatcgccttcttcatctacaagagaagactgaacgagaacaccgacttccccgacgtgaccgtgaagaaccccaaggtgaagaagaaggaggagaccgacctgtag

SEQ ID NO: 100307 - DNA, 1974 bp, Artificial Sequence
  Description of Artificial Sequence: Synthetic coding sequence
atgttcgtgggcgtggccagacacagcggcagccaggacgaggtgagcagaggcgtggagcccctggaggccgccagagcccagcccgccaaggacagaagagccaagggcacccccaagagcagcaagcccggcaagaagcacagatacctgagactgctgcccgaggccctgatcagattcggcggcttcagaaagagaaagaaggccaagagcagcgtgagcaagaagcccggcgaggtggacgacagcctggagcagccctgcggcctgggctgcctggtgagcacctgctgcgagtgctgcaacaacatcagatgcttcatgatcttctactgcatcctgctgatctgccagggcgtggtgttcggcctgatcgacgtgagcatcggcgacttccagaaggagtaccagctgaagaccatcgagaagctggccctggagaagagctacgacatcagcagcggcctggtggccatcttcatcgccttctacggcgacagaaagaaggtgatctggttcgtggccagcagcttcctgatcggcctgggcagcctgctgtgcgccttccccagcatcaacgaggagaacaagcagagcaaggtgggcatcgagggcatcgccgagtgcaccagcatgatcggctacgccctgggctacgtgctgggcgcccccctggtgaaggtgcccgagaacaccaccagcgccaccaacaccaccgtgaacaacggcagccccgagtggctgtggacctggtggatcaacttcctgttcgccgccgtggtggcctggtgcaccctgatccccctgagctgcttccccaacaacatgcccggcagcaccagaatcaaggccagaaagagaaagcagctgcacttcttcgacagcagactgaaggacctgaagctgggcaccaacatcaaggacctgtgcgccgccctgtggatcctgatgaagaaccccgtgctgatctgcctggccctgagcaaggccaccgagtacctggtgatcatcggcgccagcgagttcctgcccatctacctggagaaccagttcatcctgacccccaccgtggccaccaccctggccggcctggtgctgatccccggcggcgccctgggccagctgctgggcggcgtgatcgtgagcaccctggagatgagctgcaaggccctgatgagattcatcatggtgaccagcgtgatcagcctgatcctgctggtgttcatcatcttcgtgagatgcaaccccgtgcagttcgccggcatcaacgaggactacgacggcaccggcaagctgggcaacctgaccgccccctgcaacgagaagtgcagatgcagcagcagcatctacagcagcatctgcggcagagacgacatcgagtacttcagcccctgcttcgccggctgcacctacagcaaggcccagaaccagaagaagatgtactacaactgcagctgcatcaaggagggcctgatcaccgccgacgccgagggcgacttcatcgacgccagacccggcaagtgcgacgccaagtgctacaagctgcccctgttcatcgccttcatcttcagcaccctgatcttcagcggcttcagcggcgtgcccatcgtgctggccatgaccagagtggtgcccgacaagctgagaagcctggccctgggcgtgagctacgtgatcctgagaatcttcggcaccatccccggccccagcatcttcaagatgagcggcgagaccagctgcatcctgagagacgtgaacaagtgcggccacaccggcagatgctggatctacaacaagaccaagatggccttcctgctggtgggcatctgcttcctgtgcaagctgtgcaccatcatcttcaccaccatcgccttcttcatctacaagagaagactgaacgagaacaccgacttccccgacgtgaccgtgaagaaccccaaggtgaagaagaaggaggagaccgacctgtag

SEQ ID NO: 100308 - DNA, 2160 bp, Artificial Sequence; identical to SEQ ID NO: 100305
  Description of Artificial Sequence: Synthetic coding sequence

SEQ ID NO: 100309 - DNA, 78 bp, Artificial Sequence
  Description of Artificial Sequence: Synthetic coding sequence
ctgaacgagaacaccgacttccccgacgtgaccgtgaagaaccccaaggtgaagaagaaggaggagaccgacctgtag

SEQ ID NO: 100310 - DNA, 1401 bp, Artificial Sequence; identical to SEQ ID NO: 100306
  Description of Artificial Sequence: Synthetic coding sequence

SEQ ID NO: 100311 - DNA, 351 bp, Artificial Sequence
  Description of Artificial Sequence: Synthetic coding sequence
atgctgagctgcagactgcagtgcgccctggccgccctgagcatcgtgctggccctgggctgcgtgaccggcgcccccagcgaccccagactgagacagttcctgcagaagagcctggccgccgccgccggcaagcaggagctggccaagtacttcctggccgagctgctgagcgagcccaaccagaccgagaacgacgccctggagcccgaggacctgagccaggccgccgagcaggacgagatgagactggagctgcagagaagcgccaacagcaaccccgccatggcccccagagagagaaaggccggctgcaagaacttcttctggaagaccttcaccagctgctag

SEQ ID NO: 100312 - DNA, 1176 bp, Artificial Sequence
  Description of Artificial Sequence: Synthetic coding sequence
atgttccccaacggcaccgccagcagccccagcagcagccccagccccagccccggcagctgcggcgagggcggcggcagcagaggccccggcgccggcgccgccgacggcatggaggagcccggcagaaacgccagccagaacggcaccctgagcgagggccagggcagcgccatcctgatcagcttcatctacagcgtggtgtgcctggtgggcctgtgcggcaacagcatggtgatctacgtgatcctgagatacgccaagatgaagaccgccaccaacatctacatcctgaacctggccatcgccgacgagctgctgatgctgagcgtgcccttcctggtgaccagcaccctgctgagacactggcccttcggcgccctgctgtgcagactggtgctgagcgtggacgccgtgaacatgttcaccagcatctactgcctgaccgtgctgagcgtggacagatacgtggccgtggtgcaccccatcaaggccgccagatacagaagacccaccgtggccaaggtggtgaacctgggcgtgtgggtgctgagcctgctggtgatcctgcccatcgtggtgttcagcagaaccgccgccaacagcgacggcaccgtggcctgcaacatgctgatgcccgagcccgcccagagatggctggtgggcttcgtgctgtacaccttcctgatgggcttcctgctgcccgtgggcgccatctgcctgtgctacgtgctgatcatcgccaagatgagaatggtggccctgaaggccggctggcagcagagaaagagaagcgagagaaagatcaccctgatggtgatgatggtggtgatggtgttcgtgatctgctggatgcccttctacgtggtgcagctggtgaacgtgttcgccgagcaggacgacgccaccgtgagccagctgagcgtgatcctgggctacgccaacagctgcgccaaccccatcctgtacggcttcctgagcgacaacttcaagagaagcttccagagaatcctgtgcctgagctggatggacaacgccgccgaggagcccgtggactactacgccaccgccctgaagagcagagcctacagcgtggaggacttccagcccgagaacctggagagcggcggcgtgttcagaaacggcacctgcaccagcagaatcaccaccctgtag

SEQ ID NO: 100313 - DNA, 1257 bp, Artificial Sequence
  Description of Artificial Sequence: Synthetic coding sequence
atggacatgctgcaccccagcagcgtgagcaccaccagcgagcccgagaacgccagcagcgcctggccccccgacgccaccctgggcaacgtgagcgccggccccagccccgccggcctggccgtgagcggcgtgctgatccccctggtgtacctggtggtgtgcgtggtgggcctgctgggcaacagcctggtgatctacgtggtgctgagacacaccgccagccccagcgtgaccaacgtgtacatcctgaacctggccctggccgacgagctgttcatgctgggcctgcccttcctggccgcccagaacgccctgagctactggcccttcggcagcctgatgtgcagactggtgatggccgtggacggcatcaaccagttcaccagcatcttctgcctgaccgtgatgagcgtggacagatacctggccgtggtgcaccccaccagaagcgccagatggagaaccgcccccgtggccagaaccgtgagcgccgccgtgtgggtggccagcgccgtggtggtgctgcccgtggtggtgttcagcggcgtgcccagaggcatgagcacctgccacatgcagtggcccgagcccgccgccgcctggagagccggcttcatcatctacaccgccgccctgggcttcttcggccccctgctggtgatctgcctgtgctacctgctgatcgtggtgaaggtgagaagcgccggcagaagagtgtgggcccccagctgccagagaagaagaagaagcgagagaagagtgaccagaatggtggtggccgtggtggccctgttcgtgctgtgctggatgcccttctacgtgctgaacatcgtgaacgtggtgtgccccctgcccgaggagcccgccttcttcggcctgtacttcctggtggtggccctgccctacgccaacagctgcgccaaccccatcctgtacggcttcctgagctacagattcaagcagggcttcagaagagtgctgctgagacccagcagaagagtgagaagccaggagcccaccgtgggcccccccgagaagaccgaggaggaggacgaggaggaggaggacggcgaggagagcagagagggcggcaagggcaaggagatgaacggcagagtgagccagatcacccagcccggcaccagcggccaggagagaccccccagcagagtggccagcaaggagcagcagctgctgccccaggaggccagcaccggcgagaagagcagcaccatgagaatcagctacctgtag

SEQ ID NO: 100314 - DNA, 1257 bp, Artificial Sequence; identical to SEQ ID NO: 100313
  Description of Artificial Sequence: Synthetic coding sequence

SEQ ID NO: 100315 - DNA, 1167 bp, Artificial Sequence
  Description of Artificial Sequence: Synthetic coding sequence
atgagcgcccccagcaccctgccccccggcggcgaggagggcctgggcaccgcctggcccagcgccgccaacgccagcagcgcccccgccgaggccgaggaggccgtggccggccccggcgacgccagagccgccggcatggtggccatccagtgcatctacgccctggtgtgcctggtgggcctggtgggcaacgccctggtgatcttcgtgatcctgagatacgccaagatgaagaccgccaccaacatctacctgctgaacctggccgtggccgacgagctgttcatgctgagcgtgcccttcgtggccagcagcgccgccctgagacactggcccttcggcagcgtgctgtgcagagccgtgctgagcgtggacggcctgaacatgttcaccagcgtgttctgcctgaccgtgctgagcgtggacagatacgtggccgtggtgcaccccctgagagccgccacctacagaagacccagcgtggccaagctgatcaacctgggcgtgtggctggccagcctgctggtgaccctgcccatcgccatcttcgccgacaccagacccgccagaggcggccaggccgtggcctgcaacctgcagtggccccaccccgcctggagcgccgtgttcgtggtgtacaccttcctgctgggcttcctgctgcccgtgctggccatcggcctgtgctacctgctgatcgtgggcaagatgagagccgtggccctgagagccggctggcagcagagaagaagaagcgagaagaagatcaccagactggtgctgatggtggtggtggtgttcgtgctgtgctggatgcccttctacgtggtgcagctgctgaacctgttcgtgaccagcctggacgccaccgtgaaccacgtgagcctgatcctgagctacgccaacagctgcgccaaccccatcctgtacggcttcctgagcgacaacttcagaagattcttccagagagtgctgtgcctgagatgctgcctgctggagggcgccggcggcgccgaggaggagcccctggactactacgccaccgccctgaagagcaagggcggcgccggctgcatgtgcccccccctgccctgccagcaggaggccctgcagcccgagcccggcagaaagagaatccccctgaccagaaccaccaccttctag

SEQ ID NO: 100316 - DNA, 1095 bp, Artificial Sequence
  Description of Artificial Sequence: Synthetic coding sequence
atggagcccctgttccccgccagcacccccagctggaacgccagcagccccggcgccgccagcggcggcggcgacaacagaaccctggtgggccccgcccccagcgccggcgccagagccgtgctggtgcccgtgctgtacctgctggtgtgcgccgccggcctgggcggcaacaccctggtgatctacgtggtgctgagattcgccaagatgaagaccgtgaccaacatctacatcctgaacctggccgtggccgacgtgctgtacatgctgggcctgcccttcctggccacccagaacgccgccagcttctggcccttcggccccgtgctgtgcagactggtgatgaccctggacggcgtgaaccagttcaccagcgtgttctgcctgaccgtgatgagcgtggacagatacctggccgtggtgcaccccctgagcagcgccagatggagaagacccagagtggccaagctggccagcgccgccgcctgggtgctgagcctgtgcatgagcctgcccctgctggtgttcgccgacgtgcaggagggcggcacctgcaacgccagctggcccgagcccgtgggcctgtggggcgccgtgttcatcatctacaccgccgtgctgggcttcttcgcccccctgctggtgatctgcctgtgctacctgctgatcgtggtgaaggtgagagccgccggcgtgagagtgggctgcgtgagaagaagaagcgagagaaaggtgaccagaatggtgctggtggtggtgctggtgttcgccggctgctggctgcccttcttcaccgtgaacatcgtgaacctggccgtggccctgccccaggagcccgccagcgccggcctgtacttcttcgtggtgatcctgagctacgccaacagctgcgccaaccccgtgctgtacggcttcctgagcgacaacttcagacagagcttccagaaggtgctgtgcctgagaaagggcagcggcgccaaggacgccgacgccaccgagcccagacccgacagaatcagacagcagcaggaggccaccccccccgcccacagagccgccgccaacggcctgatgcagaccagcaagctgtag

SEQ ID NO: 100317 - DNA, 1095 bp, Artificial Sequence; identical to SEQ ID NO: 100316
  Description of Artificial Sequence: Synthetic coding sequence

SEQ ID NO: 100318 - DNA, 822 bp, Artificial Sequence
  Description of Artificial Sequence: Synthetic coding sequence
atggagcccctgttccccgccagcacccccagctggaacgccagcagccccggcgccgccagcggcggcggcgacaacagaaccctggtgggccccgcccccagcgccggcgccagagccgtgctggtgcccgtgctgtacctgctggtgtgcgccgccggcctgggcggcaacaccctggtgatctacgtggtgctgagattcgccaagatgaagaccgtgaccaacatctacatcctgaacctggccgtggccgacgtgctgtacatgctgggcctgcccttcctggccacccagaacgccgccagcttctggcccttcggccccgtgctgtgcagactggtgatgaccctggacggcgtgaaccagttcaccagcgtgttctgcctgaccgtgatgagcgtggacagatacctggccgtggtgcaccccctgagcagcgccagatggagaagacccagagtggccaagctggccagcgccgccgcctgggtgctgagcctgtgcatgagcctgcccctgctggtgttcgccgacgtgcaggagggcggcacctgcaacgccagctggcccgagcccgtgggcctgtggggcgccgtgttcatcatctacaccgccgtgctgggcttcttcgcccccctgctgagaggcagcggcagagccggcgacgccaacggcagaccctgggagagcagaagactgccccccagaatcgtgctgcccccccccccccagacccccgccttccccggcgcccccggccccgagagaggccccagagagccctgctggggcctgtggggcaccctggccctgctgtag

SEQ ID NO: 100319 - DNA, 6978 bp, Artificial Sequence
  Description of Artificial Sequence: Synthetic coding sequence
atggccaccaacatcgagcagatcttcagaagcttcgtggtgagcaagttcagagagatccagcaggagctgagcagcggcagaaacgagggccagctgaacggcgagaccaacacccccatcgagggcaaccaggccggcgacgccgccgccagcgccagaagcctgcccaacgaggagatcgtgcagaagatcgaggaggtgctgagcggcgtgctggacaccgagctgagatacaagcccgacctgaaggagggcagcagaaagagcagatgcgtgagcgtgcagaccgaccccaccgacgagatccccaccaagaagagcaagaagcacaagaagcacaagaacaagaagaagaagaagaagaaggagaaggagaagaagtacaagagacagcccgaggagagcgagagcaagaccaagagccacgacgacggcaacatcgacctggagagcgacagcttcctgaagttcgacagcgagcccagcgccgtggccctggagctgcccaccagagccttcggccccagcgagaccaacgagagccccgccgtggtgctggagccccccgtggtgagcatggaggtgagcgagccccacatcctggagaccctgaagcccgccaccaagaccgccgagctgagcgtggtgagcaccagcgtgatcagcgagcagagcgagcagagcgtggccgtgatgcccgagcccagcatgaccaagatcctggacagcttcgccgccgcccccgtgcccaccaccaccctggtgctgaagagcagcgagcccgtggtgaccatgagcgtggagtaccagatgaagagcgtgctgaagagcgtggagagcaccagccccgagcccagcaagatcatgctggtggagccccccgtggccaaggtgctggagcccagcgagaccctggtggtgagcagcgagacccccaccgaggtgtaccccgagcccagcaccagcaccaccatggacttccccgagagcagcgccatcgaggccctgagactgcccgagcagcccgtggacgtgcccagcgagatcgccgacagcagcatgaccagaccccaggagctgcccgagctgcccaagaccaccgccctggagctgcaggagagcagcgtggccagcgccatggagctgcccggcccccccgccaccagcatgcccgagctgcagggcccccccgtgacccccgtgctggagctgcccggccccagcgccacccccgtgcccgagctgcccggccccctgagcacccccgtgcccgagctgcccggcccccccgccaccgccgtgcccgagctgcccggccccagcgtgacccccgtgccccagctgagccaggagctgcccggcctgcccgcccccagcatgggcctggagcccccccaggaggtgcccgagccccccgtgatggcccaggagctgcccggcctgcccctggtgaccgccgccgtggagctgcccgagcagcccgccgtgaccgtggccatggagctgaccgagcagcccgtgaccaccaccgagctggagcagcccgtgggcatgaccaccgtggagcaccccggccaccccgaggtgaccaccgccaccggcctgctgggccagcccgaggccaccatggtgctggagctgcccggccagcccgtggccaccaccgccctggagctgcccggccagcccagcgtgaccggcgtgcccgagctgcccggcctgcccagcgccaccagagccctggagctgagcggccagcccgtggccaccggcgccctggagctgcccggccccctgatggccgccggcgccctggagttcagcggccagagcggcgccgccggcgccctggagctgctgggccagcccctggccaccggcgtgctggagctgcccggccagcccggcgcccccgagctgcccggccagcccgtggccaccgtggccctggagatcagcgtgcagagcgtggtgaccaccagcgagctgagcaccatgaccgtgagccagagcctggaggtgcccagcaccaccgccctggagagctacaacaccgtggcccaggagctgcccaccaccctggtgggcgagaccagcgtgaccgtgggcgtggaccccctgatggcccccgagagccacatcctggccagcaacaccatggagacccacatcctggccagcaacaccatggacagccagatgctggccagcaacaccatggacagccagatgctggccagcaacaccatggacagccagatgctggccagcagcaccatggacagccagatgctggccaccagcagcatggacagccagatgctggccaccagcagcatggacagccagatgctggccaccagcaccatggacagccagatgctggccaccagcagcatggacagccagatgctggccaccagcagcatggacagccagatgctggccaccagcagcatggacagccagatgctggccaccagcagcatggacagccagatgctggccaccagcaccatggacagccagatgctggccaccagcaccatggacagccagatgctggccaccagcagcatggacagccagatgctggccagcggcaccatggacagccagatgctggccagcggcaccatggacgcccagatgctggccagcggcaccatggacgcccagatgctggccagcagcacccaggacagcgccatgctgggcagcaagagccccgacccctacagactggcccaggacccctacagactggcccaggacccctacagactgggccacgacccctacagactgggccacgacgcctacagactgggccaggacccctacagactgggccacgacccctacagactgacccccgacccctacagaatgagccccagaccctacagaatcgcccccagaagctacagaatcgcccccagaccctacagactggcccccagacccctgatgctggccagcagaagaagcatgatgatgagctacgccgccgagagaagcatgatgagcagctacgagagaagcatgatgagctacgagagaagcatgatgagccccatggccgagagaagcatgatgagcgcctacgagagaagcatgatgagcgcctacgagagaagcatgatgagccccatggccgagagaagcatgatgagcgcctacgagagaagcatgatgagcgcctacgagagaagcatgatgagccccatggccgacagaagcatgatgagcatgggcgccgacagaagcatgatgagcagctacagcgccgccgacagaagcatgatgagcagctacagcgccgccgacagaagcatgatgagcagctacaccgccgacagaagcatgatgagcatggccgccgacagctacaccgacagctacaccgacacctacaccgaggcctacatggtgccccccctgccccccgaggagccccccaccatgccccccctgccccccgaggagccccccatgaccccccccctgccccccgaggagccccccgagggccccgccctgcccaccgagcagagcgccctgaccgccgagaacacctggcccaccgaggtgcccagcagccccagcgaggagagcgtgagccagcccgagccccccgtgagccagagcgagatcagcgagcccagcgccgtgcccaccgactacagcgtgagcgccagcgaccccagcgtgctggtgagcgaggccgccgtgaccgtgcccgagcccccccccgagcccgagagcagcatcaccctgacccccgtggagagcgccgtggtggccgaggagcacgaggtggtgcccgagagacccgtgacctgcatggtgagcgagacccccgccatgagcgccgagcccaccgtgctggccagcgagccccccgtgatgagcgagaccgccgagaccttcgacagcatgagagccagcggccacgtggccagcgaggtgagcaccagcctgctggtgcccgccgtgaccacccccgtgctggccgagagcatcctggagccccccgccatggccgcccccgagagcagcgccatggccgtgctggagagcagcgccgtgaccgtgctggagagcagcaccgtgaccgtgctggagagcagcaccgtgaccgtgctggagcccagcgtggtgaccgtgcccgagccccccgtggtggccgagcccgactacgtgaccatccccgtgcccgtggtgagcgccctggagcccagcgtgcccgtgctggagcccgccgtgagcgtgctgcagcccagcatgatcgtgagcgagcccagcgtgagcgtgcaggagagcaccgtgaccgtgagcgagcccgccgtgaccgtgagcgagcagacccaggtgatccccaccgaggtggccatcgagagcacccccatgatcctggagagcagcatcatgagcagccacgtgatgaagggcatcaacctgagcagcggcgaccagaacctggcccccgagatcggcatgcaggagatcgccctgcacagcggcgaggagccccacgccgaggagcacctgaagggcgacttctacgagagcgagcacggcatcaacatcgacctgaacatcaacaaccacctgatcgccaaggagatggagcacaacaccgtgtgcgccgccggcaccagccccgtgggcgagatcggcgaggagaagatcctgcccaccagcgagaccaagcagagaaccgtgctggacacctaccccggcgtgagcgaggccgacgccggcgagaccctgagcagcaccggccccttcgccctggagcccgacgccaccggcaccagcaagggcatcgagttcaccaccgccagcaccctgagcctggtgaacaagtacgacgtggacctgagcctgaccacccaggacaccgagcacgacatggtgatcagcaccagccccagcggcggcagcgaggccgacatcgagggccccctgcccgccaaggacatccacctggacctgcccagcaacaacaacctggtgagcaaggacaccgaggagcccctgcccgtgaaggagagcgaccagaccctggccgccctgctgagccccaaggagagcagcggcggcgagaaggaggtgccccccccccccaaggagaccctgcccgacagcggcttcagcgccaacatcgaggacatcaacgaggccgacctggtgagacccctgctgcccaaggacatggagagactgaccagcctgagagccggcatcgagggccccctgctggccagcgacgtgggcagagacagaagcgccgccagccccgtggtgagcagcatgcccgagagagccagcgagagcagcagcgaggagaaggacgactacgagatcttcgtgaaggtgaaggacacccacgagaagagcaagaagaacaagaacagagacaagggcgagaaggagaagaagagagacagcagcctgagaagcagaagcaagagaagcaagagcagcgagcacaagagcagaaagagaaccagcgagagcagaagcagagccagaaagagaagcagcaagagcaagagccacagaagccagaccagaagcagaagcagaagcagaagaagaagaagaagcagcagaagcagaagcaagagcagaggcagaagaagcgtgagcaaggagaagagaaagagaagccccaagcacagaagcaagagcagagagagaaagagaaagagaagcagcagcagagacaacagaaagaccgtgagagccagaagcagaacccccagcagaagaagcagaagccacacccccagcagaagaagaagaagcagaagcgtgggcagaagaagaagcttcagcatcagccccagcagaagaagcagaacccccagcagaagaagcagaacccccagcagaagaagcagaacccccagcagaagaagcagaacccccagcagaagaagcagaacccccagcagaagaagcagaacccccagcagaagaagaagaagcagaagcgtggtgagaagaagaagcttcagcatcagccccgtgagactgagaagaagcagaacccccctgagaagaagattcagcagaagccccatcagaagaaagagaagcagaagcagcgagagaggcagaagccccaagagactgaccgacctggacaaggcccagctgctggagatcgccaaggccaacgccgccgccatgtgcgccaaggccggcgtgcccctgccccccaacctgaagcccgcccccccccccaccatcgaggagaaggtggccaagaagagcggcggcgccaccatcgaggagctgaccgagaagtgcaagcagatcgcccagagcaaggaggacgacgacgtgatcgtgaacaagccccacgtgagcgacgaggaggaggaggagccccccttctaccaccaccccttcaagctgagcgagcccaagcccatcttcttcaacctgaacatcgccgccgccaagcccaccccccccaagagccaggtgaccctgaccaaggagttccccgtgagcagcggcagccagcacagaaagaaggaggccgacagcgtgtacggcgagtgggtgcccgtggagaagaacggcgaggagaacaaggacgacgacaacgtgttcagcagcaacctgcccagcgagcccgtggacatcagcaccgccatgagcgagagagccctggcccagaagagactgagcgagaacgccttcgacctggaggccatgagcatgctgaacagagcccaggagagaatcgacgcctgggcccagctgaacagcatccccggccagttcaccggcagcaccggcgtgcaggtgctgacccaggagcagctggccaacaccggcgcccaggcctggatcaagaagggccagatcctggtggccgtgttcctgcccagaagcgtgcccgccgtgctgttcaccaccctgctgctgcccagacccagaatcagcagctag

SEQ ID NO: 100320 - DNA, 6912 bp, Artificial Sequence
  Description of Artificial Sequence: Synthetic coding sequence
atggccaccaacatcgagcagatcttcagaagcttcgtggtgagcaagttcagagagatccagcaggagctgagcagcggcagaaacgagggccagctgaacggcgagaccaacacccccatcgagggcaaccaggccggcgacgccgccgccagcgccagaagcctgcccaacgaggagatcgtgcagaagatcgaggaggtgctgagcggcgtgctggacaccgagctgagatacaagcccgacctgaaggagggcagcagaaagagcagatgcgtgagcgtgcagaccgaccccaccgacgagatccccaccaagaagagcaagaagcacaagaagcacaagaacaagaagaagaagaagaagaaggagaaggagaagaagtacaagagacagcccgaggagagcgagagcaagaccaagagccacgacgacggcaacatcgacctggagagcgacagcttcctgaagttcgacagcgagcccagcgccgtggccctggagctgcccaccagagccttcggccccagcgagaccaacgagagccccgccgtggtgctggagccccccgtggtgagcatggaggtgagcgagccccacatcctggagaccctgaagcccgccaccaagaccgccgagctgagcgtggtgagcaccagcgtgatcagcgagcagagcgagcagagcgtggccgtgatgcccgagcccagcatgaccaagatcctggacagcttcgccgccgcccccgtgcccaccaccaccctggtgctgaagagcagcgagcccgtggtgaccatgagcgtggagtaccagatgaagagcgtgctgaagagcgtggagagcaccagccccgagcccagcaagatcatgctggtggagccccccgtggccaaggtgctggagcccagcgagaccctggtggtgagcagcgagacccccaccgaggtgtaccccgagcccagcaccagcaccaccatggacttccccgagagcagcgccatcgaggccctgagactgcccgagcagcccgtggacgtgcccagcgagatcgccgacagcagcatgaccagaccccaggagctgcccgagctgcccaagaccaccgccctggagctgcaggagagcagcgtggccagcgccatggagctgcccggcccccccgccaccagcatgcccgagctgcagggcccccccgtgacccccgtgctggagctgcccggccccagcgccacccccgtgcccgagctgcccggccccctgagcacccccgtgcccgagctgcccggcccccccgccaccgccgtgcccgagctgcccggccccagcgtgacccccgtgccccagctgagccaggagctgcccggcctgcccgcccccagcatgggcctggagcccccccaggaggtgcccgagccccccgtgatggcccaggagctgcccggcctgcccctggtgaccgccgccgtggagctgcccgagcagcccgccgtgaccgtggccatggagctgaccgagcagcccgtgaccaccaccgagctggagcagcccgtgggcatgaccaccgtggagcaccccggccaccccgaggtgaccaccgccaccggcctgctgggccagcccgaggccaccatggtgctggagctgcccggccagcccgtggccaccaccgccctggagctgcccggccagcccagcgtgaccggcgtgcccgagctgcccggcctgcccagcgccaccagagccctggagctgagcggccagcccgtggccaccggcgccctggagctgcccggccccctgatggccgccggcgccctggagttcagcggccagagcggcgccgccggcgccctggagctgctgggccagcccctggccaccggcgtgctggagctgcccggccagcccggcgcccccgagctgcccggccagcccgtggccaccgtggccctggagatcagcgtgcagagcgtggtgaccaccagcgagctgagcaccatgaccgtgagccagagcctggaggtgcccagcaccaccgccctggagagctacaacaccgtggcccaggagctgcccaccaccctggtgggcgagaccagcgtgaccgtgggcgtggaccccctgatggcccccgagagccacatcctggccagcaacaccatggagacccacatcctggccagcaacaccatggacagccagatgctggccagcaacaccatggacagccagatgctggccagcaacaccatggacagccagatgctggccagcagcaccatggacagccagatgctggccaccagcagcatggacagccagatgctggccaccagcagcatggacagccagatgctggccaccagcaccatggacagccagatgctggccaccagcagcatggacagccagatgctggccaccagcagcatggacagccagatgctggccaccagcagcatggacagccagatgctggccaccagcagcatggacagccagatgctggccaccagcaccatggacagccagatgctggccaccagcaccatggacagccagatgctggccaccagcagcatggacagccagatgctggccagcggcaccatggacagccagatgctggccagcggcaccatggacgcccagatgctggccagcggcaccatggacgcccagatgctggccagcagcacccaggacagcgccatgctgggcagcaagagccccgacccctacagactggcccaggacccctacagactggcccaggacccctacagactgggccacgacccctacagactgggccacgacgcctacagactgggccaggacccctacagactgggccacgacccctacagactgacccccgacccctacagaatgagccccagaccctacagaatcgcccccagaagctacagaatcgcccccagaccctacagactggcccccagacccctgatgctggccagcagaagaagcatgatgatgagctacgccgccgagagaagcatgatgagcagctacgagagaagcatgatgagctacgagagaagcatgatgagccccatggccgagagaagcatgatgagcgcctacgagagaagcatgatgagcgcctacgagagaagcatgatgagccccatggccgagagaagcatgatgagcgcctacgagagaagcatgatgagcgcctacgagagaagcatgatgagccccatggccgacagaagcatgatgagcatgggcgccgacagaagcatgatgagcagctacagcgccgccgacagaagcatgatgagcagctacagcgccgccgacagaagcatgatgagcagctacaccgccgacagaagcatgatgagcatggccgccgacagctacaccgacagctacaccgacacctacaccgaggcctacatggtgccccccctgccccccgaggagccccccaccatgccccccctgccccccgaggagccccccatgaccccccccctgccccccgaggagccccccgagggccccgccctgcccaccgagcagagcgccctgaccgccgagaacacctggcccaccgaggtgcccagcagccccagcgaggagagcgtgagccagcccgagccccccgtgagccagagcgagatcagcgagcccagcgccgtgcccaccgactacagcgtgagcgccagcgaccccagcgtgctggtgagcgaggccgccgtgaccgtgcccgagcccccccccgagcccgagagcagcatcaccctgacccccgtggagagcgccgtggtggccgaggagcacgaggtggtgcccgagagacccgtgacctgcatggtgagcgagacccccgccatgagcgccgagcccaccgtgctggccagcgagccccccgtgatgagcgagaccgccgagaccttcgacagcatgagagccagcggccacgtggccagcgaggtgagcaccagcctgctggtgcccgccgtgaccacccccgtgctggccgagagcatcctggagccccccgccatggccgcccccgagagcagcgccatggccgtgctggagagcagcgccgtgaccgtgctggagagcagcaccgtgaccgtgctggagagcagcaccgtgaccgtgctggagcccagcgtggtgaccgtgcccgagccccccgtggtggccgagcccgactacgtgaccatccccgtgcccgtggtgagcgccctggagcccagcgtgcccgtgctggagcccgccgtgagcgtgctgcagcccagcatgatcgtgagcgagcccagcgtgagcgtgcaggagagcaccgtgaccgtgagcgagcccgccgtgaccgtgagcgagcagacccaggtgatccccaccgaggtggccatcgagagcacccccatgatcctggagagcagcatcatgagcagccacgtgatgaagggcatcaacctgagcagcggcgaccagaacctggcccccgagatcggcatgcaggagatcgccctgcacagcggcgaggagccccacgccgaggagcacctgaagggcgacttctacgagagcgagcacggcatcaacatcgacctgaacatcaacaaccacctgatcgccaaggagatggagcacaacaccgtgtgcgccgccggcaccagccccgtgggcgagatcggcgaggagaagatcctgcccaccagcgagaccaagcagagaaccgtgctggacacctaccccggcgtgagcgaggccgacgccggcgagaccctgagcagcaccggccccttcgccctggagcccgacgccaccggcaccagcaagggcatcgagttcaccaccgccagcaccctgagcctggtgaacaagtacgacgtggacctgagcctgaccacccaggacaccgagcacgacatggtgatcagcaccagccccagcggcggcagcgaggccgacatcgagggccccctgcccgccaaggacatccacctggacctgcccagcaacaacaacctggtgagcaaggacaccgaggagcccctgcccgtgaaggagagcgaccagaccctggccgccctgctgagccccaaggagagcagcggcggcgagaaggaggtgccccccccccccaaggagaccctgcccgacagcggcttcagcgccaacatcgaggacatcaacgaggccgacctggtgagacccctgctgcccaaggacatggagagactgaccagcctgagagccggcatcgagggccccctgctggccagcgacgtgggcagagacagaagcgccgccagccccgtggtgagcagcatgcccgagagagccagcgagagcagcagcgaggagaaggacgactacgagatcttcgtgaaggtgaaggacacccacgagaagagcaagaagaacaagaacagagacaagggcgagaaggagaagaagagagacagcagcctgagaagcagaagcaagagaagcaagagcagcgagcacaagagcagaaagagaaccagcgagagcagaagcagagccagaaagagaagcagcaagagcaagagccacagaagccagaccagaagcagaagcagaagcagaagaagaagaagaagcagcagaagcagaagcaagagcagaggcagaagaagcgtgagcaaggagaagagaaagagaagccccaagcacagaagcaagagcagagagagaaagagaaagagaagcagcagcagagacaacagaaagaccgtgagagccagaagcagaacccccagcagaagaagcagaagccacacccccagcagaagaagaagaagcagaagcgtgggcagaagaagaagcttcagcatcagccccagcagaagaagcagaacccccagcagaagaagcagaacccccagcagaagaagcagaacccccagcagaagaagcagaacccccagcagaagaagcagaacccccagcagaagaagcagaacccccagcagaagaagaagaagcagaagcgtggtgagaagaagaagcttcagcatcagccccgtgagactgagaagaagcagaacccccctgagaagaagattcagcagaagccccatcagaagaaagagaagcagaagcagcgagagaggcagaagccccaagagactgaccgacctggacaaggcccagctgctggagatcgccaaggccaacgccgccgccatgtgcgccaaggccggcgtgcccctgccccccaacctgaagcccgcccccccccccaccatcgaggagaaggtggccaagaagagcggcggcgccaccatcgaggagctgaccgagaagtgcaagcagatcgcccagagcaaggaggacgacgacgtgatcgtgaacaagccccacgtgagcgacgaggaggaggaggagccccccttctaccaccaccccttcaagctgagcgagcccaagcccatcttcttcaacctgaacatcgccgccgccaagcccaccccccccaagagccaggtgaccctgaccaaggagttccccgtgagcagcggcagccagcacagaaagaaggaggccgacagcgtgtacggcgagtgggtgcccgtggagaagaacggcgaggagaacaaggacgacgacaacgtgttcagcagcaacctgcccagcgagggcagagtgaagagacagggcagagtgagaagacagatgaagcagcccgccgccagccacctgaccgtgaccagatgcaacagcctgtgcggcaccaagccccagagcgagaagcacagaatcgccgagaacagcgtgatcaccagcctgcccaacatcggccccagcctgcacctgtgggagggcagccccagatacaactacctggccagcagattcgccagcagactgtacagcagcagattctggtggtag

SEQ ID NO: 100321 - DNA, 7281 bp, Artificial Sequence
  Description of Artificial Sequence: Synthetic coding sequence
atggccaccaacatcgagcagatcttcagaagcttcgtggtgagcaagttcagagagatccagcaggagctgagcagcggcagaaacgagggccagctgaacggcgagaccaacacccccatcgagggcaaccaggccggcgacgccgccgccagcgccagaagcctgcccaacgaggagatcgtgcagaagatcgaggaggtgctgagcggcgtgctggacaccgagctgagatacaagcccgacctgaaggagggcagcagaaagagcagatgcgtgagcgtgcagaccgaccccaccgacgagatccccaccaagaagagcaagaagcacaagaagcacaagaacaagaagaagaagaagaagaaggagaaggagaagaagtacaagagacagcccgaggagagcgagagcaagaccaagagccacgacgacggcaacatcgacctggagagcgacagcttcctgaagttcgacagcgagcccagcgccgtggccctggagctgcccaccagagccttcggccccagcgagaccaacgagagccccgccgtggtgctggagccccccgtggtgagcatggaggtgagcgagccccacatcctggagaccctgaagcccgccaccaagaccgccgagctgagcgtggtgagcaccagcgtgatcagcgagcagagcgagcagagcgtggccgtgatgcccgagcccagcatgaccaagatcctggacagcttcgccgccgcccccgtgcccaccaccaccctggtgctgaagagcagcgagcccgtggtgaccatgagcgtggagtaccagatgaagagcgtgctgaagagcgtggagagcaccagccccgagcccagcaagatcatgctggtggagccccccgtggccaaggtgctggagcccagcgagaccctggtggtgagcagcgagacccccaccgaggtgtaccccgagcccagcaccagcaccaccatggacttccccgagagcagcgccatcgaggccctgagactgcccgagcagcccgtggacgtgcccagcgagatcgccgacagcagcatgaccagaccccaggagctgcccgagctgcccaagaccaccgccctggagctgcaggagagcagcgtggccagcgccatggagctgcccggcccccccgccaccagcatgcccgagctgcagggcccccccgtgacccccgtgctggagctgcccggccccagcgccacccccgtgcccgagctgcccggccccctgagcacccccgtgcccgagctgcccggcccccccgccaccgccgtgcccgagctgcccggccccagcgtgacccccgtgccccagctgagccaggagctgcccggcctgcccgcccccagcatgggcctggagcccccccaggaggtgcccgagccccccgtgatggcccaggagctgcccggcctgcccctggtgaccgccgccgtggagctgcccgagcagcccgccgtgaccgtggccatggagctgaccgagcagcccgtgaccaccaccgagctggagcagcccgtgggcatgaccaccgtggagcaccccggccaccccgaggtgaccaccgccaccggcctgctgggccagcccgaggccaccatggtgctggagctgcccggccagcccgtggccaccaccgccctggagctgcccggccagcccagcgtgaccggcgtgcccgagctgcccggcctgcccagcgccaccagagccctggagctgagcggccagcccgtggccaccggcgccctggagctgcccggccccctgatggccgccggcgccctggagttcagcggccagagcggcgccgccggcgccctggagctgctgggccagcccctggccaccggcgtgctggagctgcccggccagcccggcgcccccgagctgcccggccagcccgtggccaccgtggccctggagatcagcgtgcagagcgtggtgaccaccagcgagctgagcaccatgaccgtgagccagagcctggaggtgcccagcaccaccgccctggagagctacaacaccgtggcccaggagctgcccaccaccctggtgggcgagaccagcgtgaccgtgggcgtggaccccctgatggcccccgagagccacatcctggccagcaacaccatggagacccacatcctggccagcaacaccatggacagccagatgctggccagcaacaccatggacagccagatgctggccagcaacaccatggacagccagatgctggccagcagcaccatggacagccagatgctggccaccagcagcatggacagccagatgctggccaccagcagcatggacagccagatgctggccaccagcaccatggacagccagatgctggccaccagcagcatggacagccagatgctggccaccagcagcatggacagccagatgctggccaccagcagcatggacagccagatgctggccaccagcagcatggacagccagatgctggccaccagcaccatggacagccagatgctggccaccagcaccatggacagccagatgctggccaccagcagcatggacagccagatgctggccagcggcaccatggacagccagatgctggccagcggcaccatggacgcccagatgctggccagcggcaccatggacgcccagatgctggccagcagcacccaggacagcgccatgctgggcagcaagagccccgacccctacagactggcccaggacccctacagactggcccaggacccctacagactgggccacgacccctacagactgggccacgacgcctacagactgggccaggacccctacagactgggccacgacccctacagactgacccccgacccctacagaatgagccccagaccctacagaatcgcccccagaagctacagaatcgcccccagaccctacagactggcccccagacccctgatgctggccagcagaagaagcatgatgatgagctacgccgccgagagaagcatgatgagcagctacgagagaagcatgatgagctacgagagaagcatgatgagccccatggccgagagaagcatgatgagcgcctacgagagaagcatgatgagcgcctacgagagaagcatgatgagccccatggccgagagaagcatgatgagcgcctacgagagaagcatgatgagcgcctacgagagaagcatgatgagccccatggccgacagaagcatgatgagcatgggcgccgacagaagcatgatgagcagctacagcgccgccgacagaagcatgatgagcagctacagcgccgccgacagaagcatgatgagcagctacaccgccgacagaagcatgatgagcatggccgccgacagctacaccgacagctacaccgacacctacaccgaggcctacatggtgccccccctgccccccgaggagccccccaccatgccccccctgccccccgaggagccccccatgaccccccccctgccccccgaggagccccccgagggccccgccctgcccaccgagcagagcgccctgaccgccgagaacacctggcccaccgaggtgcccagcagccccagcgaggagagcgtgagccagcccgagccccccgtgagccagagcgagatcagcgagcccagcgccgtgcccaccgactacagcgtgagcgccagcgaccccagcgtgctggtgagcgaggccgccgtgaccgtgcccgagcccccccccgagcccgagagcagcatcaccctgacccccgtggagagcgccgtggtggccgaggagcacgaggtggtgcccgagagacccgtgacctgcatggtgagcgagacccccgccatgagcgccgagcccaccgtgctggccagcgagccccccgtgatgagcgagaccgccgagaccttcgacagcatgagagccagcggccacgtggccagcgaggtgagcaccagcctgctggtgcccgccgtgaccacccccgtgctggccgagagcatcctggagccccccgccatggccgcccccgagagcagcgccatggccgtgctggagagcagcgccgtgaccgtgctggagagcagcaccgtgaccgtgctggagagcagcaccgtgaccgtgctggagcccagcgtggtgaccgtgcccgagccccccgtggtggccgagcccgactacgtgaccatccccgtgcccgtggtgagcgccctggagcccagcgtgcccgtgctggagcccgccgtgagcgtgctgcagcccagcatgatcgtgagcgagcccagcgtgagcgtgcaggagagcaccgtgaccgtgagcgagcccgccgtgaccgtgagcgagcagacccaggtgatccccaccgaggtggccatcgagagcacccccatgatcctggagagcagcatcatgagcagccacgtgatgaagggcatcaacctgagcagcggcgaccagaacctggcccccgagatcggcatgcaggagatcgccctgcacagcggcgaggagccccacgccgaggagcacctgaagggcgacttctacgagagcgagcacggcatcaacatcgacctgaacatcaacaaccacctgatcgccaaggagatggagcacaacaccgtgtgcgccgccggcaccagccccgtgggcgagatcggcgaggagaagatcctgcccaccagcgagaccaagcagagaaccgtgctggacacctaccccggcgtgagcgaggccgacgccggcgagaccctgagcagcaccggccccttcgccctggagcccgacgccaccggcaccagcaagggcatcgagttcaccaccgccagcaccctgagcctggtgaacaagtacgacgtggacctgagcctgaccacccaggacaccgagcacgacatggtgatcagcaccagccccagcggcggcagcgaggccgacatcgagggccccctgcccgccaaggacatccacctggacctgcccagcaacaacaacctggtgagcaaggacaccgaggagcccctgcccgtgaaggagagcgaccagaccctggccgccctgctgagccccaaggagagcagcggcggcgagaaggaggtgccccccccccccaaggagaccctgcccgacagcggcttcagcgccaacatcgaggacatcaacgaggccgacctggtgagacccctgctgcccaaggacatggagagactgaccagcctgagagccggcatcgagggccccctgctggccagcgacgtgggcagagacagaagcgccgccagccccgtggtgagcagcatgcccgagagagccagcgagagcagcagcgaggagaaggacgactacgagatcttcgtgaaggtgaaggacacccacgagaagagcaagaagaacaagaacagagacaagggcgagaaggagaagaagagagacagcagcctgagaagcagaagcaagagaagcaagagcagcgagcacaagagcagaaagagaaccagcgagagcagaagcagagccagaaagagaagcagcaagagcaagagccacagaagccagaccagaagcagaagcagaagcagaagaagaagaagaagcagcagaagcagaagcaagagcagaggcagaagaagcgtgagcaaggagaagagaaagagaagccccaagcacagaagcaagagcagagagagaaagagaaagagaagcagcagcagagacaacagaaagaccgtgagagccagaagcagaacccccagcagaagaagcagaagccacacccccagcagaagaagaagaagcagaagcgtgggcagaagaagaagcttcagcatcagccccagcagaagaagcagaacccccagcagaagaagcagaacccccagcagaagaagcagaacccccagcagaagaagcagaacccccagcagaagaagcagaacccccagcagaagaagcagaacccccagcagaagaagaagaagcagaagcgtggtgagaagaagaagcttcagcatcagccccgtgagactgagaagaagcagaacccccctgagaagaagattcagcagaagccccatcagaagaaagagaagcagaagcagcgagagaggcagaagccccaagagactgaccgacctggacaaggcccagctgctggagatcgccaaggccaacgccgccgccatgtgcgccaaggccggcgtgcccctgccccccaacctgaagcccgcccccccccccaccatcgaggagaaggtggccaagaagagcggcggcgccaccatcgaggagctgaccgagaagtgcaagcagatcgcccagagcaaggaggacgacgacgtgatcgtgaacaagccccacgtgagcgacgaggaggaggaggagccccccttctaccaccaccccttcaagctgagcgagcccaagcccatcttcttcaacctgaacatcgccgccgccaagcccaccccccccaagagccaggtgaccctgaccaaggagttccccgtgagcagcggcagccagcacagaaagaaggaggccgacagcgtgtacggcgagtgggtgcccgtggagaagaacggcgaggagaacaaggacgacgacaacgtgttcagcagcaacctgcccagcgagcccgtggacatcagcaccgccatgagcgagagagccctggcccagaagagactgagcgagaacgccttcgacctggaggccatgagcatgctgaacagagcccaggagagaatcgacgcctgggcccagctgaacagcatccccggccagttcaccggcagcaccggcgtgcaggtgctgacccaggagcagctggccaacaccggcgcccaggcctggatcaagaaggaccagttcctgagagccgcccccgtgaccggcggcatgggcgccgtgctgatgagaaagatgggctggagagagggcgagggcctgggcaagaacaaggagggcaacaaggagcccatcctggtggacttcaagaccgacagaaagggcctggtggccgtgggcgagagagcccagaagagaagcggcaacttcagcgccgccatgaaggacctgagcggcaagcaccccgtgagcgccctgatggagatctgcaacaagagaagatggcagccccccgagttcctgctggtgcacgacagcggccccgaccacagaaagcacttcctgttcagagtgctgagaaacggcgccctgaccagacccaactgcatgttcttcctgaacagatactag

SEQ ID NO: 100322 - DNA, 1584 bp, Artificial Sequence
  Description of Artificial Sequence: Synthetic coding sequence
atggcccccgagagactgagaagcagagccctgagcgccttcaagctgagaggcctgctgctgagaggcgaggccatcaagtacctgaccgaggccctgcagagcatcagcgagctggagctggaggacaagctggagaagatcatcaacgccgtggagaagcagcccctgagcagcaacatgatcgagagaagcgtggtggaggccgccgtgcaggagtgcagccagagcgtggacgagaccatcgagcacgtgttcaacatcatcggcgccttcgacatccccagattcgtgtacaacagcgagagaaagaagttcctgcccctgctgatgaccaaccaccccgcccccaacctgttcggcacccccagagacaaggccgagatgttcagagagagatacaccatcctgcaccagagaacccacagacacgagctgttcaccccccccgtgatcggcagccaccccgacgagagcggcagcaagttccagctgaagaccatcgagaccctgctgggcagcaccaccaagatcggcgacgccatcgtgctgggcatgatcacccagctgaaggagggcaagttcttcctggaggaccccaccggcaccgtgcagctggacctgagcaaggcccagttccacagcggcctgtacaccgaggcctgcttcgtgctggccgagggctggttcgaggaccaggtgttccacgtgaacgccttcggcttcccccccaccgagcccagcagcaccaccagagcctactacggcaacatcaacttcttcggcggccccagcaacaccagcgtgaagaccagcgccaagctgaagcagctggaggaggagaacaaggacgccatgttcgtgttcctgagcgacgtgtggctggaccaggtggaggtgctggagaagctgagaatcatgttcgccggctacagccccgccccccccacctgcttcatcctgtgcggcaacttcagcagcgccccctacggcaagaaccaggtgcaggccctgaaggacagcctgaagaccctggccgacatcatctgcgagtaccccgacatccaccagagcagcagattcgtgttcgtgcccggccccgaggaccccggcttcggcagcatcctgcccagaccccccctggccgagagcatcaccaacgagttcagacagagagtgcccttcagcgtgttcaccaccaacccctgcagaatccagtactgcacccaggagatcaccgtgttcagagaggacctggtgaacaagatgtgcagaaactgcgtgagattccccagcagcaacctggccatccccaaccacttcgtgaagaccatcctgagccagggccacctgacccccctgcccctgtacgtgtgccccgtgtactgggcctacgactacgccctgagagtgtaccccgtgcccgacctgctggtgatcgccgacaagtacgaccccttcaccaccaccaacaccgagtgcctgtgcatcaaccccggcagcttccccagaagcggcttcagcttcaaggtgttctaccccagcaacaagaccgtggaggacagcaagctgcagggcttctag

SEQ ID NO: 100323 - DNA, 3900 bp, Artificial Sequence
  Description of Artificial Sequence: Synthetic coding sequence
atgcagcaggccccccagccctacgagttcttcagcgaggagaacagccccaagtggagaggcctgctggtgagcgccctgagaaaggtgcaggagcaggtgcaccccaccctgagcgccaacgaggagagcctgtactacatcgaggagctgatcttccagctgctgaacaagctgtgcatggcccagcccagaaccgtgcaggacgtggaggagagagtgcagaagaccttcccccaccccatcgacaagtgggccatcgccgacgcccagagcgccatcgagaagagaaagagaagaaaccccctgctgctgcccgtggacaagatccaccccagcctgaaggaggtgctgggctacaaggtggactaccacgtgagcctgtacatcgtggccgtgctggagtacatcagcgccgacatcctgaagctggccggcaactacgtgttcaacatcagacactacgagatcagccagcaggacatcaaggtgagcatgtgcgccgacaaggtgctgatggacatgttcgaccaggacgacatcggcctggtgagcctgtgcgaggacgagcccagcagcagcggcgagctgaactactacgacctggtgagaaccgagatcgccgaggagagacagtacctgagagagctgaacatgatcatcaaggtgttcagagaggccttcctgagcgacagaaagctgttcaagcccagcgacatcgagaagatcttcagcaacatcagcgacatccacgagctgaccgtgaagctgctgggcctgatcgaggacaccgtggagatgaccgacgagagcagcccccaccccctggccggcagctgcttcgaggacctggccgaggagcaggccttcgacccctacgagaccctgagccaggacatcctgagccccgagttccacgagcacttcaacaagctgatggccagacccgccgtggccctgcacttccagcagctgaaggcctgcagcgaggagcaggaggacagagagtgcctgaaccaggccatcaccgccctgatgaacctgcagggcagcatggacagaatctacaagcagtacagccccagaagaagacccggcgaccccgtgtgccccttctacagccaccagctgagaagcaagcacctggccatcaagaagatgaacgagatccagaagaacatcgacggctgggagggcaaggacatcggccagtgctgcaacgagttcatcatggagggccccctgaccagaatcggcgccaagcacgagagacacatcttcctgttcgacggcctgatgatcagctgcaagcccaaccacggccagaccagactgcccggctacagcagcgccgagtacagactgaaggagaagttcgtgatgagaaagatccagatctgcgacaaggaggacacctgcgagcacaagcacgccttcgagctggtgagcaaggacgagaacagcatcatcttcgccgccaagagcgccgaggagaagaacaactggatggccgccctgatcagcctgcactacagaagcaccctggacagaatgctggacagcgtgctgctgaaggaggagaacgagcagcccctgagactgcccagccccgaggtgtacagattcgtggtgaaggacagcgaggagaacatcgtgttcgaggacaacctgcagagcagaagcggcatccccatcatcaagggcggcaccgtggtgaagctgatcgagagactgacctaccacatgtacgccgaccccaacttcgtgagaaccttcctgaccacctacagaagcttctgcaagccccaggagctgctgagcctgctgatcgagagattcgagatccccgagcccgagcccaccgacgccgacaagctggccatcgagaagggcgagcagcccatcagcgccgacctgaagagattcagaaaggagtacgtgcagcccgtgcagctgagaatcctgaacgtgttcagacactgggtggagcaccacttctacgacttcgagagagacctggagctgctggagagactggagagcttcatcagcagcgtgagaggcaaggccatgaagaagtgggtggagagcatcgccaagatcatcagaagaaagaagcaggcccaggccaacggcgtgagccacaacatcaccttcgagagcccccccccccccatcgagtggcacatcagcaagcccggccagttcgagaccttcgacctgatgaccctgcaccccatcgagatcgccagacagctgaccctgctggagagcgacctgtacagaaaggtgcagcccagcgagctggtgggcagcgtgtggaccaaggaggacaaggagatcaacagccccaacctgctgaagatgatcagacacaccaccaacctgaccctgtggttcgagaagtgcatcgtggaggccgagaacttcgaggagagagtggccgtgctgagcagaatcatcgagatcctgcaggtgttccaggacctgaacaacttcaacggcgtgctggagatcgtgagcgccgtgaacagcgtgagcgtgtacagactggaccacaccttcgaggccctgcaggagagaaagagaaagatcctggacgaggccgtggagctgagccaggaccacttcaagaagtacctggtgaagctgaagagcatcaaccccccctgcgtgcccttcttcggcatctacctgaccaacatcctgaagaccgaggagggcaacaacgacttcctgaagaagaagggcaaggacctgatcaacttcagcaagagaagaaaggtggccgagatcaccggcgagatccagcagtaccagaaccagccctactgcctgagaatcgagcccgacatgagaagattcttcgagaacctgaaccccatgggcagcgccagcgagaaggagttcaccgactacctgttcaacaagagcctggagatcgagcccagaaactgcaagcagccccccagattccccagaaagagcaccttcagcctgaagagccccggcatcagacccaacaccggcagacacggcagcaccagcggcaccctgagaggccaccccacccccctggagagagagccctgcaagatcagcttcagcagaatcgccgagaccgagctggagagcaccgtgagcgcccccaccagccccaacacccccagcaccccccccgtgagcgccagcagcgacctgagcgtgttcctggacgtggacctgaacagcagctgcggcagcaacagcatcttcgcccccgtgctgctgccccacagcaagagcttcttcagcagctgcggcagcctgcacaagctgagcgaggagcccctgatccccccccccctgccccccagaaagaagttcgaccacgacgccagcaacagcaagggcaacatgaagagcgacgacgacccccccgccatcccccccagacagccccccccccccaaggtgaagcccagagtgcccgtgcccaccggcgccttcgacggccccctgcacagcccccccccccccccccccagagaccccctgcccgacacccccccccccgtgcccctgagaccccccgagcacttcatcaactgccccttcaacctgcagcccccccccctgggccacctgcacagagacagcgactggctgagagacatcagcacctgccccaacagccccagcaccccccccagcacccccagccccagagtgcccagaagatgctacgtgctgagcagcagccagaacaacctggcccacccccccgccccccccgtgccccccagacagaacagcagcccccacctgcccaagctgccccccaagacctacaagagagagctgagccacccccccctgtacagactgcccctgctggagaacgccgagaccccccagtag

SEQ ID NO: 100324 - DNA, 1389 bp, Artificial Sequence
  Description of Artificial Sequence: Synthetic coding sequence
atgctgctgctggccagatgcctgctgctggtgctggtgagcagcctgctggtgtgcagcggcctggcctgcggccccggcagaggcttcggcaagagaagacaccccaagaagctgacccccctggcctacaagcagttcatccccaacgtggccgagaagaccctgggcgccagcggcagatacgagggcaagatcagcagaaacagcgagagattcaaggagctgacccccaactacaaccccgacatcatcttcaaggacgaggagaacaccggcgccgacagactgatgacccagagatgcaaggacaagctgaacgccctggccatcagcgtgatgaaccagtggcccggcgtgaagctgagagtgaccgagggctgggacgaggacggccaccacagcgaggagagcctgcactacgagggcagagccgtggacatcaccaccagcgacagagacagaagcaagtacggcatgctggccagactggccgtggaggccggcttcgactgggtgtactacgagagcaaggcccacatccactgcagcgtgaaggccgagaacagcgtggccgccaagagcggcggctgcttccccggcagcgccaccgtgcacctggagcagggcggcaccaagctggtgaaggacctgagccccggcgacagagtgctggccgccgacgaccagggcagactgctgtacagcgacttcctgaccttcctggacagagacgacggcgccaagaaggtgttctacgtgatcgagaccagagagcccagagagagactgctgctgaccgccgcccacctgctgttcgtggccccccacaacgacagcgccaccggcgagcccgaggccagcagcggcagcggcccccccagcggcggcgccctgggccccagagccctgttcgccagcagagtgagacccggccagagagtgtacgtggtggccgagagagacggcgacagaagactgctgcccgccgccgtgcacagcgtgaccctgagcgaggaggccgccggcgcctacgcccccctgaccgcccagggcaccatcctgatcaacagagtgctggccagctgctacgccgtgatcgaggagcacagctgggcccacagagccttcgcccccttcagactggcccacgccctgctggccgccctggcccccgccagaaccgacagaggcggcgacagcggcggcggcgacagaggcggcggcggcggcagagtggccctgaccgcccccggcgccgccgacgcccccggcgccggcgccaccgccggcatccactggtacagccagctgctgtaccagatcggcacctggctgctggacagcgaggccctgcaccccctgggcatggccgtgaagagcagctag

SEQ ID NO: 100325 - DNA, 3456 bp, Artificial Sequence
  Description of Artificial Sequence: Synthetic coding sequence
atgagcagcgagtgcgacggcggcagcaaggccgtgatgaacggcctggcccccggcagcaacggccaggacaaggccaccgccgaccccctgagagccagaagcatcagcgccgtgaagatcatccccgtgaagaccgtgaagaacgccagcggcctggtgctgcccaccgacatggacctgaccaagatctgcaccggcaagggcgccgtgaccctgagagccagcagcagctacagagagacccccagcagcagccccgccagcccccaggagaccagacagcacgagagcaagcccggcctggagcccgagcccagcagcgccgacgagtggagactgagcagcagcgccgacgccaacggcaacgcccagcccagcagcctggccgccaagggctacagaagcgtgcaccccaacctgcccagcgacaagagccaggacgccaccagcagcagcgccgcccagcccgaggtgatcgtggtgcccctgtacctggtgaacaccgacagaggccaggagggcaccgccagaccccccacccccctgggccccctgggctgcgtgcccaccatccccgccaccgccagcgccgccagccccctgaccttccccaccctggacgacttcatccccccccacctgcagagatggccccaccacagccagcccgccagagccagcggcagcttcgcccccatcagccagaccccccccagcttcagcccccccccccccctggtgccccccgcccccgaggacctgagaagagtgagcgagcccgacctgaccggcgccgtgagcagcaccgacagcagccccctgctgaacgaggtgagcagcagcctgatcggcaccgacagccaggccttccccagcgtgagcaagcccagcagcgcctaccccagcaccaccatcgtgaaccccaccatcgtgctgctgcagcacaacagagagcagcagaagagactgagcagcctgagcgaccccgtgagcgagagaagagtgggcgagcaggacagcgcccccacccaggagaagcccaccagccccggcaaggccatcgagaagagagccaaggacgacagcagaagagtggtgaagagcacccaggacctgagcgacgtgagcatggacgaggtgggcatccccctgagaaacaccgagagaagcaaggactggtacaagaccatgttcaagcagatccacaagctgaacagagacacccccgaggagaacccctacttccccacctacaagttccccgagctgcccgagatccagcagaccagcgaggagaccaagagctgcagcgtgatgagccccagactggagtgcagcggcaccgtgatcgcccactgcagcctgaagctgctggacagcagcaacccccccaccagcgccagccaggtggccggcaccgccgacgacgacagcgacctgtacagccccagatacagcttcagcgaggacaccaagagccccctgagcgtgcccagaagcaagagcgagatgagctacatcgacggcgagaaggtggtgaagagaagcgccaccctgcccctgcccgccagaagcagcagcctgaagagcagcagcgagagaaacgactgggagccccccgacaagaaggtggacaccagaaagtacagagccgagcccaagagcatctacgagtaccagcccggcaagagcagcgtgctgaccaacgagaagatgagcagagacatcagccccgaggagatcgacctgaagaacgagccctggtacaagttcttcagcgagctggagttcggcaagcccccccccaagaagatctgggactacacccccggcgactgcagcatcctgcccagagaggacagaaagaccaacctggacaaggacctgagcctgtgccagaccgagctggaggccgacctggagaagatggagaccctgaacaaggcccccagcgccaacgtgccccagagcagcgccatcagccccacccccgagatcagcagcgagacccccggctacatctacagcagcaacttccacgccgtgaagagagagagcgacggcgcccccggcgacctgaccagcctggagaacgagagacagatctacaagagcgtgctggagggcggcgacatccccctgcagggcctgagcggcctgaagagacccagcagcagcgccagcaccaaggacagcgagagccccagacacttcatccccgccgactacctggagagcaccgaggagttcatcagaagaagacacgacgacaaggagaagctgctggccgaccagagaagactgaagagagagcaggaggaggccgacatcgccgccagaagacacaccggcgtgatccccacccaccaccagttcatcaccaacgagagattcggcgacctgctgaacatcgacgacaccgccaagagaaagagcggcagcgagatgagacccgccagagccaagttcgacttcaaggcccagaccctgaaggagctgcccctgcagaagggcgacatcgtgtacatctacaagcagatcgaccagaactggtacgagggcgagcaccacggcagagtgggcatcttccccagaacctacatcgagctgctgccccccgccgagaaggcccagcccaagaagctgacccccgtgcaggtgctggagtacggcgaggccatcgccaagttcaacttcaacggcgacacccaggtggagatgagcttcagaaagggcgagagaatcaccctgctgagacaggtggacgagaactggtacgagggcagaatccccggcaccagcagacagggcatcttccccatcacctacgtggacgtgatcaagagacccctggtgaagaaccccgtggactacatggacctgcccttcagcagcagccccagcagaagcgccaccgccagcccccagccctggagagaggagagcggccagtacgagagaaaggccgagagaggcgccggcgagagaggccccggcggccccaagatcagcaagaagagctgcctgaagcccagcgacgtggtgagatgcctgagcaccgagcagagactgagcgacctgaacacccccgaggagagcagacccggcaagcccctgggcagcgccttccccggcagcgaggccgagcagaccgagagacacagaggcggcgagcaggccggcagaaaggccgccagaagaggcggcagccagcagccccaggcccagcagagaagagtgacccccgacagaagccagaccagccaggacctgttcagctaccaggccctgtacagctacatcccccagaacgacgacgagctggagctgagagacggcgacatcgtggacgtgatggagaagtgcgacgacggctggttcgtgggcaccagcagaagaaccaagcagttcggcaccttccccggcaactacgtgaagcccctgtacctgtag

SEQ ID NO: 100326 - DNA, 2346 bp, Artificial Sequence
  Description of Artificial Sequence: Synthetic coding sequence
atgagcagcgagtgcgacggcggcagcaaggccgtgatgaacggcctggcccccggcagcaacggccaggacaaggccaccgccgaccccctgagagccagaagcatcagcgccgtgaagatcatccccgtgaagaccgtgaagaacgccagcggcctggtgctgcccaccgacatggacctgaccaagatctgcaccggcaagggcgccgtgaccctgagagccagcagcagctacagagagacccccagcagcagccccgccagcccccaggagaccagacagcacgagagcaagcccggcctggagcccgagcccagcagcgccgacgagtggagactgagcagcagcgccgacgccaacggcaacgcccagcccagcagcctggccgccaagggctacagaagcgtgcaccccaacctgcccagcgacaagagccaggacagcagccccctgctgaacgaggtgagcagcagcctgatcggcaccgacagccaggccttccccagcgtgagcaagcccagcagcgcctaccccagcaccaccatcgtgaaccccaccatcgtgctgctgcagcacaacagagagcagcagaagagactgagcagcctgagcgaccccgtgagcgagagaagagtgggcgagcaggacagcgcccccacccaggagaagcccaccagccccggcaaggccatcgagaagagagccaaggacgacagcagaagagtggtgaagagcacccaggacctgagcgacgtgagcatggacgaggtgggcatccccctgagaaacaccgagagaagcaaggactggtacaagaccatgttcaagcagatccacaagctgaacagagacgacgacagcgacctgtacagccccagatacagcttcagcgaggacaccaagagccccctgagcgtgcccagaagcaagagcgagatgagctacatcgacggcgagaaggtggtgaagagaagcgccaccctgcccctgcccgccagaagcagcagcctgaagagcagcagcgagagaaacgactgggagccccccgacaagaaggtggacaccagaaagtacagagccgagcccaagagcatctacgagtaccagcccggcaagagcagcgtgctgaccaacgagaagatgagcagcgccatcagccccacccccgagatcagcagcgagacccccggctacatctacagcagcaacttccacgccgtgaagagagagagcgacggcgcccccggcgacctgaccagcctggagaacgagagacagatctacaagagcgtgctggagggcggcgacatccccctgcagggcctgagcggcctgaagagacccagcagcagcgccagcaccaaggacagcgagagccccagacacttcatccccgccgactacctggagagcaccgaggagttcatcagaagaagacacgacgacaaggagaagctgctggccgaccagagaagactgaagagagagcaggaggaggccgacatcgccgccagaagacacaccggcgtgatccccacccaccaccagttcatcaccaacgagagattcggcgacctgctgaacatcgacgacaccgccaagagaaagagcggcagcgagatgagacccgccagagccaagttcgacttcaaggcccagaccctgaaggagctgcccctgcagaagggcgacatcgtgtacatctacaagcagatcgaccagaactggtacgagggcgagcaccacggcagagtgggcatcttccccagaacctacatcgagctgctgccccccgccgagaaggcccagcccaagaagctgacccccgtgcaggtgctggagtacggcgaggccatcgccaagttcaacttcaacggcgacacccaggtggagatgagcttcagaaagggcgagagaatcaccctgctgagacaggtggacgagaactggtacgagggcagaatccccggcaccagcagacagggcatcttccccatcacctacgtggacgtgatcaagagacccctggtgaagaaccccgtggactacatggacctgcccttcagcagcagccccagcagaagcgccaccgccagcccccagcagccccaggcccagcagagaagagtgacccccgacagaagccagaccagccaggacctgttcagctaccaggccctgtacagctacatcccccagaacgacgacgagctggagctgagagacggcgacatcgtggacgtgatggagaagtgcgacgacggctggttcgtgggcaccagcagaagaaccaagcagttcggcaccttccccggcaactacgtgaagcccctgtacctgtag

SEQ ID NO: 100327 - DNA, 2541 bp, Artificial Sequence
  Description of Artificial Sequence: Synthetic coding sequence
atgagcagcgagtgcgacggcggcagcaaggccgtgatgaacggcctggcccccggcagcaacggccaggacaaggccaccgccgaccccctgagagccagaagcatcagcgccgtgaagatcatccccgtgaagaccgtgaagaacgccagcggcctggtgctgcccaccgacatggacctgaccaagatctgcaccggcaagggcgccgtgaccctgagagccagcagcagctacagagagacccccagcagcagccccgccagcccccaggagaccagacagcacgagagcaagcccgacgagtggagactgagcagcagcgccgacgccaacggcaacgcccagcccagcagcctggccgccaagggctacagaagcgtgcaccccaacctgcccagcgacaagagccaggacagcagccccctgctgaacgaggtgagcagcagcctgatcggcaccgacagccaggccttccccagcgtgagcaagcccagcagcgcctaccccagcaccaccatcgtgaaccccaccatcgtgctgctgcagcacaacagagagcagcagaagagactgagcagcctgagcgaccccgtgagcgagagaagagtgggcgagcaggacagcgcccccacccaggagaagcccaccagccccggcaaggccatcgagaagagagccaaggacgacagcagaagagtggtgaagagcacccaggacctgagcgacgtgagcatggacgaggtgggcatccccctgagaaacaccgagagaagcaaggactggtacaagaccatgttcaagcagatccacaagctgaacagagacacccccgaggagaacccctacttccccacctacaagttccccgagctgcccgagatccagcagaccagcgaggaggacaacccctacacccccacctaccagttccccgccagcacccccagccccaagagcgaggacgacgacagcgacctgtacagccccagatacagcttcagcgaggacaccaagagccccctgagcgtgcccagaagcaagagcgagatgagctacatcgacggcgagaaggtggtgaagagaagcgccaccctgcccctgcccgccagaagcagcagcctgaagagcagcagcgagagaaacgactgggagccccccgacaagaaggtggacaccagaaagtacagagccgagcccaagagcatctacgagtaccagcccggcaagagcagcgtgctgaccaacgagaagatgagcagagacatcagccccgaggagatcgacctgaagaacgagccctggtacaagttcttcagcgagctggagttcggcaagcccagcagcgccatcagccccacccccgagatcagcagcgagacccccggctacatctacagcagcaacttccacgccgtgaagagagagagcgacggcgcccccggcgacctgaccagcctggagaacgagagacagatctacaagagcgtgctggagggcggcgacatccccctgcagggcctgagcggcctgaagagacccagcagcagcgccagcaccaaggacagcgagagccccagacacttcatccccgccgactacctggagagcaccgaggagttcatcagaagaagacacgacgacaaggagaagctgctggccgaccagagaagactgaagagagagcaggaggaggccgacatcgccgccagaagacacaccggcgtgatccccacccaccaccagttcatcaccaacgagagattcggcgacctgctgaacatcgacgacaccgccaagagaaagagcggcagcgagatgagacccgccagagccaagttcgacttcaaggcccagaccctgaaggagctgcccctgcagaagggcgacatcgtgtacatctacaagcagatcgaccagaactggtacgagggcgagcaccacggcagagtgggcatcttccccagaacctacatcgagctgctgccccccgccgagaaggcccagcccaagaagctgacccccgtgcaggtgctggagtacggcgaggccatcgccaagttcaacttcaacggcgacacccaggtggagatgagcttcagaaagggcgagagaatcaccctgctgagacaggtggacgagaactggtacgagggcagaatccccggcaccagcagacagggcatcttccccatcacctacgtggacgtgatcaagagacccctggtgaagaaccccgtggactacatggacctgcccttcagcagcagccccagcagaagcgccaccgccagcccccagcagccccaggcccagcagagaagagtgacccccgacagaagccagaccagccaggacctgttcagctaccaggccctgtacagctacatcccccagaacgacgacgagctggagctgagagacggcgacatcgtggacgtgatggagaagtgcgacgacggctggttcgtgggcaccagcagaagaaccaagcagttcggcaccttccccggcaactacgtgaagcccctgtacctgtag

SEQ ID NO: 100328 - DNA, 2718 bp, Artificial Sequence
  Description of Artificial Sequence: Synthetic coding sequence
atgagcagcgagtgcgacggcggcagcaaggccgtgatgaacggcctggcccccggcagcaacggccaggacaaggccaccgccgaccccctgagagccagaagcatcagcgccgtgaagatcatccccgtgaagaccgtgaagaacgccagcggcctggtgctgcccaccgacatggacctgaccaagatctgcaccggcaagggcgccgtgaccctgagagccagcagcagctacagagagacccccagcagcagccccgccagcccccaggagaccagacagcacgagagcaagcccggcctggagcccgagcccagcagcgccgacgagtggagactgagcagcagcgccgacgccaacggcaacgcccagcccagcagcctggccgccaagggctacagaagcgtgcaccccaacctgcccagcgacaagagccagagatggccccaccacagccagcccgccagagccagcggcagcttcgcccccatcagccagaccccccccagcttcagcccccccccccccctggtgccccccgcccccgaggacctgagaagagtgagcgagcccgacctgaccggcgccgtgagcagcaccgacagcagccccctgctgaacgaggtgagcagcagcctgatcggcaccgacagccaggccttccccagcgtgagcaagcccagcagcgcctaccccagcaccaccatcgtgaaccccaccatcgtgctgctgcagcacaacagagagcagcagaagagactgagcagcctgagcgaccccgtgagcgagagaagagtgggcgagcaggacagcgcccccacccaggagaagcccaccagccccggcaaggccatcgagaagagagccaaggacgacagcagaagagtggtgaagagcacccaggacctgagcgacgtgagcatggacgaggtgggcatccccctgagaaacaccgagagaagcaaggactggtacaagaccatgttcaagcagatccacaagctgaacagagacgacgacagcgacctgtacagccccagatacagcttcagcgaggacaccaagagccccctgagcgtgcccagaagcaagagcgagatgagctacatcgacggcgagaaggtggtgaagagaagcgccaccctgcccctgcccgccagaagcagcagcctgaagagcagcagcgagagaaacgactgggagccccccgacaagaaggtggacaccagaaagtacagagccgagcccaagagcatctacgagtaccagcccggcaagagcagcgtgctgaccaacgagaagatgagcagagacatcagccccgaggagatcgacctgaagaacgagccctggtacaagttcttcagcgagctggagttcggcaagcccccccccaagaagatctgggactacacccccggcgactgcagcatcctgcccagagaggacagaaagagcagcgccatcagccccacccccgagatcagcagcgagacccccggctacatctacagcagcaacttccacgccgtgaagagagagagcgacggcgcccccggcgacctgaccagcctggagaacgagagacagatctacaagagcgtgctggagggcggcgacatccccctgcagggcctgagcggcctgaagagacccagcagcagcgccagcaccaaggacagcgagagccccagacacttcatccccgccgactacctggagagcaccgaggagttcatcagaagaagacacgacgacaaggagaagctgctggccgaccagagaagactgaagagagagcaggaggaggccgacatcgccgccagaagacacaccggcgtgatccccacccaccaccagttcatcaccaacgagagattcggcgacctgctgaacatcgacgacaccgccaagagaaagagcggcagcgagatgagacccgccagagccaagttcgacttcaaggcccagaccctgaaggagctgcccctgcagaagggcgacatcgtgtacatctacaagcagatcgaccagaactggtacgagggcgagcaccacggcagagtgggcatcttccccagaacctacatcgagctgctgccccccgccgagaaggcccagcccaagaagctgacccccgtgcaggtgctggagtacggcgaggccatcgccaagttcaacttcaacggcgacacccaggtggagatgagcttcagaaagggcgagagaatcaccctgctgagacaggtggacgagaactggtacgagggcagaatccccggcaccagcagacagggcatcttccccatcacctacgtggacgtgatcaagagacccctggtgaagaaccccgtggactacatggacctgcccttcagcagcagccccagcagaagcgccaccgccagcccccagctgagccaccacagcctgagagccggccccgacctgaccgagagcgagaagagctacgtgcagccccaggcccagcagagaagagtgacccccgacagaagccagaccagccaggacctgttcagctaccaggccctgtacagctacatcccccagaacgacgacgagctggagctgagagacggcgacatcgtggacgtgatggagaagtgcgacgacggctggttcgtgggcaccagcagaagaaccaagcagttcggcaccttccccggcaactacgtgaagcccctgtacctgtag

SEQ ID NO: 100329 - DNA, 3015 bp, Artificial Sequence
  Description of Artificial Sequence: Synthetic coding sequence
atgagcagcgagtgcgacggcggcagcaaggccgtgatgaacggcctggcccccggcagcaacggccaggacaaggccaccgccgaccccctgagagccagaagcatcagcgccgtgaagatcatccccgtgaagaccgtgaagaacgccagcggcctggtgctgcccaccgacatggacctgaccaagatctgcaccggcaagggcgccgtgaccctgagagccagcagcagctacagagagacccccagcagcagccccgccagcccccaggagaccagacagcacgagagcaagcccgacgagtggagactgagcagcagcgccgacgccaacggcaacgcccagcccagcagcctggccgccaagggctacagaagcgtgcaccccaacctgcccagcgacaagagccaggacgccaccagcagcagcgccgcccagcccgaggtgatcgtggtgcccctgtacctggtgaacaccgacagaggccaggagggcaccgccagaccccccacccccctgggccccctgggctgcgtgcccaccatccccgccaccgccagcgccgccagccccctgaccttccccaccctggacgacttcatccccccccacctgcagagatggccccaccacagccagcccgccagagccagcggcagcttcgcccccatcagccagaccccccccagcttcagcccccccccccccctggtgccccccgcccccgaggacctgagaagagtgagcgagcccgacctgaccggcgccgtgagcagcaccgacagcagccccctgctgaacgaggtgagcagcagcctgatcggcaccgacagccaggccttccccagcgtgagcaagcccagcagcgcctaccccagcaccaccatcgtgaaccccaccatcgtgctgctgcagcacaacagagagcagcagaagagactgagcagcctgagcgaccccgtgagcgagagaagagtgggcgagcaggacagcgcccccacccaggagaagcccaccagccccggcaaggccatcgagaagagagccaaggacgacagcagaagagtggtgaagagcacccaggacctgagcgacgtgagcatggacgaggtgggcatccccctgagaaacaccgagagaagcaaggactggtacaagaccatgttcaagcagatccacaagctgaacagagacacccccgaggagaacccctacttccccacctacaagttccccgagctgcccgagatccagcagaccagcgaggacgacgacagcgacctgtacagccccagatacagcttcagcgaggacaccaagagccccctgagcgtgcccagaagcaagagcgagatgagctacatcgacggcgagaaggtggtgaagagaagcgccaccctgcccctgcccgccagaagcagcagcctgaagagcagcagcgagagaaacgactgggagccccccgacaagaaggtggacaccagaaagtacagagccgagcccaagagcatctacgagtaccagcccggcaagagcagcgtgctgaccaacgagaagatgagcagagacatcagccccgaggagatcgacctgaagaacgagccctggtacaagttcttcagcgagctggagttcggcaagcccccccccaagaagatctgggactacacccccggcgactgcagcatcctgcccagagaggacagaaagaccaacctggacaaggacctgagcctgtgccagaccgagctggaggccgacctggagaagatggagaccctgaacaaggcccccagcgccaacgtgccccagagcagcgccatcagccccacccccgagatcagcagcgagacccccggctacatctacagcagcaacttccacgccgtgaagagagagagcgacggcgcccccggcgacctgaccagcctggagaacgagagacagatctacaagagcgtgctggagggcggcgacatccccctgcagggcctgagcggcctgaagagacccagcagcagcgccagcaccaaggacagcgagagccccagacacttcatccccgccgactacctggagagcaccgaggagttcatcagaagaagacacgacgacaaggagaagctgctggccgaccagagaagactgaagagagagcaggaggaggccgacatcgccgccagaagacacaccggcgtgatccccacccaccaccagttcatcaccaacgagagattcggcgacctgctgaacatcgacgacaccgccaagagaaagagcggcagcgagatgagacccgccagagccaagttcgacttcaaggcccagaccctgaaggagctgcccctgcagaagggcgacatcgtgtacatctacaagcagatcgaccagaactggtacgagggcgagcaccacggcagagtgggcatcttccccagaacctacatcgagctgctgccccccgccgagaaggcccagcccaagaagctgacccccgtgcaggtgctggagtacggcgaggccatcgccaagttcaacttcaacggcgacacccaggtggagatgagcttcagaaagggcgagagaatcaccctgctgagacaggtggacgagaactggtacgagggcagaatccccggcaccagcagacagggcatcttccccatcacctacgtggacgtgatcaagagacccctggtgaagaaccccgtggactacatggacctgcccttcagcagcagccccagcagaagcgccaccgccagcccccagcagccccaggcccagcagagaagagtgacccccgacagaagccagaccagccaggacctgttcagctaccaggccctgtacagctacatcccccagaacgacgacgagctggagctgagagacggcgacatcgtggacgtgatggagaagtgcgacgacggctggttcgtgggcaccagcagaagaaccaagcagttcggcaccttccccggcaactacgtgaagcccctgtacctgtag

SEQ ID NO: 100330 - DNA, 3879 bp, Artificial Sequence
  Description of Artificial Sequence: Synthetic coding sequence
atgagcagcgagtgcgacggcggcagcaaggccgtgatgaacggcctggcccccggcagcaacggccaggacaaggccaccgccgaccccctgagagccagaagcatcagcgccgtgaagatcatccccgtgaagaccgtgaagaacgccagcggcctggtgctgcccaccgacatggacctgaccaagatctgcaccggcaagggcgccgtgaccctgagagccagcagcagctacagagagacccccagcagcagccccgccagcccccaggagaccagacagcacgagagcaagcccggcctggagcccgagcccagcagcgccgacgagtggagactgagcagcagcgccgacgccaacggcaacgcccagcccagcagcctggccgccaagggctacagaagcgtgcaccccaacctgcccagcgacaagagccaggacgccaccagcagcagcgccgcccagcccgaggtgatcgtggtgcccctgtacctggtgaacaccgacagaggccaggagggcaccgccagaccccccacccccctgggccccctgggctgcgtgcccaccatccccgccaccgccagcgccgccagccccctgaccttccccaccctggacgacttcatccccccccacctgcagagatggccccaccacagccagcccgccagagccagcggcagcttcgcccccatcagccagaccccccccagcttcagcccccccccccccctggtgccccccgcccccgaggacctgagaagagtgagcgagcccgacctgaccggcgccgtgagcagcaccgacagcagccccctgctgaacgaggtgagcagcagcctgatcggcaccgacagccaggccttccccagcgtgagcaagcccagcagcgcctaccccagcaccaccatcgtgaaccccaccatcgtgctgctgcagcacaacagagagcagcagaagagactgagcagcctgagcgaccccgtgagcgagagaagagtgggcgagcaggacagcgcccccacccaggagaagcccaccagccccggcaaggccatcgagaagagagccaaggacgacagcagaagagtggtgaagagcacccaggacctgagcgacgtgagcatggacgaggtgggcatccccctgagaaacaccgagagaagcaaggactggtacaagaccatgttcaagcagatccacaagctgaacagagacacccccgaggagaacccctacttccccacctacaagttccccgagctgcccgagatccagcagaccagcgaggaggacaacccctacacccccacctaccagttccccgccagcacccccagccccaagagcgaggacgacgacagcgacctgtacagccccagatacagcttcagcgaggacaccaagagccccctgagcgtgcccagaagcaagagcgagatgagctacatcgacggcgagaaggtggtgaagagaagcgccaccctgcccctgcccgccagaagcagcagcctgaagagcagcagcgagagaaacgactgggagccccccgacaagaaggtggacaccagaaagtacagagccgagcccaagagcatctacgagtaccagcccggcaagagcagcgtgctgaccaacgagaagatgagcagagacatcagccccgaggagatcgacctgaagaacgagccctggtacaagttcttcagcgagctggagttcggcaagcccccccccaagaagatctgggactacacccccggcgactgcagcatcctgcccagagaggacagaaagaccaacctggacaaggacctgagcctgtgccagaccgagctggaggccgacctggagaagatggagaccctgaacaaggcccccagcgccaacgtgccccagagcagcgccatcagccccacccccgagatcagcagcgagacccccggctacatctacagcagcaacttccacgccgtgaagagagagagcgacggcgcccccggcgacctgaccagcctggagaacgagagacagatctacaagagcgtgctggagggcggcgacatccccctgcagggcctgagcggcctgaagagacccagcagcagcgccagcaccaaggacagcgagagccccagacacttcatccccgccgactacctggagagcaccgaggagttcatcagaagaagacacgacgacaaggagaagctgctggccgaccagagaagactgaagagagagcaggaggaggccgacatcgccgccagaagacacaccggcgtgatccccacccaccaccagttcatcaccaacgagagattcggcgacctgctgaacatcgacgacaccgccaagagaaagagcggcagcgagatgagacccgccagagccaagttcgacttcaaggcccagaccctgaaggagctgcccctgcagaagggcgacatcgtgtacatctacaagcagatcgaccagaactggtacgagggcgagcaccacggcagagtgggcatcttccccagaacctacatcgagctgctgccccccgccgagaaggcccagcccaagaagctgacccccgtgcaggtgctggagtacggcgaggccatcgccaagttcaacttcaacggcgacacccaggtggagatgagcttcagaaagggcgagagaatcaccctgctgagacaggtggacgagaactggtacgagggcagaatccccggcaccagcagacagggcatcttccccatcacctacgtggacgtgatcaagagacccctggtgaagaaccccgtggactacatggacctgcccttcagcagcagccccagcagaagcgccaccgccagcccccagttcagcagccacagcaagctgatcacccccgcccccagcagcctgccccacagcagaagagccctgagccccgagatgcacgccgtgaccagcgagtggatcagcctgaccgtgggcgtgcccggcagaagaagcctggccctgaccccccccctgccccccctgcccgaggccagcatctacaacaccgaccacctggccctgagccccagagccagccccagcctgagcctgagcctgccccacctgagctggagcgacagacccacccccagaagcgtggccagccccctggccctgcccagcccccacaagacctacagcctggcccccaccagccaggccagcctgcacatgaacggcgacggcggcgtgcacacccccagcagcggcatccaccaggacagcttcctgcagctgcccctgggcagcagcgacagcgtgatcagccagctgagcgacgccttcagcagccagagcaagagacagccctggagagaggagagcggccagtacgagagaaaggccgagagaggcgccggcgagagaggccccggcggccccaagatcagcaagaagagctgcctgaagcccagcgacgtggtgagatgcctgagcaccgagcagagactgagcgacctgaacacccccgaggagagcagacccggcaagcccctgggcagcgccttccccggcagcgaggccgagcagaccgagagacacagaggcggcgagcaggccggcagaaaggccgccagaagaggcggcagccagcagccccaggcccagcagagaagagtgacccccgacagaagccagaccagccaggacctgttcagctaccaggccctgtacagctacatcccccagaacgacgacgagctggagctgagagacggcgacatcgtggacgtgatggagaagtgcgacgacggctggttcgtgggcaccagcagaagaaccaagcagttcggcaccttccccggcaactacgtgaagcccctgtacctgtag

SEQ ID NO: 100331 - DNA, 3801 bp, Artificial Sequence
  Description of Artificial Sequence: Synthetic coding sequence
atgagcagcgagtgcgacggcggcagcaaggccgtgatgaacggcctggcccccggcagcaacggccaggacaaggccaccgccgaccccctgagagccagaagcatcagcgccgtgaagatcatccccgtgaagaccgtgaagaacgccagcggcctggtgctgcccaccgacatggacctgaccaagatctgcaccggcaagggcgccgtgaccctgagagccagcagcagctacagagagacccccagcagcagccccgccagcccccaggagaccagacagcacgagagcaagcccggcctggagcccgagcccagcagcgccgacgagtggagactgagcagcagcgccgacgccaacggcaacgcccagcccagcagcctggccgccaagggctacagaagcgtgcaccccaacctgcccagcgacaagagccaggacgccaccagcagcagcgccgcccagcccgaggtgatcgtggtgcccctgtacctggtgaacaccgacagaggccaggagggcaccgccagaccccccacccccctgggccccctgggctgcgtgcccaccatccccgccaccgccagcgccgccagccccctgaccttccccaccctggacgacttcatccccccccacctgcagagatggccccaccacagccagcccgccagagccagcggcagcttcgcccccatcagccagaccccccccagcttcagcccccccccccccctggtgccccccgcccccgaggacctgagaagagtgagcgagcccgacctgaccggcgccgtgagcagcaccgacagcagccccctgctgaacgaggtgagcagcagcctgatcggcaccgacagccaggccttccccagcgtgagcaagcccagcagcgcctaccccagcaccaccatcgtgaaccccaccatcgtgctgctgcagcacaacagagagcagcagaagagactgagcagcctgagcgaccccgtgagcgagagaagagtgggcgagcaggacagcgcccccacccaggagaagcccaccagccccggcaaggccatcgagaagagagccaaggacgacagcagaagagtggtgaagagcacccaggacctgagcgacgtgagcatggacgaggtgggcatccccctgagaaacaccgagagaagcaaggactggtacaagaccatgttcaagcagatccacaagctgaacagagacgacgacagcgacctgtacagccccagatacagcttcagcgaggacaccaagagccccctgagcgtgcccagaagcaagagcgagatgagctacatcgacggcgagaaggtggtgaagagaagcgccaccctgcccctgcccgccagaagcagcagcctgaagagcagcagcgagagaaacgactgggagccccccgacaagaaggtggacaccagaaagtacagagccgagcccaagagcatctacgagtaccagcccggcaagagcagcgtgctgaccaacgagaagatgagcagagacatcagccccgaggagatcgacctgaagaacgagccctggtacaagttcttcagcgagctggagttcggcaagcccccccccaagaagatctgggactacacccccggcgactgcagcatcctgcccagagaggacagaaagaccaacctggacaaggacctgagcctgtgccagaccgagctggaggccgacctggagaagatggagaccctgaacaaggcccccagcgccaacgtgccccagagcagcgccatcagccccacccccgagatcagcagcgagacccccggctacatctacagcagcaacttccacgccgtgaagagagagagcgacggcgcccccggcgacctgaccagcctggagaacgagagacagatctacaagagcgtgctggagggcggcgacatccccctgcagggcctgagcggcctgaagagacccagcagcagcgccagcaccaaggacagcgagagccccagacacttcatccccgccgactacctggagagcaccgaggagttcatcagaagaagacacgacgacaaggagaagctgctggccgaccagagaagactgaagagagagcaggaggaggccgacatcgccgccagaagacacaccggcgtgatccccacccaccaccagttcatcaccaacgagagattcggcgacctgctgaacatcgacgacaccgccaagagaaagagcggcagcgagatgagacccgccagagccaagttcgacttcaaggcccagaccctgaaggagctgcccctgcagaagggcgacatcgtgtacatctacaagcagatcgaccagaactggtacgagggcgagcaccacggcagagtgggcatcttccccagaacctacatcgagctgctgccccccgccgagaaggcccagcccaagaagctgacccccgtgcaggtgctggagtacggcgaggccatcgccaagttcaacttcaacggcgacacccaggtggagatgagcttcagaaagggcgagagaatcaccctgctgagacaggtggacgagaactggtacgagggcagaatccccggcaccagcagacagggcatcttccccatcacctacgtggacgtgatcaagagacccctggtgaagaaccccgtggactacatggacctgcccttcagcagcagccccagcagaagcgccaccgccagcccccagttcagcagccacagcaagctgatcacccccgcccccagcagcctgccccacagcagaagagccctgagccccgagatgcacgccgtgaccagcgagtggatcagcctgaccgtgggcgtgcccggcagaagaagcctggccctgaccccccccctgccccccctgcccgaggccagcatctacaacaccgaccacctggccctgagccccagagccagccccagcctgagcctgagcctgccccacctgagctggagcgacagacccacccccagaagcgtggccagccccctggccctgcccagcccccacaagacctacagcctggcccccaccagccaggccagcctgcacatgaacggcgacggcggcgtgcacacccccagcagcggcatccaccaggacagcttcctgcagctgcccctgggcagcagcgacagcgtgatcagccagctgagcgacgccttcagcagccagagcaagagacagccctggagagaggagagcggccagtacgagagaaaggccgagagaggcgccggcgagagaggccccggcggccccaagatcagcaagaagagctgcctgaagcccagcgacgtggtgagatgcctgagcaccgagcagagactgagcgacctgaacacccccgaggagagcagacccggcaagcccctgggcagcgccttccccggcagcgaggccgagcagaccgagagacacagaggcggcgagcaggccggcagaaaggccgccagaagaggcggcagccagctgagccaccacagcctgagagccggccccgacctgaccgagagcgagaagagctacgtgcagccccaggcccagcagagaagagtgacccccgacagaagccagaccagccaggacctgttcagctaccaggccctgtacagctacatcccccagaacgacgacgagctggagctgagagacggcgacatcgtggacgtgatggagaagtgcgacgacggctggttcgtgggcaccagcagaagaaccaagcagttcggcaccttccccggcaactacgtgaagcccctgtacctgtag

SEQ ID NO: 100332 - DNA, 2436 bp, Artificial Sequence
  Description of Artificial Sequence: Synthetic coding sequence
atgagcagcgagtgcgacggcggcagcaaggccgtgatgaacggcctggcccccggcagcaacggccaggacaaggacatggacctgaccaagatctgcaccggcaagggcgccgtgaccctgagagccagcagcagctacagagagacccccagcagcagccccgccagcccccaggagaccagacagcacgagagcaagcccggcctggagcccgagcccagcagcgccgacgagtggagactgagcagcagcgccgacgccaacggcaacgcccagcccagcagcctggccgccaagggctacagaagcgtgcaccccaacctgcccagcgacaagagccaggacagcagccccctgctgaacgaggtgagcagcagcctgatcggcaccgacagccaggccttccccagcgtgagcaagcccagcagcgcctaccccagcaccaccatcgtgaaccccaccatcgtgctgctgcagcacaacagagagcagcagaagagactgagcagcctgagcgaccccgtgagcgagagaagagtgggcgagcaggacagcgcccccacccaggagaagcccaccagccccggcaaggccatcgagaagagagccaaggacgacagcagaagagtggtgaagagcacccaggacctgagcgacgtgagcatggacgaggtgggcatccccctgagaaacaccgagagaagcaaggactggtacaagaccatgttcaagcagatccacaagctgaacagagacgacgacagcgacctgtacagccccagatacagcttcagcgaggacaccaagagccccctgagcgtgcccagaagcaagagcgagatgagctacatcgacggcgagaaggtggtgaagagaagcgccaccctgcccctgcccgccagaagcagcagcctgaagagcagcagcgagagaaacgactgggagccccccgacaagaaggtggacaccagaaagtacagagccgagcccaagagcatctacgagtaccagcccggcaagagcagcgtgctgaccaacgagaagatgagcagagacatcagccccgaggagatcgacctgaagaacgagccctggtacaagttcttcagcgagctggagttcggcaagcccaccaacctggacaaggacctgagcctgtgccagaccgagctggaggccgacctggagaagatggagaccctgaacaaggcccccagcgccaacgtgccccagagcagcgccatcagccccacccccgagatcagcagcgagacccccggctacatctacagcagcaacttccacgccgtgaagagagagagcgacggcgcccccggcgacctgaccagcctggagaacgagagacagatctacaagagcgtgctggagggcggcgacatccccctgcagggcctgagcggcctgaagagacccagcagcagcgccagcaccaaggacagcgagagccccagacacttcatccccgccgactacctggagagcaccgaggagttcatcagaagaagacacgacgacaaggagaagctgctggccgaccagagaagactgaagagagagcaggaggaggccgacatcgccgccagaagacacaccggcgtgatccccacccaccaccagttcatcaccaacgagagattcggcgacctgctgaacatcgacgacaccgccaagagaaagagcggcagcgagatgagacccgccagagccaagttcgacttcaaggcccagaccctgaaggagctgcccctgcagaagggcgacatcgtgtacatctacaagcagatcgaccagaactggtacgagggcgagcaccacggcagagtgggcatcttccccagaacctacatcgagctgctgccccccgccgagaaggcccagcccaagaagctgacccccgtgcaggtgctggagtacggcgaggccatcgccaagttcaacttcaacggcgacacccaggtggagatgagcttcagaaagggcgagagaatcaccctgctgagacaggtggacgagaactggtacgagggcagaatccccggcaccagcagacagggcatcttccccatcacctacgtggacgtgatcaagagacccctggtgaagaaccccgtggactacatggacctgcccttcagcagcagccccagcagaagcgccaccgccagcccccagcagccccaggcccagcagagaagagtgacccccgacagaagccagaccagccaggacctgttcagctaccaggccctgtacagctacatcccccagaacgacgacgagctggagctgagagacggcgacatcgtggacgtgatggagaagtgcgacgacggctggttcgtgggcaccagcagaagaaccaagcagttcggcaccttccccggcaactacgtgaagcccctgtacctgtag

SEQ ID NO: 100333 - DNA, 2055 bp, Artificial Sequence
  Description of Artificial Sequence: Synthetic coding sequence
atgagcagcgagtgcgacggcggcagcaaggccgtgatgaacggcctggcccccggcagcaacggccaggacaaggacatggacctgaccaagatctgcaccggcaagggcgccgtgaccctgagagccagcagcagctacagagagacccccagcagcagccccgccagcccccaggagaccagacagcacgagagcaagcccgacgagtggagactgagcagcagcgccgacgccaacggcaacgcccagcccagcagcctggccgccaagggctacagaagcgtgcaccccaacctgcccagcgacaagagccaggacagcagccccctgctgaacgaggtgagcagcagcctgatcggcaccgacagccaggccttccccagcgtgagcaagcccagcagcgcctaccccagcaccaccatcgtgaaccccaccatcgtgctgctgcagcacaacagagagcagcagaagagactgagcagcctgagcgaccccgtgagcgagagaagagtgggcgagcaggacagcgcccccacccaggagaagcccaccagccccggcaaggccatcgagaagagagccaaggacgacagcagaagagtggtgaagagcacccaggacctgagcgacgtgagcatggacgaggtgggcatccccctgagaaacaccgagagaagcaaggactggtacaagaccatgttcaagcagatccacaagctgaacagagacgacgacagcgacctgtacagccccagatacagcttcagcgaggacaccaagagccccctgagcgtgcccagaagcaagagcgagatgagctacatcgacggcgagaaggtggtgaagagaagcgccaccctgcccctgcccgccagaagcagcagcctgaagagcagcagcgagagaaacgactgggagccccccgacaagaaggtggacaccagaaagtacagagccgagcccaagagcatctacgagtaccagcccggcaagagcagcgtgctgaccaacgagaagatgagcagcgccatcagccccacccccgagatcagcagcgagacccccggctacatctacagcagcaacttccacgccgtgaagagagagagcgacggcgcccccggcgacctgaccagcctggagaacgagagacagatctacaagagcgtgctggagggcggcgacatccccctgcagggcctgagcggcctgaagagacccagcagcagcgccagcaccaaggacagcgagagccccagacacttcatccccgccgactacctggagagcaccgaggagttcatcagaagaagacacgacgacaaggagatgagacccgccagagccaagttcgacttcaaggcccagaccctgaaggagctgcccctgcagaagggcgacatcgtgtacatctacaagcagatcgaccagaactggtacgagggcgagcaccacggcagagtgggcatcttccccagaacctacatcgagctgctgccccccgccgagaaggcccagcccaagaagctgacccccgtgcaggtgctggagtacggcgaggccatcgccaagttcaacttcaacggcgacacccaggtggagatgagcttcagaaagggcgagagaatcaccctgctgagacaggtggacgagaactggtacgagggcagaatccccggcaccagcagacagggcatcttccccatcacctacgtggacgtgatcaagagacccctggtgaagaaccccgtggactacatggacctgcccttcagcagcagccccagcagaagcgccaccgccagcccccagcagccccaggcccagcagagaagagtgacccccgacagaagccagaccagccaggacctgttcagctaccaggccctgtacagctacatcccccagaacgacgacgagctggagctgagagacggcgacatcgtggacgtgatggagaagtgcgacgacggctggttcgtgggcaccagcagaagaaccaagcagttcggcaccttccccggcaactacgtgaagcccctgtacctgtag

SEQ ID NO: 100334 - DNA, 2718 bp, Artificial Sequence; identical to SEQ ID NO: 100328
  Description of Artificial Sequence: Synthetic coding sequence

SEQ ID NO: 100335 - DNA, 3456 bp, Artificial Sequence; identical to SEQ ID NO: 100325
  Description of Artificial Sequence: Synthetic coding sequence

SEQ ID NO: 100336 - DNA, 3879 bp, Artificial Sequence; identical to SEQ ID NO: 100330
  Description of Artificial Sequence: Synthetic coding sequence

SEQ ID NO: 100337 - DNA, 2451 bp, Artificial Sequence
  Description of Artificial Sequence: Synthetic coding sequence
atgagcagcgagtgcgacggcggcagcaaggccgtgatgaacggcctggcccccggcagcaacggccaggacaaggacatggacctgaccaagatctgcaccggcaagggcgccgtgaccctgagagccagcagcagctacagagagacccccagcagcagccccgccagcccccaggagaccagacagcacgagagcaagcccggcctggagcccgagcccagcagcgccgacgagtggagactgagcagcagcgccgacgccaacggcaacgcccagcccagcagcctggccgccaagggctacagaagcgtgcaccccaacctgcccagcgacaagagccaggacgccaccagcagcagcgccgcccagcccgaggtgatcgtggtgcccctgtacctggtgaacaccgacagaggccaggagggcaccgccagaccccccacccccctgggccccctgggctgcgtgcccaccatccccgccaccgccagcgccgccagccccctgaccttccccaccctggacgacttcatccccccccacctgcagagatggccccaccacagccagcccgccagagccagcggcagcttcgcccccatcagccagaccccccccagcttcagcccccccccccccctggtgccccccgcccccgaggacctgagaagagtgagcgagcccgacctgaccggcgccgtgagcagcaccgacagcagccccctgctgaacgaggtgagcagcagcctgatcggcaccgacagccaggccttccccagcgtgagcaagcccagcagcgcctaccccagcaccaccatcgtgaaccccaccatcgtgctgctgcagcacaacagagagcagcagaagagactgagcagcctgagcgaccccgtgagcgagagaagagtgggcgagcaggacagcgcccccacccaggagaagcccaccagccccggcaaggccatcgagaagagagccaaggacgacagcagaagagtggtgaagagcacccaggacctgagcgacgtgagcatggacgaggtgggcatccccctgagaaacaccgagagaagcaaggactggtacaagaccatgttcaagcagatccacaagctgaacagagacgacgacagcgacctgtacagccccagatacagcttcagcgaggacaccaagagccccctgagcgtgcccagaagcaagagcgagatgagctacatcgacggcgagaaggtggtgaagagaagcgccaccctgcccctgcccgccagaagcagcagcctgaagagcagcagcgagagaaacgactgggagccccccgacaagaaggtggacaccagaaagtacagagccgagcccaagagcatctacgagtaccagcccggcaagagcagcgtgctgaccaacgagaagatgagcagcgccatcagccccacccccgagatcagcagcgagacccccggctacatctacagcagcaacttccacgccgtgaagagagagagcgacggcgcccccggcgacctgaccagcctggagaacgagagacagatctacaagagcgtgctggagggcggcgacatccccctgcagggcctgagcggcctgaagagacccagcagcagcgccagcaccaaggacagcgagagccccagacacttcatccccgccgactacctggagagcaccgaggagttcatcagaagaagacacgacgacaaggagatgagacccgccagagccaagttcgacttcaaggcccagaccctgaaggagctgcccctgcagaagggcgacatcgtgtacatctacaagcagatcgaccagaactggtacgagggcgagcaccacggcagagtgggcatcttccccagaacctacatcgagctgctgccccccgccgagaaggcccagcccaagaagctgacccccgtgcaggtgctggagtacggcgaggccatcgccaagttcaacttcaacggcgacacccaggtggagatgagcttcagaaagggcgagagaatcaccctgctgagacaggtggacgagaactggtacgagggcagaatccccggcaccagcagacagggcatcttccccatcacctacgtggacgtgatcaagagacccctggtgaagaaccccgtggactacatggacctgcccttcagcagcagccccagcagaagcgccaccgccagcccccagcagccccaggcccagcagagaagagtgacccccgacagaagccagaccagccaggacctgttcagctaccaggccctgtacagctacatcccccagaacgacgacgagctggagctgagagacggcgacatcgtggacgtgatggagaagtgcgacgacggctggttcgtgggcaccagcagaagaaccaagcagttcggcaccttccccggcaactacgtgaagcccctgtacctgtag

SEQ ID NO: 100338 - DNA, 3015 bp, Artificial Sequence; identical to SEQ ID NO: 100329
  Description of Artificial Sequence: Synthetic coding sequence

SEQ ID NO: 100339 - DNA, 2016 bp, Artificial Sequence
  Description of Artificial Sequence: Synthetic coding sequence
atgcagggcccccccagaagcctgagagccggcctgagcctggacgacttcatccccggccacctgcagagccacatcggcagcagcagcagaggcaccagagtgcccgtgatcagaaacggcggcagcaacaccctgaacttccagttccacgaccccgcccccagaaccgtgtgcaacggcggctacacccccagaagagacgccagccagcaccccgaccccgcctggtaccagacctggcccggccccggcagcaagcccagcgccagcaccaagatccccgccagccagcacacccagaactggagcgccacctggaccaaggacagcaagagaagagacaagagatgggtgaagtacgagggcatcggccccgtggacgagagcggcatgcccatcgcccccagaagcagcgtggacagacccagagactggtacagaagaatgttccagcagatccacagaaagatgcccgacctgcagctggactggaccttcgaggagccccccagagaccccagacacctgggcgcccagcagagacccgcccacagacccggccccgccaccagcagcagcggcagaagctgggaccacagcgaggagctgcccagaagcaccttcaactacagacccggcgccttcagcaccgtgctgcagcccagcaaccaggtgctgagaagaagagagaaggtggacaacgtgtggaccgaggagagctggaaccagttcctgcaggagctggagaccggccagagacccaagaagcccctggtggacgaccccggcgagaagcccagccagcccatcgaggtgctgctggagagagagctggccgagctgagcgccgagctggacaaggacctgagagccatcgagaccagactgcccagccccaagagcagccccgcccccagaagagcccccgagcagagaccccccgccggccccgccagcgcctggagcagcagctacccccacgccccctacctgggcagcgccagaagcctgagcccccacaagatggccgacggcggcagccccttcctgggcagaagagacttcgtgtaccccagcagcaccagagaccccagcgccagcaacggcggcggcagccccgccagaagagaggagaagaagagaaaggccgccagactgaagttcgacttccaggcccagagccccaaggagctgaccctgcagaagggcgacatcgtgtacatccacaaggaggtggacaagaactggctggagggcgagcaccacggcagactgggcatcttccccgccaactacgtggaggtgctgcccgccgacgagatccccaagcccatcaagccccccacctaccaggtgctggagtacggcgaggccgtggcccagtacaccttcaagggcgacctggaggtggagctgagcttcagaaagggcgagcacatctgcctgatcagaaaggtgaacgagaactggtacgagggcagaatcaccggcaccggcagacagggcatcttccccgccagctacgtgcaggtgagcagagagcccagactgagactgtgcgacgacggcccccagctgcccaccagccccagactgaccgccgccgccagaagcgccagacaccccagcagccccagcgccctgagaagccccgccgaccccatcgacctgggcggccagaccagccccagaagaaccggcttcagcttccccacccaggagcccagaccccagacccagaacctgggcacccccggccccgccctgagccacagcagaggccccagccaccccctggacctgggcaccagcagccccaacaccagccagatccactggaccccctacagagccatgtaccagtacagaccccagaacgaggacgagctggagctgagagagggcgacagagtggacgtgatgcagcagtgcgacgacggctggttcgtgggcgtgagcagaagaacccagaagttcggcaccttccccggcaactacgtggcccccgtgtag

SEQ ID NO: 100340 - DNA, 990 bp, Artificial Sequence
  Description of Artificial Sequence: Synthetic coding sequence
atggccgacggcggcagccccttcctgggcagaagagacttcgtgtaccccagcagcaccagagaccccagcgccagcaacggcggcggcagccccgccagaagagaggagaagaagagaaaggccgccagactgaagttcgacttccaggcccagagccccaaggagctgaccctgcagaagggcgacatcgtgtacatccacaaggaggtggacaagaactggctggagggcgagcaccacggcagactgggcatcttccccgccaactacgtggaggtgctgcccgccgacgagatccccaagcccatcaagccccccacctaccaggtgctggagtacggcgaggccgtggcccagtacaccttcaagggcgacctggaggtggagctgagcttcagaaagggcgagcacatctgcctgatcagaaaggtgaacgagaactggtacgagggcagaatcaccggcaccggcagacagggcatcttccccgccagctacgtgcaggtgagcagagagcccagactgagactgtgcgacgacggcccccagctgcccaccagccccagactgaccgccgccgccagaagcgccagacaccccagcagccccagcgccctgagaagccccgccgaccccatcgacctgggcggccagaccagccccagaagaaccggcttcagcttccccacccaggagcccagaccccagacccagaacctgggcacccccggccccgccctgagccacagcagaggccccagccaccccctggacctgggcaccagcagccccaacaccagccagatccactggaccccctacagagccatgtaccagtacagaccccagaacgaggacgagctggagctgagagagggcgacagagtggacgtgatgcagcagtgcgacgacggctggttcgtgggcgtgagcagaagaacccagaagttcggcaccttccccggcaactacgtggcccccgtgtag

SEQ ID NO: 100341 - DNA, 1074 bp, Artificial Sequence
  Description of Artificial Sequence: Synthetic coding sequence
atggccgccgccgccaagcccaacaacctgagcctggtggtgcacggccccggcgacctgagactggagaactaccccatccccgagcccggccccaacgaggtgctgctgagaatgcacagcgtgggcatctgcggcagcgacgtgcactactgggagtacggcagaatcggcaacttcatcgtgaagaagcccatggtgctgggccacgaggccagcggcaccgtggagaaggtgggcagcagcgtgaagcacctgaagcccggcgacagagtggccatcgagcccggcgcccccagagagaacgacgagttctgcaagatgggcagatacaacctgagccccagcatcttcttctgcgccaccccccccgacgacggcaacctgtgcagattctacaagcacaacgccgccttctgctacaagctgcccgacaacgtgaccttcgaggagggcgccctgatcgagcccctgagcgtgggcatccacgcctgcagaagaggcggcgtgaccctgggccacaaggtgctggtgtgcggcgccggccccatcggcatggtgaccctgctggtggccaaggccatgggcgccgcccaggtggtggtgaccgacctgagcgccaccagactgagcaaggccaaggagatcggcgccgacctggtgctgcagatcagcaaggagagcccccaggagatcgccagaaaggtggagggccagctgggctgcaagcccgaggtgaccatcgagtgcaccggcgccgaggccagcatccaggccggcatctacgccaccagaagcggcggcaacctggtgctggtgggcctgggcagcgagatgaccaccgtgcccctgctgcacgccgccatcagagaggtggacatcaagggcgtgttcagatactgcaacacctggcccgtggccatcagcatgctggccagcaagagcgtgaacgtgaagcccctggtgacccacagattccccctggagaaggccctggaggccttcgagaccttcaagaagggcctgggcctgaagatcatgctgaagtgcgaccccagcgaccagaacccctag

SEQ ID NO: 100342 - DNA, 597 bp, Artificial Sequence
  Description of Artificial Sequence: Synthetic coding sequence
atggcctaccccggccaccccggcgccggcggcggctactaccccggcggctacggcggcgcccccggcggccccgccttccccggccagacccaggaccccctgtacggctacttcgccgccgtggccggccaggacggccagatcgacgccgacgagctgcagagatgcctgacccagagcggcatcgccggcggctacaagcccttcaacctggagacctgcagactgatggtgagcatgctggacagagacatgagcggcaccatgggcttcaacgagttcaaggagctgtgggccgtgctgaacggctggagacagcacttcatcagcttcgacaccgacagaagcggcaccgtggacccccaggagctgcagaaggccctgaccaccatgggcttcagactgagcccccaggccgtgaacagcatcgccaagagatacagcaccaacggcaagatcaccttcgacgactacatcgcctgctgcgtgaagctgagagccctgaccgacagcttcagaagaagagacaccgcccagcagggcgtggtgaacttcccctacgacgacttcatccagtgcgtgatgagcgtgtag

SEQ ID NO: 100343 - DNA, 552 bp, Artificial Sequence
  Description of Artificial Sequence: Synthetic coding sequence
atgcagtacggcggcgcccccggcggccccgccttccccggccagacccaggaccccctgtacggctacttcgccgccgtggccggccaggacggccagatcgacgccgacgagctgcagagatgcctgacccagagcggcatcgccggcggctacaagcccttcaacctggagacctgcagactgatggtgagcatgctggacagagacatgagcggcaccatgggcttcaacgagttcaaggagctgtgggccgtgctgaacggctggagacagcacttcatcagcttcgacaccgacagaagcggcaccgtggacccccaggagctgcagaaggccctgaccaccatgggcttcagactgagcccccaggccgtgaacagcatcgccaagagatacagcaccaacggcaagatcaccttcgacgactacatcgcctgctgcgtgaagctgagagccctgaccgacagcttcagaagaagagacaccgcccagcagggcgtggtgaacttcccctacgacgacttcatccagtgcgtgatgagcgtgtag

SEQ ID NO: 100344 - DNA, 543 bp, Artificial Sequence
  Description of Artificial Sequence: Synthetic coding sequence
atgcagtacggcggcgcccccggcggccccgccttccccggccagacccaggaccccctgtacggctacttcgccgccgtggccggccaggacggccagatcgacgccgacgagctgcagagatgcctgacccagagcggcatcgccggcggctacaagcccttcaacctggagacctgcagactgatggtgagcatgctggacagagacatgagcggcaccatgggcttcaacgagttcaaggagctgtgggccgtgctgaacggctggagacagcacttcatcagcttcgacaccgacagaagcggcaccgtggacccccaggagctgcagaaggccctgaccaccatgggcttcagactgagcccccaggccgtgaacagcatcgccaagagatacagcaccaacggcaagatcaccttcgacgactacatcgcctgctgcgtgaagctgagagccctgaccgacagcttcagaagaagagacaccgcccagcagggcgtggtgaacttcccctacgacgacgtgagcctgagaaactag

SEQ ID NO: 100345 - DNA, 6645 bp, Artificial Sequence
  Description of Artificial Sequence: Synthetic coding sequence
atggccaccagaagcagcagaagagagagcagactgcccttcctgttcaccctggtggccctgctgccccccggcgccctgtgcgaggtgtggacccagagactgcacggcggcagcgcccccctgccccaggacagaggcttcctggtggtgcagggcgaccccagagagctgagactgtgggccagaggcgacgccagaggcgccagcagagccgacgagaagcccctgagaagaaagagaagcgccgccctgcagcccgagcccatcaaggtgtacggccaggtgagcctgaacgacagccacaaccagatggtggtgcactgggccggcgagaagagcaacgtgatcgtggccctggccagagacagcctggccctggccagacccaagagcagcgacgtgtacgtgagctacgactacggcaagagcttcaagaagatcagcgacaagctgaacttcggcctgggcaacagaagcgaggccgtgatcgcccagttctaccacagccccgccgacaacaagagatacatcttcgccgacgcctacgcccagtacctgtggatcaccttcgacttctgcaacaccctgcagggcttcagcatccccttcagagccgccgacctgctgctgcacagcaaggccagcaacctgctgctgggcttcgacagaagccaccccaacaagcagctgtggaagagcgacgacttcggccagacctggatcatgatccaggagcacgtgaagagcttcagctggggcatcgacccctacgacaagcccaacaccatctacatcgagagacacgagcccagcggctacagcaccgtgttcagaagcaccgacttcttccagagcagagagaaccaggaggtgatcctggaggaggtgagagacttccagctgagagacaagtacatgttcgccaccaaggtggtgcacctgctgggcagcgagcagcagagcagcgtgcagctgtgggtgagcttcggcagaaagcccatgagagccgcccagttcgtgaccagacaccccatcaacgagtactacatcgccgacgccagcgaggaccaggtgttcgtgtgcgtgagccacagcaacaacagaaccaacctgtacatcagcgaggccgagggcctgaagttcagcctgagcctggagaacgtgctgtactacagccccggcggcgccggcagcgacaccctggtgagatacttcgccaacgagcccttcgccgacttccacagagtggagggcctgcagggcgtgtacatcgccaccctgatcaacggcagcatgaacgaggagaacatgagaagcgtgatcaccttcgacaagggcggcacctgggagttcctgcaggcccccgccttcaccggctacggcgagaagatcaactgcgagctgagccagggctgcagcctgcacctggcccagagactgagccagctgctgaacctgcagctgagaagaatgcccatcctgagcaaggagagcgcccccggcctgatcatcgccaccggcagcgtgggcaagaacctggccagcaagaccaacgtgtacatcagcagcagcgccggcgccagatggagagaggccctgcccggcccccactactacacctggggcgaccacggcggcatcatcaccgccatcgcccagggcatggagaccaacgagctgaagtacagcaccaacgagggcgagacctggaagaccttcatcttcagcgagaagcccgtgttcgtgtacggcctgctgaccgagcccggcgagaagagcaccgtgttcaccatcttcggcagcaacaaggagaacgtgcacagctggctgatcctgcaggtgaacgccaccgacgccctgggcgtgccctgcaccgagaacgactacaagctgtggagccccagcgacgagagaggcaacgagtgcctgctgggccacaagaccgtgttcaagagaagaaccccccacgccacctgcttcaacggcgaggacttcgacagacccgtggtggtgagcaactgcagctgcaccagagaggactacgagtgcgacttcggcttcaagatgagcgaggacctgagcctggaggtgtgcgtgcccgaccccgagttcagcggcaagagctacagcccccccgtgccctgccccgtgggcagcacctacagaagaaccagaggctacagaaagatcagcggcgacacctgcagcggcggcgacgtggaggccagactggagggcgagctggtgccctgccccctggccgaggagaacgagttcatcctgtacgccgtgagaaagagcatctacagatacgacctggccagcggcgccaccgagcagctgcccctgaccggcctgagagccgccgtggccctggacttcgactacgagcacaactgcctgtactggagcgacctggccctggacgtgatccagagactgtgcctgaacggcagcaccggccaggaggtgatcatcaacagcggcctggagaccgtggaggccctggccttcgagcccctgagccagctgctgtactgggtggacgccggcttcaagaagatcgaggtggccaaccccgacggcgacttcagactgaccatcgtgaacagcagcgtgctggacagacccagagccctggtgctggtgccccaggagggcgtgatgttctggaccgactggggcgacctgaagcccggcatctacagaagcaacatggacggcagcgccgcctaccacctggtgagcgaggacgtgaagtggcccaacggcatcagcgtggacgaccagtggatctactggaccgacgcctacctggagtgcatcgagagaatcaccttcagcggccagcagagaagcgtgatcctggacaacctgccccacccctacgccatcgccgtgttcaagaacgagatctactgggacgactggagccagctgagcatcttcagagccagcaagtacagcggcagccagatggagatcctggccaaccagctgaccggcctgatggacatgaagatcttctacaagggcaagaacaccggcagcaacgcctgcgtgcccagaccctgcagcctgctgtgcctgcccaaggccaacaacagcagaagctgcagatgccccgaggacgtgagcagcagcgtgctgcccagcggcgacctgatgtgcgactgcccccagggctaccagctgaagaacaacacctgcgtgaagcaggagaacacctgcctgagaaaccagtacagatgcagcaacggcaactgcatcaacagcatctggtggtgcgacttcgacaacgactgcggcgacatgagcgacgagagaaactgccccaccaccatctgcgacctggacacccagttcagatgccaggagagcggcacctgcatccccctgagctacaagtgcgacctggaggacgactgcggcgacaacagcgacgagagccactgcgagatgcaccagtgcagaagcgacgagtacaactgcagcagcggcatgtgcatcagaagcagctgggtgtgcgacggcgacaacgactgcagagactggagcgacgaggccaactgcaccgccatctaccacacctgcgaggccagcaacttccagtgcagaaacggccactgcatcccccagagatgggcctgcgacggcgacaccgactgccaggacggcagcgacgaggaccccgtgaactgcgagaagaagtgcaacggcttcagatgccccaacggcacctgcatccccagcagcaagcactgcgacggcctgagagactgcagcgacggcagcgacgagcagcactgcgagcccctgtgcacccacttcatggacttcgtgtgcaagaacagacagcagtgcctgttccacagcatggtgtgcgacggcatcatccagtgcagagacggcagcgacgaggacgccgccttcgccggctgcagccaggaccccgagttccacaaggtgtgcgacgagttcggcttccagtgccagaacggcgtgtgcatcagcctgatctggaagtgcgacggcatggacgactgcggcgactacagcgacgaggccaactgcgagaaccccaccgaggcccccaactgcagcagatacttccagttcagatgcgagaacggccactgcatccccaacagatggaagtgcgacagagagaacgactgcggcgactggagcgacgagaaggactgcggcgacagccacatcctgcccttcagcacccccggccccagcacctgcctgcccaactactacagatgcagcagcggcacctgcgtgatggacacctgggtgtgcgacggctacagagactgcgccgacggcagcgacgaggaggcctgccccctgctggccaacgtgaccgccgccagcacccccacccagctgggcagatgcgacagattcgagttcgagtgccaccagcccaagacctgcatccccaactggaagagatgcgacggccaccaggactgccaggacggcagagacgaggccaactgccccacccacagcaccctgacctgcatgagcagagagttccagtgcgaggacggcgaggcctgcatcgtgctgagcgagagatgcgacggcttcctggactgcagcgacgagagcgacgagaaggcctgcagcgacgagctgaccgtgtacaaggtgcagaacctgcagtggaccgccgacttcagcggcgacgtgaccctgacctggatgagacccaagaagatgcccagcgccagctgcgtgtacaacgtgtactacagagtggtgggcgagagcatctggaagaccctggagacccacagcaacaagaccaacaccgtgctgaaggtgctgaagcccgacaccacctaccaggtgaaggtgcaggtgcagtgcctgagcaaggcccacaacaccaacgacttcgtgaccctgagaacccccgagggcctgcccgacgcccccagaaacctgcagctgagcctgcccagagaggccgagggcgtgatcgtgggccactgggccccccccatccacacccacggcctgatcagagagtacatcgtggagtacagcagaagcggcagcaagatgtgggccagccagagagccgccagcaacttcaccgagatcaagaacctgctggtgaacaccctgtacaccgtgagagtggccgccgtgaccagcagaggcatcggcaactggagcgacagcaagagcatcaccaccatcaagggcaaggtgatccccccccccgacatccacatcgacagctacggcgagaactacctgagcttcaccctgaccatggagagcgacatcaaggtgaacggctacgtggtgaacctgttctgggccttcgacacccacaagcaggagagaagaaccctgaacttcagaggcagcatcctgagccacaaggtgggcaacctgaccgcccacaccagctacgagatcagcgcctgggccaagaccgacctgggcgacagccccctggccttcgagcacgtgatgaccagaggcgtgagaccccccgcccccagcctgaaggccaaggccatcaaccagaccgccgtggagtgcacctggaccggccccagaaacgtggtgtacggcatcttctacgccaccagcttcctggacctgtacagaaaccccaagagcctgaccaccagcctgcacaacaagaccgtgatcgtgagcaaggacgagcagtacctgttcctggtgagagtggtggtgccctaccagggccccagcagcgactacgtggtggtgaagatgatccccgacagcagactgccccccagacacctgcacgtggtgcacaccggcaagaccagcgtggtgatcaagtgggagagcccctacgacagccccgaccaggacctgctgtacgccgtggccgtgaaggacctgatcagaaagaccgacagaagctacaaggtgaagagcagaaacagcaccgtggagtacaccctgaacaagctggagcccggcggcaagtaccacatcatcgtgcagctgggcaacatgagcaaggacagcagcatcaagatcaccaccgtgagcctgagcgcccccgacgccctgaagatcatcaccgagaacgaccacgtgctgctgttctggaagagcctggccctgaaggagaagcacttcaacgagagcagaggctacgagatccacatgttcgacagcgccatgaacatcaccgcctacctgggcaacaccaccgacaacttcttcaagatcagcaacctgaagatgggccacaactacaccttcaccgtgcaggccagatgcctgttcggcaaccagatctgcggcgagcccgccatcctgctgtacgacgagctgggcagcggcgccgacgccagcgccacccaggccgccagaagcaccgacgtggccgccgtggtggtgcccatcctgttcctgatcctgctgagcctgggcgtgggcttcgccatcctgtacaccaagcacagaagactgcagagcagcttcaccgccttcgccaacagccactacagcagcagactgggcagcgccatcttcagcagcggcgacgacctgggcgaggacgacgaggacgcccccatgatcaccggcttcagcgacgacgtgcccatggtgatcgcctag

SEQ ID NO: 100346 - DNA, 3507 bp, Artificial Sequence
  Description of Artificial Sequence: Synthetic coding sequence
atgggcaaggtgggcgccggcggcggcagccaggccagactgagcgccctgctggccggcgccggcctgctgatcctgtgcgcccccggcgtgtgcggcggcggcagctgctgccccagcccccaccccagcagcgcccccagaagcgccagcacccccagaggcttcagccaccagggcagacccggcagagcccccgccacccccctgcccctggtggtgagacccctgttcagcgtggcccccggcgacagagccctgagcctggagagagccagaggcaccggcgccagcatggccgtggccgccagaagcggcagaagaagaagaagcggcgccgaccaggagaaggccgagagaggcgagggcgccagcagaagccccagaggcgtgctgagagacggcggccagcaggagcccggcaccagagagagagaccccgacaaggccaccagattcagaatggaggagctgagactgaccagcaccaccttcgccctgaccggcgacagcgcccacaaccaggccatggtgcactggagcggccacaacagcagcgtgatcctgatcctgaccaagctgtacgactacaacctgggcagcatcaccgagagcagcctgtggagaagcaccgactacggcaccacctacgagaagctgaacgacaaggtgggcctgaagaccatcctgagctacctgtacgtgtgccccaccaacaagagaaagatcatgctgctgaccgaccccgagatcgagagcagcctgctgatcagcagcgacgagggcgccacctaccagaagtacagactgaacttctacatccagagcctgctgttccaccccaagcaggaggactggatcctggcctacagccaggaccagaagctgtacagcagcgccgagttcggcagaagatggcagctgatccaggagggcgtggtgcccaacagattctactggagcgtgatgggcagcaacaaggagcccgacctggtgcacctggaggccagaaccgtggacggccacagccactacctgacctgcagaatgcagaactgcaccgaggccaacagaaaccagcccttccccggctacatcgaccccgacagcctgatcgtgcaggaccactacgtgttcgtgcagctgaccagcggcggcagaccccactactacgtgagctacagaagaaacgccttcgcccagatgaagctgcccaagtacgccctgcccaaggacatgcacgtgatcagcaccgacgagaaccaggtgttcgccgccgtgcaggagtggaaccagaacgacacctacaacctgtacatcagcgacaccagaggcgtgtacttcaccctggccctggagaacgtgcagagcagcagaggccccgagggcaacatcatgatcgacctgtacgaggtggccggcatcaagggcatgttcctggccaacaagaagatcgacaaccaggtgaagaccttcatcacctacaacaagggcagagactggagactgctgcaggcccccgacaccgacctgagaggcgaccccgtgcactgcctgctgccctactgcagcctgcacctgcacctgaaggtgagcgagaacccctacaccagcggcatcatcgccagcaaggacaccgcccccagcatcatcgtggccagcggcaacatcggcagcgagctgagcgacaccgacatcagcatgttcgtgagcagcgacgccggcaacacctggagacagatcttcgaggaggagcacagcgtgctgtacctggaccagggcggcgtgctggtggccatgaagcacaccagcctgcccatcagacacctgtggctgagcttcgacgagggcagaagctggagcaagtacagcttcaccagcatccccctgttcgtggacggcgtgctgggcgagcccggcgaggagaccctgatcatgaccgtgttcggccacttcagccacagaagcgagtggcagctggtgaaggtggactacaagagcatcttcgacagaagatgcgccgaggaggactacagaccctggcagctgcacagccagggcgaggcctgcatcatgggcgccaagagaatctacaagaagagaaagagcgagagaaagtgcatgcagggcaagtacgccggcgccatggagagcgagccctgcgtgtgcaccgaggccgacttcgactgcgactacggctacgagagacacagcaacggccagtgcctgcccgccttctggttcaaccccagcagcctgagcaaggactgcagcctgggccagagctacctgaacagcaccggctacagaaaggtggtgagcaacaactgcaccgacggcgtgagagagcagtacaccgccaagccccagaagtgccccggcaaggcccccagaggcctgagaatcgtgaccgccgacggcaagctgaccgccgagcagggccacaacgtgaccctgatggtgcagctggaggagggcgacgtgcagagaaccctgatccaggtggacttcggcgacggcatcgccgtgagctacgtgaacctgagcagcatggaggacggcatcaagcacgtgtaccagaacgtgggcatcttcagagtgaccgtgcaggtggacaacagcctgggcagcgacagcgccgtgctgtacctgcacgtgacctgccccctggagcacgtgcacctgagcctgcccttcgtgaccaccaagaacaaggaggtgaacgccaccgccgtgctgtggcccagccaggtgggcaccctgacctacgtgtggtggtacggcaacaacaccgagcccctgatcaccctggagggcagcatcagcttcagattcaccagcgagggcatgaacaccatcaccgtgcaggtgagcgccggcaacgccatcctgcaggacaccaagaccatcgccgtgtacgaggagttcagaagcctgagactgagcttcagccccaacctggacgactacaaccccgacatccccgagtggagaagagacatcggcagagtgatcaagaagagcctggtggaggccaccggcgtgcccggccagcacatcctggtggccgtgctgcccggcctgcccaccaccgccgagctgttcgtgctgccctaccaggaccccgccggcgagaacaagagaagcaccgacgacctggagcagatcagcgagctgctgatccacaccctgaaccagaacagcgtgcacttcgagctgaagcccggcgtgagagtgctggtgcacgccgcccacctgaccgccgcccccctggtggacctgacccccacccacagcggcagcgccatgctgatgctgctgagcgtggtgttcgtgggcctggccgtgttcgtgatctacaagttcaagagaagagtggccctgcccagcccccccagccccagcacccagcccggcgacagcagcctgagactgcagagagccagacacgccaccccccccagcacccccaagagaggcagcgccggcgcccagtacgccatctag

SEQ ID NO: 100347 - DNA, 3597 bp, Artificial Sequence
  Description of Artificial Sequence: Synthetic coding sequence
atgggcaaggtgggcgccggcggcggcagccaggccagactgagcgccctgctggccggcgccggcctgctgatcctgtgcgcccccggcgtgtgcggcggcggcagctgctgccccagcccccaccccagcagcgcccccagaagcgccagcacccccagaggcttcagccaccagggcagacccggcagagcccccgccacccccctgcccctggtggtgagacccctgttcagcgtggcccccggcgacagagccctgagcctggagagagccagaggcaccggcgccagcatggccgtggccgccagaagcggcagaagaagaagaagcggcgccgaccaggagaaggccgagagaggcgagggcgccagcagaagccccagaggcgtgctgagagacggcggccagcaggagcccggcaccagagagagagaccccgacaaggccaccagattcagaatggaggagctgagactgaccagcaccaccttcgccctgaccggcgacagcgcccacaaccaggccatggtgcactggagcggccacaacagcagcgtgatcctgatcctgaccaagctgtacgactacaacctgggcagcatcaccgagagcagcctgtggagaagcaccgactacggcaccacctacgagaagctgaacgacaaggtgggcctgaagaccatcctgagctacctgtacgtgtgccccaccaacaagagaaagatcatgctgctgaccgaccccgagatcgagagcagcctgctgatcagcagcgacgagggcgccacctaccagaagtacagactgaacttctacatccagagcctgctgttccaccccaagcaggaggactggatcctggcctacagccaggaccagaagctgtacagcagcgccgagttcggcagaagatggcagctgatccaggagggcgtggtgcccaacagattctactggagcgtgatgggcagcaacaaggagcccgacctggtgcacctggaggccagaaccgtggacggccacagccactacctgacctgcagaatgcagaactgcaccgaggccaacagaaaccagcccttccccggctacatcgaccccgacagcctgatcgtgcaggaccactacgtgttcgtgcagctgaccagcggcggcagaccccactactacgtgagctacagaagaaacgccttcgcccagatgaagctgcccaagtacgccctgcccaaggacatgcacgtgatcagcaccgacgagaaccaggtgttcgccgccgtgcaggagtggaaccagaacgacacctacaacctgtacatcagcgacaccagaggcgtgtacttcaccctggccctggagaacgtgcagagcagcagaggccccgagggcaacatcatgatcgacctgtacgaggtggccggcatcaagggcatgttcctggccaacaagaagatcgacaaccaggtgaagaccttcatcacctacaacaagggcagagactggagactgctgcaggcccccgacaccgacctgagaggcgaccccgtgcactgcctgctgccctactgcagcctgcacctgcacctgaaggtgagcgagaacccctacaccagcggcatcatcgccagcaaggacaccgcccccagcatcatcgtggccagcggcaacatcggcagcgagctgagcgacaccgacatcagcatgttcgtgagcagcgacgccggcaacacctggagacagatcttcgaggaggagcacagcgtgctgtacctggaccagggcggcgtgctggtggccatgaagcacaccagcctgcccatcagacacctgtggctgagcttcgacgagggcagaagctggagcaagtacagcttcaccagcatccccctgttcgtggacggcgtgctgggcgagcccggcgaggagaccctgatcatgaccgtgttcggccacttcagccacagaagcgagtggcagctggtgaaggtggactacaagagcatcttcgacagaagatgcgccgaggaggactacagaccctggcagctgcacagccagggcgaggcctgcatcatgggcgccaagagaatctacaagaagagaaagagcgagagaaagtgcatgcagggcaagtacgccggcgccatggagagcgagccctgcgtgtgcaccgaggccgacttcgactgcgactacggctacgagagacacagcaacggccagtgcctgcccgccttctggttcaaccccagcagcctgagcaaggactgcagcctgggccagagctacctgaacagcaccggctacagaaaggtggtgagcaacaactgcaccgacggcgtgagagagcagtacaccgccaagccccagaagtgccccggcaaggcccccagaggcctgagaatcgtgaccgccgacggcaagctgaccgccgagcagggccacaacgtgaccctgatggtgcagctggaggagggcgacgtgcagagaaccctgatccaggtggacttcggcgacggcatcgccgtgagctacgtgaacctgagcagcatggaggacggcatcaagcacgtgtaccagaacgtgggcatcttcagagtgaccgtgcaggtggacaacagcctgggcagcgacagcgccgtgctgtacctgcacgtgacctgccccctggagcacgtgcacctgagcctgcccttcgtgaccaccaagaacaaggaggtgaacgccaccgccgtgctgtggcccagccaggtgggcaccctgacctacgtgtggtggtacggcaacaacaccgagcccctgatcaccctggagggcagcatcagcttcagattcaccagcgagggcatgaacaccatcaccgtgcaggtgagcgccggcaacgccatcctgcaggacaccaagaccatcgccgtgtacgaggagttcagaagcctgagactgagcttcagccccaacctggacgactacaaccccgacatccccgagtggagaagagacatcggcagagtgatcaagaagagcctggtggaggccaccggcgtgcccggccagcacatcctggtggccgtgctgcccggcctgcccaccaccgccgagctgttcgtgctgccctaccaggaccccgccggcgagaacaagagaagcaccgacgacctggagcagatcagcgagctgctgatccacaccctgaaccagaacagcgtgcacttcgagctgaagcccggcgtgagagtgctggtgcacgccgcccacctgaccgccgcccccctggtggacctgacccccacccacagcggcagcgccatgctgatgctgctgagcgtggtgttcgtgggcctggccgtgttcgtgatctacaagttcaagagaaagatccccggcatcaacgtgtacgcccagatgcagaacgagaaggagcaggagatgatcagccccgtgagccacagcgagagcagacccaacgtgccccagaccgagctgagaagacccggccagctgatcgacgagaaggtggagagccagctgatcggcagcatcagcatcgtggccgagaaccagagcaccaaggagatccccacctacgtgaacgtgtag

SEQ ID NO: 100348 - DNA, 2145 bp, Artificial Sequence
  Description of Artificial Sequence: Synthetic coding sequence
atgatcgacctgtacgaggtggccggcatcaagggcatgttcctggccaacaagaagatcgacaaccaggtgaagaccttcatcacctacaacaagggcagagactggagactgctgcaggcccccgacaccgacctgagaggcgaccccgtgcactgcctgctgccctactgcagcctgcacctgcacctgaaggtgagcgagaacccctacaccagcggcatcatcgccagcaaggacaccgcccccagcatcatcgtggccagcggcaacatcggcagcgagctgagcgacaccgacatcagcatgttcgtgagcagcgacgccggcaacacctggagacagatcttcgaggaggagcacagcgtgctgtacctggaccagggcggcgtgctggtggccatgaagcacaccagcctgcccatcagacacctgtggctgagcttcgacgagggcagaagctggagcaagtacagcttcaccagcatccccctgttcgtggacggcgtgctgggcgagcccggcgaggagaccctgatcatgaccgtgttcggccacttcagccacagaagcgagtggcagctggtgaaggtggactacaagagcatcttcgacagaagatgcgccgaggaggactacagaccctggcagctgcacagccagggcgaggcctgcatcatgggcgccaagagaatctacaagaagagaaagagcgagagaaagtgcatgcagggcaagtacgccggcgccatggagagcgagccctgcgtgtgcaccgaggccgacttcgactgcgactacggctacgagagacacagcaacggccagtgcctgcccgccttctggttcaaccccagcagcctgagcaaggactgcagcctgggccagagctacctgaacagcaccggctacagaaaggtggtgagcaacaactgcaccgacggcgtgagagagcagtacaccgccaagccccagaagtgccccggcaaggcccccagaggcctgagaatcgtgaccgccgacggcaagctgaccgccgagcagggccacaacgtgaccctgatggtgcagctggaggagggcgacgtgcagagaaccctgatccaggtggacttcggcgacggcatcgccgtgagctacgtgaacctgagcagcatggaggacggcatcaagcacgtgtaccagaacgtgggcatcttcagagtgaccgtgcaggtggacaacagcctgggcagcgacagcgccgtgctgtacctgcacgtgacctgccccctggagcacgtgcacctgagcctgcccttcgtgaccaccaagaacaaggaggtgaacgccaccgccgtgctgtggcccagccaggtgggcaccctgacctacgtgtggtggtacggcaacaacaccgagcccctgatcaccctggagggcagcatcagcttcagattcaccagcgagggcatgaacaccatcaccgtgcaggtgagcgccggcaacgccatcctgcaggacaccaagaccatcgccgtgtacgaggagttcagaagcctgagactgagcttcagccccaacctggacgactacaaccccgacatccccgagtggagaagagacatcggcagagtgatcaagaagagcctggtggaggccaccggcgtgcccggccagcacatcctggtggccgtgctgcccggcctgcccaccaccgccgagctgttcgtgctgccctaccaggaccccgccggcgagaacaagagaagcaccgacgacctggagcagatcagcgagctgctgatccacaccctgaaccagaacagcgtgcacttcgagctgaagcccggcgtgagagtgctggtgcacgccgcccacctgaccgccgcccccctggtggacctgacccccacccacagcggcagcgccatgctgatgctgctgagcgtggtgttcgtgggcctggccgtgttcgtgatctacaagttcaagagaaagatccccggcatcaacgtgtacgcccagatgcagaacgagaaggagcaggagatgatcagccccgtgagccacagcgagagcagacccaacgtgccccagaccgagctgagaagacccggccagctgatcgacgagaaggtggagagccagctgatcggcgagtag

SEQ ID NO: 100349 - DNA, 642 bp, Artificial Sequence
  Description of Artificial Sequence: Synthetic coding sequence
tgactggacgactacaaccccgacatccccgagtggagaagagacatcggcagagtgatcaagaagagcctggtggaggccaccggcgtgcccggccagcacatcctggtggccgtgctgcccggcctgcccaccaccgccgagctgttcgtgctgccctaccaggaccccgccggcgagaacaagagaagcaccgacgacctggagcagatcagcgagctgctgatccacaccctgaaccagaacagcgtgcacttcgagctgaagcccggcgtgagagtgctggtgcacgccgcccacctgaccgccgcccccctggtggacctgacccccacccacagcggcagcgccatgctgatgctgctgagcgtggtgttcgtgggcctggccgtgttcgtgatctacaagttcaagagaaagatccccggcatcaacgtgtacgcccagatgcagaacgagaaggagcaggagatgatcagccccgtgagccacagcgagagcagacccaacgtgccccagaccgagctgagaagacccggccagctgatcgacgagaaggtggagagccagctgatcggcagcatcagcatcgtggccgagaaccagagcaccaaggagatccccacctacgtgaacgtgtag

SEQ ID NO: 100350 - DNA, 3009 bp, Artificial Sequence
  Description of Artificial Sequence: Synthetic coding sequence
atgggcaaggtgctggagagcagcctgtggagaagcagcgacttcggcaccagctacaccaagctgaccctgcagcccggcgtgaccaccgtgatcgacaacttctacatctgccccaccaacaagagaaaggtgatcctggtgagcagcagcctgagcgacagagaccagagcctgttcctgagcgccgacgagggcgccaccttccagaagcagcccatccccttcttcgtggagaccctgatcttccaccccaaggaggaggacaaggtgctggcctacaccaaggagagcaagctgtacgtgagcagcgacctgggcaagaagtggaccctgctgcaggagagagtgaccaaggaccacgtgttctggagcgtgagcggcgtggacgccgaccccgacctggtgcacgtggaggcccaggacctgggcggcgacttcagatacgtgacctgcgccatccacaactgcagcgagaagatgctgaccgcccccttcgccggccccatcgaccacggcagcctgaccgtgcaggacgactacatcttcttcaaggccaccagcgccaaccagaccaagtactacgtgagctacagaagaaacgagttcgtgctgatgaagctgcccaagtacgccctgcccaaggacctgcagatcatcagcaccgacgagagccaggtgttcgtggccgtgcaggagtggtaccagatggacacctacaacctgtaccagagcgaccccagaggcgtgagatacgccctggtgctgcaggacgtgagaagcagcagacaggccgaggagagcgtgctgatcgacatcctggaggtgagaggcgtgaagggcgtgttcctggccaaccagaagatcgacggcaaggtgatgaccctgatcacctacaacaagggcagagactgggactacctgagaccccccagcatggacatgaacggcaagcccaccaactgcaagccccccgactgccacctgcacctgcacctgagatgggccgacaacccctacgtgagcggcaccgtgcacaccaaggacaccgcccccggcctgatcatgggcgccggcaacctgggcagccagctggtggagtacaaggaggagatgtacatcaccagcgactgcggccacacctggagacaggtgttcgaggaggagcaccacatcctgtacctggaccacggcggcgtgatcgtggccatcaaggacaccagcatccccctgaagatcctgaagttcagcgtggacgagggcctgacctggagcacccacaacttcaccagcaccagcgtgttcgtggacggcctgctgagcgagcccggcgacgagaccctggtgatgaccgtgttcggccacatcagcttcagaagcgactgggagctggtgaaggtggacttcagacccagcttcagcagacagtgcggcgaggaggactacagcagctgggagctgagcaacctgcagggcgacagatgcatcatgggccagcagagaagcttcagaaagagaaagagcaccagctggtgcatcaagggcagaagcttcaccagcgccctgaccagcagagtgtgcgagtgcagagacagcgacttcctgtgcgactacggcttcgagagaagcagcagcagcgagagcagcaccaacaagtgcagcgccaacttctggttcaaccccctgagcccccccgacgactgcgccctgggccagacctacaccagcagcctgggctacagaaaggtggtgagcaacgtgtgcgagggcggcgtggacatgcagcagagccaggtgcagctgcagtgccccctgaccccccccagaggcctgcaggtgagcatccagggcgaggccgtggccgtgagacccggcgaggacgtgctgttcgtggtgagacaggagcagggcgacgtgctgaccaccaagtaccaggtggacctgggcgacggcttcaaggccatgtacgtgaacctgaccctgaccggcgagcccatcagacacagatacgagagccccggcatctacagagtgagcgtgagagccgagaacaccgccggccacgacgaggccgtgctgttcgtgcaggtgaacagccccctgcaggccctgtacctggaggtggtgcccgtgatcggcctgaaccaggaggtgaacctgaccgccgtgctgctgcccctgaaccccaacctgaccgtgttctactggtggatcggccacagcctgcagcccctgctgagcctggacaacagcgtgaccaccagattcagcgacaccggcgacgtgagagtgaccgtgcaggccgcctgcggcaacagcgtgctgcaggacagcagagtgctgagagtgctggaccagttccaggtgatgcccctgcagttcagcaaggagctggacgcctacaaccccaacacccccgagtggagagaggacgtgggcctggtggtgaccagactgctgagcaaggagaccagcgtgccccaggagctgctggtgaccgtggtgaagcccggcctgcccaccctggccgacctgtacgtgctgctgcccccccccagacccaccagaaagagaagcctgagcagcgacaagagactggccgccatccagcaggtgctgaacgcccagaagatcagcttcctgctgagaggcggcgtgagagtgctggtggccctgagagacaccggcaccggcgccgagcagctgggcggcggcggcggctactgggccgtggtggtgctgttcgtgatcggcctgttcgccgccggcgccttcatcctgtacaagttcaagagcagaaagagacccggcagaaccgtgtacgcccagatgcacaacgagaaggagcaggagatgaccagccccgtgagccacagcgaggacgtgcagggcgccgtgcagggcgaggagttcatcgacgacgacctggacagccagaccctgggcaaccacagcggcgtggtgctgagcatcaacagcagagagatgcacagctacctggtgagctag

SEQ ID NO: 100351 - DNA, 3480 bp, Artificial Sequence
  Description of Artificial Sequence: Synthetic coding sequence
atggcccacagaggccccagcagagccagcaagggccccggccccaccgccagagcccccagccccggcgccccccccccccccagaagccccagaagcagacccctgctgctgctgctgctgctgctgggcgcctgcggcgccgccggcagaagccccgagcccggcagactgggcccccacgcccagctgaccagagtgcccagaagcccccccgccggcagagccgagcccggcggcggcgaggacagacaggccagaggcaccgagcccggcgcccccggccccagccccggccccgcccccggccccggcgaggacggcgcccccgccgccggctacagaagatgggagagagccgcccccctggccggcgtggccagcagagcccaggtgagcctgatcagcaccagcttcgtgctgaagggcgacgccacccacaaccaggccatggtgcactggaccggcgagaacagcagcgtgatcctgatcctgaccaagtactaccacgccgacatgggcaaggtgctggagagcagcctgtggagaagcagcgacttcggcaccagctacaccaagctgaccctgcagcccggcgtgaccaccgtgatcgacaacttctacatctgccccaccaacaagagaaaggtgatcctggtgagcagcagcctgagcgacagagaccagagcctgttcctgagcgccgacgagggcgccaccttccagaagcagcccatccccttcttcgtggagaccctgatcttccaccccaaggaggaggacaaggtgctggcctacaccaaggagagcaagctgtacgtgagcagcgacctgggcaagaagtggaccctgctgcaggagagagtgaccaaggaccacgtgttctggagcgtgagcggcgtggacgccgaccccgacctggtgcacgtggaggcccaggacctgggcggcgacttcagatacgtgacctgcgccatccacaactgcagcgagaagatgctgaccgcccccttcgccggccccatcgaccacggcagcctgaccgtgcaggacgactacatcttcttcaaggccaccagcgccaaccagaccaagtactacgtgagctacagaagaaacgagttcgtgctgatgaagctgcccaagtacgccctgcccaaggacctgcagatcatcagcaccgacgagagccaggtgttcgtggccgtgcaggagtggtaccagatggacacctacaacctgtaccagagcgaccccagaggcgtgagatacgccctggtgctgcaggacgtgagaagcagcagacaggccgaggagagcgtgctgatcgacatcctggaggtgagaggcgtgaagggcgtgttcctggccaaccagaagatcgacggcaaggtgatgaccctgatcacctacaacaagggcagagactgggactacctgagaccccccagcatggacatgaacggcaagcccaccaactgcaagccccccgactgccacctgcacctgcacctgagatgggccgacaacccctacgtgagcggcaccgtgcacaccaaggacaccgcccccggcctgatcatgggcgccggcaacctgggcagccagctggtggagtacaaggaggagatgtacatcaccagcgactgcggccacacctggagacaggtgttcgaggaggagcaccacatcctgtacctggaccacggcggcgtgatcgtggccatcaaggacaccagcatccccctgaagatcctgaagttcagcgtggacgagggcctgacctggagcacccacaacttcaccagcaccagcgtgttcgtggacggcctgctgagcgagcccggcgacgagaccctggtgatgaccgtgttcggccacatcagcttcagaagcgactgggagctggtgaaggtggacttcagacccagcttcagcagacagtgcggcgaggaggactacagcagctgggagctgagcaacctgcagggcgacagatgcatcatgggccagcagagaagcttcagaaagagaaagagcaccagctggtgcatcaagggcagaagcttcaccagcgccctgaccagcagagtgtgcgagtgcagagacagcgacttcctgtgcgactacggcttcgagagaagcagcagcagcgagagcagcaccaacaagtgcagcgccaacttctggttcaaccccctgagcccccccgacgactgcgccctgggccagacctacaccagcagcctgggctacagaaaggtggtgagcaacgtgtgcgagggcggcgtggacatgcagcagagccaggtgcagctgcagtgccccctgaccccccccagaggcctgcaggtgagcatccagggcgaggccgtggccgtgagacccggcgaggacgtgctgttcgtggtgagacaggagcagggcgacgtgctgaccaccaagtaccaggtggacctgggcgacggcttcaaggccatgtacgtgaacctgaccctgaccggcgagcccatcagacacagatacgagagccccggcatctacagagtgagcgtgagagccgagaacaccgccggccacgacgaggccgtgctgttcgtgcaggtgaacagccccctgcaggccctgtacctggaggtggtgcccgtgatcggcctgaaccaggaggtgaacctgaccgccgtgctgctgcccctgaaccccaacctgaccgtgttctactggtggatcggccacagcctgcagcccctgctgagcctggacaacagcgtgaccaccagattcagcgacaccggcgacgtgagagtgaccgtgcaggccgcctgcggcaacagcgtgctgcaggacagcagagtgctgagagtgctggaccagttccaggtgatgcccctgcagttcagcaaggagctggacgcctacaaccccaacacccccgagtggagagaggacgtgggcctggtggtgaccagactgctgagcaaggagaccagcgtgccccaggagctgctggtgaccgtggtgaagcccggcctgcccaccctggccgacctgtacgtgctgctgcccccccccagacccaccagaaagagaagcctgagcagcgacaagagactggccgccatccagcaggtgctgaacgcccagaagatcagcttcctgctgagaggcggcgtgagagtgctggtggccctgagagacaccggcaccggcgccgagcagctgggcggcggcggcggctactgggccgtggtggtgctgttcgtgatcggcctgttcgccgccggcgccttcatcctgtacaagttcaagagaaagagacccggcagaaccgtgtacgcccagatgcacaacgagaaggagcaggagatgaccagccccgtgagccacagcgaggacgtgcagggcgccgtgcagggcaaccacagcggcgtggtgctgagcatcaacagcagagagatgcacagctacctggtgagctag

SEQ ID NO: 100352 - DNA, 594 bp, Artificial Sequence
  Description of Artificial Sequence: Synthetic coding sequence
atgggcgagagaaagatcttcaagaagagaaagcccggcgcccagtgcgccctgggcagagaccacagcggcagcgtggtgagcgagccctgcgtgtgcgccaactgggacttcgagtgcgactacggctacgagagacacggcgagagccagtgcgtgcccgccttctggtacaaccccgccagccccagcaaggactgcagcctgggccagagctacctgaacagcaccggctacagaagaatcgtgagcaacaactgcaccgacggcctgagagagaagtacaccgccaaggcccagatgtgccccggcaaggcccccagaggcctgcacgtggtgaccaccgacggcagactggtggccgagcagggccacaacgccaccttcatcatcctgatggaggagggcgacctgcagagaaccaacatccagctggacttcggcgacggcatcgccgtgagctacgccaacttcagccccatcgaggacggcatcaagcacgtgtacaagagcgccggcatcttccaggtgaccgcctacgccgagaacaacctgggcagcgacaccgccgtgctgttcctgcacgtggtgtag

SEQ ID NO: 100353 - DNA, 3669 bp, Artificial Sequence
  Description of Artificial Sequence: Synthetic coding sequence
atggaggccgccagaaccgagagacccgccggcagacccggcgcccccctggtgagaaccggcctgctgctgctgagcacctgggtgctggccggcgccgagatcacctgggacgccaccggcggccccggcagacccgccgcccccgccagcagaccccccgccctgagccccctgagccccagagccgtggccagccagtggcccgaggagctggccagcgccagaagagccgccgtgctgggcagaagagccggccccgagctgctgccccagcagggcggcggcagaggcggcgagatgcaggtggaggccggcggcaccagccccgccggcgagagaagaggcagaggcatccccgcccccgccaagctgggcggcgccagaagaagcagaagagcccagccccccatcacccaggagagaggcgacgcctgggccaccgcccccgccgacggcagcagaggcagcagacccctggccaagggcagcagagaggaggtgaaggcccccagagccggcggcagcgccgccgaggacctgagactgcccagcaccagcttcgccctgaccggcgacagcgcccacaaccaggccatggtgcactggagcggccacaacagcagcgtgatcctgatcctgaccaagctgtacgacttcaacctgggcagcgtgaccgagagcagcctgtggagaagcaccgactacggcaccacctacgagaagctgaacgacaaggtgggcctgaagaccgtgctgagctacctgtacgtgaaccccaccaacaagagaaagatcatgctgctgagcgaccccgagatggagagcagcatcctgatcagcagcgacgagggcgccacctaccagaagtacagactgaccttctacatccagagcctgctgttccaccccaagcaggaggactgggtgctggcctacagcctggaccagaagctgtacagcagcatggacttcggcagaagatggcagctgatgcacgagagaatcacccccaacagattctactggagcgtggccggcctggacaaggaggccgacctggtgcacatggaggtgagaaccaccgacggctacgcccactacctgacctgcagaatccaggagtgcgccgagaccaccagaagcggccccttcgccagaagcatcgacatcagcagcctggtggtgcaggacgagtacatcttcatccaggtgaccaccagcggcagagccagctactacgtgagctacagaagagaggccttcgcccagatcaagctgcccaagtacagcctgcccaaggacatgcacatcatcagcaccgacgagaaccaggtgttcgccgccgtgcaggagtggaaccagaacgacacctacaacctgtacatcagcgacaccagaggcatctacttcaccctggccatggagaacatcaagagcagcagaggcctgatgggcaacatcatcatcgagctgtacgaggtggccggcatcaagggcatcttcctggccaacaagaaggtggacgaccaggtgaagacctacatcacctacaacaagggcagagactggagactgctgcaggcccccgacgtggacctgagaggcagccccgtgcactgcctgctgcccttctgcagcctgcacctgcacctgcagctgagcgagaacccctacagcagcggcagaatcagcagcaaggagaccgcccccggcctggtggtggccaccggcaacatcggccccgagctgagctacaccgacatcggcgtgttcatcagcagcgacggcggcaacacctggagacagatcttcgacgaggagtacaacgtgtggttcctggactggggcggcgccctggtggccatgaagcacacccccctgcccgtgagacacctgtgggtgagcttcgacgagggccacagctgggacaagtacggcttcaccagcgtgcccctgttcgtggacggcgccctggtggaggccggcatggagacccacatcatgaccgtgttcggccacttcagcctgagaagcgagtggcagctggtgaaggtggactacaagagcatcttcagcagacactgcaccaaggaggactaccagacctggcacctgctgaaccagggcgagccctgcgtgatgggcgagagaaagatcttcaagaagagaaagcccggcgcccagtgcgccctgggcagagaccacagcggcagcgtggtgagcgagccctgcgtgtgcgccaactgggacttcgagtgcgactacggctacgagagacacggcgagagccagtgcgtgcccgccttctggtacaaccccgccagccccagcaaggactgcagcctgggccagagctacctgaacagcaccggctacagaagaatcgtgagcaacaactgcaccgacggcctgagagagaagtacaccgccaaggcccagatgtgccccggcaaggcccccagaggcctgcacgtggtgaccaccgacggcagactggtggccgagcagggccacaacgccaccttcatcatcctgatggaggagggcgacctgcagagaaccaacatccagctggacttcggcgacggcatcgccgtgagctacgccaacttcagccccatcgaggacggcatcaagcacgtgtacaagagcgccggcatcttccaggtgaccgcctacgccgagaacaacctgggcagcgacaccgccgtgctgttcctgcacgtggtgtgccccgtggagcacgtgcacctgagagtgcccttcgtggccatcagaaacaaggaggtgaacatcagcgccgtggtgtggcccagccagctgggcaccctgacctacttctggtggttcggcaacagcaccaagcccctgatcaccctggacagcagcatcagcttcaccttcctggccgagggcaccgacaccatcaccgtgcaggtggccgccggcaacgccctgatccaggacaccaaggagatcgccgtgcacgagtacttccagagccagctgctgagcttcagccccaacctggactaccacaaccccgacatccccgagtggagaaaggacatcggcaacgtgatcaagagagccctggtgaaggtgaccagcgtgcccgaggaccagatcctgatcgccgtgttccccggcctgcccaccagcgccgagctgttcatcctgccccccaagaacctgaccgagagaagaaagggcaacgagggcgacctggagcagatcgtggagaccctgttcaacgccctgaaccagaacctggtgcagttcgagctgaagcccggcgtgcaggtgatcgtgtacgtgacccagctgaccctggcccccctggtggacagcagcgccggccacagcagcagcgccatgctgatgctgctgagcgtggtgttcgtgggcctggccgtgttcctgatctacaagttcaagagaaagatcccctggatcaacatctacgcccaggtgcagcacgacaaggagcaggagatgatcggcagcgtgagccagagcgagaacgcccccaagatcaccctgagcgacttcaccgagcccgaggagctgctggacaaggagctggacaccagagtgatcggcggcatcgccaccatcgccaacagcgagagcaccaaggagatccccaactgcaccagcgtgtag

SEQ ID NO: 100354 - DNA, 462 bp, Artificial Sequence
  Description of Artificial Sequence: Synthetic coding sequence
gagaacccctacagcagcggcagaatcagcagcaaggagaccgcccccggcctggtggtggccaccggcaacatcggccccgagctgagctacaccgacatcggcgtgttcatcagcagcgacggcggcaacacctggagacagatcttcgacgaggagtacaacgtgtggttcctggactggggcggcgccctggtggccatgaagcacacccccctgcccgtgagacacctgtgggtgagcttcgacgagggccacagctgggacaagtacggcttcaccagcgtgcccctgttcgtggacggcgccctggtggaggccggcatggagacccacatcatgaccgactacggctacgagagacacggcgagagccagtgcgtgcccgccttctggtacaaccccgccagccccagcaaggactgcagcctgggccagagctacctgaacagcaccggctag

SEQ ID NO: 100355 - DNA, 1410 bp, Artificial Sequence
  Description of Artificial Sequence: Synthetic coding sequence
atgggcaccgtgcacgccagaagcctggagcccctgcccagcagcggccccgacttcggcggcctgggcgaggaggccgagttcgtggaggtggagcccgaggccaagcaggagatcctggagaacaaggacgtggtggtgcagcacgtgcacttcgacggcctgggcagaaccaaggacgacatcatcatctgcgagatcggcgacgtgttcaaggccaagaacctgatcgaggtgatgagaaagagccacgaggccagagagaagctgctgagactgggcatcttcagacaggtggacgtgctgatcgacacctgccagggcgacgacgccctgcccaacggcctggacgtgaccttcgaggtgaccgagctgagaagactgaccggcagctacaacaccatggtgggcaacaacgagggcagcatggtgctgggcctgaagctgcccaacctgctgggcagagccgagaaggtgaccttccagttcagctacggcaccaaggagaccagctacggcctgagcttcttcaagcccagacccggcaacttcgagagaaacttcagcgtgaacctgtacaaggtgaccggccagttcccctggagcagcctgagagagaccgacagaggcatgagcgccgagtacagcttccccatctggaagaccagccacaccgtgaagtgggagggcgtgtggagagagctgggctgcctgagcagaaccgccagcttcgccgtgagaaaggagagcggccacagcctgaagagcagcctgagccacgccatggtgatcgacagcagaaacagcagcatcctgcccagaagaggcgccctgctgaaggtgaaccaggagctggccggctacaccggcggcgacgtgagcttcatcaaggaggacttcgagctgcagctgaacaagcagctgatcttcgacagcgtgttcagcgccagcttctggggcggcatgctggtgcccatcggcgacaagcccagcagcatcgccgacagattctacctgggcggccccaccagcatcagaggcttcagcatgcacagcatcggcccccagagcgagggcgactacctgggcggcgaggcctactgggccggcggcctgcacctgtacacccccctgcccttcagacccggccagggcggcttcggcgagctgttcagaacccacttcttcctgaacgccggcaacctgtgcaacctgaactacggcgagggccccaaggcccacatcagaaagctggccgagtgcatcagatggagctacggcgccggcatcgtgctgagactgggcaacatcgccagactggagctgaactactgcgtgcccatgggcgtgcagaccggcgacagaatctgcgacggcgtgcagttcggcgccggcatcagattcctgtag

SEQ ID NO: 100356 - DNA, 780 bp, Artificial Sequence
  Description of Artificial Sequence: Synthetic coding sequence
atgagcgccgagtacagcttccccatctggaagaccagccacaccgtgaagtgggagggcgtgtggagagagctgggctgcctgagcagaaccgccagcttcgccgtgagaaaggagagcggccacagcctgaagagcagcctgagccacgccatggtgatcgacagcagaaacagcagcatcctgcccagaagaggcgccctgctgaaggtgaaccaggagctggccggctacaccggcggcgacgtgagcttcatcaaggaggacttcgagctgcagctgaacaagcagctgatcttcgacagcgtgttcagcgccagcttctggggcggcatgctggtgcccatcggcgacaagcccagcagcatcgccgacagattctacctgggcggccccaccagcatcagaggcttcagcatgcacagcatcggcccccagagcgagggcgactacctgggcggcgaggcctactgggccggcggcctgcacctgtacacccccctgcccttcagacccggccagggcggcttcggcgagctgttcagaacccacttcttcctgaacgccggcaacctgtgcaacctgaactacggcgagggccccaaggcccacatcagaaagctggccgagtgcatcagatggagctacggcgccggcatcgtgctgagactgggcaacatcgccagactggagctgaactactgcgtgcccatgggcgtgcagaccggcgacagaatctgcgacggcgtgcagttcggcgccggcatcagattcctgtag

SEQ ID NO: 100357 - DNA, 1425 bp, Artificial Sequence
  Description of Artificial Sequence: Synthetic coding sequence
atggccagcggcggcggcggctgcagcgccagcgagagactgcccccccccttccccggcctggagcccgagagcgagggcgccgccggcggcagcgagcccgaggccggcgacagcgacaccgagggcgaggacatcttcaccggcgccgccgtggtgagcaagcaccagagccccaagatcaccaccagcctgctgcccatcaacaacggcagcaaggagaacggcatccacgaggagcaggaccaggagccccaggacctgttcgccgacgccaccgtggagctgagcctggacagcacccagaacaaccagaagaaggtgctggccaagaccctgatcagcctgcccccccaggaggccaccaacagcagcaagccccagcccacctacgaggagctggaggaggaggagcaggaggaccagttcgacctgaccgtgggcatcaccgaccccgagaagatcggcgacggcatgaacgcctacgtggcctacaaggtgaccacccagaccagcctgcccctgttcagaagcaagcagttcgccgtgaagagaagattcagcgacttcctgggcctgtacgagaagctgagcgagaagcacagccagaacggcttcatcgtgccccccccccccgagaagagcctgatcggcatgaccaaggtgaaggtgggcaaggaggacagcagcagcgccgagttcctggagaagagaagagccgccctggagagatacctgcagagaatcgtgaaccaccccaccatgctgcaggaccccgacgtgagagagttcctggagaaggaggagctgcccagagccgtgggcacccagaccctgagcggcgccggcctgctgaagatgttcaacaaggccaccgacgccgtgagcaagatgaccatcaagatgaacgagagcgacatctggttcgaggagaagctgcaggaggtggagtgcgaggagcagagactgagaaagctgcacgccgtggtggagaccctggtgaaccacagaaaggagctggccctgaacaccgcccagttcgccaagagcctggccatgctgggcagcagcgaggacaacaccgccctgagcagagccctgagccagctggccgaggtggaggagaagatcgagcagctgcaccaggagcaggccaacaacgacttcttcctgctggccgagctgctgagcgactacatcagactgctggccatcgtgagatgggagagcagagtgacccagtacgagagagacttcgagagaatcagcaccgtggtgagaaaggaggtgatcagattcgagaaggagaagagcaaggacttcaagaaccacgtgatcaagtacctggagaccctgctgtacagccagcagcagctggccaagtactgggaggccttcctgcccgaggccaaggccatcagctag

SEQ ID NO: 100358 - DNA, 1569 bp, Artificial Sequence
  Description of Artificial Sequence: Synthetic coding sequence
atggccagcggcggcggcggctgcagcgccagcgagagactgcccccccccttccccggcctggagcccgagagcgagggcgccgccggcggcagcgagcccgaggccggcgacagcgacaccgagggcgaggacatcttcaccggcgccgccgtggtgagcaagcaccagagccccaagatcaccaccagcctgctgcccatcaacaacggcagcaaggagaacggcatccacgaggagcaggaccaggagccccaggacctgttcgccgacgccaccgtggagctgagcctggacagcacccagaacaaccagaagaaggtgctggccaagaccctgatcagcctgcccccccaggaggccaccaacagcagcaagccccagcccacctacgaggagctggaggaggaggagcaggaggaccagttcgacctgaccgtgggcatcaccgaccccgagaagatcggcgacggcatgaacgcctacgtggcctacaaggtgaccacccagaccagcctgcccctgttcagaagcaagcagttcgccgtgaagagaagattcagcgacttcctgggcctgtacgagaagctgagcgagaagcacagccagaacggcttcatcgtgccccccccccccgagaagagcctgatcggcatgaccaaggtgaaggtgggcaaggaggacagcagcagcgccgagttcctggagaagagaagagccgccctggagagatacctgcagagaatcgtgaaccaccccaccatgctgcaggaccccgacgtgagagagttcctggagaaggaggagctgcccagagccgtgggcacccagaccctgagcggcgccggcctgctgaagatgttcaacaaggccaccgacgccgtgagcaagatgaccatcaagatgaacgagagcgacatctggttcgaggagaagctgcaggaggtggagtgcgaggagcagagactgagaaagctgcacgccgtggtggagaccctggtgaaccacagaaaggagctggccctgaacaccgcccagttcgccaagagcctggccatgctgggcagcagcgaggacaacaccgccctgagcagagccctgagccagctggccgaggtggaggagaagatcgagcagctgcaccaggagcaggccaacaacgacttcttcctgctggccgagctgctgagcgactacatcagactgctggccatcgtgagagccgccttcgaccagagaatgaagacctggcagagatggcaggacgcccaggccaccctgcagaagaagagagaggccgaggccagactgctgtgggccaacaagcccgacaagctgcagcaggccaaggacgagatcctggagtgggagagcagagtgacccagtacgagagagacttcgagagaatcagcaccgtggtgagaaaggaggtgatcagattcgagaaggagaagagcaaggacttcaagaaccacgtgatcaagtacctggagaccctgctgtacagccagcagcagctggccaagtactgggaggccttcctgcccgaggccaaggccatcagctag

SEQ ID NO: 100359 - DNA, 1374 bp, Artificial Sequence
  Description of Artificial Sequence: Synthetic coding sequence
atggccagcggcggcggcggctgcagcgccagcgagagactgcccccccccttccccggcctggagcccgagagcgagggcgccgccggcggcagcgagcccgaggccggcgacagcgacaccgagggcgaggacatcttcaccggcgccgccgtggtgagcaagcaccagagccccaagatcaccaccagcctgctgcccatcaacaacggcagcaaggagaacggcatccacgaggagcaggaccaggagccccaggacctgttcgccggcgacggcatgaacgcctacgtggcctacaaggtgaccacccagaccagcctgcccctgttcagaagcaagcagttcgccgtgaagagaagattcagcgacttcctgggcctgtacgagaagctgagcgagaagcacagccagaacggcttcatcgtgccccccccccccgagaagagcctgatcggcatgaccaaggtgaaggtgggcaaggaggacagcagcagcgccgagttcctggagaagagaagagccgccctggagagatacctgcagagaatcgtgaaccaccccaccatgctgcaggaccccgacgtgagagagttcctggagaaggaggagctgcccagagccgtgggcacccagaccctgagcggcgccggcctgctgaagatgttcaacaaggccaccgacgccgtgagcaagatgaccatcaagatgaacgagagcgacatctggttcgaggagaagctgcaggaggtggagtgcgaggagcagagactgagaaagctgcacgccgtggtggagaccctggtgaaccacagaaaggagctggccctgaacaccgcccagttcgccaagagcctggccatgctgggcagcagcgaggacaacaccgccctgagcagagccctgagccagctggccgaggtggaggagaagatcgagcagctgcaccaggagcaggccaacaacgacttcttcctgctggccgagctgctgagcgactacatcagactgctggccatcgtgagagccgccttcgaccagagaatgaagacctggcagagatggcaggacgcccaggccaccctgcagaagaagagagaggccgaggccagactgctgtgggccaacaagcccgacaagctgcagcaggccaaggacgagatcctggagtgggagagcagagtgacccagtacgagagagacttcgagagaatcagcaccgtggtgagaaaggaggtgatcagattcgagaaggagaagagcaaggacttcaagaaccacgtgatcaagtacctggagaccctgctgtacagccagcagcagctggccaagtactgggaggccttcctgcccgaggccaaggccatcagctag

SEQ ID NO: 100360 - DNA, 1374 bp, Artificial Sequence; identical to SEQ ID NO: 100359
  Description of Artificial Sequence: Synthetic coding sequence

SEQ ID NO: 100361 - DNA, 3018 bp, Artificial Sequence
  Description of Artificial Sequence: Synthetic coding sequence
atggccgccagacccagcagagccaccggccccagaggcggccagagaagcagagtgaagcccccccccggcagaagactgaaggagcagctgccccccctggccgccgccagagccgtgttcgccgccgccaccgccgtgatcatgctgaccgaggccagcctgagcatctggggctggggcagcctgggcatcgtgctgttcctgatcaccttcggccccttcgtgatcttctacctgaccttctacatcctgtgcttcgtgggcggcggcctggtggtgaccctgctgttcggcaagaccaacagcgagaagtacctggagcagtgcgagcacagcttcctgccccccaccagccccggcgtgcccaagtgcctggaggagatgaagagagaggccagaaccatcaagatcgacagaagactgaccggcgccaacatcatcgacgagcccctgcagcaggtgatccagttcagcctgagagactacgtgcagtactggtactacaccctgagcgacgacgagagcttcctgctggagatcagacagaccctgcagaacgccctgatccagttcgccaccagaagcaaggagatcgactggcagccctacttcaccaccagaatcgtggacgacttcggcacccacctgagagtgttcagaaaggcccagcagaagatcaccgagaaggacgaccaggtgaagggcaccgccgaggacctggtggacaccttcttcgaggtggaggtggagatggagaaggaggtgtgcagagacctggtgtgcaccagccccaaggacgaggagggcttcctgagagacctgtgcgaggtgctgctgtacctgctgctgccccccggcgacttccagaacaagatcatgagatacttcgtgagagagatcctggccagaggcatcctgctgcccctgatcaaccagctgagcgaccccgactacatcaaccagtacgtgatctggatgatcagagacagcaactgcaactacgaggccttcatgaacatcatcaagctgagcgacaacatcggcgagctggaggccgtgagagacaaggccgccgaggagctgcagtacctgagaagcctggacaccgccggcgacgacatcaacaccatcaagaaccagatcaacagcctgctgttcgtgaagaaggtgtgcgacagcagaatccagagactgcagagcggcaaggagatcaacaccgtgaagctggccgccaacttcggcaagctgtgcaccgtgcccctggacagcatcctggtggacaacgtggccctgcagttcttcatggactacatgcagcagaccggcggccaggcccacctgttcttctggatgaccgtggagggctacagagtgaccgcccagcagcagctggaggtgctgctgagcagacagagagacggcaagcaccagaccaaccagaccaagggcctgctgagagccgccgccgtgggcatctacgagcagtacctgagcgagaaggccagccccagagtgaccgtggacgactacctggtggccaagctggccgacaccctgaaccacgaggaccccacccccgagatcttcgacgacatccagagaaaggtgtacgagctgatgctgagagacgagagattctaccccagcttcagacagaacgccctgtacgtgagaatgctggccgagctggacatgctgaaggaccccagcttcagaggcagcgacgacggcgacggcgagagcttcaacggcagccccaccggcagcatcaacctgagcctggacgacctgagcaacgtgagcagcgacgacagcgtgcagctgcacgcctacatcagcgacaccggcgtgtgcaacgaccacggcaagacctacgccctgtacgccatcaccgtgcacagaagaaacctgaacagcgaggagatgtggaagacctacagaagatacagcgacttccacgacttccacatgagaatcaccgagcagttcgagagcctgagcagcatcctgaagctgcccggcaagaagaccttcaacaacatggacagagacttcctggagaagagaaagaaggacctgaacgcctacctgcagctgctgctggcccccgagatgatgaaggccagccccgccctggcccactacgtgtacgacttcctggagaacaaggcctacagcaagggcaagggcgacttcgccagaaagatggacaccttcgtgaaccccctgagaaacagcatgagaaacgtgagcaacgccgtgaagagcctgcccgacagcctggccgagggcatgaccaagatgagcgacaacatgggcaagatgagcgagagactgggccaggacatcaagcagagcttcttcaaggtgccccccctgatccccaagaccgacagcgaccccgagcacagaagagtgagcgcccagctggacgacaacgtggacgacaacatccccctgagagtgatgctgctgctgatggacgaggtgttcgacctgaaggagagaaaccagtggctgagaagaaacatcaagaacctgctgcagcagctgatcagagccacctacggcgacaccatcaacagaaagatcgtggaccacgtggactggatgaccagccccgagcaggtggccgacagcgtgaagagattcagagacgccttctggcccaacggcatcctggccgaggccgtgccctgcagagacaagagcatcagaatgagaaccagagtggccggcaagaccaagctgctggccatcatgcccgacgagctgaagcacatcatcggcgccgagaccaccagaaagggcatcctgagagtgttcgagatgttccagcacaaccagctgaacagaagaatggtgtacgtgttcctggagggcttcctggagaccctgttcccccagtacaagttcagagagctgttcaacaagctgcacagcagaagcaagcagatgcagaagtacaagcagaagctgcagaccacccaggcccccagcctgcagaagagatag

SEQ ID NO: 100362 - DNA, 2874 bp, Artificial Sequence
  Description of Artificial Sequence: Synthetic coding sequence
atgctgaccgaggccagcctgagcatctggggctggggcagcctgggcatcgtgctgttcctgatcaccttcggccccttcgtgatcttctacctgaccttctacatcctgtgcttcgtgggcggcggcctggtggtgaccctgctgttcggcaagaccaacagcgagaagtacctggagcagtgcgagcacagcttcctgccccccaccagccccggcgtgcccaagtgcctggaggagatgaagagagaggccagaaccatcaagatcgacagaagactgaccggcgccaacatcatcgacgagcccctgcagcaggtgatccagttcagcctgagagactacgtgcagtactggtactacaccctgagcgacgacgagagcttcctgctggagatcagacagaccctgcagaacgccctgatccagttcgccaccagaagcaaggagatcgactggcagccctacttcaccaccagaatcgtggacgacttcggcacccacctgagagtgttcagaaaggcccagcagaagatcaccgagaaggacgaccaggtgaagggcaccgccgaggacctggtggacaccttcttcgaggtggaggtggagatggagaaggaggtgtgcagagacctggtgtgcaccagccccaaggacgaggagggcttcctgagagacctgtgcgaggtgctgctgtacctgctgctgccccccggcgacttccagaacaagatcatgagatacttcgtgagagagatcctggccagaggcatcctgctgcccctgatcaaccagctgagcgaccccgactacatcaaccagtacgtgatctggatgatcagagacagcaactgcaactacgaggccttcatgaacatcatcaagctgagcgacaacatcggcgagctggaggccgtgagagacaaggccgccgaggagctgcagtacctgagaagcctggacaccgccggcgacgacatcaacaccatcaagaaccagatcaacagcctgctgttcgtgaagaaggtgtgcgacagcagaatccagagactgcagagcggcaaggagatcaacaccgtgaagctggccgccaacttcggcaagctgtgcaccgtgcccctggacagcatcctggtggacaacgtggccctgcagttcttcatggactacatgcagcagaccggcggccaggcccacctgttcttctggatgaccgtggagggctacagagtgaccgcccagcagcagctggaggtgctgctgagcagacagagagacggcaagcaccagaccaaccagaccaagggcctgctgagagccgccgccgtgggcatctacgagcagtacctgagcgagaaggccagccccagagtgaccgtggacgactacctggtggccaagctggccgacaccctgaaccacgaggaccccacccccgagatcttcgacgacatccagagaaaggtgtacgagctgatgctgagagacgagagattctaccccagcttcagacagaacgccctgtacgtgagaatgctggccgagctggacatgctgaaggaccccagcttcagaggcagcgacgacggcgacggcgagagcttcaacggcagccccaccggcagcatcaacctgagcctggacgacctgagcaacgtgagcagcgacgacagcgtgcagctgcacgcctacatcagcgacaccggcgtgtgcaacgaccacggcaagacctacgccctgtacgccatcaccgtgcacagaagaaacctgaacagcgaggagatgtggaagacctacagaagatacagcgacttccacgacttccacatgagaatcaccgagcagttcgagagcctgagcagcatcctgaagctgcccggcaagaagaccttcaacaacatggacagagacttcctggagaagagaaagaaggacctgaacgcctacctgcagctgctgctggcccccgagatgatgaaggccagccccgccctggcccactacgtgtacgacttcctggagaacaaggcctacagcaagggcaagggcgacttcgccagaaagatggacaccttcgtgaaccccctgagaaacagcatgagaaacgtgagcaacgccgtgaagagcctgcccgacagcctggccgagggcatgaccaagatgagcgacaacatgggcaagatgagcgagagactgggccaggacatcaagcagagcttcttcaaggtgccccccctgatccccaagaccgacagcgaccccgagcacagaagagtgagcgcccagctggacgacaacgtggacgacaacatccccctgagagtgatgctgctgctgatggacgaggtgttcgacctgaaggagagaaaccagtggctgagaagaaacatcaagaacctgctgcagcagctgatcagagccacctacggcgacaccatcaacagaaagatcgtggaccacgtggactggatgaccagccccgagcaggtggccgacagcgtgaagagattcagagacgccttctggcccaacggcatcctggccgaggccgtgccctgcagagacaagagcatcagaatgagaaccagagtggccggcaagaccaagctgctggccatcatgcccgacgagctgaagcacatcatcggcgccgagaccaccagaaagggcatcctgagagtgttcgagatgttccagcacaaccagctgaacagaagaatggtgtacgtgttcctggagggcttcctggagaccctgttcccccagtacaagttcagagagctgttcaacaagctgcacagcagaagcaagcagatgcagaagtacaagcagaagctgcagaccacccaggcccccagcctgcagaagagatag

SEQ ID NO: 100363 - DNA, 771 bp, Artificial Sequence
  Description of Artificial Sequence: Synthetic coding sequence
atgagcagacaggccaaggacgacttcctgagacactacaccgtgagcgaccccagaacccaccccaagggctacaccgagtacaaggtgaccgcccagttcatcagcaagaaggaccccgaggacgtgaaggaggtggtggtgtggaagagatacagcgacttcagaaagctgcacggcgacctggcctacacccacagaaacctgttcagaagactggaggagttccccgccttccccagagcccaggtgttcggcagattcgaggccagcgtgatcgaggagagaagaaagggcgccgaggacctgctgagattcaccgtgcacatccccgccctgaacaacagcccccagctgaaggagttcttcagaggcggcgaggtgaccagacccctggaggtgagcagagacctgcacatcctgcccccccccctgatccccacccccccccccgacgaccccagactgagccagctgctgcccgccgagagaagaggcctggaggagctggaggtgcccgtggaccccccccccagcagccccgcccaggaggccctggacctgctgttcaactgcgagagcaccgaggaggccagcggcagccccgccagaggccccctgaccgaggccgagctggccctgttcgaccccttcagcaaggagggcgaccccctgcccgccagacaggagggcgtgaagaagaaggccgccgagtacctgaagagagccgaggagatcctgagactgcacctgagccagctgcccccctag

SEQ ID NO: 100364 - DNA, 1029 bp, Artificial Sequence
  Description of Artificial Sequence: Synthetic coding sequence
atgagcagacaggccaaggacgacttcctgagacactacaccgtgagcgaccccagaacccaccccaagggctacaccgagtacaaggtgaccgcccagttcatcagcaagaaggaccccgaggacgtgaaggaggtggtggtgtggaagagatacagcgacttcagaaagctgcacggcgacctggcctacacccacagaaacctgttcagaagactggaggagttccccgccttccccagagcccaggtgttcggcagattcgaggccagcgtgatcgaggagagaagaaagggcgccgaggacctgctgagattcaccgtgcacatccccgccctgaacaacagcccccagctgaaggagttcttcagaggcggcgaggtgaccagacccctggaggtgagcagagacctgcacatcctgcccccccccctgatccccacccccccccccgacgaccccagactgagccagctgctgcccgccgagagaagaggcctggaggagctggaggtgcccgtggaccccccccccagcagccccgcccaggaggccctggacctgctgttcaactgcgagagcaccgaggaggccagcggcagccccgccagaggccccctgaccgaggccgagctggccctgttcgaccccttcagcaaggaggagggcgccgcccccagccccacccacgtggccgagctggccaccatggaggtggagagcgccagactggaccaggagccctgggagcccggcggccaggaggaggaggaggacggcgagggcggccccacccccgcctacctgagccaggccaccgagctgatcacccaggccctgagagacgagaaggccggcgcctacgccgccgccctgcagggctacagagacggcgtgcacgtgctgctgcagggcgtgcccagcgaccccctgcccgccagacaggagggcgtgaagaagaaggccgccgagtacctgaagagagccgaggagatcctgagactgcacctgagccagctgcccccctag

SEQ ID NO: 100365 - DNA, 1608 bp, Artificial Sequence
  Description of Artificial Sequence: Synthetic coding sequence
atgagcgagggcgagagccagaccgtgctgagcagcggcagcgaccccaaggtggagagcagcagcagcgcccccggcctgaccagcgtgagcccccccgtgaccagcaccaccagcgccgccagccccgaggaggaggaggagagcgaggacgagagcgagatcctggaggagagcccctgcggcagatggcagaagagaagagaggaggtgaaccagagaaacgtgcccggcatcgacagcgcctacctggccatggacaccgaggagggcgtggaggtggtgtggaacgaggtgcagttcagcgagagaaagaactacaagctgcaggaggagaaggtgagagccgtgttcgacaacctgatccagctggagcacctgaacatcgtgaagttccacaagtactgggccgacatcaaggagaacaaggccagagtgatcttcatcaccgagtacatgagcagcggcagcctgaagcagttcctgaagaagaccaagaagaaccacaagaccatgaacgagaaggcctggaagagatggtgcacccagatcctgagcgccctgagctacctgcacagctgcgacccccccatcatccacggcaacctgacctgcgacaccatcttcatccagcacaacggcctgatcaagatcggcagcgtggcccccgacaccatcaacaaccacgtgaagacctgcagagaggagcagaagaacctgcacttcttcgcccccgagtacggcgaggtgaccaacgtgaccaccgccgtggacatctacagcttcggcatgtgcgccctggagatggccgtgctggagatccagggcaacggcgagagcagctacgtgccccaggaggccatcagcagcgccatccagctgctggaggaccccctgcagagagagttcatccagaagtgcctgcagagcgagcccgccagaagacccaccgccagagagctgctgttccaccccgccctgttcgaggtgcccagcctgaagctgctggccgcccactgcatcgtgggccaccagcacatgatccccgagaacgccctggaggagatcaccaagaacatggacaccagcgccgtgctggccgagatccccgccggccccggcagagagcccgtgcagaccctgtacagccagagccccgccctggagctggacaagttcctggaggacgtgagaaacggcatctaccccctgaccgccttcggcctgcccagaccccagcagccccagcaggaggaggtgaccagccccgtggtgccccccagcgtgaagacccccacccccgagcccgccgaggtggagaccagaaaggtggtgctgatgcagtgcaacatcgagagcgtggaggagggcgtgaagcaccacctgaccctgctgctgaagctggaggacaagctgaacagacacctgagctgcgacctgatgcccaacgagaacatccccgagctggccgccgagctggtgcagctgggcttcatcagcgaggccgaccagagcagactgaccagcctgctggaggagaccctgaacaagttcaacttcgccagaaacagcaccctgaacagcgccgccgtgaccgtgagcagctag

SEQ ID NO: 100366 - DNA, 1338 bp, Artificial Sequence
  Description of Artificial Sequence: Synthetic coding sequence
atgcacttcagcatccccgagaccgagagcagaagcggcgacagcggcggcagcgcctacgtgctgagaaaggagtacggcgccaacgtgctgcccgccttcccccccaagaagctgttcagcctgacccccgccgaggtggagcagagaagagagcagctggagaagtacatgcaggccgtgagacaggaccccctgctgggcagcagcgagaccttcaacagcttcctgagaagagcccagcaggagacccagcaggtgcccaccgaggaggtgagcctggaggtgctgctgagcaacggccagaaggtgctggtgaacgtgctgaccagcgaccagaccgaggacgtgctggaggccgtggccgccaagctggacctgcccgacgacctgatcggctacttcagcctgttcctggtgagagagaaggaggacggcgccttcagcttcgtgagaaagctgcaggagttcgagctgccctacgtgagcgtgaccagcctgagaagccaggagtacaagatcgtgctgagaaagagctactgggacagcgcctacgacgacgacgtgatggagaacagagtgggcctgaacctgctgtacgcccagaccgtgagcgacatcgagagaggctggatcctggtgaccaaggagcagcacagacagctgaagagcctgcaggagaaggtgagcaagaaggagttcctgagactggcccagaccctgagacactacggctacctgagattcgacgcctgcgtggccgacttccccgagaaggactgccccgtggtggtgagcgccggcaacagcgagctgagcctgcagctgagactgcccggccagcagctgagagagggcagcttcagagtgaccagaatgagatgctggagagtgaccagcagcgtgcccctgcccagcggcagcaccagcagccccggcagaggcagaggcgaggtgagactggagctggccttcgagtacctgatgagcaaggacagactgcagtgggtgaccatcaccagcccccaggccatcatgatgagcatctgcctgcagagcatggtggacgagctgatggtgaagaagagcggcggcagcatcagaaagatgctgagaagaagagtgggcggcaccctgagaagaagcgacagccagcaggccgtgaagagcccccccctgctggagagccccgacgccaccagagagagcatggtgaagctgagcagcaagctgagcgccgtgagcctgagaggcatcggcagccccagcaccgacgccagcgccagcgacgtgcacggcaacttcgccttcgagggcatcggcgacgaggacctgtag

SEQ ID NO: 100367 - DNA, 771 bp, Artificial Sequence
  Description of Artificial Sequence: Synthetic coding sequence
atggagaacagagtgggcctgaacctgctgtacgcccagaccgtgagcgacatcgagagaggctggatcctggtgaccaaggagcagcacagacagctgaagagcctgcaggagaaggtgagcaagaaggagttcctgagactggcccagaccctgagacactacggctacctgagattcgacgcctgcgtggccgacttccccgagaaggactgccccgtggtggtgagcgccggcaacagcgagctgagcctgcagctgagactgcccggccagcagctgagagagggcagcttcagagtgaccagaatgagatgctggagagtgaccagcagcgtgcccctgcccagcggcagcaccagcagccccggcagaggcagaggcgaggtgagactggagctggccttcgagtacctgatgagcaaggacagactgcagtgggtgaccatcaccagcccccaggccatcatgatgagcatctgcctgcagagcatggtggacgagctgatggtgaagaagagcggcggcagcatcagaaagatgctgagaagaagagtgggcggcaccctgagaagaagcgacagccagcaggccgtgaagagcccccccctgctggagagccccgacgccaccagagagagcatggtgaagctgagcagcaagctgagcgccgtgagcctgagaggcatcggcagccccagcaccgacgccagcgccagcgacgtgcacggcaacttcgccttcgagggcatcggcgacgaggacctgtag

SEQ ID NO: 100368 - DNA, 771 bp, Artificial Sequence; identical to SEQ ID NO: 100367
  Description of Artificial Sequence: Synthetic coding sequence

SEQ ID NO: 100369 - DNA, 1560 bp, Artificial Sequence
  Description of Artificial Sequence: Synthetic coding sequence
atggccgccgagagagagcccccccccctgggcgacggcaagcccaccgacttcgaggacctggaggacggcgaggacctgttcaccagcaccgtgagcaccctggagagcagccccagcagccccgagcccgccagcctgcccgccgaggacatcagcgccaacagcaacggccccaagcccaccgaggtggtgctggacgacgacagagaggacctgttcgccgaggccaccgaggaggtgagcctggacagccccgagagagagcccatcctgagcagcgagcccagccccgccgtgacccccgtgacccccaccaccctgatcgcccccagaatcgagagcaagagcatgagcgcccccgtgatcttcgacagaagcagagaggagatcgaggaggaggccaacggcgacatcttcgacatcgagatcggcgtgagcgaccccgagaaggtgggcgacggcatgaacgcctacatggcctacagagtgaccaccaagaccagcctgagcatgttcagcaagagcgagttcagcgtgaagagaagattcagcgacttcctgggcctgcacagcaagctggccagcaagtacctgcacgtgggctacatcgtgccccccgcccccgagaagagcatcgtgggcatgaccaaggtgaaggtgggcaaggaggacagcagcagcaccgagttcgtggagaagagaagagccgccctggagagatacctgcagagaaccgtgaagcaccccaccctgctgcaggaccccgacctgagacagttcctggagagcagcgagctgcccagagccgtgaacacccaggccctgagcggcgccggcatcctgagaatggtgaacaaggccgccgacgccgtgaacaagatgaccatcaagatgaacgagagcgacgcctggttcgaggagaagcagcagcagttcgagaacctggaccagcagctgagaaagctgcacgtgagcgtggaggccctggtgtgccacagaaaggagctgagcgccaacaccgccgccttcgccaagagcgccgccatgctgggcaacagcgaggaccacaccgccctgagcagagccctgagccagctggccgaggtggaggagaagatcgaccagctgcaccaggagcaggccttcgccgacttctacatgttcagcgagctgctgagcgactacatcagactgatcgccgccgtgaagggcgtgttcgaccacagaatgaagtgctggcagaagtgggaggacgcccagatcaccctgctgaagaagagagaggccgaggccaagatgatggtggccaacaagcccgacaagatccagcaggccaagaacgagatcagagagtgggaggccaaggtgcagcagggcgagagagacttcgagcagatcagcaagaccatcagaaaggaggtgggcagattcgagaaggagagagtgaaggacttcaagaccgtgatcatcaagtacctggagagcctggtgcagacccagcagcagctgatcaagtactgggaggccttcctgcccgaggccaaggccatcgcctag

SEQ ID NO: 100370 - DNA, 390 bp, Artificial Sequence
  Description of Artificial Sequence: Synthetic coding sequence
atggccagccccgagcaccccggcagccccggctgcatgggccccatcacccagtgcaccgccagaacccagcaggaggcccccgccaccggccccgacctgccccaccccggccccgacggccacctggacacccacagcggcctgagcagcaacagcagcatgaccaccagagagctgcagcagtactggcagaaccagaagtgcagatggaagcacgtgaagctgctgttcgagatcgccagcgccagaatcgaggagagaaaggtgagcaagttcgtgatgggcaagagcagacccggcgagatgacctaccccggcagcagaggcgagaccggcaccgcccccgagcccgaccccagatgccccagacagagcgacatgctgtag

SEQ ID NO: 100371 - DNA, 951 bp, Artificial Sequence
  Description of Artificial Sequence: Synthetic coding sequence
atggccagccccgagcaccccggcagccccggctgcatgggccccatcacccagtgcaccgccagaacccagcaggaggcccccgccaccggccccgacctgccccaccccggccccgacggccacctggacacccacagcggcctgagcagcaacagcagcatgaccaccagagagctgcagcagtactggcagaaccagaagtgcagatggaagcacgtgaagctgctgttcgagatcgccagcgccagaatcgaggagagaaaggtgagcaagttcgtggtgtaccagatcatcgtgatccagaccggcagcttcgacaacaacaaggccgtgctggagagaagatacagcgacttcgccaagctgcagaaggccctgctgaagaccttcagagaggagatcgaggacgtggagttccccagaaagcacctgaccggcaacttcgccgaggagatgatctgcgagagaagaagagccctgcaggagtacctgggcctgctgtacgccatcagatgcgtgagaagaagcagagagttcctggacttcctgaccagacccgagctgagagaggccttcggctgcctgagagccggccagtaccccagagccctggagctgctgctgagagtgctgcccctgcaggagaagctgaccgcccactgccccgccgccgccgtgcccgccctgtgcgccgtgctgctgtgccacagagacctggacagacccgccgaggccttcgccgccggcgagagagccctgcagagactgcaggccagagagggccacagatactacgcccccctgctggacgccatggtgagactggcctacgccctgggcaaggacttcgtgaccctgcaggagagactggaggagagccagctgagaagacccacccccagaggcatcaccctgaaggagctgaccgtgagagagtacctgcactag

SEQ ID NO: 100372 - DNA, 459 bp, Artificial Sequence
  Description of Artificial Sequence: Synthetic coding sequence
atggccagccccgagcaccccggcagccccggctgcatgggccccatcacccagtgcaccgccagaacccagcaggaggcccccgccaccggccccgacctgccccaccccggccccgacggccacctggacacccacagcggcctgagcagcaacagcagcatgaccaccagagagctgcagcagtactggcagaaccagaagtgcagatggaagcacgtgaagctgctgttcgagatcgccagcgccagaatcgaggagagaaaggtgagcaagttcgtggtgtaccagatcatcgtgatccagaccggcagcttcgacaacaacaaggccgtgctggagagaagatacagcgacttcgtgaccctgcaggagagactggaggagagccagctgagaagacccacccccagaggcatcaccctgaaggagctgaccgtgagagagtacctgcactag

SEQ ID NO: 100373 - DNA, 309 bp, Artificial Sequence
  Description of Artificial Sequence: Synthetic coding sequence
atggccagccccgagcaccccggcagccccggctgcatgggccccatcacccagtgcaccgccagaacccagcaggaggcccccgccaccggccccgacctgccccaccccggccccgacggccacctggacacccacagcggcctgagcagcaacagcagcatgaccaccagagagctgcagcagtactggcagaaccagaagtgcagatggaagcacgtgaagctgctgttcgagatcgccagcgccagaatcgaggagagaaaggtgagcaagttcgtggcccccgcccccgacgccaccccctag

SEQ ID NO: 100374 - DNA, 807 bp, Artificial Sequence
  Description of Artificial Sequence: Synthetic coding sequence
atgcagcagatcagaccccccttcatcagaggccccccccaccacgccagcaaccccaacagccccctgagcaaccccatgctgcccggcatcggccccccccccggcggccccagaaacctgggccccaccagcagccccatgcacagacccatgctgagcccccacatccacccccccagcacccccaccatgcccggcaacccccccggcctgctgcccccccccccccccggcgcccccctgcccagcctgcccttcccccccgtgagcatgatgcccaacggccccatgcccgtgccccagatgatgaacttcggcctgcccagcctggcccccctggtgcccccccccaccctgctggtgccctaccccgtgatcgtgcccctgcccgtgcccatccccatccccatccccatcccccacgtgagcgacagcaagccccccaagaagctgctgagccccgaggagcccgccgtgagcgagctggagagcgtgaaggagaacaactgcgccagcaactgccacctggacggcgaggccgccaagaagctgatgggcgaggaggccctggccggcggcgacaagagcgaccccaacctgaacaaccccgccgacgaggaccacgcctacgccctgagaatgctgcccaagaccggctgcgtgatccagcccgtgcccaagcccgccgagaaggccgccatggccccctgcatcatcagcagccccatgctgagcgccggccccgaggacctggagccccccctgaagagaagatgcctgagaatcagaaaccagaacaagtag

SEQ ID NO: 100375 - DNA, 423 bp, Artificial Sequence
  Description of Artificial Sequence: Synthetic coding sequence
atggccgagaccgtggccgacaccagaagactgatcaccaagccccagaacctgaacgacgcctacggcccccccagcaacttcctggagatcgacaccaacctgcccatcttcaagctgaaggagagcaccgtgagaagaagatacagcgacttcgagtggctgagaagcgagctggagagagagagcaaggtggtggtgccccccctgcccggcaaggccttcctgagacagctgcccttcagaggcgacgacggcatcttcgacgacaacttcatcgaggagagaaagcagggcctggagcagttcatcaacaaggtggccggccaccccctggcccagaacgagagatgcctgcacatgttcctgcaggacgagatcatcgacaagagctacacccccagcaagatcagacacgcctag

SEQ ID NO: 100376 - DNA, 342 bp, Artificial Sequence
  Description of Artificial Sequence: Synthetic coding sequence
atggccgagaccgtggccgacaccagaagactgatcaccaagccccagaacctgaacgacgcctacggcccccccagcaacttcctggagatcgacgtgagcaacccccagaccgtgggcgtgggcagaggcagattcaccacctacgagatcagagtgaagaccaacctgcccatcttcaagctgaaggagagcaccgtgagaagaagatacagcgacttcgagtggctgagaagcgagctggagagagagagcaagccctgcctgagaatgaccagcgaggccagaagccacggcagaacctggtgcgcccagaacgacgagaagctgttctgcgactag

SEQ ID NO: 100377 - DNA, 393 bp, Artificial Sequence
  Description of Artificial Sequence: Synthetic coding sequence
atggccgagaccgtggccgacaccagaagactgatcaccaagccccagaacctgaacgacgcctacggcccccccagcaacttcctggagatcgacgtgagcaacccccagaccgtgggcgtgggcagaggcagattcaccacctacgagatcagagtgaaggtggtggtgccccccctgcccggcaaggccttcctgagacagctgcccttcagaggcgacgacggcatcttcgacgacaacttcatcgaggagagaaagcagggcctggagcagttcatcaacaaggtggccggccaccccctggcccagaacgagagatgcctgcacatgttcctgcaggacgagatcatcgacaagagctacacccccagcaagatcagacacgcctag

SEQ ID NO: 100378 - DNA, 1353 bp, Artificial Sequence
  Description of Artificial Sequence: Synthetic coding sequence
atggagcaggccccccccgaccccgagagacagctgcagcccgcccccctggagcccctgggcagccccgacgccggcctgggcgccgccgtgggcaaggaggccgagggcgccggcgaggagagcagcggcgtggacaccatgacccacaacaacttctggctgaagaagatcgagatcagcgtgagcgaggccgagaagagaaccggcagaaacgccatgaacatgcaggagacctacaccgcctacctgatcgagaccagaagcgtggagcacaccgacggccagagcgtgctgaccgacagcctgtggagaagatacagcgagttcgagctgctgagaagctacctgctggtgtactacccccacatcgtggtgccccccctgcccgagaagagagccgagttcgtgtggcacaagctgagcgccgacaacatggaccccgacttcgtggagagaagaagaatcggcctggagaacttcctgctgagaatcgccagccaccccatcctgtgcagagacaagatcttctacctgttcctgacccaggagggcaactggaaggagaccgtgaacgagaccggcttccagctgaaggccgacagcagactgaaggccctgaacgccaccttcagagtgaagaaccccgacaagagattcaccgacctgaagcactacagcgacgagctgcagagcgtgatcagccacctgctgagagtgagagccagagtggccgacagactgtacggcgtgtacaaggtgcacggcaactacggcagagtgttcagcgagtggagcgccatcgagaaggagatgggcgacggcctgcagagcgccggccaccacatggacgtgtacgccagcagcatcgacgacatcctggaggacgaggagcactacgccgaccagctgaaggagtacctgttctacgccgaggccctgagagccgtgtgcagaaagcacgagctgatgcagtacgacctggagatggccgcccaggacctggccagcaagaagcagcagtgcgaggagctggtgaccggcaccgtgagaaccttcagcctgaagggcatgaccaccaagctgttcggccaggagacccccgagcagagagaggccagaatcaaggtgctggaggagcagatcaacgagggcgagcagcagctgaagagcaagaacctggagggcagagagttcgtgaagaacgcctgggccgacatcgagagattcaaggagcagaagaacagagacctgaaggaggccctgatcagctacgccgtgatgcagatcagcatgtgcaagaagggcatccaggtgtggaccaacgccaaggagtgcttcagcaagatgtag

SEQ ID NO: 100379 - DNA, 918 bp, Artificial Sequence
  Description of Artificial Sequence: Synthetic coding sequence
atggaccccgacttcgtggagagaagaagaatcggcctggagaacttcctgctgagaatcgccagccaccccatcctgtgcagagacaagatcttctacctgttcctgacccaggagggcaactggaaggagaccgtgaacgagaccggcttccagctgaaggccgacagcagactgaaggccctgaacgccaccttcagagtgaagaaccccgacaagagattcaccgacctgaagcactacagcgacgagctgcagagcgtgatcagccacctgctgagagtgagagccagagtggccgacagactgtacggcgtgtacaaggtgcacggcaactacggcagagtgttcagcgagtggagcgccatcgagaaggagatgggcgacggcctgcagagcgccggccaccacatggacgtgtacgccagcagcatcgacgacatcctggaggacgaggagcactacgccgaccagctgaaggagtacctgttctacgccgaggccctgagagccgtgtgcagaaagcacgagctgatgcagtacgacctggagatggccgcccaggacctggccagcaagaagcagcagtgcgaggagctggtgaccggcaccgtgagaaccttcagcctgaagggcatgaccaccaagctgttcggccaggagacccccgagcagagagaggccagaatcaaggtgctggaggagcagatcaacgagggcgagcagcagctgaagagcaagaacctggagggcagagagttcgtgaagaacgcctgggccgacatcgagagattcaaggagcagaagaacagagacctgaaggaggccctgatcagctacgccgtgatgcagatcagcatgtgcaagaagggcatccaggtgtggaccaacgccaaggagtgcttcagcaagatgtag

SEQ ID NO: 100380 - DNA, 1215 bp, Artificial Sequence
  Description of Artificial Sequence: Synthetic coding sequence
atggccgccgtgcccgagctgctgcagcagcaggaggaggacagaagcaagctgagaagcgtgagcgtggacctgaacgtggaccccagcctgcagatcgacatccccgacgccctgagcgagagagacaaggtgaagttcaccgtgcacaccaagaccaccctgcccaccttccagagccccgagttcagcgtgaccagacagcacgaggacttcgtgtggctgcacgacaccctgatcgagaccaccgactacgccggcctgatcatcccccccgcccccaccaagcccgacttcgacggccccagagagaagatgcagaagctgggcgagggcgagggcagcatgaccaaggaggagttcgccaagatgaagcaggagctggaggccgagtacctggccgtgttcaagaagaccgtgagcagccacgaggtgttcctgcagagactgagcagccaccccgtgctgagcaaggacagaaacttccacgtgttcctggagtacgaccaggacctgagcgtgagaagaaagaacaccaaggagatgttcggcggcttcttcaagagcgtggtgaagagcgccgacgaggtgctgttcaccggcgtgaaggaggtggacgacttcttcgagcaggagaagaacttcctgatcaactactacaacagaatcaaggacagctgcgtgaaggccgacaagatgaccagaagccacaagaacgtggccgacgactacatccacaccgccgcctgcctgcacagcctggccctggaggagcccaccgtgatcaagaagtacctgctgaaggtggccgagctgttcgagaagctgagaaaggtggagggcagagtgagcagcgacgaggacctgaagctgaccgagctgctgagatactacatgctgaacatcgaggccgccaaggacctgctgtacagaagaaccaaggccctgatcgactacgagaacagcaacaaggccctggacaaggccagactgaagagcaaggacgtgaagctggccgaggcccaccagcaggagtgctgccagaagttcgagcagctgagcgagagcgccaaggaggagctgatcaacttcaagagaaagagagtggccgccttcagaaagaacctgatcgagatgagcgagctggagatcaagcacgccagaaacaacgtgagcctgctgcagagctgcatcgacctgttcaagaacaactag

SEQ ID NO: 100381 - DNA, 1215 bp, Artificial Sequence; identical to SEQ ID NO: 100380
  Description of Artificial Sequence: Synthetic coding sequence

SEQ ID NO: 100382 - DNA, 687 bp, Artificial Sequence
  Description of Artificial Sequence: Synthetic coding sequence
atggccgccgtgcccgagctgctgcagcagcaggaggaggacagaagcaagaccaccctgcccaccttccagagccccgagttcagcgtgaccagacagcacgaggacttcgtgtggctgcacgacaccctgatcgagaccaccgactacgccggcctgatcatcccccccgcccccaccaagcccgacttcgacggccccagagagaagatgcagaagctgggcgagggcgagggcagcatgaccaaggaggagttcgccaagatgaagcaggagctggaggccgagtacctggccgtgttcaagaagaccgtgagcagccacgaggtgttcctgcagagactgagcagccaccccgtgctgagcaaggacagaaacttccacgtgttcctggagtacgaccaggacctgagcgtgagaagaaagaacaccaaggagatgttcggcggcttcttcaagagcgtggtgaagagcgccgacgaggtgctgttcaccggcgtgaaggaggtggacgacttcttcgagcaggagaagaacttcctgatcaactactacaacagaatcaaggacagctgcgtgaaggccgacaagatgaccagaagccacaagaacgtggccgacgactacatccacaccgccgcctgcctgcacagcctggccctggaggagcccaccgtgatcaagtag

SEQ ID NO: 100383 - DNA, 810 bp, Artificial Sequence
  Description of Artificial Sequence: Synthetic coding sequence
atggccgccgtgcccgagctgctgcagcagcaggaggaggacagaagcaagctgagaagcgtgagcgtggacctgaacgtggaccccagcctgcagatcgacatccccgacgccctgagcgagagagacaaggtgaagttcaccgtgcacaccaagatcccccccgcccccaccaagcccgacttcgacggccccagagagaagatgcagaagctgggcgagggcgagggcagcatgaccaaggaggagttcgccaagatgaagcaggagctggaggccgagtacctggccgtgttcaagaagaccgtgagcagccacgaggtgttcctgcagagactgagcagccaccccgtgctgagcaaggacagaaacttccacgtgttcctggagtacgaccaggacctgagcgtgagaagaaagaacaccaaggagatgttcggcggcttcttcaagagcgtggtgaagagcgccgacgaggtgctgttcaccggcgtgaaggaggtggacgacttcttcgagcaggagaagaacttcctgatcaactactacaacagaatcaaggacagctgcgtgaaggccgacaagatgaccagaagccacaagaacgtggccgacgactacatccacaccgccgcctgcctgcacagcctggccctggaggagcccaccgtgatcaagaagtacctgctgaaggtggccgagctgttcgagaagctgagaaaggtggagggcagagtgagcagcgacgaggacctgaagctgaccgagctgctgagatactacatgctgaacatcgaggccgccaagtag

SEQ ID NO: 100384 - DNA, 885 bp, Artificial Sequence
  Description of Artificial Sequence: Synthetic coding sequence
atgaccaccctgaccgagatcaagctgctgcccagcctggtgctgctggtgtgctgcgagtacctggccatcttcaagaagaccgtggccatgcacgaggtgttcctgtgcagagtggccgcccaccccatcctgagaagagacctgaacttccacgtgttcctggagtacaaccaggacctgagcgtgagaggcaagaacaagaaggagaagctggaggacttcttcaagaacatggtgaagagcgccgacggcgtgatcgtgagcggcgtgaaggacgtggacgacttcttcgagcacgagagaaccttcctgctggagtaccacaacagagtgaaggacgccagcgccaagagcgacagaatgaccagaagccacaagagcgccgccgacgactacaacagaatcggcagcagcctgtacgccctgggcacccaggacagcaccgacatctgcaagttcttcctgaaggtgagcgagctgttcgacaagaccagaaagatcgaggccagagtgagcgccgacgaggacctgaagctgagcgacctgctgaagtactacctgagagagagccaggccgccaaggacctgctgtacagaagaagcagaagcctggtggactacgagaacgccaacaaggccctggacaaggccagagccaagaacaaggacgtgctgcaggccgagaccagccagcagctgtgctgccagaagttcgagaagatcagcgagagcgccaagcaggagctgatcgacttcaagaccagaagagtggccgccttcagaaagaacctggtggagctggccgagctggagctgaagcacgccaagggcaacctgcagctgctgcagaactgcctggccgtgctgaacggcgacacctag

SEQ ID NO: 100385 - DNA, 1257 bp, Artificial Sequence
  Description of Artificial Sequence: Synthetic coding sequence
atgagagcctgcgccggccccagactgggcgccgccatgatggagggcctggacgacggccccgacttcctgagcgaggaggacagaggcctgaaggccatcaacgtggacctgcagagcgacgccgccctgcaggtggacatcagcgacgccctgagcgagagagacaaggtgaagttcaccgtgcacaccaagagcagcctgcccaacttcaagcagaacgagttcagcgtggtgagacagcacgaggagttcatctggctgcacgacagcttcgtggagaacgaggactacgccggctacatcatcccccccgccccccccagacccgacttcgacgccagcagagagaagctgcagaagctgggcgagggcgagggcagcatgaccaaggaggagttcaccaagatgaagcaggagctggaggccgagtacctggccatcttcaagaagaccgtggccatgcacgaggtgttcctgtgcagagtggccgcccaccccatcctgagaagagacctgaacttccacgtgttcctggagtacaaccaggacctgagcgtgagaggcaagaacaagaaggagaagctggaggacttcttcaagaacatggtgaagagcgccgacggcgtgatcgtgagcggcgtgaaggacgtggacgacttcttcgagcacgagagaaccttcctgctggagtaccacaacagagtgaaggacgccagcgccaagagcgacagaatgaccagaagccacaagagcgccgccgacgactacaacagaatcggcagcagcctgtacgccctgggcacccaggacagcaccgacatctgcaagttcttcctgaaggtgagcgagctgttcgacaagaccagaaagatcgaggccagagtgagcgccgacgaggacctgaagctgagcgacctgctgaagtactacctgagagagagccaggccgccaaggacctgctgtacagaagaagcagaagcctggtggactacgagaacgccaacaaggccctggacaaggccagagccaagaacaaggacgtgctgcaggccgagaccagccagcagctgtgctgccagaagttcgagaagatcagcgagagcgccaagcaggagctgatcgacttcaagaccagaagagtggccgccttcagaaagaacctggtggagctggccgagctggagctgaagcacgccaagggcaacctgcagctgctgcagaactgcctggccgtgctgaacggcgacacctag

SEQ ID NO: 100386 - DNA, 873 bp, Artificial Sequence
  Description of Artificial Sequence: Synthetic coding sequence
atgaccaaggaggagttcaccaagatgaagcaggagctggaggccgagtacctggccatcttcaagaagaccgtggccatgcacgaggtgttcctgtgcagagtggccgcccaccccatcctgagaagagacctgaacttccacgtgttcctggagtacaaccaggacctgagcgtgagaggcaagaacaagaaggagaagctggaggacttcttcaagaacatggtgaagagcgccgacggcgtgatcgtgagcggcgtgaaggacgtggacgacttcttcgagcacgagagaaccttcctgctggagtaccacaacagagtgaaggacgccagcgccaagagcgacagaatgaccagaagccacaagagcgccgccgacgactacaacagaatcggcagcagcctgtacgccctgggcacccaggacagcaccgacatctgcaagttcttcctgaaggtgagcgagctgttcgacaagaccagaaagatcgaggccagagtgagcgccgacgaggacctgaagctgagcgacctgctgaagtactacctgagagagagccaggccgccaaggacctgctgtacagaagaagcagaagcctggtggactacgagaacgccaacaaggccctggacaaggccagagccaagaacaaggacgtgctgcaggccgagaccagccagcagctgtgctgccagaagttcgagaagatcagcgagagcgccaagcaggagctgatcgacttcaagaccagaagagtggccgccttcagaaagaacctggtggagctggccgagctggagctgaagcacgccaagggcaacctgcagctgctgcagaactgcctggccgtgctgaacggcgacacctag

SEQ ID NO: 100387 - DNA, 873 bp, Artificial Sequence; identical to SEQ ID NO: 100386
  Description of Artificial Sequence: Synthetic coding sequence

SEQ ID NO: 100388 - DNA, 1188 bp, Artificial Sequence
  Description of Artificial Sequence: Synthetic coding sequence
atgaagatccccctgaacaagttccccggcttcgccaagcccggcaccgagcagtacctgctggccaagcagctggccaagcccaaggagaagatccccatcatcgtgggcgactacggccccatgtgggtgtaccccaccagcaccttcgactgcgtggtggccgaccccagaaagggcagcaagatgtacggcctgaagagctacatcgagtaccagctgacccccaccaacaccaacagaagcgtgaaccacagatacaagcacttcgactggctgtacgagagactgctggtgaagttcggcagcgccatccccatccccagcctgcccgacaagcaggtgaccggcagattcgaggaggagttcatcaagatgagaatggagagactgcaggcctggatgaccagaatgtgcagacaccccgtgatcagcgagagcgaggtgttccagcagttcctgaacttcagagacgagaaggagtggaagaccggcaagagaaaggccgagagagacgagctggccggcgtgatgatcttcagcaccatggagcccgaggcccccgacctggacctggtggagatcgagcagaagtgcgaggccgtgggcaagttcaccaaggccatggacgacggcgtgaaggagctgctgaccgtgggccaggagcactggaagagatgcaccggccccctgcccaaggagtaccagaagatcggcaaggccctgcagagcctggccaccgtgttcagcagcagcggctaccagggcgagaccgacctgaacgacgccatcaccgaggccggcaagacctacgaggagatcgccagcctggtggccgagcagcccaagaaggacctgcacttcctgatggagtgcaaccacgagtacaagggcttcctgggctgcttccccgacatcatcggcacccacaagggcgccatcgagaaggtgaaggagagcgacaagctggtggccaccagcaagatcaccctgcaggacaagcagaacatggtgaagagagtgagcatcatgagctacgccctgcaggccgagatgaaccacttccacagcaacagaatctacgactacaacagcgtgatcagactgtacctggagcagcaggtgcagttctacgagaccatcgccgagaagctgagacaggccctgagcagattccccgtgatgtag

SEQ ID NO: 100389 - DNA, 1788 bp, Artificial Sequence
  Description of Artificial Sequence: Synthetic coding sequence
atggccaccaaggccagagtgatgtacgacttcgccgccgagcccggcaacaacgagctgaccgtgaacgagggcgagatcatcaccatcaccaaccccgacgtgggcggcggctggctggagggcagaaacatcaagggcgagagaggcctggtgcccaccgactacgtggagatcctgcccagcgacggcaaggaccagttcagctgcggcaacagcgtggccgaccaggccttcctggacagcctgagcgccagcaccgcccaggccagcagcagcgccgccagcaacaaccaccaggtgggcagcggcaacgacccctggagcgcctggagcgccagcaagagcggcaactgggagagcagcgagggctggggcgcccagcccgagggcgccggcgcccagagaaacaccaacacccccaacaactgggacaccgccttcggccacccccaggcctaccagggccccgccaccggcgacgacgacgactgggacgaggactgggacggccccaagagcagcagctacttcaaggacagcgagagcgccgacgccggcggcgcccagagaggcaacagcagagccagcagcagcagcatgaagatccccctgaacaagttccccggcttcgccaagcccggcaccgagcagtacctgctggccaagcagctggccaagcccaaggagaagatccccatcatcgtgggcgactacggccccatgtgggtgtaccccaccagcaccttcgactgcgtggtggccgaccccagaaagggcagcaagatgtacggcctgaagagctacatcgagtaccagctgacccccaccaacaccaacagaagcgtgaaccacagatacaagcacttcgactggctgtacgagagactgctggtgaagttcggcagcgccatccccatccccagcctgcccgacaagcaggtgaccggcagattcgaggaggagttcatcaagatgagaatggagagactgcaggcctggatgaccagaatgtgcagacaccccgtgatcagcgagagcgaggtgttccagcagttcctgaacttcagagacgagaaggagtggaagaccggcaagagaaaggccgagagagacgagctggccggcgtgatgatcttcagcaccatggagcccgaggcccccgacctggacctggtggagatcgagcagaagtgcgaggccgtgggcaagttcaccaaggccatggacgacggcgtgaaggagctgctgaccgtgggccaggagcactggaagagatgcaccggccccctgcccaaggagtaccagaagatcggcaaggccctgcagagcctggccaccgtgttcagcagcagcggctaccagggcgagaccgacctgaacgacgccatcaccgaggccggcaagacctacgaggagatcgccagcctggtggccgagcagcccaagaaggacctgcacttcctgatggagtgcaaccacgagtacaagggcttcctgggctgcttccccgacatcatcggcacccacaagggcgccatcgagaaggtgaaggagagcgacaagctggtggccaccagcaagatcaccctgcaggacaagcagaacatggtgaagagagtgagcatcatgagctacgccctgcaggccgagatgaaccacttccacagcaacagaatctacgactacaacagcgtgatcagactgtacctggagcagcaggtgcagttctacgagaccatcgccgagaagctgagacaggccctgagcagattccccgtgatgtag

SEQ ID NO: 100390 - DNA, 1788 bp, Artificial Sequence; identical to SEQ ID NO: 100389
  Description of Artificial Sequence: Synthetic coding sequence

SEQ ID NO: 100391 - DNA, 1308 bp, Artificial Sequence
  Description of Artificial Sequence: Synthetic coding sequence
atgggcctgagcttcagcctgttccccctgagaaaccacgtgaacgtggagggcgccacccacaagcaggtggtggacctgatcagagccggcgagaaggagctgatcctgaccgtgctgagcgtgcccccccacgaggccgacaacctggaccccagcgacgacagcctgggccagagcttctacgactacaccgagaagcaggccgtgcccatcagcgtgcccagatacaagcacgtggagcagaacggcgagaagttcgtggtgtacaacgtgtacatggccggcagacagctgtgcagcaagagatacagagagttcgccatcctgcaccagaacctgaagagagagttcgccaacttcaccttccccagactgcccggcaagtggcccttcagcctgagcgagcagcagctggacgccagaagaagaggcctggaggagtacctggagaaggtgtgcagcatcagagtgatcggcgagagcgacatcatgcaggagttcctgagcgagagcgacgagaactacaacggcgtgagcgacgtggagctgagagtggccctgcccgacggcaccaccgtgaccgtgagagtgaagaagaacagcaccaccgaccaggtgtaccaggccatcgccgccaaggtgggcatggacagcaccaccgtgaactacttcgccctgttcgaggtgatcagccacagcttcgtgagaaagctggcccccaacgagttcccccacaagctgtacatccagaactacaccagcgccgtgcccggcacctgcctgaccatcagaaagtggctgttcaccaccgaggaggagatcctgctgaacgacaacgacctggccgtgacctacttcttccaccaggccgtggacgacgtgaagaagggctacatcaaggccgaggagaagagctaccagctgcagaagctgtacgagcagagaaagatggtgatgtacctgaacatgctgagaacctgcgagggctacaacgagatcatcttcccccactgcgcctgcgacagcagaagaaagggccacgtgatcaccgccatcagcatcacccacttcaagctgcacgcctgcaccgaggagggccagctggagaaccaggtgatcgccttcgagtgggacgagatgcagagatgggacaccgacgaggagggcatggccttctgcttcgagtacgccagaggcgagaagaagcccagatgggtgaagatcttcaccccctacttcaactacatgcacgagtgcttcgagagagtgttctgcgagctgaagtggagaaaggaggagtactag

SEQ ID NO: 100392 - DNA, 1587 bp, Artificial Sequence
  Description of Artificial Sequence: Synthetic coding sequence
atggccgacgaggacggcgagggcatccaccccagcgccccccacagaaacggcggcggcggcggcggcggcggcagcggcctgcactgcgccggcaacggcggcggcggcggcggcggccccagagtggtgagaatcgtgaagagcgagagcggctacggcttcaacgtgagaggccaggtgagcgagggcggccagctgagaagcatcaacggcgagctgtacgcccccctgcagcacgtgagcgccgtgctgcccggcggcgccgccgacagagccggcgtgagaaagggcgacagaatcctggaggtgaaccacgtgaacgtggagggcgccacccacaagcaggtggtggacctgatcagagccggcgagaaggagctgatcctgaccgtgctgagcgtgcccccccacgaggccgacaacctggaccccagcgacgacagcctgggccagagcttctacgactacaccgagaagcaggccgtgcccatcagcgtgcccagatacaagcacgtggagcagaacggcgagaagttcgtggtgtacaacgtgtacatggccggcagacagctgtgcagcaagagatacagagagttcgccatcctgcaccagaacctgaagagagagttcgccaacttcaccttccccagactgcccggcaagtggcccttcagcctgagcgagcagcagctggacgccagaagaagaggcctggaggagtacctggagaaggtgtgcagcatcagagtgatcggcgagagcgacatcatgcaggagttcctgagcgagagcgacgagaactacaacggcgtgagcgacgtggagctgagagtggccctgcccgacggcaccaccgtgaccgtgagagtgaagaagaacagcaccaccgaccaggtgtaccaggccatcgccgccaaggtgggcatggacagcaccaccgtgaactacttcgccctgttcgaggtgatcagccacagcttcgtgagaaagctggcccccaacgagttcccccacaagctgtacatccagaactacaccagcgccgtgcccggcacctgcctgaccatcagaaagtggctgttcaccaccgaggaggagatcctgctgaacgacaacgacctggccgtgacctacttcttccaccaggccgtggacgacgtgaagaagggctacatcaaggccgaggagaagagctaccagctgcagaagctgtacgagcagagaaagatggtgatgtacctgaacatgctgagaacctgcgagggctacaacgagatcatcttcccccactgcgcctgcgacagcagaagaaagggccacgtgatcaccgccatcagcatcacccacttcaagctgcacgcctgcaccgaggagggccagctggagaaccaggtgatcgccttcgagtgggacgagatgcagagatgggacaccgacgaggagggcatggccttctgcttcgagtacgccagaggcgagaagaagcccagatgggtgaagatcttcaccccctacttcaactacatgcacgagtgcttcgagagagtgttctgcgagctgaagtggagaaaggaggagtactag

SEQ ID NO: 100393 - DNA, 1626 bp, Artificial Sequence
  Description of Artificial Sequence: Synthetic coding sequence
atggccgacgaggacggcgagggcatccaccccagcgccccccacagaaacggcggcggcggcggcggcggcggcagcggcctgcactgcgccggcaacggcggcggcggcggcggcggccccagagtggtgagaatcgtgaagagcgagagcggctacggcttcaacgtgagaggccaggtgagcgagggcggccagctgagaagcatcaacggcgagctgtacgcccccctgcagcacgtgagcgccgtgctgcccggcggcgccgccgacagagccggcgtgagaaagggcgacagaatcctggaggtgaaccacgtgaacgtggagggcgccacccacaagcaggtggtggacctgatcagagccggcgagaaggagctgatcctgaccgtgctgagcgtgcccccccacgaggccgacaacctggaccccagcgacgacagcctgggccagagcttctacgactacaccgagaagcaggccgtgcccatcagcgtgcccagatacaagcacgtggagcagaacggcgagaagttcgtggtgtacaacgtgtacatggccggcagacagctgtgcagcaagagatacagagagttcgccatcctgcaccagaacctgaagagagagttcgccaacttcaccttccccagactgcccggcaagtggcccttcagcctgagcgagcagcagctggacgccagaagaagaggcctggaggagtacctggagaaggtgtgcagcatcagagtgatcggcgagagcgacatcatgcaggagttcctgagcgagagcgacgagaactacaacggcgtgagcgacgtggagctgagagtggccctgcccgacggcaccaccgtgaccgtgagagtgaagaagaacagcaccaccgaccaggtgtaccaggccatcgccgccaaggtgggcatggacagcaccaccgtgaactacttcgccctgttcgaggtgatcagccacagcttcgtgagaaagctggcccccaacgagttcccccacaagctgtacatccagaactacaccagcgccgtgcccggcacctgcctgaccatcagaaagtggctgttcaccaccgaggaggagatcctgctgaacgacaacgacctggccgtgacctacttcttccaccaggccgtggacgacgtgaagaagggctacatcaaggccgaggagaagagctaccagctgcagaagctgtacgagcagagaaagatggtgatgtacctgaacatgctgagaacctgcgagggctacaacgagatcatcttcccccactgcgcctgcgacagcagaagaaagggccacgtgatcaccgccatcagcatcacccacttcaagctgcacgcctgcaccgaggagggccagctggagaaccaggtgatcgccttcgagtgggacgagatgcagagatgggacaccgacgaggagggcatggccttctgcttcgagtacgccagaggcgagaagaagcccagatgggtgaagatcttcaccccctacttcaactacatgcacgagtgcttcgagagagtgttctgcgagctgaagtggagaaaggagaacatcttccagatggccagaagccagcagagagacgtggccacctag

SEQ ID NO: 100394 - DNA, 2640 bp, Artificial Sequence
  Description of Artificial Sequence: Synthetic coding sequence
atggccggcggcggcggcgacctgagcaccagaagactgaacgagtgcatcagccccgtggccaacgagatgaaccacctgcccgcccacagccacgacctgcagagaatgttcaccgaggaccagggcgtggacgacagactgctgtacgacatcgtgttcaagcacttcaagagaaacaaggtggagatcagcaacgccatcaagaagaccttccccttcctggagggcctgagagacagagacctgatcaccaacaagatgttcgaggacagccaggacagctgcagaaacctggtgcccgtgcagagagtggtgtacaacgtgctgagcgagctggagaagaccttcaacctgcccgtgctggaggccctgttcagcgacgtgaacatgcaggagtaccccgacctgatccacatctacaagggcttcgagaacgtgatccacgacaagctgcccctgcaggagagcgaggaggaggagagagaggagagaagcggcctgcagctgagcctggagcagggcaccggcgagaacagcttcagaagcctgacctggccccccagcggcagccccagccacgccggcaccaccccccccgagaacggcctgagcgagcacccctgcgagaccgagcagatcaacgccaagagaaaggacaccaccagcgacaaggacgacagcctgggcagccagcagaccaacgagcagtgcgcccagaaggccgagcccaccgagagctgcgagcagatcgccgtgcaggtgaacaacggcgacgccggcagagagatgccctgccccctgccctgcgacgaggagagccccgaggccgagctgcacaaccacggcatccagatcaacagctgcagcgtgagactggtggacatcaagaaggagaagcccttcagcaacagcaaggtggagtgccaggcccaggccagaacccaccacaaccaggccagcgacatcatcgtgatcagcagcgaggacagcgagggcagcaccgacgtggacgagcccctggaggtgttcatcagcgcccccagaagcgagcccgtgatcaacaacgacaaccccctggagagcaacgacgagaaggagggccaggaggccacctgcagcagaccccagatcgtgcccgagcccatggacttcagaaagctgagcaccttcagagagagcttcaagaagagagtgatcggccaggaccacgacttcagcgagagcagcgaggaggaggcccccgccgaggccagcagcggcgccctgagaagcaagcacggcgagaaggcccccatgaccagcagaagcaccagcacctggagaatccccagcagaaagagaagattcagcagcagcgacttcagcgacctgagcaacggcgaggagctgcaggagacctgcagcagcagcctgagaagaggcagcggcagccagccccaggagcccgagaacaagaagtgcagctgcgtgatgtgcttccccaagggcgtgcccagaagccaggaggccagaaccgagagcagccaggccagcgacatgatggacaccatggacgtggagaacaacagcaccctggagaagcacagcggcaagagaagaaagaagagaagacacagaagcaaggtgaacggcctgcagagaggcagaaagaaggacagacccagaaagcacctgaccctgaacaacaaggtgcagaagaagagatggcagcagagaggcagaaaggccaacaccagacccctgaagagaagaagaaagagaggccccagaatccccaaggacgagaacatcaacttcaagcagagcgagctgcccgtgacctgcggcgaggtgaagggcaccctgtacaaggagagattcaagcagggcaccagcaagaagtgcatccagagcgaggacaagaagtggttcacccccagagagttcgagatcgagggcgacagaggcgccagcaagaactggaagctgagcatcagatgcggcggctacaccctgaaggtgctgatggagaacaagttcctgcccgagccccccagcaccagaaagaagagaatcctggagagccacaacaacaccctggtggacccctgcgaggagcacaagaagaagaaccccgacgccagcgtgaagttcagcgagttcctgaagaagtgcagcgagacctggaagaccatcttcgccaaggagaagggcaagttcgaggacatggccaaggccgacaaggcccactacgagagagagatgaagacctacatcccccccaagggcgagaagaagaagaagttcaaggaccccaacgcccccaagagaccccccctggccttcttcctgttctgcagcgagtacagacccaagatcaagggcgagcaccccggcctgagcatcgacgacgtggtgaagaagctggccggcatgtggaacaacaccgccgccgccgacaagcagttctacgagaagaaggccgccaagctgaaggagaagtacaagaaggacatcgccgcctacagagccaagggcaagcccaacagcgccaagaagagagtggtgaaggccgagaagagcaagaagaagaaggaggaggaggaggacgaggaggacgagcaggaggaggagaacgaggaggacgacgacaagtag

SEQ ID NO: 100395 - DNA, 2658 bp, Artificial Sequence
  Description of Artificial Sequence: Synthetic coding sequence
atggccggcggcggcggcgacctgagcaccagaagactgaacgagtgcatcagccccgtggccaacgagatgaaccacctgcccgcccacagccacgacctgcagagaatgttcaccgaggaccagggcgtggacgacagactgctgtacgacatcgtgttcaagcacttcaagagaaacaaggtggagatcagcaacgccatcaagaagaccttccccttcctggagggcctgagagacagagacctgatcaccaacaagatgttcgaggacagccaggacagctgcagaaacctggtgcccgtgcagagagtggtgtacaacgtgctgagcgagctggagaagaccttcaacctgcccgtgctggaggccctgttcagcgacgtgaacatgcaggagtaccccgacctgatccacatctacaagggcttcgagaacgtgatccacgacaagctgcccctgcaggagagcgaggaggaggagagagaggagagaagcggcctgcagctgagcctggagcagggcaccggcgagaacagcttcagaagcctgacctggccccccagcggcagccccagccacgccggcaccaccccccccgagaacggcctgagcgagcacccctgcgagaccgagcagatcaacgccaagagaaaggacaccaccagcgacaaggacgacagcctgggcagccagcagaccaacgagcagtgcgcccagaaggccgagcccaccgagagctgcgagcagatcgccgtgcaggtgaacaacggcgacgccggcagagagatgccctgccccctgccctgcgacgaggagagccccgaggccgagctgcacaaccacggcatccagatcaacagctgcagcgtgagactggtggacatcaagaaggagaagcccttcagcaacagcaaggtggagtgccaggcccaggccagaacccaccacaaccaggccagcgacatcatcgtgatcagcagcgaggacagcgagggcagcaccgacgtggacgagcccctggaggtgttcatcagcgcccccagaagcgagcccgtgatcaacaacgacaaccccctggagagcaacgacgagaaggagggccaggaggccacctgcagcagaccccagatcgtgcccgagcccatggacttcagaaagctgagcaccttcagagagagcttcaagaagagagtgatcggccaggaccacgacttcagcgagagcagcgaggaggaggcccccgccgaggccagcagcggcgccctgagaagcaagcacggcgagaaggcccccatgaccagcagaagcaccagcacctggagaatccccagcagaaagagaagattcagcagcagcgacttcagcgacctgagcaacggcgaggagctgcaggagacctgcagcagcagcctgagaagaggcagcggcagccagccccaggagcccgagaacaagaagtgcagctgcgtgatgtgcttccccaagggcgtgcccagaagccaggaggccagaaccgagagcagccaggccagcgacatgatggacaccatggacgtggagaacaacagcaccctggagaagcacagcggcaagagaagaaagaagagaagacacagaagcaaggtgaacggcctgcagagaggcagaaagaaggacagacccagaaagcacctgaccctgaacaacaaggtgcagaagaagagatggcagcagagaggcagaaaggccaacaccagacccctgaagagaagaagaaagagaggccccagaatccccaaggacgagaacatcaacttcaagcagagcgagctgcccgtgacctgcggcgaggtgaagggcaccctgtacaaggagagattcaagcagggcaccagcaagaagtgcatccagagcgaggacaagaagtggttcacccccagagagttcgagatcgagggcgacagaggcgccagcaagaactggaagctgagcatcagatgcggcggctacaccctgaaggtgctgatggagaacaagttcctgcccgagccccccagcaccagaaagaagagaatcctggagagccacaacaacaccctggtggacccctgccccgagaacagcaacatctgcgaggtgtgcaacaagtggggcagactgttctgctgcgacacctgccccagaagcttccacgagcactgccacatccccagcgtggaggccaacaagaacccctggagctgcatcttctgcagaatcaagaccatccaggagagatgccccgagagccagagcggccaccaggagagcgaggtgctgatgagacagatgctgcccgaggagcagctgaagtgcgagttcctgctgctgaaggtgtactgcgacagcaagagctgcttcttcgccagcgagccctactacaacagagagggcagccagggcccccagaagcccatgtggctgaacaaggtgaagaccagcctgaacgagcagatgtacaccagagtggagggcttcgtgcaggacatgagactgatcttccacaaccacaaggagttctacagagaggacaagttcaccagactgggcatccaggtgcaggacatcttcgagaagaacttcagaaacatcttcgccatccaggagaccagcaagaacatcatcatgttcatctag

SEQ ID NO: 100396 - DNA, 1422 bp, Artificial Sequence
  Description of Artificial Sequence: Synthetic coding sequence
atggccggcggcggcggcgacctgagcaccagaagactgaacgagtgcatcagccccgtggccaacgagatgaaccacctgcccgcccacagccacgacctgcagagaatgttcaccgaggaccagggcgtggacgacagactgctgtacgacatcgtgttcaagcacttcaagagaaacaaggtggagatcagcaacgccatcaagaagaccttccccttcctggagggcctgagagacagagacctgatcaccaacaagatgttcgaggacagccaggacagctgcagaaacctggtgcccgtgcagagagtggtgtacaacgtgctgagcgagctggagaagaccttcaacctgcccgtgctggaggccctgttcagcgacgtgaacatgcaggagtaccccgacctgatccacatctacaagggcttcgagaacgtgatccacgacaagctgcccctgcaggagagcgaggaggaggagagagaggagagaagcggcctgcagctgagcctggagcagggcaccggcgagaacagcttcagaagcctgacctggccccccagcggcagccccagccacgccggcaccaccccccccgagaacggcctgagcgagcacccctgcgagaccgagcagatcaacgccaagagaaaggacaccaccagcgacaaggacgacagcctgggcagccagcagaccaacgagcagtgcgcccagaaggccgagcccaccgagagctgcgagcagatcgccgtgcaggtgaacaacggcgacgccggcagagagatgccctgccccctgccctgcgacgaggagagccccgaggccgagctgcacaaccacggcatccagatcaacagctgcagcgtgagactggtggacatcaagaaggagaagcccttcagcaacagcaaggtggagtgccaggcccaggccagaacccaccacaaccaggccagcgacatcatcgtgatcagcagcgaggacagcgagggcagcaccgacgtggacgagcccctggaggtgttcatcagcgcccccagaagcgagcccgtgatcaacaacgacaaccccctggagagcaacgacgagaaggagggccaggaggccacctgcagcagaccccagatcgtgcccgagcccatggacttcagaaagctgagcaccttcagagagagcttcaagaagagagtgatcggccaggaccacgacttcagcgagagcagcgaggaggaggcccccgccgaggccagcagcggcgccctgagaagcaagcacggcgagaaggcccccatgaccagcagaagcaccagcacctggagaatccccagcagaaagagacagctgaagaagaagaagaagaagaagcagtgccacccccagccccagccccagagaggcctgctggagcagagctag

SEQ ID NO: 100397 - DNA, 2067 bp, Artificial Sequence
  Description of Artificial Sequence: Synthetic coding sequence
atggccggcggcggcggcgacctgagcaccagaagactgaacgagtgcatcagccccgtggccaacgagatgaaccacctgcccgcccacagccacgacctgcagagaatgttcaccgaggaccagggcgtggacgacagactgctgtacgacatcgtgttcaagcacttcaagagaaacaaggtggagatcagcaacgccatcaagaagaccttccccttcctggagggcctgagagacagagacctgatcaccaacaagatgttcgaggacagccaggacagctgcagaaacctggtgcccgtgcagagagtggtgtacaacgtgctgagcgagctggagaagaccttcaacctgcccgtgctggaggccctgttcagcgacgtgaacatgcaggagtaccccgacctgatccacatctacaagggcttcgagaacgtgatccacgacaagctgcccctgcaggagagcgaggaggaggagagagaggagagaagcggcctgcagctgagcctggagcagggcaccggcgagaacagcttcagaagcctgacctggccccccagcggcagccccagccacgccggcaccaccccccccgagaacggcctgagcgagcacccctgcgagaccgagcagatcaacgccaagagaaaggacaccaccagcgacaaggacgacagcctgggcagccagcagaccaacgagcagtgcgcccagaaggccgagcccaccgagagctgcgagcagatcgccgtgcaggtgaacaacggcgacgccggcagagagatgccctgccccctgccctgcgacgaggagagccccgaggccgagctgcacaaccacggcatccagatcaacagctgcagcgtgagactggtggacatcaagaaggagaagcccttcagcaacagcaaggtggagtgccaggcccaggccagaacccaccacaaccaggccagcgacatcatcgtgatcagcagcgaggacagcgagggcagcaccgacgtggacgagcccctggaggtgttcatcagcgcccccagaagcgagcccgtgatcaacaacgacaaccccctggagagcaacgacgagaaggagggccaggaggccacctgcagcagaccccagatcgtgcccgagcccatggacttcagaaagctgagcaccttcagagagagcttcaagaagagagtgatcggccaggaccacgacttcagcgagagcagcgaggaggaggcccccgccgaggccagcagcggcgccctgagaagcaagcacggcgagaaggcccccatgaccagcagaagcaccagcacctggagaatccccagcagaaagagaagattcagcagcagcgacttcagcgacctgagcaacggcgaggagctgcaggagacctgcagcagcagcctgagaagaggcagcggcagccagccccaggagcccgagaacaagaagtgcagctgcgtgatgtgcttccccaagggcgtgcccagaagccaggaggccagaaccgagagcagccaggccagcgacatgatggacaccatggacgtggagaacaacagcaccctggagaagcacagcggcaagagaagaaagaagagaagacacagaagcaaggtgaacggcctgcagagaggcagaaagaaggacagacccagaaagcacctgaccctgaacaacaaggtgcagaagaagagatggcagcagagaggcagaaaggccaacaccagacccctgaagagaagaagaaagagaggccccagaatccccaaggacgagaacatcaacttcaagcagagcgagctgcccgtgacctgcggcgaggtgaagggcaccctgtacaaggagagattcaagcagggcaccagcaagaagtgcatccagagcgaggacaagaagtggttcacccccagagagttcgagatcgagggcgacagaggcgccagcaagaactggaagctgagcatcagatgcggcggctacaccctgaaggtgctgatggagaacaagttcctgcccgagccccccagcaccagaaagaaggtgatgatcaagtag

SEQ ID NO: 100398 - DNA, 1443 bp, Artificial Sequence
  Description of Artificial Sequence: Synthetic coding sequence
atggccggcggcggcggcgacctgagcaccagaagactgaacgagtgcatcagccccgtggccaacgagatgaaccacctgcccgcccacagccacgacctgcagagaatgttcaccgaggaccagggcgtggacgacagactgctgtacgacatcgtgttcaagcacttcaagagaaacaaggtggagatcagcaacgccatcaagaagaccttccccttcctggagggcctgagagacagagacctgatcaccaacaagatgttcgaggacagccaggacagctgcagaaacctggtgcccgtgcagagagtggtgtacaacgtgctgagcgagctggagaagaccttcaacctgcccgtgctggaggccctgttcagcgacgtgaacatgcaggagtaccccgacctgatccacatctacaagggcttcgagaacgtgatccacgacaagctgcccctgcaggagagcgaggaggaggagagagaggagagaagcggcctgcagctgagcctggagcagggcaccggcgagaacagcttcagaagcctgacctggccccccagcggcagccccagccacgccggcaccaccccccccgagaacggcctgagcgagcacccctgcgagaccgagcagatcaacgccaagagaaaggacaccaccagcgacaaggacgacagcctgggcagccagcagaccaacgagcagtgcgcccagaaggccgagcccaccgagagctgcgagcagatcgccgtgcaggtgaacaacggcgacgccggcagagagatgccctgccccctgccctgcgacgaggagagccccgaggccgagctgcacaaccacggcatccagatcaacagctgcagcgtgagactggtggacatcaagaaggagaagcccttcagcaacagcaaggtggagtgccaggcccaggccagaacccaccacaaccaggccagcgacatcatcgtgatcagcagcgaggacagcgagggcagcaccgacgtggacgagcccctggaggtgttcatcagcgcccccagaagcgagcccgtgatcaacaacgacaaccccctggagagcaacgacgagaaggagggccaggaggccacctgcagcagaccccagatcgtgcccgagcccatggacttcagaaagctgagcaccttcagagagagcttcaagaagagagtgatcggccaggaccacgacttcagcgagagcagcgaggaggaggcccccgccgaggccagcagcggcgccctgagaagcaagcacggcgagaaggcccccatgaccagcagaagcaccagcacctggagaatccccagcagaaagagaagattcagcagcagcgacttcagcgacctgagcaacggcgaggagctgcaggagacctgcagcagcagcctgagaagaggcagcggcaaggaggactag

SEQ ID NO: 100399 - DNA, 1068 bp, Artificial Sequence
  Description of Artificial Sequence: Synthetic coding sequence
atggacgtggagaacaacagcaccctggagaagcacagcggcaagagaagaaagaagagaagacacagaagcaaggtgaacggcctgcagagaggcagaaagaaggacagacccagaaagcacctgaccctgaacaacaaggtgcagaagaagagatggcagcagagaggcagaaaggccaacaccagacccctgaagagaagaagaaagagaggccccagaatccccaaggacgagaacatcaacttcaagcagagcgagctgcccgtgacctgcggcgaggtgaagggcaccctgtacaaggagagattcaagcagggcaccagcaagaagtgcatccagagcgaggacaagaagtggttcacccccagagagttcgagatcgagggcgacagaggcgccagcaagaactggaagctgagcatcagatgcggcggctacaccctgaaggtgctgatggagagaatcctggagagccacaacaacaccctggtggacccctgccccgagaacagcaacatctgcgaggtgtgcaacaagtggggcagactgttctgctgcgacacctgccccagaagcttccacgagcactgccacatccccagcgtggaggccaacaagaacccctggagctgcatcttctgcagaatcaagaccatccaggagagatgccccgagagccagagcggccaccaggagagcgaggtgctgatgagacagatgctgcccgaggagcagctgaagtgcgagttcctgctgctgaaggtgtactgcgacagcaagagctgcttcttcgccagcgagccctactacaacagagagggcagccagggcccccagaagcccatgtggctgaacaaggtgaagaccagcctgaacgagcagatgtacaccagagtggagggcttcgtgcaggacatgagactgatcttccacaaccacaaggagttctacagagaggacaagttcaccagactgggcatccaggtgcaggacatcttcgagaagaacttcagaaacatcttcgccatccaggagaccagcaagaacatcatcatgttcatctag

SEQ ID NO: 100400 - DNA, 1359 bp, Artificial Sequence
  Description of Artificial Sequence: Synthetic coding sequence
atggccggcggcggcggcgacctgagcaccagaatgttcaccgaggaccagggcgtggacgacagactgctgtacgacatcgtgttcaagcacttcaagagaaacaaggtggagatcagcaacgccatcaagaagaccttccccttcctggagggcctgagagacagagacctgatcaccaacaagatgttcgaggacagccaggacagctgcagaaacctggtgcccgtgcagagagtggtgtacaacgtgctgagcgagctggagaagaccttcaacctgcccgtgctggaggccctgttcagcgacgtgaacatgcaggagtaccccgacctgatccacatctacaagggcttcgagaacgtgatccacgacaagctgcccctgcaggagagcgaggaggaggagagagaggagagaagcggcctgcagctgagcctggagcagggcaccggcgagaacagcttcagaagcctgacctggccccccagcggcagccccagccacgccggcaccaccccccccgagaacggcctgagcgagcacccctgcgagaccgagcagatcaacgccaagagaaaggacaccaccagcgacaaggacgacagcctgggcagccagcagaccaacgagcagtgcgcccagaaggccgagcccaccgagagctgcgagcagatcgccgtgcaggtgaacaacggcgacgccggcagagagatgccctgccccctgccctgcgacgaggagagccccgaggccgagctgcacaaccacggcatccagatcaacagctgcagcgtgagactggtggacatcaagaaggagaagcccttcagcaacagcaaggtggagtgccaggcccaggccagaacccaccacaaccaggccagcgacatcatcgtgatcagcagcgaggacagcgagggcagcaccgacgtggacgagcccctggaggtgttcatcagcgcccccagaagcgagcccgtgatcaacaacgacaaccccctggagagcaacgacgagaaggagggccaggaggccacctgcagcagaccccagatcgtgcccgagcccatggacttcagaaagctgagcaccttcagagagagcttcaagaagagagtgatcggccaggaccacgacttcagcgagagcagcgaggaggaggcccccgccgaggccagcagcggcgccctgagaagcaagcacgcccccatgaccagcagaagcaccagcacctggagaatccccagcagaaagagaagattcagcagcagcgacttcagcgacctgagcaacggcgaggagctgcaggagacctgcagcagcagcctgagaagaggcagcggcaaggaggactag

SEQ ID NO: 100401 - DNA, 1338 bp, Artificial Sequence
  Description of Artificial Sequence: Synthetic coding sequence
atgatgttcaccgaggaccagggcgtggacgacagactgctgtacgacatcgtgttcaagcacttcaagagaaacaaggtggagatcagcaacgccatcaagaagaccttccccttcctggagggcctgagagacagagacctgatcaccaacaagatgttcgaggacagccaggacagctgcagaaacctggtgcccgtgcagagagtggtgtacaacgtgctgagcgagctggagaagaccttcaacctgcccgtgctggaggccctgttcagcgacgtgaacatgcaggagtaccccgacctgatccacatctacaagggcttcgagaacgtgatccacgacaagctgcccctgcaggagagcgaggaggaggagagagaggagagaagcggcctgcagctgagcctggagcagggcaccggcgagaacagcttcagaagcctgacctggccccccagcggcagccccagccacgccggcaccaccccccccgagaacggcctgagcgagcacccctgcgagaccgagcagatcaacgccaagagaaaggacaccaccagcgacaaggacgacagcctgggcagccagcagaccaacgagcagtgcgcccagaaggccgagcccaccgagagctgcgagcagatcgccgtgcaggtgaacaacggcgacgccggcagagagatgccctgccccctgccctgcgacgaggagagccccgaggccgagctgcacaaccacggcatccagatcaacagctgcagcgtgagactggtggacatcaagaaggagaagcccttcagcaacagcaaggtggagtgccaggcccaggccagaacccaccacaaccaggccagcgacatcatcgtgatcagcagcgaggacagcgagggcagcaccgacgtggacgagcccctggaggtgttcatcagcgcccccagaagcgagcccgtgatcaacaacgacaaccccctggagagcaacgacgagaaggagggccaggaggccacctgcagcagaccccagatcgtgcccgagcccatggacttcagaaagctgagcaccttcagagagagcttcaagaagagagtgatcggccaggaccacgacttcagcgagagcagcgaggaggaggcccccgccgaggccagcagcggcgccctgagaagcaagcacggcgagaaggcccccatgaccagcagaagcaccagcacctggagaatccccagcagaaagagaagattcagcagcagcgacttcagcgacctgagcaacggcgaggagctgcaggagacctgcagcagcagcctgagaagaggcagcggcaaggaggactag

SEQ ID NO: 100402 - DNA, 2142 bp, Artificial Sequence
  Description of Artificial Sequence: Synthetic coding sequence
atgttcaccatgaccagagccatggaggaggccctgttccagcacttcatgcaccagaagctgggcatcgcctacgccatccacaagcccttccccttcttcgagggcctgctggacaacagcatcatcaccaagagaatgtacatggagagcctggaggcctgcagaaacctgatccccgtgagcagagtggtgcacaacatcctgacccagctggagagaaccttcaacctgagcctgctggtgaccctgttcagccagatcaacctgagagagtaccccaacctggtgaccatctacagaagcttcaagagagtgggcgccagctacgagtggcagagcagagacacccccatcctgctggaggcccccaccggcctggccgagggcagcagcctgcacacccccctggccctgccccccccccagcccccccagcccagctgcagcccctgcgcccccagagtgagcgagcccggcaccagcagccagcagagcgacgagatcctgagcgagagccccagccccagcgaccccgtgctgcccctgcccgccctgatccaggagggcagaagcaccagcgtgaccaacgacaagctgaccagcaagatgaacgccgaggaggacagcgaggagatgcccagcctgctgaccagcaccgtgcaggtggccagcgacaacctgatcccccagatcagagacaaggaggacccccaggagatgccccacagccccctgggcagcatgcccgagatcagagacaacagccccgagcccaacgaccccgaggagccccaggaggtgagcagcacccccagcgacaagaagggcaagaagagaaagagatgcatctggagcacccccaagagaagacacaagaagaagagcctgcccggcggcaccgccagcagcagacacggcatccagaagaagctgaagagagtggaccaggtgccccagaagaaggacgacagcacctgcaacagcaccgtggagaccagagcccagaaggccagaaccgagtgcgccagaaagagcagaagcgaggagatcatcgacggcaccagcgagatgaacgagggcaagagaagccagaagacccccagcacccccagaagagtgacccagggcgccgccagccccggccacggcatccaggagaagctgcaggtggtggacaaggtgacccagagaaaggacgacagcacctggaacagcgaggtgatgatgagagtgcagaaggccagaaccaagtgcgccagaaagagcagactgaaggagaagaagaaggagaaggacatctgcagcagcagcaagagaagattccagaagaacatccacagaagaggcaagcccaagagcgacaccgtggacttccactgcagcaagctgcccgtgacctgcggcgaggccaagggcatcctgtacaagaagaagatgaagcacggcagcagcgtgaagtgcatcagaaacgaggacggcacctggctgacccccaacgagttcgaggtggagggcaagggcagaaacgccaagaactggaagagaaacatcagatgcgagggcatgaccctgggcgagctgctgaagagaaagaacagcgacgagtgcgaggtgtgctgccagggcggccagctgctgtgctgcggcacctgccccagagtgttccacgaggactgccacatcccccccgtggaggccaagagaatgctgtggagctgcaccttctgcagaatgaagagaagcagcggcagccagcagtgccaccacgtgagcaagaccctggagagacagatgcagccccaggaccagctgaagtgcgagttcctgctgctgaaggcctactgccacccccagagcagcttcttcaccggcatccccttcaacatcagagactacggcgagcccttccaggaggccatgtggctggacctggtgaaggagagactgatcaccgagatgtacaccgtggcctggttcgtgagagacatgagactgatgttcagaaaccacaagaccttctacaaggccagcgacttcggccaggtgggcctggacctggaggccgagttcgagaaggacctgaaggacgtgctgggcttccacgaggccaacgacggcggcttctggaccctgccctag

SEQ ID NO: 100403 - DNA, 1650 bp, Artificial Sequence
  Description of Artificial Sequence: Synthetic coding sequence
atgttcaccatgaccagagccatggaggaggccctgttccagcacttcatgcaccagaagctgggcatcgcctacgccatccacaagcccttccccttcttcgagggcctgctggacaacagcatcatcaccaagagaatgtacatggagagcctggaggcctgcagaaacctgatccccgtgagcagagtggtgcacaacatcctgacccagctggagagaaccttcaacctgagcctgctggtgaccctgttcagccagatcaacctgagagagtaccccaacctggtgaccatctacagaagcttcaagagagtgggcgccagctacgagtggcagagcagagacacccccatcctgctggaggcccccaccggcctggccgagggcagcagcctgcacacccccctggccctgccccccccccagcccccccagcccagctgcagcccctgcgcccccagagtgagcgagcccggcaccagcagccagcagagcgacgagatcctgagcgagagccccagccccagcgaccccgtgctgcccctgcccgccctgatccaggagggcagaagcaccagcgtgaccaacgacaagctgaccagcaagatgaacgccgaggaggacagcgaggagatgcccagcctgctgaccagcaccgtgcaggtggccagcgacaacctgatcccccagatcagagacaaggaggacccccaggagatgccccacagccccctgggcagcatgcccgagatcagagacaacagccccgagcccaacgaccccgaggagccccaggaggtgagcagcacccccagcgacaagaagggcaagaagagaaagagatgcatctggagcacccccaagagaagacacaagaagaagagcctgcccggcggcaccgccagcagcagacacggcatccagaagaagctgaagagagtggaccaggtgccccagaagaaggacgacagcacctgcaacagcaccgtggagaccagagcccagaaggccagaaccgagtgcgccagaaagagcagaagcgaggagatcatcgacggcaccagcgagatgaacgagggcaagagaagccagaagacccccagcacccccagaagagtgacccagggcgccgccagccccggccacggcatccaggagaagctgcaggtggtggacaaggtgacccagagaaaggacgacagcacctggaacagcgaggtgatgatgagagtgcagaaggccagaaccaagtgcgccagaaagagcagactgaaggagaagaagaaggagaaggacatctgcagcagcagcaagagaagattccagaagaacatccacagaagaggcaagcccaagagcgacaccgtggacttccactgcagcaagctgcccgtgacctgcggcgaggccaagggcatcctgtacaagaagaagatgaagcacggcagcagcgtgaagtgcatcagaaacgaggacggcacctggctgacccccaacgagttcgaggtggagggcaagggcagaaacgccaagaactggaagagaaacatcagatgcgagggcatgaccctgggcgagctgctgaagagcggcctgctgctgtgcccccccagaatcaacctgaagagagagctgaacagcaagtag

SEQ ID NO: 100404 - DNA, 756 bp, Artificial Sequence
  Description of Artificial Sequence: Synthetic coding sequence
atgcccgagatcagagacaacagccccgagcccaacgaccccgaggagccccaggaggtgagcagcacccccagcgacaagaagggcaagaagagaaagagatgcatctggagcacccccaagagaagacacaagaagaagagcctgcccggcgagatcatcgacggcaccagcgagatgaacgagggcaagagaagccagaagacccccagcacccccagaagagtgacccagggcgccgccagccccggccacggcatccaggagaagctgcaggtggtggacaaggtgacccagagaaaggacgacagcacctggaacagcgaggtgatgatgagagtgcagaaggccagaaccaagtgcgccagaaagagcagactgaaggagaagaagaaggagaaggacatctgcagcagcagcaagagaagattccagaagaacatccacagaagaggcaagcccaagagcgacaccgtggacttccactgcagcaagctgcccgtgacctgcggcgaggccaagggcatcctgtacaagaagaagatgaagcacggcagcagcgtgaagtgcatcagaaacgaggacggcacctggctgacccccaacgagttcgaggtggagggcaagggcagaaacgccaagaactggaagagaaacatcagatgcgagggcatgaccctgggcgagctgctgaagagcggcctgctgctgtgcccccccagaatcaacctgaagagagagctgaacagcaagtag

SEQ ID NO: 100405 - DNA, 2070 bp, Artificial Sequence
  Description of Artificial Sequence: Synthetic coding sequence
atgttcaccatgaccagagccatggaggaggccctgttccagcacttcatgcaccagaagctgggcatcgcctacgccatccacaagcccttccccttcttcgagggcctgctggacaacagcatcatcaccaagagaatgtacatggagagcctggaggcctgcagaaacctgatccccgtgagcagagtggtgcacaacatcctgacccagctggagagaaccttcaacctgagcctgctggtgaccctgttcagccagatcaacctgagagagtaccccaacctggtgaccatctacagaagcttcaagagagtgggcgccagctacgagtggcagagcagagacacccccatcctgctggaggcccccaccggcctggccgagggcagcagcctgcacacccccctggccctgccccccccccagcccccccagcccagctgcagcccctgcgcccccagagtgagcgagcccggcaccagcagccagcagagcgacgagatcctgagcgagagccccagccccagcgaccccgtgctgcccctgcccgccctgatccaggagggcagaagcaccagcgtgaccaacgacaagctgaccagcaagatgaacgccgaggaggacagcgaggagatgcccagcctgctgaccagcaccgtgcaggtggccagcgacaacctgatcccccagatcagagacaaggaggacccccaggagatgccccacagccccctgggcagcatgcccgagatcagagacaacagccccgagcccaacgaccccgaggagccccaggaggtgagcagcacccccagcgacaagaagggcaagaagagaaagagatgcatctggagcacccccaagagaagacacaagaagaagagcctgcccggcggcaccgccagcagcagacacggcatccagaagaagctgaagagagtggaccaggtgccccagaagaaggacgacagcacctgcaacagcaccgtggagaccagagcccagaaggccagaaccgagtgcgccagaaagagcagaagcgaggagatcatcgacggcaccagcgagatgaacgagggcaagagaagccagaagacccccagcacccccagaagagtgacccagggcgccgccagccccggccacggcatccaggagaagctgcaggtggtggacaaggtgacccagagaaaggacgacagcacctggaacagcgaggtgatgatgagagtgcagaaggccagaaccaagtgcgccagaaagagcagactgaaggagaagaagaaggagaaggacatctgcagcagcagcaagagaagattccagaagaacatccacagaagaggcaagcccaagagcgacaccgtggacttccactgcagcaagctgcccgtgacctgcggcgaggccaagggcatcctgtacaagaagaagatgaagcacggcagcagcgtgaagtgcatcagaaacgaggacggcacctggctgacccccaacgagttcgaggtggagggcaagggcagaaacgccaagaactggaagagaaacatcagatgcgagggcatgaccctgggcgagctgctgaagagaaagaacagcgacgagtgcgaggtgtgctgccagggcggccagctgctgtgctgcggcacctgccccagagtgttccacgaggactgccacatcccccccgtggaggccaagagaatgctgtggagctgcaccttctgcagaatgaagagaagcagcggcagccagcagtgccaccacgtgagcaagaccctggagagacagatgcagccccaggaccagctgatcagagactacggcgagcccttccaggaggccatgtggctggacctggtgaaggagagactgatcaccgagatgtacaccgtggcctggttcgtgagagacatgagactgatgttcagaaaccacaagaccttctacaaggccagcgacttcggccaggtgggcctggacctggaggccgagttcgagaaggacctgaaggacgtgctgggcttccacgaggccaacgacggcggcttctggaccctgccctag

SEQ ID NO: 100406 - DNA, 1644 bp, Artificial Sequence
  Description of Artificial Sequence: Synthetic coding sequence
atgttcaccatgaccagagccatggaggaggccctgttccagcacttcatgcaccagaagctgggcatcgcctacgccatccacaagcccttccccttcttcgagggcctgctggacaacagcatcatcaccaagagaatgtacatggagagcctggaggcctgcagaaacctgatccccgtgagcagagtggtgcacaacatcctgacccagctggagagaaccttcaacctgagcctgctggtgaccctgttcagccagatcaacctgagagagtaccccaacctggtgaccatctacagaagcttcaagagagtgggcgccagctacgagtggcagagcagagacacccccatcctgctggaggcccccaccggcctggccgagggcagcagcctgcacacccccctggccctgccccccccccagcccccccagcccagctgcagcccctgcgcccccagagtgagcgagcccggcaccagcagccagcagagcgacgagatcctgagcgagagccccagccccagcgaccccgtgctgcccctgcccgccctgatccaggagggcagaagcaccagcgtgaccaacgacaagctgaccagcaagatgaacgccgaggaggacagcgaggagatgcccagcctgctgaccagcaccgtgcaggtggccagcgacaacctgatcccccagatcagagacaaggaggacccccaggagatgccccacagccccctgggcagcatgcccgagatcagagacaacagccccgagcccaacgaccccgaggagccccaggaggtgagcagcacccccagcgacaagaagggcaagaagagaaagagatgcatctggagcacccccaagagaagacacaagaagaagagcctgcccggcgccagcagcagacacggcatccagaagaagctgaagagagtggaccaggtgccccagaagaaggacgacagcacctgcaacagcaccgtggagaccagagcccagaaggccagaaccgagtgcgccagaaagagcagaagcgaggagatcatcgacggcaccagcgagatgaacgagggcaagagaagccagaagacccccagcacccccagaagagtgacccagggcgccgccagccccggccacggcatccaggagaagctgcaggtggtggacaaggtgacccagagaaaggacgacagcacctggaacagcgaggtgatgatgagagtgcagaaggccagaaccaagtgcgccagaaagagcagactgaaggagaagaagaaggagaaggacatctgcagcagcagcaagagaagattccagaagaacatccacagaagaggcaagcccaagagcgacaccgtggacttccactgcagcaagctgcccgtgacctgcggcgaggccaagggcatcctgtacaagaagaagatgaagcacggcagcagcgtgaagtgcatcagaaacgaggacggcacctggctgacccccaacgagttcgaggtggagggcaagggcagaaacgccaagaactggaagagaaacatcagatgcgagggcatgaccctgggcgagctgctgaagagcggcctgctgctgtgcccccccagaatcaacctgaagagagagctgaacagcaagtag

SEQ ID NO: 100407 - DNA, 666 bp, Artificial Sequence
  Description of Artificial Sequence: Synthetic coding sequence
atgttcaccatgaccagagccatggaggaggccctgttccagcacttcatgcaccagaagctgggcatcgcctacgccatccacaagcccttccccttcttcgagggcctgctggacaacagcatcatcaccaagagaatgtacatggagagcctggaggcctgcagaaacctgatccccgtgagcagagtggtgcacaacatcctgacccagctggagagaaccttcaacctgagcctgctggtgaccctgttcagccagatcaacctgagagagtaccccaacctggtgaccatctacagaagcttcaagagagtgggcgccagctacgagtggcagagcagagacacccccatcctgctggaggcccccaccggcctggccgagggcagcagcctgcacacccccctggccctgccccccccccagcccccccagcccagctgcagcccctgcgcccccagagtgagcgagcccggcaccagcagccagcagagcgacgagatcctgagcgagagccccagccccagcgaccccgtgctgcccctgcccgccctgatccaggagggcagaagcaccagcgtgaccaacgacaagctgaccagcaagatgaacgccgaggaggacagcgaggagatgcccagcctgctgaccagcaccgtgtag

SEQ ID NO: 100408 - DNA, 306 bp, Artificial Sequence
  Description of Artificial Sequence: Synthetic coding sequence
atgttcaccatgaccagagccatggaggaggccctgttccagcacttcatgcaccagaagctgggcatcgcctacgccatccacaagcccttccccttcttcgagggcctgctggacaacagcatcatcaccaagagaatgtacatggagagcctggaggcctgcagaaacctgatccccgtgagcagagtggtgcacaacatcctgacccagctggagagaaccttcaacctgagcctgctggtgaccctgttcagccagatcaacctgagagagtaccccaacctggtgaccatctacagatag

SEQ ID NO: 100409 - DNA, 1668 bp, Artificial Sequence
  Description of Artificial Sequence: Synthetic coding sequence
atgggcagaggcttcagaatgttcaccatgaccagagccatggaggaggccctgttccagcacttcatgcaccagaagctgggcatcgcctacgccatccacaagcccttccccttcttcgagggcctgctggacaacagcatcatcaccaagagaatgtacatggagagcctggaggcctgcagaaacctgatccccgtgagcagagtggtgcacaacatcctgacccagctggagagaaccttcaacctgagcctgctggtgaccctgttcagccagatcaacctgagagagtaccccaacctggtgaccatctacagaagcttcaagagagtgggcgccagctacgagtggcagagcagagacacccccatcctgctggaggcccccaccggcctggccgagggcagcagcctgcacacccccctggccctgccccccccccagcccccccagcccagctgcagcccctgcgcccccagagtgagcgagcccggcaccagcagccagcagagcgacgagatcctgagcgagagccccagccccagcgaccccgtgctgcccctgcccgccctgatccaggagggcagaagcaccagcgtgaccaacgacaagctgaccagcaagatgaacgccgaggaggacagcgaggagatgcccagcctgctgaccagcaccgtgcaggtggccagcgacaacctgatcccccagatcagagacaaggaggacccccaggagatgccccacagccccctgggcagcatgcccgagatcagagacaacagccccgagcccaacgaccccgaggagccccaggaggtgagcagcacccccagcgacaagaagggcaagaagagaaagagatgcatctggagcacccccaagagaagacacaagaagaagagcctgcccggcggcaccgccagcagcagacacggcatccagaagaagctgaagagagtggaccaggtgccccagaagaaggacgacagcacctgcaacagcaccgtggagaccagagcccagaaggccagaaccgagtgcgccagaaagagcagaagcgaggagatcatcgacggcaccagcgagatgaacgagggcaagagaagccagaagacccccagcacccccagaagagtgacccagggcgccgccagccccggccacggcatccaggagaagctgcaggtggtggacaaggtgacccagagaaaggacgacagcacctggaacagcgaggtgatgatgagagtgcagaaggccagaaccaagtgcgccagaaagagcagactgaaggagaagaagaaggagaaggacatctgcagcagcagcaagagaagattccagaagaacatccacagaagaggcaagcccaagagcgacaccgtggacttccactgcagcaagctgcccgtgacctgcggcgaggccaagggcatcctgtacaagaagaagatgaagcacggcagcagcgtgaagtgcatcagaaacgaggacggcacctggctgacccccaacgagttcgaggtggagggcaagggcagaaacgccaagaactggaagagaaacatcagatgcgagggcatgaccctgggcgagctgctgaagagcggcctgctgctgtgcccccccagaatcaacctgaagagagagctgaacagcaagtag

SEQ ID NO: 100410 - DNA, 2346 bp, Artificial Sequence
  Description of Artificial Sequence: Synthetic coding sequence
atgaccgcccccgagaagcccgtgaagcaggaggagatggccgccctggacgtggacagcggcggcggcggcggcggcggcggcggccacggcgagtacctgcagcagcagcagcagcacggcaacggcgccgtggccgccgccgccgccgcccaggacacccagcccagccccctggccctgctggccgccacctgcagcaagatcggcccccccagccccggcgacgacgaggaggaggccgccgccgccgccggcgcccccgccgccgccggcgccaccggcgacctggccagcgcccagctgggcggcgcccccaacagatgggaggtgctgagcgccacccccaccaccatcaaggacgaggccggcaacctggtgcagatccccagcgccgccaccagcagcggccagtacgtgctgcccctgcagaacctgcagaaccagcagatcttcagcgtggcccccggcagcgacagcagcaacggcaccgtgagcagcgtgcagtaccaggtgatcccccagatccagagcgccgacggccagcaggtgcagatcggcttcaccggcagcagcgacaacggcggcatcaaccaggagagcagccagatccagatcatccccggcagcaaccagaccctgctggccagcggcacccccagcgccaacatccagaacctgatcccccagaccggccaggtgcaggtgcagggcgtggccatcggcggcagcagcttccccggccagacccaggtggtggccaacgtgcccctgggcctgcccggcaacatcaccttcgtgcccatcaacagcgtggacctggacagcctgggcctgagcggcagcagccagaccatgaccgccggcatcaacgccgacggccacctgatcaacaccggccaggccatggacagcagcgacaacagcgagagaaccggcgagagagtgagccccgacatcaacgagaccaacaccgacaccgacctgttcgtgcccaccagcagcagcagccagctgcccgtgaccatcgacagcaccggcatcctgcagcagaacaccaacagcctgaccaccagcagcggccaggtgcacagcagcgacctgcagggcaactacatccagagccccgtgagcgaggagacccaggcccagaacatccaggtgagcaccgcccagcccgtggtgcagcacctgcagctgcaggagagccagcagcccaccagccaggcccagatcgtgcagggcatcaccccccagaccatccacggcgtgcaggccagcggccagaacatcagccagcaggccctgcagaacctgcagctgcagctgaaccccggcaccttcctgatccaggcccagaccgtgacccccagcggccaggtgacctggcagaccttccaggtgcagggcgtgcagaacctgcagaacctgcagatccagaacaccgccgcccagcagatcaccctgacccccgtgcagaccctgaccctgggccaggtggccgccggcggcgccttcaccagcacccccgtgagcctgagcaccggccagctgcccaacctgcagaccgtgaccgtgaacagcatcgacagcgccggcatccagctgcaccccggcgagaacgccgacagccccgccgacatcagaatcaaggaggaggagcccgaccccgaggagtggcagctgagcggcgacagcaccctgaacaccaacgacctgacccacctgagagtgcaggtggtggacgaggagggcgaccagcagcaccaggagggcaagagactgagaagagtggcctgcacctgccccaactgcaaggagggcggcggcagaggcaccaacctgggcaagaagaagcagcacatctgccacatccccggctgcggcaaggtgtacggcaagaccagccacctgagagcccacctgagatggcacagcggcgagagacccttcgtgtgcaactggatgtactgcggcaagagattcaccagaagcgacgagctgcagagacacagaagaacccacaccggcgagaagaagttcgtgtgccccgagtgcagcaagagattcatgagaagcgaccacctggccaagcacatcaagacccaccagaacaagaagggcatccacagcagcagcaccgtgctggccagcgtggaggccgccagagacgacaccctgatcaccgccggcggcaccaccctgatcctggccaacatccagcagggcagcgtgagcggcatcggcaccgtgaacaccagcgccaccagcaaccaggacatcctgaccaacaccgagatccccctgcagctggtgaccgtgagcggcaacgagaccatggagtag

SEQ ID NO: 100411 - DNA, 2217 bp, Artificial Sequence
  Description of Artificial Sequence: Synthetic coding sequence
tgacccgagaagcccgtgaagcaggaggagatggccgccctggacgtggacagcggcggcggcggcggcggcggcggcggccacggcgagtacctgcagcagcagcagcagcacggcaacggcgccgtggccgccgccgccgccgcccagaccggcgacctggccagcgcccagctgggcggcgcccccaacagatgggaggtgctgagcgccacccccaccaccatcaaggacgaggccggcaacctggtgcagatccccagcgccgccaccagcagcggccagtacgtgctgcccctgcagaacctgcagaaccagcagatcttcagcgtggcccccggcagcgacagcagcaacggcaccgtgagcagcgtgcagtaccaggtgatcccccagatccagagcgccgacggccagcaggtgcagatcggcttcaccggcagcagcgacaacggcggcatcaaccaggagagcagccagatccagatcatccccggcagcaaccagaccctgctggccagcggcacccccagcgccaacatccagaacctgatcccccagaccggccaggtgcaggtgcagggcgtggccatcggcggcagcagcttccccggccagacccaggtggtggccaacgtgcccctgggcctgcccggcaacatcaccttcgtgcccatcaacagcgtggacctggacagcctgggcctgagcggcagcagccagaccatgaccgccggcatcaacgccgacggccacctgatcaacaccggccaggccatggacagcagcgacaacagcgagagaaccggcgagagagtgagccccgacatcaacgagaccaacaccgacaccgacctgttcgtgcccaccagcagcagcagccagctgcccgtgaccatcgacagcaccggcatcctgcagcagaacaccaacagcctgaccaccagcagcggccaggtgcacagcagcgacctgcagggcaactacatccagagccccgtgagcgaggagacccaggcccagaacatccaggtgagcaccgcccagcccgtggtgcagcacctgcagctgcaggagagccagcagcccaccagccaggcccagatcgtgcagggcatcaccccccagaccatccacggcgtgcaggccagcggccagaacatcagccagcaggccctgcagaacctgcagctgcagctgaaccccggcaccttcctgatccaggcccagaccgtgacccccagcggccaggtgacctggcagaccttccaggtgcagggcgtgcagaacctgcagaacctgcagatccagaacaccgccgcccagcagatcaccctgacccccgtgcagaccctgaccctgggccaggtggccgccggcggcgccttcaccagcacccccgtgagcctgagcaccggccagctgcccaacctgcagaccgtgaccgtgaacagcatcgacagcgccggcatccagctgcaccccggcgagaacgccgacagccccgccgacatcagaatcaaggaggaggagcccgaccccgaggagtggcagctgagcggcgacagcaccctgaacaccaacgacctgacccacctgagagtgcaggtggtggacgaggagggcgaccagcagcaccaggagggcaagagactgagaagagtggcctgcacctgccccaactgcaaggagggcggcggcagaggcaccaacctgggcaagaagaagcagcacatctgccacatccccggctgcggcaaggtgtacggcaagaccagccacctgagagcccacctgagatggcacagcggcgagagacccttcgtgtgcaactggatgtactgcggcaagagattcaccagaagcgacgagctgcagagacacagaagaacccacaccggcgagaagaagttcgtgtgccccgagtgcagcaagagattcatgagaagcgaccacctggccaagcacatcaagacccaccagaacaagaagggcatccacagcagcagcaccgtgctggccagcgtggaggccgccagagacgacaccctgatcaccgccggcggcaccaccctgatcctggccaacatccagcagggcagcgtgagcggcatcggcaccgtgaacaccagcgccaccagcaaccaggacatcctgaccaacaccgagatccccctgcagctggtgaccgtgagcggcaacgagaccatggagtag

SEQ ID NO: 100412 - DNA, 2142 bp, Artificial Sequence
  Description of Artificial Sequence: Synthetic coding sequence
atcggcccccccagccccggcgacgacgaggaggaggccgccgccgccgccggcgcccccgccgccgccggcgccaccggcgacctggccagcgcccagctgggcggcgcccccaacagatgggaggtgctgagcgccacccccaccaccatcaaggacgaggccggcaacctggtgcagatccccagcgccgccaccagcagcggccagtacgtgctgcccctgcagaacctgcagaaccagcagatcttcagcgtggcccccggcagcgacagcagcaacggcaccgtgagcagcgtgcagtaccaggtgatcccccagatccagagcgccgacggccagcaggtgcagatcggcttcaccggcagcagcgacaacggcggcatcaaccaggagagcagccagatccagatcatccccggcagcaaccagaccctgctggccagcggcacccccagcgccaacatccagaacctgatcccccagaccggccaggtgcaggtgcagggcgtggccatcggcggcagcagcttccccggccagacccaggtggtggccaacgtgcccctgggcctgcccggcaacatcaccttcgtgcccatcaacagcgtggacctggacagcctgggcctgagcggcagcagccagaccatgaccgccggcatcaacgccgacggccacctgatcaacaccggccaggccatggacagcagcgacaacagcgagagaaccggcgagagagtgagccccgacatcaacgagaccaacaccgacaccgacctgttcgtgcccaccagcagcagcagccagctgcccgtgaccatcgacagcaccggcatcctgcagcagaacaccaacagcctgaccaccagcagcggccaggtgcacagcagcgacctgcagggcaactacatccagagccccgtgagcgaggagacccaggcccagaacatccaggtgagcaccgcccagcccgtggtgcagcacctgcagctgcaggagagccagcagcccaccagccaggcccagatcgtgcagggcatcaccccccagaccatccacggcgtgcaggccagcggccagaacatcagccagcaggccctgcagaacctgcagctgcagctgaaccccggcaccttcctgatccaggcccagaccgtgacccccagcggccaggtgacctggcagaccttccaggtgcagggcgtgcagaacctgcagaacctgcagatccagaacaccgccgcccagcagatcaccctgacccccgtgcagaccctgaccctgggccaggtggccgccggcggcgccttcaccagcacccccgtgagcctgagcaccggccagctgcccaacctgcagaccgtgaccgtgaacagcatcgacagcgccggcatccagctgcaccccggcgagaacgccgacagccccgccgacatcagaatcaaggaggaggagcccgaccccgaggagtggcagctgagcggcgacagcaccctgaacaccaacgacctgacccacctgagagtgcaggtggtggacgaggagggcgaccagcagcaccaggagggcaagagactgagaagagtggcctgcacctgccccaactgcaaggagggcggcggcagaggcaccaacctgggcaagaagaagcagcacatctgccacatccccggctgcggcaaggtgtacggcaagaccagccacctgagagcccacctgagatggcacagcggcgagagacccttcgtgtgcaactggatgtactgcggcaagagattcaccagaagcgacgagctgcagagacacagaagaacccacaccggcgagaagaagttcgtgtgccccgagtgcagcaagagattcatgagaagcgaccacctggccaagcacatcaagacccaccagaacaagaagggcatccacagcagcagcaccgtgctggccagcgtggaggccgccagagacgacaccctgatcaccgccggcggcaccaccctgatcctggccaacatccagcagggcagcgtgagcggcatcggcaccgtgaacaccagcgccaccagcaaccaggacatcctgaccaacaccgagatccccctgcagctggtgaccgtgagcggcaacgagaccatggagtag

SEQ ID NO: 100413 - DNA, 2187 bp, Artificial Sequence
  Description of Artificial Sequence: Synthetic coding sequence
atggccgccctggacgtggacagcggcggcggcggcggcggcggcggcggccacggcgagtacctgcagcagcagcagcagcacggcaacggcgccgtggccgccgccgccgccgcccagaccggcgacctggccagcgcccagctgggcggcgcccccaacagatgggaggtgctgagcgccacccccaccaccatcaaggacgaggccggcaacctggtgcagatccccagcgccgccaccagcagcggccagtacgtgctgcccctgcagaacctgcagaaccagcagatcttcagcgtggcccccggcagcgacagcagcaacggcaccgtgagcagcgtgcagtaccaggtgatcccccagatccagagcgccgacggccagcaggtgcagatcggcttcaccggcagcagcgacaacggcggcatcaaccaggagagcagccagatccagatcatccccggcagcaaccagaccctgctggccagcggcacccccagcgccaacatccagaacctgatcccccagaccggccaggtgcaggtgcagggcgtggccatcggcggcagcagcttccccggccagacccaggtggtggccaacgtgcccctgggcctgcccggcaacatcaccttcgtgcccatcaacagcgtggacctggacagcctgggcctgagcggcagcagccagaccatgaccgccggcatcaacgccgacggccacctgatcaacaccggccaggccatggacagcagcgacaacagcgagagaaccggcgagagagtgagccccgacatcaacgagaccaacaccgacaccgacctgttcgtgcccaccagcagcagcagccagctgcccgtgaccatcgacagcaccggcatcctgcagcagaacaccaacagcctgaccaccagcagcggccaggtgcacagcagcgacctgcagggcaactacatccagagccccgtgagcgaggagacccaggcccagaacatccaggtgagcaccgcccagcccgtggtgcagcacctgcagctgcaggagagccagcagcccaccagccaggcccagatcgtgcagggcatcaccccccagaccatccacggcgtgcaggccagcggccagaacatcagccagcaggccctgcagaacctgcagctgcagctgaaccccggcaccttcctgatccaggcccagaccgtgacccccagcggccaggtgacctggcagaccttccaggtgcagggcgtgcagaacctgcagaacctgcagatccagaacaccgccgcccagcagatcaccctgacccccgtgcagaccctgaccctgggccaggtggccgccggcggcgccttcaccagcacccccgtgagcctgagcaccggccagctgcccaacctgcagaccgtgaccgtgaacagcatcgacagcgccggcatccagctgcaccccggcgagaacgccgacagccccgccgacatcagaatcaaggaggaggagcccgaccccgaggagtggcagctgagcggcgacagcaccctgaacaccaacgacctgacccacctgagagtgcaggtggtggacgaggagggcgaccagcagcaccaggagggcaagagactgagaagagtggcctgcacctgccccaactgcaaggagggcggcggcagaggcaccaacctgggcaagaagaagcagcacatctgccacatccccggctgcggcaaggtgtacggcaagaccagccacctgagagcccacctgagatggcacagcggcgagagacccttcgtgtgcaactggatgtactgcggcaagagattcaccagaagcgacgagctgcagagacacagaagaacccacaccggcgagaagaagttcgtgtgccccgagtgcagcaagagattcatgagaagcgaccacctggccaagcacatcaagacccaccagaacaagaagggcatccacagcagcagcaccgtgctggccagcgtggaggccgccagagacgacaccctgatcaccgccggcggcaccaccctgatcctggccaacatccagcagggcagcgtgagcggcatcggcaccgtgaacaccagcgccaccagcaaccaggacatcctgaccaacaccgagatccccctgcagctggtgaccgtgagcggcaacgagaccatggagtag

SEQ ID NO: 100414 - DNA, 1545 bp, Artificial Sequence
  Description of Artificial Sequence: Synthetic coding sequence
atggtgtgggaggtgaagaccaaccagatgcccaacgccgtgcagaagctgctgctggtgatggacaagagagccagcggcatgaacgacagcctggagctgctgcagtgcaacgagaacctgcccagcagccccggctacaacagctgcgacgagcacatggagctggacgacctgcccgagctgcaggccgtgcagagcgaccccacccagagcggcatgtaccagctgagcagcgacgtgagccaccaggagtaccccagaagcagctggaaccagaacaccagcgacatccccgagaccacctacagagagaacgaggtggactggctgaccgagctggccaacatcgccaccagcccccagagccccctgatgcagtgcagcttctacaacagaagcagccccgtgcacatcatcgccaccagcaagagcctgcacagctacgccagacccccccccgtgagcagcagcagcaagagcgagcccgccttcccccaccaccactggaaggaggagacccccgtgagacacgagagagccaacagcgagagcgagagcggcatcttctgcatgagcagcctgagcgacgacgacgacctgggctggtgcaacagctggcccagcaccgtgtggcactgcttcctgaagggcaccagactgtgcttccacaagggcagcaacaaggagtggcaggacgtggaggacttcgccagagccgagggctgcgacaacgaggaggacctgcagatgggcatccacaagggctacggcagcgacggcctgaagctgctgagccacgaggagagcgtgagcttcggcgagagcgtgctgaagctgaccttcgaccccggcaccgtggaggacggcctgctgaccgtggagtgcaagctggaccaccccttctacgtgaagaacaagggctggagcagcttctaccccagcctgaccgtggtgcagcacggcatcccctgctgcgaggtgcacatcggcgacgtgtgcctgccccccggccaccccgacgccatcaacttcgacgacagcggcgtgttcgacaccttcaagagctacgacttcacccccatggacagcagcgccgtgtacgtgctgagcagcatggccagacagagaagagccagcctgagctgcggcggccccggcggccaggacttcgccagaagcggcttcagcaagaactgcggcagccccggcagcagccagctgagcagcaacagcctgtacgccaaggccgtgaagaaccacagcagcggcaccgtgagcgccaccagccccaacaagtgcaagagacccatgaacgccttcatgctgttcgccaagaagtacagagtggagtacacccagatgtaccccggcaaggacaacagagccatcagcgtgatcctgggcgacagatggaagaagatgaagaacgaggagagaagaatgtacaccctggaggccaaggccctggccgaggagcagaagagactgaaccccgactgctggaagagaaagagaaccaacagcggcagccagcagcactag

SEQ ID NO: 100415 - DNA, 432 bp, Artificial Sequence
  Description of Artificial Sequence: Synthetic coding sequence
atgagcgaccagaagaaggaggaggaggaggaggccgccgccgccgccgccatggccaccgagggcggcaagaccagcgagcccgagaacaacaacaagaagcccaagaccagcggcagccaggacagccagcccagccccctggccctgctggccgccacctgcagcaagatcggcacccccggcgagaaccaggccaccggccagcagcagagaaacctgctggagaccctgggcaacctgctgccccccctgctgctgctgcagaagagaatcaccttcctgaaccagcccctggtgagactggtgctgcccgccgtgatcaccggcgtgcacctgctgcagaagctgaaccaggtgatcctgccccccctggtgaacttcaagagctacaagtacaagatccaggtggtggtgtacagcaccaagtag

SEQ ID NO: 100416 - DNA, 1296 bp, Artificial Sequence
  Description of Artificial Sequence: Synthetic coding sequence
atggccagcagcctgctggaggaggaggtgcactacggcagcagccccctggccatgctgaccgccgcctgcagcaagttcggcggcagcagccccctgagagacagcaccaccctgggcaaggccggcaccaagaagccctacagcgtgggcagcgacctgagcgccagcaagaccatgggcgacgcctaccccgcccccttcaccagcaccaacggcctgctgagccccgccggcagcccccccgcccccaccagcggctacgccaacgactacccccccttcagccacagcttccccggccccaccggcacccaggaccccggcctgctggtgcccaagggccacagcagcagcgactgcctgcccagcgtgtacaccagcctggacatgacccacccctacggcagctggtacaaggccggcatccacgccggcatcagccccggccccggcaacacccccaccccctggtgggacatgcaccccggcggcaactggctgggcggcggccagggccagggcgacggcctgcagggcaccctgcccaccggccccgcccagccccccctgaacccccagctgcccacctaccccagcgacttcgcccccctgaaccccgccccctaccccgccccccacctgctgcagcccggcccccagcacgtgctgccccaggacgtgtacaagcccaaggccgtgggcaacagcggccagctggagggcagcggcggcgccaagccccccagaggcgccagcaccggcggcagcggcggctacggcggcagcggcgccggcagaagcagctgcgactgccccaactgccaggagctggagagactgggcgccgccgccgccggcctgagaaagaagcccatccacagctgccacatccccggctgcggcaaggtgtacggcaaggccagccacctgaaggcccacctgagatggcacaccggcgagagacccttcgtgtgcaactggctgttctgcggcaagagattcaccagaagcgacgagctggagagacacgtgagaacccacaccagagagaagaagttcacctgcctgctgtgcagcaagagattcaccagaagcgaccacctgagcaagcaccagagaacccacggcgagcccggccccggccccccccccagcggccccaaggagctgggcgagggcagaagcaccggcgaggaggaggccagccagacccccagacccagcgccagccccgccacccccgagaaggcccccggcggcagccccgagcagagcaacctgctggagatctag

SEQ ID NO: 100417 - DNA, 1296 bp, Artificial Sequence; identical to SEQ ID NO: 100416
  Description of Artificial Sequence: Synthetic coding sequence

SEQ ID NO: 100418 - DNA, 1242 bp, Artificial Sequence
  Description of Artificial Sequence: Synthetic coding sequence
atgctgaccgccgcctgcagcaagttcggcggcagcagccccctgagagacagcaccaccctgggcaaggccggcaccaagaagccctacagcgtgggcagcgacctgagcgccagcaagaccatgggcgacgcctaccccgcccccttcaccagcaccaacggcctgctgagccccgccggcagcccccccgcccccaccagcggctacgccaacgactacccccccttcagccacagcttccccggccccaccggcacccaggaccccggcctgctggtgcccaagggccacagcagcagcgactgcctgcccagcgtgtacaccagcctggacatgacccacccctacggcagctggtacaaggccggcatccacgccggcatcagccccggccccggcaacacccccaccccctggtgggacatgcaccccggcggcaactggctgggcggcggccagggccagggcgacggcctgcagggcaccctgcccaccggccccgcccagccccccctgaacccccagctgcccacctaccccagcgacttcgcccccctgaaccccgccccctaccccgccccccacctgctgcagcccggcccccagcacgtgctgccccaggacgtgtacaagcccaaggccgtgggcaacagcggccagctggagggcagcggcggcgccaagccccccagaggcgccagcaccggcggcagcggcggctacggcggcagcggcgccggcagaagcagctgcgactgccccaactgccaggagctggagagactgggcgccgccgccgccggcctgagaaagaagcccatccacagctgccacatccccggctgcggcaaggtgtacggcaaggccagccacctgaaggcccacctgagatggcacaccggcgagagacccttcgtgtgcaactggctgttctgcggcaagagattcaccagaagcgacgagctggagagacacgtgagaacccacaccagagagaagaagttcacctgcctgctgtgcagcaagagattcaccagaagcgaccacctgagcaagcaccagagaacccacggcgagcccggccccggccccccccccagcggccccaaggagctgggcgagggcagaagcaccggcgaggaggaggccagccagacccccagacccagcgccagccccgccacccccgagaaggcccccggcggcagccccgagcagagcaacctgctggagatctag

SEQ ID NO: 100419 - DNA, 1401 bp, Artificial Sequence
  Description of Artificial Sequence: Synthetic coding sequence
atggccaccagcctgctgggcgaggagcccagactgggcagcacccccctggccatgctggccgccacctgcaacaagatcggcagccccagccccagccccagcagcctgagcgacagcagcagcagcttcggcaagggcttccacccctggaagagaagcagcagcagcagcagcgccagctgcaacgtggtgggcagcagcctgagcagcttcggcgtgagcggcgccagcagaaacggcggcagcagcagcgccgccgccgccgccgccgccgccgccgccgccgccgccgccctggtgagcgacagcttcagctgcggcggcagccccggcagcagcgccttcagcctgaccagcagcggcggcagcagcgcccacagccaggacggcagccaccagcccgtgttcatcagcaaggtgcacaccagcgtggacggcctgcagggcatctaccccagagtgggcatggcccacccctacgagagctggttcaagcccagccaccccggcctgggcgccgccggcgaggtgggcagcgccggcgccagcagctggtgggacgtgggcgccggctggatcgacgtgcagaaccccaacagcgccgccgccctgcccggcagcctgcaccccgccgccggcggcctgcagaccagcctgcacagccccctgggcggctacaacagcgactacagcggcctgagccacagcgccttcagcagcggcgccagcagccacctgctgagccccgccggccagcacctgatggacggcttcaagcccgtgctgcccggcagctaccccgacagcgcccccagccccctggccggcgccggcggcagcatgctgagcgccggccccagcgcccccctgggcggcagccccagaagcagcgccagaagatacagcggcagagccacctgcgactgccccaactgccaggaggccgagagactgggccccgccggcgccagcctgagaagaaagggcctgcacagctgccacatccccggctgcggcaaggtgtacggcaagaccagccacctgaaggcccacctgagatggcacaccggcgagagacccttcgtgtgcaactggctgttctgcggcaagagattcaccagaagcgacgagctgcagagacacctgagaacccacaccggcgagaagagattcgcctgccccgtgtgcaacaagagattcatgagaagcgaccacctgagcaagcacgtgaagacccacagcggcggcggcggcggcggcggcagcgccggcagcggcagcggcggcaagaagggcagcgacaccgacagcgagcacagcgccgccggcagccccccctgccacagccccgagctgctgcagccccccgagcccggccacagaaacggcctggagtag

SEQ ID NO: 100420 - DNA, 1473 bp, Artificial Sequence
  Description of Artificial Sequence: Synthetic coding sequence
atgctggccgccacctgcaacaagatcggcagccccagccccagccccagcagcctgagcgacagcagcagcagcttcggcaagggcttccacccctggaagagaagcagcagcagcagcagcgccagctgcaacgtggtgggcagcagcctgagcagcttcggcgtgagcggcgccagcagaaacggcggcagcagcagcgccgccgccgccgccgccgccgccgccgccgccgccgccgccctggtgagcgacagcttcagctgcggcggcagccccggcagcagcgccttcagcctgaccagcagcagcgccgccgccgccgccgccgccgccgccgccgccgccagcagcagccccttcgccaacgactacagcgtgttccaggcccccggcgtgagcggcggcagcggcggcggcggcggcggcggcggcggcggcagcagcgcccacagccaggacggcagccaccagcccgtgttcatcagcaaggtgcacaccagcgtggacggcctgcagggcatctaccccagagtgggcatggcccacccctacgagagctggttcaagcccagccaccccggcctgggcgccgccggcgaggtgggcagcgccggcgccagcagctggtgggacgtgggcgccggctggatcgacgtgcagaaccccaacagcgccgccgccctgcccggcagcctgcaccccgccgccggcggcctgcagaccagcctgcacagccccctgggcggctacaacagcgactacagcggcctgagccacagcgccttcagcagcggcgccagcagccacctgctgagccccgccggccagcacctgatggacggcttcaagcccgtgctgcccggcagctaccccgacagcgcccccagccccctggccggcgccggcggcagcatgctgagcgccggccccagcgcccccctgggcggcagccccagaagcagcgccagaagatacagcggcagagccacctgcgactgccccaactgccaggaggccgagagactgggccccgccggcgccagcctgagaagaaagggcctgcacagctgccacatccccggctgcggcaaggtgtacggcaagaccagccacctgaaggcccacctgagatggcacaccggcgagagacccttcgtgtgcaactggctgttctgcggcaagagattcaccagaagcgacgagctgcagagacacctgagaacccacaccggcgagaagagattcgcctgccccgtgtgcaacaagagattcatgagaagcgaccacctgagcaagcacgtgaagacccacagcggcggcggcggcggcggcggcagcgccggcagcggcagcggcggcaagaagggcagcgacaccgacagcgagcacagcgccgccggcagccccccctgccacagccccgagctgctgcagccccccgagcccggccacagaaacggcctggagtag

SEQ ID NO: 100421 - DNA, 1527 bp, Artificial Sequence
  Description of Artificial Sequence: Synthetic coding sequence
atggccaccagcctgctgggcgaggagcccagactgggcagcacccccctggccatgctggccgccacctgcaacaagatcggcagccccagccccagccccagcagcctgagcgacagcagcagcagcttcggcaagggcttccacccctggaagagaagcagcagcagcagcagcgccagctgcaacgtggtgggcagcagcctgagcagcttcggcgtgagcggcgccagcagaaacggcggcagcagcagcgccgccgccgccgccgccgccgccgccgccgccgccgccgccctggtgagcgacagcttcagctgcggcggcagccccggcagcagcgccttcagcctgaccagcagcagcgccgccgccgccgccgccgccgccgccgccgccgccagcagcagccccttcgccaacgactacagcgtgttccaggcccccggcgtgagcggcggcagcggcggcggcggcggcggcggcggcggcggcagcagcgcccacagccaggacggcagccaccagcccgtgttcatcagcaaggtgcacaccagcgtggacggcctgcagggcatctaccccagagtgggcatggcccacccctacgagagctggttcaagcccagccaccccggcctgggcgccgccggcgaggtgggcagcgccggcgccagcagctggtgggacgtgggcgccggctggatcgacgtgcagaaccccaacagcgccgccgccctgcccggcagcctgcaccccgccgccggcggcctgcagaccagcctgcacagccccctgggcggctacaacagcgactacagcggcctgagccacagcgccttcagcagcggcgccagcagccacctgctgagccccgccggccagcacctgatggacggcttcaagcccgtgctgcccggcagctaccccgacagcgcccccagccccctggccggcgccggcggcagcatgctgagcgccggccccagcgcccccctgggcggcagccccagaagcagcgccagaagatacagcggcagagccacctgcgactgccccaactgccaggaggccgagagactgggccccgccggcgccagcctgagaagaaagggcctgcacagctgccacatccccggctgcggcaaggtgtacggcaagaccagccacctgaaggcccacctgagatggcacaccggcgagagacccttcgtgtgcaactggctgttctgcggcaagagattcaccagaagcgacgagctgcagagacacctgagaacccacaccggcgagaagagattcgcctgccccgtgtgcaacaagagattcatgagaagcgaccacctgagcaagcacgtgaagacccacagcggcggcggcggcggcggcggcagcgccggcagcggcagcggcggcaagaagggcagcgacaccgacagcgagcacagcgccgccggcagccccccctgccacagccccgagctgctgcagccccccgagcccggccacagaaacggcctggagtag

SEQ ID NO: 100422 - DNA, 294 bp, Artificial Sequence
  Description of Artificial Sequence: Synthetic coding sequence
atggacaagcagagcagcgccggcggcgtgaagagaagcgtgccctgcgacagcaacgaggccaacgagatgatgcccgagacccccaccggcgacagcgacccccagcccgcccccaagaagatgaagaccagcgagagcagcaccatcctggtggtgagatacagaagaaacttcaagagaaccagccccgaggagctgctgaacgaccacgccagagagaacagaatcaaccccctgcagatggaggaggaggagttcatggagatcatggtggagatccccgccaagtag

SEQ ID NO: 100423 - DNA, 294 bp, Artificial Sequence
  Description of Artificial Sequence: Synthetic coding sequence
atggacaagcagagcagcgccggcggcgtgaagagaagcgtgccctgcgagagcaacgaggtgaacgagaccatgcccgagacccccaccggcgacagcgacccccagcccgcccccaagaagatgaagaccagcgagagcagcaccatcctggtggtgagatacagaagaaacgtgaagagaaccagccccgaggagctgctgaacgaccacgccagagagaacagaatcaaccccctgcagatggaggaggaggagttcatggagatcatggtggagatccccgccaagtag

SEQ ID NO: 100424 - DNA, 1308 bp, Artificial Sequence
  Description of Artificial Sequence: Synthetic coding sequence
atgctgcccgccagatgcgccagactgctgaccccccacctgctgctggtgctggtgcagctgagccccgccagaggccacagaaccaccggccccagattcctgatcagcgacagagacccccagtgcaacctgcactgcagcagaacccagcccaagcccatctgcgccagcgacggcagaagctacgagagcatgtgcgagtaccagagagccaagtgcagagaccccaccctgggcgtggtgcacagaggcagatgcaaggacgccggccagagcaagtgcagactggagagagcccaggccctggagcaggccaagaagccccaggaggccgtgttcgtgcccgagtgcggcgaggacggcagcttcacccaggtgcagtgccacacctacaccggctactgctggtgcgtgacccccgacggcaagcccatcagcggcagcagcgtgcagaacaagacccccgtgtgcagcggcagcgtgaccgacaagcccctgagccagggcaacagcggcagaaaggacgacggcagcaagcccacccccaccatggagacccagcccgtgttcgacggcgacgagatcaccgcccccaccctgtggatcaagcacctggtgatcaaggacagcaagctgaacaacaccaacatcagaaacagcgagaaggtgtacagctgcgaccaggagagacagagcgccctggaggaggcccagcagaaccccagagagggcatcgtgatccccgagtgcgcccccggcggcctgtacaagcccgtgcagtgccaccagagcaccggctactgctggtgcgtgctggtggacaccggcagacccctgcccggcaccagcaccagatacgtgatgcccagctgcgagagcgacgccagagccaagaccaccgaggccgacgaccccttcaaggacagagagctgcccggctgccccgagggcaagaagatggagttcatcaccagcctgctggacgccctgaccaccgacatggtgcaggccatcaacagcgccgcccccaccggcggcggcagattcagcgagcccgaccccagccacaccctggaggagagagtggtgcactggtacttcagccagctggacagcaacagcagcaacgacatcaacaagagagagatgaagcccttcaagagatacgtgaagaagaaggccaagcccaagaagtgcgccagaagattcaccgactactgcgacctgaacaaggacaaggtgatcagcctgcccgagctgaagggctgcctgggcgtgagcaaggaggtgggcagactggtgtag

SEQ ID NO: 100425 - DNA, 1305 bp, Artificial Sequence
  Description of Artificial Sequence: Synthetic coding sequence
atgctgcccgccagatgcgccagactgctgaccccccacctgctgctggtgctggtgcagctgagccccgccagaggccacagaaccaccggccccagattcctgatcagcgacagagacccccagtgcaacctgcactgcagcagaacccagcccaagcccatctgcgccagcgacggcagaagctacgagagcatgtgcgagtaccagagagccaagtgcagagaccccaccctgggcgtggtgcacagaggcagatgcaaggacgccggccagagcaagtgcagactggagagagcccaggccctggagcaggccaagaagccccaggaggccgtgttcgtgcccgagtgcggcgaggacggcagcttcacccaggtgcagtgccacacctacaccggctactgctggtgcgtgacccccgacggcaagcccatcagcggcagcagcgtgcagaacaagacccccgtgtgcagcggcagcgtgaccgacaagcccctgagccagggcaacagcggcagaaaggacgacggcagcaagcccacccccaccatggagacccagcccgtgttcgacggcgacgagatcaccgcccccaccctgtggatcaagcacctggtgatcaaggacagcaagctgaacaacaccaacatcagaaacagcgagaaggtgtacagctgcgaccaggagagacagagcgccctggaggaggcccagcagaaccccagagagggcatcgtgatccccgagtgcgcccccggcggcctgtacaagcccgtgcagtgccaccagagcaccggctactgctggtgcgtgctggtggacaccggcagacccctgcccggcaccagcaccagatacgtgatgcccagctgcgagagcgacgccagagccaagaccaccgaggccgacgaccccttcaaggacagagagctgcccggctgccccgagggcaagaagatggagttcatcaccagcctgctggacgccctgaccaccgacatggtgcaggccatcaacagcgccgcccccaccggcggcggcagattcagcgagcccgaccccagccacaccctggaggagagagtggtgcactggtacttcagccagctggacagcaacagcagcaacgacatcaacaagagagagatgaagcccttcaagagatacgtgaagaagaaggccaagcccaagaagtgcgccagaagattcaccgactactgcgacctgaacaaggacaaggtgatcagcctgcccgagctgaagggctgcctgggcgtgagcaaggagggcagactggtgtag

SEQ ID NO: 100426 - DNA, 1374 bp, Artificial Sequence
  Description of Artificial Sequence: Synthetic coding sequence
atgctgctgccccagctgtgctggctgcccctgctggccggcctgctgccccccgtgcccgcccagaagttcagcgccctgaccttcctgagagtggaccaggacaaggacaaggactgcagcctggactgcgccggcagcccccagaagcccctgtgcgccagcgacggcagaaccttcctgagcagatgcgagttccagagagccaagtgcaaggacccccagctggagatcgcctacagaggcaactgcaaggacgtgagcagatgcgtggccgagagaaagtacacccaggagcaggccagaaaggagttccagcaggtgttcatccccgagtgcaacgacgacggcacctacagccaggtgcagtgccacagctacaccggctactgctggtgcgtgacccccaacggcagacccatcagcggcaccgccgtggcccacaagacccccagatgccccggcagcgtgaacgagaagctgccccagagagagggcaccggcaagaccgtgagcctgcagatcttcagcgtgctgaacagcgacgacgccgccgcccccgccctggagacccagccccagggcgacgaggaggacatcgccagcagataccccaccctgtggaccgagcaggtgaagagcagacagaacaagaccaacaagaacagcgtgagcagctgcgaccaggagcaccagagcgccctggaggaggccaagcagcccaagaacgacaacgtggtgatccccgagtgcgcccacggcggcctgtacaagcccgtgcagtgccaccccagcaccggctactgctggtgcgtgctggtggacaccggcagacccatccccggcaccagcaccagatacgagcagcccaagtgcgacaacaccgccagagcccaccccgccaaggccagagacctgtacaagggcagacagctgcagggctgccccggcgccaagaagcacgagttcctgaccagcgtgctggacgccctgagcaccgacatggtgcacgccgccagcgaccccagcagcagcagcggcagactgagcgagcccgaccccagccacaccctggaggagagagtggtgcactggtacttcaagctgctggacaagaacagcagcggcgacatcggcaagaaggagatcaagcccttcaagagattcctgagaaagaagagcaagcccaagaagtgcgtgaagaagttcgtggagtactgcgacgtgaacaacgacaagagcatcagcgtgcaggagctgatgggctgcctgggcgtggccaaggaggacggcaaggccgacaccaagaagagacacacccccagaggccacgccgagagcaccagcaacagacagcccagaaagcagggctag

SEQ ID NO: 100427 - DNA, 1341 bp, Artificial Sequence
  Description of Artificial Sequence: Synthetic coding sequence
atgctgctgccccagctgtgctggctgcccctgctggccggcctgctgccccccgtgcccgcccagaagttcagcgccctgaccttcctgagagtggaccaggacaaggacaaggactgcagcctggactgcgccggcagcccccagaagcccctgtgcgccagcgacggcagaaccttcctgagcagatgcgagttccagagagccaagtgcaaggacccccagctggagatcgcctacagaggcaactgcaaggacgtgagcagatgcgtggccgagagaaagtacacccaggagcaggccagaaaggagttccagcaggtgttcatccccgagtgcaacgacgacggcacctacagccaggtgcagtgccacagctacaccggctactgctggtgcgtgacccccaacggcagacccatcagcggcaccgccgtggcccacaagacccccagatgccccggcagcgtgaacgagaagctgccccagagagagggcaccggcaagaccgacgacgccgccgcccccgccctggagacccagccccagggcgacgaggaggacatcgccagcagataccccaccctgtggaccgagcaggtgaagagcagacagaacaagaccaacaagaacagcgtgagcagctgcgaccaggagcaccagagcgccctggaggaggccaagcagcccaagaacgacaacgtggtgatccccgagtgcgcccacggcggcctgtacaagcccgtgcagtgccaccccagcaccggctactgctggtgcgtgctggtggacaccggcagacccatccccggcaccagcaccagatacgagcagcccaagtgcgacaacaccgccagagcccaccccgccaaggccagagacctgtacaagggcagacagctgcagggctgccccggcgccaagaagcacgagttcctgaccagcgtgctggacgccctgagcaccgacatggtgcacgccgccagcgaccccagcagcagcagcggcagactgagcgagcccgaccccagccacaccctggaggagagagtggtgcactggtacttcaagctgctggacaagaacagcagcggcgacatcggcaagaaggagatcaagcccttcaagagattcctgagaaagaagagcaagcccaagaagtgcgtgaagaagttcgtggagtactgcgacgtgaacaacgacaagagcatcagcgtgcaggagctgatgggctgcctgggcgtggccaaggaggacggcaaggccgacaccaagaagagacacacccccagaggccacgccgagagcaccagcaacagacagcccagaaagcagggctag

SEQ ID NO: 100428 - DNA, 1347 bp, Artificial Sequence
  Description of Artificial Sequence: Synthetic coding sequence
atgctgctgccccagctgtgctggctgcccctgctggccggcctgctgccccccgtgcccgcccagaagttcagcgccctgaccttcctgagagtggaccaggacaaggacaaggactgcagcctggactgcgccggcagcccccagaagcccctgtgcgccagcgacggcagaaccttcctgagcagatgcgagttccagagagccaagtgcaaggacccccagctggagatcgcctacagaggcaactgcaaggacgtgagcagatgcgtggccgagagaaagtacacccaggagcaggccagaaaggagttccagcaggtgttcatccccgagtgcaacgacgacggcacctacagccaggtgcagtgccacagctacaccggctactgctggtgcgtgacccccaacggcagacccatcagcggcaccgccgtggcccacaagacccccagatgccccggcagcgtgaacgagaagctgccccagagagagggcaccggcaagaccgacgacgccgccgcccccgccctggagacccagccccagggcgacgaggaggacatcgccagcagataccccaccctgtggaccgagcaggtgaagagcagacagaacaagaccaacaagaacagcgtgagcagctgcgaccaggagcaccagagcgccctggaggaggccaagcagcccaagaacgacaacgtggtgatccccgagtgcgcccacggcggcctgtacaagcccgtgcagtgccaccccagcaccggctactgctggtgcgtgctggtggacaccggcagacccatccccggcaccagcaccagatacgagcagcccaagtgcgacaacaccgccagagcccaccccgccaaggccagagacctgtacaagggcagacagctgcagggctgccccggcgccaagaagcacgagttcctgaccagcgtgctggacgccctgagcaccgacatggtgcacgccgccagcgaccccagcagcagcagcggcagactgagcgagcccgaccccagccacaccctggaggagagagtggtgcactggtacttcaagctgctggacaagaacagcagcggcgacatcggcaagaaggagatcaagcccttcaagagattcctgagaaagaagagcaagcccaagaagtgcgtgaagaagttcgtggagtactgcgacgtgaacaacgacaagagcatcagcgtgcaggagctgatgggctgcctgggcgtggccaaggaggacggcaaggccgacaccaagaagagacacacccccagaggccacgccgagagcaccagcaacagacaggagaaccccagaaaggagggctag

SEQ ID NO: 100429 - DNA, 255 bp, Artificial Sequence
  Description of Artificial Sequence: Synthetic coding sequence
aagaagagcaagcccaagaagtgcgtgaagaagttcgtggagtactgcgacgtgaacaacgacaagagcatcagcgtgcaggagctgatgggctgcctgggcgtggccaaggaggacggcaaggccgacaccaagaagagacacacccccagaggccacgccgagagcaccagcaacagacaggacgccatggtggtgagcagcagacccaaggccaccacccacagaaagagcagaaccctgagcagaagatag

SEQ ID NO: 100430 - DNA, 1275 bp, Artificial Sequence
  Description of Artificial Sequence: Synthetic coding sequence
atgagagcccccggctgcggcagactggtgctgcccctgctgctgctggccgccgccgccctggccgagggcgacgccaagggcctgaaggagggcgagacccccggcaacttcatggaggacgagcagtggctgagcagcatcagccagtacagcggcaagatcaagcactggaacagattcagagacgaggtggaggacgactacatcaagagctgggaggacaaccagcagggcgacgaggccctggacaccaccaaggacccctgccagaaggtgaagtgcagcagacacaaggtgtgcatcgcccagggctaccagagagccatgtgcatcagcagaaagaagctggagcacagaatcaagcagcccaccgtgaagctgcacggcaacaaggacagcatctgcaagccctgccacatggcccagctggccagcgtgtgcggcagcgacggccacacctacagcagcgtgtgcaagctggagcagcaggcctgcctgagcagcaagcagctggccgtgagatgcgagggcccctgcccctgccccaccgagcaggccgccaccagcaccgccgacggcaagcccgagacctgcaccggccaggacctggccgacctgggcgacagactgagagactggttccagctgctgcacgagaacagcaagcagaacggcagcgccagcagcgtggccggccccgccagcggcctggacaagagcctgggcgccagctgcaaggacagcatcggctggatgttcagcaagctggacaccagcgccgacctgttcctggaccagaccgagctggccgccatcaacctggacaagtacgaggtgtgcatcagacccttcttcaacagctgcgacacctacaaggacggcagagtgagcaccgccgagtggtgcttctgcttctggagagagaagcccccctgcctggccgagctggagagaatccagatccaggaggccgccaagaagaagcccggcatcttcatccccagctgcgacgaggacggctactacagaaagatgcagtgcgaccagagcagcggcgactgctggtgcgtggaccagctgggcctggagctgaccggcaccagaacccacggcagccccgactgcgacgacatcgtgggcttcagcggcgacttcggcagcggcgtgggctgggaggacgaggaggagaaggagaccgaggaggccggcgaggaggccgaggaggaggagggcgaggccggcgaggccgacgacggcggctacatctggtag

SEQ ID NO: 100431 - DNA, 1266 bp, Artificial Sequence
  Description of Artificial Sequence: Synthetic coding sequence
atgagagcccccggctgcggcagactggtgctgcccctgctgctgctggccgccgccgccctggccgagggcgacgccaagggcctgaaggagggcgagacccccggcaacttcatggaggacgagcagtggctgagcagcatcagccagtacagcggcaagatcaagcactggaacagattcagagacgacgactacatcaagagctgggaggacaaccagcagggcgacgaggccctggacaccaccaaggacccctgccagaaggtgaagtgcagcagacacaaggtgtgcatcgcccagggctaccagagagccatgtgcatcagcagaaagaagctggagcacagaatcaagcagcccaccgtgaagctgcacggcaacaaggacagcatctgcaagccctgccacatggcccagctggccagcgtgtgcggcagcgacggccacacctacagcagcgtgtgcaagctggagcagcaggcctgcctgagcagcaagcagctggccgtgagatgcgagggcccctgcccctgccccaccgagcaggccgccaccagcaccgccgacggcaagcccgagacctgcaccggccaggacctggccgacctgggcgacagactgagagactggttccagctgctgcacgagaacagcaagcagaacggcagcgccagcagcgtggccggccccgccagcggcctggacaagagcctgggcgccagctgcaaggacagcatcggctggatgttcagcaagctggacaccagcgccgacctgttcctggaccagaccgagctggccgccatcaacctggacaagtacgaggtgtgcatcagacccttcttcaacagctgcgacacctacaaggacggcagagtgagcaccgccgagtggtgcttctgcttctggagagagaagcccccctgcctggccgagctggagagaatccagatccaggaggccgccaagaagaagcccggcatcttcatccccagctgcgacgaggacggctactacagaaagatgcagtgcgaccagagcagcggcgactgctggtgcgtggaccagctgggcctggagctgaccggcaccagaacccacggcagccccgactgcgacgacatcgtgggcttcagcggcgacttcggcagcggcgtgggctgggaggacgaggaggagaaggagaccgaggaggccggcgaggaggccgaggaggaggagggcgaggccggcgaggccgacgacggcggctacatctggtag

SEQ ID NO: 100432 - DNA, 234 bp, Artificial Sequence
  Description of Artificial Sequence: Synthetic coding sequence
atgagagcccccggctgcggcagactggtgctgcccctgctgctgctggccgccgccgccctggccgagggcgacgccaagggcctgaaggagggcgagacccccggcaacttcatggaggacgagcagtggctgagcagcatcagccagtacagcggcaagatcaagcactggaacagattcagagacgtgcccagcagcgacccccccagcaccacccaggccaccccctag

SEQ ID NO: 100433 - DNA, 1275 bp, Artificial Sequence
  Description of Artificial Sequence: Synthetic coding sequence
atgagagcccccggctgcggcagactggtgctgcccctgctgctgctggccgccgccgccctggccgagggcgacgccaagggcctgaaggagggcgagacccccggcaacttcatggaggacgagcagtggctgagcagcatcagccagtacagcggcaagatcaagcactggaacagattcagagacggcatcgaggacgactacatcaagagctgggaggacaaccagcagggcgacgaggccctggacaccaccaaggacccctgccagaaggtgaagtgcagcagacacaaggtgtgcatcgcccagggctaccagagagccatgtgcatcagcagaaagaagctggagcacagaatcaagcagcccaccgtgaagctgcacggcaacaaggacagcatctgcaagccctgccacatggcccagctggccagcgtgtgcggcagcgacggccacacctacagcagcgtgtgcaagctggagcagcaggcctgcctgagcagcaagcagctggccgtgagatgcgagggcccctgcccctgccccaccgagcaggccgccaccagcaccgccgacggcaagcccgagacctgcaccggccaggacctggccgacctgggcgacagactgagagactggttccagctgctgcacgagaacagcaagcagaacggcagcgccagcagcgtggccggccccgccagcggcctggacaagagcctgggcgccagctgcaaggacagcatcggctggatgttcagcaagctggacaccagcgccgacctgttcctggaccagaccgagctggccgccatcaacctggacaagtacgaggtgtgcatcagacccttcttcaacagctgcgacacctacaaggacggcagagtgagcaccgccgagtggtgcttctgcttctggagagagaagcccccctgcctggccgagctggagagaatccagatccaggaggccgccaagaagaagcccggcatcttcatccccagctgcgacgaggacggctactacagaaagatgcagtgcgaccagagcagcggcgactgctggtgcgtggaccagctgggcctggagctgaccggcaccagaacccacggcagccccgactgcgacgacatcgtgggcttcagcggcgacttcggcagcggcgtgggctgggaggacgaggaggagaaggagaccgaggaggccggcgaggaggccgaggaggaggagggcgaggccggcgaggccgacgacggcggctacatctggtag

SEQ ID NO: 100434 - DNA, 1311 bp, Artificial Sequence
  Description of Artificial Sequence: Synthetic coding sequence
atgctgaaggtgagcgccgtgctgtgcgtgtgcgccgccgcctggtgcagccagagcctggccgccgccgccgccgtggccgccgccggcggcagaagcgacggcggcaacttcctggacgacaagcagtggctgaccaccatcagccagtacgacaaggaggtgggccagtggaacaagttcagagacgaggtggaggacgactacttcagaacctggagccccggcaagcccttcgaccaggccctggaccccgccaaggacccctgcctgaagatgaagtgcagcagacacaaggtgtgcatcgcccaggacagccagaccgccgtgtgcatcagccacagaagactgacccacagaatgaaggaggccggcgtggaccacagacagtggagaggccccatcctgagcacctgcaagcagtgccccgtggtgtaccccagccccgtgtgcggcagcgacggccacacctacagcttccagtgcaagctggagtaccaggcctgcgtgctgggcaagcagatcagcgtgaagtgcgagggccactgcccctgccccagcgacaagcccaccagcaccagcagaaacgtgaagagagcctgcagcgacctggagttcagagaggtggccaacagactgagagactggttcaaggccctgcacgagagcggcagccagaacaagaagaccaagaccctgctgagacccgagagaagcagattcgacaccagcatcctgcccatctgcaaggacagcctgggctggatgttcaacagactggacaccaactacgacctgctgctggaccagagcgagctgagaagcatctacctggacaagaacgagcagtgcaccaaggccttcttcaacagctgcgacacctacaaggacagcctgatcagcaacaacgagtggtgctactgcttccagagacagcaggaccccccctgccagaccgagctgagcaacatccagaagagacagggcgtgaagaagctgctgggccagtacatccccctgtgcgacgaggacggctactacaagcccacccagtgccacggcagcgtgggccagtgctggtgcgtggacagatacggcaacgaggtgatgggcagcagaatcaacggcgtggccgactgcgccatcgacttcgagatcagcggcgacttcgccagcggcgacttccacgagtggaccgacgacgaggacgacgaggacgacatcatgaacgacgaggacgagatcgaggacgacgacgaggacgagggcgacgacgacgacggcggcgacgaccacgacgtgtacatctag

SEQ ID NO: 100435 - DNA, 1302 bp, Artificial Sequence
  Description of Artificial Sequence: Synthetic coding sequence
atgctgaaggtgagcgccgtgctgtgcgtgtgcgccgccgcctggtgcagccagagcctggccgccgccgccgccgtggccgccgccggcggcagaagcgacggcggcaacttcctggacgacaagcagtggctgaccaccatcagccagtacgacaaggaggtgggccagtggaacaagttcagagacgacgactacttcagaacctggagccccggcaagcccttcgaccaggccctggaccccgccaaggacccctgcctgaagatgaagtgcagcagacacaaggtgtgcatcgcccaggacagccagaccgccgtgtgcatcagccacagaagactgacccacagaatgaaggaggccggcgtggaccacagacagtggagaggccccatcctgagcacctgcaagcagtgccccgtggtgtaccccagccccgtgtgcggcagcgacggccacacctacagcttccagtgcaagctggagtaccaggcctgcgtgctgggcaagcagatcagcgtgaagtgcgagggccactgcccctgccccagcgacaagcccaccagcaccagcagaaacgtgaagagagcctgcagcgacctggagttcagagaggtggccaacagactgagagactggttcaaggccctgcacgagagcggcagccagaacaagaagaccaagaccctgctgagacccgagagaagcagattcgacaccagcatcctgcccatctgcaaggacagcctgggctggatgttcaacagactggacaccaactacgacctgctgctggaccagagcgagctgagaagcatctacctggacaagaacgagcagtgcaccaaggccttcttcaacagctgcgacacctacaaggacagcctgatcagcaacaacgagtggtgctactgcttccagagacagcaggaccccccctgccagaccgagctgagcaacatccagaagagacagggcgtgaagaagctgctgggccagtacatccccctgtgcgacgaggacggctactacaagcccacccagtgccacggcagcgtgggccagtgctggtgcgtggacagatacggcaacgaggtgatgggcagcagaatcaacggcgtggccgactgcgccatcgacttcgagatcagcggcgacttcgccagcggcgacttccacgagtggaccgacgacgaggacgacgaggacgacatcatgaacgacgaggacgagatcgaggacgacgacgaggacgagggcgacgacgacgacggcggcgacgaccacgacgtgtacatctag

SEQ ID NO: 100436 - DNA, 1158 bp, Artificial Sequence
  Description of Artificial Sequence: Synthetic coding sequence
atgatcacccaggaccacatccacatgagcagcggcctgagccaggacgactacttcagaacctggagccccggcaagcccttcgaccaggccctggaccccgccaaggacccctgcctgaagatgaagtgcagcagacacaaggtgtgcatcgcccaggacagccagaccgccgtgtgcatcagccacagaagactgacccacagaatgaaggaggccggcgtggaccacagacagtggagaggccccatcctgagcacctgcaagcagtgccccgtggtgtaccccagccccgtgtgcggcagcgacggccacacctacagcttccagtgcaagctggagtaccaggcctgcgtgctgggcaagcagatcagcgtgaagtgcgagggccactgcccctgccccagcgacaagcccaccagcaccagcagaaacgtgaagagagcctgcagcgacctggagttcagagaggtggccaacagactgagagactggttcaaggccctgcacgagagcggcagccagaacaagaagaccaagaccctgctgagacccgagagaagcagattcgacaccagcatcctgcccatctgcaaggacagcctgggctggatgttcaacagactggacaccaactacgacctgctgctggaccagagcgagctgagaagcatctacctggacaagaacgagcagtgcaccaaggccttcttcaacagctgcgacacctacaaggacagcctgatcagcaacaacgagtggtgctactgcttccagagacagcaggaccccccctgccagaccgagctgagcaacatccagaagagacagggcgtgaagaagctgctgggccagtacatccccctgtgcgacgaggacggctactacaagcccacccagtgccacggcagcgtgggccagtgctggtgcgtggacagatacggcaacgaggtgatgggcagcagaatcaacggcgtggccgactgcgccatcgacttcgagatcagcggcgacttcgccagcggcgacttccacgagtggaccgacgacgaggacgacgaggacgacatcatgaacgacgaggacgagatcgaggacgacgacgaggacgagggcgacgacgacgacggcggcgacgaccacgacgtgtacatctag

SEQ ID NO: 100437 - DNA, 1311 bp, Artificial Sequence; identical to SEQ ID NO: 100434
  Description of Artificial Sequence: Synthetic coding sequence

SEQ ID NO: 100438 - DNA, 1302 bp, Artificial Sequence; identical to SEQ ID NO: 100435
  Description of Artificial Sequence: Synthetic coding sequence

SEQ ID NO: 100439 - DNA, 348 bp, Artificial Sequence
  Description of Artificial Sequence: Synthetic coding sequence
atgctgaaggtgagcgccgtgctgtgcgtgtgcgccgccgcctggtgcagccagagcctggccgccgccgccgccgtggccgccgccggcggcagaagcgacggcggcaacttcctggacgacaagcagtggctgaccaccatcagccagtacgacaaggaggtgggccagtggaacaagttcagagacgaggtggaggacgactacttcagaacctggagccccggcaagcccttcgaccaggccctggaccccgccaaggacccctgcctgaagatgaagtgcagcagacacaaggtgtgcatcgcccaggacagccagaccgccgtgtgcatcagccacagatag

SEQ ID NO: 100440 - DNA, 1311 bp, Artificial Sequence; identical to SEQ ID NO: 100434
  Description of Artificial Sequence: Synthetic coding sequence

SEQ ID NO: 100441 - DNA, 486 bp, Artificial Sequence
  Description of Artificial Sequence: Synthetic coding sequence
atgctgaaggtgagcgccgtgctgtgcgtgtgcgccgccgcctggtgcagccagagcctggccgccgccgccgccgtggccgccgccggcggcagaagcgacggcggcaacttcctggacgacaagcagtggctgaccaccatcagccagtacgacaaggaggtgggccagtggaacaagttcagagacgacgactacttcagaacctggagccccggcaagcccttcgaccaggccctggaccccgccaaggacccctgcctgaagatgaagtgcagcagacacaaggtgtgcatcgcccaggacagccagaccgccgtgtgcatcagccacagaagactgacccacagaatgaaggaggccggcgtggaccacagacagtggagaggccccatcctgagcacctgcaagcagtgccccgtggtgtaccccagccccgtgtgcggcagcgacggccacacctacagcttccagtgcaagctgtag

SEQ ID NO: 100442 - DNA, 522 bp, Artificial Sequence
  Description of Artificial Sequence: Synthetic coding sequence
atgctgaaggtgagcgccgtgctgtgcgtgtgcgccgccgcctggtgcagccagagcctggccgccgccgccgccgtggccgccgccggcggcagaagcgacggcggcaacttcctggacgacaagcagtggctgaccaccatcagccagtacgacaaggaggtgggccagtggaacaagttcagagacgacgactacttcagaacctggagccccggcaagcccttcgaccaggcctgcagcgacctggagttcagagaggtggccaacagactgagagactggttcaaggccctgcacgagagcggcagccagaacaagaagaccaagaccctgctgagacccgagagaagcagattcgacaccagcatcctgcccatctgcaaggacagcctgggctggatgttcaacagactggacaccaactacgacctgctgctggaccagagcgagctgagaagcatctacctggacaagaacgagcagtgcaccaaggccttcttcaacagctgcgacacctag

SEQ ID NO: 100443 - DNA, 1182 bp, Artificial Sequence
  Description of Artificial Sequence: Synthetic coding sequence
atgctgaaggtgagcgccgtgctgtgcgtgtgcgccgccgcctggtgcagccagagcctggccgccgccgccgccgtggccgccgccggcggcagaagcgacggcggcaacttcctggacgacaagcagtggctgaccaccatcagccagtacgacaaggaggtgggccagtggaacaagttcagagacgacgactacttcagaacctggagccccggcaagcccttcgaccaggccctggaccccgccaaggacccctgcctgaagatgaagtgcagcagacacaaggtgtgcatcgcccaggacagccagaccgccgtgtgcatcagccacagaagactgacccacagaatgaaggaggccggcgtggaccacagacagtggagaggccccatcctgagcacctgcaagcagtgccccgtggtgtaccccagccccgtgtgcggcagcgacggccacacctacagcttccagtgcaagctggagtaccaggcctgcgtgctgggcaagcagatcagcgtgaagtgcgagggccactgcccctgccccagcgacaagcccaccagcaccagcagaaacgtgaagagaggcttcgacaccagcatcctgcccatctgcaaggacagcctgggctggatgttcaacagactggacaccaactacgacctgctgctggaccagagcgagctgagaagcatctacctggacaagaacgagcagtgcaccaaggccttcttcaacagctgcgacacctacaaggacagcctgatcagcaacaacgagtggtgctactgcttccagagacagcaggaccccccctgccagaccgagctgagcaacatccagaagagacagggcgtgaagaagctgctgggccagtacatccccctgtgcgacgaggacggctactacaagcccacccagtgccacggcagcgtgggccagtgctggtgcgtggacagatacggcaacgaggtgatgggcagcagaatcaacggcgtggccgactgcgccatcgacttcgagatcagcggcgacttcgccagcggcgacttccacgagtggaccgacgacgaggacgacgaggacgacatcatgaacgacgaggacgagatcgaggacgacgacgaggacgagggcgacgacgacgacggcggcgacgaccacgacgtgtacatctag

SEQ ID NO: 100444 - DNA, 1302 bp, Artificial Sequence; identical to SEQ ID NO: 100435
  Description of Artificial Sequence: Synthetic coding sequence

SEQ ID NO: 100445 - DNA, 1311 bp, Artificial Sequence; identical to SEQ ID NO: 100434
  Description of Artificial Sequence: Synthetic coding sequence

SEQ ID NO: 100446 - DNA, 348 bp, Artificial Sequence; identical to SEQ ID NO: 100439
  Description of Artificial Sequence: Synthetic coding sequence

SEQ ID NO: 100447 - DNA, 942 bp, Artificial Sequence
  Description of Artificial Sequence: Synthetic coding sequence
atgctgaaggtgagcgccgtgctgtgcgtgtgcgccgccgcctggtgcagccagagcctggccgccgccgccgccgtggccgccgccggcggcagaagcgacggcggcaacttcctggacgacaagcagtggctgaccaccatcagccagtacgacaaggaggtgggccagtggaacaagttcagagacgacgactacttcagaacctggagccccggcaagcccttcgaccaggccctggaccccgccaaggacccctgcctgaagatgaagtgcagcagacacaaggtgtgcatcgcccaggacagccagaccgccgtgtgcatcagccacagaagactgacccacagaatgaaggaggccggcgtggaccacagacagtggagaggccccatcctgagcacctgcaagcagtgccccgtggtgtaccccagccccgtgtgcggcagcgacggccacacctacagcttccagtgcaagctggagtaccaggcctgcgtgctgggcaagcagatcagcgtgaagtgcgagggccactgcccctgccccagcgacaagcccaccagcaccagcagaaacgtgaagagagcctgcagcgacctggagttcagagaggtggccaacagactgagagactggttcaaggccctgcacgagagcggcagccagaacaagaagaccaagaccctgctgagacccgagagaagcagattcgacaccagcatcctgcccatctgcaaggacagcctgggctggatgttcaacagactggacaccaactacgacctgctgctggaccagagcgagctgagaagcatctacctggacaagaacgagcagtgcaccaaggccttcttcaacagctgcgacacctacaaggacagcctgatcagcaacaacgagtggtgctactgcttccagagacagcagggcaagagatag

SEQ ID NO: 100448 - DNA, 1017 bp, Artificial Sequence
  Description of Artificial Sequence: Synthetic coding sequence
atgctgaaggtgagcgccgtgctgtgcgtgtgcgccgccgcctggtgcagccagagcctggccgccgccgccgccgtggccgccgccggcggcagaagcgacggcggcaacttcctggacgacaagcagtggctgaccaccatcagccagtacgacaaggaggtgggccagtggaacaagttcagagactgcaagctggagtaccaggcctgcgtgctgggcaagcagatcagcgtgaagtgcgagggccactgcccctgccccagcgacaagcccaccagcaccagcagaaacgtgaagagagcctgcagcgacctggagttcagagaggtggccaacagactgagagactggttcaaggccctgcacgagagcggcagccagaacaagaagaccaagaccctgctgagacccgagagaagcagattcgacaccagcatcctgcccatctgcaaggacagcctgggctggatgttcaacagactggacaccaactacgacctgctgctggaccagagcgagctgagaagcatctacctggacaagaacgagcagtgcaccaaggccttcttcaacagctgcgacacctacaaggacagcctgatcagcaacaacgagtggtgctactgcttccagagacagcaggaccccccctgccagaccgagctgagcaacatccagaagagacagggcgtgaagaagctgctgggccagtacatccccctgtgcgacgaggacggctactacaagcccacccagtgccacggcagcgtgggccagtgctggtgcgtggacagatacggcaacgaggtgatgggcagcagaatcaacggcgtggccgactgcgccatcgacttcgagatcagcggcgacttcgccagcggcgacttccacgagtggaccgacgacgaggacgacgaggacgacatcatgaacgacgaggacgagatcgaggacgacgacgaggacgagggcgacgacgacgacggcggcgacgaccacgacgtgtacatctag

SEQ ID NO: 100449 - DNA, 1023 bp, Artificial Sequence
  Description of Artificial Sequence: Synthetic coding sequence
atgatcaacaacggcagcccccagagcctgagcatgaccagaaagagcgacagcggcaccaacagcgagaccatgaaggaggccggcgtggaccacagacagtggagaggccccatcctgagcacctgcaagcagtgccccgtggtgtaccccagccccgtgtgcggcagcgacggccacacctacagcttccagtgcaagctggagtaccaggcctgcgtgctgggcaagcagatcagcgtgaagtgcgagggccactgcccctgccccagcgacaagcccaccagcaccagcagaaacgtgaagagagcctgcagcgacctggagttcagagaggtggccaacagactgagagactggttcaaggccctgcacgagagcggcagccagaacaagaagaccaagaccctgctgagacccgagagaagcagattcgacaccagcatcctgcccatctgcaaggacagcctgggctggatgttcaacagactggacaccaactacgacctgctgctggaccagagcgagctgagaagcatctacctggacaagaacgagcagtgcaccaaggccttcttcaacagctgcgacacctacaaggacagcctgatcagcaacaacgagtggtgctactgcttccagagacagcaggaccccccctgccagaccgagctgagcaacatccagaagagacagggcgtgaagaagctgctgggccagtacatccccctgtgcgacgaggacggctactacaagcccacccagtgccacggcagcgtgggccagtgctggtgcgtggacagatacggcaacgaggtgatgggcagcagaatcaacggcgtggccgactgcgccatcgacttcgagatcagcggcgacttcgccagcggcgacttccacgagtggaccgacgacgaggacgacgaggacgacatcatgaacgacgaggacgagatcgaggacgacgacgaggacgagggcgacgacgacgacggcggcgacgaccacgacgtgtacatctag

SEQ ID NO: 100450 - DNA, 915 bp, Artificial Sequence
  Description of Artificial Sequence: Synthetic coding sequence
atgaagtgcagcagacacaaggtgtgcatcgcccaggacagccagaccgccgtgtgcatcagccacagaagactgacccacagaatgaaggaggccggcgtggaccacagacagtggagaggccccatcctgagcacctgcaagcagtgccccgtggtgtaccccagccccgtgtgcggcagcgacggccacacctacagcttccagtgcaagctggagtaccaggcctgcgtgctgggcaagcagatcagcgtgaagtgcgagggccactgcccctgccccagcgacaagcccaccagcaccagcagaaacgtgaagagaggcttcgacaccagcatcctgcccatctgcaaggacagcctgggctggatgttcaacagactggacaccaactacgacctgctgctggaccagagcgagctgagaagcatctacctggacaagaacgagcagtgcaccaaggccttcttcaacagctgcgacacctacaaggacagcctgatcagcaacaacgagtggtgctactgcttccagagacagcaggaccccccctgccagaccgagctgagcaacatccagaagagacagggcgtgaagaagctgctgggccagtacatccccctgtgcgacgaggacggctactacaagcccacccagtgccacggcagcgtgggccagtgctggtgcgtggacagatacggcaacgaggtgatgggcagcagaatcaacggcgtggccgactgcgccatcgacttcgagatcagcggcgacttcgccagcggcgacttccacgagtggaccgacgacgaggacgacgaggacgacatcatgaacgacgaggacgagatcgaggacgacgacgaggacgagggcgacgacgacgacggcggcgacgaccacgacgtgtacatctag

SEQ ID NO: 100451 - DNA, 951 bp, Artificial Sequence
  Description of Artificial Sequence: Synthetic coding sequence
atgaaggaggccggcgtggaccacagacagtggagaggccccatcctgagcacctgcaagcagtgccccgtggtgtaccccagccccgtgtgcggcagcgacggccacacctacagcttccagtgcaagctggagtaccaggcctgcgtgctgggcaagcagatcagcgtgaagtgcgagggccactgcccctgccccagcgacaagcccaccagcaccagcagaaacgtgaagagagcctgcagcgacctggagttcagagaggtggccaacagactgagagactggttcaaggccctgcacgagagcggcagccagaacaagaagaccaagaccctgctgagacccgagagaagcagattcgacaccagcatcctgcccatctgcaaggacagcctgggctggatgttcaacagactggacaccaactacgacctgctgctggaccagagcgagctgagaagcatctacctggacaagaacgagcagtgcaccaaggccttcttcaacagctgcgacacctacaaggacagcctgatcagcaacaacgagtggtgctactgcttccagagacagcaggaccccccctgccagaccgagctgagcaacatccagaagagacagggcgtgaagaagctgctgggccagtacatccccctgtgcgacgaggacggctactacaagcccacccagtgccacggcagcgtgggccagtgctggtgcgtggacagatacggcaacgaggtgatgggcagcagaatcaacggcgtggccgactgcgccatcgacttcgagatcagcggcgacttcgccagcggcgacttccacgagtggaccgacgacgaggacgacgaggacgacatcatgaacgacgaggacgagatcgaggacgacgacgaggacgagggcgacgacgacgacggcggcgacgaccacgacgtgtacatctag

SEQ ID NO: 100452 - DNA, 1017 bp, Artificial Sequence; identical to SEQ ID NO: 100448
  Description of Artificial Sequence: Synthetic coding sequence

SEQ ID NO: 100453 - DNA, 13740 bp, Artificial Sequence
  Description of Artificial Sequence: Synthetic coding sequence
atggagaccaaggagaacagatgggtgcccgtgaccgtgctgcccggctgcgtgggctgcagaaccgtggccgccctggccagctggaccgtgagagacgtgaaggagagaatcttcgccgagaccggcttccccgtgagcgagcagagactgtggagaggcggcagagagctgagcgactggatcaagatcggcgacctgaccagcaagaactgccacctgttcgtgaacctgcagagcaagggcctgaagggcggcggcagattcggccagaccaccccccccctggtggacttcctgaaggacatcctgagaagataccccgagggcggccagatcctgaaggagctgatccagaacgccgaggacgccggcgccaccgaggtgaagttcctgtacgacgagacccagtacggcaccgagaccctgtggagcaaggacatggccccctaccagggccccgccctgtacgtgtacaacaacgccgtgttcacccccgaggactggcacggcatccaggagatcgccagaagcagaaagaaggacgaccccctgaaggtgggcagattcggcatcggcttcaacagcgtgtaccacatcaccgacgtgccctgcatcttcagcggcgaccagatcggcatgctggacccccaccagaccctgttcggcccccacgagagcggccagtgctggaacctgaaggacgacagcaaggagatcagcgagctgagcgaccagttcgcccccttcgtgggcatcttcggcagcaccaaggagaccttcatcaacggcaacttccccggcaccttcttcagattccccctgagactgcagcccagccagctgagcagcaacctgtacaacaagcagaaggtgctggagctgttcgagagcttcagagccgacgccgacaccgtgctgctgttcctgaagagcgtgcaggacgtgagcctgtacgtgagagaggccgacggcaccgagaagctggtgttcagagtgaccagcagcgagagcaaggccctgaagcacgagagacccaacagcatcaagatcctgggcaccgccatcagcaactactgcaagaagacccccagcaacaacatcacctgcgtgacctaccacgtgaacatcgtgctggaggaggagagcaccaaggacgcccagaagaccagctggctggtgtgcaacagcgtgggcggcagaggcatcagcagcaagctggacagcctggccgacgagctgaagttcgtgcccatcatcggcatcgccatgcccctgagcagcagagacgacgaggccaagggcgccaccagcgacttcagcggcaaggccttctgcttcctgcccctgccccccggcgaggagagcagcaccggcctgcccgtgcacatcagcggcttcttcggcctgaccgacaacagaagaagcatcaagtggagagagctggaccagtggagagaccccgccgccctgtggaacgagttcctggtgatgaacgtggtgcccaaggcctacgccaccctgatcctggacagcatcaagagactggagatggagaagagcagcgacttccccctgagcgtggacgtgatctacaagctgtggcccgaggccagcaaggtgaaggtgcactggcagcccgtgctggagcccctgttcagcgagctgctgcagaacgccgtgatctacagcatcagctgcgactgggtgagactggagcaggtgtacttcagcgagctggacgagaacctggagtacaccaagaccgtgctgaactacctgcagagcagcggcaagcagatcgccaaggtgcccggcaacgtggacgccgccgtgcagctgaccgccgccagcggcaccacccccgtgagaaaggtgacccccgcctgggtgagacaggtgctgagaaagtgcgcccacctgggctgcgccgaggagaagctgcacctgctggagttcgtgctgagcgaccaggcctacagcgagctgctgggcctggagctgctgcccctgcagaacggcaacttcgtgcccttcagcagcagcgtgagcgaccaggacgtgatctacatcaccagcgccgagtaccccagaagcctgttccccagcctggagggcagattcatcctggacaacctgaagccccacctggtggccgccctgaaggaggccgcccagaccagaggcagaccctgcacccagctgcagctgctgaaccccgagagattcgccagactgatcaaggaggtgatgaacaccttctggcccggcagagagctgatcgtgcagtggtaccccttcgacgagaacagaaaccaccccagcgtgagctggctgaagatggtgtggaagaacctgtacatccacttcagcgaggacctgaccctgttcgacgagatgcccctgatccccagaaccatcctggaggagggccagacctgcgtggagctgatcagactgagaatccccagcctggtgatcctggacgacgagagcgaggcccagctgcccgagttcctggccgacatcgtgcagaagctgggcggcttcgtgctgaagaagctggacgccagcatccagcaccccctgatcaagaagtacatccacagccccctgcccagcgccgtgctgcagatcatggagaagatgcccctgcagaagctgtgcaaccagatcaccagcctgctgcccacccacaaggacgccctgagaaagttcctggccagcctgaccgacagcagcgagaaggagaagagaatcatccaggagctggccatcttcaagagaatcaaccacagcagcgaccagggcatcagcagctacaccaagctgaagggctgcaaggtgctgcaccacaccgccaagctgcccgccgacctgagactgagcatcagcgtgatcgacagcagcgacgaggccaccatcagactggccaacatgctgaagatcgagcagctgaagaccaccagctgcctgaagctggtgctgaaggacatcgagaacgccttctacagccacgaggaggtgacccagctgatgctgtgggtgctggagaacctgagcagcctgaagaacgagaaccccaacgtgctggagtggctgacccccctgaagttcatccagatcagccaggagcagatggtgagcgccggcgagctgttcgaccccgacatcgaggtgctgaaggacctgttctgcaacgaggagggcacctacttcccccccagcgtgttcaccagccccgacatcctgcacagcctgagacagatcggcctgaagaacgaggccagcctgaaggagaaggacgtggtgcaggtggccaagaagatcgaggccctgcaggtgggcgcctgccccgaccaggacgtgctgctgaagaaggccaagaccctgctgctggtgctgaacaagaaccacaccctgctgcagagcagcgagggcaagatgaccctgaagaagatcaagtgggtgcccgcctgcaaggagagaccccccaactaccccggcagcctggtgtggaagggcgacctgtgcaacctgtgcgccccccccgacatgtgcgacgtgggccacgccatcctgatcggcagcagcctgcccctggtggagagcatccacgtgaacctggagaaggccctgggcatcttcaccaagcccagcctgagcgccgtgctgaagcacttcaagatcgtggtggactggtacagcagcaagaccttcagcgacgaggactactaccagttccagcacatcctgctggagatctacggcttcatgcacgaccacctgaacgagggcaaggacagcttcagagccctgaagttcccctgggtgtggaccggcaagaagttctgccccctggcccaggccgtgatcaagcccatccacgacctggacctgcagccctacctgcacaacgtgcccaagaccatggccaagttccaccagctgttcaaggtgtgcggcagcatcgaggagctgaccagcgaccacatcagcatggtgatccagaagatctacctgaagagcgaccaggacctgagcgagcaggagagcaagcagaacctgcacctgatgctgaacatcatcagatggctgtacagcaaccagatccccgccagccccaacacccccgtgcccatccaccacagcaagaaccccagcaagctgatcatgaagcccatccacgagtgctgctactgcgacatcaaggtggacgacctgaacgacctgctggaggacagcgtggagcccatcatcctggtgcacgaggacatccccatgaagaccgccgagtggctgaaggtgccctgcctgagcaccagactgatcaaccccgagaacatgggcttcgagcagagcggccagagagagcccctgaccgtgagaatcaagaacatcctggaggagtaccccagcgtgagcgacatcttcaaggagctgctgcagaacgccgacgacgccaacgccaccgagtgcagcttcctgatcgacatgagaagaaacatggacatcagagagaacctgctggaccccggcatggccgcctgccacggccccgccctgtggagcttcaacaacagccagttcagcgacagcgacttcgtgaacatcaccagactgggcgagagcctgaagagaggcgaggtggacaaggtgggcaagttcggcctgggcttcaacagcgtgtaccacatcaccgacatccccatcatcatgagcagagagttcatgatcatgttcgaccccaacatcaaccacatcagcaagcacatcaaggacaagagcaaccccggcatcaagatcaactggagcaagcagcagaagagactgagaaagttccccaaccagttcaagcccttcatcgacgtgttcggctgccagctgcccctgaccgtggaggccccctacagctacaacggcaccctgttcagactgagcttcagaacccagcaggaggccaaggtgagcgaggtgagcagcacctgctacaacaccgccgacatctacagcctggtggacgagttcagcctgtgcggccacagactgatcatcttcacccagagcgtgaagagcatgtacctgaagtacctgaagatcgaggagaccaaccccagcctggcccaggacaccgtgatcatcaagaagaagagctgcagcagcaaggccctgaacacccccgtgctgagcgtgctgaaggaggccgccaagctgatgaagacctgcagcagcagcaacaagaagctgcccagcgacgagcccaagagcagctgcatcctgcagatcaccgtggaggagttccaccacgtgttcagaagaatcgccgacctgcagagccccctgttcagaggccccgacgacgaccccgccgccctgttcgagatggccaagagcggccagagcaagaagcccagcgacgagctgagccagaagaccgtggagtgcaccacctggctgctgtgcacctgcatggacaccggcgaggccctgaagttcagcctgagcgagagcggcagaagactgggcctggtgccctgcggcgccgtgggcgtgcagctgagcgagatccaggaccagaagtggaccgtgaagccccacatcggcgaggtgttctgctacctgcccctgagaatcaagaccggcctgcccgtgcacatcaacggctgcttcgccgtgaccagcaacagaaaggagatctggaagaccgacaccaagggcagatggaacaccaccttcatgagacacgtgatcgtgaaggcctacctgcaggtgctgagcgtgctgagagacctggccaccagcggcgagctgatggactacacctactacgccgtgtggcccgaccccgacctggtgcacgacgacttcagcgtgatctgccagggcttctacgaggacatcgcccacggcaagggcaaggagctgaccaaggtgttcagcgacggcagcacctgggtgagcatgaagaacgtgagattcctggacgacagcatcctgaagagaagagacgtgggcagcgccgccttcaagatcttcctgaagtacctgaagaagaccggcagcaagaacctgtgcgccgtggagctgcccagcagcgtgaagctgggcttcgaggaggccggctgcaagcagatcctgctggagaacaccttcagcgagaagcagttcttcagcgaggtgttcttccccaacatccaggagatcgaggccgagctgagagaccccctgatgatcttcgtgctgaacgagaaggtggacgagttcagcggcgtgctgagagtgaccccctgcatcccctgcagcctggagggccaccccctggtgctgcccagcagactgatccaccccgagggcagagtggccaagctgttcgacatcaaggacggcagattcccctacggcagcacccaggactacctgaaccccatcatcctgatcaagctggtgcagctgggcatggccaaggacgacatcctgtgggacgacatgctggagagagccgtgagcgtggccgagatcaacaagagcgaccacgtggccgcctgcctgagaagcagcatcctgctgagcctgatcgacgagaagctgaagatcagagaccccagagccaaggacttcgccgccaagtaccagaccatcagattcctgcccttcctgaccaagcccgccggcttcagcctggactggaagggcaacagcttcaagcccgagaccatgttcgccgccaccgacctgtacaccgccgagcaccaggacatcgtgtgcctgctgcagcccatcctgaacgagaacagccacagcttcagaggctgcggcagcgtgagcctggccgtgaaggagttcctgggcctgctgaagaagcccaccgtggacctggtgatcaaccagctgaaggaggtggccaagagcgtggacgacggcatcaccctgtaccaggagaacatcaccaacgcctgctacaagtacctgcacgaggccctgatgcagaacgagatcaccaagatgagcatcatcgacaagctgaagcccttcagcttcatcctggtggagaacgcctacgtggacagcgagaaggtgagcttccacctgaacttcgaggccgccccctacctgtaccagctgcccaacaagtacaagaacaacttcagagagctgttcgagaccgtgggcgtgagacagagctgcaccgtggaggacttcgccctggtgctggagagcatcgaccaggagagaggcaccaagcagatcaccgaggagaacttccagctgtgcagaagaatcatcagcgagggcatctggagcctgatcagagagaagaagcaggagttctgcgagaagaactacggcaagatcctgctgcccgacaccaacctgatgctgctgcccgccaagagcctgtgctacaacgactgcccctggatcaaggtgaaggacaccaccgtgaagtactgccacgccgacatccccagagaggtggccgtgaagctgggcgccgtgcccaagagacacaaggccctggagagatacgccagcaacgtgtgcttcaccaccctgggcaccgagttcggccagaaggagaagctgaccagcagaatcaagagcatcctgaacgcctaccccagcgagaaggagatgctgaaggagctgctgcagaacgccgacgacgccaaggccaccgagatctgcttcgtgttcgaccccagacagcaccccgtggacagaatcttcgacgacaagtgggcccccctgcagggccccgccctgtgcgtgtacaacaaccagcccttcaccgaggacgacgtgagaggcatccagaacctgggcaagggcaccaaggagggcaacccctacaagaccggccagtacggcatcggcttcaacagcgtgtaccacatcaccgactgccccagcttcatcagcggcaacgacatcctgtgcatcttcgacccccacgccagatacgcccccggcgccaccagcatcagccccggcagaatgttcagagacctggacgccgacttcagaacccagttcagcgacgtgctggacctgtacctgggcacccacttcaagctggacaactgcaccatgttcagattccccctgagaaacgccgagatggccaaggtgagcgagatcagcagcgtgcccgccagcgacagaatggtgcagaacctgctggacaagctgagaagcgacggcgccgagctgctgatgttcctgaaccacatggagaagatcagcatctgcgagatcgacaagagcaccggcgccctgaacgtgctgtacagcgtgaagggcaagatcaccgacggcgacagactgaagagaaagcagttccacgccagcgtgatcgacagcgtgaccaagaagagacagctgaaggacatccccgtgcagcagatcacctacaccatggacaccgaggacagcgagggcaacctgaccacctggctgatctgcaacagaagcggcttcagcagcatggagaaggtgagcaagagcgtgatcagcgcccacaagaaccaggacatcaccctgttccccagaggcggcgtggccgcctgcatcacccacaactacaagaagccccacagagccttctgcttcctgcccctgagcctggagaccggcctgcccttccacgtgaacggccacttcgccctggacagcgccagaagaaacctgtggagagacgacaacggcgtgggcgtgagaagcgactggaacaacagcctgatgaccgccctgatcgcccccgcctacgtggagctgctgatccagctgaagaagagatacttccccggcagcgaccccaccctgagcgtgctgcagaacacccccatccacgtggtgaaggacaccctgaagaagttcctgagcttcttccccgtgaacagactggacctgcagcccgacctgtactgcctggtgaaggccctgtacaactgcatccacgaggacatgaagagactgctgcccgtggtgagagcccccaacatcgacggcagcgacctgcacagcgccgtgatcatcacctggatcaacatgagcaccagcaacaagaccagacccttcttcgacaacctgctgcaggacgagctgcagcacctgaagaacgccgactacaacatcaccaccagaaagaccgtggccgagaacgtgtacagactgaagcacctgctgctggagatcggcttcaacctggtgtacaactgcgacgagaccgccaacctgtaccactgcctgatcgacgccgacatccccgtgagctacgtgacccccgccgacatcagaagcttcctgatgaccttcagcagccccgacaccaactgccacatcggcaagctgccctgcagactgcagcagaccaacctgaagctgttccacagcctgaagctgctggtggactactgcttcaaggacgccgaggagaacgagatcgaggtggagggcctgcccctgctgatcaccctggacagcgtgctgcagaccttcgacgccaagagacccaagttcctgaccacctaccacgagctgatccccagcagaaaggacctgttcatgaacaccctgtacctgaagtacagcaacatcctgctgaactgcaaggtggccaaggtgttcgacatcagcagcttcgccgacctgctgagcagcgtgctgcccagagagtacaagaccaagagctgcaccaagtggaaggacaacttcgccagcgagagctggctgaagaacgcctggcacttcatcagcgagagcgtgagcgtgaaggaggaccaggaggagaccaagcccaccttcgacatcgtggtggacaccctgaaggactgggccctgctgcccggcaccaagttcaccgtgagcgccaaccagctggtggtgcccgagggcgacgtgctgctgcccctgagcctgatgcacatcgccgtgttccccaacgcccagagcgacaaggtgttccacgccctgatgaaggccggctgcatccagctggccctgaacaagatctgcagcaaggacagcgccttcgtgcccctgctgagctgccacaccgccaacatcgagagccccaccagcatcctgaaggccctgcactacatggtgcagaccagcaccttcagagccgagaagctggtggagaacgacttcgaggccctgctgatgtacttcaactgcaacctgaaccacctgatgagccaggacgacatcaagatcctgaagagcctgccctgctacaagagcatcagcggcagatacgtgagcatcggcaagttcggcacctgctacgtgctgaccaagagcatccccagcgccgaggtggagaagtggacccagagcagcagcagcgccttcctggaggagaagatccacctgaaggagctgtacgaggtgatcggctgcgtgcccgtggacgacctggaggtgtacctgaagcacctgctgcccaagatcgagaacctgagctacgacgccaagctggagcacctgatctacctgaagaacagactgagcagcgccgaggagctgagcgagatcaaggagcagctgttcgagaagctggagagcctgctgatcatccacgacgccaacagcagactgaagcaggccaagcacttctacgacagaaccgtgagagtgttcgaggtgatgctgcccgagaagctgttcatccccaacgacttcttcaagaagctggagcagctgatcaagcccaagaaccacgtgaccttcatgaccagctgggtggagttcctgagaaacatcggcctgaagtacatcctgagccagcagcagctgctgcagttcgccaaggagatcagcgtgagagccaacaccgagaactggagcaaggagaccctgcagaacaccgtggacatcctgctgcaccacatcttccaggagagaatggacctgctgagcggcaacttcctgaaggagctgagcctgatccccttcctgtgccccgagagagcccccgccgagttcatcagattccacccccagtaccaggaggtgaacggcaccctgcccctgatcaagttcaacggcgcccaggtgaaccccaagttcaagcagtgcgacgtgctgcagctgctgtggaccagctgccccatcctgcccgagaaggccacccccctgagcatcaaggagcaggagggcagcgacctgggcccccaggagcagctggagcaggtgctgaacatgctgaacgtgaacctggacccccccctggacaaggtgatcaacaactgcagaaacatctgcaacatcaccaccctggacgaggagatggtgaagaccagagccaaggtgctgagaagcatctacgagttcctgagcgccgagaagagagagttcagattccagctgagaggcgtggccttcgtgatggtggaggacggctggaagctgctgaagcccgaggaggtggtgatcaacctggagtacgagagcgacttcaagccctacctgtacaagctgcccctggagctgggcaccttccaccagctgttcaagcacctgggcaccgaggacatcatcagcaccaagcagtacgtggaggtgctgagcagaatcttcaagaacagcgagggcaagcagctggaccccaacgagatgagaaccgtgaagagagtggtgagcggcctgttcagaagcctgcagaacgacagcgtgaaggtgagaagcgacctggagaacgtgagagacctggccctgtacctgcccagccaggacggcagactggtgaagagcagcatcctggtgttcgacgacgccccccactacaagagcagaatccagggcaacatcggcgtgcagatgctggtggacctgagccagtgctacctgggcaaggaccacggcttccacaccaagctgatcatgctgttcccccagaagctgagacccagactgctgagcagcatcctggaggagcagctggacgaggagacccccaaggtgtgccagttcggcgccctgtgcagcctgcagggcagactgcagctgctgctgagcagcgagcagttcatcaccggcctgatcagaatcatgaagcacgagaacgacaacgccttcctggccaacgaggagaaggccatcagactgtgcaaggccctgagagagggcctgaaggtgagctgcttcgagaagctgcagaccaccctgagagtgaagggcttcaaccccatcccccacagcagaagcgagaccttcgccttcctgaagagattcggcaacgccgtgatcctgctgtacatccagcacagcgacagcaaggacatcaacttcctgctggccctggccatgaccctgaagagcgccaccgacaacctgatcagcgacaccagctacctgatcgccatgctgggctgcaacgacatctacagaatcggcgagaagctggacagcctgggcgtgaagtacgacagcagcgagcccagcaagctggagctgcccatgcccggcacccccatccccgccgagatccactacaccctgctgatggaccccatgaacgtgttctaccccggcgagtacgtgggctacctggtggacgccgagggcggcgacatctacggcagctaccagcccacctacacctacgccatcatcgtgcaggaggtggagagagaggacgccgacaacagcagcttcctgggcaagatctaccagatcgacatcggctacagcgagtacaagatcgtgagcagcctggacctgtacaagttcagcagacccgaggagagcagccagagcagagacagcgcccccagcacccccaccagccccaccgagttcctgacccccggcctgagaagcatcccccccctgttcagcggcagagagagccacaagaccagcagcaagcaccagagccccaagaagctgaaggtgaacagcctgcccgagatcctgaaggaggtgaccagcgtggtggagcaggcctggaagctgcccgagagcgagagaaagaagatcatcagaagactgtacctgaagtggcaccccgacaagaaccccgagaaccacgacatcgccaacgaggtgttcaagcacctgcagaacgagatcaacagactggagaagcaggccttcctggaccagaacgccgacagagccagcagaagaaccttcagcaccagcgccagcagattccagagcgacaagtacagcttccagagattctacaccagctggaaccaggaggccaccagccacaagagcgagagacagcagcagaacaaggagaagtgcccccccagcgccggccagacctacagccagagattcttcgtgccccccaccttcaagagcgtgggcaaccccgtggaggccagaagatggctgagacaggccagagccaacttcagcgccgccagaaacgacctgcacaagaacgccaacgagtgggtgtgcttcaagtgctacctgagcaccaagctggccctgatcgccgccgactacgccgtgagaggcaagagcgacaaggacgtgaagcccaccgccctggcccagaagatcgaggagtacagccagcagctggagggcctgaccaacgacgtgcacaccctggaggcctacggcgtggacagcctgaagaccagataccccgacctgctgcccttcccccagatccccaacgacagattcaccagcgaggtggccatgagagtgatggagtgcaccgcctgcatcatcatcaagctggagaacttcatgcagcagaaggtgtag

SEQ ID NO: 100454 - DNA, 13740 bp, Artificial Sequence; identical to SEQ ID NO: 100453
  Description of Artificial Sequence: Synthetic coding sequence

SEQ ID NO: 100455 - DNA, 11490 bp, Artificial Sequence
  Description of Artificial Sequence: Synthetic coding sequence
atgaacaccttctggcccggcagagagctgatcgtgcagtggtaccccttcgacgagaacagaaaccaccccagcgtgagctggctgaagatggtgtggaagaacctgtacatccacttcagcgaggacctgaccctgttcgacgagatgcccctgatccccagaaccatcctggaggagggccagacctgcgtggagctgatcagactgagaatccccagcctggtgatcctggacgacgagagcgaggcccagctgcccgagttcctggccgacatcgtgcagaagctgggcggcttcgtgctgaagaagctggacgccagcatccagcaccccctgatcaagaagtacatccacagccccctgcccagcgccgtgctgcagatcatggagaagatgcccctgcagaagctgtgcaaccagatcaccagcctgctgcccacccacaaggacgccctgagaaagttcctggccagcctgaccgacagcagcgagaaggagaagagaatcatccaggagctggccatcttcaagagaatcaaccacagcagcgaccagggcatcagcagctacaccaagctgaagggctgcaaggtgctgcaccacaccgccaagctgcccgccgacctgagactgagcatcagcgtgatcgacagcagcgacgaggccaccatcagactggccaacatgctgaagatcgagcagctgaagaccaccagctgcctgaagctggtgctgaaggacatcgagaacgccttctacagccacgaggaggtgacccagctgatgctgtgggtgctggagaacctgagcagcctgaagaacgagaaccccaacgtgctggagtggctgacccccctgaagttcatccagatcagccaggagcagatggtgagcgccggcgagctgttcgaccccgacatcgaggtgctgaaggacctgttctgcaacgaggagggcacctacttcccccccagcgtgttcaccagccccgacatcctgcacagcctgagacagatcggcctgaagaacgaggccagcctgaaggagaaggacgtggtgcaggtggccaagaagatcgaggccctgcaggtgggcgcctgccccgaccaggacgtgctgctgaagaaggccaagaccctgctgctggtgctgaacaagaaccacaccctgctgcagagcagcgagggcaagatgaccctgaagaagatcaagtgggtgcccgcctgcaaggagagaccccccaactaccccggcagcctggtgtggaagggcgacctgtgcaacctgtgcgccccccccgacatgtgcgacgtgggccacgccatcctgatcggcagcagcctgcccctggtggagagcatccacgtgaacctggagaaggccctgggcatcttcaccaagcccagcctgagcgccgtgctgaagcacttcaagatcgtggtggactggtacagcagcaagaccttcagcgacgaggactactaccagttccagcacatcctgctggagatctacggcttcatgcacgaccacctgaacgagggcaaggacagcttcagagccctgaagttcccctgggtgtggaccggcaagaagttctgccccctggcccaggccgtgatcaagcccatccacgacctggacctgcagccctacctgcacaacgtgcccaagaccatggccaagttccaccagctgttcaaggtgtgcggcagcatcgaggagctgaccagcgaccacatcagcatggtgatccagaagatctacctgaagagcgaccaggacctgagcgagcaggagagcaagcagaacctgcacctgatgctgaacatcatcagatggctgtacagcaaccagatccccgccagccccaacacccccgtgcccatccaccacagcaagaaccccagcaagctgatcatgaagcccatccacgagtgctgctactgcgacatcaaggtggacgacctgaacgacctgctggaggacagcgtggagcccatcatcctggtgcacgaggacatccccatgaagaccgccgagtggctgaaggtgccctgcctgagcaccagactgatcaaccccgagaacatgggcttcgagcagagcggccagagagagcccctgaccgtgagaatcaagaacatcctggaggagtaccccagcgtgagcgacatcttcaaggagctgctgcagaacgccgacgacgccaacgccaccgagtgcagcttcctgatcgacatgagaagaaacatggacatcagagagaacctgctggaccccggcatggccgcctgccacggccccgccctgtggagcttcaacaacagccagttcagcgacagcgacttcgtgaacatcaccagactgggcgagagcctgaagagaggcgaggtggacaaggtgggcaagttcggcctgggcttcaacagcgtgtaccacatcaccgacatccccatcatcatgagcagagagttcatgatcatgttcgaccccaacatcaaccacatcagcaagcacatcaaggacaagagcaaccccggcatcaagatcaactggagcaagcagcagaagagactgagaaagttccccaaccagttcaagcccttcatcgacgtgttcggctgccagctgcccctgaccgtggaggccccctacagctacaacggcaccctgttcagactgagcttcagaacccagcaggaggccaaggtgagcgaggtgagcagcacctgctacaacaccgccgacatctacagcctggtggacgagttcagcctgtgcggccacagactgatcatcttcacccagagcgtgaagagcatgtacctgaagtacctgaagatcgaggagaccaaccccagcctggcccaggacaccgtgatcatcaagaagaagagctgcagcagcaaggccctgaacacccccgtgctgagcgtgctgaaggaggccgccaagctgatgaagacctgcagcagcagcaacaagaagctgcccagcgacgagcccaagagcagctgcatcctgcagatcaccgtggaggagttccaccacgtgttcagaagaatcgccgacctgcagagccccctgttcagaggccccgacgacgaccccgccgccctgttcgagatggccaagagcggccagagcaagaagcccagcgacgagctgagccagaagaccgtggagtgcaccacctggctgctgtgcacctgcatggacaccggcgaggccctgaagttcagcctgagcgagagcggcagaagactgggcctggtgccctgcggcgccgtgggcgtgcagctgagcgagatccaggaccagaagtggaccgtgaagccccacatcggcgaggtgttctgctacctgcccctgagaatcaagaccggcctgcccgtgcacatcaacggctgcttcgccgtgaccagcaacagaaaggagatctggaagaccgacaccaagggcagatggaacaccaccttcatgagacacgtgatcgtgaaggcctacctgcaggtgctgagcgtgctgagagacctggccaccagcggcgagctgatggactacacctactacgccgtgtggcccgaccccgacctggtgcacgacgacttcagcgtgatctgccagggcttctacgaggacatcgcccacggcaagggcaaggagctgaccaaggtgttcagcgacggcagcacctgggtgagcatgaagaacgtgagattcctggacgacagcatcctgaagagaagagacgtgggcagcgccgccttcaagatcttcctgaagtacctgaagaagaccggcagcaagaacctgtgcgccgtggagctgcccagcagcgtgaagctgggcttcgaggaggccggctgcaagcagatcctgctggagaacaccttcagcgagaagcagttcttcagcgaggtgttcttccccaacatccaggagatcgaggccgagctgagagaccccctgatgatcttcgtgctgaacgagaaggtggacgagttcagcggcgtgctgagagtgaccccctgcatcccctgcagcctggagggccaccccctggtgctgcccagcagactgatccaccccgagggcagagtggccaagctgttcgacatcaaggacggcagattcccctacggcagcacccaggactacctgaaccccatcatcctgatcaagctggtgcagctgggcatggccaaggacgacatcctgtgggacgacatgctggagagagccgtgagcgtggccgagatcaacaagagcgaccacgtggccgcctgcctgagaagcagcatcctgctgagcctgatcgacgagaagctgaagatcagagaccccagagccaaggacttcgccgccaagtaccagaccatcagattcctgcccttcctgaccaagcccgccggcttcagcctggactggaagggcaacagcttcaagcccgagaccatgttcgccgccaccgacctgtacaccgccgagcaccaggacatcgtgtgcctgctgcagcccatcctgaacgagaacagccacagcttcagaggctgcggcagcgtgagcctggccgtgaaggagttcctgggcctgctgaagaagcccaccgtggacctggtgatcaaccagctgaaggaggtggccaagagcgtggacgacggcatcaccctgtaccaggagaacatcaccaacgcctgctacaagtacctgcacgaggccctgatgcagaacgagatcaccaagatgagcatcatcgacaagctgaagcccttcagcttcatcctggtggagaacgcctacgtggacagcgagaaggtgagcttccacctgaacttcgaggccgccccctacctgtaccagctgcccaacaagtacaagaacaacttcagagagctgttcgagaccgtgggcgtgagacagagctgcaccgtggaggacttcgccctggtgctggagagcatcgaccaggagagaggcaccaagcagatcaccgaggagaacttccagctgtgcagaagaatcatcagcgagggcatctggagcctgatcagagagaagaagcaggagttctgcgagaagaactacggcaagatcctgctgcccgacaccaacctgatgctgctgcccgccaagagcctgtgctacaacgactgcccctggatcaaggtgaaggacaccaccgtgaagtactgccacgccgacatccccagagaggtggccgtgaagctgggcgccgtgcccaagagacacaaggccctggagagatacgccagcaacgtgtgcttcaccaccctgggcaccgagttcggccagaaggagaagctgaccagcagaatcaagagcatcctgaacgcctaccccagcgagaaggagatgctgaaggagctgctgcagaacgccgacgacgccaaggccaccgagatctgcttcgtgttcgaccccagacagcaccccgtggacagaatcttcgacgacaagtgggcccccctgcagggccccgccctgtgcgtgtacaacaaccagcccttcaccgaggacgacgtgagaggcatccagaacctgggcaagggcaccaaggagggcaacccctacaagaccggccagtacggcatcggcttcaacagcgtgtaccacatcaccgactgccccagcttcatcagcggcaacgacatcctgtgcatcttcgacccccacgccagatacgcccccggcgccaccagcatcagccccggcagaatgttcagagacctggacgccgacttcagaacccagttcagcgacgtgctggacctgtacctgggcacccacttcaagctggacaactgcaccatgttcagattccccctgagaaacgccgagatggccaaggtgagcgagatcagcagcgtgcccgccagcgacagaatggtgcagaacctgctggacaagctgagaagcgacggcgccgagctgctgatgttcctgaaccacatggagaagatcagcatctgcgagatcgacaagagcaccggcgccctgaacgtgctgtacagcgtgaagggcaagatcaccgacggcgacagactgaagagaaagcagttccacgccagcgtgatcgacagcgtgaccaagaagagacagctgaaggacatccccgtgcagcagatcacctacaccatggacaccgaggacagcgagggcaacctgaccacctggctgatctgcaacagaagcggcttcagcagcatggagaaggtgagcaagagcgtgatcagcgcccacaagaaccaggacatcaccctgttccccagaggcggcgtggccgcctgcatcacccacaactacaagaagccccacagagccttctgcttcctgcccctgagcctggagaccggcctgcccttccacgtgaacggccacttcgccctggacagcgccagaagaaacctgtggagagacgacaacggcgtgggcgtgagaagcgactggaacaacagcctgatgaccgccctgatcgcccccgcctacgtggagctgctgatccagctgaagaagagatacttccccggcagcgaccccaccctgagcgtgctgcagaacacccccatccacgtggtgaaggacaccctgaagaagttcctgagcttcttccccgtgaacagactggacctgcagcccgacctgtactgcctggtgaaggccctgtacaactgcatccacgaggacatgaagagactgctgcccgtggtgagagcccccaacatcgacggcagcgacctgcacagcgccgtgatcatcacctggatcaacatgagcaccagcaacaagaccagacccttcttcgacaacctgctgcaggacgagctgcagcacctgaagaacgccgactacaacatcaccaccagaaagaccgtggccgagaacgtgtacagactgaagcacctgctgctggagatcggcttcaacctggtgtacaactgcgacgagaccgccaacctgtaccactgcctgatcgacgccgacatccccgtgagctacgtgacccccgccgacatcagaagcttcctgatgaccttcagcagccccgacaccaactgccacatcggcaagctgccctgcagactgcagcagaccaacctgaagctgttccacagcctgaagctgctggtggactactgcttcaaggacgccgaggagaacgagatcgaggtggagggcctgcccctgctgatcaccctggacagcgtgctgcagaccttcgacgccaagagacccaagttcctgaccacctaccacgagctgatccccagcagaaaggacctgttcatgaacaccctgtacctgaagtacagcaacatcctgctgaactgcaaggtggccaaggtgttcgacatcagcagcttcgccgacctgctgagcagcgtgctgcccagagagtacaagaccaagagctgcaccaagtggaaggacaacttcgccagcgagagctggctgaagaacgcctggcacttcatcagcgagagcgtgagcgtgaaggaggaccaggaggagaccaagcccaccttcgacatcgtggtggacaccctgaaggactgggccctgctgcccggcaccaagttcaccgtgagcgccaaccagctggtggtgcccgagggcgacgtgctgctgcccctgagcctgatgcacatcgccgtgttccccaacgcccagagcgacaaggtgttccacgccctgatgaaggccggctgcatccagctggccctgaacaagatctgcagcaaggacagcgccttcgtgcccctgctgagctgccacaccgccaacatcgagagccccaccagcatcctgaaggccctgcactacatggtgcagaccagcaccttcagagccgagaagctggtggagaacgacttcgaggccctgctgatgtacttcaactgcaacctgaaccacctgatgagccaggacgacatcaagatcctgaagagcctgccctgctacaagagcatcagcggcagatacgtgagcatcggcaagttcggcacctgctacgtgctgaccaagagcatccccagcgccgaggtggagaagtggacccagagcagcagcagcgccttcctggaggagaagatccacctgaaggagctgtacgaggtgatcggctgcgtgcccgtggacgacctggaggtgtacctgaagcacctgctgcccaagatcgagaacctgagctacgacgccaagctggagcacctgatctacctgaagaacagactgagcagcgccgaggagctgagcgagatcaaggagcagctgttcgagaagctggagagcctgctgatcatccacgacgccaacagcagactgaagcaggccaagcacttctacgacagaaccgtgagagtgttcgaggtgatgctgcccgagaagctgttcatccccaacgacttcttcaagaagctggagcagctgatcaagcccaagaaccacgtgaccttcatgaccagctgggtggagttcctgagaaacatcggcctgaagtacatcctgagccagcagcagctgctgcagttcgccaaggagatcagcgtgagagccaacaccgagaactggagcaaggagaccctgcagaacaccgtggacatcctgctgcaccacatcttccaggagagaatggacctgctgagcggcaacttcctgaaggagctgagcctgatccccttcctgtgccccgagagagcccccgccgagttcatcagattccacccccagtaccaggaggtgaacggcaccctgcccctgatcaagttcaacggcgcccaggtgaaccccaagttcaagcagtgcgacgtgctgcagctgctgtggaccagctgccccatcctgcccgagaaggccacccccctgagcatcaaggagcaggagggcagcgacctgggcccccaggagcagctggagcaggtgctgaacatgctgaacgtgaacctggacccccccctggacaaggtgatcaacaactgcagaaacatctgcaacatcaccaccctggacgaggagatggtgaagaccagagccaaggtgctgagaagcatctacgagttcctgagcgccgagaagagagagttcagattccagctgagaggcgtggccttcgtgatggtggaggacggctggaagctgctgaagcccgaggaggtggtgatcaacctggagtacgagagcgacttcaagccctacctgtacaagctgcccctggagctgggcaccttccaccagctgttcaagcacctgggcaccgaggacatcatcagcaccaagcagtacgtggaggtgctgagcagaatcttcaagaacagcgagggcaagcagctggaccccaacgagatgagaaccgtgaagagagtggtgagcggcctgttcagaagcctgcagaacgacagcgtgaaggtgagaagcgacctggagaacgtgagagacctggccctgtacctgcccagccaggacggcagactggtgaagagcagcatcctggtgttcgacgacgccccccactacaagagcagaatccagggcaacatcggcgtgcagatgctggtggacctgagccagtgctacctgggcaaggaccacggcttccacaccaagctgatcatgctgttcccccagaagctgagacccagactgctgagcagcatcctggaggagcagctggacgaggagacccccaaggtgtgccagttcggcgccctgtgcagcctgcagggcagactgcagctgctgctgagcagcgagcagttcatcaccggcctgatcagaatcatgaagcacgagaacgacaacgccttcctggccaacgaggagaaggccatcagactgtgcaaggccctgagagagggcctgaaggtgagctgcttcgagaagctgcagaccaccctgagagtgaagggcttcaaccccatcccccacagcagaagcgagaccttcgccttcctgaagagattcggcaacgccgtgatcctgctgtacatccagcacagcgacagcaaggacatcaacttcctgctggccctggccatgaccctgaagagcgccaccgacaacctgatcagcgacaccagctacctgatcgccatgctgggctgcaacgacatctacagaatcggcgagaagctggacagcctgggcgtgaagtacgacagcagcgagcccagcaagctggagctgcccatgcccggcacccccatccccgccgagatccactacaccctgctgatggaccccatgaacgtgttctaccccggcgagtacgtgggctacctggtggacgccgagggcggcgacatctacggcagctaccagcccacctacacctacgccatcatcgtgcaggaggtggagagagaggacgccgacaacagcagcttcctgggcaagatctaccagatcgacatcggctacagcgagtacaagatcgtgagcagcctggacctgtacaagttcagcagacccgaggagagcagccagagcagagacagcgcccccagcacccccaccagccccaccgagttcctgacccccggcctgagaagcatcccccccctgttcagcggcagagagagccacaagaccagcagcaagcaccagagccccaagaagctgaaggtgaacagcctgcccgagatcctgaaggaggtgaccagcgtggtggagcaggcctggaagctgcccgagagcgagagaaagaagatcatcagaagactgtacctgaagtggcaccccgacaagaaccccgagaaccacgacatcgccaacgaggtgttcaagcacctgcagaacgagatcaacagactggagaagcaggccttcctggaccagaacgccgacagagccagcagaagaaccttcagcaccagcgccagcagattccagagcgacaagtacagcttccagagattctacaccagctggaaccaggaggccaccagccacaagagcgagagacagcagcagaacaaggagaagtgcccccccagcgccggccagacctacagccagagattcttcgtgccccccaccttcaagagcgtgggcaaccccgtggaggccagaagatggctgagacaggccagagccaacttcagcgccgccagaaacgacctgcacaagaacgccaacgagtgggtgtgcttcaagtgctacctgagcaccaagctggccctgatcgccgccgactacgccgtgagaggcaagagcgacaaggacgtgaagcccaccgccctggcccagaagatcgaggagtacagccagcagctggagggcctgaccaacgacgtgcacaccctggaggcctacggcgtggacagcctgaagaccagataccccgacctgctgcccttcccccagatccccaacgacagattcaccagcgaggtggccatgagagtgatggagtgcaccgcctgcatcatcatcaagctggagaacttcatgcagcagaaggtgtag

SEQ ID NO: 100456 - DNA, 7332 bp, Artificial Sequence
  Description of Artificial Sequence: Synthetic coding sequence
atggccgccgaggagggcgtggccagcgccgccagcgccggcggcagctggggcaccgccgccatgggcagagtgctgcccatgctgctggtgcccgtgcccgccgaggccatgggccagctgggcagcagagcccagctgagaacccagcccgaggccctgggcagcctgaccgccgccggcagcctgcaggtgctgagcctgacccccggcagcagaggcggcggcagatgctgcctggagggccccttctggcacttcctgtgggaggacagcagaaacagcagcacccccaccgagaagcccaagctgctggccctgggcgagaactacgagctgctgatctacgagttcaacctgaaggacggcagatgcgacgccaccatcctgtacagctgcagcagagaggccctgcagaagctgatcgacgaccaggacatcagcatcagcctgctgagcctgagaatcctgagcttccacaacaacaccagcctgctgttcatcaacaagtgcgtgatcctgcacatcatcttccccgagagagacgccgccatcagagtgctgaactgcttcaccctgcccctgcccgcccaggccgtggacatgatcatcgacacccagctgtgcagaggcatcctgttcgtgctgagcagcctgggctggatctacatcttcgacgtggtggacggcacctacgtggcccacgtggacctggccctgcacaaggaggacatgtgcaacgagcagcagcaggagcccgccaagatcagcagcttcaccagcctgaaggtgagccaggacctggacgtggccgtgatcgtgagcagcagcaacagcgccgtggccctgaacctgaacctgtacttcagacagcaccccggccacctgctgtgcgagagaatcctggaggacctgcccatccagggccccaagggcgtggacgaggacgaccccgtgaacagcgcctacaacatgaagctggccaagttcagcttccagatcgacagaagctggaaggcccagctgagcagcctgaacgagaccatcaagaacagcaagctggaggtgagctgctgcgccccctggttccaggacatcctgcacctggagagccccgagagcggcaaccacagcaccagcgtgcagagctgggccttcatcccccaggacatcatgcacggccagtacaacgtgctgcagaaggaccacgccaagaccagcgaccccggcagaagctggaagatcatgcacatcagcgagcaggaggagcccatcgagctgaagtgcgtgagcgtgaccggcttcaccgccctgttcacctgggaggtggagagaatgggctacaccatcaccctgtgggacctggagacccagggcatgcagtgcttcagcctgggcaccaagtgcatccccgtggacagcagcggcgaccagcagctgtgcttcgtgctgaccgagaacggcctgagcctgatcctgttcggcctgacccaggaggagttcctgaacagactgatgatccacggcagcgccagcaccgtggacaccctgtgccacctgaacggctggggcagatgcagcatccccatccacgccctggaggccggcatcgagaacagacagctggacaccgtgaacttcttcctgaagagcaaggagaacctgttcaaccccagcagcaagagcagcgtgagcgaccagttcgaccacctgagcagccacctgtacctgagaaacgtggaggagctgatccccgccctggacctgctgtgcagcgccatcagagagagctacagcgagccccagagcaagcacttcagcgagcagctgctgaacctgaccctgagcttcctgaacaaccagatcaaggagctgttcatccacaccgaggagctggacgagcacctgcagaagggcgtgaacatcctgaccagctacatcaacgagctgagaaccttcatgatcaagttcccctggaagctgaccgacgccatcgacgagtacgacgtgcacgagaacgtgcccaaggtgaaggagagcaacatctggaagaagctgagcttcgaggaggtgatcgccagcgccatcctgaacaacaagatccccgaggcccagaccttcttcagaatcgacagccacagcgcccagaagctggaggagctgatcggcatcggcctgaacctggtgttcgacaacctgaagaagaacaacatcaaggaggccagcgagctgctgaagaacatgggcttcgacgtgaagggccagctgctgaagatctgcttctacaccaccaacaagaacatcagagacttcctggtggagatcctgaaggagaagaactacttcagcgagaaggagaagagaaccatcgacttcgtgcaccaggtggagaagctgtacctgggccacttccaggagaacatgcagatccagagcttccccagatactggatcaaggagcaggacttcttcaagcacaagagcgtgctggacagcttcctgaagtacgactgcaaggacgagttcaacaagcaggaccacagaatcgtgctgaactgggccctgtggtgggaccagctgacccaggagagcatcctgctgcccagaatcagccccgaggagtacaagagctacagccccgaggccctgtggagatacctgaccgccagacacgactggctgaacatcatcctgtggatcggcgagttccagacccagcacagctacgccagcctgcagcagaacaagtggcccctgctgaccgtggacgtgatcaaccagaacaccagctgcaacaactacatgagaaacgagatcctggacaagctggccagaaacggcgtgttcctggccagcgagctggaggacttcgagtgcttcctgctgagactgagcagaatcggcggcgtgatccaggacaccctgcccgtgcagaactacaagaccaaggagggctgggacttccacagccagttcatcctgtactgcctggagcacagcctgcagcacctgctgtacgtgtacctggactgctacaagctgagccccgagaactgccccttcctggagaagaaggagctgcacgaggcccacccctggttcgagttcctggtgcagtgcagacaggtggccagcaacctgaccgaccccaagctgatcttccaggccagcctggccaacgcccagatcctgatccccaccaaccaggccagcgtgagcagcatgctgctggagggccacaccctgctggccctggccaccaccatgtacagccccggcggcgtgagccaggtggtgcagaacgaggagaacgagaactgcctgaagaaggtggacccccagctgctgaagatggccctgaccccctaccccaagctgaagaccgccctgttcccccagtgcaccccccccagcgtgctgcccagcgacatcaccatctaccacctgatccagagcctgagccccttcgaccccagcagactgttcggctggcagagcgccaacaccctggccatcggcgacgcctggagccacctgccccacttcagcagccccgacctggtgaacaagtacgccatcgtggagagactgaacttcgcctactacctgcacaacggcagacccagcttcgccttcggcaccttcctggtgcaggagctgatcaagagcaagacccccaagcagctgatccagcaggtgggcaacgaggcctacgtgatcggcctgagcagcttccacatccccagcatcggcgccgcctgcgtgtgcttcctggagctgctgggcctggacagcctgaagctgagagtggacatgaaggtggccaacatcatcctgagctacaagtgcagaaacgaggacgcccagtacagcttcatcagagagagcgtggccgagaagctgagcaagctggccgacggcgagaagaccaccaccgaggagctgctggtgctgctggaggagggcacctggaacagcatccagcagcaggagatcaagagactgagcagcgagagcagcagccagtgggccctggtggtgcagttctgcagactgcacaacatgaagctgagcatcagctacctgagagagtgcgccaaggccaacgactggctgcagttcatcatccacagccagctgcacaactaccaccccgccgaggtgaagagcctgatccagtacttcagccccgtgatccaggaccacctgagactggccttcgagaacctgcccagcgtgcccaccagcaagatggacagcgaccaggtgtgcaacaagtgcccccaggagctgcagggcagcaagcaggagatgaccgacctgttcgagatcctgctgcagtgcagcgaggagcccgacagctggcactggctgctggtggaggccgtgaagcagcaggcccccatcctgagcgtgctggccagctgcctgcagggcgccagcgccatcagctgcctgtgcgtgtggatcatcaccagcgtggaggacaacgtggccaccgaggccatgggccacatccaggacagcaccgaggaccacacctggaacctggaggacctgagcgtgatctggagaaccctgctgaccagacagaagagcaagaccctgatcagaggcttccagctgttcttcaaggacagccccctgctgctggtgatggagatgtacgagctgtgcatgttcttcagaaactacaaggaggccgaggccaagctgctggagttccagaagagcctggagaccctgaacaccgccgccaccaaggtgcaccccgtgatccccgccatgtggctggaggaccaggtgtgcttcctgctgaagctgatgctgcagcagtgcaagacccagtacgagctgggcaagctgctgcagctgttcgtggagagagagcacctgttcagcgacggccccgacgtgaagaagctgtgcatcctgtgccagatcctgaaggacaccagcatcgccatcaaccacaccatcatcaccagctacagcatcgagaacctgcagcacgagtgcagaagcatcctggagagactgcagaccgacggccagttcgccctggccagaagagtggccgagctggccgagctgcccgtggacaacctggtgatcaaggagatcacccaggagatgcagaccctgaagcacatcgagcagtggagcctgaagcaggccagaatcgacttctggaagaagtgccacgagaacttcaagaagaacagcatcagcagcaaggccgccagcagcttcttcagcacccaggcccacgtggcctgcgagcaccccaccggctggagcagcatggaggagagacacctgctgctgaccctggccggccactggctggcccaggaggacgtggtgcccctggacaagctggaggagctggagaagcagatctggctgtgcagaatcacccagcacaccctgggcagaaaccaggaggagaccgagcccagattcagcagacagatcagcaccagcggcgagctgagcttcgacagcctggccagcgagttcagcttcagcaagctggccgccctgaacaccagcaagtacctggagctgaacagcctgcccagcaaggagacctgcgagaacagactggactggaaggagcaggagagcctgaacttcctgatcggcagactgctggacgacggctgcgtgcacgaggccagcagagtgtgcagatacttccacttctacaaccccgacgtggccctggtgctgcactgcagagccctggccagcggcgaggccagcatggaggacctgcaccccgagatccacgccctgctgcagagcgccgagctgctggaggaggaggcccccgacatccccctgagaagagtgcacagcaccagcagcctggacagccagaagttcgtgaccgtgcccagcagcaacgaggtggtgaccaacctggaggtgctgaccagcaagtgcctgcacggcaagaactactgcagacaggtgctgtgcctgtacgacctggccaaggagctgggctgcagctacaccgacgtggccgcccaggacggcgaggccatgctgagaaagatcctggccagccagcagcccgacagatgcaagagagcccaggccttcatcagcacccagggcctgaagcccgacaccgtggccgagctggtggccgaggaggtgaccagagagctgctgaccagcagccagggcaccggccacaagcagatgttcaaccccaccgaggagagccagaccttcctgcagctgaccaccctgtgccaggacagaaccctggtgggcatgaagctgctggacaagatcagcagcgtgccccacggcgagctgagctgcaccaccgagctgctgatcctggcccaccactgcttcaccctgacctgccacatggagggcatcatcagagtgctgcaggccgcccacatgctgaccgacaaccacctggcccccagcgaggagtacggcctggtggtgagactgctgaccggcatcggcagatacaacgagatgacctacatcttcgacctgctgcacaagaagcactacttcgaggtgctgatgagaaagaagctggaccccagcggcaccctgaagaccgccctgctggactacatcaagagatgcagacccggcgacagcgagaagcacaacatgatcgccctgtgcttcagcatgtgcagagagatcggcgagaaccacgaggccgccgccagaatccagctgaagctgatcgagagccagccctgggaggacagcctgaaggacggccaccagctgaagcagctgctgctgaaggccctgaccctgatgctggacgccgccgagagctacgccaaggacagctgcgtgagacaggcccagcactgccagagactgaccaagctgatcaccctgcagatccacttcctgaacaccggccagaacaccatgctgatcaacctgggcagacacaagctgatggactgcatcctggccctgcccagattctaccaggccagcatcgtggccgaggcctacgacttcgtgcccgactgggccgagatcctgtaccagcaggtgatcctgaagggcgacttcaactacctggaggagttcaagcagcagagactgctgaagagcagcatcttcgaggagatcagcaagaagtacaagcagcaccagcccaccgacatggtgatggagaacctgaagaagctgctgacctactgcgaggacgtgtacctgtactacaagctggcctacgagcacaagttctacgagatcgtgaacgtgctgctgaaggacccccagaccggctgctgcctgaaggacatgctggccggctag

SEQ ID NO: 100457 - DNA, 6993 bp, Artificial Sequence
  Description of Artificial Sequence: Synthetic coding sequence
atggccgccgaggagggcgtggccagcgccgccagcgccggcggcagctggggcaccgccgccatgggcagagtgctgcccatgctgctggtgcccgtgcccgccgaggccatgggccagctgggcagcagagcccagctgagaacccagcccgaggccctgggcagcctgaccgccgccggcagcctgcaggtgctgagcctgacccccggcagcagaggcggcggcagatgctgcctggagggccccttctggcacttcctgtgggaggacagcagaaacagcagcacccccaccgagaagcccaagctgctggccctgggcgagaactacgagctgctgatctacgagttcaacctgaaggacggcagatgcgacgccaccatcctgtacagctgcagcagagaggccctgcagaagctgatcgacgaccaggacatcagcatcagcctgctgagcctgagaatcctgagcttccacaacaacaccagcctgctgttcatcaacaagtgcgtgatcctgcacatcatcttccccgagagagacgccgccatcagagtgctgaactgcttcaccctgcccctgcccgcccaggccgtggacatgatcatcgacacccagctgtgcagaggcatcctgttcgtgctgagcagcctgggctggatctacatcttcgacgtggtggacggcacctacgtggcccacgtggacctggccctgcacaaggaggacatgtgcaacgagcagcagcaggagcccgccaagatcagcagcttcaccagcctgaaggtgagccaggacctggacgtggccgtgatcgtgagcagcagcaacagcgccgtggccctgaacctgaacctgtacttcagacagcaccccggccacctgctgtgcgagagaatcctggaggacctgcccatccagggccccaagggcgtggacgaggacgaccccgtgaacagcgcctacaacatgaagctggccaagttcagcttccagatcgacagaagctggaaggcccagctgagcagcctgaacgagaccatcaagaacagcaagctggaggtgagctgctgcgccccctggttccaggacatcctgcacctggagagccccgagagcggcaaccacagcaccagcgtgcagagctgggccttcatcccccaggacatcatgcacggccagtacaacgtgctgcagaaggaccacgccaagaccagcgaccccggcagaagctggaagatcatgcacatcagcgagcaggaggagcccatcgagctgaagtgcgtgagcgtgaccggcttcaccgccctgttcacctgggaggtggagagaatgggctacaccatcaccctgtgggacctggagacccagggcatgcagtgcttcagcctgggcaccaagtgcatccccgtggacagcagcggcgaccagcagctgtgcttcgtgctgaccgagaacggcctgagcctgatcctgttcggcctgacccaggaggagttcctgaacagactgatgatccacggcagcgccagcaccgtggacaccctgtgccacctgaacggctggggcagatgcagcatccccatccacgccctggaggccggcatcgagaacagacagctggacaccgtgaacttcttcctgaagagcaaggagaacctgttcaaccccagcagcaagagcagcgtgagcgaccagttcgaccacctgagcagccacctgtacctgagaaacgtggaggagctgatccccgccctggacctgctgtgcagcgccatcagagagagctacagcgagccccagagcaagcacttcagcgagcagctgctgaacctgaccctgagcttcctgaacaaccagatcaaggagctgttcatccacaccgaggagctggacgagcacctgcagaagggcgtgaacatcctgaccagctacatcaacgagctgagaaccttcatgatcaagttcccctggaagctgaccgacgccatcgacgagtacgacgtgcacgagaacgtgcccaaggtgaaggagagcaacatctggaagaagctgagcttcgaggaggtgatcgccagcgccatcctgaacaacaagatccccgaggcccagaccttcttcagaatcgacagccacagcgcccagaagctggaggagctgatcggcatcggcctgaacctggtgttcgacaacctgaagaagaacaacatcaaggaggccagcgagctgctgaagaacatgggcttcgacgtgaagggccagctgctgaagatctgcttctacaccaccaacaagaacatcagagacttcctggtggagatcctgaaggagaagaactacttcagcgagaaggagaagagaaccatcgacttcgtgcaccaggtggagaagctgtacctgggccacttccaggagaacatgcagatccagagcttccccagatactggatcaaggagcaggacttcttcaagcacaagagcgtgctggacagcttcctgaagtacgactgcaaggacgagttcaacaagcaggaccacagaatcgtgctgaactgggccctgtggtgggaccagctgacccaggagagcatcctgctgcccagaatcagccccgaggagtacaagagctacagccccgaggccctgtggagatacctgaccgccagacacgactggctgaacatcatcctgtggatcggcgagttccagacccagcacagctacgccagcctgcagcagaacaagtggcccctgctgaccgtggacgtgatcaaccagaacaccagctgcaacaactacatgagaaacgagatcctggacaagctggccagaaacggcgtgttcctggccagcgagctggaggacttcgagtgcttcctgctgagactgagcagaatcggcggcgtgatccaggacaccctgcccgtgcagaactacaagaccaaggagggctgggacttccacagccagttcatcctgtactgcctggagcacagcctgcagcacctgctgtacgtgtacctggactgctacaagctgagccccgagaactgccccttcctggagaagaaggagctgcacgaggcccacccctggttcgagttcctggtgcagtgcagacaggtggccagcaacctgaccgaccccaagctgatcttccaggccagcctggccaacgcccagatcctgatccccaccaaccaggccagcgtgagcagcatgctgctggagggccacaccctgctggccctggccaccaccatgtacagccccggcggcgtgagccaggtggtgcagaacgaggagaacgagaactgcctgaagaaggtggacccccagctgctgaagatggccctgaccccctaccccaagctgaagaccgccctgttcccccagtgcaccccccccagcgtgctgcccagcgacatcaccatctaccacctgatccagagcctgagccccttcgaccccagcagactgttcggctggcagagcgccaacaccctggccatcggcgacgcctggagccacctgccccacttcagcagccccgacctggtgaacaagtacgccatcgtggagagactgaacttcgcctactacctgcacaacggcagacccagcttcgccttcggcaccttcctggtgcaggagctgatcaagagcaagacccccaagcagctgatccagcaggtgggcaacgaggcctacgtgatcggcctgagcagcttccacatccccagcatcggcgccgcctgcgtgtgcttcctggagctgctgggcctggacagcctgaagctgagagtggacatgaaggtggccaacatcatcctgagctacaagtgcagaaacgaggacgcccagtacagcttcatcagagagagcgtggccgagaagctgagcaagctggccgacggcgagaagaccaccaccgaggagctgctggtgctgctggaggagggcacctggaacagcatccagcagcaggagatcaagagactgagcagcgagagcagcagccagtgggccctggtggtgcagttctgcagactgcacaacatgaagctgagcatcagctacctgagagagtgcgccaaggccaacgactggctgcagttcatcatccacagccagctgcacaactaccaccccgccgaggtgaagagcctgatccagtacttcagccccgtgatccaggaccacctgagactggccttcgagaacctgcccagcgtgcccaccagcaagatggacagcgaccaggtgtgcaacaagtgcccccaggagctgcagggcagcaagcaggagatgaccgacctgttcgagatcctgctgcagtgcagcgaggagcccgacagctggcactggctgctggtggaggccgtgaagcagcaggcccccatcctgagcgtgctggccagctgcctgcagggcgccagcgccatcagctgcctgtgcgtgtggatcatcaccagcgtggaggacaacgtggccaccgaggccatgggccacatccaggacagcaccgaggaccacacctggaacctggaggacctgagcgtgatctggagaaccctgctgaccagacagaagagcaagaccctgatcagaggcttccagctgttcttcaaggacagccccctgctgctggtgatggagatgtacgagctgtgcatgttcttcagaaactacaaggaggccgaggccaagctgctggagttccagaagagcctggagaccctgaacaccgccgccaccaaggtgcaccccgtgatccccgccatgtggctggaggaccaggtgtgcttcctgctgaagctgatgctgcagcagtgcaagacccagtacgagctgggcaagctgctgcagctgttcgtggagagagagcacctgttcagcgacggccccgacgtgaagaagctgtgcatcctgtgccagatcctgaaggacaccagcatcgccatcaaccacaccatcatcaccagctacagcatcgagaacctgcagcacgagtgcagaagcatcctggagagactgcagaccgacggccagttcgccctggccagaagagtggccgagctggccgagctgcccgtggacaacctggtgatcaaggagatcacccaggagatgcagaccctgaagcacatcgagcagtggagcctgaagcaggccagaatcgacttctggaagaagtgccacgagaacttcaagaagaacagcatcagcagcaaggccgccagcagcttcttcagcacccaggcccacgtggcctgcgagcaccccaccggctggagcagcatggaggagagacacctgctgctgaccctggccggccactggctggcccaggaggacgtggtgcccctggacaagctggaggagctggagaagcagatctggctgtgcagaatcacccagcacaccctgggcagaaaccaggaggagaccgagcccagattcagcagacagatcagcaccagcggcgagctgagcttcgacagcctggccagcgagttcagcttcagcaagctggccgccctgaacaccagcaagtacctggagctgaacagcctgcccagcaaggagacctgcgagaacagactggactggaaggagcaggagagcctgaacttcctgatcggcagactgctggacgacggctgcgtgcacgaggccagcagagtgtgcagatacttccacttctacaaccccgacgtggccctggtgctgcactgcagagccctggccagcggcgaggccagcatggaggacctgcaccccgagatccacgccctgctgcagagcgccgagctgctggaggaggaggcccccgacatccccctgagaagagtgcacagcagacacaagcagatgttcaaccccaccgaggagagccagaccttcctgcagctgaccaccctgtgccaggacagaaccctggtgggcatgaagctgctggacaagatcagcagcgtgccccacggcgagctgagctgcaccaccgagctgctgatcctggcccaccactgcttcaccctgacctgccacatggagggcatcatcagagtgctgcaggccgcccacatgctgaccgacaaccacctggcccccagcgaggagtacggcctggtggtgagactgctgaccggcatcggcagatacaacgagatgacctacatcttcgacctgctgcacaagaagcactacttcgaggtgctgatgagaaagaagctggaccccagcggcaccctgaagaccgccctgctggactacatcaagagatgcagacccggcgacagcgagaagcacaacatgatcgccctgtgcttcagcatgtgcagagagatcggcgagaaccacgaggccgccgccagaatccagctgaagctgatcgagagccagccctgggaggacagcctgaaggacggccaccagctgaagcagctgctgctgaaggccctgaccctgatgctggacgccgccgagagctacgccaaggacagctgcgtgagacaggcccagcactgccagagactgaccaagctgatcaccctgcagatccacttcctgaacaccggccagaacaccatgctgatcaacctgggcagacacaagctgatggactgcatcctggccctgcccagattctaccaggccagcatcgtggccgaggcctacgacttcgtgcccgactgggccgagatcctgtaccagcaggtgatcctgaagggcgacttcaactacctggaggagttcaagcagcagagactgctgaagagcagcatcttcgaggagatcagcaagaagtacaagcagcaccagcccaccgacatggtgatggagaacctgaagaagctgctgacctactgcgaggacgtgtacctgtactacaagctggcctacgagcacaagttctacgagatcgtgaacgtgctgctgaaggacccccagaccggctgctgcctgaaggacatgctggccggctag

SEQ ID NO: 100458 - DNA, 6240 bp, Artificial Sequence
  Description of Artificial Sequence: Synthetic coding sequence
atggccgccgaggagggcgtggccagcgccgccagcgccggcggcagctggggcaccgccgccatgggcagagtgctgcccatgctgctggtgcccgtgcccgccgaggccatgggccagctgggcagcagagcccagctgagaacccagcccgaggccctgggcagcctgaccgccgccggcagcctgcaggtgctgagcctgacccccggcagcagaggcggcggcagatgctgcctggagggccccttctggcacttcctgtgggaggacagcagaaacagcagcacccccaccgagaagcccaagctgctggccctgggcgagaactacgagctgctgatctacgagttcaacctgaaggacggcagatgcgacgccaccatcctgtacagctgcagcagagaggccctgcagaagctgatcgacgaccaggacatcagcatcagcctgctgagcctgagaatcctgagcttccacaacaacaccagcctgctgttcatcaacaagtgcgtgatcctgcacatcatcttccccgagagagacgccgccatcagagtgctgaactgcttcaccctgcccctgcccgcccaggccgtggacatgatcatcgacacccagctgtgcagaggcatcctgttcgtgctgagcagcctgggctggatctacatcttcgacgtggtggacggcacctacgtggcccacgtggacctggccctgcacaaggaggacatgtgcaacgagcagcagcaggagcccgccaagatcagcagcttcaccagcctgaaggtgagccaggacctggacgtggccgtgatcgtgagcagcagcaacagcgccgtggccctgaacctgaacctgtacttcagacagcaccccggccacctgctgtgcgagagaatcctggaggacctgcccatccagggccccaagggcgtggacgaggacgaccccgtgaacagcgcctacaacatgaagctggccaagttcagcttccagatcgacagaagctggaaggcccagctgagcagcctgaacgagaccatcaagaacagcaagctggaggtgagctgctgcgccccctggttccaggacatcctgcacctggagagccccgagagcggcaaccacagcaccagcgtgcagagctgggccttcatcccccaggacatcatgcacggccagtacaacgtgctgcagaaggaccacgccaagaccagcgaccccggcagaagctggaagatcatgcacatcagcgagcaggaggagcccatcgagctgaagtgcgtgagcgtgaccggcttcaccgccctgttcacctgggaggtggagagaatgggctacaccatcaccctgtgggacctggagacccagggcatgcagtgcttcagcctgggcaccaagtgcatccccgtggacagcagcggcgaccagcagctgtgcttcgtgctgaccgagaacggcctgagcctgatcctgttcggcctgacccaggaggagttcctgaacagactgatgatccacggcagcgccagcaccgtggacaccctgtgccacctgaacggctggggcagatgcagcatccccatccacgccctggaggccggcatcgagaacagacagctggacaccgtgaacttcttcctgaagagcaaggagaacctgttcaaccccagcagcaagagcagcgtgagcgaccagttcgaccacctgagcagccacctgtacctgagaaacgtggaggagctgatccccgccctggacctgctgtgcagcgccatcagagagagctacagcgagccccagagcaagcacttcagcgagcagctgctgaacctgaccctgagcttcctgaacaaccagatcaaggagctgttcatccacaccgaggagctggacgagcacctgcagaagggcgtgaacatcctgaccagctacatcaacgagctgagaaccttcatgatcaagttcccctggaagctgaccgacgccatcgacgagtacgacgtgcacgagaacgtgcccaaggtgaaggagagcaacatctggaagaagctgagcttcgaggaggtgatcgccagcgccatcctgaacaacaagatccccgaggcccagaccttcttcagaatcgacagccacagcgcccagaagctggaggagctgatcggcatcggcctgaacctggtgttcgacaacctgaagaagaacaacatcaaggaggccagcgagctgctgaagaacatgggcttcgacgtgaagggccagctgctgaagatctgcttctacaccaccaacaagaacatcagagacttcctggtggagatcctgaaggagaagaactacttcagcgagaaggagaagagaaccatcgacttcgtgcaccaggtggagaagctgtacctgggccacttccaggagaacatgcagatccagagcttccccagatactggatcaaggagcaggacttcttcaagcacaagagcgtgctggacagcttcctgaagtacgactgcaaggacgagttcaacaagcaggaccacagaatcgtgctgaactgggccctgtggtgggaccagctgacccaggagagcatcctgctgcccagaatcagccccgaggagtacaagagctacagccccgaggccctgtggagatacctgaccgccagacacgactggctgaacatcatcctgtggatcggcgagttccagacccagcacagctacgccagcctgcagcagaacaagtggcccctgctgaccgtggacgtgatcaaccagaacaccagctgcaacaactacatgagaaacgagatcctggacaagctggccagaaacggcgtgttcctggccagcgagctggaggacttcgagtgcttcctgctgagactgagcagaatcggcggcgtgatccaggacaccctgcccgtgcagaactacaagaccaaggagggctgggacttccacagccagttcatcctgtactgcctggagcacagcctgcagcacctgctgtacgtgtacctggactgctacaagctgagccccgagaactgccccttcctggagaagaaggagctgcacgaggcccacccctggttcgagttcctggtgcagtgcagacaggtggccagcaacctgaccgaccccaagctgatcttccaggccagcctggccaacgcccagatcctgatccccaccaaccaggccagcgtgagcagcatgctgctggagggccacaccctgctggccctggccaccaccatgtacagccccggcggcgtgagccaggtggtgcagaacgaggagaacgagaactgcctgaagaaggtggacccccagctgctgaagatggccctgaccccctaccccaagctgaagaccgccctgttcccccagtgcaccccccccagcgtgctgcccagcgacatcaccatctaccacctgatccagagcctgagccccttcgaccccagcagactgttcggctggcagagcgccaacaccctggccatcggcgacgcctggagccacctgccccacttcagcagccccgacctggtgaacaagtacgccatcgtggagagactgaacttcgcctactacctgcacaacggcagacccagcttcgccttcggcaccttcctggtgcaggagctgatcaagagcaagacccccaagcagctgatccagcaggtgggcaacgaggcctacgtgatcggcctgagcagcttccacatccccagcatcggcgccgcctgcgtgtgcttcctggagctgctgggcctggacagcctgaagctgagagtggacatgaaggtggccaacatcatcctgagctacaagtgcagaaacgaggacgcccagtacagcttcatcagagagagcgtggccgagaagctgagcaagctggccgacggcgagaagaccaccaccgaggagctgctggtgctgctggaggagggcacctggaacagcatccagcagcaggagatcaagagactgagcagcgagagcagcagccagtgggccctggtggtgcagttctgcagactgcacaacatgaagctgagcatcagctacctgagagagtgcgccaaggccaacgactggctgcagttcatcatccacagccagctgcacaactaccaccccgccgaggtgaagagcctgatccagtacttcagccccgtgatccaggaccacctgagactggccttcgagaacctgcccagcgtgcccaccagcaagatggacagcgaccaggtgtgcaacaagtgcccccaggagctgcagggcagcaagcaggagatgaccgacctgttcgagatcctgctgcagtgcagcgaggagcccgacagctggcactggctgctggtggaggccgtgaagcagcaggcccccatcctgagcgtgctggccagctgcctgcagggcgccagcgccatcagctgcctgtgcgtgtggatcatcaccagcgtggaggacaacgtggccaccgaggccatgggccacatccaggacagcaccgaggaccacacctggaacctggaggacctgagcgtgatctggagaaccctgctgaccagacagaagagcaagaccctgatcagaggcttccagctgttcttcaaggacagccccctgctgctggtgatggagatgtacgagctgtgcatgttcttcagaaactacaaggaggccgaggccaagctgctggagttccagaagagcctggagaccctgaacaccgccgccaccaaggtgcaccccgtgatccccgccatgtggctggaggaccaggtgtgcttcctgctgaagctgatgctgcagcagtgcaagacccagtacgagctgggcaagctgctgcagctgttcgtggagagagagcacctgttcagcgacggccccgacgtgaagaagctgtgcatcctgtgccagatcctgaaggacaccagcatcgccatcaaccacaccatcatcaccagctacagcatcgagaacctgcagcacgagtgcagaagcatcctggagagactgcagaccgacggccagttcgccctggccagaagagtggccgagctggccgagctgcccgtggacaacctggtgatcaaggagatcacccaggagatgcagaccctgaagcacatcgagcagtggagcctgaagcaggccagaatcgacttctggaagaagtgccacgagaacttcaagaagaacagcatcagcagcaaggccgccagcagcttcttcagcacccaggcccacgtggcctgcgagcaccccaccggctggagcagcatggaggagagacacctgctgctgaccctggccggccactggctggcccaggaggacgtggtgcccctggacaagctggaggagctggagaagcagatctggctgtgcagaatcacccagcacaccctgggcagaaaccaggaggagaccgagcccagattcagcagacagatcagcaccagcggcgagctgagcttcgacagcctggccagcgagttcagcttcagcaagctggccgccctgaacaccagcaagtacctggagctgaacagcctgcccagcaaggagacctgcgagaacagactggactggaaggagcaggagagcctgaacttcctgatcggcagactgctggacgacggctgcgtgcacgaggccagcagagtgtgcagatacttccacttctacaaccccgacgtggccctggtgctgcactgcagagccctggccagcggcgaggccagcatggaggacctgcaccccgagatccacgccctgctgcagagcgccgagctgctggaggaggaggcccccgacatccccctgagaagagtgcacagcaccagcagcctggacagccagaagttcgtgaccgtgcccagcagcaacgaggtggtgaccaacctggaggtgctgaccagcaagtgcctgcacggcaagaactactgcagacaggtgctgtgcctgtacgacctggccaaggagctgggctgcagctacaccgacgtggccgcccaggacggcgaggccatgctgagaaagatcctggccagccagcagcccgacagatgcaagagagcccaggccttcatcagcacccagggcctgaagcccgacaccgtggccgagctggtggccgaggaggtgaccagagagctgctgaccagcagccagggcaccggcgccctgccccccggcgacagccagcccctgtag

SEQ ID NO: 100459 - DNA, 2001 bp, Artificial Sequence
  Description of Artificial Sequence: Synthetic coding sequence
atggagcaggagccccagaacggcgagcccgccgagatcaagatcatcagagaggcctacaagaaggccttcctgttcgtgaacaagggcctgaacaccgacgagctgggccagaaggaggaggccaagaactactacaagcagggcatcggccacctgctgagaggcatcagcatcagcagcaaggagagcgagcacaccggccccggctgggagagcgccagacagatgcagcagaagatgaaggagaccctgcagaacgtgagaaccagactggagatcctggagaagggcctggccaccagcctgcagaacgacctgcaggaggtgcccaagctgtaccccgagttcccccccaaggacatgtgcgagaagctgcccgagccccagagcttcagcagcgccccccagcacgccgaggtgaacggcaacaccagcacccccagcgccggcgccgtggccgcccccgccagcctgagcctgcccagccagagctgccccgccgaggccccccccgcctacaccccccaggccgccgagggccactacaccgtgagctacggcaccgacagcggcgagttcagcagcgtgggcgaggagttctacagaaaccacagccagcccccccccctggagaccctgggcctggacgccgacgagctgatcctgatccccaacggcgtgcagatcttcttcgtgaaccccgccggcgaggtgagcgcccccagctaccccggctacctgagaatcgtgagattcctggacaacagcctggacaccgtgctgaacagaccccccggcttcctgcaggtgtgcgactggctgtaccccctggtgcccgacagaagccccgtgctgaagtgcaccgccggcgcctacatgttccccgacaccatgctgcaggccgccggctgcttcgtgggcgtggtgctgagcagcgagctgcccgaggacgacagagagctgttcgaggacctgctgagacagatgagcgacctgagactgcaggccaactggaacagagccgaggaggagaacgagttccagatccccggcagaaccagacccagcagcgaccagctgaaggaggccagcggcaccgacgtgaagcagctggaccagggcaacaaggacgtgagacacaagggcaagagaggcaagagagccaaggacaccagcagcgaggaggtgaacctgagccacatcgtgccctgcgagcccgtgcccgaggagaagcccaaggagctgcccgagtggagcgagaaggtggcccacaacatcctgagcggcgccagctgggtgagctggggcctggtgaagggcgccgagatcaccggcaaggccatccagaagggcgccagcaagctgagagagagaatccagcccgaggagaagcccgtggaggtgagccccgccgtgaccaagggcctgtacatcgccaagcaggccaccggcggcgccgccaaggtgagccagttcctggtggacggcgtgtgcaccgtggccaactgcgtgggcaaggagctggccccccacgtgaagaagcacggcagcaagctggtgcccgagagcctgaagaaggacaaggacggcaagagccccctggacggcgccatggtggtggccgccagcagcgtgcagggcttcagcaccgtgtggcagggcctggagtgcgccgccaagtgcatcgtgaacaacgtgagcgccgagaccgtgcagaccgtgagatacaagtacggctacaacgccggcgaggccacccaccacgccgtggacagcgccgtgaacgtgggcgtgaccgcctacaacatcaacaacatcggcatcaaggccatggtgaagaagaccgccacccagaccggccacaccctgctggaggactaccagatcgtggacaacagccagagagagaaccaggagggcgccgccaacgtgaacgtgagaggcgagaaggacgagcagaccaaggaggtgaaggaggccaagaagaaggacaagtag

SEQ ID NO: 100460 - DNA, 2001 bp, Artificial Sequence; identical to SEQ ID NO: 100459
  Description of Artificial Sequence: Synthetic coding sequence

SEQ ID NO: 100461 - DNA, 2001 bp, Artificial Sequence; identical to SEQ ID NO: 100459
  Description of Artificial Sequence: Synthetic coding sequence

SEQ ID NO: 100462 - DNA, 2001 bp, Artificial Sequence; identical to SEQ ID NO: 100459
  Description of Artificial Sequence: Synthetic coding sequence

SEQ ID NO: 100463 - DNA, 846 bp, Artificial Sequence
  Description of Artificial Sequence: Synthetic coding sequence
atgggcgagatcaaggtgagccccgactacaactggttcagaggcaccgtgcccctgaagaagatcatcgtggacgacgacgacagcaagatctggagcctgtacgacgccggccccagaagcatcagatgccccctgatcttcctgccccccgtgagcggcaccgccgacgtgttcttcagacagatcctggccctgaccggctggggctacagagtgatcgccgtgcacctgttcggcgccagcctgggcggcttcctggcccagaagttcgccgagtacacccacaagagccccagagtgcacagcctgatcctgtgcaacagcttcagcgacaccagcatcttcaaccagacctggaccgccaacagcttctggctgatgcccgccttcatgctgaagaagatcgtgctgggcaacttcagcagcggccccgtggaccccatgatggccgacgccatcgacttcatggtggacagactggagagcctgggccagagcgagctggccagcagactgaccctgaactgccagaacagctacgtggagccccacaagatcagagacatccccgtgaccatcatggacgtgttcgaccagagcgccctgagcaccgaggccaaggaggagatgtacaagctgtaccccaacgccagaagagcccacctgaagaccggcggcaacttcccctacctgtgcagaagcgccgaggtgaacctgtacgtgcagatccacctgctgcagttccacggcaccaagtacgccgccatcgaccccagcatggtgagcgccgaggagctggaggtgcagaagggcagcctgggcatcagccaggaggagcagtag

SEQ ID NO: 100464 - DNA, 927 bp, Artificial Sequence
  Description of Artificial Sequence: Synthetic coding sequence
atgggcgagatcaaggtgagccccgactacaactggttcagaggcaccgtgcccctgaagaagatcatcgtggacgacgacgacagcaagatctggagcctgtacgacgccggccccagaagcatcagatgccccctgatcttcctgccccccgtgagcggcaccgccgacgtgttcttcagacagatcctggccctgaccggctggggctacagagtgatcgccctgcagtaccccgtgtactgggaccacctggagttctgcgacggcttcagaaagctgctggaccacctgcagctggacaaggtgcacctgttcggcgccagcctgggcggcttcctggcccagaagttcgccgagtacacccacaagagccccagagtgcacagcctgatcctgtgcaacagcttcagcgacaccagcatcttcaaccagacctggaccgccaacagcttctggctgatgcccgccttcatgctgaagaagatcgtgctgggcaacttcagcagcggccccgtggaccccatgatggccgacgccatcgacttcatggtggacagactggagagcctgggccagagcgagctggccagcagactgaccctgaactgccagaacagctacgtggagccccacaagatcagagacatccccgtgaccatcatggacgtgttcgaccagagcgccctgagcaccgaggccaaggaggagatgtacaagctgtaccccaacgccagaagagcccacctgaagaccggcggcaacttcccctacctgtgcagaagcgccgaggtgaacctgtacgtgcagatccacctgctgcagttccacggcaccaagtacgccgccatcgaccccagcatggtgagcgccgaggagctggaggtgcagaagggcagcctgggcatcagccaggaggagcagtag

SEQ ID NO: 100465 - DNA, 927 bp, Artificial Sequence; identical to SEQ ID NO: 100464
  Description of Artificial Sequence: Synthetic coding sequence

SEQ ID NO: 100466 - DNA, 2388 bp, Artificial Sequence
  Description of Artificial Sequence: Synthetic coding sequence
atggccgtgctgctgctgctgctgagagccctgagaagaggccccggccccggccccagacccctgtggggccccggccccgcctggagccccggcttccccgccagacccggcagaggcagaccctacatggccagcagaccccccggcgacctggccgaggccggcggcagagccctgcagagcctgcagctgagactgctgacccccaccttcgagggcatcaacggcctgctgctgaagcagcacctggtgcagaaccccgtgagactgtggcagctgctgggcggcaccttctacttcaacaccagcagactgaagcagaagaacaaggagaaggacaagagcaagggcaaggcccccgaggaggacgaggaggagagaagaagaagagagagagacgaccagatgtacagagagagactgagaaccctgctggtgatcgccgtggtgatgagcctgctgaacgccctgagcaccagcggcggcagcatcagctggaacgacttcgtgcacgagatgctggccaagggcgaggtgcagagagtgcaggtggtgcccgagagcgacgtggtggaggtgtacctgcaccccggcgccgtggtgttcggcagacccagactggccctgatgtacagaatgcaggtggccaacatcgacaagttcgaggagaagctgagagccgccgaggacgagctgaacatcgaggccaaggacagaatccccgtgagctacaagagaaccggcttcttcggcaacgccctgtacagcgtgggcatgaccgccgtgggcctggccatcctgtggtacgtgttcagactggccggcatgaccggcagagagggcggcttcagcgccttcaaccagctgaagatggccagattcaccatcgtggacggcaagatgggcaagggcgtgagcttcaaggacgtggccggcatgcacgaggccaagctggaggtgagagagttcgtggactacctgaagagccccgagagattcctgcagctgggcgccaaggtgcccaagggcgccctgctgctgggcccccccggctgcggcaagaccctgctggccaaggccgtggccaccgaggcccaggtgcccttcctggccatggccggccccgagttcgtggaggtgatcggcggcctgggcgccgccagagtgagaagcctgttcaaggaggccagagccagagccccctgcatcgtgtacatcgacgagatcgacgccgtgggcaagaagagaagcaccaccatgagcggcttcagcaacaccgaggaggagcagaccctgaaccagctgctggtggagatggacggcatgggcaccaccgaccacgtgatcgtgctggccagcaccaacagagccgacatcctggacggcgccctgatgagacccggcagactggacagacacgtgttcatcgacctgcccaccctgcaggagagaagagagatcttcgagcagcacctgaagagcctgaagctgacccagagcagcaccttctacagccagagactggccgagctgacccccggcttcagcggcgccgacatcgccaacatctgcaacgaggccgccctgcacgccgccagagagggccacaccagcgtgcacaccctgaacttcgagtacgccgtggagagagtgctggccggcaccgccaagaagagcaagatcctgagcaaggaggagcagaaggtggtggccttccacgagagcggccacgccctggtgggctggatgctggagcacaccgaggccgtgatgaaggtgagcatcacccccagaaccaacgccgccctgggcttcgcccagatgctgcccagagaccagcacctgttcaccaaggagcagctgttcgagagaatgtgcatggccctgggcggcagagccagcgaggccctgagcttcaacgaggtgaccagcggcgcccaggacgacctgagaaaggtgaccagaatcgcctacagcatggtgaagcagttcggcatggcccccggcatcggccccatcagcttccccgaggcccaggagggcctgatgggcatcggcagaagacccttcagccagggcctgcagcagatgatggaccacgaggccagactgctggtggccaaggcctacagacacaccgagaaggtgctgcaggacaacctggacaagctgcaggccctggccaacgccctgctggagaaggaggtgatcaactacgaggacatcgaggccctgatcggcccccccccccacggccccaagaagatgatcgccccccagagatggatcgacgcccagagagagaagcaggacctgggcgaggaggagaccgaggagacccagcagccccccctgggcggcgaggagcccacctggcccaagtag

SEQ ID NO: 100467 - DNA, 672 bp, Artificial Sequence
  Description of Artificial Sequence: Synthetic coding sequence
atgagactgagatgcaccagaagaggcagagacaccctgccctgcaccctgagcaccagcagcaccccctggagcgccagcagccaggtgcccagagcccagctgggcaaggccgtgggcagctgcagaggcgtgggcagctgctgcgccagacactgcaagacccacctggccagcctgagacagccctgcggcgagagaaccggcgccgcctgcgtgctgctgatctacttcagagtgaccatctacttctacgtggagatcgagaagctgctgatcatcgtggccaagcaggagggcctgagcggcaaccacaagcccgtggagagaaagtacatgacctacctgagcgcccaggaccacgagctgatccaggtggtgcagaacggccacctgcagatgtgcggcaagagcgagaccggcaacgaggccagccccggcctgcccaagagagccagaagctgccccagaaagaacagaaagtggctgagattcatgagcagagccaccccctggtgggccggctgctggagcaccagaagagacgagggcctgcacaaccccagcaccaacgccgccctgggcttcgcccaggccccccagagacccgcccccctgcacgagcagctgttcgagagaatgtgcatggccctgggcggcagagccagctag

SEQ ID NO: 100468 - DNA, 618 bp, Artificial Sequence
  Description of Artificial Sequence: Synthetic coding sequence
ctgggcccccaggcctgcaccgtggtgcccagaagcaagtgcttcgacctggagatggtgagcagcagatgggagcccctgctgctgctgaccgaggtgaccagcgccaacgaggtgtgggtgaccagcaacagcaccgccctggtgttcgtgagcgacaacgtgagagaggagctggaggaggtgcaggacctgctgtgcagaaccctgcccctgcccgtgcagctgagcttccccgaggaggccctggacgtggccagagtggcccacgtgttcgtgagccccttctgcttcagcgccggcagcgaggagagaagaagaagagagagagacgaccagatgtacagagagagactgagaaccctgctggtgatcgccgtggtgatgagcctgctgaacgccctgagcaccagcggcggcagcatcagctggaacgacttcgtgcacgagatgctggccaagggcgaggtgcagagagtgcaggtggtgcccgagagcgacgtggtggaggtgtacctgcaccccggcgccgtggtgttcggcagacccagactggccctgatgtacagaatgcaggtggccaacatcgacaagttcgaggagaagctgagagcctag

SEQ ID NO: 100469 - DNA, 1470 bp, Artificial Sequence
  Description of Artificial Sequence: Synthetic coding sequence
atggccgtgctgctgctgctgctgagagccctgagaagaggccccggccccggccccagacccctgtggggccccggccccgcctggagccccggcttccccgccagacccggcagaggcagaccctacatggccagcagaccccccggcgacctggccgaggccggcggcagagccctgcagagcctgcagctgagactgctgacccccaccttcgagggcatcaacggcctgctgctgaagcagcacctggtgcagaaccccgtgagactgtggcagctgctgggcggcaccttctacttcaacaccagcagactgaagcagaagaacaaggagaaggacaagagcaagggcaaggcccccgaggaggacgaggaggagagaagaagaagagagagagacgaccagatgtacagagagagactgagaaccctgctggtgatcgccgtggtgatgagcctgctgaacgccctgagcaccagcggcggcagcatcagctggaacgacttcgtgcacgagatgctggccaagggcgaggtgcagagagtgcaggtggtgcccgagagcgacgtggtggaggtgtacctgcaccccggcgccgtggtgttcggcagacccagactggccctgatgtacagaatgcaggtggccaacatcgacaagttcgaggagaagctgagagccgccgaggacgagctgaacatcgaggccaaggacagaatccccgtgagctacaagagaaccggcttcttcggcaacgccctgtacagcgtgggcatgaccgccgtgggcctggccatcctgtggtacgtgttcagactggccggcatgaccggcagagagggcggcttcagcgccttcaaccagctgaagatggccagattcaccatcgtggacggcaagatgggcaagggcgtgagcttcaaggacgtggccggcatgcacgaggccaagctggaggtgagagagttcgtggactacctgaagagccccgagagattcctgcagctgggcgccaaggtgcccaagggcgccctgctgctgggcccccccggctgcggcaagaccctgctggccaaggccgtggccaccgaggcccaggtgcccttcctggccatggccggccccgagttcgtggaggtgatcggcggcctgggcgccgccagagtgagaagcctgttcaaggaggccagagccagagccccctgcatcgtgtacatcgacgagatcgacgccgtgggcaagaagagaagcaccaccatgagcggcttcagcaacaccgaggaggagcagaccctgaaccagctgctggtggagatggacggcgccagcctggaccagctgcccagccagggcaccatgagaaagctgagaggcaagacccccgcctgcagctgcctgaccgagcccaccggcagcagaagagccatggagggccacagcctgtgctggggctgcctgctgcactag

SEQ ID NO: 100470 - DNA, 1851 bp, Artificial Sequence
  Description of Artificial Sequence: Synthetic coding sequence
atgaacagccccggcggcagaggcaagaagaagggcagcggcggcgccagcaaccccgtgccccccagacccccccccccctgcctggcccccgccccccccgccgccggccccgcccccccccccgagagcccccacaagagaaacctgtactacttcagctaccccctgttcgtgggcttcgccctgctgagactggtggccttccacctgggcctgctgttcgtgtggctgtgccagagattcagcagagccctgatggccgccaagagaagcagcggcgccgcccccgcccccgccagcgccagcgcccccgcccccgtgcccggcggcgaggccgagagagtgagagtgttccacaagcaggccttcgagtacatcagcatcgccctgagaatcgacgaggacgagaaggccggccagaaggagcaggccgtggagtggtacaagaagggcatcgaggagctggagaagggcatcgccgtgatcgtgaccggccagggcgagcagtgcgagagagccagaagactgcaggccaagatgatgaccaacctggtgatggccaaggacagactgcagctgctggagaagatgcagcccgtgctgcccttcagcaagagccagaccgacgtgtacaacgacagcaccaacctggcctgcagaaacggccacctgcagagcgagagcggcgccgtgcccaagagaaaggaccccctgacccacaccagcaacagcctgcccagaagcaagaccgtgatgaagaccggcagcgccggcctgagcggccaccacagagcccccagctacagcggcctgagcatggtgagcggcgtgaagcagggcagcggccccgcccccaccacccacaagggcacccccaagaccaacagaaccaacaagcccagcacccccaccaccgccaccagaaagaagaaggacctgaagaacttcagaaacgtggacagcaacctggccaacctgatcatgaacgagatcgtggacaacggcaccgccgtgaagttcgacgacatcgccggccaggacctggccaagcaggccctgcaggagatcgtgatcctgcccagcctgagacccgagctgttcaccggcctgagagcccccgccagaggcctgctgctgttcggcccccccggcaacggcaagaccatgctggccaaggccgtggccgccgagagcaacgccaccttcttcaacatcagcgccgccagcctgaccagcaagtacgtgggcgagggcgagaagctggtgagagccctgttcgccgtggccagagagctgcagcccagcatcatcttcatcgacgaggtggacagcctgctgtgcgagagaagagagggcgagcacgacgccagcagaagactgaagaccgagttcctgatcgagttcgacggcgtgcagagcgccggcgacgacagagtgctggtgatgggcgccaccaacagaccccaggagctggacgaggccgtgctgagaagattcatcaagagagtgtacgtgagcctgcccaacgaggagaccagactgctgctgctgaagaacctgctgtgcaagcagggcagccccctgacccagaaggagctggcccagctggccagaatgaccgacggctacagcggcagcgacctgaccgccctggccaaggacgccgccctgggccccatcagagagctgaagcccgagcaggtgaagaacatgagcgccagcgagatgagaaacatcagactgagcgacttcaccgagagcctgaagaagatcaagagaagcgtgagcccccagaccctggaggcctacatcagatggaacaaggacttcggcgacaccaccgtgtag

SEQ ID NO: 100471 - DNA, 1755 bp, Artificial Sequence
  Description of Artificial Sequence: Synthetic coding sequence
atgaacagccccggcggcagaggcaagaagaagggcagcggcggcgccagcaaccccgtgccccccagacccccccccccctgcctggcccccgccccccccgccgccggccccgcccccccccccgagagcccccacaagagaaacctgtactacttcagctaccccctgttcgtgggcttcgccctgctgagactggtggccttccacctgggcctgctgttcgtgtggctgtgccagagattcagcagagccctgatggccgccaagagaagcagcggcgccgcccccgcccccgccagcgccagcgcccccgcccccgtgcccggcggcgaggccgagagagtgagagtgttccacaagcaggccttcgagtacatcagcatcgccctgagaatcgacgaggacgagaaggccggccagaaggagcaggccgtggagtggtacaagaagggcatcgaggagctggagaagggcatcgccgtgatcgtgaccggccagggcgagcagtgcgagagagccagaagactgcaggccaagatgatgaccaacctggtgatggccaaggacagactgcagctgctggagagcggcgccgtgcccaagagaaaggaccccctgacccacaccagcaacagcctgcccagaagcaagaccgtgatgaagaccggcagcgccggcctgagcggccaccacagagcccccagctacagcggcctgagcatggtgagcggcgtgaagcagggcagcggccccgcccccaccacccacaagggcacccccaagaccaacagaaccaacaagcccagcacccccaccaccgccaccagaaagaagaaggacctgaagaacttcagaaacgtggacagcaacctggccaacctgatcatgaacgagatcgtggacaacggcaccgccgtgaagttcgacgacatcgccggccaggacctggccaagcaggccctgcaggagatcgtgatcctgcccagcctgagacccgagctgttcaccggcctgagagcccccgccagaggcctgctgctgttcggcccccccggcaacggcaagaccatgctggccaaggccgtggccgccgagagcaacgccaccttcttcaacatcagcgccgccagcctgaccagcaagtacgtgggcgagggcgagaagctggtgagagccctgttcgccgtggccagagagctgcagcccagcatcatcttcatcgacgaggtggacagcctgctgtgcgagagaagagagggcgagcacgacgccagcagaagactgaagaccgagttcctgatcgagttcgacggcgtgcagagcgccggcgacgacagagtgctggtgatgggcgccaccaacagaccccaggagctggacgaggccgtgctgagaagattcatcaagagagtgtacgtgagcctgcccaacgaggagaccagactgctgctgctgaagaacctgctgtgcaagcagggcagccccctgacccagaaggagctggcccagctggccagaatgaccgacggctacagcggcagcgacctgaccgccctggccaaggacgccgccctgggccccatcagagagctgaagcccgagcaggtgaagaacatgagcgccagcgagatgagaaacatcagactgagcgacttcaccgagagcctgaagaagatcaagagaagcgtgagcccccagaccctggaggcctacatcagatggaacaaggacttcggcgacaccaccgtgtag

SEQ ID NO: 100472 - DNA, 26394 bp, Artificial Sequence
  Description of Artificial Sequence: Synthetic coding sequence
atggccaccagcagaggcgccagcagatgccccagagacatcgccaacgtgatgcagagactgcaggacgagcaggagatcgtgcagaagagaaccttcaccaagtggatcaacagccacctggccaagagaaagccccccatggtggtggacgacctgttcgaggacatgaaggacggcgtgaagctgctggccctgctggaggtgctgagcggccagaagctgccctgcgagcagggcagaagaatgaagagaatccacgccgtggccaacatcggcaccgccctgaagttcctggagggcagaaagatcaagctggtgaacatcaacagcaccgacatcgccgacggcagacccagcatcgtgctgggcctgatgtggaccatcatcctgtacttccagatcgaggagctgaccagcaacctgccccagctgcagagcctgagcagcagcgccagcagcgtggacagcatcgtgagcagcgagacccccagcccccccagcaagagaaaggtgaccaccaagatccagggcaacgccaagaaggccctgctgaagtgggtgcagtacaccgccggcaagcagaccggcatcgaggtgaaggacttcggcaagagctggagaagcggcgtggccttccacagcgtgatccacgccatcagacccgagctggtggacctggagaccgtgaagggcagaagcaacagagagaacctggaggacgccttcaccatcgccgagaccgagctgggcatccccagactgctggaccccgaggacgtggacgtggacaagcccgacgagaagagcatcatgacctacgtggcccagttcctgaagcactaccccgacatccacaacgccagcaccgacggccaggaggacgacgagatcctgcccggcttccccagcttcgccaacagcgtgcagaacttcaagagagaggacagagtgatcttcaaggagatgaaggtgtggatcgagcagttcgagagagacctgaccagagcccagatggtggagagcaacctgcaggacaagtaccagagcttcaagcacttcagagtgcagtacgagatgaagagaaagcagatcgagcacctgatccagcccctgcacagagacggcaagctgagcctggaccaggccctggtgaagcagagctgggacagagtgaccagcagactgttcgactggcacatccagctggacaagagcctgcccgcccccctgggcaccatcggcgcctggctgtacagagccgaggtggccctgagagaggagatcaccgtgcagcaggtgcacgaggagaccgccaacaccatccagagaaagctggagcagcacaaggacctgctgcagaacaccgacgcccacaagagagccttccacgagatctacagaaccagaagcgtgaacggcatccccgtgccccccgaccagctggaggacatggccgagagattccacttcgtgagcagcaccagcgagctgcacctgatgaagatggagttcctggagctgaagtacagactgctgagcctgctggtgctggccgagagcaagctgaagagctggatcatcaagtacggcagaagagagagcgtggagcagctgctgcagaactacgtgagcttcatcgagaacagcaagttcttcgagcagtacgaggtgacctaccagatcctgaagcagaccgccgagatgtacgtgaaggccgacggcagcgtggaggaggccgagaacgtgatgaagttcatgaacgagaccaccgcccagtggagaaacctgagcgtggaggtgagaagcgtgagaagcatgctggaggaggtgatcagcaactgggacagatacggcaacaccgtggccagcctgcaggcctggctggaggacgccgagaagatgctgaaccagagcgagaacgccaagaaggacttcttcagaaacctgccccactggatccagcagcacaccgccatgaacgacgccggcaacttcctgatcgagacctgcgacgagatggtgagcagagacctgaagcagcagctgctgctgctgaacggcagatggagagagctgttcatggaggtgaagcagtacgcccaggccgacgagatggacagaatgaagaaggagtacaccgactgcgtggtgaccctgagcgccttcgccaccgaggcccacaagaagctgagcgagcccctggaggtgagcttcatgaacgtgaagctgctgatccaggacctggaggacatcgagcagagagtgcccgtgatggacgcccagtacaagatcatcaccaagaccgcccacctgatcaccaaggagagcccccaggaggagggcaaggagatgttcgccaccatgagcaagctgaaggagcagctgaccaaggtgaaggagtgctacagccccctgctgtacgagagccagcagctgctgatccccctggaggagctggagaagcagatgaccagcttctacgacagcctgggcaagatcaacgagatcatcaccgtgctggagagagaggcccagagcagcgccctgttcaagcagaagcaccaggagctgctggcctgccaggagaactgcaagaagaccctgaccctgatcgagaagggcagccagagcgtgcagaagttcgtgaccctgagcaacgtgctgaagcacttcgaccagaccagactgcagagacagatcgccgacatccacgtggccttccagagcatggtgaagaagaccggcgactggaagaagcacgtggagaccaacagcagactgatgaagaagttcgaggagagcagagccgagctggagaaggtgctgagaatcgcccaggagggcctggaggagaagggcgaccccgaggagctgctgagaagacacaccgagttcttcagccagctggaccagagagtgctgaacgccttcctgaaggcctgcgacgagctgaccgacatcctgcccgagcaggagcagcagggcctgcaggaggccgtgagaaagctgcacaagcagtggaaggacctgcagggcgaggccccctaccacctgctgcacctgaagatcgacgtggagaagaacagattcctggccagcgtggaggagtgcagaaccgagctggacagagagaccaagctgatgccccaggagggcagcgagaagatcatcaaggagcacagagtgttcttcagcgacaagggcccccaccacctgtgcgagaagagactgcagctgatcgaggagctgtgcgtgaagctgcccgtgagagaccccgtgagagacacccccggcacctgccacgtgaccctgaaggagctgagagccgccatcgacagcacctacagaaagctgatggaggaccccgacaagtggaaggactacaccagcagattcagcgagttcagcagctggatcagcaccaacgagacccagctgaagggcatcaagggcgaggccatcgacaccgccaaccacggcgaggtgaagagagccgtggaggagatcagaaacggcgtgaccaagagaggcgagaccctgagctggctgaagagcagactgaaggtgctgaccgaggtgagcagcgagaacgaggcccagaagcagggcgacgagctggccaagctgagcagcagcttcaaggccctggtgaccctgctgagcgaggtggagaagatgctgagcaacttcggcgactgcgtgcagtacaaggagatcgtgaagaacagcctggaggagctgatcagcggcagcaaggaggtgcaggagcaggccgagaagatcctggacaccgagaacctgttcgaggcccagcagctgctgctgcaccaccagcagaagaccaagagaatcagcgccaagaagagagacgtgcagcagcagatcgcccaggcccagcagggcgagggcggcctgcccgacagaggccacgaggagctgagaaagctggagagcaccctggacggcctggagagaagcagagagagacaggagagaagaatccaggtgaccctgagaaagtgggagagattcgagaccaacaaggagaccgtggtgagatacctgttccagaccggcagcagccacgagagattcctgagcttcagcagcctggagagcctgagcagcgagctggagcagaccaaggagttcagcaagagaaccgagagcatcgccgtgcaggccgagaacctggtgaaggaggccagcgagatccccctgggcccccagaacaagcagctgctgcagcagcaggccaagagcatcaaggagcaggtgaagaagctggaggacaccctggaggaggacatcaagaccatggagatggtgaagaccaagtgggaccacttcggcagcaacttcgagaccctgagcgtgtggatcaccgagaaggagaaggagctgaacgccctggagaccagcagcagcgccatggacatgcagatcagccagatcaaggtgaccatccaggagatcgagagcaagctgagcagcatcgtgggcctggaggaggaggcccagagcttcgcccagttcgtgaccaccggcgagagcgccagaatcaaggccaagctgacccagatcagaagatacggcgaggagctgagagagcacgcccagtgcctggagggcaccatcctgggccacctgagccagcagcagaagttcgaggagaacctgagaaagatccagcagagcgtgagcgagttcgaggacaagctggccgtgcccatcaagatctgcagcagcgccaccgagacctacaaggtgctgcaggagcacatggacctgtgccaggccctggagagcctgagcagcgccatcaccgccttcagcgccagcgccagaaaggtggtgaacagagacagctgcgtgcaggaggccgccgccctgcagcagcagtacgaggacatcctgagaagagccaaggagagacagaccgccctggagaacctgctggcccactggcagagactggagaaggagctgagcagcttcctgacctggctggagagaggcgaggccaaggccagcagccccgagatggacatcagcgccgacagagtgaaggtggagggcgagctgcagctgatccaggccctgcagaacgaggtggtgagccaggccagcttctacagcaagctgctgcagctgaaggagagcctgttcagcgtggccagcaaggacgacgtgaagatgatgaagctgcacctggagcagctggacgagagatggagagacctgccccagatcatcaacaagagaatcaacttcctgcagagcgtggtggccgagcaccagcagttcgacgagctgctgctgagcttcagcgtgtggatcaagctgttcctgagcgagctgcagaccaccagcgagatcagcatcatggaccaccaggtggccctgaccagacacaaggaccacgccgccgaggtggagagcaagaagggcgagctgcagagcctgcagggccacctggccaagctgggcagcctgggcagagccgaggacctgcacctgctgcagggcaaggccgaggactgcttccagctgttcgaggaggccagccaggtggtggagagaagacagctggccctgagccacctggccgagttcctgcagagccacgccagcctgagcggcatcctgagacagctgagacagaccgtggaggccaccaacagcatgaacaagaacgagagcgacctgatcgagaaggacctgaacgacgccctgcagaacgccaaggccctggagagcgccgccgtgagcctggacggcatcctgagcaaggcccagtaccacctgaagatcggcagcagcgagcagagaaccagctgcagagccaccgccgaccagctgtgcggcgaggtggagagaatccagaacctgctgggcaccaagcagagcgaggccgacgccctggccgtgctgaagaaggccttccaggaccagaaggaggagctgctgaagagcatcgaggacatcgaggagagaaccgacaaggagagactgaaggagcccaccagacaggccctgcagcagagactgagagtgttcaaccagctggaggacgagctgaacagccacgagcacgagctgtgctggctgaaggacaaggccaagcagatcgcccagaaggacgtggccttcgcccccgaggtggacagagagatcaacagactggaggtgacctgggacgacaccaagagactgatccacgagaaccagggccagtgctgcggcctgatcgacctgatgagagagtaccagaacctgaagagcgccgtgagcaaggtgctggagaacgccagcagcgtgatcgtgaccagaaccaccatcaaggaccaggaggacctgaagtgggccttcagcaagcacgagaccgccaagaacaagatgaactacaagcagaaggacctggacaacttcaccagcaagggcaagcacctgctgagcgagctgaagaagatccacagcagcgacttcagcctggtgaagaccgacatggagagcaccgtggacaagtggctggacgtgagcgagaagctggaggagaacatggacagactgagagtgagcctgagcatctgggacgacgtgctgagcaccagagacgagatcgagggctggagcaacaactgcgtgccccagatggccgagaacatcagcaacctggacaaccacctgagagccgaggagctgctgaaggagttcgagagcgaggtgaagaacaaggccctgagactggaggagctgcacagcaaggtgaacgacctgaaggagctgaccaagaacctggagaccccccccgacctgcagttcatcgaggccgacctgatgcagaagctggagcacgccaaggagatcaccgaggtggccaagggcaccctgaaggacttcaccgcccagagcacccaggtggagaagttcatcaacgacatcaccacctggttcaccaaggtggaggagagcctgatgaactgcgcccagaacgagacctgcgaggccctgaagaaggtgaaggacatccagaaggagctgcagagccagcagagcaacatcagcagcacccaggagaacctgaacagcctgtgcagaaagtaccacagcgccgagctggagagcctgggcagagccatgaccggcctgatcaagaagcacgaggccgtgagccagctgtgcagcaagacccaggccagcctgcaggagagcctggagaagcacttcagcgagagcatgcaggagttccaggagtggttcctgggcgccaaggccgccgccaaggagagcagcgacagaaccggcgacagcaaggtgctggaggccaagctgcacgacctgcagaacatcctggacagcgtgagcgacggccagagcaagctggacgccgtgacccaggagggccagaccctgtacgcccacctgagcaagcagatcgtgagcagcatccaggagcagatcaccaaggccaacgaggagttccaggccttcctgaagcagtgcctgaaggacaagcaggccctgcaggactgcgccagcgagctgggcagcttcgaggaccagcacagaaagctgaacctgtggatccacgagatggaggagagattcaacaccgagaacctgggcgagagcaagcagcacatccccgagaagaagaacgaggtgcacaaggtggagatgttcctgggcgagctgctggccgccagagagagcctggacaagctgagccagagaggccagctgctgagcgaggagggccacggcgccggccaggagggcagactgtgcagccagctgctgaccagccaccagaacctgctgagaatgaccaaggagaagctgagaagctgccaggtggccctgcaggagcacgaggccctggaggaggccctgcagagcatgtggttctgggtgaaggccatccaggacagactggcctgcgccgagagcaccctgggcagcaaggacaccctggagaagagactgagccagatccaggacatcctgctgatgaagggcgagggcgaggtgaagctgaacatggccatcggcaagggcgagcaggccctgagaagcagcaacaaggagggccagagagtgatccagacccagctggagaccctgaaggaggtgtgggccgacatcatgagcagcagcgtgcacgcccagagcaccctggagagcgtgatcagccagtggaacgactacgtggagagaaagaaccagctggagcagtggatggagagcgtggaccagaagatcgagcaccccctgcagccccagcccggcctgaaggagaagttcgtgctgctggaccacctgcagagcatcctgagcgaggccgaggaccacaccagagccctgcacagactgatcgccaagagcagagagctgtacgagaagaccgaggacgagagcttcaaggacaccgcccaggaggagctgaagacccagttcaacgacatcatgaccgtggccaaggagaagatgagaaaggtggaggagatcgtgaaggaccacctgatgtacctggacgccgtgcacgagttcaccgactggctgcacagcgccaaggaggagctgcacagatggagcgacatgagcggcgacagcagcgccacccagaagaagctgagcaagatcaaggagctgatcgacagcagagagatcggcgccagcagactgagcagagtggagagcctggcccccgaggtgaagcagaacaccaccgccagcggctgcgagctgatgcacaccgagatgcaggccctgagagccgactggaagcagtgggaggacagcgtgttccagacccagagctgcctggagaacctggtgagccagatggccctgagcgagcaggagttcagcggccaggtggcccagctggagcaggccctggagcagttcagcgccctgctgaagacctgggcccagcagctgaccctgctggagggcaagaacaccgacgaggagatcgtggagtgctggcacaagggccaggagatcctggacgccctgcagaaggccgagcccagaaccgaggacctgaagagccagctgaacgagctgtgcagattcagcagagacctgagcacctacagcggcaaggtgagcggcctgatcaaggagtacaactgcctgtgcctgcaggccagcaagggctgccagaacaaggagcagatcctgcagcagagattcagaaaggccttcagagacttccagcagtggctggtgaacgccaagatcaccaccgccaagtgcttcgacatcccccagaacatcagcgaggtgagcaccagcctgcagaagatccaggagttcctgagcgagagcgagaacggccagcacaagctgaacatgatgctgagcaagggcgagctgctgagcaccctgctgaccaaggagaaggccaagggcatccaggccaaggtgaccgccgccaaggaggactggaagaacttccacagcaacctgcaccagaaggagagcgccctggagaacctgaagatccagatgaaggacttcgaggtgagcgccgagcccatccaggactggctgagcaagaccgagaagatggtgcacgagagcagcaacagactgtacgacctgcccgccaagagaagagagcagcagaagctgcagagcgtgctggaggagatccactgctacgagccccagctgaacagactgaaggagaaggcccagcagctgtgggagggccaggccgccagcaagagcttcagacacagagtgagccagctgagcagccagtacctggccctgagcaacctgaccaaggagaaggtgagcagactggacagaatcgtggccgagcacaaccagttcagcctgggcatcaaggagctgcaggactggatgaccgacgccatccacatgctggacagctactgccaccccaccagcgacaagagcgtgctggacagcagaaccctgaagctggaggccctgctgagcgtgaagcaggagaaggagatccagatgaagatgatcgtgaccagaggcgagagcgtgctgcagaacaccagccccgagggcatccccaccatccagcagcagctgcagagcgtgaaggacatgtgggccagcctgctgagcgccggcatcagatgcaagagccagctggagggcgccctgagcaagtggaccagctaccaggacggcgtgagacagttcagcggctggatggacagcatggaggccaacctgaacgagagcgagagacagcacgccgagctgagagacaagaccaccatgctgggcaaggccaagctgctgaacgaggaggtgctgagctacagcagcctgctggagaccatcgaggtgaagggcgccggcatgaccgagcactacgtgacccagctggagctgcaggacctgcaggagagatacagagccatccaggagagagccaaggaggccgtgaccaagagcgagaagctggtgagactgcaccaggagtaccagagagacctgaaggccttcgaggtgtggctgggccaggagcaggagaagctggaccagtacagcgtgctggagggcgacgcccacacccacgagaccaccctgagagacctgcaggagctgcaggtgcactgcgccgagggccaggccctgctgaacagcgtgctgcacaccagagaggacgtgatccccagcggcatcccccaggccgaggacagagccctggagagcctgagacaggactggcaggcctaccagcacagactgagcgagaccagaacccagttcaacaacgtggtgaacaagctgagactgatggagcagaagttccagcaggtggacgagtggctgaagaccgccgaggagaaggtgagccccagaaccagaagacagagcaacagagccaccaaggagatccagctgcaccagatgaagaagtggcacgaggaggtgaccgcctacagagacgaggtggaggaggtgggcgccagagcccaggagatcctggacgagagccacgtgaacagcagaatgggctgccaggccacccagctgaccagcagataccaggccctgctgctgcaggtgctggagcagatcaagttcctggaggaggagatccagagcctggaggagagcgagagcagcctgagcagctacagcgactggtacggcagcacccacaagaacttcaagaacgtggccaccaagatcgacaaggtggacaccgtgatgatgggcaagaagctgaagaccctggaggtgctgctgaaggacatggagaagggccacagcctgctgaagagcgccagagagaagggcgagagagccgtgaagtacctggaggagggcgaggccgagagactgagaaaggagatccacgaccacatggagcagctgaaggagctgaccagcaccgtgagaaaggagcacatgaccctggagaagggcctgcacctggccaaggagttcagcgacaagtgcaaggccctgacccagtggatcgccgagtaccaggagatcctgcacgtgcccgaggagcccaagatggagctgtacgagaagaaggcccagctgagcaagtacaagagcctgcagcagaccgtgctgagccacgagcccagcgtgaagagcgtgagagagaagggcgaggccctgctggagctggtgcaggacgtgaccctgaaggacaagatcgaccagctgcagagcgactaccaggacctgtgcagcatcggcaaggagcacgtgttcagcctggaggccaaggtgaaggaccacgaggactacaacagcgagctgcaggaggtggagaagtggctgctgcagatgagcggcagactggtggcccccgacctgctggagaccagcagcctggagaccatcacccagcagctggcccaccacaaggccatgatggaggagatcgccggcttcgaggacagactgaacaacctgcagatgaagggcgacaccctgatcggccagtgcgccgaccacctgcaggccaagctgaagcagaacgtgcacgcccacctgcagggcaccaaggacagctacagcgccatctgcagcaccgcccagagaatgtaccagagcctggagcacgagctgcagaagcacgtgagcagacaggacaccctgcagcagtgccaggcctggctgagcgccgtgcagcccgacctggagcccagcccccagccccccctgagcagagccgaggccatcaagcaggtgaagcacttcagagccctgcaggagcaggccagaacctacctggacctgctgtgcagcatgtgcgacctgagcaacgccagcgtgaagaccaccgccaaggacatccagcagaccgagcagaccatcgagcagaagctggtgcaggcccagaacctgacccagggctgggaggagatcaagcacctgaagagcgagctgtggatctacctgcaggacgccgaccagcagctgcagaacatgaagagaagacacagcgagctggagctgaacatcgcccagaacatggtgagccaggtgaaggacttcgtgaagaagctgcagagcaagcaggccagcgtgaacaccatcatcgagaaggtgaacaagctgaccaagaaggaggagagccccgagcacaaggagatcaaccacctgaacgaccagtggctggacctgtgcagacagagcaacaacctgtgcctgcagagagaggaggacctgcagagaaccagagactaccacgactgcatgaacgtggtggaggtgttcctggagaagttcaccaccgagtgggacaacctggccagaagcgacgccgagagcaccgccgtgcacctggaggccctgaagaagctggccctggccctgcaggagagaaagtacgccatcgaggacctgaaggaccagaagcagaagatgatcgagcacctgaacctggacgacaaggagctggtgaaggagcagaccagccacctggagcagagatggttccagctggaggacctgatcaagagaaagatccaggtgagcgtgaccaacctggaggagctgaacgtggtgcagagcagattccaggagctgatggagtgggccgaggagcagcagcccaacatcgccgaggccctgaagcagagccccccccccgacatggcccagaacctgctgatggaccacctggccatctgcagcgagctggaggccaagcagatgctgctgaagagcctgatcaaggacgccgacagagtgatggccgacctgggcctgaacgagagacaggtgatccagaaggccctgagcgacgcccagagccacgtgaactgcctgagcgacctggtgggccagagaagaaagtacctgaacaaggccctgagcgagaagacccagttcctgatggccgtgttccaggccaccagccagatccagcagcacgagagaaagatcatgttcagagagcacatctgcctgctgcccgacgacgtgagcaagcaggtgaagacctgcaagagcgcccaggccagcctgaagacctaccagaacgaggtgaccggcctgtgggcccagggcagagagctgatgaaggaggtgaccgagcaggagaagagcgaggtgctgggcaagctgcaggagctgcagagcgtgtacgacagcgtgctgcagaagtgcagccacagactgcaggagctggagaagaacctggtgagcagaaagcacttcaaggaggacttcgacaaggcctgccactggctgaagcaggccgacatcgtgaccttccccgagatcaacctgatgaacgagagcagcgagctgcacacccagctggccaagtaccagaacatcctggagcagagccccgagtacgagaacctgctgctgaccctgcagagaaccggccagaccatcctgcccagcctgaacgaggtggaccacagctacctgagcgagaagctgaacgccctgcccagacagttcaacgtgatcgtggccctggccaaggacaagttctacaaggtgcaggaggccatcctggccagaaaggagtacgccagcctgatcgagctgaccacccagagcctgagcgagctggaggcccagttcctgagaatgagcaaggtgcccaccgacctggccgtggaggaggccctgagcctgcaggacggctgcagagccatcctggacgaggtggccggcctgggcgaggccgtggacgagctgaaccagaagaaggagggcttcagaagcaccggccagccctggcagcccgacaagatgctgcacctggtgaccctgtaccacagactgaagagacagaccgagcagagagtgagcctgctggaggacaccaccagcgcctaccaggagcacgagaagatgtgccagcagctggagagacagctgaagagcgtgaaggaggagcagagcaaggtgaacgaggagaccctgcccgccgaggagaagctgaagatgtaccacagcctggccggcagcctgcaggacagcggcatcgtgctgaagagagtgaccatccacctggaggacctggccccccacctggaccccctggcctacgagaaggccagacaccagatccagagctggcagggcgagctgaagctgctgaccagcgccatcggcgagaccgtgaccgagtgcgagagcagaatggtgcagagcatcgacttccagaccgagatgagcagaagcctggactggctgagaagagtgaaggccgagctgagcggccccgtgtacctggacctgaacctgcaggacatccaggaggagatcagaaagatccagatccaccaggaggaggtgcagagcagcctgagaatcatgaacgccctgagccacaaggagaaggagaagttcaccaaggccaaggagctgatcagcgccgacctggagcacagcctggccgagctgagcgagctggacggcgacatccaggaggccctgagaaccagacaggccaccctgaccgagatctacagccagtgccagagatactaccaggtgttccaggccgccaacgactggctggaggacgcccaggagctgctgcagctggccggcaacggcctggacgtggagagcgccgaggagaacctgaagagccacatggagttcttcagcaccgaggaccagttccacagcaacctggaggagctgcacagcctggtggccaccctggaccccctgatcaagcccaccggcaaggaggacctggagcagaaggtggccagcctggagctgagaagccagagaatgagcagagacagcggcgcccaggtggacctgctgcagagatgcaccgcccagtggcacgactaccagaaggccagagaggaggtgatcgagctgatgaacgacaccgagaagaagctgagcgagttcagcctgctgaagaccagcagcagccacgaggccgaggagaagctgagcgagcacaaggccctggtgagcgtggtgaacagcttccacgagaagatcgtggccctggaggagaaggccagccagctggagaagaccggcaacgacgccagcaaggccaccctgagcagaagcatgaccaccgtgtggcagagatggaccagactgagagccgtggcccaggaccaggagaagatcctggaggacgccgtggacgagtggaccggcttcaacaacaaggtgaagaaggccaccgagatgatcgaccagctgcaggacaagctgcccggcagcagcgccgagaaggccagcaaggccgagctgctgaccctgctggagtaccacgacaccttcgtgctggagctggagcagcagcagagcgccctgggcatgctgagacagcagaccctgagcatgctgcaggacggcgccgcccccacccccggcgaggagccccccctgatgcaggagatcaccgccatgcaggacagatgcctgaacatgcaggagaaggtgaagaccaacggcaagctggtgaagcaggagctgaaggacagagagatggtggagacccagatcaacagcgtgaagtgctgggtgcaggagaccaaggagtacctgggcaaccccaccatcgagatcgacgcccagctggaggagctgcagatcctgctgaccgaggccaccaaccacagacagaacatcgagaagatggccgaggagcagaaggagaagtacctgggcctgtacaccatcctgcccagcgagctgagcctgcagctggccgaggtggccctggacctgaagatcagagaccagatccaggacaagatcaaggaggtggagcagagcaaggccaccagccaggagctgagcagacagatccagaagctggccaaggacctgaccaccatcctgaccaagctgaaggccaagaccgacaacgtggtgcaggccaagaccgaccagaaggtgctgggcgaggagctggacggctgcaacagcaagctgatggagctggacgccgccgtgcagaagttcctggagcagaacggccagctgggcaagcccctggccaagaagatcggcaagctgaccgagctgcaccagcagaccatcagacaggccgagaacagactgagcaagctgaaccaggccgccagccacctggaggagtacaacgagatgctggagctgatcctgaagtggatcgagaaggccaaggtgctggcccacggcaccatcgcctggaacagcgccagccagctgagagagcagtacatcctgcaccagaccctgctggaggagagcaaggagatcgacagcgagctggaggccatgaccgagaagctgcagtacctgaccagcgtgtactgcaccgagaagatgagccagcaggtggccgagctgggcagagagaccgaggagctgagacagatgatcaagatcagactgcagaacctgcaggacgccgccaaggacatgaagaagttcgaggccgagctgaagaagctgcaggccgccctggagcaggcccaggccaccctgaccagccccgaggtgggcagactgagcctgaaggagcagctgagccacagacagcacctgctgagcgagatggagagcctgaagcccaaggtgcaggccgtgcagctgtgccagagcgccctgagaatccccgaggacgtggtggccagcctgcccctgtgccacgccgccctgagactgcaggaggaggccagcagactgcagcacaccgccatccagcagtgcaacatcatgcaggccgccgtggtgcagtacgagcagtacgagcaggagatgaagcacctgcagcagctgatcgagggcgcccacagagagatcgaggacaagcccgtggccaccagcaacatccaggagctgcaggcccagatcagcagacacgaggagctggcccagaagatcaagggctaccaggagcagatcgccagcctgaacagcaagtgcaagatgctgaccatgaaggccaagcacgccaccatgctgctgaccgtgaccgaggtggagggcctggccgagggcaccgaggacctggacggcgagctgctgcccacccccagcgcccaccccagcgtggtgatgatgaccgccggcagatgccacaccctgctgagccccgtgaccgaggagagcggcgaggagggcaccaacagcgagatcagcagcccccccgcctgcagaagccccagccccgtggccaacaccgacgccagcgtgaaccaggacatcgcctactaccaggccctgagcgccgagagactgcagaccgacgccgccaagatccaccccagcaccagcgccagccaggagttctacgagcccggcctggagcccagcgccaccgccaagctgggcgacctgcagagaagctgggagaccctgaagaacgtgatcagcgagaagcagagaaccctgtacgaggccctggagagacagcagaagtaccaggacagcctgcagagcatcagcaccaagatggaggccatcgagctgaagctgagcgagagccccgagcccggcagaagccccgagagccagatggccgagcaccaggccctgatggacgagatcctgatgctgcaggacgagatcaacgagctgcagagcagcctggccgaggagctggtgagcgagagctgcgaggccgaccccgccgagcagctggccctgcagagcaccctgaccgtgctggccgagagaatgagcaccatcagaatgaaggccagcggcaagagacagctgctggaggagaagctgaacgaccagctggaggagcagagacaggagcaggccctgcagagatacagatgcgaggccgacgagctggacagctggctgctgagcaccaaggccaccctggacaccgccctgagcccccccaaggagcccatggacatggaggcccagctgatggactgccagaacatgctggtggagatcgagcagaaggtggtggccctgagcgagctgagcgtgcacaacgagaacctgctgctggagggcaaggcccacaccaaggacgaggccgagcagctggccggcaagctgagaagactgaagggcagcctgctggagctgcagagagccctgcacgacaagcagctgaacatgcagggcaccgcccaggagaaggaggagagcgacgtggacctgaccgccacccagagccccggcgtgcaggagtggctggcccaggccagaaccacctggacccagcagagacagagcagcctgcagcagcagaaggagctggagcaggagctggccgagcagaagagcctgctgagaagcgtggccagcagaggcgaggagatcctgatccagcacagcgccgccgagaccagcggcgacgccggcgagaagcccgacgtgctgagccaggagctgggcatggagggcgagaagagcagcgccgaggaccagatgagaatgaagtgggagagcctgcaccaggagttcagcaccaagcagaagctgctgcagaacgtgctggagcaggagcaggagcaggtgctgtacagcagacccaacagactgctgagcggcgtgcccctgtacaagggcgacgtgcccacccaggacaagagcgccgtgaccagcctgctggacggcctgaaccaggccttcgaggaggtgagcagccagagcggcggcgccaagagacagagcatccacctggagcagaagctgtacgacggcgtgagcgccaccagcacctggctggacgacgtggaggagagactgttcgtggccaccgccctgctgcccgaggagaccgagacctgcctgttcaaccaggagatcctggccaaggacatcaaggagatgagcgaggagatggacaagaacaagaacctgttcagccaggccttccccgagaacggcgacaacagagacgtgatcgaggacaccctgggctgcctgctgggcagactgagcctgctggacagcgtggtgaaccagagatgccaccagatgaaggagagactgcagcagatcctgaacttccagaacgacctgaaggtgctgttcaccagcctggccgacaacaagtacatcatcctgcagaagctggccaacgtgttcgagcagcccgtggccgagcagatcgaggccatccagcaggccgaggacggcctgaaggagttcgacgccggcatcatcgagctgaagagaagaggcgacaagctgcaggtggagcagcccagcatgcaggagctgagcaagctgcaggacatgtacgacgagctgatgatgatcatcggcagcagaagaagcggcctgaaccagaacctgaccctgaagagccagtacgagagagccctgcaggacctggccgacctgctggagaccggccaggagaagatggccggcgaccagaagatcatcgtgagcagcaaggaggagatccagcagctgctggacaagcacaaggagtacttccagggcctggagagccacatgatcctgaccgagaccctgttcagaaagatcatcagcttcgccgtgcagaaggagacccagttccacaccgagctgatggcccaggccagcgccgtgctgaagagagcccacaagagaggcgtggagctggagtacatcctggagacctggagccacctggacgaggaccagcaggagctgagcagacagctggaggtggtggagagcagcatccccagcgtgggcctggtggaggagaacgaggacagactgatcgacagaatcaccctgtaccagcacctgaagagcagcctgaacgagtaccagcccaagctgtaccaggtgctggacgacggcaagagactgctgatcagcatcagctgcagcgacctggagagccagctgaaccagctgggcgagtgctggctgagcaacaccaacaagatgagcaaggagctgcacagactggagaccatcctgaagcactggaccagataccagagcgagagcgccgacctgatccactggctgcagagcgccaaggacagactggagttctggacccagcagagcgtgaccgtgccccaggagctggagatggtgagagaccacctgaacgccttcctggagttcagcaaggaggtggacgcccagagcagcctgaagagcagcgtgctgagcaccggcaaccagctgctgagactgaagaaggtggacaccgccaccctgagaagcgagctgagcagaatcgacagccagtggaccgacctgctgaccaacatccccgccgtgcaggagaagctgcaccagctgcagatggacaagctgcccagcagacacgccatcagcgaggtgatgagctggatcagcctgatggagaacgtgatccagaaggacgaggacaacatcaagaacagcatcggctacaaggccatccacgagtacctgcagaagtacaagggcttcaagatcgacatcaactgcaagcagctgaccgtggacttcgtgaaccagagcgtgctgcagatcagcagccaggacgtggagagcaagagaagcgacaagaccgacttcgccgagcagctgggcgccatgaacaagagctggcagatcctgcagggcctggtgaccgagaagatccagctgctggagggcctgctggagagctggagcgagtacgagaacaacgtgcagtgcctgaagacctggttcgagacccaggagaagagactgaagcagcagcacagaatcggcgaccaggccagcgtgcagaacgccctgaaggactgccaggacctggaggacctgatcaaggccaaggagaaggaggtggagaagatcgagcagaacggcctggccctgatccagaacaagaaggaggacgtgagcagcatcgtgatgagcaccctgagagagctgggccagacctgggccaacctggaccacatggtgggccagctgaagatcctgctgaagagcgtgctggaccagtggagcagccacaaggtggccttcgacaagatcaacagctacctgatggaggccagatacagcctgagcagattcagactgctgaccggcagcctggaggccgtgcaggtgcaggtggacaacctgcagaacctgcaggacgacctggagaagcaggagagaagcctgcagaagttcggcagcatcaccaaccagctgctgaaggagtgccacccccccgtgaccgagaccctgaccaacaccctgaaggaggtgaacatgagatggaacaacctgctggaggagatcgccgagcagctgcagagcagcaaggccctgctgcagctgtggcagagatacaaggactacagcaagcagtgcgccagcaccgtgcagcagcaggaggacagaaccaacgagctgctgaaggccgccaccaacaaggacatcgccgacgacgaggtggccacctggatccaggactgcaacgacctgctgaagggcctgggcaccgtgaaggacagcctgttcttcctgcacgagctgggcgagcagctgaagcagcaggtggacgccagcgccgccagcgccatccagagcgaccagctgagcctgagccagcacctgtgcgccctggagcaggccctgtgcaagcagcagaccagcctgcaggccggcgtgctggactacgagaccttcgccaagagcctggaggccctggaggcctggatcgtggaggccgaggagatcctgcagggccaggaccccagccacagcagcgacctgagcaccatccaggagagaatggaggagctgaagggccagatgctgaagttcagcagcatggcccccgacctggacagactgaacgagctgggctacagactgcccctgaacgacaaggagatcaagagaatgcagaacctgaacagacactggagcctgatcagcagccagaccaccgagagattcagcaagctgcagagcttcctgctgcagcaccagaccttcctggagaagtgcgagacctggatggagttcctggtgcagaccgagcagaagctggccgtggagatcagcggcaactaccagcacctgctggagcagcagagagcccacgagctgttccaggccgagatgttcagcagacagcagatcctgcacagcatcatcatcgacggccagagactgctggagcagggccaggtggacgacagagacgagttcaacctgaagctgaccctgctgagcaaccagtggcagggcgtgatcagaagagcccagcagagaagaggcatcatcgacagccagatcagacagtggcagagatacagagagatggccgagaagctgagaaagtggctggtggaggtgagctacctgcccatgagcggcctgggcagcgtgcccatccccctgcagcaggccagaaccctgttcgacgaggtgcagttcaaggagaaggtgttcctgagacagcagggcagctacatcctgaccgtggaggccggcaagcagctgctgctgagcgccgacagcggcgccgaggccgccctgcaggccgagctggccgagatccaggagaagtggaagagcgccagcatgagactggaggagcagaagaagaagctggccttcctgctgaaggactgggagaagtgcgagaagggcatcgccgacagcctggagaagctgagaaccttcaagaagaagctgagccagagcctgcccgaccaccacgaggagctgcacgccgagcagatgagatgcaaggagctggagaacgccgtgggcagctggaccgacgacctgacccagctgagcctgctgaaggacaccctgagcgcctacatcagcgccgacgacatcagcatcctgaacgagagagtggagctgctgcagagacagtgggaggagctgtgccaccagctgagcctgagaagacagcagatcggcgagagactgaacgagtgggccgtgttcagcgagaagaacaaggagctgtgcgagtggctgacccagatggagagcaaggtgagccagaacggcgacatcctgatcgaggagatgatcgagaagctgaagaaggactaccaggaggagatcgccatcgcccaggagaacaagatccagctgcagcagatgggcgagagactggccaaggccagccacgagagcaaggccagcgagatcgagtacaagctgggcaaggtgaacgacagatggcagcacctgctggacctgatcgccgccagagtgaagaagctgaaggagaccctggtggccgtgcagcagctggacaagaacatgagcagcctgagaacctggctggcccacatcgagagcgagctggccaagcccatcgtgtacgacagctgcaacagcgaggagatccagagaaagctgaacgagcagcaggagctgcagagagacatcgagaagcacagcaccggcgtggccagcgtgctgaacctgtgcgaggtgctgctgcacgactgcgacgcctgcgccaccgacgccgagtgcgacagcatccagcaggccaccagaaacctggacagaagatggagaaacatctgcgccatgagcatggagagaagactgaagatcgaggagacctggagactgtggcagaagttcctggacgactacagcagattcgaggactggctgaagagcagcgagagaaccgccgccttccccagcagcagcggcgtgatctacaccgtggccaaggaggagctgaagaagttcgaggccttccagagacaggtgcacgagtgcctgacccagctggagctgatcaacaagcagtacagaagactggccagagagaacagaaccgacagcgcctgcagcctgaagcagatggtgcacgagggcaaccagagatgggacaacctgcagaagagagtgaccagcatcctgagaagactgaagcacttcatcggccagagagaggagttcgagaccgccagagacagcatcctggtgtggctgaccgagatggacctgcagctgaccaacatcgagcacttcagcgagtgcgacgtgcaggccaagatcaagcagctgaaggccttccagcaggagatcagcctgaaccacaacaagatcgagcagatcatcgcccagggcgagcagctgatcgagaagagcgagcccctggacgccgccatcatcgaggaggagctggacgagctgagaagatactgccaggaggtgttcggcagagtggagagataccacaagaagctgatcagactgcccctgcccgacgacgagcacgacctgagcgacagagagctggagctggaggacagcgccgccctgagcgacctgcactggcacgacagaagcgccgacagcctgctgagcccccagcccagcagcaacctgagcctgagcctggcccagcccctgagaagcgagagaagcggcagagacacccccgccagcgtggacagcatccccctggagtgggaccacgactacgacctgagcagagacctggagagcgccatgagcagagccctgcccagcgaggacgaggagggccaggacgacaaggacttctacctgagaggcgccgtgggcctgagcggcgaccacagcgccctggagagccagatcagacagctgggcaaggccctggacgacagcagattccagatccagcagaccgagaacatcatcagaagcaagacccccaccggccccgagctggacaccagctacaagggctacatgaagctgctgggcgagtgcagcagcagcatcgacagcgtgaagagactggagcacaagctgaaggaggaggaggagagcctgcccggcttcgtgaacctgcacagcaccgagacccagaccgccggcgtgatcgacagatgggagctgctgcaggcccaggccctgagcaaggagctgagaatgaagcagaacctgcagaagtggcagcagttcaacagcgacctgaacagcatctgggcctggctgggcgacaccgaggaggagctggagcagctgcagagactggagctgagcaccgacatccagaccatcgagctgcagatcaagaagctgaaggagctgcagaaggccgtggaccacagaaaggccatcatcctgagcatcaacctgtgcagccccgagttcacccaggccgacagcaaggagagcagagacctgcaggacagactgagccagatgaacggcagatgggacagagtgtgcagcctgctggaggagtggagaggcctgctgcaggacgccctgatgcagtgccagggcttccacgagatgagccacggcctgctgctgatgctggagaacatcgacagaagaaagaacgagatcgtgcccatcgacagcaacctggacgccgagatcctgcaggaccaccacaagcagctgatgcagatcaagcacgagctgctggagagccagctgagagtggccagcctgcaggacatgagctgccagctgctggtgaacgccgagggcaccgactgcctggaggccaaggagaaggtgcacgtgatcggcaacagactgaagctgctgctgaaggaggtgagcagacacatcaaggagctggagaagctgctggacgtgagcagcagccagcaggacctgagcagctggagcagcgccgacgagctggacaccagcggcagcgtgagccccaccagcggcagaagcacccccaacagacagaagacccccagaggcaagtgcagcctgagccagcccggccccagcgtgagcagcccccacagcagaagcaccaagggcggcagcgacagcagcctgagcgagcccggccccggcagaagcggcagaggcttcctgttcagagtgctgagagccgccctgcccctgcagctgctgctgctgctgctgatcggcctggcctgcctggtgcccatgagcgaggaggactacagctgcgccctgagcaacaacttcgccagaagcttccaccccatgctgagatacaccaacggccccccccccctgtag

SEQ ID NO: 100473 - DNA, 25230 bp, Artificial Sequence
  Description of Artificial Sequence: Synthetic coding sequence
atggccaccagcagaggcgccagcagatgccccagagacatcgccaacgtgatgcagagactgcaggacgagcaggagatcgtgcagaagagaaccttcaccaagtggatcaacagccacctggccaagagaaagccccccatggtggtggacgacctgttcgaggacatgaaggacggcgtgaagctgctggccctgctggaggtgctgagcggccagaagctgccctgcgagcagggcagaagaatgaagagaatccacgccgtggccaacatcggcaccgccctgaagttcctggagggcagaaagatcaagctggtgaacatcaacagcaccgacatcgccgacggcagacccagcatcgtgctgggcctgatgtggaccatcatcctgtacttccagatcgaggagctgaccagcaacctgccccagctgcagagcctgagcagcagcgccagcagcgtggacagcatcgtgagcagcgagacccccagcccccccagcaagagaaaggtgaccaccaagatccagggcaacgccaagaaggccctgctgaagtgggtgcagtacaccgccggcaagcagaccggcatcgaggtgaaggacttcggcaagagctggagaagcggcgtggccttccacagcgtgatccacgccatcagacccgagctggtggacctggagaccgtgaagggcagaagcaacagagagaacctggaggacgccttcaccatcgccgagaccgagctgggcatccccagactgctggaccccgaggacgtggacgtggacaagcccgacgagaagagcatcatgacctacgtggcccagttcctgaagcactaccccgacatccacaacgccagcaccgacggccaggaggacgacgagatcctgcccggcttccccagcttcgccaacagcgtgcagaacttcaagagagaggacagagtgatcttcaaggagatgaaggtgtggatcgagcagttcgagagagacctgaccagagcccagatggtggagagcaacctgcaggacaagtaccagagcttcaagcacttcagagtgcagtacgagatgaagagaaagcagatcgagcacctgatccagcccctgcacagagacggcaagctgagcctggaccaggccctggtgaagcagagctgggacagagtgaccagcagactgttcgactggcacatccagctggacaagagcctgcccgcccccctgggcaccatcggcgcctggctgtacagagccgaggtggccctgagagaggagatcaccgtgcagcaggtgcacgaggagaccgccaacaccatccagagaaagctggagcagcacaagagaaagctgagaaacgtgatcgacctgctgcagaacaccgacgcccacaagagagccttccacgagatctacagaaccagaagcgtgaacggcatccccgtgccccccgaccagctggaggacatggccgagagattccacttcgtgagcagcaccagcgagctgcacctgatgaagatggagttcctggagctgaagtacagactgctgagcctgctggtgctggccgagagcaagctgaagagctggatcatcaagtacggcagaagagagagcgtggagcagctgctgcagaactacgtgagcttcatcgagaacagcaagttcttcgagcagtacgaggtgacctaccagatcctgaagcagaccgccgagatgtacgtgaaggccgacggcagcgtggaggaggccgagaacgtgatgaagttcatgaacgagaccaccgcccagtggagaaacctgagcgtggaggtgagaagcgtgagaagcatgctggaggaggtgatcagcaactgggacagatacggcaacaccgtggccagcctgcaggcctggctggaggacgccgagaagatgctgaaccagagcgagaacgccaagaaggacttcttcagaaacctgccccactggatccagcagcacaccgccatgaacgacgccggcaacttcctgatcgagacctgcgacgagatggtgagcagagacctgaagcagcagctgctgctgctgaacggcagatggagagagctgttcatggaggtgaagcagtacgcccaggccgacgagatggacagaatgaagaaggagtacaccgactgcgtggtgaccctgagcgccttcgccaccgaggcccacaagaagctgagcgagcccctggaggtgagcttcatgaacgtgaagctgctgatccaggacctggaggacatcgagcagagagtgcccgtgatggacgcccagtacaagatcatcaccaagaccgcccacctgatcaccaaggagagcccccaggaggagggcaaggagatgttcgccaccatgagcaagctgaaggagcagctgaccaaggtgaaggagtgctacagccccctgctgtacgagagccagcagctgctgatccccctggaggagctggagaagcagatgaccagcttctacgacagcctgggcaagatcaacgagatcatcaccgtgctggagagagaggcccagagcagcgccctgttcaagcagaagcaccagctgagaatcctgaagtgcaagtggtgcaacagcagccagaagatgaccctgtgcctggtgctgggcagcatgatcagcatgctgagcaccgccaagatcaccatcgccggctacaagagcgaggtggaggtgagcgagctgctggcctgccaggagaactgcaagaagaccctgaccctgatcgagaagggcagccagagcgtgcagaagttcgtgaccctgagcaacgtgctgaagcacttcgaccagaccagactgcagaccgactgcagatacagctgctgcttcagcgtgatgagaaagcagcaccacatcatgatcgtgttccacatcaagagcatggtgaagaagaccggcgactggaagaagcacgtggagaccaacagcagactgatgaagaagttcgaggagagcagagccgagctggagaaggtgctgagaatcgcccaggagggcctggaggagaagggcgaccccgaggagctgctgagaagacacaccgagttcttcagccagctggaccagagagtgctgaacgccttcctgaaggcctgcgacgagctgaccgacatcctgcccgagcaggagcagcagggcctgcaggaggccgtgagaaagctgcacaagcagtggaaggacctgcagggcgaggccccctaccacctgctgcacctgaagatcgacgtggagaagaacagattcctggccagcgtggaggagtgcagaaccgagctggacagagagaccaagctgatgccccaggagggcagcgagaagatcatcaaggagcacagagtgttcttcagcgacaagggcccccaccacctgtgcgagaagagactgcagctgatcgaggagctgtgcgtgaagctgcccgtgagagaccccgtgagagacacccccggcacctgccacgtgaccctgaaggagctgagagccgccatcgacagcacctacagaaagctgatggaggaccccgacaagtggaaggactacaccagcagattcagcgagttcagcagctggatcagcaccaacgagacccagctgaagggcatcaagggcgaggccatcgacaccgccaaccacggcgaggtgaagagagccgtggaggagatcagaaacggcgtgaccaagagaggcgagaccctgagctggctgaagagcagactgaaggtgctgaccgaggtgagcagcgagaacgaggcccagaagcagggcgacgagctggccaagctgagcagcagcttcaaggccctggtgaccctgctgagcgaggtggagaagatgctgagcaacttcggcgactgcgtgcagtacaaggagatcgtgaagaacagcctggaggagctgatcagcggcagcaaggaggtgcaggagcaggccgagaagatcctggacaccgagaacctgttcgaggcccagcagctgctgctgcaccaccagcagaagaccaagagaatcagcgccaagaagagagacgtgcagcagcagatcgcccaggcccagcagggcgagggcggcctgcccgacagaggccacgaggagctgagaaagctggagagcaccctggacggcctggagagaagcagagagagacaggagagaagaatccaggtgaccctgagaaagtgggagagattcgagaccaacaaggagaccgtggtgagatacctgttccagaccggcagcagccacgagagattcctgagcttcagcagcctggagagcctgagcagcgagctggagcagaccaaggagttcagcaagagaaccgagagcatcgccgtgcaggccgagaacctggtgaaggaggccagcgagatccccctgggcccccagaacaagcagctgctgcagcagcaggccaagagcatcaaggagcaggtgaagaagctggaggacaccctggaggaggagtacgtgatcgacaacaagaccatggagatggtgaagaccaagtgggaccacttcggcagcaacttcgagaccctgagcgtgtggatcaccgagaaggagaaggagctgaacgccctggagaccagcagcagcgccatggacatgcagatcagccagatcaaggtgaccatccaggagatcgagagcaagctgagcagcatcgtgggcctggaggaggaggcccagagcttcgcccagttcgtgaccaccggcgagagcgccagaatcaaggccaagctgacccagatcagaagatacggcgaggagctgagagagcacgcccagtgcctggagggcaccatcctgggccacctgagccagcagcagaagttcgaggagaacctgagaaagatccagcagagcgtgagcgagttcgaggacaagctggccgtgcccatcaagatctgcagcagcgccaccgagacctacaaggtgctgcaggagcacatggacctgtgccaggccctggagagcctgagcagcgccatcaccgccttcagcgccagcgccagaaaggtggtgaacagagacagctgcgtgcaggaggccgccgccctgcagcagcagtacgaggacatcctgagaagagccaaggagagacagaccgccctggagaacctgctggcccactggcagagactggagaaggagctgagcagcttcctgacctggctggagagaggcgaggccaaggccagcagccccgagatggacatcagcgccgacagagtgaaggtggaggccagcaaggacgacgtgaagatgatgaagctgcacctggagcagctggacgagagatggagagacctgccccagatcatcaacaagagaatcaacttcctgcagagcgtggtggccgagcaccagcagttcgacgagctgctgctgagcttcagcgtgtggatcaagctgttcctgagcgagctgcagaccaccagcgagatcagcatcatggaccaccaggtggccctgaccagacacaaggaccacgccgccgaggtggagagcaagaagggcgagctgcagagcctgcagggccacctggccaagctgggcagcctgggcagagccgaggacctgcacctgctgcagggcaaggccgaggactgcttccagctgttcgaggaggccagccaggtggtggagagaagacagctggccctgagccacctggccgagttcctgcagagccacgccagcctgagcggcatcctgagacagctgagacagaccgtggaggccaccaacagcatgaacaagaacgagagcgacctgatcgagaaggacctgaacgacgccctgcagaacgccaaggccctggagagcgccgccgtgagcctggacggcatcctgagcaaggcccagtaccacctgaagatcggcagcagcgagcagagaaccagctgcagagccaccgccgaccagctgtgcggcgaggtggagagaatccagaacctgctgggcaccaagcagagcgaggccgacgccctggccgtgctgaagaaggccttccaggaccagaaggaggagctgctgaagagcatcgaggacatcgaggagagaaccgacaaggagagactgaaggagcccaccagacaggccctgcagcagagactgagagtgttcaaccagctggaggacgagctgaacagccacgagcacgagctgtgctggctgaaggacaaggccaagcagatcgcccagaaggacgtggccttcgcccccgaggtggacagagagatcaacagactggaggtgacctgggacgacaccaagagactgatccacgagaaccagggccagtgctgcggcctgatcgacctgatgagagagtaccagaacctgaagagcgccgtgagcaaggtgctggagaacgccagcagcgtgatcgtgaccagaaccaccatcaaggaccaggaggacctgaagtgggccttcagcaagcacgagaccgccaagaacaagatgaactacaagcagaaggacctggacaacttcaccagcaagggcaagcacctgctgagcgagctgaagaagatccacagcagcgacttcagcctggtgaagaccgacatggagagcaccgtggacaagtggctggacgtgagcgagaagctggaggagaacatggacagactgagagtgagcctgagcatctgggacgacgtgctgagcaccagagacgagatcgagggctggagcaacaactgcgtgccccagatggccgagaacatcagcaacctggacaaccacctgagagccgaggagctgctgaaggagttcgagagcgaggtgaagaacaaggccctgagactggaggagctgcacagcaaggtgaacgacctgaaggagctgaccaagaacctggagaccccccccgacctgcagttcatcgaggccgacctgatgcagaagctggagcacgccaaggagatcaccgaggtggccaagggcaccctgaaggacttcaccgcccagagcacccaggtggagaagttcatcaacgacatcaccacctggttcaccaaggtggaggagagcctgatgaactgcgcccagaacgagacctgcgaggccctgaagaaggtgaaggacatccagaaggagctgcagagccagcagagcaacatcagcagcacccaggagaacctgaacagcctgtgcagaaagtaccacagcgccgagctggagagcctgggcagagccatgaccggcctgatcaagaagcacgaggccgtgagccagctgtgcagcaagacccaggccagcctgcaggagagcctggagaagcacttcagcgaggagagcatgcaggagttccaggagtggttcctgggcgccaaggccgccgccaaggagagcagcgacagaaccggcgacagcaaggtgctggaggccaagctgcacgacctgcagcagaacatcctggacagcgtgagcgacggccagagcaagctggacgccgtgacccaggagggccagaccctgtacgcccacctgagcaagcagatcgtgagcagcatccaggagcagatcaccaaggccaacgaggagttccaggccttcctgaagcagtgcctgaaggacaagcaggccctgcaggactgcgccagcgagctgggcagcttcgaggaccagcacagaaagctgaacctgtggatccacgagatggaggagagattcaacaccgagaacctgggcgagagcaagcagcacatccccgagaagaagaacgaggtgcacaaggtggagatgttcctgggcgagctgctggccgccagagagagcctggacaagctgagccagagaggccagctgctgagcgaggagggccacggcgccggccaggagggcagactgtgcagccagctgctgaccagccaccagaacctgctgagaatgaccaaggagaagctgagaagctgccaggtggccctgcaggagcacgaggccctggaggaggccctgcagagcatgtggttctgggtgaaggccatccaggacagactggcctgcgccgagagcaccctgggcagcaaggacaccctggagaagagactgagccagatccaggacatcctgctgatgaagggcgagggcgaggtgaagctgaacatggccatcggcaagggcgagcaggccctgagaagcagcaacaaggagggccagagagtgatccagacccagctggagaccctgaaggaggtgtgggccgacatcatgagcagcagcgtgcacgcccagagcaccctggagagcgtgatcagccagtggaacgactacgtggagagaaagaaccagctggagcagtggatggagagcgtggaccagaagatcgagcaccccctgcagccccagcccggcctgaaggagaagttcgtgctgctggaccacctgcagagcatcctgagcgaggccgaggaccacaccagagccctgcacagactgatcgccaagagcagagagctgtacgagaagaccgaggacgagagcttcaaggacaccgcccaggaggagctgaagacccagttcaacgacatcatgaccgtggccaaggagaagatgagaaaggtggaggagatcgtgaaggaccacctgatgtacctggacgccgtgcacgagttcaccgactggctgcacagcgccaaggaggagctgcacagatggagcgacatgagcggcgacagcagcgccacccagaagaagctgagcaagatcaaggagctgatcgacagcagagagatcggcgccagcagactgagcagagtggagagcctggcccccgaggtgaagcagaacaccaccgccagcggctgcgagctgatgcacaccgagatgcaggccctgagagccgactggaagcagtgggaggacagcgtgttccagacccagagctgcctggagaacctggtgagccagatggccctgagcgagcaggagttcagcggccaggtggcccagctggagcaggccctggagcagttcagcgccctgctgaagacctgggcccagcagctgaccctgctggagggcaagaacaccgacgaggagatcgtggagtgctggcacaagggccaggagatcctggacgccctgcagaaggccgagcccagaaccgaggacctgaagagccagctgaacgagctgtgcagattcagcagagacctgagcacctacagcggcaaggtgagcggcctgatcaaggagtacaactgcctgtgcctgcaggccagcaagggctgccagaacaaggagcagatcctgcagcagagattcagaaaggccttcagagacttccagcagtggctggtgaacgccaagatcaccaccgccaagtgcttcgacatcccccagaacatcagcgaggtgagcaccagcctgcagaagatccaggagttcctgagcgagagcgagaacggccagcacaagctgaacatgatgctgagcaagggcgagctgctgagcaccctgctgaccaaggagaaggccaagggcatccaggccaaggtgaccgccgccaaggaggactggaagaacttccacagcaacctgcaccagaaggagagcgccctggagaacctgaagatccagatgaaggacttcgaggtgagcgccgagcccatccaggactggctgagcaagaccgagaagatggtgcacgagagcagcaacagactgtacgacctgcccgccaagagaagagagcagcagaagctgcagagcgtgctggaggagatccactgctacgagccccagctgaacagactgaaggagaaggcccagcagctgtgggagggccaggccgccagcaagagcttcagacacagagtgagccagctgagcagccagtacctggccctgagcaacctgaccaaggagaaggtgagcagactggacagaatcgtggccgagcacaaccagttcagcctgggcatcaaggagctgcaggactggatgaccgacgccatccacatgctggacagctactgccaccccaccagcgacaagagcgtgctggacagcagaaccctgaagctggaggccctgctgagcgtgaagcaggagaaggagatccagatgaagatgatcgtgaccagaggcgagagcgtgctgcagaacaccagccccgagggcatccccaccatccagcagcagctgcagagcgtgaaggacatgtgggccagcctgctgagcgccggcatcagatgcaagagagtgagactgccctgcgcctacatcgccctgaagctgagagtgcaccagcacgccgagctgagagacaagaccaccatgctgggcaaggccaaggaggccgtgaccaagagcgagaagctggtgagactgcaccaggagtaccagagagacctgaaggccttcgaggtgtggctgggccaggagcaggagaagctggaccagtacagcgtgctggagggcgacgcccacacccacgagaccaccctgagagacctgcaggagctgcaggtgcactgcgccgagggccaggccctgctgaacagcgtgctgcacaccagagaggacgtgatccccagcggcatcccccaggccgaggacagagccctggagagcctgagacaggactggcaggcctaccagcacagactgagcgagaccagaacccagttcaacaacgtggtgaacaagctgagactgatggagcagaagttccagcaggtggacgagtggctgaagaccgccgaggagaaggtgagccccagaaccagaagacagagcaacagagccaccaaggagatccagctgcaccagatgaagaagtggcacgaggaggtgaccgcctacagagacgaggtggaggaggtgggcgccagagcccaggagatcctggacgagagccacgtgaacagcagaatgggctgccaggccacccagctgaccagcagataccaggccctgctgctgcaggtgctggagcagatcaagttcctggaggaggagatccagagcctggaggagagcgagagcagcctgagcagctacagcgactggtacggcagcacccacaagaacttcaagaacgtggccaccaagatcgacaaggtggacaccgtgatgatgggcaagaagctgaagaccctggaggtgctgctgaaggacatggagaagggccacagcctgctgaagagcgccagagagaagggcgagagagccgtgaagtacctggaggagggcgaggccgagagactgagaaaggagatccacgaccacatggagcagctgaaggagctgaccagcaccgtgagaaaggagcacatgaccctggagaagagcctgcagcagaccgtgctgagccacgagcccagcgtgaagagcgtgagagagaagggcgaggccctgctggagctggtgcaggacgtgaccctgaaggacaagatcgaccagctgcagagcgactaccaggacctgtgcagcatcggcaaggagcacgtgttcagcctggaggccaaggtgaaggaccacgaggactacaacagcgagctgcaggaggtggagaagtggctgctgcagatgagcggcagactggtggcccccgacctgctggagaccagcagcctggagaccatcacccagcagctggcccaccacaagatgtaccagagcctggagcacgagctgcagaagcacgtgagcagacaggacaccctgcagcagtgccaggcctggctgagcgccgtgcagcccgacctggagcccagcccccagccccccctgagcagagccgaggccatcaagcaggtgaagcacttcagagccctgcaggagcaggccagaacctacctggacctgctgtgcagcatgtgcgacctgagcaacgccagcgtgaagaccaccgccaaggacatccagcagaccgagcagaccatcgagcagaagctggtgcaggcccagaacctgacccagggctgggaggagatcaagcacctgaagagcgagctgtggatctacctgcaggacgccgaccagcagctgcagaacatgaagagaagacacagcgagctggagctgaacatcgcccagaacatggtgagccaggtgaaggacttcgtgaagaagctgcagagcaagcaggccagcgtgaacaccatcatcgagaaggtgaacaagctgaccaagaaggaggagagccccgagcacaaggagatcaaccacctgaacgaccagtggctggacctgtgcagacagagcaacaacctgtgcctgcagagagaggaggacctgcagagaaccagagactaccacgactgcatgaacgtggtggaggtgttcctggagaagttcaccaccgagtgggacaacctggccagaagcgacgccgagagcaccgccgtgcacctggaggccctgaagaagctggccctggccctgcaggagagaaagtacgccatcgaggacctgaaggaccagaagcagaagatgatcgagcacctgaacctggacgacaaggagctggtgaaggagcagaccagccacctggagcagagatggttccagctggaggacctgatcaagagaaagatccaggtgagcgtgaccaacctggaggagctgaacgtggtgcagagcagattccaggagctgatggagtgggccgaggagcagcagcccaacatcgccgaggccctgaagcagagccccccccccgacatggcccagaacctgctgatggaccacctggccatctgcagcgagctggaggccaagcagatgctgctgaagagcctgatcaaggacgccgacagagtgatggccgacctgggcctgaacgagagacaggtgatccagaaggccctgagcgacgcccagagccacgtgaactgcctgagcgacctggtgggccagagaagaaagaagcacttcaaggaggacttcgacaaggcctgccactggctgaagcaggccgacatcgtgaccttccccgagatcaacctgatgaacgagagcagcgagctgcacacccagctggccaagtaccagaacatcctggagcagagccccgagtacgagaacctgctgctgaccctgcagagaaccggccagaccatcctgcccagcctgaacgaggtggaccacagctacctgagcgagaagctgaacgccctgcccagacagttcaacgtgatcgtggccctggccaaggacaagttctacaaggtgcaggaggccatcctggccagaaaggagtacgccagcctgatcgagctgaccacccagagcctgagcgagctggaggcccagttcctgagaatgagcaaggtgcccaccgacctggccgtggaggaggccctgagcctgcaggacggctgcagagccatcctggacgaggtggccggcctgggcgaggccgtggacgagctgaaccagaagaaggagggcttcagaagcaccggccagccctggcagcccgacaagatgctgcacctggtgaccctgtaccacagactgaagagacagaccgagcagagagtgagcctgctggaggacaccaccagcgcctaccaggagcacgagaagatgtgccagcagctggagagacagctgaagagcgtgaaggaggagcagagcaaggtgaacgaggagaccctgcccgccgaggagaagctgaagatgtaccacagcctggccggcagcctgcaggacagcggcatcgtgctgaagagagtgaccatccacctggaggacctggccccccacctggaccccctggcctacgagaaggccagacaccagatccagagctggcagggcgagctgaagctgctgaccagcgccatcggcgagaccgtgaccgagtgcgagagcagaatggtgcagagcatcgacttccagaccgagatgagcagaagcctggactggctgagaagagtgaaggccgagctgagcggccccgtgtacctggacctgaacctgcaggacatccaggaggagatcagaaagatccagatccaccaggaggaggtgcagagcagcctgagaatcatgaacgccctgagccacaaggagaaggagaagttcaccaaggccaaggagctgatcagcgccgacctggagcacagcctggccgagctgagcgagctggacggcgacatccaggaggccctgagaaccagacaggccaccctgaccgagatctacagccagtgccagagatactaccaggtgttccaggccgccaacgactggctggaggacgcccaggagctgctgcagctggccggcaacggcctggacgtggagagcgccgaggagaacctgaagagccacatggagttcttcagcaccgaggaccagttccacagcaacctggaggagctgcacagcctggtggccaccctggaccccctgatcaagcccaccggcaaggaggacctggagcagaaggtggccagcctggagctgagaagccagagaatgagcagagacagcggcgcccaggccctggtgagcgtggtgaacagcttccacgagaagatcgtggccctggaggagaaggccagccagctggagaagaccggcaacgacgccagcaaggccaccctgagcagaagcatgaccaccgtgtggcagagatggaccagactgagagccgtggcccaggaccaggagaagatcctggaggacgccgtggacgagtggaccggcttcaacaacaaggtgaagaaggccaccgagatgatcgaccagctgcaggacaagctgcccggcagcagcgccgagaaggccagcaaggccgagctgctgaccctgctggagtaccacgacaccttcgtgctggagctggagcagcagcagagcgccctgggcatgctgagacagcagaccctgagcatgctgcaggacggcgccgcccccacccccggcgaggagccccccctgatgcaggagatcaccgccatgcaggacagatgcctgaagatggtggagacccagatcaacagcgtgaagtgctgggtgcaggagaccaaggagtacctgggcaaccccaccatcgagatcgacgcccagctggaggagctgcagatcctgctgaccgaggccaccaaccacagacagaacatcgagaagatggccgaggagcagaaggagaagtacctgggcctgtacaccatcctgcccagcgagctgagcctgcagctggccgaggtggccctggacctgaagatcagagaccagatccaggacaagatcaaggaggtggagcagagcaaggccaccagccaggagctgagcagacagatccagaagctggccaaggacctgaccaccatcctgaccaagctgaaggccaagaccgacaacgtggtgcaggccaagaccgaccagaaggccgccagccacctggaggagtacaacgagatgctggagctgatcctgaagtggatcgagaaggccaaggtgctggcccacggcaccatcgcctggaacagcgccagccagctgagagagcagtacatcctgcaccagaccctgctggaggagagcaaggagatcgacagcgagctggaggccatgaccgagaagctgcagtacctgaccagcgtgtactgcaccgagaagatgagccagcaggtggccgagctgggcagagagaccgaggagctgagacagatgatcaagatcagactgcagaacctgcaggacgccgccaaggacatgaagaagttcgaggccgagctgaagaagctgcaggccgccctggagcaggcccaggccaccctgaccagccccgaggtgggcagactgagcctgaaggagcagctgagccacagacagcacctgctgagcgagatggagagcctgaagcccaaggtgcaggccgtgcagctgtgccagagcgccctgagaatccccgaggacgtggtggccagcctgcccctgtgccacgccgccctgagactgcaggaggaggccagcagactgcagcacaccgccatccagcagtgcaacatcatgcaggaggccgtggtgcagtacgagcagtacgagcaggagatgaagcacctgcagcagctgatcgagggcgcccacagagagatcgaggacaagcccgtggccaccagcaacatccaggagctgcaggcccagatcagcagacacgaggagctggcccagaagatcaagggctaccaggagcagatcgccagcctgaacagcaagtgcaagatgctgaccatgaaggccaagcacgccaccatgctgctgaccgtgaccgaggtggagggcctggccgagggcaccgaggacctggacggcgagctgctgcccacccccagcgcccaccccagcgtggtgatgatgaccgccggcagatgccacaccctgctgagccccgtgaccgaggagagcggcgaggagggcaccaacagcgagatcagcagcccccccgcctgcagaagccccagccccgtggccaacaccgacgccagcgtgaaccaggacatcgcctactaccaggccctgagcgccgagagactgcagaccgacgccgccaagatccaccccagcaccagcgccagccaggagttctacgagcccggcctggagcccagcgccaccgccaagctgggcgacctgcagagaagctgggagaccctgaagaacgtgatcagcgagaagcagagaaccctgtacgaggccctggagagacagcagaagtaccaggacagcctgcagagcatcagcaccaagatggaggccatcgagctgaagctgagcgagagccccgagcccggcagaagccccgagagccagatggccgagcaccaggccctgatggacgagatcctgatgctgcaggacgagatcaacgagctgcagagcagcctggccgaggagctggtgagcgagagctgcgaggccgaccccgccgagcagctggccctgcagagcaccctgaccgtgctggccgagagaatgagcaccatcagaatgaaggccagcggcaagagacagctgctggaggagaagctgaacgaccagctggaggagcagagacaggagcaggccctgcagagatacagatgcgaggccgacgagctggacagctggctgctgagcaccaaggccaccctggacaccgccctgagcccccccaaggagcccatggacatggaggcccagctgatggactgccagaacatgctggtggagatcgagcagaaggtggtggccctgagcgagctgagcgtgcacaacgagaacctgctgctggagggcaaggcccacaccaaggacgaggccgagcagctggccggcaagctgagaagactgaagggcagcctgctggagctgcagagagccctgcacgacaagcagctgaacatgcagggcaccgcccaggagaaggaggagagcgacgtggacctgaccgccacccagagccccggcgtgcaggagtggctggcccaggccagaaccacctggacccagcagagacagagcagcctgcagcagcagaaggagctggagcaggagctggccgagcagaagagcctgctgagaagcgtggccagcagaggcgaggagatcctgatccagcacagcgccgccgagaccagcggcgacgccggcgagaagcccgacgtgctgagccaggagctgggcatggagggcgagaagagcagcgccgaggaccagatgagaatgaagtgggagagcctgcaccaggagttcagcaccaagcagaagctgctgcagaacgtgctggagcaggagcaggagcaggtgctgtacagcagacccaacagactgctgagcggcgtgcccctgtacaagggcgacgtgcccacccaggacaagagcgccgtgaccagcctgctggacggcctgaaccaggccttcgaggaggtgagcagccagagcggcggcgccaagagacagagcatccacctggagcagaagctgtacgacggcgtgagcgccaccagcacctggctggacgacgtggaggagagactgttcgtggccaccgccctgctgcccgaggagaccgagacctgcctgttcaaccaggagatcctggccaaggacatcaaggagatgagcgaggagatggacaagaacaagaacctgttcagccaggccttccccgagaacggcgacaacagagacgtgatcgaggacaccctgggctgcctgctgggcagactgagcctgctggacagcgtggtgaaccagagatgccaccagatgaaggagagactgcagcagatcctgaacttccagaacgacctgaaggtgctgttcaccagcctggccgacaacaagtacatcatcctgcagaagctggccaacgtgttcgagcagcccgtggccgagcagatcgaggccatccagcaggccgaggacggcctgaaggagttcgacgccggcatcatcgagctgaagagaagaggcgacaagctgcaggtggagcagcccagcatgcaggagctgagcaagctgcaggacatgtacgacgagctgatgatgatcatcggcagcagaagaagcggcctgaaccagaacctgaccctgaagagccagtacgagagagccctgcaggacctggccgacctgctggagaccggccaggagaagatggccggcgaccagaagatcatcgtgagcagcaaggaggagatccagcagctgctggacaagcacaaggagtacttccagggcctggagagccacatgatcctgaccgagaccctgttcagaaagatcatcagcttcgccgtgcagaaggagacccagttccacaccgagctgatggcccaggccagcgccgtgctgaagagagcccacaagagaggcgtggagctggagtacatcctggagacctggagccacctggacgaggaccagcaggagctgagcagacagctggaggtggtggagagcagcatccccagcgtgggcctggtggaggagaacgaggacagactgatcgacagaatcaccctgtaccagcacctgaagagcagcctgaacgagtaccagcccaagctgtaccaggtgctggacgacggcaagagactgctgatcagcatcagctgcagcgacctggagagccagctgaaccagctgggcgagtgctggctgagcaacaccaacaagatgagcaaggagctgcacagactggagaccatcctgaagcactggaccagataccagagcgagagcgccgacctgatccactggctgcagagcgccaaggacagactggagttctggacccagcagagcgtgaccgtgccccaggagctggagatggtgagagaccacctgaacgccttcctggagttcagcaaggaggtggacgcccagagcagcctgaagagcagcgtgctgagcaccggcaaccagctgctgagactgaagaaggtggacaccgccaccctgagaagcgagctgagcagaatcgacagccagtggaccgacctgctgaccaacatccccgccgtgcaggagaagctgcaccagctgcagatggacaagctgcccagcagacacgccatcagcgaggtgatgagctggatcagcctgatggagaacgtgatccagaaggacgaggacaacatcaagaacagcatcggctacaaggccatccacgagtacctgcagaagtacaagggcttcaagatcgacatcaactgcaagcagctgaccgtggacttcgtgaaccagagcgtgctgcagatcagcagccaggacgtggagagcaagagaagcgacaagaccgacttcgccgagcagctgggcgccatgaacaagagctggcagatcctgcagggcctggtgaccgagaagatccagctgctggagggcctgctggagagctggagcgagtacgagaacaacgtgcagtgcctgaagacctggttcgagacccaggagaagagactgaagcagcagcacagaatcggcgaccaggccagcgtgcagaacgccctgaaggactgccaggacctggaggacctgatcaaggccaaggagaaggaggtggagaagatcgagcagaacggcctggccctgatccagaacaagaaggaggacgtgagcagcatcgtgatgagcaccctgagagagctgggccagacctgggccaacctggaccacatggtgggccagctgaagatcctgctgaagagcgtgctggaccagtggagcagccacaaggtggccttcgacaagatcaacagctacctgatggaggccagatacagcctgagcagattcagactgctgaccggcagcctggaggccgtgcaggtgcaggtggacaacctgcagaacctgcaggacgacctggagaagcaggagagaagcctgcagaagttcggcagcatcaccaaccagctgctgaaggagtgccacccccccgtgaccgagaccctgaccaacaccctgaaggaggtgaacatgagatggaacaacctgctggaggagatcgccgagcagctgcagagcagcaaggccctgctgcagctgtggcagagatacaaggactacagcaagcagtgcgccagcaccgtgcagcagcaggaggacagaaccaacgagctgctgaaggccgccaccaacaaggacatcgccgacgacgaggtggccacctggatccaggactgcaacgacctgctgaagggcctgggcaccgtgaaggacagcctgttcttcctgcacgagctgggcgagcagctgaagcagcaggtggacgccagcgccgccagcgccatccagagcgaccagctgagcctgagccagcacctgtgcgccctggagcaggccctgtgcaagcagcagaccagcctgcaggccggcgtgctggactacgagaccttcgccaagagcctggaggccctggaggcctggatcgtggaggccgaggagatcctgcagggccaggaccccagccacagcagcgacctgagcaccatccaggagagaatggaggagctgaagggccagatgctgaagttcagcagcatggcccccgacctggacagactgaacgagctgggctacagactgcccctgaacgacaaggagatcaagagaatgcagaacctgaacagacactggagcctgatcagcagccagaccaccgagagattcagcaagctgcagagcttcctgctgcagcaccagaccttcctggagaagtgcgagacctggatggagttcctggtgcagaccgagcagaagctggccgtggagatcagcggcaactaccagcacctgctggagcagcagagagcccacgagctgttccaggccgagatgttcagcagacagcagatcctgcacagcatcatcatcgacggccagagactgctggagcagggccaggtggacgacagagacgagttcaacctgaagctgaccctgctgagcaaccagtggcagggcgtgatcagaagagcccagcagagaagaggcatcatcgacagccagatcagacagtggcagagatacagagagatggccgagaagctgagaaagtggctggtggaggtgagctacctgcccatgagcggcctgggcagcgtgcccatccccctgcagcaggccagaaccctgttcgacgaggtgcagttcaaggagaaggtgttcctgagacagcagggcagctacatcctgaccgtggaggccggcaagcagctgctgctgagcgccgacagcggcgccgaggccgccctgcaggccgagctggccgagatccaggagaagtggaagagcgccagcatgagactggaggagcagaagaagaagctggccttcctgctgaaggactgggagaagtgcgagaagggcatcgccgacagcctggagaagctgagaaccttcaagaagaagctgagccagagcctgcccgaccaccacgaggagctgcacgccgagcagatgagatgcaaggagctggagaacgccgtgggcagctggaccgacgacctgacccagctgagcctgctgaaggacaccctgagcgcctacatcagcgccgacgacatcagcatcctgaacgagagagtggagctgctgcagagacagtgggaggagctgtgccaccagctgagcctgagaagacagcagatcggcgagagactgaacgagtgggccgtgttcagcgagaagaacaaggagctgtgcgagtggctgacccagatggagagcaaggtgagccagaacggcgacatcctgatcgaggagatgatcgagaagctgaagaaggactaccaggaggagatcgccatcgcccaggagaacaagatccagctgcagcagatgggcgagagactggccaaggccagccacgagagcaaggccagcgagatcgagtacaagctgggcaaggtgaacgacagatggcagcacctgctggacctgatcgccgccagagtgaagaagctgaaggagaccctggtggccgtgcagcagctggacaagaacatgagcagcctgagaacctggctggcccacatcgagagcgagctggccaagcccatcgtgtacgacagctgcaacagcgaggagatccagagaaagctgaacgagcagcaggagctgcagagagacatcgagaagcacagcaccggcgtggccagcgtgctgaacctgtgcgaggtgctgctgcacgactgcgacgcctgcgccaccgacgccgagtgcgacagcatccagcaggccaccagaaacctggacagaagatggagaaacatctgcgccatgagcatggagagaagactgaagatcgaggagacctggagactgtggcagaagttcctggacgactacagcagattcgaggactggctgaagagcagcgagagaaccgccgccttccccagcagcagcggcgtgatctacaccgtggccaaggaggagctgaagaagttcgaggccttccagagacaggtgcacgagtgcctgacccagctggagctgatcaacaagcagtacagaagactggccagagagaacagaaccgacagcgcctgcagcctgaagcagatggtgcacgagggcaaccagagatgggacaacctgcagaagagagtgaccagcatcctgagaagactgaagcacttcatcggccagagagaggagttcgagaccgccagagacagcatcctggtgtggctgaccgagatggacctgcagctgaccaacatcgagcacttcagcgagtgcgacgtgcaggccaagatcaagcagctgaaggccttccagcaggagatcagcctgaaccacaacaagatcgagcagatcatcgcccagggcgagcagctgatcgagaagagcgagcccctggacgccgccatcatcgaggaggagctggacgagctgagaagatactgccaggaggtgttcggcagagtggagagataccacaagaagctgatcagactgcccctgcccgacgacgagcacgacctgagcgacagagagctggagctggaggacagcgccgccctgagcgacctgcactggcacgacagaagcgccgacagcctgctgagcccccagcccagcagcaacctgagcctgagcctggcccagcccctgagaagcgagagaagcggcagagacacccccgccagcgtggacagcatccccctggagtgggaccacgactacgacctgagcagagacctggagagcgccatgagcagagccctgcccagcgaggacgaggagggccaggacgacaaggacttctacctgagaggcgccgtgggcctgagcggcgaccacagcgccctggagagccagatcagacagctgggcaaggccctggacgacagcagattccagatccagcagaccgagaacatcatcagaagcaagacccccaccggccccgagctggacaccagctacaagggctacatgaagctgctgggcgagtgcagcagcagcatcgacagcgtgaagagactggagcacaagctgaaggaggaggaggagagcctgcccggcttcgtgaacctgcacagcaccgagacccagaccgccggcgtgatcgacagatgggagctgctgcaggcccaggccctgagcaaggagctgagaatgaagcagaacctgcagaagtggcagcagttcaacagcgacctgaacagcatctgggcctggctgggcgacaccgaggaggagctggagcagctgcagagactggagctgagcaccgacatccagaccatcgagctgcagatcaagaagctgaaggagctgcagaaggccgtggaccacagaaaggccatcatcctgagcatcaacctgtgcagccccgagttcacccaggccgacagcaaggagagcagagacctgcaggacagactgagccagatgaacggcagatgggacagagtgtgcagcctgctggaggagtggagaggcctgctgcaggacgccctgatgcagtgccagggcttccacgagatgagccacggcctgctgctgatgctggagaacatcgacagaagaaagaacgagatcgtgcccatcgacagcaacctggacgccgagatcctgcaggaccaccacaagcagctgatgcagatcaagcacgagctgctggagagccagctgagagtggccagcctgcaggacatgagctgccagctgctggtgaacgccgagggcaccgactgcctggaggccaaggagaaggtgcacgtgatcggcaacagactgaagctgctgctgaaggaggtgagcagacacatcaaggagctggagaagctgctggacgtgagcagcagccagcaggacctgagcagctggagcagcgccgacgagctggacaccagcggcagcgtgagccccaccagcggcagaagcacccccaacagacagaagacccccagaggcaagtgcagcctgagccagcccggccccagcgtgagcagcccccacagcagaagcaccaagggcggcagcgacagcagcctgagcgagcccggccccggcagaagcggcagaggcttcctgttcagagtgctgagagccgccctgcccctgcagctgctgctgctgctgctgatcggcctggcctgcctggtgcccatgagcgaggaggactacagctgcgccctgagcaacaacttcgccagaagcttccaccccatgctgagatacaccaacggccccccccccctgtag

SEQ ID NO: 100474 - DNA, 9966 bp, Artificial Sequence
  Description of Artificial Sequence: Synthetic coding sequence
atggagctggacgccgccgtgcagaagttcctggagcagaacggccagctgggcaagcccctggccaagaagatcggcaagctgaccgagctgcaccagcagaccatcagacaggccgagaacagactgagcaagctgaaccaggccgccagccacctggaggagtacaacgagatgctggagctgatcctgaagtggatcgagaaggccaaggtgctggcccacggcaccatcgcctggaacagcgccagccagctgagagagcagtacatcctgcaccagaccctgctggaggagagcaaggagatcgacagcgagctggaggccatgaccgagaagctgcagtacctgaccagcgtgtactgcaccgagaagatgagccagcaggtggccgagctgggcagagagaccgaggagctgagacagatgatcaagatcagactgcagaacctgcaggacgccgccaaggacatgaagaagttcgaggccgagctgaagaagctgcaggccgccctggagcaggcccaggccaccctgaccagccccgaggtgggcagactgagcctgaaggagcagctgagccacagacagcacctgctgagcgagatggagagcctgaagcccaaggtgcaggccgtgcagctgtgccagagcgccctgagaatccccgaggacgtggtggccagcctgcccctgtgccacgccgccctgagactgcaggaggaggccagcagactgcagcacaccgccatccagcagtgcaacatcatgcaggccgccgtggtgcagtacgagcagtacgagcaggagatgaagcacctgcagcagctgatcgagggcgcccacagagagatcgaggacaagcccgtggccaccagcaacatccaggagctgcaggcccagatcagcagacacgaggagctggcccagaagatcaagggctaccaggagcagatcgccagcctgaacagcaagtgcaagatgctgaccatgaaggccaagcacgccaccatgctgctgaccgtgaccgaggtggagggcctggccgagggcaccgaggacctggacggcgagctgctgcccacccccagcgcccaccccagcgtggtgatgatgaccgccggcagatgccacaccctgctgagccccgtgaccgaggagagcggcgaggagggcaccaacagcgagatcagcagcccccccgcctgcagaagccccagccccgtggccaacaccgacgccagcgtgaaccaggacatcgcctactaccaggccctgagcgccgagagactgcagaccgacgccgccaagatccaccccagcaccagcgccagccaggagttctacgagcccggcctggagcccagcgccaccgccaagctgggcgacctgcagagaagctgggagaccctgaagaacgtgatcagcgagaagcagagaaccctgtacgaggccctggagagacagcagaagtaccaggacagcctgcagagcatcagcaccaagatggaggccatcgagctgaagctgagcgagagccccgagcccggcagaagccccgagagccagatggccgagcaccaggccctgatggacgagatcctgatgctgcaggacgagatcaacgagctgcagagcagcctggccgaggagctggtgagcgagagctgcgaggccgaccccgccgagcagctggccctgcagagcaccctgaccgtgctggccgagagaatgagcaccatcagaatgaaggccagcggcaagagacagctgctggaggagaagctgaacgaccagctggaggagcagagacaggagcaggccctgcagagatacagatgcgaggccgacgagctggacagctggctgctgagcaccaaggccaccctggacaccgccctgagcccccccaaggagcccatggacatggaggcccagctgatggactgccagaacatgctggtggagatcgagcagaaggtggtggccctgagcgagctgagcgtgcacaacgagaacctgctgctggagggcaaggcccacaccaaggacgaggccgagcagctggccggcaagctgagaagactgaagggcagcctgctggagctgcagagagccctgcacgacaagcagctgaacatgcagggcaccgcccaggagaaggaggagagcgacgtggacctgaccgccacccagagccccggcgtgcaggagtggctggcccaggccagaaccacctggacccagcagagacagagcagcctgcagcagcagaaggagctggagcaggagctggccgagcagaagagcctgctgagaagcgtggccagcagaggcgaggagatcctgatccagcacagcgccgccgagaccagcggcgacgccggcgagaagcccgacgtgctgagccaggagctgggcatggagggcgagaagagcagcgccgaggaccagatgagaatgaagtgggagagcctgcaccaggagttcagcaccaagcagaagctgctgcagaacgtgctggagcaggagcaggagcaggtgctgtacagcagacccaacagactgctgagcggcgtgcccctgtacaagggcgacgtgcccacccaggacaagagcgccgtgaccagcctgctggacggcctgaaccaggccttcgaggaggtgagcagccagagcggcggcgccaagagacagagcatccacctggagcagaagctgtacgacggcgtgagcgccaccagcacctggctggacgacgtggaggagagactgttcgtggccaccgccctgctgcccgaggagaccgagacctgcctgttcaaccaggagatcctggccaaggacatcaaggagatgagcgaggagatggacaagaacaagaacctgttcagccaggccttccccgagaacggcgacaacagagacgtgatcgaggacaccctgggctgcctgctgggcagactgagcctgctggacagcgtggtgaaccagagatgccaccagatgaaggagagactgcagcagatcctgaacttccagaacgacctgaaggtgctgttcaccagcctggccgacaacaagtacatcatcctgcagaagctggccaacgtgttcgagcagcccgtggccgagcagatcgaggccatccagcaggccgaggacggcctgaaggagttcgacgccggcatcatcgagctgaagagaagaggcgacaagctgcaggtggagcagcccagcatgcaggagctgagcaagctgcaggacatgtacgacgagctgatgatgatcatcggcagcagaagaagcggcctgaaccagaacctgaccctgaagagccagtacgagagagccctgcaggacctggccgacctgctggagaccggccaggagaagatggccggcgaccagaagatcatcgtgagcagcaaggaggagatccagcagctgctggacaagcacaaggagtacttccagggcctggagagccacatgatcctgaccgagaccctgttcagaaagatcatcagcttcgccgtgcagaaggagacccagttccacaccgagctgatggcccaggccagcgccgtgctgaagagagcccacaagagaggcgtggagctggagtacatcctggagacctggagccacctggacgaggaccagcaggagctgagcagacagctggaggtggtggagagcagcatccccagcgtgggcctggtggaggagaacgaggacagactgatcgacagaatcaccctgtaccagcacctgaagagcagcctgaacgagtaccagcccaagctgtaccaggtgctggacgacggcaagagactgctgatcagcatcagctgcagcgacctggagagccagctgaaccagctgggcgagtgctggctgagcaacaccaacaagatgagcaaggagctgcacagactggagaccatcctgaagcactggaccagataccagagcgagagcgccgacctgatccactggctgcagagcgccaaggacagactggagttctggacccagcagagcgtgaccgtgccccaggagctggagatggtgagagaccacctgaacgccttcctggagttcagcaaggaggtggacgcccagagcagcctgaagagcagcgtgctgagcaccggcaaccagctgctgagactgaagaaggtggacaccgccaccctgagaagcgagctgagcagaatcgacagccagtggaccgacctgctgaccaacatccccgccgtgcaggagaagctgcaccagctgcagatggacaagctgcccagcagacacgccatcagcgaggtgatgagctggatcagcctgatggagaacgtgatccagaaggacgaggacaacatcaagaacagcatcggctacaaggccatccacgagtacctgcagaagtacaagggcttcaagatcgacatcaactgcaagcagctgaccgtggacttcgtgaaccagagcgtgctgcagatcagcagccaggacgtggagagcaagagaagcgacaagaccgacttcgccgagcagctgggcgccatgaacaagagctggcagatcctgcagggcctggtgaccgagaagatccagctgctggagggcctgctggagagctggagcgagtacgagaacaacgtgcagtgcctgaagacctggttcgagacccaggagaagagactgaagcagcagcacagaatcggcgaccaggccagcgtgcagaacgccctgaaggactgccaggacctggaggacctgatcaaggccaaggagaaggaggtggagaagatcgagcagaacggcctggccctgatccagaacaagaaggaggacgtgagcagcatcgtgatgagcaccctgagagagctgggccagacctgggccaacctggaccacatggtgggccagctgaagatcctgctgaagagcgtgctggaccagtggagcagccacaaggtggccttcgacaagatcaacagctacctgatggaggccagatacagcctgagcagattcagactgctgaccggcagcctggaggccgtgcaggtgcaggtggacaacctgcagaacctgcaggacgacctggagaagcaggagagaagcctgcagaagttcggcagcatcaccaaccagctgctgaaggagtgccacccccccgtgaccgagaccctgaccaacaccctgaaggaggtgaacatgagatggaacaacctgctggaggagatcgccgagcagctgcagagcagcaaggccctgctgcagctgtggcagagatacaaggactacagcaagcagtgcgccagcaccgtgcagcagcaggaggacagaaccaacgagctgctgaaggccgccaccaacaaggacatcgccgacgacgaggtggccacctggatccaggactgcaacgacctgctgaagggcctgggcaccgtgaaggacagcctgttcttcctgcacgagctgggcgagcagctgaagcagcaggtggacgccagcgccgccagcgccatccagagcgaccagctgagcctgagccagcacctgtgcgccctggagcaggccctgtgcaagcagcagaccagcctgcaggccggcgtgctggactacgagaccttcgccaagagcctggaggccctggaggcctggatcgtggaggccgaggagatcctgcagggccaggaccccagccacagcagcgacctgagcaccatccaggagagaatggaggagctgaagggccagatgctgaagttcagcagcatggcccccgacctggacagactgaacgagctgggctacagactgcccctgaacgacaaggagatcaagagaatgcagaacctgaacagacactggagcctgatcagcagccagaccaccgagagattcagcaagctgcagagcttcctgctgcagcaccagaccttcctggagaagtgcgagacctggatggagttcctggtgcagaccgagcagaagctggccgtggagatcagcggcaactaccagcacctgctggagcagcagagagcccacgagctgttccaggccgagatgttcagcagacagcagatcctgcacagcatcatcatcgacggccagagactgctggagcagggccaggtggacgacagagacgagttcaacctgaagctgaccctgctgagcaaccagtggcagggcgtgatcagaagagcccagcagagaagaggcatcatcgacagccagatcagacagtggcagagatacagagagatggccgagaagctgagaaagtggctggtggaggtgagctacctgcccatgagcggcctgggcagcgtgcccatccccctgcagcaggccagaaccctgttcgacgaggtgcagttcaaggagaaggtgttcctgagacagcagggcagctacatcctgaccgtggaggccggcaagcagctgctgctgagcgccgacagcggcgccgaggccgccctgcaggccgagctggccgagatccaggagaagtggaagagcgccagcatgagactggaggagcagaagaagaagctggccttcctgctgaaggactgggagaagtgcgagaagggcatcgccgacagcctggagaagctgagaaccttcaagaagaagctgagccagagcctgcccgaccaccacgaggagctgcacgccgagcagatgagatgcaaggagctggagaacgccgtgggcagctggaccgacgacctgacccagctgagcctgctgaaggacaccctgagcgcctacatcagcgccgacgacatcagcatcctgaacgagagagtggagctgctgcagagacagtgggaggagctgtgccaccagctgagcctgagaagacagcagatcggcgagagactgaacgagtgggccgtgttcagcgagaagaacaaggagctgtgcgagtggctgacccagatggagagcaaggtgagccagaacggcgacatcctgatcgaggagatgatcgagaagctgaagaaggactaccaggaggagatcgccatcgcccaggagaacaagatccagctgcagcagatgggcgagagactggccaaggccagccacgagagcaaggccagcgagatcgagtacaagctgggcaaggtgaacgacagatggcagcacctgctggacctgatcgccgccagagtgaagaagctgaaggagaccctggtggccgtgcagcagctggacaagaacatgagcagcctgagaacctggctggcccacatcgagagcgagctggccaagcccatcgtgtacgacagctgcaacagcgaggagatccagagaaagctgaacgagcagcaggagctgcagagagacatcgagaagcacagcaccggcgtggccagcgtgctgaacctgtgcgaggtgctgctgcacgactgcgacgcctgcgccaccgacgccgagtgcgacagcatccagcaggccaccagaaacctggacagaagatggagaaacatctgcgccatgagcatggagagaagactgaagatcgaggagacctggagactgtggcagaagttcctggacgactacagcagattcgaggactggctgaagagcagcgagagaaccgccgccttccccagcagcagcggcgtgatctacaccgtggccaaggaggagctgaagaagttcgaggccttccagagacaggtgcacgagtgcctgacccagctggagctgatcaacaagcagtacagaagactggccagagagaacagaaccgacagcgcctgcagcctgaagcagatggtgcacgagggcaaccagagatgggacaacctgcagaagagagtgaccagcatcctgagaagactgaagcacttcatcggccagagagaggagttcgagaccgccagagacagcatcctggtgtggctgaccgagatggacctgcagctgaccaacatcgagcacttcagcgagtgcgacgtgcaggccaagatcaagcagctgaaggccttccagcaggagatcagcctgaaccacaacaagatcgagcagatcatcgcccagggcgagcagctgatcgagaagagcgagcccctggacgccgccatcatcgaggaggagctggacgagctgagaagatactgccaggaggtgttcggcagagtggagagataccacaagaagctgatcagactgcccctgcccgacgacgagcacgacctgagcgacagagagctggagctggaggacagcgccgccctgagcgacctgcactggcacgacagaagcgccgacagcctgctgagcccccagcccagcagcaacctgagcctgagcctggcccagcccctgagaagcgagagaagcggcagagacacccccgccagcgtggacagcatccccctggagtgggaccacgactacgacctgagcagagacctggagagcgccatgagcagagccctgcccagcgaggacgaggagggccaggacgacaaggacttctacctgagaggcgccgtgggcctgagcggcgaccacagcgccctggagagccagatcagacagctgggcaaggccctggacgacagcagattccagatccagcagaccgagaacatcatcagaagcaagacccccaccggccccgagctggacaccagctacaagggctacatgaagctgctgggcgagtgcagcagcagcatcgacagcgtgaagagactggagcacaagctgaaggaggaggaggagagcctgcccggcttcgtgaacctgcacagcaccgagacccagaccgccggcgtgatcgacagatgggagctgctgcaggcccaggccctgagcaaggagctgagaatgaagcagaacctgcagaagtggcagcagttcaacagcgacctgaacagcatctgggcctggctgggcgacaccgaggaggagctggagcagctgcagagactggagctgagcaccgacatccagaccatcgagctgcagatcaagaagctgaaggagctgcagaaggccgtggaccacagaaaggccatcatcctgagcatcaacctgtgcagccccgagttcacccaggccgacagcaaggagagcagagacctgcaggacagactgagccagatgaacggcagatgggacagagtgtgcagcctgctggaggagtggagaggcctgctgcaggacgccctgatgcagtgccagggcttccacgagatgagccacggcctgctgctgatgctggagaacatcgacagaagaaagaacgagatcgtgcccatcgacagcaacctggacgccgagatcctgcaggaccaccacaagcagctgatgcagatcaagcacgagctgctggagagccagctgagagtggccagcctgcaggacatgagctgccagctgctggtgaacgccgagggcaccgactgcctggaggccaaggagaaggtgcacgtgatcggcaacagactgaagctgctgctgaaggaggtgagcagacacatcaaggagctggagaagctgctggacgtgagcagcagccagcaggacctgagcagctggagcagcgccgacgagctggacaccagcggcagcgtgagccccaccagcggcagaagcacccccaacagacagaagacccccagaggcaagtgcagcctgagccagcccggccccagcgtgagcagcccccacagcagaagcaccaagggcggcagcgacagcagcctgagcgagcccggccccggcagaagcggcagaggcttcctgttcagagtgctgagagccgccctgcccctgcagctgctgctgctgctgctgatcggcctggcctgcctggtgcccatgagcgaggaggactacagctgcgccctgagcaacaacttcgccagaagcttccaccccatgctgagatacaccaacggccccccccccctgtag

SEQ ID NO: 100475 - DNA, 2934 bp, Artificial Sequence
  Description of Artificial Sequence: Synthetic coding sequence
atggtggtggccgaggacctgagcgccctgagaatggccgaggacagctgcgtggacgccgacctgcccgactgcaactgcgacgtgaccagacagagagtgaagaagctgaaggagaccctggtggccgtgcagcagctggacaagaacatgagcagcctgagaacctggctggcccacatcgagagcgagctggccaagcccatcgtgtacgacagctgcaacagcgaggagatccagagaaagctgaacgagcagcaggagctgcagagagacatcgagaagcacagcaccggcgtggccagcgtgctgaacctgtgcgaggtgctgctgcacgactgcgacgcctgcgccaccgacgccgagtgcgacagcatccagcaggccaccagaaacctggacagaagatggagaaacatctgcgccatgagcatggagagaagactgaagatcgaggagacctggagactgtggcagaagttcctggacgactacagcagattcgaggactggctgaagagcagcgagagaaccgccgccttccccagcagcagcggcgtgatctacaccgtggccaaggaggagctgaagaagttcgaggccttccagagacaggtgcacgagtgcctgacccagctggagctgatcaacaagcagtacagaagactggccagagagaacagaaccgacagcgcctgcagcctgaagcagatggtgcacgagggcaaccagagatgggacaacctgcagaagagagtgaccagcatcctgagaagactgaagcacttcatcggccagagagaggagttcgagaccgccagagacagcatcctggtgtggctgaccgagatggacctgcagctgaccaacatcgagcacttcagcgagtgcgacgtgcaggccaagatcaagcagctgaaggccttccagcaggagatcagcctgaaccacaacaagatcgagcagatcatcgcccagggcgagcagctgatcgagaagagcgagcccctggacgccgccatcatcgaggaggagctggacgagctgagaagatactgccaggaggtgttcggcagagtggagagataccacaagaagctgatcagactgcccctgcccgacgacgagcacgacctgagcgacagagagctggagctggaggacagcgccgccctgagcgacctgcactggcacgacagaagcgccgacagcctgctgagcccccagcccagcagcaacctgagcctgagcctggcccagcccctgagaagcgagagaagcggcagagacacccccgccagcgtggacagcatccccctggagtgggaccacgactacgacctgagcagagacctggagagcgccatgagcagagccctgcccagcgaggacgaggagggccaggacgacaaggacttctacctgagaggcgccgtgggcctgagcgacgtgatgatccccgagagccccgaggcctacgtgaagctgaccgagaacgccatcaagaacaccagcggcgaccacagcgccctggagagccagatcagacagctgggcaaggccctggacgacagcagattccagatccagcagaccgagaacatcatcagaagcaagacccccaccggccccgagctggacaccagctacaagggctacatgaagctgctgggcgagtgcagcagcagcatcgacagcgtgaagagactggagcacaagctgaaggaggaggaggagagcctgcccggcttcgtgaacctgcacagcaccgagacccagaccgccggcgtgatcgacagatgggagctgctgcaggcccaggccctgagcaaggagctgagaatgaagcagaacctgcagaagtggcagcagttcaacagcgacctgaacagcatctgggcctggctgggcgacaccgaggaggagctggagcagctgcagagactggagctgagcaccgacatccagaccatcgagctgcagatcaagaagctgaaggagctgcagaaggccgtggaccacagaaaggccatcatcctgagcatcaacctgtgcagccccgagttcacccaggccgacagcaaggagagcagagacctgcaggacagactgagccagatgaacggcagatgggacagagtgtgcagcctgctggaggagtggagaggcctgctgcaggacgccctgatgcagtgccagggcttccacgagatgagccacggcctgctgctgatgctggagaacatcgacagaagaaagaacgagatcgtgcccatcgacagcaacctggacgccgagatcctgcaggaccaccacaagcagctgatgcagatcaagcacgagctgctggagagccagctgagagtggccagcctgcaggacatgagctgccagctgctggtgaacgccgagggcaccgactgcctggaggccaaggagaaggtgcacgtgatcggcaacagactgaagctgctgctgaaggaggtgagcagacacatcaaggagctggagaagctgctggacgtgagcagcagccagcaggacctgagcagctggagcagcgccgacgagctggacaccagcggcagcgtgagccccaccagcggcagaagcacccccaacagacagaagacccccagaggcaagtgcagcctgagccagcccggccccagcgtgagcagcccccacagcagaagcaccaagggcggcagcgacagcagcctgagcgagcccggccccggcagaagcggcagaggcttcctgttcagagtgctgagagccgccctgcccctgcagctgctgctgctgctgctgatcggcctggcctgcctggtgcccatgagcgaggaggactacagctgcgccctgagcaacaacttcgccagaagcttccaccccatgctgagatacaccaacggccccccccccctgtag

SEQ ID NO: 100476 - DNA, 26394 bp, Artificial Sequence
  Description of Artificial Sequence: Synthetic coding sequence
atggccaccagcagaggcgccagcagatgccccagagacatcgccaacgtgatgcagagactgcaggacgagcaggagatcgtgcagaagagaaccttcaccaagtggatcaacagccacctggccaagagaaagccccccatggtggtggacgacctgttcgaggacatgaaggacggcgtgaagctgctggccctgctggaggtgctgagcggccagaagctgccctgcgagcagggcagaagaatgaagagaatccacgccgtggccaacatcggcaccgccctgaagttcctggagggcagaaagatcaagctggtgaacatcaacagcaccgacatcgccgacggcagacccagcatcgtgctgggcctgatgtggaccatcatcctgtacttccagatcgaggagctgaccagcaacctgccccagctgcagagcctgagcagcagcgccagcagcgtggacagcatcgtgagcagcgagacccccagcccccccagcaagagaaaggtgaccaccaagatccagggcaacgccaagaaggccctgctgaagtgggtgcagtacaccgccggcaagcagaccggcatcgaggtgaaggacttcggcaagagctggagaagcggcgtggccttccacagcgtgatccacgccatcagacccgagctggtggacctggagaccgtgaagggcagaagcaacagagagaacctggaggacgccttcaccatcgccgagaccgagctgggcatccccagactgctggaccccgaggacgtggacgtggacaagcccgacgagaagagcatcatgacctacgtggcccagttcctgaagcactaccccgacatccacaacgccagcaccgacggccaggaggacgacgagatcctgcccggcttccccagcttcgccaacagcgtgcagaacttcaagagagaggacagagtgatcttcaaggagatgaaggtgtggatcgagcagttcgagagagacctgaccagagcccagatggtggagagcaacctgcaggacaagtaccagagcttcaagcacttcagagtgcagtacgagatgaagagaaagcagatcgagcacctgatccagcccctgcacagagacggcaagctgagcctggaccaggccctggtgaagcagagctgggacagagtgaccagcagactgttcgactggcacatccagctggacaagagcctgcccgcccccctgggcaccatcggcgcctggctgtacagagccgaggtggccctgagagaggagatcaccgtgcagcaggtgcacgaggagaccgccaacaccatccagagaaagctggagcagcacaaggacctgctgcagaacaccgacgcccacaagagagccttccacgagatctacagaaccagaagcgtgaacggcatccccgtgccccccgaccagctggaggacatggccgagagattccacttcgtgagcagcaccagcgagctgcacctgatgaagatggagttcctggagctgaagtacagactgctgagcctgctggtgctggccgagagcaagctgaagagctggatcatcaagtacggcagaagagagagcgtggagcagctgctgcagaactacgtgagcttcatcgagaacagcaagttcttcgagcagtacgaggtgacctaccagatcctgaagcagaccgccgagatgtacgtgaaggccgacggcagcgtggaggaggccgagaacgtgatgaagttcatgaacgagaccaccgcccagtggagaaacctgagcgtggaggtgagaagcgtgagaagcatgctggaggaggtgatcagcaactgggacagatacggcaacaccgtggccagcctgcaggcctggctggaggacgccgagaagatgctgaaccagagcgagaacgccaagaaggacttcttcagaaacctgccccactggatccagcagcacaccgccatgaacgacgccggcaacttcctgatcgagacctgcgacgagatggtgagcagagacctgaagcagcagctgctgctgctgaacggcagatggagagagctgttcatggaggtgaagcagtacgcccaggccgacgagatggacagaatgaagaaggagtacaccgactgcgtggtgaccctgagcgccttcgccaccgaggcccacaagaagctgagcgagcccctggaggtgagcttcatgaacgtgaagctgctgatccaggacctggaggacatcgagcagagagtgcccgtgatggacgcccagtacaagatcatcaccaagaccgcccacctgatcaccaaggagagcccccaggaggagggcaaggagatgttcgccaccatgagcaagctgaaggagcagctgaccaaggtgaaggagtgctacagccccctgctgtacgagagccagcagctgctgatccccctggaggagctggagaagcagatgaccagcttctacgacagcctgggcaagatcaacgagatcatcaccgtgctggagagagaggcccagagcagcgccctgttcaagcagaagcaccaggagctgctggcctgccaggagaactgcaagaagaccctgaccctgatcgagaagggcagccagagcgtgcagaagttcgtgaccctgagcaacgtgctgaagcacttcgaccagaccagactgcagagacagatcgccgacatccacgtggccttccagagcatggtgaagaagaccggcgactggaagaagcacgtggagaccaacagcagactgatgaagaagttcgaggagagcagagccgagctggagaaggtgctgagaatcgcccaggagggcctggaggagaagggcgaccccgaggagctgctgagaagacacaccgagttcttcagccagctggaccagagagtgctgaacgccttcctgaaggcctgcgacgagctgaccgacatcctgcccgagcaggagcagcagggcctgcaggaggccgtgagaaagctgcacaagcagtggaaggacctgcagggcgaggccccctaccacctgctgcacctgaagatcgacgtggagaagaacagattcctggccagcgtggaggagtgcagaaccgagctggacagagagaccaagctgatgccccaggagggcagcgagaagatcatcaaggagcacagagtgttcttcagcgacaagggcccccaccacctgtgcgagaagagactgcagctgatcgaggagctgtgcgtgaagctgcccgtgagagaccccgtgagagacacccccggcacctgccacgtgaccctgaaggagctgagagccgccatcgacagcacctacagaaagctgatggaggaccccgacaagtggaaggactacaccagcagattcagcgagttcagcagctggatcagcaccaacgagacccagctgaagggcatcaagggcgaggccatcgacaccgccaaccacggcgaggtgaagagagccgtggaggagatcagaaacggcgtgaccaagagaggcgagaccctgagctggctgaagagcagactgaaggtgctgaccgaggtgagcagcgagaacgaggcccagaagcagggcgacgagctggccaagctgagcagcagcttcaaggccctggtgaccctgctgagcgaggtggagaagatgctgagcaacttcggcgactgcgtgcagtacaaggagatcgtgaagaacagcctggaggagctgatcagcggcagcaaggaggtgcaggagcaggccgagaagatcctggacaccgagaacctgttcgaggcccagcagctgctgctgcaccaccagcagaagaccaagagaatcagcgccaagaagagagacgtgcagcagcagatcgcccaggcccagcagggcgagggcggcctgcccgacagaggccacgaggagctgagaaagctggagagcaccctggacggcctggagagaagcagagagagacaggagagaagaatccaggtgaccctgagaaagtgggagagattcgagaccaacaaggagaccgtggtgagatacctgttccagaccggcagcagccacgagagattcctgagcttcagcagcctggagagcctgagcagcgagctggagcagaccaaggagttcagcaagagaaccgagagcatcgccgtgcaggccgagaacctggtgaaggaggccagcgagatccccctgggcccccagaacaagcagctgctgcagcagcaggccaagagcatcaaggagcaggtgaagaagctggaggacaccctggaggaggacatcaagaccatggagatggtgaagaccaagtgggaccacttcggcagcaacttcgagaccctgagcgtgtggatcaccgagaaggagaaggagctgaacgccctggagaccagcagcagcgccatggacatgcagatcagccagatcaaggtgaccatccaggagatcgagagcaagctgagcagcatcgtgggcctggaggaggaggcccagagcttcgcccagttcgtgaccaccggcgagagcgccagaatcaaggccaagctgacccagatcagaagatacggcgaggagctgagagagcacgcccagtgcctggagggcaccatcctgggccacctgagccagcagcagaagttcgaggagaacctgagaaagatccagcagagcgtgagcgagttcgaggacaagctggccgtgcccatcaagatctgcagcagcgccaccgagacctacaaggtgctgcaggagcacatggacctgtgccaggccctggagagcctgagcagcgccatcaccgccttcagcgccagcgccagaaaggtggtgaacagagacagctgcgtgcaggaggccgccgccctgcagcagcagtacgaggacatcctgagaagagccaaggagagacagaccgccctggagaacctgctggcccactggcagagactggagaaggagctgagcagcttcctgacctggctggagagaggcgaggccaaggccagcagccccgagatggacatcagcgccgacagagtgaaggtggagggcgagctgcagctgatccaggccctgcagaacgaggtggtgagccaggccagcttctacagcaagctgctgcagctgaaggagagcctgttcagcgtggccagcaaggacgacgtgaagatgatgaagctgcacctggagcagctggacgagagatggagagacctgccccagatcatcaacaagagaatcaacttcctgcagagcgtggtggccgagcaccagcagttcgacgagctgctgctgagcttcagcgtgtggatcaagctgttcctgagcgagctgcagaccaccagcgagatcagcatcatggaccaccaggtggccctgaccagacacaaggaccacgccgccgaggtggagagcaagaagggcgagctgcagagcctgcagggccacctggccaagctgggcagcctgggcagagccgaggacctgcacctgctgcagggcaaggccgaggactgcttccagctgttcgaggaggccagccaggtggtggagagaagacagctggccctgagccacctggccgagttcctgcagagccacgccagcctgagcggcatcctgagacagctgagacagaccgtggaggccaccaacagcatgaacaagaacgagagcgacctgatcgagaaggacctgaacgacgccctgcagaacgccaaggccctggagagcgccgccgtgagcctggacggcatcctgagcaaggcccagtaccacctgaagatcggcagcagcgagcagagaaccagctgcagagccaccgccgaccagctgtgcggcgaggtggagagaatccagaacctgctgggcaccaagcagagcgaggccgacgccctggccgtgctgaagaaggccttccaggaccagaaggaggagctgctgaagagcatcgaggacatcgaggagagaaccgacaaggagagactgaaggagcccaccagacaggccctgcagcagagactgagagtgttcaaccagctggaggacgagctgaacagccacgagcacgagctgtgctggctgaaggacaaggccaagcagatcgcccagaaggacgtggccttcgcccccgaggtggacagagagatcaacagactggaggtgacctgggacgacaccaagagactgatccacgagaaccagggccagtgctgcggcctgatcgacctgatgagagagtaccagaacctgaagagcgccgtgagcaaggtgctggagaacgccagcagcgtgatcgtgaccagaaccaccatcaaggaccaggaggacctgaagtgggccttcagcaagcacgagaccgccaagaacaagatgaactacaagcagaaggacctggacaacttcaccagcaagggcaagcacctgctgagcgagctgaagaagatccacagcagcgacttcagcctggtgaagaccgacatggagagcaccgtggacaagtggctggacgtgagcgagaagctggaggagaacatggacagactgagagtgagcctgagcatctgggacgacgtgctgagcaccagagacgagatcgagggctggagcaacaactgcgtgccccagatggccgagaacatcagcaacctggacaaccacctgagagccgaggagctgctgaaggagttcgagagcgaggtgaagaacaaggccctgagactggaggagctgcacagcaaggtgaacgacctgaaggagctgaccaagaacctggagaccccccccgacctgcagttcatcgaggccgacctgatgcagaagctggagcacgccaaggagatcaccgaggtggccaagggcaccctgaaggacttcaccgcccagagcacccaggtggagaagttcatcaacgacatcaccacctggttcaccaaggtggaggagagcctgatgaactgcgcccagaacgagacctgcgaggccctgaagaaggtgaaggacatccagaaggagctgcagagccagcagagcaacatcagcagcacccaggagaacctgaacagcctgtgcagaaagtaccacagcgccgagctggagagcctgggcagagccatgaccggcctgatcaagaagcacgaggccgtgagccagctgtgcagcaagacccaggccagcctgcaggagagcctggagaagcacttcagcgagagcatgcaggagttccaggagtggttcctgggcgccaaggccgccgccaaggagagcagcgacagaaccggcgacagcaaggtgctggaggccaagctgcacgacctgcagaacatcctggacagcgtgagcgacggccagagcaagctggacgccgtgacccaggagggccagaccctgtacgcccacctgagcaagcagatcgtgagcagcatccaggagcagatcaccaaggccaacgaggagttccaggccttcctgaagcagtgcctgaaggacaagcaggccctgcaggactgcgccagcgagctgggcagcttcgaggaccagcacagaaagctgaacctgtggatccacgagatggaggagagattcaacaccgagaacctgggcgagagcaagcagcacatccccgagaagaagaacgaggtgcacaaggtggagatgttcctgggcgagctgctggccgccagagagagcctggacaagctgagccagagaggccagctgctgagcgaggagggccacggcgccggccaggagggcagactgtgcagccagctgctgaccagccaccagaacctgctgagaatgaccaaggagaagctgagaagctgccaggtggccctgcaggagcacgaggccctggaggaggccctgcagagcatgtggttctgggtgaaggccatccaggacagactggcctgcgccgagagcaccctgggcagcaaggacaccctggagaagagactgagccagatccaggacatcctgctgatgaagggcgagggcgaggtgaagctgaacatggccatcggcaagggcgagcaggccctgagaagcagcaacaaggagggccagagagtgatccagacccagctggagaccctgaaggaggtgtgggccgacatcatgagcagcagcgtgcacgcccagagcaccctggagagcgtgatcagccagtggaacgactacgtggagagaaagaaccagctggagcagtggatggagagcgtggaccagaagatcgagcaccccctgcagccccagcccggcctgaaggagaagttcgtgctgctggaccacctgcagagcatcctgagcgaggccgaggaccacaccagagccctgcacagactgatcgccaagagcagagagctgtacgagaagaccgaggacgagagcttcaaggacaccgcccaggaggagctgaagacccagttcaacgacatcatgaccgtggccaaggagaagatgagaaaggtggaggagatcgtgaaggaccacctgatgtacctggacgccgtgcacgagttcaccgactggctgcacagcgccaaggaggagctgcacagatggagcgacatgagcggcgacagcagcgccacccagaagaagctgagcaagatcaaggagctgatcgacagcagagagatcggcgccagcagactgagcagagtggagagcctggcccccgaggtgaagcagaacaccaccgccagcggctgcgagctgatgcacaccgagatgcaggccctgagagccgactggaagcagtgggaggacagcgtgttccagacccagagctgcctggagaacctggtgagccagatggccctgagcgagcaggagttcagcggccaggtggcccagctggagcaggccctggagcagttcagcgccctgctgaagacctgggcccagcagctgaccctgctggagggcaagaacaccgacgaggagatcgtggagtgctggcacaagggccaggagatcctggacgccctgcagaaggccgagcccagaaccgaggacctgaagagccagctgaacgagctgtgcagattcagcagagacctgagcacctacagcggcaaggtgagcggcctgatcaaggagtacaactgcctgtgcctgcaggccagcaagggctgccagaacaaggagcagatcctgcagcagagattcagaaaggccttcagagacttccagcagtggctggtgaacgccaagatcaccaccgccaagtgcttcgacatcccccagaacatcagcgaggtgagcaccagcctgcagaagatccaggagttcctgagcgagagcgagaacggccagcacaagctgaacatgatgctgagcaagggcgagctgctgagcaccctgctgaccaaggagaaggccaagggcatccaggccaaggtgaccgccgccaaggaggactggaagaacttccacagcaacctgcaccagaaggagagcgccctggagaacctgaagatccagatgaaggacttcgaggtgagcgccgagcccatccaggactggctgagcaagaccgagaagatggtgcacgagagcagcaacagactgtacgacctgcccgccaagagaagagagcagcagaagctgcagagcgtgctggaggagatccactgctacgagccccagctgaacagactgaaggagaaggcccagcagctgtgggagggccaggccgccagcaagagcttcagacacagagtgagccagctgagcagccagtacctggccctgagcaacctgaccaaggagaaggtgagcagactggacagaatcgtggccgagcacaaccagttcagcctgggcatcaaggagctgcaggactggatgaccgacgccatccacatgctggacagctactgccaccccaccagcgacaagagcgtgctggacagcagaaccctgaagctggaggccctgctgagcgtgaagcaggagaaggagatccagatgaagatgatcgtgaccagaggcgagagcgtgctgcagaacaccagccccgagggcatccccaccatccagcagcagctgcagagcgtgaaggacatgtgggccagcctgctgagcgccggcatcagatgcaagagccagctggagggcgccctgagcaagtggaccagctaccaggacggcgtgagacagttcagcggctggatggacagcatggaggccaacctgaacgagagcgagagacagcacgccgagctgagagacaagaccaccatgctgggcaaggccaagctgctgaacgaggaggtgctgagctacagcagcctgctggagaccatcgaggtgaagggcgccggcatgaccgagcactacgtgacccagctggagctgcaggacctgcaggagagatacagagccatccaggagagagccaaggaggccgtgaccaagagcgagaagctggtgagactgcaccaggagtaccagagagacctgaaggccttcgaggtgtggctgggccaggagcaggagaagctggaccagtacagcgtgctggagggcgacgcccacacccacgagaccaccctgagagacctgcaggagctgcaggtgcactgcgccgagggccaggccctgctgaacagcgtgctgcacaccagagaggacgtgatccccagcggcatcccccaggccgaggacagagccctggagagcctgagacaggactggcaggcctaccagcacagactgagcgagaccagaacccagttcaacaacgtggtgaacaagctgagactgatggagcagaagttccagcaggtggacgagtggctgaagaccgccgaggagaaggtgagccccagaaccagaagacagagcaacagagccaccaaggagatccagctgcaccagatgaagaagtggcacgaggaggtgaccgcctacagagacgaggtggaggaggtgggcgccagagcccaggagatcctggacgagagccacgtgaacagcagaatgggctgccaggccacccagctgaccagcagataccaggccctgctgctgcaggtgctggagcagatcaagttcctggaggaggagatccagagcctggaggagagcgagagcagcctgagcagctacagcgactggtacggcagcacccacaagaacttcaagaacgtggccaccaagatcgacaaggtggacaccgtgatgatgggcaagaagctgaagaccctggaggtgctgctgaaggacatggagaagggccacagcctgctgaagagcgccagagagaagggcgagagagccgtgaagtacctggaggagggcgaggccgagagactgagaaaggagatccacgaccacatggagcagctgaaggagctgaccagcaccgtgagaaaggagcacatgaccctggagaagggcctgcacctggccaaggagttcagcgacaagtgcaaggccctgacccagtggatcgccgagtaccaggagatcctgcacgtgcccgaggagcccaagatggagctgtacgagaagaaggcccagctgagcaagtacaagagcctgcagcagaccgtgctgagccacgagcccagcgtgaagagcgtgagagagaagggcgaggccctgctggagctggtgcaggacgtgaccctgaaggacaagatcgaccagctgcagagcgactaccaggacctgtgcagcatcggcaaggagcacgtgttcagcctggaggccaaggtgaaggaccacgaggactacaacagcgagctgcaggaggtggagaagtggctgctgcagatgagcggcagactggtggcccccgacctgctggagaccagcagcctggagaccatcacccagcagctggcccaccacaaggccatgatggaggagatcgccggcttcgaggacagactgaacaacctgcagatgaagggcgacaccctgatcggccagtgcgccgaccacctgcaggccaagctgaagcagaacgtgcacgcccacctgcagggcaccaaggacagctacagcgccatctgcagcaccgcccagagaatgtaccagagcctggagcacgagctgcagaagcacgtgagcagacaggacaccctgcagcagtgccaggcctggctgagcgccgtgcagcccgacctggagcccagcccccagccccccctgagcagagccgaggccatcaagcaggtgaagcacttcagagccctgcaggagcaggccagaacctacctggacctgctgtgcagcatgtgcgacctgagcaacgccagcgtgaagaccaccgccaaggacatccagcagaccgagcagaccatcgagcagaagctggtgcaggcccagaacctgacccagggctgggaggagatcaagcacctgaagagcgagctgtggatctacctgcaggacgccgaccagcagctgcagaacatgaagagaagacacagcgagctggagctgaacatcgcccagaacatggtgagccaggtgaaggacttcgtgaagaagctgcagagcaagcaggccagcgtgaacaccatcatcgagaaggtgaacaagctgaccaagaaggaggagagccccgagcacaaggagatcaaccacctgaacgaccagtggctggacctgtgcagacagagcaacaacctgtgcctgcagagagaggaggacctgcagagaaccagagactaccacgactgcatgaacgtggtggaggtgttcctggagaagttcaccaccgagtgggacaacctggccagaagcgacgccgagagcaccgccgtgcacctggaggccctgaagaagctggccctggccctgcaggagagaaagtacgccatcgaggacctgaaggaccagaagcagaagatgatcgagcacctgaacctggacgacaaggagctggtgaaggagcagaccagccacctggagcagagatggttccagctggaggacctgatcaagagaaagatccaggtgagcgtgaccaacctggaggagctgaacgtggtgcagagcagattccaggagctgatggagtgggccgaggagcagcagcccaacatcgccgaggccctgaagcagagccccccccccgacatggcccagaacctgctgatggaccacctggccatctgcagcgagctggaggccaagcagatgctgctgaagagcctgatcaaggacgccgacagagtgatggccgacctgggcctgaacgagagacaggtgatccagaaggccctgagcgacgcccagagccacgtgaactgcctgagcgacctggtgggccagagaagaaagtacctgaacaaggccctgagcgagaagacccagttcctgatggccgtgttccaggccaccagccagatccagcagcacgagagaaagatcatgttcagagagcacatctgcctgctgcccgacgacgtgagcaagcaggtgaagacctgcaagagcgcccaggccagcctgaagacctaccagaacgaggtgaccggcctgtgggcccagggcagagagctgatgaaggaggtgaccgagcaggagaagagcgaggtgctgggcaagctgcaggagctgcagagcgtgtacgacagcgtgctgcagaagtgcagccacagactgcaggagctggagaagaacctggtgagcagaaagcacttcaaggaggacttcgacaaggcctgccactggctgaagcaggccgacatcgtgaccttccccgagatcaacctgatgaacgagagcagcgagctgcacacccagctggccaagtaccagaacatcctggagcagagccccgagtacgagaacctgctgctgaccctgcagagaaccggccagaccatcctgcccagcctgaacgaggtggaccacagctacctgagcgagaagctgaacgccctgcccagacagttcaacgtgatcgtggccctggccaaggacaagttctacaaggtgcaggaggccatcctggccagaaaggagtacgccagcctgatcgagctgaccacccagagcctgagcgagctggaggcccagttcctgagaatgagcaaggtgcccaccgacctggccgtggaggaggccctgagcctgcaggacggctgcagagccatcctggacgaggtggccggcctgggcgaggccgtggacgagctgaaccagaagaaggagggcttcagaagcaccggccagccctggcagcccgacaagatgctgcacctggtgaccctgtaccacagactgaagagacagaccgagcagagagtgagcctgctggaggacaccaccagcgcctaccaggagcacgagaagatgtgccagcagctggagagacagctgaagagcgtgaaggaggagcagagcaaggtgaacgaggagaccctgcccgccgaggagaagctgaagatgtaccacagcctggccggcagcctgcaggacagcggcatcgtgctgaagagagtgaccatccacctggaggacctggccccccacctggaccccctggcctacgagaaggccagacaccagatccagagctggcagggcgagctgaagctgctgaccagcgccatcggcgagaccgtgaccgagtgcgagagcagaatggtgcagagcatcgacttccagaccgagatgagcagaagcctggactggctgagaagagtgaaggccgagctgagcggccccgtgtacctggacctgaacctgcaggacatccaggaggagatcagaaagatccagatccaccaggaggaggtgcagagcagcctgagaatcatgaacgccctgagccacaaggagaaggagaagttcaccaaggccaaggagctgatcagcgccgacctggagcacagcctggccgagctgagcgagctggacggcgacatccaggaggccctgagaaccagacaggccaccctgaccgagatctacagccagtgccagagatactaccaggtgttccaggccgccaacgactggctggaggacgcccaggagctgctgcagctggccggcaacggcctggacgtggagagcgccgaggagaacctgaagagccacatggagttcttcagcaccgaggaccagttccacagcaacctggaggagctgcacagcctggtggccaccctggaccccctgatcaagcccaccggcaaggaggacctggagcagaaggtggccagcctggagctgagaagccagagaatgagcagagacagcggcgcccaggtggacctgctgcagagatgcaccgcccagtggcacgactaccagaaggccagagaggaggtgatcgagctgatgaacgacaccgagaagaagctgagcgagttcagcctgctgaagaccagcagcagccacgaggccgaggagaagctgagcgagcacaaggccctggtgagcgtggtgaacagcttccacgagaagatcgtggccctggaggagaaggccagccagctggagaagaccggcaacgacgccagcaaggccaccctgagcagaagcatgaccaccgtgtggcagagatggaccagactgagagccgtggcccaggaccaggagaagatcctggaggacgccgtggacgagtggaccggcttcaacaacaaggtgaagaaggccaccgagatgatcgaccagctgcaggacaagctgcccggcagcagcgccgagaaggccagcaaggccgagctgctgaccctgctggagtaccacgacaccttcgtgctggagctggagcagcagcagagcgccctgggcatgctgagacagcagaccctgagcatgctgcaggacggcgccgcccccacccccggcgaggagccccccctgatgcaggagatcaccgccatgcaggacagatgcctgaacatgcaggagaaggtgaagaccaacggcaagctggtgaagcaggagctgaaggacagagagatggtggagacccagatcaacagcgtgaagtgctgggtgcaggagaccaaggagtacctgggcaaccccaccatcgagatcgacgcccagctggaggagctgcagatcctgctgaccgaggccaccaaccacagacagaacatcgagaagatggccgaggagcagaaggagaagtacctgggcctgtacaccatcctgcccagcgagctgagcctgcagctggccgaggtggccctggacctgaagatcagagaccagatccaggacaagatcaaggaggtggagcagagcaaggccaccagccaggagctgagcagacagatccagaagctggccaaggacctgaccaccatcctgaccaagctgaaggccaagaccgacaacgtggtgcaggccaagaccgaccagaaggtgctgggcgaggagctggacggctgcaacagcaagctgatggagctggacgccgccgtgcagaagttcctggagcagaacggccagctgggcaagcccctggccaagaagatcggcaagctgaccgagctgcaccagcagaccatcagacaggccgagaacagactgagcaagctgaaccaggccgccagccacctggaggagtacaacgagatgctggagctgatcctgaagtggatcgagaaggccaaggtgctggcccacggcaccatcgcctggaacagcgccagccagctgagagagcagtacatcctgcaccagaccctgctggaggagagcaaggagatcgacagcgagctggaggccatgaccgagaagctgcagtacctgaccagcgtgtactgcaccgagaagatgagccagcaggtggccgagctgggcagagagaccgaggagctgagacagatgatcaagatcagactgcagaacctgcaggacgccgccaaggacatgaagaagttcgaggccgagctgaagaagctgcaggccgccctggagcaggcccaggccaccctgaccagccccgaggtgggcagactgagcctgaaggagcagctgagccacagacagcacctgctgagcgagatggagagcctgaagcccaaggtgcaggccgtgcagctgtgccagagcgccctgagaatccccgaggacgtggtggccagcctgcccctgtgccacgccgccctgagactgcaggaggaggccagcagactgcagcacaccgccatccagcagtgcaacatcatgcaggaggccgtggtgcagtacgagcagtacgagcaggagatgaagcacctgcagcagctgatcgagggcgcccacagagagatcgaggacaagcccgtggccaccagcaacatccaggagctgcaggcccagatcagcagacacgaggagctggcccagaagatcaagggctaccaggagcagatcgccagcctgaacagcaagtgcaagatgctgaccatgaaggccaagcacgccaccatgctgctgaccgtgaccgaggtggagggcctggccgagggcaccgaggacctggacggcgagctgctgcccacccccagcgcccaccccagcgtggtgatgatgaccgccggcagatgccacaccctgctgagccccgtgaccgaggagagcggcgaggagggcaccaacagcgagatcagcagcccccccgcctgcagaagccccagccccgtggccaacaccgacgccagcgtgaaccaggacatcgcctactaccaggccctgagcgccgagagactgcagaccgacgccgccaagatccaccccagcaccagcgccagccaggagttctacgagcccggcctggagcccagcgccaccgccaagctgggcgacctgcagagaagctgggagaccctgaagaacgtgatcagcgagaagcagagaaccctgtacgaggccctggagagacagcagaagtaccaggacagcctgcagagcatcagcaccaagatggaggccatcgagctgaagctgagcgagagccccgagcccggcagaagccccgagagccagatggccgagcaccaggccctgatggacgagatcctgatgctgcaggacgagatcaacgagctgcagagcagcctggccgaggagctggtgagcgagagctgcgaggccgaccccgccgagcagctggccctgcagagcaccctgaccgtgctggccgagagaatgagcaccatcagaatgaaggccagcggcaagagacagctgctggaggagaagctgaacgaccagctggaggagcagagacaggagcaggccctgcagagatacagatgcgaggccgacgagctggacagctggctgctgagcaccaaggccaccctggacaccgccctgagcccccccaaggagcccatggacatggaggcccagctgatggactgccagaacatgctggtggagatcgagcagaaggtggtggccctgagcgagctgagcgtgcacaacgagaacctgctgctggagggcaaggcccacaccaaggacgaggccgagcagctggccggcaagctgagaagactgaagggcagcctgctggagctgcagagagccctgcacgacaagcagctgaacatgcagggcaccgcccaggagaaggaggagagcgacgtggacctgaccgccacccagagccccggcgtgcaggagtggctggcccaggccagaaccacctggacccagcagagacagagcagcctgcagcagcagaaggagctggagcaggagctggccgagcagaagagcctgctgagaagcgtggccagcagaggcgaggagatcctgatccagcacagcgccgccgagaccagcggcgacgccggcgagaagcccgacgtgctgagccaggagctgggcatggagggcgagaagagcagcgccgaggaccagatgagaatgaagtgggagagcctgcaccaggagttcagcaccaagcagaagctgctgcagaacgtgctggagcaggagcaggagcaggtgctgtacagcagacccaacagactgctgagcggcgtgcccctgtacaagggcgacgtgcccacccaggacaagagcgccgtgaccagcctgctggacggcctgaaccaggccttcgaggaggtgagcagccagagcggcggcgccaagagacagagcatccacctggagcagaagctgtacgacggcgtgagcgccaccagcacctggctggacgacgtggaggagagactgttcgtggccaccgccctgctgcccgaggagaccgagacctgcctgttcaaccaggagatcctggccaaggacatcaaggagatgagcgaggagatggacaagaacaagaacctgttcagccaggccttccccgagaacggcgacaacagagacgtgatcgaggacaccctgggctgcctgctgggcagactgagcctgctggacagcgtggtgaaccagagatgccaccagatgaaggagagactgcagcagatcctgaacttccagaacgacctgaaggtgctgttcaccagcctggccgacaacaagtacatcatcctgcagaagctggccaacgtgttcgagcagcccgtggccgagcagatcgaggccatccagcaggccgaggacggcctgaaggagttcgacgccggcatcatcgagctgaagagaagaggcgacaagctgcaggtggagcagcccagcatgcaggagctgagcaagctgcaggacatgtacgacgagctgatgatgatcatcggcagcagaagaagcggcctgaaccagaacctgaccctgaagagccagtacgagagagccctgcaggacctggccgacctgctggagaccggccaggagaagatggccggcgaccagaagatcatcgtgagcagcaaggaggagatccagcagctgctggacaagcacaaggagtacttccagggcctggagagccacatgatcctgaccgagaccctgttcagaaagatcatcagcttcgccgtgcagaaggagacccagttccacaccgagctgatggcccaggccagcgccgtgctgaagagagcccacaagagaggcgtggagctggagtacatcctggagacctggagccacctggacgaggaccagcaggagctgagcagacagctggaggtggtggagagcagcatccccagcgtgggcctggtggaggagaacgaggacagactgatcgacagaatcaccctgtaccagcacctgaagagcagcctgaacgagtaccagcccaagctgtaccaggtgctggacgacggcaagagactgctgatcagcatcagctgcagcgacctggagagccagctgaaccagctgggcgagtgctggctgagcaacaccaacaagatgagcaaggagctgcacagactggagaccatcctgaagcactggaccagataccagagcgagagcgccgacctgatccactggctgcagagcgccaaggacagactggagttctggacccagcagagcgtgaccgtgccccaggagctggagatggtgagagaccacctgaacgccttcctggagttcagcaaggaggtggacgcccagagcagcctgaagagcagcgtgctgagcaccggcaaccagctgctgagactgaagaaggtggacaccgccaccctgagaagcgagctgagcagaatcgacagccagtggaccgacctgctgaccaacatccccgccgtgcaggagaagctgcaccagctgcagatggacaagctgcccagcagacacgccatcagcgaggtgatgagctggatcagcctgatggagaacgtgatccagaaggacgaggacaacatcaagaacagcatcggctacaaggccatccacgagtacctgcagaagtacaagggcttcaagatcgacatcaactgcaagcagctgaccgtggacttcgtgaaccagagcgtgctgcagatcagcagccaggacgtggagagcaagagaagcgacaagaccgacttcgccgagcagctgggcgccatgaacaagagctggcagatcctgcagggcctggtgaccgagaagatccagctgctggagggcctgctggagagctggagcgagtacgagaacaacgtgcagtgcctgaagacctggttcgagacccaggagaagagactgaagcagcagcacagaatcggcgaccaggccagcgtgcagaacgccctgaaggactgccaggacctggaggacctgatcaaggccaaggagaaggaggtggagaagatcgagcagaacggcctggccctgatccagaacaagaaggaggacgtgagcagcatcgtgatgagcaccctgagagagctgggccagacctgggccaacctggaccacatggtgggccagctgaagatcctgctgaagagcgtgctggaccagtggagcagccacaaggtggccttcgacaagatcaacagctacctgatggaggccagatacagcctgagcagattcagactgctgaccggcagcctggaggccgtgcaggtgcaggtggacaacctgcagaacctgcaggacgacctggagaagcaggagagaagcctgcagaagttcggcagcatcaccaaccagctgctgaaggagtgccacccccccgtgaccgagaccctgaccaacaccctgaaggaggtgaacatgagatggaacaacctgctggaggagatcgccgagcagctgcagagcagcaaggccctgctgcagctgtggcagagatacaaggactacagcaagcagtgcgccagcaccgtgcagcagcaggaggacagaaccaacgagctgctgaaggccgccaccaacaaggacatcgccgacgacgaggtggccacctggatccaggactgcaacgacctgctgaagggcctgggcaccgtgaaggacagcctgttcttcctgcacgagctgggcgagcagctgaagcagcaggtggacgccagcgccgccagcgccatccagagcgaccagctgagcctgagccagcacctgtgcgccctggagcaggccctgtgcaagcagcagaccagcctgcaggccggcgtgctggactacgagaccttcgccaagagcctggaggccctggaggcctggatcgtggaggccgaggagatcctgcagggccaggaccccagccacagcagcgacctgagcaccatccaggagagaatggaggagctgaagggccagatgctgaagttcagcagcatggcccccgacctggacagactgaacgagctgggctacagactgcccctgaacgacaaggagatcaagagaatgcagaacctgaacagacactggagcctgatcagcagccagaccaccgagagattcagcaagctgcagagcttcctgctgcagcaccagaccttcctggagaagtgcgagacctggatggagttcctggtgcagaccgagcagaagctggccgtggagatcagcggcaactaccagcacctgctggagcagcagagagcccacgagctgttccaggccgagatgttcagcagacagcagatcctgcacagcatcatcatcgacggccagagactgctggagcagggccaggtggacgacagagacgagttcaacctgaagctgaccctgctgagcaaccagtggcagggcgtgatcagaagagcccagcagagaagaggcatcatcgacagccagatcagacagtggcagagatacagagagatggccgagaagctgagaaagtggctggtggaggtgagctacctgcccatgagcggcctgggcagcgtgcccatccccctgcagcaggccagaaccctgttcgacgaggtgcagttcaaggagaaggtgttcctgagacagcagggcagctacatcctgaccgtggaggccggcaagcagctgctgctgagcgccgacagcggcgccgaggccgccctgcaggccgagctggccgagatccaggagaagtggaagagcgccagcatgagactggaggagcagaagaagaagctggccttcctgctgaaggactgggagaagtgcgagaagggcatcgccgacagcctggagaagctgagaaccttcaagaagaagctgagccagagcctgcccgaccaccacgaggagctgcacgccgagcagatgagatgcaaggagctggagaacgccgtgggcagctggaccgacgacctgacccagctgagcctgctgaaggacaccctgagcgcctacatcagcgccgacgacatcagcatcctgaacgagagagtggagctgctgcagagacagtgggaggagctgtgccaccagctgagcctgagaagacagcagatcggcgagagactgaacgagtgggccgtgttcagcgagaagaacaaggagctgtgcgagtggctgacccagatggagagcaaggtgagccagaacggcgacatcctgatcgaggagatgatcgagaagctgaagaaggactaccaggaggagatcgccatcgcccaggagaacaagatccagctgcagcagatgggcgagagactggccaaggccagccacgagagcaaggccagcgagatcgagtacaagctgggcaaggtgaacgacagatggcagcacctgctggacctgatcgccgccagagtgaagaagctgaaggagaccctggtggccgtgcagcagctggacaagaacatgagcagcctgagaacctggctggcccacatcgagagcgagctggccaagcccatcgtgtacgacagctgcaacagcgaggagatccagagaaagctgaacgagcagcaggagctgcagagagacatcgagaagcacagcaccggcgtggccagcgtgctgaacctgtgcgaggtgctgctgcacgactgcgacgcctgcgccaccgacgccgagtgcgacagcatccagcaggccaccagaaacctggacagaagatggagaaacatctgcgccatgagcatggagagaagactgaagatcgaggagacctggagactgtggcagaagttcctggacgactacagcagattcgaggactggctgaagagcagcgagagaaccgccgccttccccagcagcagcggcgtgatctacaccgtggccaaggaggagctgaagaagttcgaggccttccagagacaggtgcacgagtgcctgacccagctggagctgatcaacaagcagtacagaagactggccagagagaacagaaccgacagcgcctgcagcctgaagcagatggtgcacgagggcaaccagagatgggacaacctgcagaagagagtgaccagcatcctgagaagactgaagcacttcatcggccagagagaggagttcgagaccgccagagacagcatcctggtgtggctgaccgagatggacctgcagctgaccaacatcgagcacttcagcgagtgcgacgtgcaggccaagatcaagcagctgaaggccttccagcaggagatcagcctgaaccacaacaagatcgagcagatcatcgcccagggcgagcagctgatcgagaagagcgagcccctggacgccgccatcatcgaggaggagctggacgagctgagaagatactgccaggaggtgttcggcagagtggagagataccacaagaagctgatcagactgcccctgcccgacgacgagcacgacctgagcgacagagagctggagctggaggacagcgccgccctgagcgacctgcactggcacgacagaagcgccgacagcctgctgagcccccagcccagcagcaacctgagcctgagcctggcccagcccctgagaagcgagagaagcggcagagacacccccgccagcgtggacagcatccccctggagtgggaccacgactacgacctgagcagagacctggagagcgccatgagcagagccctgcccagcgaggacgaggagggccaggacgacaaggacttctacctgagaggcgccgtgggcctgagcggcgaccacagcgccctggagagccagatcagacagctgggcaaggccctggacgacagcagattccagatccagcagaccgagaacatcatcagaagcaagacccccaccggccccgagctggacaccagctacaagggctacatgaagctgctgggcgagtgcagcagcagcatcgacagcgtgaagagactggagcacaagctgaaggaggaggaggagagcctgcccggcttcgtgaacctgcacagcaccgagacccagaccgccggcgtgatcgacagatgggagctgctgcaggcccaggccctgagcaaggagctgagaatgaagcagaacctgcagaagtggcagcagttcaacagcgacctgaacagcatctgggcctggctgggcgacaccgaggaggagctggagcagctgcagagactggagctgagcaccgacatccagaccatcgagctgcagatcaagaagctgaaggagctgcagaaggccgtggaccacagaaaggccatcatcctgagcatcaacctgtgcagccccgagttcacccaggccgacagcaaggagagcagagacctgcaggacagactgagccagatgaacggcagatgggacagagtgtgcagcctgctggaggagtggagaggcctgctgcaggacgccctgatgcagtgccagggcttccacgagatgagccacggcctgctgctgatgctggagaacatcgacagaagaaagaacgagatcgtgcccatcgacagcaacctggacgccgagatcctgcaggaccaccacaagcagctgatgcagatcaagcacgagctgctggagagccagctgagagtggccagcctgcaggacatgagctgccagctgctggtgaacgccgagggcaccgactgcctggaggccaaggagaaggtgcacgtgatcggcaacagactgaagctgctgctgaaggaggtgagcagacacatcaaggagctggagaagctgctggacgtgagcagcagccagcaggacctgagcagctggagcagcgccgacgagctggacaccagcggcagcgtgagccccaccagcggcagaagcacccccaacagacagaagacccccagaggcaagtgcagcctgagccagcccggccccagcgtgagcagcccccacagcagaagcaccaagggcggcagcgacagcagcctgagcgagcccggccccggcagaagcggcagaggcttcctgttcagagtgctgagagccgccctgcccctgcagctgctgctgctgctgctgatcggcctggcctgcctggtgcccatgagcgaggaggactacagctgcgccctgagcaacaacttcgccagaagcttccaccccatgctgagatacaccaacggccccccccccctgtag

SEQ ID NO: 100477 - DNA, 26250 bp, Artificial Sequence
  Description of Artificial Sequence: Synthetic coding sequence
atggccaccagcagaggcgccagcagatgccccagagacatcgccaacgtgatgcagagactgcaggacgagcaggagatcgtgcagaagagaaccttcaccaagtggatcaacagccacctggccaagagaaagccccccatggtggtggacgacctgttcgaggacatgaaggacggcgtgaagctgctggccctgctggaggtgctgagcggccagaagctgccctgcgagcagggcagaagaatgaagagaatccacgccgtggccaacatcggcaccgccctgaagttcctggagggcagaaagagcatgcacagaggcagccccatcaagctggtgaacatcaacagcaccgacatcgccgacggcagacccagcatcgtgctgggcctgatgtggaccatcatcctgtacttccagatcgaggagctgaccagcaacctgccccagctgcagagcctgagcagcagcgccagcagcgtggacagcatcgtgagcagcgagacccccagcccccccagcaagagaaaggtgaccaccaagatccagggcaacgccaagaaggccctgctgaagtgggtgcagtacaccgccggcaagcagaccggcatcgaggtgaaggacttcggcaagagctggagaagcggcgtggccttccacagcgtgatccacgccatcagacccgagctggtggacctggagaccgtgaagggcagaagcaacagagagaacctggaggacgccttcaccatcgccgagaccgagctgggcatccccagactgctggaccccgaggacgtggacgtggacaagcccgacgagaagagcatcatgacctacgtggcccagttcctgaagcactaccccgacatccacaacgccagcaccgacggccaggaggacgacgagatcctgcccggcttccccagcttcgccaacagcgtgcagaacttcaagagagaggacagagtgatcttcaaggagatgaaggtgtggatcgagcagttcgagagagacctgaccagagcccagatggtggagagcaacctgcaggacaagtaccagagcttcaagcacttcagagtgcagtacgagatgaagagaaagcagatcgagcacctgatccagcccctgcacagagacggcaagctgagcctggaccaggccctggtgaagcagagctgggacagagtgaccagcagactgttcgactggcacatccagctggacaagagcctgcccgcccccctgggcaccatcggcgcctggctgtacagagccgaggtggccctgagagaggagatcaccgtgcagcaggtgcacgaggagaccgccaacaccatccagagaaagctggagcagcacaaggacctgctgcagaacaccgacgcccacaagagagccttccacgagatctacagaaccagaagcgtgaacggcatccccgtgccccccgaccagctggaggacatggccgagagattccacttcgtgagcagcaccagcgagctgcacctgatgaagatggagttcctggagctgaagtacagactgctgagcctgctggtgctggccgagagcaagctgaagagctggatcatcaagtacggcagaagagagagcgtggagcagctgctgcagaactacgtgagcttcatcgagaacagcaagttcttcgagcagtacgaggtgacctaccagatcctgaagcagaccgccgagatgtacgtgaaggccgacggcagcgtggaggaggccgagaacgtgatgaagttcatgaacgagaccaccgcccagtggagaaacctgagcgtggaggtgagaagcgtgagaagcatgctggaggaggtgatcagcaactgggacagatacggcaacaccgtggccagcctgcaggcctggctggaggacgccgagaagatgctgaaccagagcgagaacgccaagaaggacttcttcagaaacctgccccactggatccagcagcacaccgccatgaacgacgccggcaacttcctgatcgagacctgcgacgagatggtgagcagagacctgaagcagcagctgctgctgctgaacggcagatggagagagctgttcatggaggtgaagcagtacgcccaggccgacgagatggacagaatgaagaaggagtacaccgactgcgtggtgaccctgagcgccttcgccaccgaggcccacaagaagctgagcgagcccctggaggtgagcttcatgaacgtgaagctgctgatccaggacctggaggacatcgagcagagagtgcccgtgatggacgcccagtacaagatcatcaccaagaccgcccacctgatcaccaaggagagcccccaggaggagggcaaggagatgttcgccaccatgagcaagctgaaggagcagctgaccaaggtgaaggagtgctacagccccctgctgtacgagagccagcagctgctgatccccctggaggagctggagaagcagatgaccagcttctacgacagcctgggcaagatcaacgagatcatcaccgtgctggagagagaggcccagagcagcgccctgttcaagcagaagcaccaggagctgctggcctgccaggagaactgcaagaagaccctgaccctgatcgagaagggcagccagagcgtgcagaagttcgtgaccctgagcaacgtgctgaagcacttcgaccagaccagactgcagagacagatcgccgacatccacgtggccttccagagcatggtgaagaagaccggcgactggaagaagcacgtggagaccaacagcagactgatgaagaagttcgaggagagcagagccgagctggagaaggtgctgagaatcgcccaggagggcctggaggagaagggcgaccccgaggagctgctgagaagacacaccgagttcttcagccagctggaccagagagtgctgaacgccttcctgaaggcctgcgacgagctgaccgacatcctgcccgagcaggagcagcagggcctgcaggaggccgtgagaaagctgcacaagcagtggaaggacctgcagggcgaggccccctaccacctgctgcacctgaagatcgacgtggagaagaacagattcctggccagcgtggaggagtgcagaaccgagctggacagagagaccaagctgatgccccaggagggcagcgagaagatcatcaaggagcacagagtgttcttcagcgacaagggcccccaccacctgtgcgagaagagactgcagctgatcgaggagctgtgcgtgaagctgcccgtgagagaccccgtgagagacacccccggcacctgccacgtgaccctgaaggagctgagagccgccatcgacagcacctacagaaagctgatggaggaccccgacaagtggaaggactacaccagcagattcagcgagttcagcagctggatcagcaccaacgagacccagctgaagggcatcaagggcgaggccatcgacaccgccaaccacggcgaggtgaagagagccgtggaggagatcagaaacggcgtgaccaagagaggcgagaccctgagctggctgaagagcagactgaaggtgctgaccgaggtgagcagcgagaacgaggcccagaagcagggcgacgagctggccaagctgagcagcagcttcaaggccctggtgaccctgctgagcgaggtggagaagatgctgagcaacttcggcgactgcgtgcagtacaaggagatcgtgaagaacagcctggaggagctgatcagcggcagcaaggaggtgcaggagcaggccgagaagatcctggacaccgagaacctgttcgaggcccagcagctgctgctgcaccaccagcagaagaccaagagaatcagcgccaagaagagagacgtgcagcagcagatcgcccaggcccagcagggcgagggcggcctgcccgacagaggccacgaggagctgagaaagctggagagcaccctggacggcctggagagaagcagagagagacaggagagaagaatccaggtgaccctgagaaagtgggagagattcgagaccaacaaggagaccgtggtgagatacctgttccagaccggcagcagccacgagagattcctgagcttcagcagcctggagagcctgagcagcgagctggagcagaccaaggagttcagcaagagaaccgagagcatcgccgtgcaggccgagaacctggtgaaggaggccagcgagatccccctgggcccccagaacaagcagctgctgcagcagcaggccaagagcatcaaggagcaggtgaagaagctggaggacaccctggaggaggacatcaagaccatggagatggtgaagaccaagtgggaccacttcggcagcaacttcgagaccctgagcgtgtggatcaccgagaaggagaaggagctgaacgccctggagaccagcagcagcgccatggacatgcagatcagccagatcaaggtgaccatccaggagatcgagagcaagctgagcagcatcgtgggcctggaggaggaggcccagagcttcgcccagttcgtgaccaccggcgagagcgccagaatcaaggccaagctgacccagatcagaagatacggcgaggagctgagagagcacgcccagtgcctggagggcaccatcctgggccacctgagccagcagcagaagttcgaggagaacctgagaaagatccagcagagcgtgagcgagttcgaggacaagctggccgtgcccatcaagatctgcagcagcgccaccgagacctacaaggtgctgcaggagcacatggacctgtgccaggccctggagagcctgagcagcgccatcaccgccttcagcgccagcgccagaaaggtggtgaacagagacagctgcgtgcaggaggccgccgccctgcagcagcagtacgaggacatcctgagaagagccaaggagagacagaccgccctggagaacctgctggcccactggcagagactggagaaggagctgagcagcttcctgacctggctggagagaggcgaggccaaggccagcagccccgagatggacatcagcgccgacagagtgaaggtggagggcgagctgcagctgatccaggccctgcagaacgaggtggtgagccaggccagcttctacagcaagctgctgcagctgaaggagagcctgttcagcgtggccagcaaggacgacgtgaagatgatgaagctgcacctggagcagctggacgagagatggagagacctgccccagatcatcaacaagagaatcaacttcctgcagagcgtggtggccgagcaccagcagttcgacgagctgctgctgagcttcagcgtgtggatcaagctgttcctgagcgagctgcagaccaccagcgagatcagcatcatggaccaccaggtggccctgaccagacacaaggaccacgccgccgaggtggagagcaagaagggcgagctgcagagcctgcagggccacctggccaagctgggcagcctgggcagagccgaggacctgcacctgctgcagggcaaggccgaggactgcttccagctgttcgaggaggccagccaggtggtggagagaagacagctggccctgagccacctggccgagttcctgcagagccacgccagcctgagcggcatcctgagacagctgagacagaccgtggaggccaccaacagcatgaacaagaacgagagcgacctgatcgagaaggacctgaacgacgccctgcagaacgccaaggccctggagagcgccgccgtgagcctggacggcatcctgagcaaggcccagtaccacctgaagatcggcagcagcgagcagagaaccagctgcagagccaccgccgaccagctgtgcggcgaggtggagagaatccagaacctgctgggcaccaagcagagcgaggccgacgccctggccgtgctgaagaaggccttccaggaccagaaggaggagctgctgaagagcatcgaggacatcgaggagagaaccgacaaggagagactgaaggagcccaccagacaggccctgcagcagagactgagagtgttcaaccagctggaggacgagctgaacagccacgagcacgagctgtgctggctgaaggacaaggccaagcagatcgcccagaaggacgtggccttcgcccccgaggtggacagagagatcaacagactggaggtgacctgggacgacaccaagagactgatccacgagaaccagggccagtgctgcggcctgatcgacctgatgagagagtaccagaacctgaagagcgccgtgagcaaggtgctggagaacgccagcagcgtgatcgtgaccagaaccaccatcaaggaccaggaggacctgaagtgggccttcagcaagcacgagaccgccaagaacaagatgaactacaagcagaaggacctggacaacttcaccagcaagggcaagcacctgctgagcgagctgaagaagatccacagcagcgacttcagcctggtgaagaccgacatggagagcaccgtggacaagtggctggacgtgagcgagaagctggaggagaacatggacagactgagagtgagcctgagcatctgggacgacgtgctgagcaccagagacgagatcgagggctggagcaacaactgcgtgccccagatggccgagaacatcagcaacctggacaaccacctgagagccgaggagctgctgaaggagttcgagagcgaggtgaagaacaaggccctgagactggaggagctgcacagcaaggtgaacgacctgaaggagctgaccaagaacctggagaccccccccgacctgcagttcatcgaggccgacctgatgcagaagctggagcacgccaaggagatcaccgaggtggccaagggcaccctgaaggacttcaccgcccagagcacccaggtggagaagttcatcaacgacatcaccacctggttcaccaaggtggaggagagcctgatgaactgcgcccagaacgagacctgcgaggccctgaagaaggtgaaggacatccagaaggagctgcagagccagcagagcaacatcagcagcacccaggagaacctgaacagcctgtgcagaaagtaccacagcgccgagctggagagcctgggcagagccatgaccggcctgatcaagaagcacgaggccgtgagccagctgtgcagcaagacccaggccagcctgcaggagagcctggagaagcacttcagcgagagcatgcaggagttccaggagtggttcctgggcgccaaggccgccgccaaggagagcagcgacagaaccggcgacagcaaggtgctggaggccaagctgcacgacctgcagaacatcctggacagcgtgagcgacggccagagcaagctggacgccgtgacccaggagggccagaccctgtacgcccacctgagcaagcagatcgtgagcagcatccaggagcagatcaccaaggccaacgaggagttccaggccttcctgaagcagtgcctgaaggacaagcaggccctgcaggactgcgccagcgagctgggcagcttcgaggaccagcacagaaagctgaacctgtggatccacgagatggaggagagattcaacaccgagaacctgggcgagagcaagcagcacatccccgagaagaagaacgaggtgcacaaggtggagatgttcctgggcgagctgctggccgccagagagagcctggacaagctgagccagagaggccagctgctgagcgaggagggccacggcgccggccaggagggcagactgtgcagccagctgctgaccagccaccagaacctgctgagaatgaccaaggagaagctgagaagctgccaggtggccctgcaggagcacgaggccctggaggaggccctgcagagcatgtggttctgggtgaaggccatccaggacagactggcctgcgccgagagcaccctgggcagcaaggacaccctggagaagagactgagccagatccaggacatcctgctgatgaagggcgagggcgaggtgaagctgaacatggccatcggcaagggcgagcaggccctgagaagcagcaacaaggagggccagagagtgatccagacccagctggagaccctgaaggaggtgtgggccgacatcatgagcagcagcgtgcacgcccagagcaccctggagagcgtgatcagccagtggaacgactacgtggagagaaagaaccagctggagcagtggatggagagcgtggaccagaagatcgagcaccccctgcagccccagcccggcctgaaggagaagttcgtgctgctggaccacctgcagagcatcctgagcgaggccgaggaccacaccagagccctgcacagactgatcgccaagagcagagagctgtacgagaagaccgaggacgagagcttcaaggacaccgcccaggaggagctgaagacccagttcaacgacatcatgaccgtggccaaggagaagatgagaaaggtggaggagatcgtgaaggaccacctgatgtacctggacgccgtgcacgagttcaccgactggctgcacagcgccaaggaggagctgcacagatggagcgacatgagcggcgacagcagcgccacccagaagaagctgagcaagatcaaggagctgatcgacagcagagagatcggcgccagcagactgagcagagtggagagcctggcccccgaggtgaagcagaacaccaccgccagcggctgcgagctgatgcacaccgagatgcaggccctgagagccgactggaagcagtgggaggacagcgtgttccagacccagagctgcctggagaacctggtgagccagatggccctgagcgagcaggagttcagcggccaggtggcccagctggagcaggccctggagcagttcagcgccctgctgaagacctgggcccagcagctgaccctgctggagggcaagaacaccgacgaggagatcgtggagtgctggcacaagggccaggagatcctggacgccctgcagaaggccgagcccagaaccgaggacctgaagagccagctgaacgagctgtgcagattcagcagagacctgagcacctacagcggcaaggtgagcggcctgatcaaggagtacaactgcctgtgcctgcaggccagcaagggctgccagaacaaggagcagatcctgcagcagagattcagaaaggccttcagagacttccagcagtggctggtgaacgccaagatcaccaccgccaagtgcttcgacatcccccagaacatcagcgaggtgagcaccagcctgcagaagatccaggagttcctgagcgagagcgagaacggccagcacaagctgaacatgatgctgagcaagggcgagctgctgagcaccctgctgaccaaggagaaggccaagggcatccaggccaaggtgaccgccgccaaggaggactggaagaacttccacagcaacctgcaccagaaggagagcgccctggagaacctgaagatccagatgaaggacttcgaggtgagcgccgagcccatccaggactggctgagcaagaccgagaagatggtgcacgagagcagcaacagactgtacgacctgcccgccaagagaagagagcagcagaagctgcagagcgtgctggaggagatccactgctacgagccccagctgaacagactgaaggagaaggcccagcagctgtgggagggccaggccgccagcaagagcttcagacacagagtgagccagctgagcagccagtacctggccctgagcaacctgaccaaggagaaggtgagcagactggacagaatcgtggccgagcacaaccagttcagcctgggcatcaaggagctgcaggactggatgaccgacgccatccacatgctggacagctactgccaccccaccagcgacaagagcgtgctggacagcagaaccctgaagctggaggccctgctgagcgtgaagcaggagaaggagatccagatgaagatgatcgtgaccagaggcgagagcgtgctgcagaacaccagccccgagggcatccccaccatccagcagcagctgcagagcgtgaaggacatgtgggccagcctgctgagcgccggcatcagatgcaagagccagctggagggcgccctgagcaagtggaccagctaccaggacggcgtgagacagttcagcggctggatggacagcatggaggccaacctgaacgagagcgagagacagcacgccgagctgagagacaagaccaccatgctgggcaaggccaagctgctgaacgaggaggtgctgagctacagcagcctgctggagaccatcgaggtgaagggcgccggcatgaccgagcactacgtgacccagctggagctgcaggacctgcaggagagatacagagccatccaggagagagccaaggaggccgtgaccaagagcgagaagctggtgagactgcaccaggagtaccagagagacctgaaggccttcgaggtgtggctgggccaggagcaggagaagctggaccagtacagcgtgctggagggcgacgcccacacccacgagaccaccctgagagacctgcaggagctgcaggtgcactgcgccgagggccaggccctgctgaacagcgtgctgcacaccagagaggacgtgatccccagcggcatcccccaggccgaggacagagccctggagagcctgagacaggactggcaggcctaccagcacagactgagcgagaccagaacccagttcaacaacgtggtgaacaagctgagactgatggagcagaagttccagcaggtggacgagtggctgaagaccgccgaggagaagaagtggcacgaggaggtgaccgcctacagagacgaggtggaggaggtgggcgccagagcccaggagatcctggacgagagccacgtgaacagcagaatgggctgccaggccacccagctgaccagcagataccaggccctgctgctgcaggtgctggagcagatcaagttcctggaggaggagatccagagcctggaggagagcgagagcagcctgagcagctacagcgactggtacggcagcacccacaagaacttcaagaacgtggccaccaagatcgacaaggtggacaccgtgatgatgggcaagaagctgaagaccctggaggtgctgctgaaggacatggagaagggccacagcctgctgaagagcgccagagagaagggcgagagagccgtgaagtacctggaggagggcgaggccgagagactgagaaaggagatccacgaccacatggagcagctgaaggagctgaccagcaccgtgagaaaggagcacatgaccctggagaagggcctgcacctggccaaggagttcagcgacaagtgcaaggccctgacccagtggatcgccgagtaccaggagatcctgcacgtgcccgaggagcccaagatggagctgtacgagaagaaggcccagctgagcaagtacaagagcctgcagcagaccgtgctgagccacgagcccagcgtgaagagcgtgagagagaagggcgaggccctgctggagctggtgcaggacgtgaccctgaaggacaagatcgaccagctgcagagcgactaccaggacctgtgcagcatcggcaaggccatgatggaggagatcgccggcttcgaggacagactgaacaacctgcagatgaagggcgacaccctgatcggccagtgcgccgaccacctgcaggccaagctgaagcagaacgtgcacgcccacctgcagggcaccaaggacagctacagcgccatctgcagcaccgcccagagaatgtaccagagcctggagcacgagctgcagaagcacgtgagcagacaggacaccctgcagcagtgccaggcctggctgagcgccgtgcagcccgacctggagcccagcccccagccccccctgagcagagccgaggccatcaagcaggtgaagcacttcagagccctgcaggagcaggccagaacctacctggacctgctgtgcagcatgtgcgacctgagcaacgccagcgtgaagaccaccgccaaggacatccagcagaccgagcagaccatcgagcagaagctggtgcaggcccagaacctgacccagggctgggaggagatcaagcacctgaagagcgagctgtggatctacctgcaggacgccgaccagcagctgcagaacatgaagagaagacacagcgagctggagctgaacatcgcccagaacatggtgagccaggtgaaggacttcgtgaagaagctgcagagcaagcaggccagcgtgaacaccatcatcgagaaggtgaacaagctgaccaagaaggaggagagccccgagcacaaggagatcaaccacctgaacgaccagtggctggacctgtgcagacagagcaacaacctgtgcctgcagagagaggaggacctgcagagaaccagagactaccacgactgcatgaacgtggtggaggtgttcctggagaagttcaccaccgagtgggacaacctggccagaagcgacgccgagagcaccgccgtgcacctggaggccctgaagaagctggccctggccctgcaggagagaaagtacgccatcgaggacctgaaggaccagaagcagaagatgatcgagcacctgaacctggacgacaaggagctggtgaaggagcagaccagccacctggagcagagatggttccagctggaggacctgatcaagagaaagatccaggtgagcgtgaccaacctggaggagctgaacgtggtgcagagcagattccaggagctgatggagtgggccgaggagcagcagcccaacatcgccgaggccctgaagcagagccccccccccgacatggcccagaacctgctgatggaccacctggccatctgcagcgagctggaggccaagcagatgctgctgaagagcctgatcaaggacgccgacagagtgatggccgacctgggcctgaacgagagacaggtgatccagaaggccctgagcgacgcccagagccacgtgaactgcctgagcgacctggtgggccagagaagaaagtacctgaacaaggccctgagcgagaagacccagttcctgatggccgtgttccaggccaccagccagatccagcagcacgagagaaagatcatgttcagagagcacatctgcctgctgcccgacgacgtgagcaagcaggtgaagacctgcaagagcgcccaggccagcctgaagacctaccagaacgaggtgaccggcctgtgggcccagggcagagagctgatgaaggaggtgaccgagcaggagaagagcgaggtgctgggcaagctgcaggagctgcagagcgtgtacgacagcgtgctgcagaagtgcagccacagactgcaggagctggagaagaacctggtgagcagaaagcacttcaaggaggacttcgacaaggcctgccactggctgaagcaggccgacatcgtgaccttccccgagatcaacctgatgaacgagagcagcgagctgcacacccagctggccaagtaccagaacatcctggagcagagccccgagtacgagaacctgctgctgaccctgcagagaaccggccagaccatcctgcccagcctgaacgaggtggaccacagctacctgagcgagaagctgaacgccctgcccagacagttcaacgtgatcgtggccctggccaaggacaagttctacaaggtgcaggaggccatcctggccagaaaggagtacgccagcctgatcgagctgaccacccagagcctgagcgagctggaggcccagttcctgagaatgagcaaggtgcccaccgacctggccgtggaggaggccctgagcctgcaggacggctgcagagccatcctggacgaggtggccggcctgggcgaggccgtggacgagctgaaccagaagaaggagggcttcagaagcaccggccagccctggcagcccgacaagatgctgcacctggtgaccctgtaccacagactgaagagacagaccgagcagagagtgagcctgctggaggacaccaccagcgcctaccaggagcacgagaagatgtgccagcagctggagagacagctgaagagcgtgaaggaggagcagagcaaggtgaacgaggagaccctgcccgccgaggagaagctgaagatgtaccacagcctggccggcagcctgcaggacagcggcatcgtgctgaagagagtgaccatccacctggaggacctggccccccacctggaccccctggcctacgagaaggccagacaccagatccagagctggcagggcgagctgaagctgctgaccagcgccatcggcgagaccgtgaccgagtgcgagagcagaatggtgcagagcatcgacttccagaccgagatgagcagaagcctggactggctgagaagagtgaaggccgagctgagcggccccgtgtacctggacctgaacctgcaggacatccaggaggagatcagaaagatccagatccaccaggaggaggtgcagagcagcctgagaatcatgaacgccctgagccacaaggagaaggagaagttcaccaaggccaaggagctgatcagcgccgacctggagcacagcctggccgagctgagcgagctggacggcgacatccaggaggccctgagaaccagacaggccaccctgaccgagatctacagccagtgccagagatactaccaggtgttccaggccgccaacgactggctggaggacgcccaggagctgctgcagctggccggcaacggcctggacgtggagagcgccgaggagaacctgaagagccacatggagttcttcagcaccgaggaccagttccacagcaacctggaggagctgcacagcctggtggccaccctggaccccctgatcaagcccaccggcaaggaggacctggagcagaaggtggccagcctggagctgagaagccagagaatgagcagagacagcggcgcccaggtggacctgctgcagagatgcaccgcccagtggcacgactaccagaaggccagagaggaggtgatcgagctgatgaacgacaccgagaagaagctgagcgagttcagcctgctgaagaccagcagcagccacgaggccgaggagaagctgagcgagcacaaggccctggtgagcgtggtgaacagcttccacgagaagatcgtggccctggaggagaaggccagccagctggagaagaccggcaacgacgccagcaaggccaccctgagcagaagcatgaccaccgtgtggcagagatggaccagactgagagccgtggcccaggaccaggagaagatcctggaggacgccgtggacgagtggaccggcttcaacaacaaggtgaagaaggccaccgagatgatcgaccagctgcaggacaagctgcccggcagcagcgccgagaaggccagcaaggccgagctgctgaccctgctggagtaccacgacaccttcgtgctggagctggagcagcagcagagcgccctgggcatgctgagacagcagaccctgagcatgctgcaggacggcgccgcccccacccccggcgaggagccccccctgatgcaggagatcaccgccatgcaggacagatgcctgaacatgcaggagaaggtgaagaccaacggcaagctggtgaagcaggagctgaaggacagagagatggtggagacccagatcaacagcgtgaagtgctgggtgcaggagaccaaggagtacctgggcaaccccaccatcgagatcgacgcccagctggaggagctgcagatcctgctgaccgaggccaccaaccacagacagaacatcgagaagatggccgaggagcagaaggagaagtacctgggcctgtacaccatcctgcccagcgagctgagcctgcagctggccgaggtggccctggacctgaagatcagagaccagatccaggacaagatcaaggaggtggagcagagcaaggccaccagccaggagctgagcagacagatccagaagctggccaaggacctgaccaccatcctgaccaagctgaaggccaagaccgacaacgtggtgcaggccaagaccgaccagaaggtgctgggcgaggagctggacggctgcaacagcaagctgatggagctggacgccgccgtgcagaagttcctggagcagaacggccagctgggcaagcccctggccaagaagatcggcaagctgaccgagctgcaccagcagaccatcagacaggccgagaacagactgagcaagctgaaccaggccgccagccacctggaggagtacaacgagatgctggagctgatcctgaagtggatcgagaaggccaaggtgctggcccacggcaccatcgcctggaacagcgccagccagctgagagagcagtacatcctgcaccagaccctgctggaggagagcaaggagatcgacagcgagctggaggccatgaccgagaagctgcagtacctgaccagcgtgtactgcaccgagaagatgagccagcaggtggccgagctgggcagagagaccgaggagctgagacagatgatcaagatcagactgcagaacctgcaggacgccgccaaggacatgaagaagttcgaggccgagctgaagaagctgcaggccgccctggagcaggcccaggccaccctgaccagccccgaggtgggcagactgagcctgaaggagcagctgagccacagacagcacctgctgagcgagatggagagcctgaagcccaaggtgcaggccgtgcagctgtgccagagcgccctgagaatccccgaggacgtggtggccagcctgcccctgtgccacgccgccctgagactgcaggaggaggccagcagactgcagcacaccgccatccagcagtgcaacatcatgcaggccgccgtggtgcagtacgagcagtacgagcaggagatgaagcacctgcagcagctgatcgagggcgcccacagagagatcgaggacaagcccgtggccaccagcaacatccaggagctgcaggcccagatcagcagacacgaggagctggcccagaagatcaagggctaccaggagcagatcgccagcctgaacagcaagtgcaagatgctgaccatgaaggccaagcacgccaccatgctgctgaccgtgaccgaggtggagggcctggccgagggcaccgaggacctggacggcgagctgctgcccacccccagcgcccaccccagcgtggtgatgatgaccgccggcagatgccacaccctgctgagccccgtgaccgaggagagcggcgaggagggcaccaacagcgagatcagcagcccccccgcctgcagaagccccagccccgtggccaacaccgacgccagcgtgaaccaggacatcgcctactaccaggccctgagcgccgagagactgcagaccgacgccgccaagatccaccccagcaccagcgccagccaggagttctacgagcccggcctggagcccagcgccaccgccaagctgggcgacctgcagagaagctgggagaccctgaagaacgtgatcagcgagaagcagagaaccctgtacgaggccctggagagacagcagaagtaccaggacagcctgcagagcatcagcaccaagatggaggccatcgagctgaagctgagcgagagccccgagcccggcagaagccccgagagccagatggccgagcaccaggccctgatggacgagatcctgatgctgcaggacgagatcaacgagctgcagagcagcctggccgaggagctggtgagcgagagctgcgaggccgaccccgccgagcagctggccctgcagagcaccctgaccgtgctggccgagagaatgagcaccatcagaatgaaggccagcggcaagagacagctgctggaggagaagctgaacgaccagctggaggagcagagacaggagcaggccctgcagagatacagatgcgaggccgacgagctggacagctggctgctgagcaccaaggccaccctggacaccgccctgagcccccccaaggagcccatggacatggaggcccagctgatggactgccagaacatgctggtggagatcgagcagaaggtggtggccctgagcgagctgagcgtgcacaacgagaacctgctgctggagggcaaggcccacaccaaggacgaggccgagcagctggccggcaagctgagaagactgaagggcagcctgctggagctgcagagagccctgcacgacaagcagctgaacatgcagggcaccgcccaggagaaggaggagagcgacgtggacctgaccgccacccagagccccggcgtgcaggagtggctggcccaggccagaaccacctggacccagcagagacagagcagcctgcagcagcagaaggagctggagcaggagctggccgagcagaagagcctgctgagaagcgtggccagcagaggcgaggagatcctgatccagcacagcgccgccgagaccagcggcgacgccggcgagaagcccgacgtgctgagccaggagctgggcatggagggcgagaagagcagcgccgaggaccagatgagaatgaagtgggagagcctgcaccaggagttcagcaccaagcagaagctgctgcagaacgtgctggagcaggagcaggagcaggtgctgtacagcagacccaacagactgctgagcggcgtgcccctgtacaagggcgacgtgcccacccaggacaagagcgccgtgaccagcctgctggacggcctgaaccaggccttcgaggaggtgagcagccagagcggcggcgccaagagacagagcatccacctggagcagaagctgtacgacggcgtgagcgccaccagcacctggctggacgacgtggaggagagactgttcgtggccaccgccctgctgcccgaggagaccgagacctgcctgttcaaccaggagatcctggccaaggacatcaaggagatgagcgaggagatggacaagaacaagaacctgttcagccaggccttccccgagaacggcgacaacagagacgtgatcgaggacaccctgggctgcctgctgggcagactgagcctgctggacagcgtggtgaaccagagatgccaccagatgaaggagagactgcagcagatcctgaacttccagaacgacctgaaggtgctgttcaccagcctggccgacaacaagtacatcatcctgcagaagctggccaacgtgttcgagcagcccgtggccgagcagatcgaggccatccagcaggccgaggacggcctgaaggagttcgacgccggcatcatcgagctgaagagaagaggcgacaagctgcaggtggagcagcccagcatgcaggagctgagcaagctgcaggacatgtacgacgagctgatgatgatcatcggcagcagaagaagcggcctgaaccagaacctgaccctgaagagccagtacgagagagccctgcaggacctggccgacctgctggagaccggccaggagaagatggccggcgaccagaagatcatcgtgagcagcaaggaggagatccagcagctgctggacaagcacaaggagtacttccagggcctggagagccacatgatcctgaccgagaccctgttcagaaagatcatcagcttcgccgtgcagaaggagacccagttccacaccgagctgatggcccaggccagcgccgtgctgaagagagcccacaagagaggcgtggagctggagtacatcctggagacctggagccacctggacgaggaccagcaggagctgagcagacagctggaggtggtggagagcagcatccccagcgtgggcctggtggaggagaacgaggacagactgatcgacagaatcaccctgtaccagcacctgaagagcagcctgaacgagtaccagcccaagctgtaccaggtgctggacgacggcaagagactgctgatcagcatcagctgcagcgacctggagagccagctgaaccagctgggcgagtgctggctgagcaacaccaacaagatgagcaaggagctgcacagactggagaccatcctgaagcactggaccagataccagagcgagagcgccgacctgatccactggctgcagagcgccaaggacagactggagttctggacccagcagagcgtgaccgtgccccaggagctggagatggtgagagaccacctgaacgccttcctggagttcagcaaggaggtggacgcccagagcagcctgaagagcagcgtgctgagcaccggcaaccagctgctgagactgaagaaggtggacaccgccaccctgagaagcgagctgagcagaatcgacagccagtggaccgacctgctgaccaacatccccgccgtgcaggagaagctgcaccagctgcagatggacaagctgcccagcagacacgccatcagcgaggtgatgagctggatcagcctgatggagaacgtgatccagaaggacgaggacaacatcaagaacagcatcggctacaaggccatccacgagtacctgcagaagtacaagggcttcaagatcgacatcaactgcaagcagctgaccgtggacttcgtgaaccagagcgtgctgcagatcagcagccaggacgtggagagcaagagaagcgacaagaccgacttcgccgagcagctgggcgccatgaacaagagctggcagatcctgcagggcctggtgaccgagaagatccagctgctggagggcctgctggagagctggagcgagtacgagaacaacgtgcagtgcctgaagacctggttcgagacccaggagaagagactgaagcagcagcacagaatcggcgaccaggccagcgtgcagaacgccctgaaggactgccaggacctggaggacctgatcaaggccaaggagaaggaggtggagaagatcgagcagaacggcctggccctgatccagaacaagaaggaggacgtgagcagcatcgtgatgagcaccctgagagagctgggccagacctgggccaacctggaccacatggtgggccagctgaagatcctgctgaagagcgtgctggaccagtggagcagccacaaggtggccttcgacaagatcaacagctacctgatggaggccagatacagcctgagcagattcagactgctgaccggcagcctggaggccgtgcaggtgcaggtggacaacctgcagaacctgcaggacgacctggagaagcaggagagaagcctgcagaagttcggcagcatcaccaaccagctgctgaaggagtgccacccccccgtgaccgagaccctgaccaacaccctgaaggaggtgaacatgagatggaacaacctgctggaggagatcgccgagcagctgcagagcagcaaggccctgctgcagctgtggcagagatacaaggactacagcaagcagtgcgccagcaccgtgcagcagcaggaggacagaaccaacgagctgctgaaggccgccaccaacaaggacatcgccgacgacgaggtggccacctggatccaggactgcaacgacctgctgaagggcctgggcaccgtgaaggacagcctgttcttcctgcacgagctgggcgagcagctgaagcagcaggtggacgccagcgccgccagcgccatccagagcgaccagctgagcctgagccagcacctgtgcgccctggagcaggccctgtgcaagcagcagaccagcctgcaggccggcgtgctggactacgagaccttcgccaagagcctggaggccctggaggcctggatcgtggaggccgaggagatcctgcagggccaggaccccagccacagcagcgacctgagcaccatccaggagagaatggaggagctgaagggccagatgctgaagttcagcagcatggcccccgacctggacagactgaacgagctgggctacagactgcccctgaacgacaaggagatcaagagaatgcagaacctgaacagacactggagcctgatcagcagccagaccaccgagagattcagcaagctgcagagcttcctgctgcagcaccagaccttcctggagaagtgcgagacctggatggagttcctggtgcagaccgagcagaagctggccgtggagatcagcggcaactaccagcacctgctggagcagcagagagcccacgagctgttccaggccgagatgttcagcagacagcagatcctgcacagcatcatcatcgacggccagagactgctggagcagggccaggtggacgacagagacgagttcaacctgaagctgaccctgctgagcaaccagtggcagggcgtgatcagaagagcccagcagagaagaggcatcatcgacagccagatcagacagtggcagagatacagagagatggccgagaagctgagaaagtggctggtggaggtgagctacctgcccatgagcggcctgggcagcgtgcccatccccctgcagcaggccagaaccctgttcgacgaggtgcagttcaaggagaaggtgttcctgagacagcagggcagctacatcctgaccgtggaggccggcaagcagctgctgctgagcgccgacagcggcgccgaggccgccctgcaggccgagctggccgagatccaggagaagtggaagagcgccagcatgagactggaggagcagaagaagaagctggccttcctgctgaaggactgggagaagtgcgagaagggcatcgccgacagcctggagaagctgagaaccttcaagaagaagctgagccagagcctgcccgaccaccacgaggagctgcacgccgagcagatgagatgcaaggagctggagaacgccgtgggcagctggaccgacgacctgacccagctgagcctgctgaaggacaccctgagcgcctacatcagcgccgacgacatcagcatcctgaacgagagagtggagctgctgcagagacagtgggaggagctgtgccaccagctgagcctgagaagacagcagatcggcgagagactgaacgagtgggccgtgttcagcgagaagaacaaggagctgtgcgagtggctgacccagatggagagcaaggtgagccagaacggcgacatcctgatcgaggagatgatcgagaagctgaagaaggactaccaggaggagatcgccatcgcccaggagaacaagatccagctgcagcagatgggcgagagactggccaaggccagccacgagagcaaggccagcgagatcgagtacaagctgggcaaggtgaacgacagatggcagcacctgctggacctgatcgccgccagagtgaagaagctgaaggagaccctggtggccgtgcagcagctggacaagaacatgagcagcctgagaacctggctggcccacatcgagagcgagctggccaagcccatcgtgtacgacagctgcaacagcgaggagatccagagaaagctgaacgagcagcaggagctgcagagagacatcgagaagcacagcaccggcgtggccagcgtgctgaacctgtgcgaggtgctgctgcacgactgcgacgcctgcgccaccgacgccgagtgcgacagcatccagcaggccaccagaaacctggacagaagatggagaaacatctgcgccatgagcatggagagaagactgaagatcgaggagacctggagactgtggcagaagttcctggacgactacagcagattcgaggactggctgaagagcagcgagagaaccgccgccttccccagcagcagcggcgtgatctacaccgtggccaaggaggagctgaagaagttcgaggccttccagagacaggtgcacgagtgcctgacccagctggagctgatcaacaagcagtacagaagactggccagagagaacagaaccgacagcgcctgcagcctgaagcagatggtgcacgagggcaaccagagatgggacaacctgcagaagagagtgaccagcatcctgagaagactgaagcacttcatcggccagagagaggagttcgagaccgccagagacagcatcctggtgtggctgaccgagatggacctgcagctgaccaacatcgagcacttcagcgagtgcgacgtgcaggccaagatcaagcagctgaaggccttccagcaggagatcagcctgaaccacaacaagatcgagcagatcatcgcccagggcgagcagctgatcgagaagagcgagcccctggacgccgccatcatcgaggaggagctggacgagctgagaagatactgccaggaggtgttcggcagagtggagagataccacaagaagctgatcagactgcccctgcccgacgacgagcacgacctgagcgacagagagctggagctggaggacagcgccgccctgagcgacctgcactggcacgacagaagcgccgacagcctgctgagcccccagcccagcagcaacctgagcctgagcctggcccagcccctgagaagcgagagaagcggcagagacacccccgccagcgtggacagcatccccctggagtgggaccacgactacgacctgagcagagacctggagagcgccatgagcagagccctgcccagcgaggacgaggagggccaggacgacaaggacttctacctgagaggcgccgtgggcctgagcgacgtgatgatccccgagagccccgaggcctacgtgaagctgaccgagaacgccatcaagaacaccagcggcgaccacagcgccctggagagccagatcagacagctgggcaaggccctggacgacagcagattccagatccagcagaccgagaacatcatcagaagcaagacccccaccggccccgagctggacaccagctacaagggctacatgaagctgctgggcgagtgcagcagcagcatcgacagcgtgaagagactggagcacaagctgaaggaggaggaggagagcctgcccggcttcgtgaacctgcacagcaccgagacccagaccgccggcgtgatcgacagatgggagctgctgcaggcccaggccctgagcaaggagctgagaatgaagcagaacctgcagaagtggcagcagttcaacagcgacctgaacagcatctgggcctggctgggcgacaccgaggaggagctggagcagctgcagagactggagctgagcaccgacatccagaccatcgagctgcagatcaagaagctgaaggagctgcagaaggccgtggaccacagaaaggccatcatcctgagcatcaacctgtgcagccccgagttcacccaggccgacagcaaggagagcagagacctgcaggacagactgagccagatgaacggcagatgggacagagtgtgcagcctgctggaggagtggagaggcctgctgcaggacgccctgatgcagtgccagggcttccacgagatgagccacggcctgctgctgatgctggagaacatcgacagaagaaagaacgagatcgtgcccatcgacagcaacctggacgccgagatcctgcaggaccaccacaagcagctgatgcagatcaagcacgagctgctggagagccagctgagagtggccagcctgcaggacatgagctgccagctgctggtgaacgccgagggcaccgactgcctggaggccaaggagaaggtgcacgtgatcggcaacagactgaagctgctgctgaaggaggtgagcagacacatcaaggagctggagaagctgctggacgtgagcagcagccagcaggacctgagcagctggagcagcgccgacgagctggacaccagcggcagcgtgagccccaccagcggcagaagcacccccaacagacagaagacccccagaggcaagtgcagcctgagccagcccggccccagcgtgagcagcccccacagcagaagcaccaagggcggcagcgacagcagcctgagcgagcccggccccggcagaagcggcagaggcttcctgttcagagtgctgagagccgccctgcccctgcagctgctgctgctgctgctgatcggcctggcctgcctggtgcccatgagcgaggaggactacagctgcgccctgagcaacaacttcgccagaagcttccaccccatgctgagatacaccaacggccccccccccctgtag

SEQ ID NO: 100478 - DNA, 26250 bp, Artificial Sequence
  Description of Artificial Sequence: Synthetic coding sequence
atggccaccagcagaggcgccagcagatgccccagagacatcgccaacgtgatgcagagactgcaggacgagcaggagatcgtgcagaagagaaccttcaccaagtggatcaacagccacctggccaagagaaagccccccatggtggtggacgacctgttcgaggacatgaaggacggcgtgaagctgctggccctgctggaggtgctgagcggccagaagctgccctgcgagcagggcagaagaatgaagagaatccacgccgtggccaacatcggcaccgccctgaagttcctggagggcagaaagagcatgcacagaggcagccccatcaagctggtgaacatcaacagcaccgacatcgccgacggcagacccagcatcgtgctgggcctgatgtggaccatcatcctgtacttccagatcgaggagctgaccagcaacctgccccagctgcagagcctgagcagcagcgccagcagcgtggacagcatcgtgagcagcgagacccccagcccccccagcaagagaaaggtgaccaccaagatccagggcaacgccaagaaggccctgctgaagtgggtgcagtacaccgccggcaagcagaccggcatcgaggtgaaggacttcggcaagagctggagaagcggcgtggccttccacagcgtgatccacgccatcagacccgagctggtggacctggagaccgtgaagggcagaagcaacagagagaacctggaggacgccttcaccatcgccgagaccgagctgggcatccccagactgctggaccccgaggacgtggacgtggacaagcccgacgagaagagcatcatgacctacgtggcccagttcctgaagcactaccccgacatccacaacgccagcaccgacggccaggaggacgacgagatcctgcccggcttccccagcttcgccaacagcgtgcagaacttcaagagagaggacagagtgatcttcaaggagatgaaggtgtggatcgagcagttcgagagagacctgaccagagcccagatggtggagagcaacctgcaggacaagtaccagagcttcaagcacttcagagtgcagtacgagatgaagagaaagcagatcgagcacctgatccagcccctgcacagagacggcaagctgagcctggaccaggccctggtgaagcagagctgggacagagtgaccagcagactgttcgactggcacatccagctggacaagagcctgcccgcccccctgggcaccatcggcgcctggctgtacagagccgaggtggccctgagagaggagatcaccgtgcagcaggtgcacgaggagaccgccaacaccatccagagaaagctggagcagcacaaggacctgctgcagaacaccgacgcccacaagagagccttccacgagatctacagaaccagaagcgtgaacggcatccccgtgccccccgaccagctggaggacatggccgagagattccacttcgtgagcagcaccagcgagctgcacctgatgaagatggagttcctggagctgaagtacagactgctgagcctgctggtgctggccgagagcaagctgaagagctggatcatcaagtacggcagaagagagagcgtggagcagctgctgcagaactacgtgagcttcatcgagaacagcaagttcttcgagcagtacgaggtgacctaccagatcctgaagcagaccgccgagatgtacgtgaaggccgacggcagcgtggaggaggccgagaacgtgatgaagttcatgaacgagaccaccgcccagtggagaaacctgagcgtggaggtgagaagcgtgagaagcatgctggaggaggtgatcagcaactgggacagatacggcaacaccgtggccagcctgcaggcctggctggaggacgccgagaagatgctgaaccagagcgagaacgccaagaaggacttcttcagaaacctgccccactggatccagcagcacaccgccatgaacgacgccggcaacttcctgatcgagacctgcgacgagatggtgagcagagacctgaagcagcagctgctgctgctgaacggcagatggagagagctgttcatggaggtgaagcagtacgcccaggccgacgagatggacagaatgaagaaggagtacaccgactgcgtggtgaccctgagcgccttcgccaccgaggcccacaagaagctgagcgagcccctggaggtgagcttcatgaacgtgaagctgctgatccaggacctggaggacatcgagcagagagtgcccgtgatggacgcccagtacaagatcatcaccaagaccgcccacctgatcaccaaggagagcccccaggaggagggcaaggagatgttcgccaccatgagcaagctgaaggagcagctgaccaaggtgaaggagtgctacagccccctgctgtacgagagccagcagctgctgatccccctggaggagctggagaagcagatgaccagcttctacgacagcctgggcaagatcaacgagatcatcaccgtgctggagagagaggcccagagcagcgccctgttcaagcagaagcaccaggagctgctggcctgccaggagaactgcaagaagaccctgaccctgatcgagaagggcagccagagcgtgcagaagttcgtgaccctgagcaacgtgctgaagcacttcgaccagaccagactgcagagacagatcgccgacatccacgtggccttccagagcatggtgaagaagaccggcgactggaagaagcacgtggagaccaacagcagactgatgaagaagttcgaggagagcagagccgagctggagaaggtgctgagaatcgcccaggagggcctggaggagaagggcgaccccgaggagctgctgagaagacacaccgagttcttcagccagctggaccagagagtgctgaacgccttcctgaaggcctgcgacgagctgaccgacatcctgcccgagcaggagcagcagggcctgcaggaggccgtgagaaagctgcacaagcagtggaaggacctgcagggcgaggccccctaccacctgctgcacctgaagatcgacgtggagaagaacagattcctggccagcgtggaggagtgcagaaccgagctggacagagagaccaagctgatgccccaggagggcagcgagaagatcatcaaggagcacagagtgttcttcagcgacaagggcccccaccacctgtgcgagaagagactgcagctgatcgaggagctgtgcgtgaagctgcccgtgagagaccccgtgagagacacccccggcacctgccacgtgaccctgaaggagctgagagccgccatcgacagcacctacagaaagctgatggaggaccccgacaagtggaaggactacaccagcagattcagcgagttcagcagctggatcagcaccaacgagacccagctgaagggcatcaagggcgaggccatcgacaccgccaaccacggcgaggtgaagagagccgtggaggagatcagaaacggcgtgaccaagagaggcgagaccctgagctggctgaagagcagactgaaggtgctgaccgaggtgagcagcgagaacgaggcccagaagcagggcgacgagctggccaagctgagcagcagcttcaaggccctggtgaccctgctgagcgaggtggagaagatgctgagcaacttcggcgactgcgtgcagtacaaggagatcgtgaagaacagcctggaggagctgatcagcggcagcaaggaggtgcaggagcaggccgagaagatcctggacaccgagaacctgttcgaggcccagcagctgctgctgcaccaccagcagaagaccaagagaatcagcgccaagaagagagacgtgcagcagcagatcgcccaggcccagcagggcgagggcggcctgcccgacagaggccacgaggagctgagaaagctggagagcaccctggacggcctggagagaagcagagagagacaggagagaagaatccaggtgaccctgagaaagtgggagagattcgagaccaacaaggagaccgtggtgagatacctgttccagaccggcagcagccacgagagattcctgagcttcagcagcctggagagcctgagcagcgagctggagcagaccaaggagttcagcaagagaaccgagagcatcgccgtgcaggccgagaacctggtgaaggaggccagcgagatccccctgggcccccagaacaagcagctgctgcagcagcaggccaagagcatcaaggagcaggtgaagaagctggaggacaccctggaggaggacatcaagaccatggagatggtgaagaccaagtgggaccacttcggcagcaacttcgagaccctgagcgtgtggatcaccgagaaggagaaggagctgaacgccctggagaccagcagcagcgccatggacatgcagatcagccagatcaaggtgaccatccaggagatcgagagcaagctgagcagcatcgtgggcctggaggaggaggcccagagcttcgcccagttcgtgaccaccggcgagagcgccagaatcaaggccaagctgacccagatcagaagatacggcgaggagctgagagagcacgcccagtgcctggagggcaccatcctgggccacctgagccagcagcagaagttcgaggagaacctgagaaagatccagcagagcgtgagcgagttcgaggacaagctggccgtgcccatcaagatctgcagcagcgccaccgagacctacaaggtgctgcaggagcacatggacctgtgccaggccctggagagcctgagcagcgccatcaccgccttcagcgccagcgccagaaaggtggtgaacagagacagctgcgtgcaggaggccgccgccctgcagcagcagtacgaggacatcctgagaagagccaaggagagacagaccgccctggagaacctgctggcccactggcagagactggagaaggagctgagcagcttcctgacctggctggagagaggcgaggccaaggccagcagccccgagatggacatcagcgccgacagagtgaaggtggagggcgagctgcagctgatccaggccagcagcagaaagttcgtgagccaggccagcttctacagcaagctgctgcagctgaaggagagcctgttcagcgtggccagcaaggacgacgtgaagatgatgaagctgcacctggagcagctggacgagagatggagagacctgccccagatcatcaacaagagaatcaacttcctgcagagcgtggtggccgagcaccagcagttcgacgagctgctgctgagcttcagcgtgtggatcaagctgttcctgagcgagctgcagaccaccagcgagatcagcatcatggaccaccaggtggccctgaccagacacaaggaccacgccgccgaggtggagagcaagaagggcgagctgcagagcctgcagggccacctggccaagctgggcagcctgggcagagccgaggacctgcacctgctgcagggcaaggccgaggactgcttccagctgttcgaggaggccagccaggtggtggagagaagacagctggccctgagccacctggccgagttcctgcagagccacgccagcctgagcggcatcctgagacagctgagacagaccgtggaggccaccaacagcatgaacaagaacgagagcgacctgatcgagaaggacctgaacgacgccctgcagaacgccaaggccctggagagcgccgccgtgagcctggacggcatcctgagcaaggcccagtaccacctgaagatcggcagcagcgagcagagaaccagctgcagagccaccgccgaccagctgtgcggcgaggtggagagaatccagaacctgctgggcaccaagcagagcgaggccgacgccctggccgtgctgaagaaggccttccaggaccagaaggaggagctgctgaagagcatcgaggacatcgaggagagaaccgacaaggagagactgaaggagcccaccagacaggccctgcagcagagactgagagtgttcaaccagctggaggacgagctgaacagccacgagcacgagctgtgctggctgaaggacaaggccaagcagatcgcccagaaggacgtggccttcgcccccgaggtggacagagagatcaacagactggaggtgacctgggacgacaccaagagactgatccacgagaaccagggccagtgctgcggcctgatcgacctgatgagagagtaccagaacctgaagagcgccgtgagcaaggtgctggagaacgccagcagcgtgatcgtgaccagaaccaccatcaaggaccaggaggacctgaagtgggccttcagcaagcacgagaccgccaagaacaagatgaactacaagcagaaggacctggacaacttcaccagcaagggcaagcacctgctgagcgagctgaagaagatccacagcagcgacttcagcctggtgaagaccgacatggagagcaccgtggacaagtggctggacgtgagcgagaagctggaggagaacatggacagactgagagtgagcctgagcatctgggacgacgtgctgagcaccagagacgagatcgagggctggagcaacaactgcgtgccccagatggccgagaacatcagcaacctggacaaccacctgagagccgaggagctgctgaaggagttcgagagcgaggtgaagaacaaggccctgagactggaggagctgcacagcaaggtgaacgacctgaaggagctgaccaagaacctggagaccccccccgacctgcagttcatcgaggccgacctgatgcagaagctggagcacgccaaggagatcaccgaggtggccaagggcaccctgaaggacttcaccgcccagagcacccaggtggagaagttcatcaacgacatcaccacctggttcaccaaggtggaggagagcctgatgaactgcgcccagaacgagacctgcgaggccctgaagaaggtgaaggacatccagaaggagctgcagagccagcagagcaacatcagcagcacccaggagaacctgaacagcctgtgcagaaagtaccacagcgccgagctggagagcctgggcagagccatgaccggcctgatcaagaagcacgaggccgtgagccagctgtgcagcaagacccaggccagcctgcaggagagcctggagaagcacttcagcgagagcatgcaggagttccaggagtggttcctgggcgccaaggccgccgccaaggagagcagcgacagaaccggcgacagcaaggtgctggaggccaagctgcacgacctgcagaacatcctggacagcgtgagcgacggccagagcaagctggacgccgtgacccaggagggccagaccctgtacgcccacctgagcaagcagatcgtgagcagcatccaggagcagatcaccaaggccaacgaggagttccaggccttcctgaagcagtgcctgaaggacaagcaggccctgcaggactgcgccagcgagctgggcagcttcgaggaccagcacagaaagctgaacctgtggatccacgagatggaggagagattcaacaccgagaacctgggcgagagcaagcagcacatccccgagaagaagaacgaggtgcacaaggtggagatgttcctgggcgagctgctggccgccagagagagcctggacaagctgagccagagaggccagctgctgagcgaggagggccacggcgccggccaggagggcagactgtgcagccagctgctgaccagccaccagaacctgctgagaatgaccaaggagaagctgagaagctgccaggtggccctgcaggagcacgaggccctggaggaggccctgcagagcatgtggttctgggtgaaggccatccaggacagactggcctgcgccgagagcaccctgggcagcaaggacaccctggagaagagactgagccagatccaggacatcctgctgatgaagggcgagggcgaggtgaagctgaacatggccatcggcaagggcgagcaggccctgagaagcagcaacaaggagggccagagagtgatccagacccagctggagaccctgaaggaggtgtgggccgacatcatgagcagcagcgtgcacgcccagagcaccctggagagcgtgatcagccagtggaacgactacgtggagagaaagaaccagctggagcagtggatggagagcgtggaccagaagatcgagcaccccctgcagccccagcccggcctgaaggagaagttcgtgctgctggaccacctgcagagcatcctgagcgaggccgaggaccacaccagagccctgcacagactgatcgccaagagcagagagctgtacgagaagaccgaggacgagagcttcaaggacaccgcccaggaggagctgaagacccagttcaacgacatcatgaccgtggccaaggagaagatgagaaaggtggaggagatcgtgaaggaccacctgatgtacctggacgccgtgcacgagttcaccgactggctgcacagcgccaaggaggagctgcacagatggagcgacatgagcggcgacagcagcgccacccagaagaagctgagcaagatcaaggagctgatcgacagcagagagatcggcgccagcagactgagcagagtggagagcctggcccccgaggtgaagcagaacaccaccgccagcggctgcgagctgatgcacaccgagatgcaggccctgagagccgactggaagcagtgggaggacagcgtgttccagacccagagctgcctggagaacctggtgagccagatggccctgagcgagcaggagttcagcggccaggtggcccagctggagcaggccctggagcagttcagcgccctgctgaagacctgggcccagcagctgaccctgctggagggcaagaacaccgacgaggagatcgtggagtgctggcacaagggccaggagatcctggacgccctgcagaaggccgagcccagaaccgaggacctgaagagccagctgaacgagctgtgcagattcagcagagacctgagcacctacagcggcaaggtgagcggcctgatcaaggagtacaactgcctgtgcctgcaggccagcaagggctgccagaacaaggagcagatcctgcagcagagattcagaaaggccttcagagacttccagcagtggctggtgaacgccaagatcaccaccgccaagtgcttcgacatcccccagaacatcagcgaggtgagcaccagcctgcagaagatccaggagttcctgagcgagagcgagaacggccagcacaagctgaacatgatgctgagcaagggcgagctgctgagcaccctgctgaccaaggagaaggccaagggcatccaggccaaggtgaccgccgccaaggaggactggaagaacttccacagcaacctgcaccagaaggagagcgccctggagaacctgaagatccagatgaaggacttcgaggtgagcgccgagcccatccaggactggctgagcaagaccgagaagatggtgcacgagagcagcaacagactgtacgacctgcccgccaagagaagagagcagcagaagctgcagagcgtgctggaggagatccactgctacgagccccagctgaacagactgaaggagaaggcccagcagctgtgggagggccaggccgccagcaagagcttcagacacagagtgagccagctgagcagccagtacctggccctgagcaacctgaccaaggagaaggtgagcagactggacagaatcgtggccgagcacaaccagttcagcctgggcatcaaggagctgcaggactggatgaccgacgccatccacatgctggacagctactgccaccccaccagcgacaagagcgtgctggacagcagaaccctgaagctggaggccctgctgagcgtgaagcaggagaaggagatccagatgaagatgatcgtgaccagaggcgagagcgtgctgcagaacaccagccccgagggcatccccaccatccagcagcagctgcagagcgtgaaggacatgtgggccagcctgctgagcgccggcatcagatgcaagagccagctggagggcgccctgagcaagtggaccagctaccaggacggcgtgagacagttcagcggctggatggacagcatggaggccaacctgaacgagagcgagagacagcacgccgagctgagagacaagaccaccatgctgggcaaggccaagctgctgaacgaggaggtgctgagctacagcagcctgctggagaccatcgaggtgaagggcgccggcatgaccgagcactacgtgacccagctggagctgcaggacctgcaggagagatacagagccatccaggagagagccaaggaggccgtgaccaagagcgagaagctggtgagactgcaccaggagtaccagagagacctgaaggccttcgaggtgtggctgggccaggagcaggagaagctggaccagtacagcgtgctggagggcgacgcccacacccacgagaccaccctgagagacctgcaggagctgcaggtgcactgcgccgagggccaggccctgctgaacagcgtgctgcacaccagagaggacgtgatccccagcggcatcccccaggccgaggacagagccctggagagcctgagacaggactggcaggcctaccagcacagactgagcgagaccagaacccagttcaacaacgtggtgaacaagctgagactgatggagcagaagttccagcaggtggacgagtggctgaagaccgccgaggagaagaagtggcacgaggaggtgaccgcctacagagacgaggtggaggaggtgggcgccagagcccaggagatcctggacgagagccacgtgaacagcagaatgggctgccaggccacccagctgaccagcagataccaggccctgctgctgcaggtgctggagcagatcaagttcctggaggaggagatccagagcctggaggagagcgagagcagcctgagcagctacagcgactggtacggcagcacccacaagaacttcaagaacgtggccaccaagatcgacaaggtggacaccgtgatgatgggcaagaagctgaagaccctggaggtgctgctgaaggacatggagaagggccacagcctgctgaagagcgccagagagaagggcgagagagccgtgaagtacctggaggagggcgaggccgagagactgagaaaggagatccacgaccacatggagcagctgaaggagctgaccagcaccgtgagaaaggagcacatgaccctggagaagggcctgcacctggccaaggagttcagcgacaagtgcaaggccctgacccagtggatcgccgagtaccaggagatcctgcacgtgcccgaggagcccaagatggagctgtacgagaagaaggcccagctgagcaagtacaagagcctgcagcagaccgtgctgagccacgagcccagcgtgaagagcgtgagagagaagggcgaggccctgctggagctggtgcaggacgtgaccctgaaggacaagatcgaccagctgcagagcgactaccaggacctgtgcagcatcggcaaggccatgatggaggagatcgccggcttcgaggacagactgaacaacctgcagatgaagggcgacaccctgatcggccagtgcgccgaccacctgcaggccaagctgaagcagaacgtgcacgcccacctgcagggcaccaaggacagctacagcgccatctgcagcaccgcccagagaatgtaccagagcctggagcacgagctgcagaagcacgtgagcagacaggacaccctgcagcagtgccaggcctggctgagcgccgtgcagcccgacctggagcccagcccccagccccccctgagcagagccgaggccatcaagcaggtgaagcacttcagagccctgcaggagcaggccagaacctacctggacctgctgtgcagcatgtgcgacctgagcaacgccagcgtgaagaccaccgccaaggacatccagcagaccgagcagaccatcgagcagaagctggtgcaggcccagaacctgacccagggctgggaggagatcaagcacctgaagagcgagctgtggatctacctgcaggacgccgaccagcagctgcagaacatgaagagaagacacagcgagctggagctgaacatcgcccagaacatggtgagccaggtgaaggacttcgtgaagaagctgcagagcaagcaggccagcgtgaacaccatcatcgagaaggtgaacaagctgaccaagaaggaggagagccccgagcacaaggagatcaaccacctgaacgaccagtggctggacctgtgcagacagagcaacaacctgtgcctgcagagagaggaggacctgcagagaaccagagactaccacgactgcatgaacgtggtggaggtgttcctggagaagttcaccaccgagtgggacaacctggccagaagcgacgccgagagcaccgccgtgcacctggaggccctgaagaagctggccctggccctgcaggagagaaagtacgccatcgaggacctgaaggaccagaagcagaagatgatcgagcacctgaacctggacgacaaggagctggtgaaggagcagaccagccacctggagcagagatggttccagctggaggacctgatcaagagaaagatccaggtgagcgtgaccaacctggaggagctgaacgtggtgcagagcagattccaggagctgatggagtgggccgaggagcagcagcccaacatcgccgaggccctgaagcagagccccccccccgacatggcccagaacctgctgatggaccacctggccatctgcagcgagctggaggccaagcagatgctgctgaagagcctgatcaaggacgccgacagagtgatggccgacctgggcctgaacgagagacaggtgatccagaaggccctgagcgacgcccagagccacgtgaactgcctgagcgacctggtgggccagagaagaaagtacctgaacaaggccctgagcgagaagacccagttcctgatggccgtgttccaggccaccagccagatccagcagcacgagagaaagatcatgttcagagagcacatctgcctgctgcccgacgacgtgagcaagcaggtgaagacctgcaagagcgcccaggccagcctgaagacctaccagaacgaggtgaccggcctgtgggcccagggcagagagctgatgaaggaggtgaccgagcaggagaagagcgaggtgctgggcaagctgcaggagctgcagagcgtgtacgacagcgtgctgcagaagtgcagccacagactgcaggagctggagaagaacctggtgagcagaaagcacttcaaggaggacttcgacaaggcctgccactggctgaagcaggccgacatcgtgaccttccccgagatcaacctgatgaacgagagcagcgagctgcacacccagctggccaagtaccagaacatcctggagcagagccccgagtacgagaacctgctgctgaccctgcagagaaccggccagaccatcctgcccagcctgaacgaggtggaccacagctacctgagcgagaagctgaacgccctgcccagacagttcaacgtgatcgtggccctggccaaggacaagttctacaaggtgcaggaggccatcctggccagaaaggagtacgccagcctgatcgagctgaccacccagagcctgagcgagctggaggcccagttcctgagaatgagcaaggtgcccaccgacctggccgtggaggaggccctgagcctgcaggacggctgcagagccatcctggacgaggtggccggcctgggcgaggccgtggacgagctgaaccagaagaaggagggcttcagaagcaccggccagccctggcagcccgacaagatgctgcacctggtgaccctgtaccacagactgaagagacagaccgagcagagagtgagcctgctggaggacaccaccagcgcctaccaggagcacgagaagatgtgccagcagctggagagacagctgaagagcgtgaaggaggagcagagcaaggtgaacgaggagaccctgcccgccgaggagaagctgaagatgtaccacagcctggccggcagcctgcaggacagcggcatcgtgctgaagagagtgaccatccacctggaggacctggccccccacctggaccccctggcctacgagaaggccagacaccagatccagagctggcagggcgagctgaagctgctgaccagcgccatcggcgagaccgtgaccgagtgcgagagcagaatggtgcagagcatcgacttccagaccgagatgagcagaagcctggactggctgagaagagtgaaggccgagctgagcggccccgtgtacctggacctgaacctgcaggacatccaggaggagatcagaaagatccagatccaccaggaggaggtgcagagcagcctgagaatcatgaacgccctgagccacaaggagaaggagaagttcaccaaggccaaggagctgatcagcgccgacctggagcacagcctggccgagctgagcgagctggacggcgacatccaggaggccctgagaaccagacaggccaccctgaccgagatctacagccagtgccagagatactaccaggtgttccaggccgccaacgactggctggaggacgcccaggagctgctgcagctggccggcaacggcctggacgtggagagcgccgaggagaacctgaagagccacatggagttcttcagcaccgaggaccagttccacagcaacctggaggagctgcacagcctggtggccaccctggaccccctgatcaagcccaccggcaaggaggacctggagcagaaggtggccagcctggagctgagaagccagagaatgagcagagacagcggcgcccaggtggacctgctgcagagatgcaccgcccagtggcacgactaccagaaggccagagaggaggtgatcgagctgatgaacgacaccgagaagaagctgagcgagttcagcctgctgaagaccagcagcagccacgaggccgaggagaagctgagcgagcacaaggccctggtgagcgtggtgaacagcttccacgagaagatcgtggccctggaggagaaggccagccagctggagaagaccggcaacgacgccagcaaggccaccctgagcagaagcatgaccaccgtgtggcagagatggaccagactgagagccgtggcccaggaccaggagaagatcctggaggacgccgtggacgagtggaccggcttcaacaacaaggtgaagaaggccaccgagatgatcgaccagctgcaggacaagctgcccggcagcagcgccgagaaggccagcaaggccgagctgctgaccctgctggagtaccacgacaccttcgtgctggagctggagcagcagcagagcgccctgggcatgctgagacagcagaccctgagcatgctgcaggacggcgccgcccccacccccggcgaggagccccccctgatgcaggagatcaccgccatgcaggacagatgcctgaacatgcaggagaaggtgaagaccaacggcaagctggtgaagcaggagctgaaggacagagagatggtggagacccagatcaacagcgtgaagtgctgggtgcaggagaccaaggagtacctgggcaaccccaccatcgagatcgacgcccagctggaggagctgcagatcctgctgaccgaggccaccaaccacagacagaacatcgagaagatggccgaggagcagaaggagaagtacctgggcctgtacaccatcctgcccagcgagctgagcctgcagctggccgaggtggccctggacctgaagatcagagaccagatccaggacaagatcaaggaggtggagcagagcaaggccaccagccaggagctgagcagacagatccagaagctggccaaggacctgaccaccatcctgaccaagctgaaggccaagaccgacaacgtggtgcaggccaagaccgaccagaaggtgctgggcgaggagctggacggctgcaacagcaagctgatggagctggacgccgccgtgcagaagttcctggagcagaacggccagctgggcaagcccctggccaagaagatcggcaagctgaccgagctgcaccagcagaccatcagacaggccgagaacagactgagcaagctgaaccaggccgccagccacctggaggagtacaacgagatgctggagctgatcctgaagtggatcgagaaggccaaggtgctggcccacggcaccatcgcctggaacagcgccagccagctgagagagcagtacatcctgcaccagaccctgctggaggagagcaaggagatcgacagcgagctggaggccatgaccgagaagctgcagtacctgaccagcgtgtactgcaccgagaagatgagccagcaggtggccgagctgggcagagagaccgaggagctgagacagatgatcaagatcagactgcagaacctgcaggacgccgccaaggacatgaagaagttcgaggccgagctgaagaagctgcaggccgccctggagcaggcccaggccaccctgaccagccccgaggtgggcagactgagcctgaaggagcagctgagccacagacagcacctgctgagcgagatggagagcctgaagcccaaggtgcaggccgtgcagctgtgccagagcgccctgagaatccccgaggacgtggtggccagcctgcccctgtgccacgccgccctgagactgcaggaggaggccagcagactgcagcacaccgccatccagcagtgcaacatcatgcaggccgccgtggtgcagtacgagcagtacgagcaggagatgaagcacctgcagcagctgatcgagggcgcccacagagagatcgaggacaagcccgtggccaccagcaacatccaggagctgcaggcccagatcagcagacacgaggagctggcccagaagatcaagggctaccaggagcagatcgccagcctgaacagcaagtgcaagatgctgaccatgaaggccaagcacgccaccatgctgctgaccgtgaccgaggtggagggcctggccgagggcaccgaggacctggacggcgagctgctgcccacccccagcgcccaccccagcgtggtgatgatgaccgccggcagatgccacaccctgctgagccccgtgaccgaggagagcggcgaggagggcaccaacagcgagatcagcagcccccccgcctgcagaagccccagccccgtggccaacaccgacgccagcgtgaaccaggacatcgcctactaccaggccctgagcgccgagagactgcagaccgacgccgccaagatccaccccagcaccagcgccagccaggagttctacgagcccggcctggagcccagcgccaccgccaagctgggcgacctgcagagaagctgggagaccctgaagaacgtgatcagcgagaagcagagaaccctgtacgaggccctggagagacagcagaagtaccaggacagcctgcagagcatcagcaccaagatggaggccatcgagctgaagctgagcgagagccccgagcccggcagaagccccgagagccagatggccgagcaccaggccctgatggacgagatcctgatgctgcaggacgagatcaacgagctgcagagcagcctggccgaggagctggtgagcgagagctgcgaggccgaccccgccgagcagctggccctgcagagcaccctgaccgtgctggccgagagaatgagcaccatcagaatgaaggccagcggcaagagacagctgctggaggagaagctgaacgaccagctggaggagcagagacaggagcaggccctgcagagatacagatgcgaggccgacgagctggacagctggctgctgagcaccaaggccaccctggacaccgccctgagcccccccaaggagcccatggacatggaggcccagctgatggactgccagaacatgctggtggagatcgagcagaaggtggtggccctgagcgagctgagcgtgcacaacgagaacctgctgctggagggcaaggcccacaccaaggacgaggccgagcagctggccggcaagctgagaagactgaagggcagcctgctggagctgcagagagccctgcacgacaagcagctgaacatgcagggcaccgcccaggagaaggaggagagcgacgtggacctgaccgccacccagagccccggcgtgcaggagtggctggcccaggccagaaccacctggacccagcagagacagagcagcctgcagcagcagaaggagctggagcaggagctggccgagcagaagagcctgctgagaagcgtggccagcagaggcgaggagatcctgatccagcacagcgccgccgagaccagcggcgacgccggcgagaagcccgacgtgctgagccaggagctgggcatggagggcgagaagagcagcgccgaggaccagatgagaatgaagtgggagagcctgcaccaggagttcagcaccaagcagaagctgctgcagaacgtgctggagcaggagcaggagcaggtgctgtacagcagacccaacagactgctgagcggcgtgcccctgtacaagggcgacgtgcccacccaggacaagagcgccgtgaccagcctgctggacggcctgaaccaggccttcgaggaggtgagcagccagagcggcggcgccaagagacagagcatccacctggagcagaagctgtacgacggcgtgagcgccaccagcacctggctggacgacgtggaggagagactgttcgtggccaccgccctgctgcccgaggagaccgagacctgcctgttcaaccaggagatcctggccaaggacatcaaggagatgagcgaggagatggacaagaacaagaacctgttcagccaggccttccccgagaacggcgacaacagagacgtgatcgaggacaccctgggctgcctgctgggcagactgagcctgctggacagcgtggtgaaccagagatgccaccagatgaaggagagactgcagcagatcctgaacttccagaacgacctgaaggtgctgttcaccagcctggccgacaacaagtacatcatcctgcagaagctggccaacgtgttcgagcagcccgtggccgagcagatcgaggccatccagcaggccgaggacggcctgaaggagttcgacgccggcatcatcgagctgaagagaagaggcgacaagctgcaggtggagcagcccagcatgcaggagctgagcaagctgcaggacatgtacgacgagctgatgatgatcatcggcagcagaagaagcggcctgaaccagaacctgaccctgaagagccagtacgagagagccctgcaggacctggccgacctgctggagaccggccaggagaagatggccggcgaccagaagatcatcgtgagcagcaaggaggagatccagcagctgctggacaagcacaaggagtacttccagggcctggagagccacatgatcctgaccgagaccctgttcagaaagatcatcagcttcgccgtgcagaaggagacccagttccacaccgagctgatggcccaggccagcgccgtgctgaagagagcccacaagagaggcgtggagctggagtacatcctggagacctggagccacctggacgaggaccagcaggagctgagcagacagctggaggtggtggagagcagcatccccagcgtgggcctggtggaggagaacgaggacagactgatcgacagaatcaccctgtaccagcacctgaagagcagcctgaacgagtaccagcccaagctgtaccaggtgctggacgacggcaagagactgctgatcagcatcagctgcagcgacctggagagccagctgaaccagctgggcgagtgctggctgagcaacaccaacaagatgagcaaggagctgcacagactggagaccatcctgaagcactggaccagataccagagcgagagcgccgacctgatccactggctgcagagcgccaaggacagactggagttctggacccagcagagcgtgaccgtgccccaggagctggagatggtgagagaccacctgaacgccttcctggagttcagcaaggaggtggacgcccagagcagcctgaagagcagcgtgctgagcaccggcaaccagctgctgagactgaagaaggtggacaccgccaccctgagaagcgagctgagcagaatcgacagccagtggaccgacctgctgaccaacatccccgccgtgcaggagaagctgcaccagctgcagatggacaagctgcccagcagacacgccatcagcgaggtgatgagctggatcagcctgatggagaacgtgatccagaaggacgaggacaacatcaagaacagcatcggctacaaggccatccacgagtacctgcagaagtacaagggcttcaagatcgacatcaactgcaagcagctgaccgtggacttcgtgaaccagagcgtgctgcagatcagcagccaggacgtggagagcaagagaagcgacaagaccgacttcgccgagcagctgggcgccatgaacaagagctggcagatcctgcagggcctggtgaccgagaagatccagctgctggagggcctgctggagagctggagcgagtacgagaacaacgtgcagtgcctgaagacctggttcgagacccaggagaagagactgaagcagcagcacagaatcggcgaccaggccagcgtgcagaacgccctgaaggactgccaggacctggaggacctgatcaaggccaaggagaaggaggtggagaagatcgagcagaacggcctggccctgatccagaacaagaaggaggacgtgagcagcatcgtgatgagcaccctgagagagctgggccagacctgggccaacctggaccacatggtgggccagctgaagatcctgctgaagagcgtgctggaccagtggagcagccacaaggtggccttcgacaagatcaacagctacctgatggaggccagatacagcctgagcagattcagactgctgaccggcagcctggaggccgtgcaggtgcaggtggacaacctgcagaacctgcaggacgacctggagaagcaggagagaagcctgcagaagttcggcagcatcaccaaccagctgctgaaggagtgccacccccccgtgaccgagaccctgaccaacaccctgaaggaggtgaacatgagatggaacaacctgctggaggagatcgccgagcagctgcagagcagcaaggccctgctgcagctgtggcagagatacaaggactacagcaagcagtgcgccagcaccgtgcagcagcaggaggacagaaccaacgagctgctgaaggccgccaccaacaaggacatcgccgacgacgaggtggccacctggatccaggactgcaacgacctgctgaagggcctgggcaccgtgaaggacagcctgttcttcctgcacgagctgggcgagcagctgaagcagcaggtggacgccagcgccgccagcgccatccagagcgaccagctgagcctgagccagcacctgtgcgccctggagcaggccctgtgcaagcagcagaccagcctgcaggccggcgtgctggactacgagaccttcgccaagagcctggaggccctggaggcctggatcgtggaggccgaggagatcctgcagggccaggaccccagccacagcagcgacctgagcaccatccaggagagaatggaggagctgaagggccagatgctgaagttcagcagcatggcccccgacctggacagactgaacgagctgggctacagactgcccctgaacgacaaggagatcaagagaatgcagaacctgaacagacactggagcctgatcagcagccagaccaccgagagattcagcaagctgcagagcttcctgctgcagcaccagaccttcctggagaagtgcgagacctggatggagttcctggtgcagaccgagcagaagctggccgtggagatcagcggcaactaccagcacctgctggagcagcagagagcccacgagctgttccaggccgagatgttcagcagacagcagatcctgcacagcatcatcatcgacggccagagactgctggagcagggccaggtggacgacagagacgagttcaacctgaagctgaccctgctgagcaaccagtggcagggcgtgatcagaagagcccagcagagaagaggcatcatcgacagccagatcagacagtggcagagatacagagagatggccgagaagctgagaaagtggctggtggaggtgagctacctgcccatgagcggcctgggcagcgtgcccatccccctgcagcaggccagaaccctgttcgacgaggtgcagttcaaggagaaggtgttcctgagacagcagggcagctacatcctgaccgtggaggccggcaagcagctgctgctgagcgccgacagcggcgccgaggccgccctgcaggccgagctggccgagatccaggagaagtggaagagcgccagcatgagactggaggagcagaagaagaagctggccttcctgctgaaggactgggagaagtgcgagaagggcatcgccgacagcctggagaagctgagaaccttcaagaagaagctgagccagagcctgcccgaccaccacgaggagctgcacgccgagcagatgagatgcaaggagctggagaacgccgtgggcagctggaccgacgacctgacccagctgagcctgctgaaggacaccctgagcgcctacatcagcgccgacgacatcagcatcctgaacgagagagtggagctgctgcagagacagtgggaggagctgtgccaccagctgagcctgagaagacagcagatcggcgagagactgaacgagtgggccgtgttcagcgagaagaacaaggagctgtgcgagtggctgacccagatggagagcaaggtgagccagaacggcgacatcctgatcgaggagatgatcgagaagctgaagaaggactaccaggaggagatcgccatcgcccaggagaacaagatccagctgcagcagatgggcgagagactggccaaggccagccacgagagcaaggccagcgagatcgagtacaagctgggcaaggtgaacgacagatggcagcacctgctggacctgatcgccgccagagtgaagaagctgaaggagaccctggtggccgtgcagcagctggacaagaacatgagcagcctgagaacctggctggcccacatcgagagcgagctggccaagcccatcgtgtacgacagctgcaacagcgaggagatccagagaaagctgaacgagcagcaggagctgcagagagacatcgagaagcacagcaccggcgtggccagcgtgctgaacctgtgcgaggtgctgctgcacgactgcgacgcctgcgccaccgacgccgagtgcgacagcatccagcaggccaccagaaacctggacagaagatggagaaacatctgcgccatgagcatggagagaagactgaagatcgaggagacctggagactgtggcagaagttcctggacgactacagcagattcgaggactggctgaagagcagcgagagaaccgccgccttccccagcagcagcggcgtgatctacaccgtggccaaggaggagctgaagaagttcgaggccttccagagacaggtgcacgagtgcctgacccagctggagctgatcaacaagcagtacagaagactggccagagagaacagaaccgacagcgcctgcagcctgaagcagatggtgcacgagggcaaccagagatgggacaacctgcagaagagagtgaccagcatcctgagaagactgaagcacttcatcggccagagagaggagttcgagaccgccagagacagcatcctggtgtggctgaccgagatggacctgcagctgaccaacatcgagcacttcagcgagtgcgacgtgcaggccaagatcaagcagctgaaggccttccagcaggagatcagcctgaaccacaacaagatcgagcagatcatcgcccagggcgagcagctgatcgagaagagcgagcccctggacgccgccatcatcgaggaggagctggacgagctgagaagatactgccaggaggtgttcggcagagtggagagataccacaagaagctgatcagactgcccctgcccgacgacgagcacgacctgagcgacagagagctggagctggaggacagcgccgccctgagcgacctgcactggcacgacagaagcgccgacagcctgctgagcccccagcccagcagcaacctgagcctgagcctggcccagcccctgagaagcgagagaagcggcagagacacccccgccagcgtggacagcatccccctggagtgggaccacgactacgacctgagcagagacctggagagcgccatgagcagagccctgcccagcgaggacgaggagggccaggacgacaaggacttctacctgagaggcgccgtgggcctgagcgacgtgatgatccccgagagccccgaggcctacgtgaagctgaccgagaacgccatcaagaacaccagcggcgaccacagcgccctggagagccagatcagacagctgggcaaggccctggacgacagcagattccagatccagcagaccgagaacatcatcagaagcaagacccccaccggccccgagctggacaccagctacaagggctacatgaagctgctgggcgagtgcagcagcagcatcgacagcgtgaagagactggagcacaagctgaaggaggaggaggagagcctgcccggcttcgtgaacctgcacagcaccgagacccagaccgccggcgtgatcgacagatgggagctgctgcaggcccaggccctgagcaaggagctgagaatgaagcagaacctgcagaagtggcagcagttcaacagcgacctgaacagcatctgggcctggctgggcgacaccgaggaggagctggagcagctgcagagactggagctgagcaccgacatccagaccatcgagctgcagatcaagaagctgaaggagctgcagaaggccgtggaccacagaaaggccatcatcctgagcatcaacctgtgcagccccgagttcacccaggccgacagcaaggagagcagagacctgcaggacagactgagccagatgaacggcagatgggacagagtgtgcagcctgctggaggagtggagaggcctgctgcaggacgccctgatgcagtgccagggcttccacgagatgagccacggcctgctgctgatgctggagaacatcgacagaagaaagaacgagatcgtgcccatcgacagcaacctggacgccgagatcctgcaggaccaccacaagcagctgatgcagatcaagcacgagctgctggagagccagctgagagtggccagcctgcaggacatgagctgccagctgctggtgaacgccgagggcaccgactgcctggaggccaaggagaaggtgcacgtgatcggcaacagactgaagctgctgctgaaggaggtgagcagacacatcaaggagctggagaagctgctggacgtgagcagcagccagcaggacctgagcagctggagcagcgccgacgagctggacaccagcggcagcgtgagccccaccagcggcagaagcacccccaacagacagaagacccccagaggcaagtgcagcctgagccagcccggccccagcgtgagcagcccccacagcagaagcaccaagggcggcagcgacagcagcctgagcgagcccggccccggcagaagcggcagaggcttcctgttcagagtgctgagagccgccctgcccctgcagctgctgctgctgctgctgatcggcctggcctgcctggtgcccatgagcgaggaggactacagctgcgccctgagcaacaacttcgccagaagcttccaccccatgctgagatacaccaacggccccccccccctgtag

SEQ ID NO: 100479 - DNA, 2859 bp, Artificial Sequence
  Description of Artificial Sequence: Synthetic coding sequence
atggtggtggccgaggacctgagcgccctgagaatggccgaggacagctgcgtggacgccgacctgcccgactgcaactgcgacgtgaccagagtgaagaagctgaaggagaccctggtggccgtgcagcagctggacaagaacatgagcagcctgagaacctggctggcccacatcgagagcgagctggccaagcccatcgtgtacgacagctgcaacagcgaggagatccagagaaagctgaacgagcagcaggagctgcagagagacatcgagaagcacagcaccggcgtggccagcgtgctgaacctgtgcgaggtgctgctgcacgactgcgacgcctgcgccaccgacgccgagtgcgacagcatccagcaggccaccagaaacctggacagaagatggagaaacatctgcgccatgagcatggagagaagactgaagatcgaggagacctggagactgtggcagaagttcctggacgactacagcagattcgaggactggctgaagagcagcgagagaaccgccgccttccccagcagcagcggcgtgatctacaccgtggccaaggaggagctgaagaagttcgaggccttccagagacaggtgcacgagtgcctgacccagctggagctgatcaacaagcagtacagaagactggccagagagaacagaaccgacagcgcctgcagcctgaagcagatggtgcacgagggcaaccagagatgggacaacctgcagaagagagtgaccagcatcctgagaagactgaagcacttcatcggccagagagaggagttcgagaccgccagagacagcatcctggtgtggctgaccgagatggacctgcagctgaccaacatcgagcacttcagcgagtgcgacgtgcaggccaagatcaagcagctgaaggccttccagcaggagatcagcctgaaccacaacaagatcgagcagatcatcgcccagggcgagcagctgatcgagaagagcgagcccctggacgccgccatcatcgaggaggagctggacgagctgagaagatactgccaggaggtgttcggcagagtggagagataccacaagaagctgatcagactgcccctgcccgacgacgagcacgacctgagcgacagagagctggagctggaggacagcgccgccctgagcgacctgcactggcacgacagaagcgccgacagcctgctgagcccccagcccagcagcaacctgagcctgagcctggcccagcccctgagaagcgagagaagcggcagagacacccccgccagcgtggacagcatccccctggagtgggaccacgactacgacctgagcagagacctggagagcgccatgagcagagccctgcccagcgaggacgaggagggccaggacgacaaggacttctacctgagaggcgccgtgggcctgagcggcgaccacagcgccctggagagccagatcagacagctgggcaaggccctggacgacagcagattccagatccagcagaccgagaacatcatcagaagcaagacccccaccggccccgagctggacaccagctacaagggctacatgaagctgctgggcgagtgcagcagcagcatcgacagcgtgaagagactggagcacaagctgaaggaggaggaggagagcctgcccggcttcgtgaacctgcacagcaccgagacccagaccgccggcgtgatcgacagatgggagctgctgcaggcccaggccctgagcaaggagctgagaatgaagcagaacctgcagaagtggcagcagttcaacagcgacctgaacagcatctgggcctggctgggcgacaccgaggaggagctggagcagctgcagagactggagctgagcaccgacatccagaccatcgagctgcagatcaagaagctgaaggagctgcagaaggccgtggaccacagaaaggccatcatcctgagcatcaacctgtgcagccccgagttcacccaggccgacagcaaggagagcagagacctgcaggacagactgagccagatgaacggcagatgggacagagtgtgcagcctgctggaggagtggagaggcctgctgcaggacgccctgatgcagtgccagggcttccacgagatgagccacggcctgctgctgatgctggagaacatcgacagaagaaagaacgagatcgtgcccatcgacagcaacctggacgccgagatcctgcaggaccaccacaagcagctgatgcagatcaagcacgagctgctggagagccagctgagagtggccagcctgcaggacatgagctgccagctgctggtgaacgccgagggcaccgactgcctggaggccaaggagaaggtgcacgtgatcggcaacagactgaagctgctgctgaaggaggtgagcagacacatcaaggagctggagaagctgctggacgtgagcagcagccagcaggacctgagcagctggagcagcgccgacgagctggacaccagcggcagcgtgagccccaccagcggcagaagcacccccaacagacagaagacccccagaggcaagtgcagcctgagccagcccggccccagcgtgagcagcccccacagcagaagcaccaagggcggcagcgacagcagcctgagcgagcccggccccggcagaagcggcagaggcttcctgttcagagtgctgagagccgccctgcccctgcagctgctgctgctgctgctgatcggcctggcctgcctggtgcccatgagcgaggaggactacagctgcgccctgagcaacaacttcgccagaagcttccaccccatgctgagatacaccaacggccccccccccctgtag

SEQ ID NO: 100480 - DNA, 20475 bp, Artificial Sequence
  Description of Artificial Sequence: Synthetic coding sequence
atggccagcagccccgagctgcccaccgaggacgagcagggcagctggggcatcgacgacctgcacatcagcctgcaggccgagcaggaggacacccagaagaaggccttcacctgctggatcaacagccagctggccagacacaccagccccagcgtgatcagcgacctgttcaccgacatcaagaagggccacgtgctgctggacctgctggaggtgctgagcggccagcagctgcccagagacaagggcagcaacaccttccagtgcagaatcaacatcgagcacgccctgaccttcctgagaaacagaagcatcaagctgatcaacatccacgtgaccgacatcatcgacggcaaccccagcatcatcctgggcctgatctggaccatcatcctgcacttccacatcgagaagctggcccagaccctgagctgcaactacaaccagcccagcctggacgacgtgagcgtggtggacagcagccccgccagcagcccccccgccaagaagtgcagcaaggtgcaggccagatggcagatgagcgccagaaaggccctgctgctgtgggcccaggagcagtgcgccacctacgagagcgtgaacgtgaccgacttcaagagcagctggagaaacggcatggccttcctggccatcatccacgccctgagacccgacctgatcgacatgaagagcgtgaagcacagaagcaacaaggacaacctgagagaggccttcagaatcgccgagcaggagctgaagatccccagactgctggagcccgaggacgtggacgtggtggaccccgacgagaagagcatcatgacctacgtggcccagttcctgcagtacagcaaggacgcccccggcaccggcgaggaggcccagggcaaggtgaaggacgccatgggctggctgaccctgcagaaggagaagctgcagaagctgctgaaggacagcgagaacgacacctacttcaagaagtacaacagcctgctgagcttcatggagagcttcaacgaggagaagaagagcttcctggacgtgctgagcatcaagagagacctggacgagctggacaaggaccacctgcagctgagagaggcctgggacggcctggaccaccagatcaacgcctggaagatcaagctgaactacgccctgcccccccccctgcaccagaccgaggcctggctgcaggaggtggaggagctgatggacgaggacctgagcgccagccaggaccacagccaggccgtgaccctgatccaggagaagatgaccctgttcaagagcctgatggacagattcgagcaccacagcaacatcctgctgaccttcgagaacaaggacgagaaccacctgcccctggtgccccccaacaagctggaggagatgaagagaagaatcaacaacatcctggagaagaagttcatcctgctgctggagttccactactacaagtgcctggtgctgggcctggtggacgaggtgaagagcaagctggacatctggaacatcaagtacggcagcagagagagcgtggagctgctgctggaggactggcacaagttcatcgaggagaaggagttcctggccagactggacaccagcttccagaagtgcggcgagatctacaagaacctggccggcgagtgccagaacatcaacaagcagtacatgatggtgaagagcgacgtgtgcatgtacagaaagaacatctacaacgtgaagagcaccctgcagaaggtgctggcctgctgggccacctacgtggagaacctgagactgctgagagcctgcttcgaggagaccaagaaggaggagatcaaggaggtgcccttcgagaccctggcccagtggaacctggagcacgccaccctgaacgaggccggcaacttcctggtggaggtgagcaacgacgtggtgggcagcagcatcagcaaggagctgagaagactgaacaagagatggagaaagctggtgagcaagacccagctggagatgaacctgcccctgatgatcaagaagcaggaccagcccaccttcgacaacagcggcaacatcctgagcaaggaggagaaggccaccgtggagttcagcaccgacatgagcgtggagctgcccgagaactacaaccagaacatcaaggccggcgagaagcacgagaaggagaacgaggagttcaccggccagctgaaggtggccaaggacgtggagaagctgatcggccaggtggagatctgggaggccgaggccaagagcgtgctggaccaggacgacgtggacaccagcatggaggagagcctgaagcacctgatcgccaagggcagcatgttcgacgagctgatggccagaagcgaggacatgctgcagatggacatccagaacatcagcagccaggagagcttccagcacgtgctgaccaccggcctgcaggccaagatccaggaggccaaggagaaggtgcagatcaacgtggtgaagctgatcgccgccctgaagaacctgaccgacgtgagccccgacctggacatcagactgaagatggaggagagccagaaggagctggagagctacatgatgagagcccagcagctgctgggccagagagagagccccggcgagctgatcagcaagcacaaggaggccctgatcatcagcaacaccaagagcctggccaagtacctgaaggccgtggaggagctgaagaacaacgtgaccgaggacatcaagatgagcctggaggagaagagcagagacgtgtgcgccaagtgggagagcctgcaccacgagctgagcctgtacgtgcagcagctgaagatcgacatcgagaagggcaagctgagcgacaacatcctgaagctggagaagcagatcaacaaggagaagaagctgatcagaagaggcagaaccaagggcctgatcaaggagcacgaggcctgcttcagcgaggagggctgcctgtaccagctgaaccaccacatggaggtgctgagagagctgtgcgaggagctgcccagccagaagagccagcaggaggtgaagagactgctgaaggactacgagcagaagatcgagagactgctgaagtgcgccagcgagatccacatgaccctgcagcccaccgccggcggcaccagcaagaacgagggcaccatcaccaccagcgagaacagaggcggcgacccccacagcgaggcccccttcgccaagagcgacaaccagcccagcaccgagaaggccatggagcccaccatgaagttcagcctggccagcgtgctgagacccctgcaggaggagagcatcatggagaaggactacagcgccagcatcaacagcctgctggagagatacgacacctacagagacatcctggagcaccacctgcagaacaacaagttcagaatcaccagcgacttcagcagcgaggaggacagaagcagcagctgcctgcaggccaagctgaccgacctgcaggtgatcaagaacgagaccgacgccagatggaaggagttcgagatcatcagcctgaagctggagaaccacgtgaacgacatcaagaagcccttcgtgatcaaggagagagacaccctgaaggagagagagagagagctgcagatgaccctgaacaccagaatggagagcctggagaccgccctgagactggtgctgcccgtggagaaggccagcctgctgctgtgcggcagcgacctgcccctgcacaagatggccatccagggcttccacctgatcgacgccgacagaatctaccagcacctgagaaacatccaggacagcatcgccaagcagatcgagatctgcaacagactggaggagcccggcaacttcgtgctgaaggagctgcaccccttcgacctgcacgccatgcagaacatcatcctgaagtacaagacccagttcgagggcatgaaccacagagtgcagagaagcgaggacaccctgaaggccctggaggacttcctggccagcctgagaaccgccaagctgagcgccgagcccgtgaccgacctgagcgccagcgacacccaggtggcccaggagaacaccctgaccgtgaagaacaaggagggcgagatccacctgatgaaggacaaggccaagcacctggacaagtgcctgaagatgctggacatgagcttcaaggacgccgagagaggcgacgacaccagctgcgagaacctgctggacgccttcagcatcaagctgagcgagacccacggctacggcgtgcaggaggagttcaccgaggagaacaagctgctggaggcctgcatcttcaagaacaacgagctgctgaagaacatccaggacgtgcagagccagatcagcaagatcggcctgaaggaccccaccgtgcccgccgtgaagcacagaaagaagagcctgatcagactggacaaggtgctggacgagtacgaggaggagaagagacacctgcaggagatggccaacagcctgccccacttcaaggacggcagagagaagaccgtgaaccagcagtgccagaacaccgtggtgctgtgggagaacaccaaggccctggtgaccgagtgcctggagcagtgcggcagagtgctggagctgctgaagcagtaccagaacttcaagagcatcctgaccaccctgatccagaaggaggagagcgtgatcagcctgcaggccagctacatgggcaaggagaacctgaagaagagaatcgccgagatcgagatcgtgaaggaggagttcaacgagcacctggaggtggtggacaagatcaaccaggtgtgcaagaacctgcagttctacctgaacaagatgaagaccttcgaggagccccccttcgagaaggaggccaacatcatcgtggacagatggctggacatcaacgagaagaccgaggactactacgagaacctgggcagagccctggccctgtgggacaagctgttcaacctgaagaacgtgatcgacgagtggaccgagaaggccctgcagaagatggagctgcaccagctgaccgaggaggacagagagagactgaaggaggagctgcaggtgcacgagcagaagaccagcgagttcagcagaagagtggccgagatccagttcctgctgcagagcagcgagatccccctggagctgcaggtgatggagagcagcatcctgaacaagatggagcacgtgcagaagtgcctgaccggcgagagcaactgccacgccctgagcggcagcaccgccgagctgagagaggacctggaccaggccaagacccagatcggcatgaccgagagcctgctgaaggccctgagccccagcgacagcctggagatcttcaccaagctggaggagatccagcagcagatcctgcagcagaagcacagcatgatcctgctggagaaccagatcggctgcctgacccccgagctgagcgagctgaagaagcagtacgagagcgtgagcgacctgttcaacaccaagaagagcgtgctgcaggaccacttcagcaagctgctgaacgaccagtgcaagaacttcaacgactggttcagcaacatcaaggtgaacctgaaggagtgcttcgagagcagcgagaccaagaagagcgtggagcagaagctgcagaagctgagcgacttcctgaccctggagggcagaaacagcaagatcaagcaggtggacagcgtgctgaagcacgtgaagaagcacctgcccaaggcccacgtgaaggagctgatcagctggctggtgggccaggagttcgagctggagaagatggagagcatctgccaggccagagccaaggagctggaggacagcctgcagcagctgctgagactgcaggacgaccacagaaacctgagaaagtggctgaccaaccaggaggagaagtggaagggcatggaggagcccggcgagaagaccgagctgttctgccaggccctggccagaaagagagagcagttcgagagcgtggcccagctgaacaacagcctgaaggagtacggcttcaccgaggaggaggagatcatcatggaggccacctgcctgatggacagataccagaccctgctgagacagctgagcgagatcgaggaggaggacaagctgctgcccaccgaggaccagagcttcaacgacctggcccacgacgtgatccactggatcaaggagatcaaggagagcctgatggtgctgaacagcagcgagggcaagatgcccctggaggagagaatccagaagatcaaggagatcatcctgctgaagcccgagggcgacgccagaatcgagaccatcatgaagcaggccgagagcagcgaggcccccctggtgcagaagaccctgaccgacatcagcaaccagtgggacaacaccctgcacctggccagcacctacctgagccaccaggagaagctgctgctggagggcgagaagtacctgcagagcaaggaggacctgagactgatgctgatcgagctgaagaagaagcaggaggccggcttcgccctgcagcacggcctgcaggagaagaaggcccagctgaagatctacaagaagttcctgaagaaggcccaggacctgaccagcctgctgaaggagctgaagagccagggcaactacctgctggagtgcaccaagaaccccagcttcagcgaggagccctggctggagatcaagcacctgcacgagagcctgctgcagcagctgcaggacagcgtgcagaacctggacggccacgtgagagagcacgacagctaccaggtgtgcgtgaccgacctgaacaccaccctggacaacttcagcaaggagttcgtgagcttcagcgacaagcccgtggaccagatcgccgtggaggagaagctgcagaagctgcaggagctggagaacagactgagcctgcaggacggcaccctgaagaagatcctggccctggccaagagcgtgaagcagaacaccagcagcgtgggccagaagatcatcaaggacgacatcaagagcctgcagtgcaagcagaaggacctggagaacagactggccagcgccaagcaggagatggagtgctgcctgaacagcatcctgaagagcaagagaagcaccgagaagaagggcaagttcaccctgcccggcagagagaagcaggccaccagcgacgtgcaggagagcacccaggagagcgccgccgtggagaagctggaggaggactgggagatcaacaagaacttcgtggagaacgtgatggccgtgagcaagaactgccaccacagcatgtacatcttcgagagcatcgtgaagaacttcatcagcgacgagatgcaggacagcgccgtggagatggccatgagcaagcagctgagcctgaacgcccaggagagcatgaagaacaccgaggacgagagaaaggtgaacgagctgcagaaccagcccctggagctggacaccatgctgagaaacgagcagctggaggagatcgagaagctgtacacccagctggaggccaagaaggccgccatcaagcccctggagcagaccgagtgcctgaacaagaccgagaccggcgccctggtgctgcacaacatcggctacagcgcccagcacctggacaacctgctgcaggccctgatcaccctgaagaagaacaaggagagccagtactgcgtgctgagagacttccaggagtacctggccgccgtggagagcagcatgaaggccctgctgaccgacaaggagagcctgaaggtgggccccctggacagcgtgacctacctggacaagatcaagaagttcatcgccagcatcgagaaggagaaggacagcctgggcaacctgaagatcaagtgggagaacctgagcaaccacgtgaccgacatggacaagaagctgctggagagccagatcaagcagctggagcacggctgggagcaggtggagcagcagatccagaagaagtacagccagcaggtggtggagtacgacgagttcaccaccctgatgaacaaggtgcaggacaccgagatcagcctgcagcagcagcagcagcacctgcagctgagactgaagagccccgaggagagagccggcaaccagagcatgatcgccctgaccaccgacctgcaggccaccaagcacggcttcagcgtgctgaagggccaggccgagctgcagatgaagagaatctggggcgagaaggagaagaagaacctggaggacggcatcaacaacctgaagaagcagtgggagaccctggagcccctgcacctggaggccgagaaccagatcaagaagtgcgacatcagaaacaagatgaaggagaccatcctgtgggccaagaacctgctgggcgagctgaaccccagcatccccctgctgcccgacgacatcctgagccagatcagaaagtgcaaggtgacccacgacggcatcctggccagacagcagagcgtggagagcctggccgaggaggtgaaggacaaggtgcccagcctgaccacctacgagggcagcgacctgaacaacaccctggaggacctgagaaaccagtaccagatgctggtgctgaagagcacccagagaagccagcagctggagttcaagctggaggagagaagcaacttcttcgccatcatcagaaagttccagctgatggtgcaggagagcgagaccctgatcatccccagagtggagaccgccgccaccgaggccgagctgaagcaccaccacgtgaccctggaggccagccagaaggagctgcaggagatcgacagcggcatcagcacccacctgcaggagctgaccaacatctacgaggagctgaacgtgttcgagagactgttcctggaggaccagctgaagaacctgaagatcagaaccaacagaatccagagattcatccagaacacctgcaacgaggtggagcacaagatcaagttctgcagacagttccacgagaagaccagcgccctgcaggaggaggccgacagcatccagagaaacgagctgctgctgaaccaggaggtgaacaagggcgtgaaggaggagatctacaacctgaaggacagactgaccgccatcaagtgctgcatcctgcaggtgctgaagctgaagaaggtgttcgactacatcggcctgaactgggacttcagccagctggaccagctgcagacccaggtgttcgagaaggagaaggagctggaggagaagatcaagcagctggacaccttcgaggaggagcacggcaagtaccaggccctgctgagcaagatgagagccatcgacctgcagatcaagaagatgaccgaggtggtgctgaaggcccccgacagcagccccgagagcagaagactgaacgcccagatcctgagccagagaatcgagaaggccaagtgcctgtgcgacgagatcatcaagaagctgaacgagaacaagaccttcgacgacagcttcaaggagaaggagatcctgcagatcaagctgaacgccgaggagaacgacaagctgtacaaggtgctgcagaacatggtgctggagctgagccccaaggagctggacgagaagaactgccaggacaagctggagaccagcctgcacgtgctgaaccagatcaagagccagctgcagcagcccctgctgatcaacctggagatcaagcacatccagaacgagaaggacaactgcgaggccttccaggagcaggtgtgggccgagatgtgcagcatcaaggccgtgaccgccatcgagaagcagagagaggagaacagcagcgaggccagcgacgtggagaccaagctgagagagttcgaggacctgcagatgcagctgaacaccagcatcgacctgagaaccaacgtgctgaacgacgcctacgagaacctgaccagatacaaggaggccgtgaccagagccgtggagagcatcaccagcctggaggccatcatcatcccctacagagtggacgtgggcaaccccgaggagagcctggagatgcccctgagaaagcaggaggagctggagagcaccgtggcccacatccaggacctgaccgagaagctgggcatgatcagcagccccgaggccaagctgcagctgcagtacaccctgcaggagctggtgagcaagaacagcgccatgaaggaggccttcaaggcccaggagaccgaggccgagagatacctggagaactacaagtgctacagaaagatggaggaggacatctacaccaacctgagcaagatggagaccgtgctgggccagagcatgagcagcctgcccctgagctacagagaggccctggagagactggagcagagcaaggccctggtgagcaacctgatcagcaccaaggaggagctgatgaagctgagacagatcctgagactgctgagactgagatgcaccgagaacgacggcatctgcctgctgaagatcgtgagcgccctgtgggagaagtggctgagcctgctggaggccgccaaggagtgggagatgtggtgcgaggagctgaagcaggagtggaagttcgtgagcgaggagatcgagagagaggccatcatcctggacaacctgcaggaggagctgcccgagatcagcaagaccaaggaggccgccaccaccgaggagctgagcgagctgctggactgcctgtgccagtacggcgagaacgtggagaagcagcagctgctgctgaccctgctgctgcagagaatcagaagcatccagaacgtgcccgagagcagcggcgccgtggagaccgtgcccgccttccaggagatcaccagcatgaaggagagatgcaacaagctgctgcagaaggtgcagaagaacaaggagctggtgcagaccgagatccaggagagacacagcttcaccaaggagatcatcgccctgaagaacttcttccagcagaccaccaccagcttccagaacatggccttccaggaccaccccgagaagagcgagcagttcgaggagctgcagagcatcctgaagaagggcaagctgaccttcgagaacatcatggagaagctgagaatcaagtacagcgagatgtacaccatcgtgcccgccgagatcgagagccaggtggaggagtgcagaaaggccctggaggacatcgacgagaagatcagcaacgaggtgctgaagagcagccccagctacgccatgagaagaaagatcgaggagatcaacaacggcctgcacaacgtggagaagatgctgcagcagaagagcaagaacatcgagaaggcccaggagatccagaagaagatgtgggacgagctggacctgtggcacagcaagctgaacgagctggacagcgaggtgcaggacatcgtggagcaggaccccggccaggcccaggagtggatggacaacctgatgatccccttccagcagtaccagcaggtgagccagagagccgagtgcagaaccagccagctgaacaaggccaccgtgaagatggaggagtacagcgacctgctgaagagcaccgaggcctggatcgagaacaccagccacctgctggccaaccccgccgactacgacagcctgagaaccctgagccaccacgccagcaccgtgcagatggccctggaggacagcgagcagaagcacaacctgctgcacagcatcttcatggacctggaggacctgagcatcatcttcgagaccgacgagctgacccagagcatccaggagctgagcaaccaggtgaccgccctgcagcagaagatcatggagagcctgccccagatccagagaatggccgacgacgtggtggccatcgagagcgaggtgaagagcatggagaagagagtgagcaagatcaagaccatcctgctgagcaaggagatcttcgacttcagccccgaggagcacctgaagcacggcgaggtgatcctggagaacatcagacccatgaagaagaccatcgccgagatcgtgagctaccaggtggagctgagactgccccagaccggcatgaagcccctgcccgtgttccagagaaccaaccagctgctgcaggacatcaagctgctggagaacgtgacccaggagcagaacgagctgctgaaggtggtgatcaagcagaccaacgagtgggacgaggagatcgagaacctgaagcagatcctgaacaactacagcgcccagttcagcctggagcacatgagccccgaccaggccgacaagctgccccagctgcagggcgagatcgagagaatggagaagcagatcctgagcctgaaccagagaaaggaggacctgctggtggacctgaaggccaccgtgctgaacctgcaccagcacctgaagcaggagcaggagggcgtggagagagacagactgcccgccgtgaccagcgaggagggcggcgtggccgagagagacgccagcgagagaaagctgaacagaagaggcagcatgagctacctggccgccgtggaggaggaggtggaggagagcagcgtgaagagcgaccacgacaaggacatggaggaggacagagccagcagcagcagcggcaccatcgtgcaggaggcctacggcaagatcagcaccagcgacaacagcatggcccagatcctgacccccgacagcctgaacaccgagcagggccccgagtgcagcctgagacccaaccagaccgaggagggcaccaccccccccatcgaggccgacaccctggacagcagcgacgcccagggcggcctggagcccagagtggagaagaccagacccgagcccaccgaggtgctgcacgcctgcaagacccaggtggccgagctggagctgtggctgcagcaggccaacgtggccgtggagcccgagaccctgaacgccgacatgcagcaggtgctggagcagcagctggtgggctgccaggccatgctgaccgagatcgagcacaaggtggccttcctgctggagacctgcaaggaccagggcctgggcgacaacggcgccacccagcacgaggccgaggccctgagcctgaagctgaagaccgtgaagtgcaacctggagaaggtgcagatgatgctgcaggagaagcacagcgaggaccagcaccccaccatcctgaagaagagcagcgagcccgagcaccaggaggccctgcagcccgtgaacctgagcgagctggagagcatcgtgaccgagagaccccagttcagcagacagaaggacttccagcagcagcaggtgctggagctgaagcccatggagcagaaggacttcatcaagttcatcgagttcaacgccaagaagatgtggccccagtactgccagcacgacaacgacaccacccaggagagcagcgccagataccccaccaccgaggagctgaagacctacaccacccagctggaggacctgagacaggaggccagcaacctgcagacccaggagaacatgaccgaggaggcctacatcaacctggacaagaagctgttcgagctgttcctgaccctgagccagtgcctgagcagcgtggaggagatgctggagatgcccagactgtacagagaggacggcagcggccagcaggtgcactacgagaccctggccctggagctgaagaagctgtacctggccctgagcgacaagaagggcgacctgctgaaggccatgacctggcccggcgagaacaccaacctgctgctggagtgcttcgacaacctgcaggtgtgcctggagcacacccaggccgccgccgtgtgcagaagcaagagcctgaaggccggcctggactacaacagaagctaccagaaggccgacgcctacaccgtggagctggagaacgccgagagcagagtggccaagctgagagacgagggcgagagactgcacctgccctacgccctgctgcaggaggtgtacaagctggaggacgtgctggacagcatgtggggcatgctgagagccagatacaccgagctgagcagccccttcgtgaccgagagccagcaggacgccctgctgcagggcatggtggagctggtgaagatcggcaaggagaagctggcccacggccacctgaagcagaccaagagcaaggtggccctgcaggcccagatcgagaaccacaaggtgttcttccagaagctggtggccgacatgctgctgatccaggcctacagcgccaagatcctgcccagcctgctgcagaacagagagaccttctgggccgagcaggtgaccgaggtgaagatcctggaggagaagagcagacagtgcggcatgaagctgcagagcctgctgcagaagtgggaggagttcgacgagaactacgccagcctggagaaggacctggagatcctgatcagcaccctgcccagcgtgagcctggtggaggagaccgaggagagactggtggagagaatcagcttctaccagcagatcaagagaaacatcggcggcaagcacgccagactgtaccagaccctgaacgagggcaagcagctggtggccagcgtgagctgccccgagctggagggccagatcgccaagctggaggagcagtggctgagcctgaacaagaagatcgaccacgagctgcacagactgcaggccctgctgaagcacctgctgagaagcgccttcctgggcgtgtacaacagagacagcgaccagctgaccaagtggctggagagcagccagcacaccctgaactactggaaggagcagagcctgaacgtgagccaggacctggacaccatcagaagcaacatcaacaacttcttcgagttcagcaaggaggtggacgagaagagcagcctgaagaccgccgtgatcagcatcggcaaccagctgctgcacctgaaggagaccgacaccgccaccctgagagccagcctggcccagttcgagcagaagtggaccatgctgatcacccagctgcccgacatccaggagaagctgcaccagctgcagatggagaagctgcccagcagaaaggccatcaccgagatgatcagctggatgaacaacgtggagcaccagaccagcgacgaggacagcgtgcacagccccagcagcgccagccaggtgaagcacctgctgcagaagcacaaggagttcagaatggagatggactacaagcagtggatcgtggacttcgtgaaccagagcctgctgcagctgagcacctgcgacgtggagagcaagagatacgagagaaccgagttcgccgagcacctgggcgagatgaacagacagtggcacagagtgcacggcatgctgaacagaaagatccagcacctggagcagctgctggagagcatcaccgagagcgagaacaagatccagatcctgaacaactggctggaggcccaggaggagagactgaagaccctgcagaagcccgagagcgtgatcagcgtgcagaagctgctgctggactgccaggacatcgagaaccagctggccatcaagagcaaggccctggacgagctgaagcagagctacctgaccctggagagcggcgccgtgcccctgctggaggacaccgccagcagaatcgacgagctgttccagaagagaagcagcgtgctgacccaggtgaaccagctgaagaccagcatgcagagcgtgctgcaggagtggaagatctacgaccagctgtacgacgaggtgaacatgatgaccatcagattctggtactgcatggagcacagcaagcccgtggtgctgagcctggagaccctgagatgccaggtggagaacctgcagagcctgcaggacgaggccgagagcagcgagggcagctgggagaagctgcaggaggtgatcggcaagctgaagggcctgtgccccagcgtggccgagatcatcgaggagaagtgccagaacacccacaagagatggacccaggtgaaccaggccatcgccgaccagctgcagaaggcccagagcctgctgcagctgtggaaggcctacagcaacgcccacggcgaggccgccgccagactgaagcagcaggaggccaagttccagcagctggccaacatcagcatgagcggcaacaacctggccgagatcctgccccccgccctgcaggacatcaaggagctgcagcacgacgtgcagaagaccaaggaggccttcctgcagaacagcagcgtgctggacagactgccccagcccgccgagagcagcacccacatgctgctgcccggccccctgcacagcctgcagagagccgcctacctggagaagatgctgctggtgaaggccaacgagttcgagaaccacgtgctggccctgaccgcccagagccccgacatcgagcacctgaacgaggtgagcctgaagctgcccctgagcgacgtggccgtgaagaccctgcagaacatgaacagacagtggatcagagccaccgccaccgccctggagagatgcagcgagctgcagggcatcggcctgaacgagaagttcctgtactgctgcgagaagtggatccagctgctggagaagatcgaggaggccctgaaggtggacgtggccaacagcctgcccgagctgctggagcagcagaagacctacaagatgctggaggccgaggtgagcatcaaccagaccatcgccgacagctacgtgacccagagcctgcagctgctggacaccaccgagatcgagaacagacccgagttcatcaccgagttcagcaagctgaccgacagatggcagaacgccgtgcagggcgtgagacagagaaagggcgacgtggacggcctgaacgcccacgtggccagatgcggcggcgccagcctgaagaagcaggacctgagatacagcctgcacaccgcctgcggcgccgccctgctgtgcagaagcagccacggcgccaacaaggagatccacttccagagaagaagaaccacctgcgccctgaccctggaggccggcgagaagctgctgctgaccaccgacctgaagaccaaggagagcgtgggcagaagaatcagccagctgcaggacagctggaaggacatggagccccagctggccgagatgatcaagcagttccagagcaccgtggagacctgggaccagtgcgagaagaagatcaaggagctgaagagcagactgcaggtgctgaaggcccagagcgaggaccccctgcccgagctgcacgaggacctgcacaacgagaaggagctgatcaaggtggccatcagaaagcaggagatcgaggacagactgaacacctgggtggtgttcaacgagaagaacaaggagctgtgcgcctggctggtgcagatggagaacaaggtgctgcagaccgccgacatcagcatcgaggagatgatcgagaagctgcagaagagaaccgtgggcagagaggaggtgcccgagagatgggagtgcgagaccatcgtgagcggccacggcaccgaggagagctgcttcctgagcatcagaaagttccaccagggcagaggcctgcacatcctgacctgccagctgatcccccaggactgcatggaggagatcaacctgttcagcgagaacaagctgcagctgaagcagatgggcgaccagctgatcaaggccagcaacaagagcagagccgccgagatcgacgacaagctgaacaagatcaacgacagatggcagcacctgttcgacgtgatcggcagcagcatggccgaccagaccaacagcagatggatgttcttccagtggcccagaggcatccagagaaccgtgacctggccctgggaccacctgtgcagctgcgccagcaccggccacaccggccccttccacagcagcgtgctgagatgcttcgagcagcacatcgagttcggcatctacagaagaacctacaaggtgaacaaggagctgggcggcgacaagaacggccagagatgccccatcatctacccccacggcctggtgcagtgcatcagactgggcgagcccctgatcctgaagagagtgaagaagctgaaggagaccttcgccttcatccagcagctggacaagaacatgagcaacctgagaacctggctggccagaatcgagagcgagctgagcaagcccgtggtgtacgacgtgtgcgacgaccaggagatccagaagagactggccgagcagcaggacctgcagagagacatcgagcagcacagcgccggcgtggagagcgtgttcaacatctgcgacgtgctgctgcacgacagcgacgcctgcgccaacgagaccgagtgcgacagcatccagcagaccaccagaagcctggacagaagatggagaaacatctgcgccatgagcatggagagaagaatgaagatcgaggagacctggagactgtggcagaagttcctggacgactacagcagattcgaggactggctgaagagcgccgagagaaccgccgcctgccccaacagcagcgaggtgctgtacaccagcgccaaggaggagctgaagagattcgagagacagatccacgagagactgacccagctggagctgatcaacaagcagtacagaagactggccagagagaacagaaccgacaccgccagcagactgaagcagatggtgcacgagggcaaccagagatgggacaacctgcagagaagagtgaccgccgtgctgagaagactgagacacttcaccaaccagagagaggagttcgagggcaccagagagagcatcctggtgtggctgaccgagatggacctgcagctgaccaacgtggagcacttcagcgagagcgacgccgacgacaagatgagacagctgaacggcttccagcaggagatcaccctgaacaccaacaagatcgaccagctgatcgtgttcggcgagcagctgatccagaagagcgagcccctggacgccgtgctgatcgaggacgagctggaggagctgcacagatactgccaggagggcctggaggacgagaaggaggccagcgagaacgagaccgacatggaggaccccagagagatccagaccgacagctggagaaagagaggcgagagcgaggagcccagcagcccccagagcctgtgccacctggtggcccccggccacgagagaagcggctgcgagacccccgtgagcgtggacagcatccccctggagtgggaccacaccggcgacgtgggcggcagcagcagccacgaggaggacgaggagggcccctactacagcgccctgagcggcaagagcatcagcgacggccacagctggcacgtgcccgacagccccagctgccccgagcaccactacaagcagatggagggcgacagaaacgtgccccccgtgccccccgccagcagcaccccctacaagcccccctacgtgagcctgaacttcaccggcagcaccgcctacgtgtgcgccttcgacagatgggagatgatccaggcccaggagctgcacaacaagctgaagatcaagcagaacctgcagcagctgaacagcgacatcagcgccatcaccacctggctgaagaagaccgaggccgagctggagatgctgaagatggccaagccccccagcgacatccaggagatcgagctgagagtgaagagactgcaggagatcctgaaggccttcgacacctacaaggccctggtggtgagcgtgaacgtgagcagcaaggagttcctgcagaccgagagccccgagagcaccgagctgcagagcagactgagacagctgagcctgctgtgggaggccgcccagggcgccgtggacagctggagaggcggcctgagacagagcctgatgcagtgccaggacttccaccagctgagccagaacctgctgctgtggctggccagcgccaagaacagaagacagaaggcccacgtgaccgaccccaaggccgaccccagagccctgctggagtgcagaagagagctgatgcagctggagaaggagctggtggagagacagccccaggtggacatgctgcaggagatcagcaacagcctgctgatcaagggccacggcgaggactgcatcgaggccgaggagaaggtgcacgtgatcgagaagaagctgaagcagctgagagagcaggtgagccaggacctgatggccctgcagggcacccagaaccccgccagccccctgcccagcttcgacgaggtggacagcggcgaccagccccccgccaccagcgtgcccgcccccagagccaagttcctgtaccccgccgtgcagagcagcgagaactacagaagaagaggcggcgacagagagcagggccccagacagcacaccgccaccgccctgctgcccctgaagggcggccccggcagccccacccccgccgccgccccccccgccgccgccgcccccggcctgcccgccgccctgctgagaagaagactgcagctgcacagcggccagcagctgtgccccgtgctgctgccccacgccgaggtgcaccagtgggccaccccccacatcgagggcatcgccggccacagcgccaccccccccgcctag

SEQ ID NO: 100481 - DNA, 20658 bp, Artificial Sequence
  Description of Artificial Sequence: Synthetic coding sequence
atggccagcagccccgagctgcccaccgaggacgagcagggcagctggggcatcgacgacctgcacatcagcctgcaggccgagcaggaggacacccagaagaaggccttcacctgctggatcaacagccagctggccagacacaccagccccagcgtgatcagcgacctgttcaccgacatcaagaagggccacgtgctgctggacctgctggaggtgctgagcggccagcagctgcccagagacaagggcagcaacaccttccagtgcagaatcaacatcgagcacgccctgaccttcctgagaaacagaagcatcaagctgatcaacatccacgtgaccgacatcatcgacggcaaccccagcatcatcctgggcctgatctggaccatcatcctgcacttccacatcgagaagctggcccagaccctgagctgcaactacaaccagcccagcctggacgacgtgagcgtggtggacagcagccccgccagcagcccccccgccaagaagtgcagcaaggtgcaggccagatggcagatgagcgccagaaaggccctgctgctgtgggcccaggagcagtgcgccacctacgagagcgtgaacgtgaccgacttcaagagcagctggagaaacggcatggccttcctggccatcatccacgccctgagacccgacctgatcgacatgaagagcgtgaagcacagaagcaacaaggacaacctgagagaggccttcagaatcgccgagcaggagctgaagatccccagactgctggagcccgaggacgtggacgtggtggaccccgacgagaagagcatcatgacctacgtggcccagttcctgcagtacagcaaggacgcccccggcaccggcgaggaggcccagggcaaggtgaaggacgccatgggctggctgaccctgcagaaggagaagctgcagaagctgctgaaggacagcgagaacgacacctacttcaagaagtacaacagcctgctgagcttcatggagagcttcaacgaggagaagaagagcttcctggacgtgctgagcatcaagagagacctggacgagctggacaaggaccacctgcagctgagagaggcctgggacggcctggaccaccagatcaacgcctggaagatcaagctgaactacgccctgcccccccccctgcaccagaccgaggcctggctgcaggaggtggaggagctgatggacgaggacctgagcgccagccaggaccacagccaggccgtgaccctgatccaggagaagatgaccctgttcaagagcctgatggacagattcgagcaccacagcaacatcctgctgaccttcgagaacaaggacgagaaccacctgcccctggtgccccccaacaagctggaggagatgaagagaagaatcaacaacatcctggagaagaagttcatcctgctgctggagttccactactacaagtgcctggtgctgggcctggtggacgaggtgaagagcaagctggacatctggaacatcaagtacggcagcagagagagcgtggagctgctgctggaggactggcacaagttcatcgaggagaaggagttcctggccagactggacaccagcttccagaagtgcggcgagatctacaagaacctggccggcgagtgccagaacatcaacaagcagtacatgatggtgaagagcgacgtgtgcatgtacagaaagaacatctacaacgtgaagagcaccctgcagaaggtgctggcctgctgggccacctacgtggagaacctgagactgctgagagcctgcttcgaggagaccaagaaggaggagatcaaggaggtgcccttcgagaccctggcccagtggaacctggagcacgccaccctgaacgaggccggcaacttcctggtggaggtgagcaacgacgtggtgggcagcagcatcagcaaggagctgagaagactgaacaagagatggagaaagctggtgagcaagacccagctggagatgaacctgcccctgatgatcaagaagcaggaccagcccaccttcgacaacagcggcaacatcctgagcaaggaggagaaggccaccgtggagttcagcaccgacatgagcgtggagctgcccgagaactacaaccagaacatcaaggccggcgagaagcacgagaaggagaacgaggagttcaccggccagctgaaggtggccaaggacgtggagaagctgatcggccaggtggagatctgggaggccgaggccaagagcgtgctggaccaggacgacgtggacaccagcatggaggagagcctgaagcacctgatcgccaagggcagcatgttcgacgagctgatggccagaagcgaggacatgctgcagatggacatccagaacatcagcagccaggagagcttccagcacgtgctgaccaccggcctgcaggccaagatccaggaggccaaggagaaggtgcagatcaacgtggtgaagctgatcgccgccctgaagaacctgaccgacgtgagccccgacctggacatcagactgaagatggaggagagccagaaggagctggagagctacatgatgagagcccagcagctgctgggccagagagagagccccggcgagctgatcagcaagcacaaggaggccctgatcatcagcaacaccaagagcctggccaagtacctgaaggccgtggaggagctgaagaacaacgtgaccgaggacatcaagatgagcctggaggagaagagcagagacgtgtgcgccaagtgggagagcctgcaccacgagctgagcctgtacgtgcagcagctgaagatcgacatcgagaagggcaagctgagcgacaacatcctgaagctggagaagcagatcaacaaggagaagaagctgatcagaagaggcagaaccaagggcctgatcaaggagcacgaggcctgcttcagcgaggagggctgcctgtaccagctgaaccaccacatggaggtgctgagagagctgtgcgaggagctgcccagccagaagagccagcaggaggtgaagagactgctgaaggactacgagcagaagatcgagagactgctgaagtgcgccagcgagatccacatgaccctgcagcccaccgccggcggcaccagcaagaacgagggcaccatcaccaccagcgagaacagaggcggcgacccccacagcgaggcccccttcgccaagagcgacaaccagcccagcaccgagaaggccatggagcccaccatgaagttcagcctggccagcgtgctgagacccctgcaggaggagagcatcatggagaaggactacagcgccagcatcaacagcctgctggagagatacgacacctacagagacatcctggagcaccacctgcagaacaacaagttcagaatcaccagcgacttcagcagcgaggaggacagaagcagcagctgcctgcaggccaagctgaccgacctgcaggtgatcaagaacgagaccgacgccagatggaaggagttcgagatcatcagcctgaagctggagaaccacgtgaacgacatcaagaagcccttcgtgatcaaggagagagacaccctgaaggagagagagagagagctgcagatgaccctgaacaccagaatggagagcctggagaccgccctgagactggtgctgcccgtggagaaggccagcctgctgctgtgcggcagcgacctgcccctgcacaagatggccatccagggcttccacctgatcgacgccgacagaatctaccagcacctgagaaacatccaggacagcatcgccaagcagatcgagatctgcaacagactggaggagcccggcaacttcgtgctgaaggagctgcaccccttcgacctgcacgccatgcagaacatcatcctgaagtacaagacccagttcgagggcatgaaccacagagtgcagagaagcgaggacaccctgaaggccctggaggacttcctggccagcctgagaaccgccaagctgagcgccgagcccgtgaccgacctgagcgccagcgacacccaggtggcccaggagaacaccctgaccgtgaagaacaaggagggcgagatccacctgatgaaggacaaggccaagcacctggacaagtgcctgaagatgctggacatgagcttcaaggacgccgagagaggcgacgacaccagctgcgagaacctgctggacgccttcagcatcaagctgagcgagacccacggctacggcgtgcaggaggagttcaccgaggagaacaagctgctggaggcctgcatcttcaagaacaacgagctgctgaagaacatccaggacgtgcagagccagatcagcaagatcggcctgaaggaccccaccgtgcccgccgtgaagcacagaaagaagagcctgatcagactggacaaggtgctggacgagtacgaggaggagaagagacacctgcaggagatggccaacagcctgccccacttcaaggacggcagagagaagaccgtgaaccagcagtgccagaacaccgtggtgctgtgggagaacaccaaggccctggtgaccgagtgcctggagcagtgcggcagagtgctggagctgctgaagcagtaccagaacttcaagagcatcctgaccaccctgatccagaaggaggagagcgtgatcagcctgcaggccagctacatgggcaaggagaacctgaagaagagaatcgccgagatcgagatcgtgaaggaggagttcaacgagcacctggaggtggtggacaagatcaaccaggtgtgcaagaacctgcagttctacctgaacaagatgaagaccttcgaggagccccccttcgagaaggaggccaacatcatcgtggacagatggctggacatcaacgagaagaccgaggactactacgagaacctgggcagagccctggccctgtgggacaagctgttcaacctgaagaacgtgatcgacgagtggaccgagaaggccctgcagaagatggagctgcaccagctgaccgaggaggacagagagagactgaaggaggagctgcaggtgcacgagcagaagaccagcgagttcagcagaagagtggccgagatccagttcctgctgcagagcagcgagatccccctggagctgcaggtgatggagagcagcatcctgaacaagatggagcacgtgcagaagtgcctgaccggcgagagcaactgccacgccctgagcggcagcaccgccgagctgagagaggacctggaccaggccaagacccagatcggcatgaccgagagcctgctgaaggccctgagccccagcgacagcctggagatcttcaccaagctggaggagatccagcagcagatcctgcagcagaagcacagcatgatcctgctggagaaccagatcggctgcctgacccccgagctgagcgagctgaagaagcagtacgagagcgtgagcgacctgttcaacaccaagaagagcgtgctgcaggaccacttcagcaagctgctgaacgaccagtgcaagaacttcaacgactggttcagcaacatcaaggtgaacctgaaggagtgcttcgagagcagcgagaccaagaagagcgtggagcagaagctgcagaagctgagcgacttcctgaccctggagggcagaaacagcaagatcaagcaggtggacagcgtgctgaagcacgtgaagaagcacctgcccaaggcccacgtgaaggagctgatcagctggctggtgggccaggagttcgagctggagaagatggagagcatctgccaggccagagccaaggagctggaggacagcctgcagcagctgctgagactgcaggacgaccacagaaacctgagaaagtggctgaccaaccaggaggagaagtggaagggcatggaggagcccggcgagaagaccgagctgttctgccaggccctggccagaaagagagagcagttcgagagcgtggcccagctgaacaacagcctgaaggagtacggcttcaccgaggaggaggagatcatcatggaggccacctgcctgatggacagataccagaccctgctgagacagctgagcgagatcgaggaggaggacaagctgctgcccaccgaggaccagagcttcaacgacctggcccacgacgtgatccactggatcaaggagatcaaggagagcctgatggtgctgaacagcagcgagggcaagatgcccctggaggagagaatccagaagatcaaggagatcatcctgctgaagcccgagggcgacgccagaatcgagaccatcatgaagcaggccgagagcagcgaggcccccctggtgcagaagaccctgaccgacatcagcaaccagtgggacaacaccctgcacctggccagcacctacctgagccaccaggagaagctgctgctggagggcgagaagtacctgcagagcaaggaggacctgagactgatgctgatcgagctgaagaagaagcaggaggccggcttcgccctgcagcacggcctgcaggagaagaaggcccagctgaagatctacaagaagttcctgaagaaggcccaggacctgaccagcctgctgaaggagctgaagagccagggcaactacctgctggagtgcaccaagaaccccagcttcagcgaggagccctggctggagatcaagcacctgcacgagagcctgctgcagcagctgcaggacagcgtgcagaacctggacggccacgtgagagagcacgacagctaccaggtgtgcgtgaccgacctgaacaccaccctggacaacttcagcaaggagttcgtgagcttcagcgacaagcccgtggaccagatcgccgtggaggagaagctgcagaagctgcaggagctggagaacagactgagcctgcaggacggcaccctgaagaagatcctggccctggccaagagcgtgaagcagaacaccagcagcgtgggccagaagatcatcaaggacgacatcaagagcctgcagtgcaagcagaaggacctggagaacagactggccagcgccaagcaggagatggagtgctgcctgaacagcatcctgaagagcaagagaagcaccgagaagaagggcaagttcaccctgcccggcagagagaagcaggccaccagcgacgtgcaggagagcacccaggagagcgccgccgtggagaagctggaggaggactgggagatcaacaaggacagcgccgtggagatggccatgagcaagcagctgagcctgaacgcccaggagagcatgaagaacaccgaggacgagagaaaggtgaacgagctgcagaaccagcccctggagctggacaccatgctgagaaacgagcagctggaggagatcgagaagctgtacacccagctggaggccaagaaggccgccatcaagcccctggagcagaccgagtgcctgaacaagaccgagaccggcgccctggtgctgcacaacatcggctacagcgcccagcacctggacaacctgctgcaggccctgatcaccctgaagaagaacaaggagagccagtactgcgtgctgagagacttccaggagtacctggccgccgtggagagcagcatgaaggccctgctgaccgacaaggagagcctgaaggtgggccccctggacagcgtgacctacctggacaagatcaagaagttcatcgccagcatcgagaaggagaaggacagcctgggcaacctgaagatcaagtgggagaacctgagcaaccacgtgaccgacatggacaagaagctgctggagagccagatcaagcagctggagcacggctgggagcaggtggagcagcagatccagaagaagtacagccagcaggtggtggagtacgacgagttcaccaccctgatgaacaaggtgcaggacaccgagatcagcctgcagcagcagcagcagcacctgcagctgagactgaagagccccgaggagagagccggcaaccagagcatgatcgccctgaccaccgacctgcaggccaccaagcacggcttcagcgtgctgaagggccaggccgagctgcagatgaagagaatctggggcgagaaggagaagaagaacctggaggacggcatcaacaacctgaagaagcagtgggagaccctggagcccctgcacctggaggccgagaaccagatcaagaagtgcgacatcagaaacaagatgaaggagaccatcctgtgggccaagaacctgctgggcgagctgaaccccagcatccccctgctgcccgacgacatcctgagccagatcagaaagtgcaaggtgacccacgacggcatcctggccagacagcagagcgtggagagcctggccgaggaggtgaaggacaaggtgcccagcctgaccacctacgagggcagcgacctgaacaacaccctggaggacctgagaaaccagtaccagatgctggtgctgaagagcacccagagaagccagcagctggagttcaagctggaggagagaagcaacttcttcgccatcatcagaaagttccagctgatggtgcaggagagcgagaccctgatcatccccagagtggagaccgccgccaccgaggccgagctgaagcaccaccacgtgaccctggaggccagccagaaggagctgcaggagatcgacagcggcatcagcacccacctgcaggagctgaccaacatctacgaggagctgaacgtgttcgagagactgttcctggaggaccagctgaagaacctgaagatcagaaccaacagaatccagagattcatccagaacacctgcaacgaggtggagcacaagatcaagttctgcagacagttccacgagaagaccagcgccctgcaggaggaggccgacagcatccagagaaacgagctgctgctgaaccaggaggtgaacaagggcgtgaaggaggagatctacaacctgaaggacagactgaccgccatcaagtgctgcatcctgcaggtgctgaagctgaagaaggtgttcgactacatcggcctgaactgggacttcagccagctggaccagctgcagacccaggtgttcgagaaggagaaggagctggaggagaagatcaagcagctggacaccttcgaggaggagcacggcaagtaccaggccctgctgagcaagatgagagccatcgacctgcagatcaagaagatgaccgaggtggtgctgaaggcccccgacagcagccccgagagcagaagactgaacgcccagatcctgagccagagaatcgagaaggccaagtgcctgtgcgacgagatcatcaagaagctgaacgagaacaagaccttcgacgacagcttcaaggagaaggagatcctgcagatcaagctgaacgccgaggagaacgacaagctgtacaaggtgctgcagaacatggtgctggagctgagccccaaggagctggacgagaagaactgccaggacaagctggagaccagcctgcacgtgctgaaccagatcaagagccagctgcagcagcccctgctgatcaacctggagatcaagcacatccagaacgagaaggacaactgcgaggccttccaggagcaggtgtgggccgagatgtgcagcatcaaggccgtgaccgccatcgagaagcagagagaggagaacagcagcgaggccagcgacgtggagaccaagctgagagagttcgaggacctgcagatgcagctgaacaccagcatcgacctgagaaccaacgtgctgaacgacgcctacgagaacctgaccagatacaaggaggccgtgaccagagccgtggagagcatcaccagcctggaggccatcatcatcccctacagagtggacgtgggcaaccccgaggagagcctggagatgcccctgagaaagcaggaggagctggagagcaccgtggcccacatccaggacctgaccgagaagctgggcatgatcagcagccccgaggccaagctgcagctgcagtacaccctgcaggagctggtgagcaagaacagcgccatgaaggaggccttcaaggcccaggagaccgaggccgagagatacctggagaactacaagtgctacagaaagatggaggaggacatctacaccaacctgagcaagatggagaccgtgctgggccagagcatgagcagcctgcccctgagctacagagaggccctggagagactggagcagagcaaggccctggtgagcaacctgatcagcaccaaggaggagctgatgaagctgagacagatcctgagactgctgagactgagatgcaccgagaacgacggcatctgcctgctgaagatcgtgagcgccctgtgggagaagtggctgagcctgctggaggccgccaaggagtgggagatgtggtgcgaggagctgaagcaggagtggaagttcgtgagcgaggagatcgagagagaggccatcatcctggacaacctgcaggaggagctgcccgagatcagcaagaccaaggaggccgccaccaccgaggagctgagcgagctgctggactgcctgtgccagtacggcgagaacgtggagaagcagcagctgctgctgaccctgctgctgcagagaatcagaagcatccagaacgtgcccgagagcagcggcgccgtggagaccgtgcccgccttccaggagatcaccagcatgaaggagagatgcaacaagctgctgcagaaggtgcagaagaacaaggagctggtgcagaccgagatccaggagagacacagcttcaccaaggagatcatcgccctgaagaacttcttccagcagaccaccaccagcttccagaacatggccttccaggaccaccccgagaagagcgagcagttcgaggagctgcagagcatcctgaagaagggcaagctgaccttcgagaacatcatggagaagctgagaatcaagtacagcgagatgtacaccatcgtgcccgccgagatcgagagccaggtggaggagtgcagaaaggccctggaggacatcgacgagaagatcagcaacgaggtgctgaagagcagccccagctacgccatgagaagaaagatcgaggagatcaacaacggcctgcacaacgtggagaagatgctgcagcagaagagcaagaacatcgagaaggcccaggagatccagaagaagatgtgggacgagctggacctgtggcacagcaagctgaacgagctggacagcgaggtgcaggacatcgtggagcaggaccccggccaggcccaggagtggatggacaacctgatgatccccttccagcagtaccagcaggtgagccagagagccgagtgcagaaccagccagctgaacaaggccaccgtgaagatggaggagtacagcgacctgctgaagagcaccgaggcctggatcgagaacaccagccacctgctggccaaccccgccgactacgacagcctgagaaccctgagccaccacgccagcaccgtgcagatggccctggaggacagcgagcagaagcacaacctgctgcacagcatcttcatggacctggaggacctgagcatcatcttcgagaccgacgagctgacccagagcatccaggagctgagcaaccaggtgaccgccctgcagcagaagatcatggagagcctgccccagatccagagaatggccgacgacgtggtggccatcgagagcgaggtgaagagcatggagaagagagtgagcaagatcaagaccatcctgctgagcaaggagatcttcgacttcagccccgaggagcacctgaagcacggcgaggtgatcctggagaacatcagacccatgaagaagaccatcgccgagatcgtgagctaccaggtggagctgagactgccccagaccggcatgaagcccctgcccgtgttccagagaaccaaccagctgctgcaggacatcaagctgctggagaacgtgacccaggagcagaacgagctgctgaaggtggtgatcaagcagaccaacgagtgggacgaggagatcgagaacctgaagcagatcctgaacaactacagcgcccagttcagcctggagcacatgagccccgaccaggccgacaagctgccccagctgcagggcgagatcgagagaatggagaagcagatcctgagcctgaaccagagaaaggaggacctgctggtggacctgaaggccaccgtgctgaacctgcaccagcacctgaagcaggagcaggagggcgtggagagagacagactgcccgccgtgaccagcgaggagggcggcgtggccgagagagacgccagcgagagaaagctgaacagaagaggcagcatgagctacctggccgccgtggaggaggaggtggaggagagcagcgtgaagagcgacaacggcgacgagaaggccgagcccagcccccagagctggagcagcctgtggaagcacgacaaggacatggaggaggacagagccagcagcagcagcggcaccatcgtgcaggaggcctacggcaagatcagcaccagcgacaacagcatggcccagatcctgacccccgacagcctgaacaccgagcagggccccgagtgcagcctgagacccaaccagaccgaggagggcaccaccccccccatcgaggccgacaccctggacagcagcgacgcccagggcggcctggagcccagagtggagaagaccagacccgagcccaccgaggtgctgcacgcctgcaagacccaggtggccgagctggagctgtggctgcagcaggccaacgtggccgtggagcccgagaccctgaacgccgacatgcagcaggtgctggagcagcagctggtgggctgccaggccatgctgaccgagatcgagcacaaggtggccttcctgctggagacctgcaaggaccagggcctgggcgacaacggcgccacccagcacgaggccgaggccctgagcctgaagctgaagaccgtgaagtgcaacctggagaaggtgcagatgatgctgcaggagaagcacagcgaggaccagcaccccaccatcctgaagaagagcagcgagcccgagcaccaggaggccctgcagcccgtgaacctgagcgagctggagagcatcgtgaccgagagaccccagttcagcagacagaaggacttccagcagcagcaggtgctggagctgaagcccatggagcagaaggacttcatcaagttcatcgagttcaacgccaagaagatgtggccccagtactgccagcacgacaacgacaccacccaggagagcagcgccagcaaccaggccagcagccccgagaacgacgtgcccgacagcatcctgagcccccagggccagaacggcgacaagtggcagtacctgcaccacgagctgagcagcaagatcaagctgcccctgccccagctggtggagccccaggtgagcaccaacatgggcatcctgcccagcgtgaccatgtacaacttcagataccccaccaccgaggagctgaagacctacaccacccagctggaggacctgagacaggaggccagcaacctgcagacccaggagaacatgaccgaggaggcctacatcaacctggacaagaagctgttcgagctgttcctgaccctgagccagtgcctgagcagcgtggaggagatgctggagatgcccagactgtacagagaggacggcagcggccagcaggtgcactacgagaccctggccctggagctgaagaagctgtacctggccctgagcgacaagaagggcgacctgctgaaggccatgacctggcccggcgagaacaccaacctgctgctggagtgcttcgacaacctgcaggtgtgcctggagcacacccaggccgccgccgtgtgcagaagcaagagcctgaaggccggcctggactacaacagaagctaccagaacgagatcaagagactgtaccaccagctgatcaagagcaagaccagcctgcagcagagcctgaacgagatcagcggccagagcgtggccgagcagctgcagaaggccgacgcctacaccgtggagctggagaacgccgagagcagagtggccaagctgagagacgagggcgagagactgcacctgccctacgccctgctgcaggaggtgtacaagctggaggacgtgctggacagcatgtggggcatgctgagagccagatacaccgagctgagcagccccttcgtgaccgagagccagcaggacgccctgctgcagggcatggtggagctggtgaagatcggcaaggagaagctggcccacggccacctgaagcagaccaagagcaaggtggccctgcaggcccagatcgagaaccacaaggtgttcttccagaagctggtggccgacatgctgctgatccaggcctacagcgccaagatcctgcccagcctgctgcagaacagagagaccttctgggccgagcaggtgaccgaggtgaagatcctggaggagaagagcagacagtgcggcatgaagctgcagagcctgctgcagaagtgggaggagttcgacgagaactacgccagcctggagaaggacctggagatcctgatcagcaccctgcccagcgtgagcctggtggaggagaccgaggagagactggtggagagaatcagcttctaccagcagatcaagagaaacatcggcggcaagcacgccagactgtaccagaccctgaacgagggcaagcagctggtggccagcgtgagctgccccgagctggagggccagatcgccaagctggaggagcagtggctgagcctgaacaagaagatcgaccacgagctgcacagactgcaggccctgctgaagcacctgctgagctacaacagagacagcgaccagctgaccaagtggctggagagcagccagcacaccctgaactactggaaggagcagagcctgaacgtgagccaggacctggacaccatcagaagcaacatcaacaacttcttcgagttcagcaaggaggtggacgagaagagcagcctgaagaccgccgtgatcagcatcggcaaccagctgctgcacctgaaggagaccgacaccgccaccctgagagccagcctggcccagttcgagcagaagtggaccatgctgatcacccagctgcccgacatccaggagaagctgcaccagctgcagatggagaagctgcccagcagaaaggccatcaccgagatgatcagctggatgaacaacgtggagcaccagaccagcgacgaggacagcgtgcacagccccagcagcgccagccaggtgaagcacctgctgcagaagcacaaggagttcagaatggagatggactacaagcagtggatcgtggacttcgtgaaccagagcctgctgcagctgagcacctgcgacgtggagagcaagagatacgagagaaccgagttcgccgagcacctgggcgagatgaacagacagtggcacagagtgcacggcatgctgaacagaaagatccagcacctggagcagctgctggagagcatcaccgagagcgagaacaagatccagatcctgaacaactggctggaggcccaggaggagagactgaagaccctgcagaagcccgagagcgtgatcagcgtgcagaagctgctgctggactgccaggacatcgagaaccagctggccatcaagagcaaggccctggacgagctgaagcagagctacctgaccctggagagcggcgccgtgcccctgctggaggacaccgccagcagaatcgacgagctgttccagaagagaagcagcgtgctgacccaggtgaaccagctgaagaccagcatgcagagcgtgctgcaggagtggaagatctacgaccagctgtacgacgaggtgaacatgatgaccatcagattctggtactgcatggagcacagcaagcccgtggtgctgagcctggagaccctgagatgccaggtggagaacctgcagagcctgcaggacgaggccgagagcagcgagggcagctgggagaagctgcaggaggtgatcggcaagctgaagggcctgtgccccagcgtggccgagatcatcgaggagaagtgccagaacacccacaagagatggacccaggtgaaccaggccatcgccgaccagctgcagaaggcccagagcctgctgcagctgtggaaggcctacagcaacgcccacggcgaggccgccgccagactgaagcagcaggaggccaagttccagcagctggccaacatcagcatgagcggcaacaacctggccgagatcctgccccccgccctgcaggacatcaaggagctgcagcacgacgtgcagaagaccaaggaggccttcctgcagaacagcagcgtgctggacagactgccccagcccgccgagagcagcacccacatgctgctgcccggccccctgcacagcctgcagagagccgcctacctggagaagatgctgctggtgaaggccaacgagttcgagttcgtgctgagccagttcaaggacttcggcgtgagactggagagcctgaagggcctgatcatgcacgaggaggagaacctggacagactgcaccagcaggagaaggagaaccccgacagcttcctgaaccacgtgctggccctgaccgcccagagccccgacatcgagcacctgaacgaggtgagcctgaagctgcccctgagcgacgtggccgtgaagaccctgcagaacatgaacagacagtggatcagagccaccgccaccgccctggagagatgcagcgagctgcagggcatcggcctgaacgagaagttcctgtactgctgcgagaagtggatccagctgctggagaagatcgaggaggccctgaaggtggacgtggccaacagcctgcccgagctgctggagcagcagaagacctacaagatgctggaggccgaggtgagcatcaaccagaccatcgccgacagctacgtgacccagagcctgcagctgctggacaccaccgagatcgagaacagacccgagttcatcaccgagttcagcaagctgaccgacagatggcagaacgccgtgcagggcgtgagacagagaaagggcgacgtggacggcctggtgagacagtggcaggacttcaccaccagcgtggagaacctgttcagattcctgaccgacaccagccacctgctgagcgccgtgaagggccaggagagattcagcctgtaccagaccagaagcctgatccacgagctgaagaacaaggagatccacttccagagaagaagaaccacctgcgccctgaccctggaggccggcgagaagctgctgctgaccaccgacctgaagaccaaggagagcgtgggcagaagaatcagccagctgcaggacagctggaaggacatggagccccagctggccgagatgatcaagcagttccagagcaccgtggagacctgggaccagtgcgagaagaagatcaaggagctgaagagcagactgcaggtgctgaaggcccagagcgaggaccccctgcccgagctgcacgaggacctgcacaacgagaaggagctgatcaaggagctggagcagagcctggccagctggacccagaacctgaaggagctgcagaccatgaaggccgacctgaccagacacgtgctggtggaggacgtgatggtgctgaaggagcagatcgagcacctgcacagacagtgggaggacctgtgcctgagagtggccatcagaaagcaggagatcgaggacagactgaacacctgggtggtgttcaacgagaagaacaaggagctgtgcgcctggctggtgcagatggagaacaaggtgctgcagaccgccgacatcagcatcgaggagatgatcgagaagctgcagaaggactgcatggaggagatcaacctgttcagcgagaacaagctgcagctgaagcagatgggcgaccagctgatcaaggccagcaacaagagcagagccgccgagatcgacgacaagctgaacaagatcaacgacagatggcagcacctgttcgacgtgatcggcagcagagtgaagaagctgaaggagaccttcgccttcatccagcagctggacaagaacatgagcaacctgagaacctggctggccagaatcgagagcgagctgagcaagcccgtggtgtacgacgtgtgcgacgaccaggagatccagaagagactggccgagcagcaggacctgcagagagacatcgagcagcacagcgccggcgtggagagcgtgttcaacatctgcgacgtgctgctgcacgacagcgacgcctgcgccaacgagaccgagtgcgacagcatccagcagaccaccagaagcctggacagaagatggagaaacatctgcgccatgagcatggagagaagaatgaagatcgaggagacctggagactgtggcagaagttcctggacgactacagcagattcgaggactggctgaagagcgccgagagaaccgccgcctgccccaacagcagcgaggtgctgtacaccagcgccaaggaggagctgaagagattcgaggccttccagagacagatccacgagagactgacccagctggagctgatcaacaagcagtacagaagactggccagagagaacagaaccgacaccgccagcagactgaagcagatggtgcacgagggcaaccagagatgggacaacctgcagagaagagtgaccgccgtgctgagaagactgagacacttcaccaaccagagagaggagttcgagggcaccagagagagcatcctggtgtggctgaccgagatggacctgcagctgaccaacgtggagcacttcagcgagagcgacgccgacgacaagatgagacagctgaacggcttccagcaggagatcaccctgaacaccaacaagatcgaccagctgatcgtgttcggcgagcagctgatccagaagagcgagcccctggacgccgtgctgatcgaggacgagctggaggagctgcacagatactgccaggaggtgttcggcagagtgagcagattccacagaagactgaccagctgcacccccggcctggaggacgagaaggaggccagcgagaacgagaccgacatggaggaccccagagagatccagaccgacagctggagaaagagaggcgagagcgaggagcccagcagcccccagagcctgtgccacctggtggcccccggccacgagagaagcggctgcgagacccccgtgagcgtggacagcatccccctggagtgggaccacaccggcgacgtgggcggcagcagcagccacgaggaggacgaggagggcccctactacagcgccctgagcggcaagagcatcagcgacggccacagctggcacgtgcccgacagccccagctgccccgagcaccactacaagcagatggagggcgacagaaacgtgccccccgtgccccccgccagcagcaccccctacaagcccccctacggcaagctgctgctgccccccggcaccgacggcggcaaggagggccccagagtgctgaacggcaacccccagcaggaggacggcggcctggccggcatcaccgagcagcagagcggcgccttcgacagatgggagatgatccaggcccaggagctgcacaacaagctgaagatcaagcagaacctgcagcagctgaacagcgacatcagcgccatcaccacctggctgaagaagaccgaggccgagctggagatgctgaagatggccaagccccccagcgacatccaggagatcgagctgagagtgaagagactgcaggagatcctgaaggccttcgacacctacaaggccctggtggtgagcgtgaacgtgagcagcaaggagttcctgcagaccgagagccccgagagcaccgagctgcagagcagactgagacagctgagcctgctgtgggaggccgcccagggcgccgtggacagctggagaggcggcctgagacagagcctgatgcagtgccaggacttccaccagctgagccagaacctgctgctgtggctggccagcgccaagaacagaagacagaaggcccacgtgaccgaccccaaggccgaccccagagccctgctggagtgcagaagagagctgatgcagctggagaaggagctggtggagagacagccccaggtggacatgctgcaggagatcagcaacagcctgctgatcaagggccacggcgaggactgcatcgaggccgaggagaaggtgcacgtgatcgagaagaagctgaagcagctgagagagcaggtgagccaggacctgatggccctgcagggcacccagaaccccgccagccccctgcccagcttcgacgaggtggacagcggcgaccagccccccgccaccagcgtgcccgcccccagagccaagcagttcagagccgtgagaaccaccgagggcgaggaggagaccgagagcagagtgcccggcagcaccagaccccagagaagcttcctgagcagagtggtgagagccgccctgcccctgcagctgctgctgctgctgctgctgctgctggcctgcctgctgcccagcagcgaggaggactacagctgcacccaggccaacaacttcgccagaagcttctaccccatgctgagatacaccaacggccccccccccacctag

SEQ ID NO: 100482 - DNA, 804 bp, Artificial Sequence
  Description of Artificial Sequence: Synthetic coding sequence
atggccagcagccccgagctgcccaccgaggacgagcagggcagctggggcatcgacgacctgcacatcagcctgcaggccgagcaggaggacacccagaagaaggccttcacctgctggatcaacagccagctggccagacacaccagccccagcgtgatcagcgacctgttcaccgacatcaagaagggccacgtgctgctggacctgctggaggtgctgagcggccagcagctgcccagagacaagggcagcaacaccttccagtgcagaatcaacatcgagcacgccctgaccttcctgagaaacagaagcatcaagctgatcaacatccacgtgaccgacatcatcgacggcaaccccagcatcatcctgggcctgatctggaccatcatcctgcacttccacatcgagaagctggcccagaccctgagctgcaactacaaccagcccagcctggacgacgtgagcgtggtggacagcagccccgccagcagcccccccgccaagaagtgcagcaaggtgcaggccagatggcagatgagcgccagaaaggccctgctgctgtgggcccaggagcagtgcgccacctacgagagcgtgaacgtgaccgacttcaagagcagctggagaaacggcatggccttcctggccatcatccacgccctgagacccgacctgatcgacatgaagagcgtgaagcacagaagcaacaaggacaacctgagagaggccttcagaatcgccgagcaggagctgaagatccccagactgctggagcccgaggcctacaagaacttctag

SEQ ID NO: 100483 - DNA, 9813 bp, Artificial Sequence
  Description of Artificial Sequence: Synthetic coding sequence
atggagaagctgagaatcaagtacagcgagatgtacaccatcgtgcccgccgagatcgagagccaggtggaggagtgcagaaaggccctggaggacatcgacgagaagatcagcaacgaggtgctgaagagcagccccagctacgccatgagaagaaagatcgaggagatcaacaacggcctgcacaacgtggagaagatgctgcagcagaagagcaagaacatcgagaaggcccaggagatccagaagaagatgtgggacgagctggacctgtggcacagcaagctgaacgagctggacagcgaggtgcaggacatcgtggagcaggaccccggccaggcccaggagtggatggacaacctgatgatccccttccagcagtaccagcaggtgagccagagagccgagtgcagaaccagccagctgaacaaggccaccgtgaagatggaggagtacagcgacctgctgaagagcaccgaggcctggatcgagaacaccagccacctgctggccaaccccgccgactacgacagcctgagaaccctgagccaccacgccagcaccgtgcaggacagcaagtgcttcagaagcggccccagacccaacatctacgtgagctactacgtgaccgtgatccagatggccctggaggacagcgagcagaagcacaacctgctgcacagcatcttcatggacctggaggacctgagcatcatcttcgagaccgacgagctgacccagagcatccaggagctgagcaaccaggtgaccgccctgcagcagaagatcatggagagcctgccccagatccagagaatggccgacgacgtggtggccatcgagagcgaggtgaagagcatggagaagagagtgagcaagatcaagaccatcctgctgagcaaggagatcttcgacttcagccccgaggagcacctgaagcacggcgaggtgatcctggagaacatcagacccatgaagaagaccatcgccgagatcgtgagctaccaggtggagctgagactgccccagaccggcatgaagcccctgcccgtgttccagagaaccaaccagctgctgcaggacatcaagctgctggagaacgtgacccaggagcagaacgagctgctgaaggtggtgatcaagcagaccaacgagtgggacgaggagatcgagaacctgaagcagatcctgaacaactacagcgcccagttcagcctggagcacatgagccccgaccaggccgacaagctgccccagctgcagggcgagatcgagagaatggagaagcagatcctgagcctgaaccagagaaaggaggacctgctggtggacctgaaggccaccgtgctgaacctgcaccagcacctgaagcaggagcaggagggcgtggagagagacagactgcccgccgtgaccagcgaggagggcggcgtggccgagagagacgccagcgagagaaagctgaacagaagaggcagcatgagctacctggccgccgtggaggaggaggtggaggagagcagcgtgaagagcgacaacggcgacgagaaggccgagcccagcccccagagctggagcagcctgtggaagcacgacaaggacatggaggaggacagagccagcagcagcagcggcaccatcgtgcaggaggcctacggcaagatcagcaccagcgacaacagcatggcccagatcctgacccccgacagcctgaacaccgagcagggccccgagtgcagcctgagacccaaccagaccgaggagggcaccaccccccccatcgaggccgacaccctggacagcagcgacgcccagggcggcctggagcccagagtggagaagaccagacccgagcccaccgaggtgctgcacgcctgcaagacccaggtggccgagctggagctgtggctgcagcaggccaacgtggccgtggagcccgagaccctgaacgccgacatgcagcaggtgctggagcagcagctggtgggctgccaggccatgctgaccgagatcgagcacaaggtggccttcctgctggagacctgcaaggaccagggcctgggcgacaacggcgccacccagcacgaggccgaggccctgagcctgaagctgaagaccgtgaagtgcaacctggagaaggtgcagatgatgctgcaggagaagcacagcgaggaccagcaccccaccatcctgaagaagagcagcgagcccgagcaccaggaggccctgcagcccgtgaacctgagcgagctggagagcatcgtgaccgagagaccccagttcagcagacagaaggacttccagcagcagcaggtgctggagctgaagcccatggagcagaaggacttcatcaagttcatcgagttcaacgccaagaagatgtggccccagtactgccagcacgacaacgacaccacccaggagagcagcgccagcaaccaggccagcagccccgagaacgacgtgcccgacagcatcctgagcccccagggccagaacggcgacaagtggcagtacctgcaccacgagctgagcagcaagatcaagctgcccctgccccagctggtggagccccaggtgagcaccaacatgggcatcctgcccagcgtgaccatgtacaacttcagataccccaccaccgaggagctgaagacctacaccacccagctggaggacctgagacaggaggccagcaacctgcagacccaggagaacatgaccgaggaggcctacatcaacctggacaagaagctgttcgagctgttcctgaccctgagccagtgcctgagcagcgtggaggagatgctggagatgcccagactgtacagagaggacggcagcggccagcaggtgcactacgagaccctggccctggagctgaagaagctgtacctggccctgagcgacaagaagggcgacctgctgaaggccatgacctggcccggcgagaacaccaacctgctgctggagtgcttcgacaacctgcaggtgtgcctggagcacacccaggccgccgccgtgtgcagaagcaagagcctgaaggccggcctggactacaacagaagctaccagaacgagatcaagagactgtaccaccagctgatcaagagcaagaccagcctgcagcagagcctgaacgagatcagcggccagagcgtggccgagcagctgcagaaggccgacgcctacaccgtggagctggagaacgccgagagcagagtggccaagctgagagacgagggcgagagactgcacctgccctacgccctgctgcaggaggtgtacaagctggaggacgtgctggacagcatgtggggcatgctgagagccagatacaccgagctgagcagccccttcgtgaccgagagccagcaggacgccctgctgcagggcatggtggagctggtgaagatcggcaaggagaagctggcccacggccacctgaagcagaccaagagcaaggtggccctgcaggcccagatcgagaaccacaaggtgttcttccagaagctggtggccgacatgctgctgatccaggcctacagcgccaagatcctgcccagcctgctgcagaacagagagaccttctgggccgagcaggtgaccgaggtgaagatcctggaggagaagagcagacagtgcggcatgaagctgcagagcctgctgcagaagtgggaggagttcgacgagaactacgccagcctggagaaggacctggagatcctgatcagcaccctgcccagcgtgagcctggtggaggagaccgaggagagactggtggagagaatcagcttctaccagcagatcaagagaaacatcggcggcaagcacgccagactgtaccagaccctgaacgagggcaagcagctggtggccagcgtgagctgccccgagctggagggccagatcgccaagctggaggagcagtggctgagcctgaacaagaagatcgaccacgagctgcacagactgcaggccctgctgaagcacctgctgagctacaacagagacagcgaccagctgaccaagtggctggagagcagccagcacaccctgaactactggaaggagcagagcctgaacgtgagccaggacctggacaccatcagaagcaacatcaacaacttcttcgagttcagcaaggaggtggacgagaagagcagcctgaagaccgccgtgatcagcatcggcaaccagctgctgcacctgaaggagaccgacaccgccaccctgagagccagcctggcccagttcgagcagaagtggaccatgctgatcacccagctgcccgacatccaggagaagctgcaccagctgcagatggagaagctgcccagcagaaaggccatcaccgagatgatcagctggatgaacaacgtggagcaccagaccagcgacgaggacagcgtgcacagccccagcagcgccagccaggtgaagcacctgctgcagaagcacaaggagttcagaatggagatggactacaagcagtggatcgtggacttcgtgaaccagagcctgctgcagctgagcacctgcgacgtggagagcaagagatacgagagaaccgagttcgccgagcacctgggcgagatgaacagacagtggcacagagtgcacggcatgctgaacagaaagatccagcacctggagcagctgctggagagcatcaccgagagcgagaacaagatccagatcctgaacaactggctggaggcccaggaggagagactgaagaccctgcagaagcccgagagcgtgatcagcgtgcagaagctgctgctggactgccaggacatcgagaaccagctggccatcaagagcaaggccctggacgagctgaagcagagctacctgaccctggagagcggcgccgtgcccctgctggaggacaccgccagcagaatcgacgagctgttccagaagagaagcagcgtgctgacccaggtgaaccagctgaagaccagcatgcagagcgtgctgcaggagtggaagatctacgaccagctgtacgacgaggtgaacatgatgaccatcagattctggtactgcatggagcacagcaagcccgtggtgctgagcctggagaccctgagatgccaggtggagaacctgcagagcctgcaggacgaggccgagagcagcgagggcagctgggagaagctgcaggaggtgatcggcaagctgaagggcctgtgccccagcgtggccgagatcatcgaggagaagtgccagaacacccacaagagatggacccaggtgaaccaggccatcgccgaccagctgcagaaggcccagagcctgctgcagctgtggaaggcctacagcaacgcccacggcgaggccgccgccagactgaagcagcaggaggccaagttccagcagctggccaacatcagcatgagcggcaacaacctggccgagatcctgccccccgccctgcaggacatcaaggagctgcagcacgacgtgcagaagaccaaggaggccttcctgcagaacagcagcgtgctggacagactgccccagcccgccgagagcagcacccacatgctgctgcccggccccctgcacagcctgcagagagccgcctacctggagaagatgctgctggtgaaggccaacgagttcgagttcgtgctgagccagttcaaggacttcggcgtgagactggagagcctgaagggcctgatcatgcacgaggaggagaacctggacagactgcaccagcaggagaaggagaaccccgacagcttcctgaaccacgtgctggccctgaccgcccagagccccgacatcgagcacctgaacgaggtgagcctgaagctgcccctgagcgacgtggccgtgaagaccctgcagaacatgaacagacagtggatcagagccaccgccaccgccctggagagatgcagcgagctgcagggcatcggcctgaacgagaagttcctgtactgctgcgagaagtggatccagctgctggagaagatcgaggaggccctgaaggtggacgtggccaacagcctgcccgagctgctggagcagcagaagacctacaagatgctggaggccgaggtgagcatcaaccagaccatcgccgacagctacgtgacccagagcctgcagctgctggacaccaccgagatcgagaacagacccgagttcatcaccgagttcagcaagctgaccgacagatggcagaacgccgtgcagggcgtgagacagagaaagggcgacgtggacggcctggtgagacagtggcaggacttcaccaccagcgtggagaacctgttcagattcctgaccgacaccagccacctgctgagcgccgtgaagggccaggagagattcagcctgtaccagaccagaagcctgatccacgagctgaagaacaaggagatccacttccagagaagaagaaccacctgcgccctgaccctggaggccggcgagaagctgctgctgaccaccgacctgaagaccaaggagagcgtgggcagaagaatcagccagctgcaggacagctggaaggacatggagccccagctggccgagatgatcaagcagttccagagcaccgtggagacctgggaccagtgcgagaagaagatcaaggagctgaagagcagactgcaggtgctgaaggcccagagcgaggaccccctgcccgagctgcacgaggacctgcacaacgagaaggagctgatcaaggagctggagcagagcctggccagctggacccagaacctgaaggagctgcagaccatgaaggccgacctgaccagacacgtgctggtggaggacgtgatggtgctgaaggagcagatcgagcacctgcacagacagtgggaggacctgtgcctgagagtggccatcagaaagcaggagatcgaggacagactgaacacctgggtggtgttcaacgagaagaacaaggagctgtgcgcctggctggtgcagatggagaacaaggtgctgcagaccgccgacatcagcatcgaggagatgatcgagaagctgcagaaggactgcatggaggagatcaacctgttcagcgagaacaagctgcagctgaagcagatgggcgaccagctgatcaaggccagcaacaagagcagagccgccgagatcgacgacaagctgaacaagatcaacgacagatggcagcacctgttcgacgtgatcggcagcagagtgaagaagctgaaggagaccttcgccttcatccagcagctggacaagaacatgagcaacctgagaacctggctggccagaatcgagagcgagctgagcaagcccgtggtgtacgacgtgtgcgacgaccaggagatccagaagagactggccgagcagcaggacctgcagagagacatcgagcagcacagcgccggcgtggagagcgtgttcaacatctgcgacgtgctgctgcacgacagcgacgcctgcgccaacgagaccgagtgcgacagcatccagcagaccaccagaagcctggacagaagatggagaaacatctgcgccatgagcatggagagaagaatgaagatcgaggagacctggagactgtggcagaagttcctggacgactacagcagattcgaggactggctgaagagcgccgagagaaccgccgcctgccccaacagcagcgaggtgctgtacaccagcgccaaggaggagctgaagagattcgaggccttccagagacagatccacgagagactgacccagctggagctgatcaacaagcagtacagaagactggccagagagaacagaaccgacaccgccagcagactgaagcagatggtgcacgagggcaaccagagatgggacaacctgcagagaagagtgaccgccgtgctgagaagactgagacacttcaccaaccagagagaggagttcgagggcaccagagagagcatcctggtgtggctgaccgagatggacctgcagctgaccaacgtggagcacttcagcgagagcgacgccgacgacaagatgagacagctgaacggcttccagcaggagatcaccctgaacaccaacaagatcgaccagctgatcgtgttcggcgagcagctgatccagaagagcgagcccctggacgccgtgctgatcgaggacgagctggaggagctgcacagatactgccaggaggtgttcggcagagtgagcagattccacagaagactgaccagctgcacccccggcctggaggacgagaaggaggccagcgagaacgagaccgacatggaggaccccagagagatccagaccgacagctggagaaagagaggcgagagcgaggagcccagcagcccccagagcctgtgccacctggtggcccccggccacgagagaagcggctgcgagacccccgtgagcgtggacagcatccccctggagtgggaccacaccggcgacgtgggcggcagcagcagccacgaggaggacgaggagggcccctactacagcgccctgagcggcaagagcatcagcgacggccacagctggcacgtgcccgacagccccagctgccccgagcaccactacaagcagatggagggcgacagaaacgtgccccccgtgccccccgccagcagcaccccctacaagcccccctacggcaagctgctgctgccccccggcaccgacggcggcaaggagggccccagagtgctgaacggcaacccccagcaggaggacggcggcctggccggcatcaccgagcagcagagcggcgccttcgacagatgggagatgatccaggcccaggagctgcacaacaagctgaagatcaagcagaacctgcagcagctgaacagcgacatcagcgccatcaccacctggctgaagaagaccgaggccgagctggagatgctgaagatggccaagccccccagcgacatccaggagatcgagctgagagtgaagagactgcaggagatcctgaaggccttcgacacctacaaggccctggtggtgagcgtgaacgtgagcagcaaggagttcctgcagaccgagagccccgagagcaccgagctgcagagcagactgagacagctgagcctgctgtgggaggccgcccagggcgccgtggacagctggagaggcggcctgagacagagcctgatgcagtgccaggacttccaccagctgagccagaacctgctgctgtggctggccagcgccaagaacagaagacagaaggcccacgtgaccgaccccaaggccgaccccagagccctgctggagtgcagaagagagctgatgcagctggagaaggagctggtggagagacagccccaggtggacatgctgcaggagatcagcaacagcctgctgatcaagggccacggcgaggactgcatcgaggccgaggagaaggtgcacgtgatcgagaagaagctgaagcagctgagagagcaggtgagccaggacctgatggccctgcagggcacccagaaccccgccagccccctgcccagcttcgacgaggtggacagcggcgaccagccccccgccaccagcgtgcccgcccccagagccaagcagttcagagccgtgagaaccaccgagggcgaggaggagaccgagagcagagtgcccggcagcaccagaccccagagaagcttcctgagcagagtggtgagagccgccctgcccctgcagctgctgctgctgctgctgctgctgctggcctgcctgctgcccagcagcgaggaggactacagctgcacccaggccaacaacttcgccagaagcttctaccccatgctgagatacaccaacggccccccccccacctag

SEQ ID NO: 100484 - DNA, 20724 bp, Artificial Sequence
  Description of Artificial Sequence: Synthetic coding sequence
atggccagcagccccgagctgcccaccgaggacgagcagggcagctggggcatcgacgacctgcacatcagcctgcaggccgagcaggaggacacccagaagaaggccttcacctgctggatcaacagccagctggccagacacaccagccccagcgtgatcagcgacctgttcaccgacatcaagaagggccacgtgctgctggacctgctggaggtgctgagcggccagcagctgcccagagacaagggcagcaacaccttccagtgcagaatcaacatcgagcacgccctgaccttcctgagaaacagaagcatcaagctgatcaacatccacgtgaccgacatcatcgacggcaaccccagcatcatcctgggcctgatctggaccatcatcctgcacttccacatcgagaagctggcccagaccctgagctgcaactacaaccagcccagcctggacgacgtgagcgtggtggacagcagccccgccagcagcccccccgccaagaagtgcagcaaggtgcaggccagatggcagatgagcgccagaaaggccctgctgctgtgggcccaggagcagtgcgccacctacgagagcgtgaacgtgaccgacttcaagagcagctggagaaacggcatggccttcctggccatcatccacgccctgagacccgacctgatcgacatgaagagcgtgaagcacagaagcaacaaggacaacctgagagaggccttcagaatcgccgagcaggagctgaagatccccagactgctggagcccgaggacgtggacgtggtggaccccgacgagaagagcatcatgacctacgtggcccagttcctgcagtacagcaaggacgcccccggcaccggcgaggaggcccagggcaaggtgaaggacgccatgggctggctgaccctgcagaaggagaagctgcagaagctgctgaaggacagcgagaacgacacctacttcaagaagtacaacagcctgctgagcttcatggagagcttcaacgaggagaagaagagcttcctggacgtgctgagcatcaagagagacctggacgagctggacaaggaccacctgcagctgagagaggcctgggacggcctggaccaccagatcaacgcctggaagatcaagctgaactacgccctgcccccccccctgcaccagaccgaggcctggctgcaggaggtggaggagctgatggacgaggacctgagcgccagccaggaccacagccaggccgtgaccctgatccaggagaagatgaccctgttcaagagcctgatggacagattcgagcaccacagcaacatcctgctgaccttcgagaacaaggacgagaaccacctgcccctggtgccccccaacaagctggaggagatgaagagaagaatcaacaacatcctggagaagaagttcatcctgctgctggagttccactactacaagtgcctggtgctgggcctggtggacgaggtgaagagcaagctggacatctggaacatcaagtacggcagcagagagagcgtggagctgctgctggaggactggcacaagttcatcgaggagaaggagttcctggccagactggacaccagcttccagaagtgcggcgagatctacaagaacctggccggcgagtgccagaacatcaacaagcagtacatgatggtgaagagcgacgtgtgcatgtacagaaagaacatctacaacgtgaagagcaccctgcagaaggtgctggcctgctgggccacctacgtggagaacctgagactgctgagagcctgcttcgaggagaccaagaaggaggagatcaaggaggtgcccttcgagaccctggcccagtggaacctggagcacgccaccctgaacgaggccggcaacttcctggtggaggtgagcaacgacgtggtgggcagcagcatcagcaaggagctgagaagactgaacaagagatggagaaagctggtgagcaagacccagctggagatgaacctgcccctgatgatcaagaagcaggaccagcccaccttcgacaacagcggcaacatcctgagcaaggaggagaaggccaccgtggagttcagcaccgacatgagcgtggagctgcccgagaactacaaccagaacatcaaggccggcgagaagcacgagaaggagaacgaggagttcaccggccagctgaaggtggccaaggacgtggagaagctgatcggccaggtggagatctgggaggccgaggccaagagcgtgctggaccaggacgacgtggacaccagcatggaggagagcctgaagcacctgatcgccaagggcagcatgttcgacgagctgatggccagaagcgaggacatgctgcagatggacatccagaacatcagcagccaggagagcttccagcacgtgctgaccaccggcctgcaggccaagatccaggaggccaaggagaaggtgcagatcaacgtggtgaagctgatcgccgccctgaagaacctgaccgacgtgagccccgacctggacatcagactgaagatggaggagagccagaaggagctggagagctacatgatgagagcccagcagctgctgggccagagagagagccccggcgagctgatcagcaagcacaaggaggccctgatcatcagcaacaccaagagcctggccaagtacctgaaggccgtggaggagctgaagaacaacgtgaccgaggacatcaagatgagcctggaggagaagagcagagacgtgtgcgccaagtgggagagcctgcaccacgagctgagcctgtacgtgcagcagctgaagatcgacatcgagaagggcaagctgagcgacaacatcctgaagctggagaagcagatcaacaaggagaagaagctgatcagaagaggcagaaccaagggcctgatcaaggagcacgaggcctgcttcagcgaggagggctgcctgtaccagctgaaccaccacatggaggtgctgagagagctgtgcgaggagctgcccagccagaagagccagcaggaggtgaagagactgctgaaggactacgagcagaagatcgagagactgctgaagtgcgccagcgagatccacatgaccctgcagcccaccgccggcggcaccagcaagaacgagggcaccatcaccaccagcgagaacagaggcggcgacccccacagcgaggcccccttcgccaagagcgacaaccagcccagcaccgagaaggccatggagcccaccatgaagttcagcctggccagcgtgctgagacccctgcaggaggagagcatcatggagaaggactacagcgccagcatcaacagcctgctggagagatacgacacctacagagacatcctggagcaccacctgcagaacaacaagttcagaatcaccagcgacttcagcagcgaggaggacagaagcagcagctgcctgcaggccaagctgaccgacctgcaggtgatcaagaacgagaccgacgccagatggaaggagttcgagatcatcagcctgaagctggagaaccacgtgaacgacatcaagaagcccttcgtgatcaaggagagagacaccctgaaggagagagagagagagctgcagatgaccctgaacaccagaatggagagcctggagaccgccctgagactggtgctgcccgtggagaaggccagcctgctgctgtgcggcagcgacctgcccctgcacaagatggccatccagggcttccacctgatcgacgccgacagaatctaccagcacctgagaaacatccaggacagcatcgccaagcagatcgagatctgcaacagactggaggagcccggcaacttcgtgctgaaggagctgcaccccttcgacctgcacgccatgcagaacatcatcctgaagtacaagacccagttcgagggcatgaaccacagagtgcagagaagcgaggacaccctgaaggccctggaggacttcctggccagcctgagaaccgccaagctgagcgccgagcccgtgaccgacctgagcgccagcgacacccaggtggcccaggagaacaccctgaccgtgaagaacaaggagggcgagatccacctgatgaaggacaaggccaagcacctggacaagtgcctgaagatgctggacatgagcttcaaggacgccgagagaggcgacgacaccagctgcgagaacctgctggacgccttcagcatcaagctgagcgagacccacggctacggcgtgcaggaggagttcaccgaggagaacaagctgctggaggcctgcatcttcaagaacaacgagctgctgaagaacatccaggacgtgcagagccagatcagcaagatcggcctgaaggaccccaccgtgcccgccgtgaagcacagaaagaagagcctgatcagactggacaaggtgctggacgagtacgaggaggagaagagacacctgcaggagatggccaacagcctgccccacttcaaggacggcagagagaagaccgtgaaccagcagtgccagaacaccgtggtgctgtgggagaacaccaaggccctggtgaccgagtgcctggagcagtgcggcagagtgctggagctgctgaagcagtaccagaacttcaagagcatcctgaccaccctgatccagaaggaggagagcgtgatcagcctgcaggccagctacatgggcaaggagaacctgaagaagagaatcgccgagatcgagatcgtgaaggaggagttcaacgagcacctggaggtggtggacaagatcaaccaggtgtgcaagaacctgcagttctacctgaacaagatgaagaccttcgaggagccccccttcgagaaggaggccaacatcatcgtggacagatggctggacatcaacgagaagaccgaggactactacgagaacctgggcagagccctggccctgtgggacaagctgttcaacctgaagaacgtgatcgacgagtggaccgagaaggccctgcagaagatggagctgcaccagctgaccgaggaggacagagagagactgaaggaggagctgcaggtgcacgagcagaagaccagcgagttcagcagaagagtggccgagatccagttcctgctgcagagcagcgagatccccctggagctgcaggtgatggagagcagcatcctgaacaagatggagcacgtgcagaagtgcctgaccggcgagagcaactgccacgccctgagcggcagcaccgccgagctgagagaggacctggaccaggccaagacccagatcggcatgaccgagagcctgctgaaggccctgagccccagcgacagcctggagatcttcaccaagctggaggagatccagcagcagatcctgcagcagaagcacagcatgatcctgctggagaaccagatcggctgcctgacccccgagctgagcgagctgaagaagcagtacgagagcgtgagcgacctgttcaacaccaagaagagcgtgctgcaggaccacttcagcaagctgctgaacgaccagtgcaagaacttcaacgactggttcagcaacatcaaggtgaacctgaaggagtgcttcgagagcagcgagaccaagaagagcgtggagcagaagctgcagaagctgagcgacttcctgaccctggagggcagaaacagcaagatcaagcaggtggacagcgtgctgaagcacgtgaagaagcacctgcccaaggcccacgtgaaggagctgatcagctggctggtgggccaggagttcgagctggagaagatggagagcatctgccaggccagagccaaggagctggaggacagcctgcagcagctgctgagactgcaggacgaccacagaaacctgagaaagtggctgaccaaccaggaggagaagtggaagggcatggaggagcccggcgagaagaccgagctgttctgccaggccctggccagaaagagagagcagttcgagagcgtggcccagctgaacaacagcctgaaggagtacggcttcaccgaggaggaggagatcatcatggaggccacctgcctgatggacagataccagaccctgctgagacagctgagcgagatcgaggaggaggacaagctgctgcccaccgaggaccagagcttcaacgacctggcccacgacgtgatccactggatcaaggagatcaaggagagcctgatggtgctgaacagcagcgagggcaagatgcccctggaggagagaatccagaagatcaaggagatcatcctgctgaagcccgagggcgacgccagaatcgagaccatcatgaagcaggccgagagcagcgaggcccccctggtgcagaagaccctgaccgacatcagcaaccagtgggacaacaccctgcacctggccagcacctacctgagccaccaggagaagctgctgctggagggcgagaagtacctgcagagcaaggaggacctgagactgatgctgatcgagctgaagaagaagcaggaggccggcttcgccctgcagcacggcctgcaggagaagaaggcccagctgaagatctacaagaagttcctgaagaaggcccaggacctgaccagcctgctgaaggagctgaagagccagggcaactacctgctggagtgcaccaagaaccccagcttcagcgaggagccctggctggagatcaagcacctgcacgagagcctgctgcagcagctgcaggacagcgtgcagaacctggacggccacgtgagagagcacgacagctaccaggtgtgcgtgaccgacctgaacaccaccctggacaacttcagcaaggagttcgtgagcttcagcgacaagcccgtggaccagatcgccgtggaggagaagctgcagaagctgcaggagctggagaacagactgagcctgcaggacggcaccctgaagaagatcctggccctggccaagagcgtgaagcagaacaccagcagcgtgggccagaagatcatcaaggacgacatcaagagcctgcagtgcaagcagaaggacctggagaacagactggccagcgccaagcaggagatggagtgctgcctgaacagcatcctgaagagcaagagaagcaccgagaagaagggcaagttcaccctgcccggcagagagaagcaggccaccagcgacgtgcaggagagcacccaggagagcgccgccgtggagaagctggaggaggactgggagatcaacaaggacagcgccgtggagatggccatgagcaagcagctgagcctgaacgcccaggagagcatgaagaacaccgaggacgagagaaaggtgaacgagctgcagaaccagcccctggagctggacaccatgctgagaaacgagcagctggaggagatcgagaagctgtacacccagctggaggccaagaaggccgccatcaagcccctggagcagaccgagtgcctgaacaagaccgagaccggcgccctggtgctgcacaacatcggctacagcgcccagcacctggacaacctgctgcaggccctgatcaccctgaagaagaacaaggagagccagtactgcgtgctgagagacttccaggagtacctggccgccgtggagagcagcatgaaggccctgctgaccgacaaggagagcctgaaggtgggccccctggacagcgtgacctacctggacaagatcaagaagttcatcgccagcatcgagaaggagaaggacagcctgggcaacctgaagatcaagtgggagaacctgagcaaccacgtgaccgacatggacaagaagctgctggagagccagatcaagcagctggagcacggctgggagcaggtggagcagcagatccagaagaagtacagccagcaggtggtggagtacgacgagttcaccaccctgatgaacaaggtgcaggacaccgagatcagcctgcagcagcagcagcagcacctgcagctgagactgaagagccccgaggagagagccggcaaccagagcatgatcgccctgaccaccgacctgcaggccaccaagcacggcttcagcgtgctgaagggccaggccgagctgcagatgaagagaatctggggcgagaaggagaagaagaacctggaggacggcatcaacaacctgaagaagcagtgggagaccctggagcccctgcacctggaggccgagaaccagatcaagaagtgcgacatcagaaacaagatgaaggagaccatcctgtgggccaagaacctgctgggcgagctgaaccccagcatccccctgctgcccgacgacatcctgagccagatcagaaagtgcaaggtgacccacgacggcatcctggccagacagcagagcgtggagagcctggccgaggaggtgaaggacaaggtgcccagcctgaccacctacgagggcagcgacctgaacaacaccctggaggacctgagaaaccagtaccagatgctggtgctgaagagcacccagagaagccagcagctggagttcaagctggaggagagaagcaacttcttcgccatcatcagaaagttccagctgatggtgcaggagagcgagaccctgatcatccccagagtggagaccgccgccaccgaggccgagctgaagcaccaccacgtgaccctggaggccagccagaaggagctgcaggagatcgacagcggcatcagcacccacctgcaggagctgaccaacatctacgaggagctgaacgtgttcgagagactgttcctggaggaccagctgaagaacctgaagatcagaaccaacagaatccagagattcatccagaacacctgcaacgaggtggagcacaagatcaagttctgcagacagttccacgagaagaccagcgccctgcaggaggaggccgacagcatccagagaaacgagctgctgctgaaccaggaggtgaacaagggcgtgaaggaggagatctacaacctgaaggacagactgaccgccatcaagtgctgcatcctgcaggtgctgaagctgaagaaggtgttcgactacatcggcctgaactgggacttcagccagctggaccagctgcagacccaggtgttcgagaaggagaaggagctggaggagaagatcaagcagctggacaccttcgaggaggagcacggcaagtaccaggccctgctgagcaagatgagagccatcgacctgcagatcaagaagatgaccgaggtggtgctgaaggcccccgacagcagccccgagagcagaagactgaacgcccagatcctgagccagagaatcgagaaggccaagtgcctgtgcgacgagatcatcaagaagctgaacgagaacaagaccttcgacgacagcttcaaggagaaggagatcctgcagatcaagctgaacgccgaggagaacgacaagctgtacaaggtgctgcagaacatggtgctggagctgagccccaaggagctggacgagaagaactgccaggacaagctggagaccagcctgcacgtgctgaaccagatcaagagccagctgcagcagcccctgctgatcaacctggagatcaagcacatccagaacgagaaggacaactgcgaggccttccaggagcaggtgtgggccgagatgtgcagcatcaaggccgtgaccgccatcgagaagcagagagaggagaacagcagcgaggccagcgacgtggagaccaagctgagagagttcgaggacctgcagatgcagctgaacaccagcatcgacctgagaaccaacgtgctgaacgacgcctacgagaacctgaccagatacaaggaggccgtgaccagagccgtggagagcatcaccagcctggaggccatcatcatcccctacagagtggacgtgggcaaccccgaggagagcctggagatgcccctgagaaagcaggaggagctggagagcaccgtggcccacatccaggacctgaccgagaagctgggcatgatcagcagccccgaggccaagctgcagctgcagtacaccctgcaggagctggtgagcaagaacagcgccatgaaggaggccttcaaggcccaggagaccgaggccgagagatacctggagaactacaagtgctacagaaagatggaggaggacatctacaccaacctgagcaagatggagaccgtgctgggccagagcatgagcagcctgcccctgagctacagagaggccctggagagactggagcagagcaaggccctggtgagcaacctgatcagcaccaaggaggagctgatgaagctgagacagatcctgagactgctgagactgagatgcaccgagaacgacggcatctgcctgctgaagatcgtgagcgccctgtgggagaagtggctgagcctgctggaggccgccaaggagtgggagatgtggtgcgaggagctgaagcaggagtggaagttcgtgagcgaggagatcgagagagaggccatcatcctggacaacctgcaggaggagctgcccgagatcagcaagaccaaggaggccgccaccaccgaggagctgagcgagctgctggactgcctgtgccagtacggcgagaacgtggagaagcagcagctgctgctgaccctgctgctgcagagaatcagaagcatccagaacgtgcccgagagcagcggcgccgtggagaccgtgcccgccttccaggagatcaccagcatgaaggagagatgcaacaagctgctgcagaaggtgcagaagaacaaggagctggtgcagaccgagatccaggagagacacagcttcaccaaggagatcatcgccctgaagaacttcttccagcagaccaccaccagcttccagaacatggccttccaggaccaccccgagaagagcgagcagttcgaggagctgcagagcatcctgaagaagggcaagctgaccttcgagaacatcatggagaagctgagaatcaagtacagcgagatgtacaccatcgtgcccgccgagatcgagagccaggtggaggagtgcagaaaggccctggaggacatcgacgagaagatcagcaacgaggtgctgaagagcagccccagctacgccatgagaagaaagatcgaggagatcaacaacggcctgcacaacgtggagaagatgctgcagcagaagagcaagaacatcgagaaggcccaggagatccagaagaagatgtgggacgagctggacctgtggcacagcaagctgaacgagctggacagcgaggtgcaggacatcgtggagcaggaccccggccaggcccaggagtggatggacaacctgatgatccccttccagcagtaccagcaggtgagccagagagccgagtgcagaaccagccagctgaacaaggccaccgtgaagatggaggagtacagcgacctgctgaagagcaccgaggcctggatcgagaacaccagccacctgctggccaaccccgccgactacgacagcctgagaaccctgagccaccacgccagcaccgtgcagatggccctggaggacagcgagcagaagcacaacctgctgcacagcatcttcatggacctggaggacctgagcatcatcttcgagaccgacgagctgacccagagcatccaggagctgagcaaccaggtgaccgccctgcagcagaagatcatggagagcctgccccagatccagagaatggccgacgacgtggtggccatcgagagcgaggtgaagagcatggagaagagagtgagcaagatcaagaccatcctgctgagcaaggagatcttcgacttcagccccgaggagcacctgaagcacggcgaggtgatcctggagaacatcagacccatgaagaagaccatcgccgagatcgtgagctaccaggtggagctgagactgccccagaccggcatgaagcccctgcccgtgttccagagaaccaaccagctgctgcaggacatcaagctgctggagaacgtgacccaggagcagaacgagctgctgaaggtggtgatcaagcagaccaacgagtgggacgaggagatcgagaacctgaagcagatcctgaacaactacagcgcccagttcagcctggagcacatgagccccgaccaggccgacaagctgccccagctgcagggcgagatcgagagaatggagaagcagatcctgagcctgaaccagagaaaggaggacctgctggtggacctgaaggccaccgtgctgaacctgcaccagcacctgaagcaggagcaggagggcgtggagagagacagactgcccgccgtgaccagcgaggagggcggcgtggccgagagagacgccagcgagagaaagctgaacagaagaggcagcatgagctacctggccgccgtggaggaggaggtggaggagagcagcgtgaagagcgacaacggcgacgagaaggccgagcccagcccccagagctggagcagcctgtggaagcacgacaaggacatggaggaggacagagccagcagcagcagcggcaccatcgtgcaggaggcctacggcaagatcagcaccagcgacaacagcatggcccagatcctgacccccgacagcctgaacaccgagcagggccccgagtgcagcctgagacccaaccagaccgaggagggcaccaccccccccatcgaggccgacaccctggacagcagcgacgcccagggcggcctggagcccagagtggagaagaccagacccgagcccaccgaggtgctgcacgcctgcaagacccaggtggccgagctggagctgtggctgcagcaggccaacgtggccgtggagcccgagaccctgaacgccgacatgcagcaggtgctggagcagcagctggtgggctgccaggccatgctgaccgagatcgagcacaaggtggccttcctgctggagacctgcaaggaccagggcctgggcgacaacggcgccacccagcacgaggccgaggccctgagcctgaagctgaagaccgtgaagtgcaacctggagaaggtgcagatgatgctgcaggagaagcacagcgaggaccagcaccccaccatcctgaagaagagcagcgagcccgagcaccaggaggccctgcagcccgtgaacctgagcgagctggagagcatcgtgaccgagagaccccagttcagcagacagaaggacttccagcagcagcaggtgctggagctgaagcccatggagcagaaggacttcatcaagttcatcgagttcaacgccaagaagatgtggccccagtactgccagcacgacaacgacaccacccaggagagcagcgccagcaaccaggccagcagccccgagaacgacgtgcccgacagcatcctgagcccccagggccagaacggcgacaagtggcagtacctgcaccacgagctgagcagcaagatcaagctgcccctgccccagctggtggagccccaggtgagcaccaacatgggcatcctgcccagcgtgaccatgtacaacttcagataccccaccaccgaggagctgaagacctacaccacccagctggaggacctgagacaggaggccagcaacctgcagacccaggagaacatgaccgaggaggcctacatcaacctggacaagaagctgttcgagctgttcctgaccctgagccagtgcctgagcagcgtggaggagatgctggagatgcccagactgtacagagaggacggcagcggccagcaggtgcactacgagaccctggccctggagctgaagaagctgtacctggccctgagcgacaagaagggcgacctgctgaaggccatgacctggcccggcgagaacaccaacctgctgctggagtgcttcgacaacctgcaggtgtgcctggagcacacccaggccgccgccgtgtgcagaagcaagagcctgaaggccggcctggactacaacagaagctaccagaacgagatcaagagactgtaccaccagctgatcaagagcaagaccagcctgcagcagagcctgaacgagatcagcggccagagcgtggccgagcagctgcagaaggccgacgcctacaccgtggagctggagaacgccgagagcagagtggccaagctgagagacgagggcgagagactgcacctgccctacgccctgctgcaggaggtgtacaagctggaggacgtgctggacagcatgtggggcatgctgagagccagatacaccgagctgagcagccccttcgtgaccgagagccagcaggacgccctgctgcagggcatggtggagctggtgaagatcggcaaggagaagctggcccacggccacctgaagcagaccaagagcaaggtggccctgcaggcccagatcgagaaccacaaggtgttcttccagaagctggtggccgacatgctgctgatccaggcctacagcgccaagatcctgcccagcctgctgcagaacagagagaccttctgggccgagcaggtgaccgaggtgaagatcctggaggagaagagcagacagtgcggcatgaagctgcagagcctgctgcagaagtgggaggagttcgacgagaactacgccagcctggagaaggacctggagatcctgatcagcaccctgcccagcgtgagcctggtggaggagaccgaggagagactggtggagagaatcagcttctaccagcagatcaagagaaacatcggcggcaagcacgccagactgtaccagaccctgaacgagggcaagcagctggtggccagcgtgagctgccccgagctggagggccagatcgccaagctggaggagcagtggctgagcctgaacaagaagatcgaccacgagctgcacagactgcaggccctgctgaagcacctgctgagctacaacagagacagcgaccagctgaccaagtggctggagagcagccagcacaccctgaactactggaaggagcagagcctgaacgtgagccaggacctggacaccatcagaagcaacatcaacaacttcttcgagttcagcaaggaggtggacgagaagagcagcctgaagaccgccgtgatcagcatcggcaaccagctgctgcacctgaaggagaccgacaccgccaccctgagagccagcctggcccagttcgagcagaagtggaccatgctgatcacccagctgcccgacatccaggagaagctgcaccagctgcagatggagaagctgcccagcagaaaggccatcaccgagatgatcagctggatgaacaacgtggagcaccagaccagcgacgaggacagcgtgcacagccccagcagcgccagccaggtgaagcacctgctgcagaagcacaaggagttcagaatggagatggactacaagcagtggatcgtggacttcgtgaaccagagcctgctgcagctgagcacctgcgacgtggagagcaagagatacgagagaaccgagttcgccgagcacctgggcgagatgaacagacagtggcacagagtgcacggcatgctgaacagaaagatccagcacctggagcagctgctggagagcatcaccgagagcgagaacaagatccagatcctgaacaactggctggaggcccaggaggagagactgaagaccctgcagaagcccgagagcgtgatcagcgtgcagaagctgctgctggactgccaggacatcgagaaccagctggccatcaagagcaaggccctggacgagctgaagcagagctacctgaccctggagagcggcgccgtgcccctgctggaggacaccgccagcagaatcgacgagctgttccagaagagaagcagcgtgctgacccaggtgaaccagctgaagaccagcatgcagagcgtgctgcaggagtggaagatctacgaccagctgtacgacgaggtgaacatgatgaccatcagattctggtactgcatggagcacagcaagcccgtggtgctgagcctggagaccctgagatgccaggtggagaacctgcagagcctgcaggacgaggccgagagcagcgagggcagctgggagaagctgcaggaggtgatcggcaagctgaagggcctgtgccccagcgtggccgagatcatcgaggagaagtgccagaacacccacaagagatggacccaggtgaaccaggccatcgccgaccagctgcagaaggcccagagcctgctgcagctgtggaaggcctacagcaacgcccacggcgaggccgccgccagactgaagcagcaggaggccaagttccagcagctggccaacatcagcatgagcggcaacaacctggccgagatcctgccccccgccctgcaggacatcaaggagctgcagcacgacgtgcagaagaccaaggaggccttcctgcagaacagcagcgtgctggacagactgccccagcccgccgagagcagcacccacatgctgctgcccggccccctgcacagcctgcagagagccgcctacctggagaagatgctgctggtgaaggccaacgagttcgagttcgtgctgagccagttcaaggacttcggcgtgagactggagagcctgaagggcctgatcatgcacgaggaggagaacctggacagactgcaccagcaggagaaggagaaccccgacagcttcctgaaccacgtgctggccctgaccgcccagagccccgacatcgagcacctgaacgaggtgagcctgaagctgcccctgagcgacgtggccgtgaagaccctgcagaacatgaacagacagtggatcagagccaccgccaccgccctggagagatgcagcgagctgcagggcatcggcctgaacgagaagttcctgtactgctgcgagaagtggatccagctgctggagaagatcgaggaggccctgaaggtggacgtggccaacagcctgcccgagctgctggagcagcagaagacctacaagatgctggaggccgaggtgagcatcaaccagaccatcgccgacagctacgtgacccagagcctgcagctgctggacaccaccgagatcgagaacagacccgagttcatcaccgagttcagcaagctgaccgacagatggcagaacgccgtgcagggcgtgagacagagaaagggcgacgtggacggcctggtgagacagtggcaggacttcaccaccagcgtggagaacctgttcagattcctgaccgacaccagccacctgctgagcgccgtgaagggccaggagagattcagcctgtaccagaccagaagcctgatccacgagctgaagaacaaggagatccacttccagagaagaagaaccacctgcgccctgaccctggaggccggcgagaagctgctgctgaccaccgacctgaagaccaaggagagcgtgggcagaagaatcagccagctgcaggacagctggaaggacatggagccccagctggccgagatgatcaagcagttccagagcaccgtggagacctgggaccagtgcgagaagaagatcaaggagctgaagagcagactgcaggtgctgaaggcccagagcgaggaccccctgcccgagctgcacgaggacctgcacaacgagaaggagctgatcaaggagctggagcagagcctggccagctggacccagaacctgaaggagctgcagaccatgaaggccgacctgaccagacacgtgctggtggaggacgtgatggtgctgaaggagcagatcgagcacctgcacagacagtgggaggacctgtgcctgagagtggccatcagaaagcaggagatcgaggacagactgaacacctgggtggtgttcaacgagaagaacaaggagctgtgcgcctggctggtgcagatggagaacaaggtgctgcagaccgccgacatcagcatcgaggagatgatcgagaagctgcagaaggactgcatggaggagatcaacctgttcagcgagaacaagctgcagctgaagcagatgggcgaccagctgatcaaggccagcaacaagagcagagccgccgagatcgacgacaagctgaacaagatcaacgacagatggcagcacctgttcgacgtgatcggcagcagagtgaagaagctgaaggagaccttcgccttcatccagcagctggacaagaacatgagcaacctgagaacctggctggccagaatcgagagcgagctgagcaagcccgtggtgtacgacgtgtgcgacgaccaggagatccagaagagactggccgagcagcaggacctgcagagagacatcgagcagcacagcgccggcgtggagagcgtgttcaacatctgcgacgtgctgctgcacgacagcgacgcctgcgccaacgagaccgagtgcgacagcatccagcagaccaccagaagcctggacagaagatggagaaacatctgcgccatgagcatggagagaagaatgaagatcgaggagacctggagactgtggcagaagttcctggacgactacagcagattcgaggactggctgaagagcgccgagagaaccgccgcctgccccaacagcagcgaggtgctgtacaccagcgccaaggaggagctgaagagattcgaggccttccagagacagatccacgagagactgacccagctggagctgatcaacaagcagtacagaagactggccagagagaacagaaccgacaccgccagcagactgaagcagatggtgcacgagggcaaccagagatgggacaacctgcagagaagagtgaccgccgtgctgagaagactgagacacttcaccaaccagagagaggagttcgagggcaccagagagagcatcctggtgtggctgaccgagatggacctgcagctgaccaacgtggagcacttcagcgagagcgacgccgacgacaagatgagacagctgaacggcttccagcaggagatcaccctgaacaccaacaagatcgaccagctgatcgtgttcggcgagcagctgatccagaagagcgagcccctggacgccgtgctgatcgaggacgagctggaggagctgcacagatactgccaggaggtgttcggcagagtgagcagattccacagaagactgaccagctgcacccccggcctggaggacgagaaggaggccagcgagaacgagaccgacatggaggaccccagagagatccagaccgacagctggagaaagagaggcgagagcgaggagcccagcagcccccagagcctgtgccacctggtggcccccggccacgagagaagcggctgcgagacccccgtgagcgtggacagcatccccctggagtgggaccacaccggcgacgtgggcggcagcagcagccacgaggaggacgaggagggcccctactacagcgccctgagcgacgtggagatccccgagaaccccgaggcctacctgaagatgaccaccaagaccctgaaggccagcagcggcaagagcatcagcgacggccacagctggcacgtgcccgacagccccagctgccccgagcaccactacaagcagatggagggcgacagaaacgtgccccccgtgccccccgccagcagcaccccctacaagcccccctacggcaagctgctgctgccccccggcaccgacggcggcaaggagggccccagagtgctgaacggcaacccccagcaggaggacggcggcctggccggcatcaccgagcagcagagcggcgccttcgacagatgggagatgatccaggcccaggagctgcacaacaagctgaagatcaagcagaacctgcagcagctgaacagcgacatcagcgccatcaccacctggctgaagaagaccgaggccgagctggagatgctgaagatggccaagccccccagcgacatccaggagatcgagctgagagtgaagagactgcaggagatcctgaaggccttcgacacctacaaggccctggtggtgagcgtgaacgtgagcagcaaggagttcctgcagaccgagagccccgagagcaccgagctgcagagcagactgagacagctgagcctgctgtgggaggccgcccagggcgccgtggacagctggagaggcggcctgagacagagcctgatgcagtgccaggacttccaccagctgagccagaacctgctgctgtggctggccagcgccaagaacagaagacagaaggcccacgtgaccgaccccaaggccgaccccagagccctgctggagtgcagaagagagctgatgcagctggagaaggagctggtggagagacagccccaggtggacatgctgcaggagatcagcaacagcctgctgatcaagggccacggcgaggactgcatcgaggccgaggagaaggtgcacgtgatcgagaagaagctgaagcagctgagagagcaggtgagccaggacctgatggccctgcagggcacccagaaccccgccagccccctgcccagcttcgacgaggtggacagcggcgaccagccccccgccaccagcgtgcccgcccccagagccaagttcagagccgtgagaaccaccgagggcgaggaggagaccgagagcagagtgcccggcagcaccagaccccagagaagcttcctgagcagagtggtgagagccgccctgcccctgcagctgctgctgctgctgctgctgctgctggcctgcctgctgcccagcagcgaggaggactacagctgcacccaggccaacaacttcgccagaagcttctaccccatgctgagatacaccaacggccccccccccacctag

SEQ ID NO: 100485 - DNA, 9813 bp, Artificial Sequence; identical to SEQ ID NO: 100483
  Description of Artificial Sequence: Synthetic coding sequence

SEQ ID NO: 100486 - DNA, 1290 bp, Artificial Sequence
  Description of Artificial Sequence: Synthetic coding sequence
atggagggcgacagaaacgtgccccccgtgccccccgccagcagcaccccctacaagcccccctacggcaagctgctgctgccccccggcaccgacggcggcaaggagggccccagagtgctgaacggcaacccccagcaggaggacggcggcctggccggcatcaccgagcagcagagcggcgccttcgacagatgggagatgatccaggcccaggagctgcacaacaagctgaagatcaagcagaacctgcagcagctgaacagcgacatcagcgccatcaccacctggctgaagaagaccgaggccgagctggagatgctgaagatggccaagccccccagcgacatccaggagatcgagctgagagtgaagagactgcaggagatcctgaaggccttcgacacctacaaggccctggtggtgagcgtgaacgtgagcagcaaggagttcctgcagaccgagagccccgagagcaccgagctgcagagcagactgagacagctgagcctgctgtgggaggccgcccagggcgccgtggacagctggagaggcggcctgagacagagcctgatgcagtgccagggcagcaagaccagacccagaagcgacgtgctgttcttcaaggacttccaccagctgagccagaacctgctgctgtggctggccagcgccaagaacagaagacagaaggcccacgtgaccgaccccaaggccgaccccagagccctgctggagtgcagaagagagctgatgcagctggagaaggagctggtggagagacagccccaggtggacatgctgcaggagatcagcaacagcctgctgatcaagggccacggcgaggactgcatcgaggccgaggagaaggtgcacgtgatcgagaagaagctgaagcagctgagagagcaggtgagccaggacctgatggccctgcagggcacccagaaccccgccagccccctgcccagcttcgacgaggtggacagcggcgaccagccccccgccaccagcgtgcccgcccccagagccaagttcagagccgtgagaaccaccgagggcgaggaggagaccgagagcagagtgcccggcagcaccagaccccagagaagcttcctgagcagagtggtgagagccgccctgcccctgcagctgctgctgctgctgctgctgctgctggcctgcctgctgcccagcagcgaggaggactacagctgcacccaggccaacaacttcgccagaagcttctaccccatgctgagatacaccaacggccccccccccacctag

SEQ ID NO: 100487 - DNA, 1671 bp, Artificial Sequence
  Description of Artificial Sequence: Synthetic coding sequence
atggaggaccccagagagatccagaccgacagctggagaaagagaggcgagagcgaggagcccagcagcccccagagcctgtgccacctggtggcccccggccacgagagaagcggctgcgagacccccgtgagcgtggacagcatccccctggagtgggaccacaccggcgacgtgggcggcagcagcagccacgaggaggacgaggagggcccctactacagcgccctgagcgacgtggagatccccgagaaccccgaggcctacctgaagatgaccaccaagaccctgaaggccagcagcggcaagagcatcagcgacggccacagctggcacgtgcccgacagccccagctgccccgagcaccactacaagcagatggagggcgacagaaacgtgccccccgtgccccccgccagcagcaccccctacaagcccccctacggcaagctgctgctgccccccggcaccgacggcggcaaggagggccccagagtgctgaacggcaacccccagcaggaggacggcggcctggccggcatcaccgagcagcagagcggcgccttcgacagatgggagatgatccaggcccaggagctgcacaacaagctgaagatcaagcagaacctgcagcagctgaacagcgacatcagcgccatcaccacctggctgaagaagaccgaggccgagctggagatgctgaagatggccaagccccccagcgacatccaggagatcgagctgagagtgaagagactgcaggagatcctgaaggccttcgacacctacaaggccctggtggtgagcgtgaacgtgagcagcaaggagttcctgcagaccgagagccccgagagcaccgagctgcagagcagactgagacagctgagcctgctgtgggaggccgcccagggcgccgtggacagctggagaggcggcctgagacagagcctgatgcagtgccagggcagcaagaccagacccagaagcgacgtgctgttcttcaaggacttccaccagctgagccagaacctgctgctgtggctggccagcgccaagaacagaagacagaaggcccacgtgaccgaccccaaggccgaccccagagccctgctggagtgcagaagagagctgatgcagctggagaaggagctggtggagagacagccccaggtggacatgctgcaggagatcagcaacagcctgctgatcaagggccacggcgaggactgcatcgaggccgaggagaaggtgcacgtgatcgagaagaagctgaagcagctgagagagcaggtgagccaggacctgatggccctgcagggcacccagaaccccgccagccccctgcccagcttcgacgaggtggacagcggcgaccagccccccgccaccagcgtgcccgcccccagagccaagcagttcagagccgtgagaaccaccgagggcgaggaggagaccgagagcagagtgcccggcagcaccagaccccagagaagcttcctgagcagagtggtgagagccgccctgcccctgcagctgctgctgctgctgctgctgctgctggcctgcctgctgcccagcagcgaggaggactacagctgcacccaggccaacaacttcgccagaagcttctaccccatgctgagatacaccaacggccccccccccacctag

SEQ ID NO: 100488 - DNA, 2007 bp, Artificial Sequence
  Description of Artificial Sequence: Synthetic coding sequence
atggtgcacgagggcaaccagagatgggacaacctgcagagaagagtgaccgccgtgctgagaagactgagacacttcaccaaccagagagaggagttcgagggcaccagagagagcatcctggtgtggctgaccgagatggacctgcagctgaccaacgtggagcacttcagcgagagcgacgccgacgacaagatgagacagctgaacggcttccagcaggagatcaccctgaacaccaacaagatcgaccagctgatcgtgttcggcgagcagctgatccagaagagcgagcccctggacgccgtgctgatcgaggacgagctggaggagctgcacagatactgccaggaggtgttcggcagagtgagcagattccacagaagactgaccagctgcacccccggcctggaggacgagaaggaggccagcgagaacgagaccgacatggaggaccccagagagatccagaccgacagctggagaaagagaggcgagagcgaggagcccagcagcccccagagcctgtgccacctggtggcccccggccacgagagaagcggctgcgagacccccgtgagcgtggacagcatccccctggagtgggaccacaccggcgacgtgggcggcagcagcagccacgaggaggacgaggagggcccctactacagcgccctgagcggcaagagcatcagcgacggccacagctggcacgtgcccgacagccccagctgccccgagcaccactacaagcagatggagggcgacagaaacgtgccccccgtgccccccgccagcagcaccccctacaagcccccctacggcaagctgctgctgccccccggcaccgacggcggcaaggagggccccagagtgctgaacggcaacccccagcaggaggacggcggcctggccggcatcaccgagcagcagagcggcgccttcgacagatgggagatgatccaggcccaggagctgcacaacaagctgaagatcaagcagaacctgcagcagctgaacagcgacatcagcgccatcaccacctggctgaagaagaccgaggccgagctggagatgctgaagatggccaagccccccagcgacatccaggagatcgagctgagagtgaagagactgcaggagatcctgaaggccttcgacacctacaaggccctggtggtgagcgtgaacgtgagcagcaaggagttcctgcagaccgagagccccgagagcaccgagctgcagagcagactgagacagctgagcctgctgtgggaggccgcccagggcgccgtggacagctggagaggcggcctgagacagagcctgatgcagtgccaggacttccaccagctgagccagaacctgctgctgtggctggccagcgccaagaacagaagacagaaggcccacgtgaccgaccccaaggccgaccccagagccctgctggagtgcagaagagagctgatgcagctggagaaggagctggtggagagacagccccaggtggacatgctgcaggagatcagcaacagcctgctgatcaagggccacggcgaggactgcatcgaggccgaggagaaggtgcacgtgatcgagaagaagctgaagcagctgagagagcaggtgagccaggacctgatggccctgcagggcacccagaaccccgccagccccctgcccagcttcgacgaggtggacagcggcgaccagccccccgccaccagcgtgcccgcccccagagccaagcagttcagagccgtgagaaccaccgagggcgaggaggagaccgagagcagagtgcccggcagcaccagaccccagagaagcttcctgagcagagtggtgagagccgccctgcccctgcagctgctgctgctgctgctgctgctgctggcctgcctgctgcccagcagcgaggaggactacagctgcacccaggccaacaacttcgccagaagcttctaccccatgctgagatacaccaacggccccccccccacctag

SEQ ID NO: 100489 - DNA, 10626 bp, Artificial Sequence
  Description of Artificial Sequence: Synthetic coding sequence
atggaggaggacatctacaccaacctgagcaagatggagaccgtgctgggccagagcatgagcagcctgcccctgagctacagagaggccctggagagactggagcagagcaaggccctggtgagcaacctgatcagcaccaaggaggagctgatgaagctgagacagatcctgagactgctgagactgagatgcaccgagaacgacggcatctgcctgctgaagatcgtgagcgccctgtgggagaagtggctgagcctgctggaggccgccaaggagtgggagatgtggtgcgaggagctgaagcaggagtggaagttcgtgagcgaggagatcgagagagaggccatcatcctggacaacctgcaggaggagctgcccgagatcagcaagaccaaggaggccgccaccaccgaggagctgagcgagctgctggactgcctgtgccagtacggcgagaacgtggagaagcagcagctgctgctgaccctgctgctgcagagaatcagaagcatccagaacgtgcccgagagcagcggcgccgtggagaccgtgcccgccttccaggagatcaccagcatgaaggagagatgcaacaagctgctgcagaaggtgcagaagaacaaggagctggtgcagaccgagatccaggagagacacagcttcaccaaggagatcatcgccctgaagaacttcttccagcagaccaccaccagcttccagaacatggccttccaggaccaccccgagaagagcgagcagttcgaggagctgcagagcatcctgaagaagggcaagctgaccttcgagaacatcatggagaagctgagaatcaagtacagcgagatgtacaccatcgtgcccgccgagatcgagagccaggtggaggagtgcagaaaggccctggaggacatcgacgagaagatcagcaacgaggtgctgaagagcagccccagctacgccatgagaagaaagatcgaggagatcaacaacggcctgcacaacgtggagaagatgctgcagcagaagagcaagaacatcgagaaggcccaggagatccagaagaagatgtgggacgagctggacctgtggcacagcaagctgaacgagctggacagcgaggtgcaggacatcgtggagcaggaccccggccaggcccaggagtggatggacaacctgatgatccccttccagcagtaccagcaggtgagccagagagccgagtgcagaaccagccagctgaacaaggccaccgtgaagatggaggagtacagcgacctgctgaagagcaccgaggcctggatcgagaacaccagccacctgctggccaaccccgccgactacgacagcctgagaaccctgagccaccacgccagcaccgtgcagatggccctggaggacagcgagcagaagcacaacctgctgcacagcatcttcatggacctggaggacctgagcatcatcttcgagaccgacgagctgacccagagcatccaggagctgagcaaccaggtgaccgccctgcagcagaagatcatggagagcctgccccagatccagagaatggccgacgacgtggtggccatcgagagcgaggtgaagagcatggagaagagagtgagcaagatcaagaccatcctgctgagcaaggagatcttcgacttcagccccgaggagcacctgaagcacggcgaggtgatcctggagaacatcagacccatgaagaagaccatcgccgagatcgtgagctaccaggtggagctgagactgccccagaccggcatgaagcccctgcccgtgttccagagaaccaaccagctgctgcaggacatcaagctgctggagaacgtgacccaggagcagaacgagctgctgaaggtggtgatcaagcagaccaacgagtgggacgaggagatcgagaacctgaagcagatcctgaacaactacagcgcccagttcagcctggagcacatgagccccgaccaggccgacaagctgccccagctgcagggcgagatcgagagaatggagaagcagatcctgagcctgaaccagagaaaggaggacctgctggtggacctgaaggccaccgtgctgaacctgcaccagcacctgaagcaggagcaggagggcgtggagagagacagactgcccgccgtgaccagcgaggagggcggcgtggccgagagagacgccagcgagagaaagctgaacagaagaggcagcatgagctacctggccgccgtggaggaggaggtggaggagagcagcgtgaagagcgacaacggcgacgagaaggccgagcccagcccccagagctggagcagcctgtggaagcacgacaaggacatggaggaggacagagccagcagcagcagcggcaccatcgtgcaggaggcctacggcaagatcagcaccagcgacaacagcatggcccagatcctgacccccgacagcctgaacaccgagcagggccccgagtgcagcctgagacccaaccagaccgaggagggcaccaccccccccatcgaggccgacaccctggacagcagcgacgcccagggcggcctggagcccagagtggagaagaccagacccgagcccaccgaggtgctgcacgcctgcaagacccaggtggccgagctggagctgtggctgcagcaggccaacgtggccgtggagcccgagaccctgaacgccgacatgcagcaggtgctggagcagcagctggtgggctgccaggccatgctgaccgagatcgagcacaaggtggccttcctgctggagacctgcaaggaccagggcctgggcgacaacggcgccacccagcacgaggccgaggccctgagcctgaagctgaagaccgtgaagtgcaacctggagaaggtgcagatgatgctgcaggagaagcacagcgaggaccagcaccccaccatcctgaagaagagcagcgagcccgagcaccaggaggccctgcagcccgtgaacctgagcgagctggagagcatcgtgaccgagagaccccagttcagcagacagaaggacttccagcagcagcaggtgctggagctgaagcccatggagcagaaggacttcatcaagttcatcgagttcaacgccaagaagatgtggccccagtactgccagcacgacaacgacaccacccaggagagcagcgccagcaaccaggccagcagccccgagaacgacgtgcccgacagcatcctgagcccccagggccagaacggcgacaagtggcagtacctgcaccacgagctgagcagcaagatcaagctgcccctgccccagctggtggagccccaggtgagcaccaacatgggcatcctgcccagcgtgaccatgtacaacttcagataccccaccaccgaggagctgaagacctacaccacccagctggaggacctgagacaggaggccagcaacctgcagacccaggagaacatgaccgaggaggcctacatcaacctggacaagaagctgttcgagctgttcctgaccctgagccagtgcctgagcagcgtggaggagatgctggagatgcccagactgtacagagaggacggcagcggccagcaggtgcactacgagaccctggccctggagctgaagaagctgtacctggccctgagcgacaagaagggcgacctgctgaaggccatgacctggcccggcgagaacaccaacctgctgctggagtgcttcgacaacctgcaggtgtgcctggagcacacccaggccgccgccgtgtgcagaagcaagagcctgaaggccggcctggactacaacagaagctaccagaacgagatcaagagactgtaccaccagctgatcaagagcaagaccagcctgcagcagagcctgaacgagatcagcggccagagcgtggccgagcagctgcagaaggccgacgcctacaccgtggagctggagaacgccgagagcagagtggccaagctgagagacgagggcgagagactgcacctgccctacgccctgctgcaggaggtgtacaagctggaggacgtgctggacagcatgtggggcatgctgagagccagatacaccgagctgagcagccccttcgtgaccgagagccagcaggacgccctgctgcagggcatggtggagctggtgaagatcggcaaggagaagctggcccacggccacctgaagcagaccaagagcaaggtggccctgcaggcccagatcgagaaccacaaggtgttcttccagaagctggtggccgacatgctgctgatccaggcctacagcgccaagatcctgcccagcctgctgcagaacagagagaccttctgggccgagcaggtgaccgaggtgaagatcctggaggagaagagcagacagtgcggcatgaagctgcagagcctgctgcagaagtgggaggagttcgacgagaactacgccagcctggagaaggacctggagatcctgatcagcaccctgcccagcgtgagcctggtggaggagaccgaggagagactggtggagagaatcagcttctaccagcagatcaagagaaacatcggcggcaagcacgccagactgtaccagaccctgaacgagggcaagcagctggtggccagcgtgagctgccccgagctggagggccagatcgccaagctggaggagcagtggctgagcctgaacaagaagatcgaccacgagctgcacagactgcaggccctgctgaagcacctgctgagctacaacagagacagcgaccagctgaccaagtggctggagagcagccagcacaccctgaactactggaaggagcagagcctgaacgtgagccaggacctggacaccatcagaagcaacatcaacaacttcttcgagttcagcaaggaggtggacgagaagagcagcctgaagaccgccgtgatcagcatcggcaaccagctgctgcacctgaaggagaccgacaccgccaccctgagagccagcctggcccagttcgagcagaagtggaccatgctgatcacccagctgcccgacatccaggagaagctgcaccagctgcagatggagaagctgcccagcagaaaggccatcaccgagatgatcagctggatgaacaacgtggagcaccagaccagcgacgaggacagcgtgcacagccccagcagcgccagccaggtgaagcacctgctgcagaagcacaaggagttcagaatggagatggactacaagcagtggatcgtggacttcgtgaaccagagcctgctgcagctgagcacctgcgacgtggagagcaagagatacgagagaaccgagttcgccgagcacctgggcgagatgaacagacagtggcacagagtgcacggcatgctgaacagaaagatccagcacctggagcagctgctggagagcatcaccgagagcgagaacaagatccagatcctgaacaactggctggaggcccaggaggagagactgaagaccctgcagaagcccgagagcgtgatcagcgtgcagaagctgctgctggactgccaggacatcgagaaccagctggccatcaagagcaaggccctggacgagctgaagcagagctacctgaccctggagagcggcgccgtgcccctgctggaggacaccgccagcagaatcgacgagctgttccagaagagaagcagcgtgctgacccaggtgaaccagctgaagaccagcatgcagagcgtgctgcaggagtggaagatctacgaccagctgtacgacgaggtgaacatgatgaccatcagattctggtactgcatggagcacagcaagcccgtggtgctgagcctggagaccctgagatgccaggtggagaacctgcagagcctgcaggacgaggccgagagcagcgagggcagctgggagaagctgcaggaggtgatcggcaagctgaagggcctgtgccccagcgtggccgagatcatcgaggagaagtgccagaacacccacaagagatggacccaggtgaaccaggccatcgccgaccagctgcagaaggcccagagcctgctgcagctgtggaaggcctacagcaacgcccacggcgaggccgccgccagactgaagcagcaggaggccaagttccagcagctggccaacatcagcatgagcggcaacaacctggccgagatcctgccccccgccctgcaggacatcaaggagctgcagcacgacgtgcagaagaccaaggaggccttcctgcagaacagcagcgtgctggacagactgccccagcccgccgagagcagcacccacatgctgctgcccggccccctgcacagcctgcagagagccgcctacctggagaagatgctgctggtgaaggccaacgagttcgagttcgtgctgagccagttcaaggacttcggcgtgagactggagagcctgaagggcctgatcatgcacgaggaggagaacctggacagactgcaccagcaggagaaggagaaccccgacagcttcctgaaccacgtgctggccctgaccgcccagagccccgacatcgagcacctgaacgaggtgagcctgaagctgcccctgagcgacgtggccgtgaagaccctgcagaacatgaacagacagtggatcagagccaccgccaccgccctggagagatgcagcgagctgcagggcatcggcctgaacgagaagttcctgtactgctgcgagaagtggatccagctgctggagaagatcgaggaggccctgaaggtggacgtggccaacagcctgcccgagctgctggagcagcagaagacctacaagatgctggaggccgaggtgagcatcaaccagaccatcgccgacagctacgtgacccagagcctgcagctgctggacaccaccgagatcgagaacagacccgagttcatcaccgagttcagcaagctgaccgacagatggcagaacgccgtgcagggcgtgagacagagaaagggcgacgtggacggcctggtgagacagtggcaggacttcaccaccagcgtggagaacctgttcagattcctgaccgacaccagccacctgctgagcgccgtgaagggccaggagagattcagcctgtaccagaccagaagcctgatccacgagctgaagaacaaggagatccacttccagagaagaagaaccacctgcgccctgaccctggaggccggcgagaagctgctgctgaccaccgacctgaagaccaaggagagcgtgggcagaagaatcagccagctgcaggacagctggaaggacatggagccccagctggccgagatgatcaagcagttccagagcaccgtggagacctgggaccagtgcgagaagaagatcaaggagctgaagagcagactgcaggtgctgaaggcccagagcgaggaccccctgcccgagctgcacgaggacctgcacaacgagaaggagctgatcaaggagctggagcagagcctggccagctggacccagaacctgaaggagctgcagaccatgaaggccgacctgaccagacacgtgctggtggaggacgtgatggtgctgaaggagcagatcgagcacctgcacagacagtgggaggacctgtgcctgagagtggccatcagaaagcaggagatcgaggacagactgaacacctgggtggtgttcaacgagaagaacaaggagctgtgcgcctggctggtgcagatggagaacaaggtgctgcagaccgccgacatcagcatcgaggagatgatcgagaagctgcagaaggactgcatggaggagatcaacctgttcagcgagaacaagctgcagctgaagcagatgggcgaccagctgatcaaggccagcaacaagagcagagccgccgagatcgacgacaagctgaacaagatcaacgacagatggcagcacctgttcgacgtgatcggcagcagagtgaagaagctgaaggagaccttcgccttcatccagcagctggacaagaacatgagcaacctgagaacctggctggccagaatcgagagcgagctgagcaagcccgtggtgtacgacgtgtgcgacgaccaggagatccagaagagactggccgagcagcaggacctgcagagagacatcgagcagcacagcgccggcgtggagagcgtgttcaacatctgcgacgtgctgctgcacgacagcgacgcctgcgccaacgagaccgagtgcgacagcatccagcagaccaccagaagcctggacagaagatggagaaacatctgcgccatgagcatggagagaagaatgaagatcgaggagacctggagactgtggcagaagttcctggacgactacagcagattcgaggactggctgaagagcgccgagagaaccgccgcctgccccaacagcagcgaggtgctgtacaccagcgccaaggaggagctgaagagattcgaggccttccagagacagatccacgagagactgacccagctggagctgatcaacaagcagtacagaagactggccagagagaacagaaccgacaccgccagcagactgaagcagatggtgcacgagggcaaccagagatgggacaacctgcagagaagagtgaccgccgtgctgagaagactgagacacttcaccaaccagagagaggagttcgagggcaccagagagagcatcctggtgtggctgaccgagatggacctgcagctgaccaacgtggagcacttcagcgagagcgacgccgacgacaagatgagacagctgaacggcttccagcaggagatcaccctgaacaccaacaagatcgaccagctgatcgtgttcggcgagcagctgatccagaagagcgagcccctggacgccgtgctgatcgaggacgagctggaggagctgcacagatactgccaggaggtgttcggcagagtgagcagattccacagaagactgaccagctgcacccccggcctggaggacgagaaggaggccagcgagaacgagaccgacatggaggaccccagagagatccagaccgacagctggagaaagagaggcgagagcgaggagcccagcagcccccagagcctgtgccacctggtggcccccggccacgagagaagcggctgcgagacccccgtgagcgtggacagcatccccctggagtgggaccacaccggcgacgtgggcggcagcagcagccacgaggaggacgaggagggcccctactacagcgccctgagcgacgtggagatccccgagaaccccgaggcctacctgaagatgaccaccaagaccctgaaggccagcagcggcaagagcatcagcgacggccacagctggcacgtgcccgacagccccagctgccccgagcaccactacaagcagatggagggcgacagaaacgtgccccccgtgccccccgccagcagcaccccctacaagcccccctacggcaagctgctgctgccccccggcaccgacggcggcaaggagggccccagagtgctgaacggcaacccccagcaggaggacggcggcctggccggcatcaccgagcagcagagcggcgccttcgacagatgggagatgatccaggcccaggagctgcacaacaagctgaagatcaagcagaacctgcagcagctgaacagcgacatcagcgccatcaccacctggctgaagaagaccgaggccgagctggagatgctgaagatggccaagccccccagcgacatccaggagatcgagctgagagtgaagagactgcaggagatcctgaaggccttcgacacctacaaggccctggtggtgagcgtgaacgtgagcagcaaggagttcctgcagaccgagagccccgagagcaccgagctgcagagcagactgagacagctgagcctgctgtgggaggccgcccagggcgccgtggacagctggagaggcggcctgagacagagcctgatgcagtgccaggacttccaccagctgagccagaacctgctgctgtggctggccagcgccaagaacagaagacagaaggcccacgtgaccgaccccaaggccgaccccagagccctgctggagtgcagaagagagctgatgcagctggagaaggagctggtggagagacagccccaggtggacatgctgcaggagatcagcaacagcctgctgatcaagggccacggcgaggactgcatcgaggccgaggagaaggtgcacgtgatcgagaagaagctgaagcagctgagagagcaggtgagccaggacctgatggccctgcagggcacccagaaccccgccagccccctgcccagcttcgacgaggtggacagcggcgaccagccccccgccaccagcgtgcccgcccccagagccaagttcagagccgtgagaaccaccgagggcgaggaggagaccgagagcagagtgcccggcagcaccagaccccagagaagcttcctgagcagagtggtgagagccgccctgcccctgcagctgctgctgctgctgctgctgctgctggcctgcctgctgcccagcagcgaggaggactacagctgcacccaggccaacaacttcgccagaagcttctaccccatgctgagatacaccaacggccccccccccacctag

SEQ ID NO: 100490 - DNA, 2292 bp, Artificial Sequence
  Description of Artificial Sequence: Synthetic coding sequence
atgagcatggagagaagaatgaagatcgaggagacctggagactgtggcagaagttcctggacgactacagcagattcgaggactggctgaagagcgccgagagaaccgccgcctgccccaacagcagcgaggtgctgtacaccagcgccaaggaggagctgaagagattcgaggccttccagagacagatccacgagagactgacccagctggagctgatcaacaagcagtacagaagactggccagagagaacagaaccgacaccgccagcagactgaagcagatggtgcacgagggcaaccagagatgggacaacctgcagagaagagtgaccgccgtgctgagaagactgagacacttcaccaaccagagagaggagttcgagggcaccagagagagcatcctggtgtggctgaccgagatggacctgcagctgaccaacgtggagcacttcagcgagagcgacgccgacgacaagatgagacagctgaacggcttccagcaggagatcaccctgaacaccaacaagatcgaccagctgatcgtgttcggcgagcagctgatccagaagagcgagcccctggacgccgtgctgatcgaggacgagctggaggagctgcacagatactgccaggaggtgttcggcagagtgagcagattccacagaagactgaccagctgcacccccggcctggaggacgagaaggaggccagcgagaacgagaccgacatggaggaccccagagagatccagaccgacagctggagaaagagaggcgagagcgaggagcccagcagcccccagagcctgtgccacctggtggcccccggccacgagagaagcggctgcgagacccccgtgagcgtggacagcatccccctggagtgggaccacaccggcgacgtgggcggcagcagcagccacgaggaggacgaggagggcccctactacagcgccctgagcggcaagagcatcagcgacggccacagctggcacgtgcccgacagccccagctgccccgagcaccactacaagcagatggagggcgacagaaacgtgccccccgtgccccccgccagcagcaccccctacaagcccccctacggcaagctgctgctgccccccggcaccgacggcggcaaggagggccccagagtgctgaacggcaacccccagcaggaggacggcggcctggccggcatcaccgagcagcagagcggcgccttcgacagatgggagatgatccaggcccaggagctgcacaacaagctgaagatcaagcagaacctgcagcagctgaacagcgacatcagcgccatcaccacctggctgaagaagaccgaggccgagctggagatgctgaagatggccaagccccccagcgacatccaggagatcgagctgagagtgaagagactgcaggagatcctgaaggccttcgacacctacaaggccctggtggtgagcgtgaacgtgagcagcaaggagttcctgcagaccgagagccccgagagcaccgagctgcagagcagactgagacagctgagcctgctgtgggaggccgcccagggcgccgtggacagctggagaggcggcctgagacagagcctgatgcagtgccaggacttccaccagctgagccagaacctgctgctgtggctggccagcgccaagaacagaagacagaaggcccacgtgaccgaccccaaggccgaccccagagccctgctggagtgcagaagagagctgatgcagctggagaaggagctggtggagagacagccccaggtggacatgctgcaggagatcagcaacagcctgctgatcaagggccacggcgaggactgcatcgaggccgaggagaaggtgcacgtgatcgagaagaagctgaagcagctgagagagcaggtgagccaggacctgatggccctgcagggcacccagaaccccgccagccccctgcccagcttcgacgaggtggacagcggcgaccagccccccgccaccagcgtgcccgcccccagagccaagcagttcagagccgtgagaaccaccgagggcgaggaggagaccgagagcagagtgcccggcagcaccagaccccagagaagcttcctgagcagagtggtgagagccgccctgcccctgcagctgctgctgctgctgctgctgctgctggcctgcctgctgcccagcagcgaggaggactacagctgcacccaggccaacaacttcgccagaagcttctaccccatgctgagatacaccaacggccccccccccacctag

SEQ ID NO: 100491 - DNA, 7251 bp, Artificial Sequence
  Description of Artificial Sequence: Synthetic coding sequence
atggagcagttccccaaggagaccgtggtggagagcagcggccccaaggtgctggagaccgccgaggagatccaggagagaagacaggaggtgctgaccagataccagagcttcaaggagagagtggccgagagaggccagaagctggaggacagctaccacctgcaggtgttcaagagagacgccgacgacctgggcaagtggatcatggagaaggtgaacatcctgaccgacaagagctacgaggaccccaccaacatccagggcaagtaccagaagcaccagagcctggaggccgaggtgcagaccaagagcagactgatgagcgagctggagaagaccagagaggagagattcaccatgggccacagcgcccacgaggagaccaaggcccacatcgaggagctgagacacctgtgggacctgctgctggagctgaccctggagaagggcgaccagctgctgagagccctgaagttccagcagtacgtgcaggagtgcgccgacatcctggagtggatcggcgacaaggaggccatcgccaccagcgtggagctgggcgaggactgggagagaaccgaggtgctgcacaagaagttcgaggacttccaggtggagctggtggccaaggagggcagagtggtggaggtgaaccagtacgccaacgagtgcgccgaggagaaccaccccgacctgcccctgatccagagcaagcagaacgaggtgaacgccgcctgggagagactgagaggcctggccctgcagagacagaaggccctgagcaacgccgccaacctgcagagattcaagagagacgtgaccgaggccatccagtggatcaaggagaaggagcccgtgctgaccagcgaggactacggcaaggacctggtggccagcgagggcctgttccacagccacaagggcctggagagaaacctggccgtgatgagcgacaaggtgaaggagctgtgcgccaaggccgagaagctgaccctgagccaccccagcgacgccccccagatccaggagatgaaggaggacctggtgagcagctgggagcacatcagagccctggccaccagcagatacgagaagctgcaggccacctactggtaccacagattcagcagcgacttcgacgagctgagcggctggatgaacgagaagaccgccgccatcaacgccgacgagctgcccaccgacgtggccggcggcgaggtgctgctggacagacaccagcagcacaagcacgagatcgacagctacgacgacagattccagagcgccgacgagaccggccaggacctggtgaacgccaaccacgaggccagcgacgaggtgagagagaagatggagatcctggacaacaactggaccgccctgctggagctgtgggacgagagacacagacagtacgagcagtgcctggacttccacctgttctacagagacagcgagcaggtggacagctggatgagcagacaggaggccttcctggagaacgaggacctgggcaacagcctgggcagcgccgaggccctgctgcagaagcacgaggacttcgaggaggccttcaccgcccaggaggagaagatcatcaccgtggacaagaccgccaccaagctgatcggcgacgaccactacgacagcgagaacatcaaggccatcagagacggcctgctggccagaagagacgccctgagagagaaggccgccaccagaagaagactgctgaaggagagcctgctgctgcagaagctgtacgaggacagcgacgacctgaagaactggatcaacaagaagaagaagctggccgacgacgaggactacaaggacatccagaacctgaagagcagagtgcagaagcagcaggtgttcgagaaggagctggccgtgaacaagacccagctggagaacatccagaagaccggccaggagatgatcgagggcggccactacgccagcgacaacgtgaccaccagactgagcgaggtggccagcctgtgggaggagctgctggaggccaccaagcagaagggcacccagctgcacgaggccaaccagcagctgcagttcgagaacaacgccgaggacctgcagagatggctggaggacgtggagtggcaggtgaccagcgaggactacggcaagggcctggccgaggtgcagaacagactgagaaagcacggcctgctggagagcgccgtggccgccagacaggaccaggtggacatcctgaccgacctggccgcctacttcgaggagatcggccaccccgacagcaaggacatcagagccagacaggagagcctggtgtgcagattcgaggccctgaaggagcccctggccaccagaaagaagaagctgctggacctgctgcacctgcagctgatctgcagagacaccgaggacgaggaggcctggatccaggagaccgagcccagcgccaccagcacctacctgggcaaggacctgatcgccagcaagaagctgctgaacagacacagagtgatcctggagaacatcgccagccacgagcccagaatccaggagatcaccgagagaggcaacaagatggtggaggagggccacttcgccgccgaggacgtggccagcagagtgaagagcctgaaccagaacatggagagcctgagagccagagccgccagaagacagaacgacctggaggccaacgtgcagttccagcagtacctggccgacctgcacgaggccgagacctggatcagagagaaggagcccatcgtggacaacaccaactacggcgccgacgaggaggccgccggcgccctgctgaagaagcacgaggccttcctgctggacctgaacagcttcggcgacagcatgaaggccctgagaaaccaggccaacgcctgccagcagcagcaggccgcccccgtggagggcgtggccggcgagcagagagtgatggccctgtacgacttccaggccagaagccccagagaggtgaccatgaagaagggcgacgtgctgaccctgctgagcagcatcaacaaggactggtggaaggtggaggccgccgaccaccagggcatcgtgcccgccgtgtacgtgagaagactggcccacgacgagttccccatgctgccccagagaagaagagaggagcccggcaacatcacccagagacaggagcagatcgagaaccagtacagaagcctgctggacagagccgaggagagaagaagaagactgctgcagagatacaacgagttcctgctggcctacgaggccggcgacatgctggagtggatccaggagaagaaggccgagaacaccggcgtggagctggacgacgtgtgggagctgcagaagaagttcgacgagttccagaaggacctgaacaccaacgagcccagactgagagacatcaacaaggtggccgacgacctgctgttcgagggcctgctgacccccgagggcgcccagatcagacaggagctgaacagcagatggggcagcctgcagagactggccgacgagcagagacagctgctgggcagcgcccacgccgtggaggtgttccacagagaggccgacgacaccaaggagcagatcgagaagaagtgccaggccctgagcgccgccgaccccggcagcgacctgttcagcgtgcaggccctgcagagaagacacgagggcttcgagagagacctggtgcccctgggcgacaaggtgaccatcctgggcgagaccgccgagagactgagcgagagccaccccgacgccaccgaggacctgcagagacagaagatggagctgaacgaggcctgggaggacctgcagggcagaaccaaggacagaaaggagagcctgaacgaggcccagaagttctacctgttcctgagcaaggccagagacctgcagaactggatcagcagcatcggcggcatggtgagcagccaggagctggccgaggacctgaccggcatcgagatcctgctggagagacaccaggagcacagagccgacatggaggccgaggcccccaccttccaggccctggaggacttcagcgccgagctgatcgacagcggccaccacgccagccccgagatcgagaagaagctgcaggccgtgaagctggagagagacgacctggagaaggcctgggagaagagaaagaagatcctggaccagtgcctggagctgcagatgttccagggcaactgcgaccaggtggagagctggatggtggccagagagaacagcctgagaagcgacgacaagagcagcctggacagcctggaggccctgatgaagaagagagacgacctggacaaggccatcaccgcccaggagggcaagatcaccgacctggagcacttcgccgagagcctgatcgccgacgagcactacgccaaggaggagatcgccaccagactgcagagagtgctggacagatggaaggccctgaaggcccagctgatcgacgagagaaccaagctgggcgactacgccaacctgaagcagttctacagagacctggaggagctggaggagtggatcagcgagatgctgcccaccgcctgcgacgagagctacaaggacgccaccaacatccagagaaagtacctgaagcaccagaccttcgcccacgaggtggacggcagaagcgagcaggtgcacggcgtgatcaacctgggcaacagcctgatcgagtgcagcgcctgcgacggcaacgaggaggccatgaaggagcagctggagcagctgaaggagcactgggaccacctgctggagagaaccaacgacaagggcaagaagctgaacgaggccagcagacagcagagattcaacaccagcatcagagacttcgagttctggctgagcgaggccgagaccctgctggccatgaaggaccaggccagagacctggccagcgccggcaacctgctgaagaagcaccagctgctggagagagagatgctggccagagaggacgccctgaaggacctgaacaccctggccgaggacctgctgagcagcggcaccttcaacgtggaccagatcgtgaagaagaaggacaacgtgaacaagagattcctgaacgtgcaggagctggccgccgcccaccacgagaagctgaaggaggcctacgccctgttccagttcttccaggacctggacgacgaggagagctggatcgaggagaagctgatcagagtgagcagccaggactacggcagagacctgcagggcgtgcagaacctgctgaagaagcacaagagactggagggcgagctggtggcccacgagcccgccatccagaacgtgctggacatggccgagaagctgaaggacaaggccgccgtgggccaggaggagatccagctgagactggcccagttcgtggagcactgggagaagctgaaggagctggccaaggccagaggcctgaagctggaggagagcctggagtacctgcagttcatgcagaacgccgaggaggaggaggcctggatcaacgagaagaacgccctggccgtgagaggcgactgcggcgacaccctggccgccacccagagcctgctgatgaagcacgaggccctggagaacgacttcgccgtgcacgagaccagagtgcagaacgtgtgcgcccagggcgaggacatcctgaacaaggaggagagccagaacaaggagatcagcagcaagatcgaggccctgaacgagaagacccccagcctggccaaggccatcgccgcctggaagctgcagctggaggacgactacgccttccaggagttcaactggaaggccgacgtggtggaggcctggatcgccgacaaggagaccagcctgaagaccaacggcaacggcgccgacctgggcgacttcctgaccctgctggccaagcaggacaccctggacgccagcctgcagagcttccagcaggagagactgcccgagatcaccgacctgaaggacaagctgatcagcgcccagcacaaccagagcaaggccatcgaggagagatacgccgccctgctgaagagatgggagcagctgctggaggccagcgccgtgcacagacagaagctgctggagaagcagctgcccctgcagaaggccgaggacctgttcgtggagttcgcccacaaggccagcgccctgaacaactggtgcgagaagatggaggagaacctgagcgagcccgtgcactgcgtgagcctgaacgagatcagacagctgcagaaggaccacgaggacttcctggccagcctggccagagcccaggccgacttcaagtgcctgctggagctggaccagcagatcaaggccctgggcgtgcccagcagcccctacacctggctgaccgtggaggtgctggagagaacctggaagcacctgagcgacatcatcgaggagagagagcaggagctgcagaaggaggaggccagacaggtgaagaacttcgagatgtgccaggagttcgagcagaacgccagcaccttcctgcagtggatcctggagaccagagcctacttcctggacggcagcctgctgaaggagaccggcaccctggagagccagctggaggccaacaagagaaagcagaaggagatccaggccatgaagagacagctgaccaagatcgtggacctgggcgacaacctggaggacgccctgatcctggacatcaagtacagcaccatcggcctggcccagcagtgggaccagctgtaccagctgggcctgagaatgcagcacaacctggagcagcagatccaggccaaggacatcaagggcgtgagcgaggagaccctgaaggagttcagcaccatctacaagcacttcgacgagaacctgaccggcagactgacccacaaggagttcagaagctgcctgagaggcctgaactactacctgcccatggtggaggaggacgagcacgagcccaagttcgagaagttcctggacgccgtggaccccggcagaaagggctacgtgagcctggaggactacaccgccttcctgatcgacaaggagagcgagaacatcaagagcagcgacgagatcgagaacgccttccaggccctggccgagggcaagagctacatcaccaaggaggacatgaagcaggccctgacccccgagcaggtgagcttctgcgccacccacatgcagcagtacatggaccccagaggcagaagccacctgagcggctacgactacgtgggcttcaccaacagctacttcggcaactag

SEQ ID NO: 100492 - DNA, 7260 bp, Artificial Sequence
  Description of Artificial Sequence: Synthetic coding sequence
atggagcagttccccaaggagaccgtggtggagagcagcggccccaaggtgctggagaccgccgaggagatccaggagagaagacaggaggtgctgaccagataccagagcttcaaggagagagtggccgagagaggccagaagctggaggacagctaccacctgcaggtgttcaagagagacgccgacgacctgggcaagtggatcatggagaaggtgaacatcctgaccgacaagagctacgaggaccccaccaacatccagggcaagtaccagaagcaccagagcctggaggccgaggtgcagaccaagagcagactgatgagcgagctggagaagaccagagaggagagattcaccatgggccacagcgcccacgaggagaccaaggcccacatcgaggagctgagacacctgtgggacctgctgctggagctgaccctggagaagggcgaccagctgctgagagccctgaagttccagcagtacgtgcaggagtgcgccgacatcctggagtggatcggcgacaaggaggccatcgccaccagcgtggagctgggcgaggactgggagagaaccgaggtgctgcacaagaagttcgaggacttccaggtggagctggtggccaaggagggcagagtggtggaggtgaaccagtacgccaacgagtgcgccgaggagaaccaccccgacctgcccctgatccagagcaagcagaacgaggtgaacgccgcctgggagagactgagaggcctggccctgcagagacagaaggccctgagcaacgccgccaacctgcagagattcaagagagacgtgaccgaggccatccagtggatcaaggagaaggagcccgtgctgaccagcgaggactacggcaaggacctggtggccagcgagggcctgttccacagccacaagggcctggagagaaacctggccgtgatgagcgacaaggtgaaggagctgtgcgccaaggccgagaagctgaccctgagccaccccagcgacgccccccagatccaggagatgaaggaggacctggtgagcagctgggagcacatcagagccctggccaccagcagatacgagaagctgcaggccacctactggtaccacagattcagcagcgacttcgacgagctgagcggctggatgaacgagaagaccgccgccatcaacgccgacgagctgcccaccgacgtggccggcggcgaggtgctgctggacagacaccagcagcacaagcacgagatcgacagctacgacgacagattccagagcgccgacgagaccggccaggacctggtgaacgccaaccacgaggccagcgacgaggtgagagagaagatggagatcctggacaacaactggaccgccctgctggagctgtgggacgagagacacagacagtacgagcagtgcctggacttccacctgttctacagagacagcgagcaggtggacagctggatgagcagacaggaggccttcctggagaacgaggacctgggcaacagcctgggcagcgccgaggccctgctgcagaagcacgaggacttcgaggaggccttcaccgcccaggaggagaagatcatcaccgtggacaagaccgccaccaagctgatcggcgacgaccactacgacagcgagaacatcaaggccatcagagacggcctgctggccagaagagacgccctgagagagaaggccgccaccagaagaagactgctgaaggagagcctgctgctgcagaagctgtacgaggacagcgacgacctgaagaactggatcaacaagaagaagaagctggccgacgacgaggactacaaggacatccagaacctgaagagcagagtgcagaagcagcaggtgttcgagaaggagctggccgtgaacaagacccagctggagaacatccagaagaccggccaggagatgatcgagggcggccactacgccagcgacaacgtgaccaccagactgagcgaggtggccagcctgtgggaggagctgctggaggccaccaagcagaagggcacccagctgcacgaggccaaccagcagctgcagttcgagaacaacgccgaggacctgcagagatggctggaggacgtggagtggcaggtgaccagcgaggactacggcaagggcctggccgaggtgcagaacagactgagaaagcacggcctgctggagagcgccgtggccgccagacaggaccaggtggacatcctgaccgacctggccgcctacttcgaggagatcggccaccccgacagcaaggacatcagagccagacaggagagcctggtgtgcagattcgaggccctgaaggagcccctggccaccagaaagaagaagctgctggacctgctgcacctgcagctgatctgcagagacaccgaggacgaggaggcctggatccaggagaccgagcccagcgccaccagcacctacctgggcaaggacctgatcgccagcaagaagctgctgaacagacacagagtgatcctggagaacatcgccagccacgagcccagaatccaggagatcaccgagagaggcaacaagatggtggaggagggccacttcgccgccgaggacgtggccagcagagtgaagagcctgaaccagaacatggagagcctgagagccagagccgccagaagacagaacgacctggaggccaacgtgcagttccagcagtacctggccgacctgcacgaggccgagacctggatcagagagaaggagcccatcgtggacaacaccaactacggcgccgacgaggaggccgccggcgccctgctgaagaagcacgaggccttcctgctggacctgaacagcttcggcgacagcatgaaggccctgagaaaccaggccaacgcctgccagcagcagcaggccgcccccgtggagggcgtggccggcgagcagagagtgatggccctgtacgacttccaggccagaagccccagagaggtgaccatgaagaagggcgacgtgctgaccctgctgagcagcatcaacaaggactggtggaaggtggaggccgccgaccaccagggcatcgtgcccgccgtgtacgtgagaagactggcccacgacgagttccccatgctgccccagagaagaagagaggagcccggcaacatcacccagagacaggagcagatcgagaaccagtacagaagcctgctggacagagccgaggagagaagaagaagactgctgcagagatacaacgagttcctgctggcctacgaggccggcgacatgctggagtggatccaggagaagaaggccgagaacaccggcgtggagctggacgacgtgtgggagctgcagaagaagttcgacgagttccagaaggacctgaacaccaacgagcccagactgagagacatcaacaaggtggccgacgacctgctgttcgagggcctgctgacccccgagggcgcccagatcagacaggagctgaacagcagatggggcagcctgcagagactggccgacgagcagagacagctgctgggcagcgcccacgccgtggaggtgttccacagagaggccgacgacaccaaggagcagatcgagaagaagtgccaggccctgagcgccgccgaccccggcagcgacctgttcagcgtgcaggccctgcagagaagacacgagggcttcgagagagacctggtgcccctgggcgacaaggtgaccatcctgggcgagaccgccgagagactgagcgagagccaccccgacgccaccgaggacctgcagagacagaagatggagctgaacgaggcctgggaggacctgcagggcagaaccaaggacagaaaggagagcctgaacgaggcccagaagttctacctgttcctgagcaaggccagagacctgcagaactggatcagcagcatcggcggcatggtgagcagccaggagctggccgaggacctgaccggcatcgagatcctgctggagagacaccaggagcacagagccgacatggaggccgaggcccccaccttccaggccctggaggacttcagcgccgagctgatcgacagcggccaccacgccagccccgagatcgagaagaagctgcaggccgtgaagctggagagagacgacctggagaaggcctgggagaagagaaagaagatcctggaccagtgcctggagctgcagatgttccagggcaactgcgaccaggtggagagctggatggtggccagagagaacagcctgagaagcgacgacaagagcagcctggacagcctggaggccctgatgaagaagagagacgacctggacaaggccatcaccgcccaggagggcaagatcaccgacctggagcacttcgccgagagcctgatcgccgacgagcactacgccaaggaggagatcgccaccagactgcagagagtgctggacagatggaaggccctgaaggcccagctgatcgacgagagaaccaagctgggcgactacgccaacctgaagcagttctacagagacctggaggagctggaggagtggatcagcgagatgctgcccaccgcctgcgacgagagctacaaggacgccaccaacatccagagaaagtacctgaagcaccagaccttcgcccacgaggtggacggcagaagcgagcaggtgcacggcgtgatcaacctgggcaacagcctgatcgagtgcagcgcctgcgacggcaacgaggaggccatgaaggagcagctggagcagctgaaggagcactgggaccacctgctggagagaaccaacgacaagggcaagaagctgaacgaggccagcagacagcagagattcaacaccagcatcagagacttcgagttctggctgagcgaggccgagaccctgctggccatgaaggaccaggccagagacctggccagcgccggcaacctgctgaagaagcaccagctgctggagagagagatgctggccagagaggacgccctgaaggacctgaacaccctggccgaggacctgctgagcagcggcaccttcaacgtggaccagatcgtgaagaagaaggacaacgtgaacaagagattcctgaacgtgcaggagctggccgccgcccaccacgagaagctgaaggaggcctacgccctgttccagttcttccaggacctggacgacgaggagagctggatcgaggagaagctgatcagagtgagcagccaggactacggcagagacctgcagggcgtgcagaacctgctgaagaagcacaagagactggagggcgagctggtggcccacgagcccgccatccagaacgtgctggacatggccgagaagctgaaggacaaggccgccgtgggccaggaggagatccagctgagactggcccagttcgtggagcactgggagaagctgaaggagctggccaaggccagaggcctgaagctggaggagagcctggagtacctgcagttcatgcagaacgccgaggaggaggaggcctggatcaacgagaagaacgccctggccgtgagaggcgactgcggcgacaccctggccgccacccagagcctgctgatgaagcacgaggccctggagaacgacttcgccgtgcacgagaccagagtgcagaacgtgtgcgcccagggcgaggacatcctgaacaaggtgctgcaggaggagagccagaacaaggagatcagcagcaagatcgaggccctgaacgagaagacccccagcctggccaaggccatcgccgcctggaagctgcagctggaggacgactacgccttccaggagttcaactggaaggccgacgtggtggaggcctggatcgccgacaaggagaccagcctgaagaccaacggcaacggcgccgacctgggcgacttcctgaccctgctggccaagcaggacaccctggacgccagcctgcagagcttccagcaggagagactgcccgagatcaccgacctgaaggacaagctgatcagcgcccagcacaaccagagcaaggccatcgaggagagatacgccgccctgctgaagagatgggagcagctgctggaggccagcgccgtgcacagacagaagctgctggagaagcagctgcccctgcagaaggccgaggacctgttcgtggagttcgcccacaaggccagcgccctgaacaactggtgcgagaagatggaggagaacctgagcgagcccgtgcactgcgtgagcctgaacgagatcagacagctgcagaaggaccacgaggacttcctggccagcctggccagagcccaggccgacttcaagtgcctgctggagctggaccagcagatcaaggccctgggcgtgcccagcagcccctacacctggctgaccgtggaggtgctggagagaacctggaagcacctgagcgacatcatcgaggagagagagcaggagctgcagaaggaggaggccagacaggtgaagaacttcgagatgtgccaggagttcgagcagaacgccagcaccttcctgcagtggatcctggagaccagagcctacttcctggacggcagcctgctgaaggagaccggcaccctggagagccagctggaggccaacaagagaaagcagaaggagatccaggccatgaagagacagctgaccaagatcgtggacctgggcgacaacctggaggacgccctgatcctggacatcaagtacagcaccatcggcctggcccagcagtgggaccagctgtaccagctgggcctgagaatgcagcacaacctggagcagcagatccaggccaaggacatcaagggcgtgagcgaggagaccctgaaggagttcagcaccatctacaagcacttcgacgagaacctgaccggcagactgacccacaaggagttcagaagctgcctgagaggcctgaactactacctgcccatggtggaggaggacgagcacgagcccaagttcgagaagttcctggacgccgtggaccccggcagaaagggctacgtgagcctggaggactacaccgccttcctgatcgacaaggagagcgagaacatcaagagcagcgacgagatcgagaacgccttccaggccctggccgagggcaagagctacatcaccaaggaggacatgaagcaggccctgacccccgagcaggtgagcttctgcgccacccacatgcagcagtacatggaccccagaggcagaagccacctgagcggctacgactacgtgggcttcaccaacagctacttcggcaactag

SEQ ID NO: 100493 - DNA, 7434 bp, Artificial Sequence
  Description of Artificial Sequence: Synthetic coding sequence
atggaccccagcggcgtgaaggtgctggagaccgccgaggacatccaggagagaagacagcaggtgctggacagataccacagattcaaggagctgagcaccctgagaagacagaagctggaggacagctacagattccagttcttccagagagacgccgaggagctggagaagtggatccaggagaagctgcagatcgccagcgacgagaactacaaggaccccaccaacctgcagggcaagctgcagaagcaccaggccttcgaggccgaggtgcaggccaacagcggcgccatcgtgaagctggacgagaccggcaacctgatgatcagcgagggccacttcgccagcgagaccatcagaaccagactgatggagctgcacagacagtgggagctgctgctggagaagatgagagagaagggcatcaagctgctgcaggcccagaagctggtgcagtacctgagagagtgcgaggacgtgatggactggatcaacgacaaggaggccatcgtgaccagcgaggagctgggccaggacctggagcacgtggaggtgctgcagaagaagttcgaggagttccagaccgacatggccgcccacgaggagagagtgaacgaggtgaaccagttcgccgccaagctgatccaggagcagcaccccgaggaggagctgatcaagaccaagcaggacgaggtgaacgccgcctggcagagactgaagggcctggccctgcagagacagggcaagctgttcggcgccgccgaggtgcagagattcaacagagacgtggacgagaccatcagctggatcaaggagaaggagcagctgatggccagcgacgacttcggcagagacctggccagcgtgcaggccctgctgagaaagcacgagggcctggagagagacctggccgccctggaggacaaggtgaaggccctgtgcgccgaggccgacagactgcagcagagccaccccctgagcgccacccagatccaggtgaagagagaggagctgatcaccaactgggagcagatcagaaccctggccgccgagagacacgccagactgaacgacagctacagactgcagagattcctggccgacttcagagacctgaccagctgggtgaccgagatgaaggccctgatcaacgccgacgagctggccagcgacgtggccggcgccgaggccctgctggacagacaccaggagcacaagggcgagatcgacgcccacgaggacagcttcaagagcgccgacgagagcggccaggccctgctggccgccggccactacgccagcgacgaggtgagagagaagctgaccgtgctgagcgaggagagagccgccctgctggagctgtgggagctgagaagacagcagtacgagcagtgcatggacctgcagctgttctacagagacaccgagcaggtggacaactggatgagcaagcaggaggccttcctgctgaacgaggacctgggcgacagcctggacagcgtggaggccctgctgaagaagcacgaggacttcgagaagagcctgagcgcccaggaggagaagatcaccgccctggacgagttcgccaccaagctgatccagaacaaccactacgccatggaggacgtggccaccagaagagacgccctgctgagcagaagaaacgccctgcacgagagagccatgagaagaagagcccagctggccgacagcttccacctgcagcagttcttcagagacagcgacgagctgaagagctgggtgaacgagaagatgaagaccgccaccgacgaggcctacaaggaccccagcaacctgcagggcaaggtgcagaagcaccaggccttcgaggccgagctgagcgccaaccagagcagaatcgacgccctggagaaggccggccagaagctgatcgacgtgaaccactacgccaaggacgaggtggccgccagaatgaacgaggtgatcagcctgtggaagaagctgctggaggccaccgagctgaagggcatcaagctgagagaggccaaccagcagcagcagttcaacagaaacgtggaggacatcgagctgtggctgtacgaggtggagggccacctggccagcgacgactacggcaaggacctgaccaacgtgcagaacctgcagaagaagcacgccctgctggaggccgacgtggccgcccaccaggacagaatcgacggcatcaccatccaggccagacagttccaggacgccggccacttcgacgccgagaacatcaagaagaagcaggaggccctggtggccagatacgaggccctgaaggagcccatggtggccagaaagcagaagctggccgacagcctgagactgcagcagctgttcagagacgtggaggacgaggagacctggatcagagagaaggagcccatcgccgccagcaccaacagaggcaaggacctgatcggcgtgcagaacctgctgaagaagcaccaggccctgcaggccgagatcgccggccacgagcccagaatcaaggccgtgacccagaagggcaacgccatggtggaggagggccacttcgccgccgaggacgtgaaggccaagctgcacgagctgaaccagaagtgggaggccctgaaggccaaggccagccagagaagacaggacctggaggacagcctgcaggcccagcagtacttcgccgacgccaacgaggccgagagctggatgagagagaaggagcccatcgtgggcagcaccgactacggcaaggacgaggacagcgccgaggccctgctgaagaagcacgaggccctgatgagcgacctgagcgcctacggcagcagcatccaggccctgagagagcaggcccagagctgcagacagcaggtggcccccaccgacgacgagaccggcaaggagctggtgctggccctgtacgactaccaggagaagagccccagagaggtgaccatgaagaagggcgacatcctgaccctgctgaacagcaccaacaaggactggtggaaggtggaggtgaacgacagacagggcttcgtgcccgccgcctacgtgaagaagctggaccccgcccagagcgccagcagagagaacctgctggaggagcagggcagcatcgccctgagacaggagcagatcgacaaccagaccagaatcaccaaggaggccggcagcgtgagcctgagaatgaagcaggtggaggagctgtaccacagcctgctggagctgggcgagaagagaaagggcatgctggagaagagctgcaagaagttcatgctgttcagagaggccaacgagctgcagcagtggatcaacgagaaggaggccgccctgaccagcgaggaggtgggcgccgacctggagcaggtggaggtgctgcagaagaagttcgacgacttccagaaggacctgaaggccaacgagagcagactgaaggacatcaacaaggtggccgaggacctggagagcgagggcctgatggccgaggaggtgcaggccgtgcagcagcaggaggtgtacggcatgatgcccagagacgagaccgacagcaagaccgccagcccctggaagagcgccagactgatggtgcacaccgtggccaccttcaacagcatcaaggagctgaacgagagatggagaagcctgcagcagctggccgaggagagaagccagctgctgggcagcgcccacgaggtgcagagattccacagagacgccgacgagaccaaggagtggatcgaggagaagaaccaggccctgaacaccgacaactacggccacgacctggccagcgtgcaggccctgcagagaaagcacgagggcttcgagagagacctggccgccctgggcgacaaggtgaacagcctgggcgagaccgccgagagactgatccagagccaccccgagagcgccgaggacctgcaggagaagtgcaccgagctgaaccaggcctggagcagcctgggcaagagagccgaccagagaaaggccaagctgggcgacagccacgacctgcagagattcctgagcgacttcagagacctgatgagctggatcaacggcatcagaggcctggtgagcagcgacgagctggccaaggacgtgaccggcgccgaggccctgctggagagacaccaggagcacagaaccgagatcgacgccagagccggcaccttccaggccttcgagcagttcggccagcagctgctggcccacggccactacgccagccccgagatcaagcagaagctggacatcctggaccaggagagagccgacctggagaaggcctgggtgcagagaagaatgatgctggaccagtgcctggagctgcagctgttccacagagactgcgagcaggccgagaactggatggccgccagagaggccttcctgaacaccgaggacaagggcgacagcctggacagcgtggaggccctgatcaagaagcacgaggacttcgacaaggccatcaacgtgcaggaggagaagatcgccgccctgcaggccttcgccgaccagctgatcgccgccggccactacgccaagggcgacatcagcagcagaagaaacgaggtgctggacagatggagaagactgaaggcccagatgatcgagaagagaagcaagctgggcgagagccagaccctgcagcagttcagcagagacgtggacgagatcgaggcctggatcagcgagaagctgcagaccgccagcgacgagagctacaaggaccccaccaacatccaggtgagcctgatgctgagcaagcaccagaagcaccaggccttcgaggccgagctgcacgccaacgccgacagaatcagaggcgtgatcgacatgggcaacagcctgatcgagagaggcgcctgcgccggcagcgaggacgccgtgaaggccagactggccgccctggccgaccagtggcagttcctggtgcagaagagcgccgagaagagccagaagctgaaggaggccaacaagcagcagaacttcaacaccggcatcaaggacttcgacttctggctgagcgaggtggaggccctgctggccagcgaggactacggcaaggacctggccagcgtgaacaacctgctgaagaagcaccagctgctggaggccgacatcagcgcccacgaggacagactgaaggacctgaacagccaggccgacagcctgatgaccagcagcgccttcgacaccagccaggtgaaggacaagagagacaccatcaacggcagattccagaagatcaagagcatggccgccagcagaagagccaagctgaacgagagccacagactgcaccagttcttcagagacatggacgacgaggagagctggatcaaggagaagaagctgctggtgggcagcgaggactacggcagagacctgaccggcgtgcagaacctgagaaagaagcacaagagactggaggccgagctggccgcccacgagcccgccatccagggcgtgctggacaccggcaagaagctgagcgacgacaacaccatcggcaaggaggagatccagcagagactggcccagttcgtggagcactggaaggagctgaagcagctggccgccgccagaggccagagactggaggagagcctggagtaccagcagttcgtggccaacgtggaggaggaggaggcctggatcaacgagaagatgaccctggtggccagcgaggactacggcgacaccctggccgccatccagggcctgctgaagaagcacgaggccttcgagaccgacttcaccgtgcacaaggacagagtgaacgacgtgtgcaccaacggccaggacctgatcaagaagaacaaccaccacgaggagaacatcagcagcaagatgaagggcctgaacggcaaggtgagcgacctggagaaggccgccgcccagagaaaggccaagctggacgagaacagcgccttcctgcagttcaactggaaggccgacgtggtggagagctggatcggcgagaaggagaacagcctgaagaccgacgactacggcagagacctgagcagcgtgcagaccctgctgaccaagcaggagaccttcgacgccggcctgcaggccttccagcaggagggcatcgccaacatcaccgccctgaaggaccagctgctggccgccaagcacgtgcagagcaaggccatcgaggccagacacgccagcctgatgaagagatggagccagctgctggccaacagcgccgccagaaagaagaagctgctggaggcccagagccacttcagaaaggtggaggacctgttcctgaccttcgccaagaaggccagcgccttcaacagctggttcgagaacgccgaggaggacctgaccgaccccgtgagatgcaacagcctggaggagatcaaggccctgagagaggcccacgacgccttcagaagcagcctgagcagcgcccaggccgacttcaaccagctggccgagctggacagacagatcaagagcttcagagtggccagcaacccctacacctggttcaccatggaggccctggaggagacctggagaaacctgcagaagatcatcaaggagagagagctggagctgcagaaggagcagagaagacaggaggagaacgacaagctgagacaggagttcgcccagcacgccaacgccttccaccagtggatccaggagaccagatgccagcccgccggcgccagctgcatggtggaggagagcggcaccctggagagccagctggaggccaccaagagaaagcaccaggagatcagagccatgagaagccagctgaagaagatcgaggacctgggcgccgccatggaggaggccctgatcctggacaacaagtacaccgagcacagcaccgtgggcctggcccagcagtgggaccagctggaccagctgggcatgagaatgcagcacaacctggagcagcagatccaggccagaaacaccaccggcgtgaccgaggaggccctgaaggagttcagcatgatgttcaagcacttcgacaaggacaagagcggcagactgaaccaccaggagttcaagagctgcctgagaagcctgggctacgacctgcccatggtggaggagggcgagcccgaccccgagttcgaggccatcctggacaccgtggaccccaacagagacggccacgtgagcctgcaggagtacatggccttcatgatcagcagagagaccgagaacgtgaagagcagcgaggagatcgagagcgccttcagagccctgagcagcgagggcaagccctacgtgaccaaggaggagctgtaccagaacctgaccagagagcaggccgactactgcgtgagccacatgaagccctacgtggacggcaagggcagagagctgcccaccgccttcgactacgtggagttcaccagaagcctgttcgtgaactag

SEQ ID NO: 100494 - DNA, 7359 bp, Artificial Sequence
  Description of Artificial Sequence: Synthetic coding sequence
atggaccccagcggcgtgaaggtgctggagaccgccgaggacatccaggagagaagacagcaggtgctggacagataccacagattcaaggagctgagcaccctgagaagacagaagctggaggacagctacagattccagttcttccagagagacgccgaggagctggagaagtggatccaggagaagctgcagatcgccagcgacgagaactacaaggaccccaccaacctgcagggcaagctgcagaagcaccaggccttcgaggccgaggtgcaggccaacagcggcgccatcgtgaagctggacgagaccggcaacctgatgatcagcgagggccacttcgccagcgagaccatcagaaccagactgatggagctgcacagacagtgggagctgctgctggagaagatgagagagaagggcatcaagctgctgcaggcccagaagctggtgcagtacctgagagagtgcgaggacgtgatggactggatcaacgacaaggaggccatcgtgaccagcgaggagctgggccaggacctggagcacgtggaggtgctgcagaagaagttcgaggagttccagaccgacatggccgcccacgaggagagagtgaacgaggtgaaccagttcgccgccaagctgatccaggagcagcaccccgaggaggagctgatcaagaccaagcaggacgaggtgaacgccgcctggcagagactgaagggcctggccctgcagagacagggcaagctgttcggcgccgccgaggtgcagagattcaacagagacgtggacgagaccatcagctggatcaaggagaaggagcagctgatggccagcgacgacttcggcagagacctggccagcgtgcaggccctgctgagaaagcacgagggcctggagagagacctggccgccctggaggacaaggtgaaggccctgtgcgccgaggccgacagactgcagcagagccaccccctgagcgccacccagatccaggtgaagagagaggagctgatcaccaactgggagcagatcagaaccctggccgccgagagacacgccagactgaacgacagctacagactgcagagattcctggccgacttcagagacctgaccagctgggtgaccgagatgaaggccctgatcaacgccgacgagctggccagcgacgtggccggcgccgaggccctgctggacagacaccaggagcacaagggcgagatcgacgcccacgaggacagcttcaagagcgccgacgagagcggccaggccctgctggccgccggccactacgccagcgacgaggtgagagagaagctgaccgtgctgagcgaggagagagccgccctgctggagctgtgggagctgagaagacagcagtacgagcagtgcatggacctgcagctgttctacagagacaccgagcaggtggacaactggatgagcaagcaggaggccttcctgctgaacgaggacctgggcgacagcctggacagcgtggaggccctgctgaagaagcacgaggacttcgagaagagcctgagcgcccaggaggagaagatcaccgccctggacgagttcgccaccaagctgatccagaacaaccactacgccatggaggacgtggccaccagaagagacgccctgctgagcagaagaaacgccctgcacgagagagccatgagaagaagagcccagctggccgacagcttccacctgcagcagttcttcagagacagcgacgagctgaagagctgggtgaacgagaagatgaagaccgccaccgacgaggcctacaaggaccccagcaacctgcagggcaaggtgcagaagcaccaggccttcgaggccgagctgagcgccaaccagagcagaatcgacgccctggagaaggccggccagaagctgatcgacgtgaaccactacgccaaggacgaggtggccgccagaatgaacgaggtgatcagcctgtggaagaagctgctggaggccaccgagctgaagggcatcaagctgagagaggccaaccagcagcagcagttcaacagaaacgtggaggacatcgagctgtggctgtacgaggtggagggccacctggccagcgacgactacggcaaggacctgaccaacgtgcagaacctgcagaagaagcacgccctgctggaggccgacgtggccgcccaccaggacagaatcgacggcatcaccatccaggccagacagttccaggacgccggccacttcgacgccgagaacatcaagaagaagcaggaggccctggtggccagatacgaggccctgaaggagcccatggtggccagaaagcagaagctggccgacagcctgagactgcagcagctgttcagagacgtggaggacgaggagacctggatcagagagaaggagcccatcgccgccagcaccaacagaggcaaggacctgatcggcgtgcagaacctgctgaagaagcaccaggccctgcaggccgagatcgccggccacgagcccagaatcaaggccgtgacccagaagggcaacgccatggtggaggagggccacttcgccgccgaggacgtgaaggccaagctgcacgagctgaaccagaagtgggaggccctgaaggccaaggccagccagagaagacaggacctggaggacagcctgcaggcccagcagtacttcgccgacgccaacgaggccgagagctggatgagagagaaggagcccatcgtgggcagcaccgactacggcaaggacgaggacagcgccgaggccctgctgaagaagcacgaggccctgatgagcgacctgagcgcctacggcagcagcatccaggccctgagagagcaggcccagagctgcagacagcaggtggcccccaccgacgacgagaccggcaaggagctggtgctggccctgtacgactaccaggagaagagccccagagaggtgaccatgaagaagggcgacatcctgaccctgctgaacagcaccaacaaggactggtggaaggtggaggtgaacgacagacagggcttcgtgcccgccgcctacgtgaagaagctggaccccgcccagagcgccagcagagagaacctgctggaggagcagggcagcatcgccctgagacaggagcagatcgacaaccagtaccacagcctgctggagctgggcgagaagagaaagggcatgctggagaagagctgcaagaagttcatgctgttcagagaggccaacgagctgcagcagtggatcaacgagaaggaggccgccctgaccagcgaggaggtgggcgccgacctggagcaggtggaggtgctgcagaagaagttcgacgacttccagaaggacctgaaggccaacgagagcagactgaaggacatcaacaaggtggccgaggacctggagagcgagggcctgatggccgaggaggtgcaggccgtgcagcagcaggaggtgtacggcatgatgcccagagacgagaccgacagcaagaccgccagcccctggaagagcgccagactgatggtgcacaccgtggccaccttcaacagcatcaaggagctgaacgagagatggagaagcctgcagcagctggccgaggagagaagccagctgctgggcagcgcccacgaggtgcagagattccacagagacgccgacgagaccaaggagtggatcgaggagaagaaccaggccctgaacaccgacaactacggccacgacctggccagcgtgcaggccctgcagagaaagcacgagggcttcgagagagacctggccgccctgggcgacaaggtgaacagcctgggcgagaccgccgagagactgatccagagccaccccgagagcgccgaggacctgcaggagaagtgcaccgagctgaaccaggcctggagcagcctgggcaagagagccgaccagagaaaggccaagctgggcgacagccacgacctgcagagattcctgagcgacttcagagacctgatgagctggatcaacggcatcagaggcctggtgagcagcgacgagctggccaaggacgtgaccggcgccgaggccctgctggagagacaccaggagcacagaaccgagatcgacgccagagccggcaccttccaggccttcgagcagttcggccagcagctgctggcccacggccactacgccagccccgagatcaagcagaagctggacatcctggaccaggagagagccgacctggagaaggcctgggtgcagagaagaatgatgctggaccagtgcctggagctgcagctgttccacagagactgcgagcaggccgagaactggatggccgccagagaggccttcctgaacaccgaggacaagggcgacagcctggacagcgtggaggccctgatcaagaagcacgaggacttcgacaaggccatcaacgtgcaggaggagaagatcgccgccctgcaggccttcgccgaccagctgatcgccgccggccactacgccaagggcgacatcagcagcagaagaaacgaggtgctggacagatggagaagactgaaggcccagatgatcgagaagagaagcaagctgggcgagagccagaccctgcagcagttcagcagagacgtggacgagatcgaggcctggatcagcgagaagctgcagaccgccagcgacgagagctacaaggaccccaccaacatccagagcaagcaccagaagcaccaggccttcgaggccgagctgcacgccaacgccgacagaatcagaggcgtgatcgacatgggcaacagcctgatcgagagaggcgcctgcgccggcagcgaggacgccgtgaaggccagactggccgccctggccgaccagtggcagttcctggtgcagaagagcgccgagaagagccagaagctgaaggaggccaacaagcagcagaacttcaacaccggcatcaaggacttcgacttctggctgagcgaggtggaggccctgctggccagcgaggactacggcaaggacctggccagcgtgaacaacctgctgaagaagcaccagctgctggaggccgacatcagcgcccacgaggacagactgaaggacctgaacagccaggccgacagcctgatgaccagcagcgccttcgacaccagccaggtgaaggacaagagagacaccatcaacggcagattccagaagatcaagagcatggccgccagcagaagagccaagctgaacgagagccacagactgcaccagttcttcagagacatggacgacgaggagagctggatcaaggagaagaagctgctggtgggcagcgaggactacggcagagacctgaccggcgtgcagaacctgagaaagaagcacaagagactggaggccgagctggccgcccacgagcccgccatccagggcgtgctggacaccggcaagaagctgagcgacgacaacaccatcggcaaggaggagatccagcagagactggcccagttcgtggagcactggaaggagctgaagcagctggccgccgccagaggccagagactggaggagagcctggagtaccagcagttcgtggccaacgtggaggaggaggaggcctggatcaacgagaagatgaccctggtggccagcgaggactacggcgacaccctggccgccatccagggcctgctgaagaagcacgaggccttcgagaccgacttcaccgtgcacaaggacagagtgaacgacgtgtgcaccaacggccaggacctgatcaagaagaacaaccaccacgaggagaacatcagcagcaagatgaagggcctgaacggcaaggtgagcgacctggagaaggccgccgcccagagaaaggccaagctggacgagaacagcgccttcctgcagttcaactggaaggccgacgtggtggagagctggatcggcgagaaggagaacagcctgaagaccgacgactacggcagagacctgagcagcgtgcagaccctgctgaccaagcaggagaccttcgacgccggcctgcaggccttccagcaggagggcatcgccaacatcaccgccctgaaggaccagctgctggccgccaagcacgtgcagagcaaggccatcgaggccagacacgccagcctgatgaagagatggagccagctgctggccaacagcgccgccagaaagaagaagctgctggaggcccagagccacttcagaaaggtggaggacctgttcctgaccttcgccaagaaggccagcgccttcaacagctggttcgagaacgccgaggaggacctgaccgaccccgtgagatgcaacagcctggaggagatcaaggccctgagagaggcccacgacgccttcagaagcagcctgagcagcgcccaggccgacttcaaccagctggccgagctggacagacagatcaagagcttcagagtggccagcaacccctacacctggttcaccatggaggccctggaggagacctggagaaacctgcagaagatcatcaaggagagagagctggagctgcagaaggagcagagaagacaggaggagaacgacaagctgagacaggagttcgcccagcacgccaacgccttccaccagtggatccaggagaccagatgccagcccgccggcgccagctgcatggtggaggagagcggcaccctggagagccagctggaggccaccaagagaaagcaccaggagatcagagccatgagaagccagctgaagaagatcgaggacctgggcgccgccatggaggaggccctgatcctggacaacaagtacaccgagcacagcaccgtgggcctggcccagcagtgggaccagctggaccagctgggcatgagaatgcagcacaacctggagcagcagatccaggccagaaacaccaccggcgtgaccgaggaggccctgaaggagttcagcatgatgttcaagcacttcgacaaggacaagagcggcagactgaaccaccaggagttcaagagctgcctgagaagcctgggctacgacctgcccatggtggaggagggcgagcccgaccccgagttcgaggccatcctggacaccgtggaccccaacagagacggccacgtgagcctgcaggagtacatggccttcatgatcagcagagagaccgagaacgtgaagagcagcgaggagatcgagagcgccttcagagccctgagcagcgagggcaagccctacgtgaccaaggaggagctgtaccagaacctgaccagagagcaggccgactactgcgtgagccacatgaagccctacgtggacggcaagggcagagagctgcccaccgccttcgactacgtggagttcaccagaagcctgttcgtgaactag

SEQ ID NO: 100495 - DNA, 1485 bp, Artificial Sequence
  Description of Artificial Sequence: Synthetic coding sequence
atggccgccagcagaagagccaagctgaacgagagccacagactgcaccagttcttcagagacatggacgacgaggagagctggatcaaggagaagaagctgctggtgggcagcgaggactacggcagagacctgaccggcgtgcagaacctgagaaagaagcacaagagactggaggccgagctggccgcccacgagcccgccatccagggcgtgctggacaccggcaagaagctgagcgacgacaacaccatcggcaaggaggagatccagcagagactggcccagttcgtggagcactggaaggagctgaagcagctggccgccgccagaggccagagactggaggagagcctggagtaccagcagttcgtggccaacgtggaggaggaggaggcctggatcaacgagaagatgaccctggtggccagcgaggactacggcgacaccctggccgccatccagggcctgctgaagaagcacgaggccttcgagaccgacttcaccgtgcacaaggacagagtgaacgacgtgtgcaccaacggccaggacctgatcaagaagaacaaccaccacgaggagaacatcagcagcaagatgaagggcctgaacggcaaggtgagcgacctggagaaggccgccgcccagagaaaggccaagctggacgagaacagcgccttcctgcagttcaactggaaggccgacgtggtggagagctggatcggcgagaaggagaacagcctgaagaccgacgactacggcagagacctgagcagcgtgcagaccctgctgaccaagcaggagaccttcgacgccggcctgcaggccttccagcaggagggcatcgccaacatcaccgccctgaaggaccagctgctggccgccaagcacgtgcagagcaaggccatcgaggccagacacgccagcctgatgaagagatggagccagctgctggccaacagcgccgccagaaagaagaagctgctggaggcccagagccacttcagaaaggtggaggacctgttcctgaccttcgccaagaaggccagcgccttcaacagctggttcgagaacgccgaggaggacctgaccgaccccgtgagatgcaacagcctggaggagatcaaggccctgagagaggcccacgacgccttcagaagcagcctgagcagcgcccaggccgacttcaaccagctggccgagctggacagacagatcaagagcttcagagtggccagcaacccctacacctggttcaccatggaggccctggaggagacctggagaaacctgcagaagatcatcaaggagagagagctggagctgcagaaggagcagagaagacaggaggagaacgacaagctgagacaggagttcgcccagcacgccaacgccttccaccagtggatccaggagaccagatgccagagaaaggacggccagctgcagggcggcagagtgggcgaccccagaatccccgcctag

SEQ ID NO: 100496 - DNA, 7419 bp, Artificial Sequence
  Description of Artificial Sequence: Synthetic coding sequence
atggaccccagcggcgtgaaggtgctggagaccgccgaggacatccaggagagaagacagcaggtgctggacagataccacagattcaaggagctgagcaccctgagaagacagaagctggaggacagctacagattccagttcttccagagagacgccgaggagctggagaagtggatccaggagaagctgcagatcgccagcgacgagaactacaaggaccccaccaacctgcagggcaagctgcagaagcaccaggccttcgaggccgaggtgcaggccaacagcggcgccatcgtgaagctggacgagaccggcaacctgatgatcagcgagggccacttcgccagcgagaccatcagaaccagactgatggagctgcacagacagtgggagctgctgctggagaagatgagagagaagggcatcaagctgctgcaggcccagaagctggtgcagtacctgagagagtgcgaggacgtgatggactggatcaacgacaaggaggccatcgtgaccagcgaggagctgggccaggacctggagcacgtggaggtgctgcagaagaagttcgaggagttccagaccgacatggccgcccacgaggagagagtgaacgaggtgaaccagttcgccgccaagctgatccaggagcagcaccccgaggaggagctgatcaagaccaagcaggacgaggtgaacgccgcctggcagagactgaagggcctggccctgcagagacagggcaagctgttcggcgccgccgaggtgcagagattcaacagagacgtggacgagaccatcagctggatcaaggagaaggagcagctgatggccagcgacgacttcggcagagacctggccagcgtgcaggccctgctgagaaagcacgagggcctggagagagacctggccgccctggaggacaaggtgaaggccctgtgcgccgaggccgacagactgcagcagagccaccccctgagcgccacccagatccaggtgaagagagaggagctgatcaccaactgggagcagatcagaaccctggccgccgagagacacgccagactgaacgacagctacagactgcagagattcctggccgacttcagagacctgaccagctgggtgaccgagatgaaggccctgatcaacgccgacgagctggccagcgacgtggccggcgccgaggccctgctggacagacaccaggagcacaagggcgagatcgacgcccacgaggacagcttcaagagcgccgacgagagcggccaggccctgctggccgccggccactacgccagcgacgaggtgagagagaagctgaccgtgctgagcgaggagagagccgccctgctggagctgtgggagctgagaagacagcagtacgagcagtgcatggacctgcagctgttctacagagacaccgagcaggtggacaactggatgagcaagcaggaggccttcctgctgaacgaggacctgggcgacagcctggacagcgtggaggccctgctgaagaagcacgaggacttcgagaagagcctgagcgcccaggaggagaagatcaccgccctggacgagttcgccaccaagctgatccagaacaaccactacgccatggaggacgtggccaccagaagagacgccctgctgagcagaagaaacgccctgcacgagagagccatgagaagaagagcccagctggccgacagcttccacctgcagcagttcttcagagacagcgacgagctgaagagctgggtgaacgagaagatgaagaccgccaccgacgaggcctacaaggaccccagcaacctgcagggcaaggtgcagaagcaccaggccttcgaggccgagctgagcgccaaccagagcagaatcgacgccctggagaaggccggccagaagctgatcgacgtgaaccactacgccaaggacgaggtggccgccagaatgaacgaggtgatcagcctgtggaagaagctgctggaggccaccgagctgaagggcatcaagctgagagaggccaaccagcagcagcagttcaacagaaacgtggaggacatcgagctgtggctgtacgaggtggagggccacctggccagcgacgactacggcaaggacctgaccaacgtgcagaacctgcagaagaagcacgccctgctggaggccgacgtggccgcccaccaggacagaatcgacggcatcaccatccaggccagacagttccaggacgccggccacttcgacgccgagaacatcaagaagaagcaggaggccctggtggccagatacgaggccctgaaggagcccatggtggccagaaagcagaagctggccgacagcctgagactgcagcagctgttcagagacgtggaggacgaggagacctggatcagagagaaggagcccatcgccgccagcaccaacagaggcaaggacctgatcggcgtgcagaacctgctgaagaagcaccaggccctgcaggccgagatcgccggccacgagcccagaatcaaggccgtgacccagaagggcaacgccatggtggaggagggccacttcgccgccgaggacgtgaaggccaagctgcacgagctgaaccagaagtgggaggccctgaaggccaaggccagccagagaagacaggacctggaggacagcctgcaggcccagcagtacttcgccgacgccaacgaggccgagagctggatgagagagaaggagcccatcgtgggcagcaccgactacggcaaggacgaggacagcgccgaggccctgctgaagaagcacgaggccctgatgagcgacctgagcgcctacggcagcagcatccaggccctgagagagcaggcccagagctgcagacagcaggtggcccccaccgacgacgagaccggcaaggagctggtgctggccctgtacgactaccaggagaagagccccagagaggtgaccatgaagaagggcgacatcctgaccctgctgaacagcaccaacaaggactggtggaaggtggaggtgaacgacagacagggcttcgtgcccgccgcctacgtgaagaagctggaccccgcccagagcgccagcagagagaacctgctggaggagcagggcagcatcgccctgagacaggagcagatcgacaaccagaccagaatcaccaaggaggccggcagcgtgagcctgagaatgaagcaggtggaggagctgtaccacagcctgctggagctgggcgagaagagaaagggcatgctggagaagagctgcaagaagttcatgctgttcagagaggccaacgagctgcagcagtggatcaacgagaaggaggccgccctgaccagcgaggaggtgggcgccgacctggagcaggtggaggtgctgcagaagaagttcgacgacttccagaaggacctgaaggccaacgagagcagactgaaggacatcaacaaggtggccgaggacctggagagcgagggcctgatggccgaggaggtgcaggccgtgcagcagcaggaggtgtacggcatgatgcccagagacgagaccgacagcaagaccgccagcccctggaagagcgccagactgatggtgcacaccgtggccaccttcaacagcatcaaggagctgaacgagagatggagaagcctgcagcagctggccgaggagagaagccagctgctgggcagcgcccacgaggtgcagagattccacagagacgccgacgagaccaaggagtggatcgaggagaagaaccaggccctgaacaccgacaactacggccacgacctggccagcgtgcaggccctgcagagaaagcacgagggcttcgagagagacctggccgccctgggcgacaaggtgaacagcctgggcgagaccgccgagagactgatccagagccaccccgagagcgccgaggacctgcaggagaagtgcaccgagctgaaccaggcctggagcagcctgggcaagagagccgaccagagaaaggccaagctgggcgacagccacgacctgcagagattcctgagcgacttcagagacctgatgagctggatcaacggcatcagaggcctggtgagcagcgacgagctggccaaggacgtgaccggcgccgaggccctgctggagagacaccaggagcacagaaccgagatcgacgccagagccggcaccttccaggccttcgagcagttcggccagcagctgctggcccacggccactacgccagccccgagatcaagcagaagctggacatcctggaccaggagagagccgacctggagaaggcctgggtgcagagaagaatgatgctggaccagtgcctggagctgcagctgttccacagagactgcgagcaggccgagaactggatggccgccagagaggccttcctgaacaccgaggacaagggcgacagcctggacagcgtggaggccctgatcaagaagcacgaggacttcgacaaggccatcaacgtgcaggaggagaagatcgccgccctgcaggccttcgccgaccagctgatcgccgccggccactacgccaagggcgacatcagcagcagaagaaacgaggtgctggacagatggagaagactgaaggcccagatgatcgagaagagaagcaagctgggcgagagccagaccctgcagcagttcagcagagacgtggacgagatcgaggcctggatcagcgagaagctgcagaccgccagcgacgagagctacaaggaccccaccaacatccagagcaagcaccagaagcaccaggccttcgaggccgagctgcacgccaacgccgacagaatcagaggcgtgatcgacatgggcaacagcctgatcgagagaggcgcctgcgccggcagcgaggacgccgtgaaggccagactggccgccctggccgaccagtggcagttcctggtgcagaagagcgccgagaagagccagaagctgaaggaggccaacaagcagcagaacttcaacaccggcatcaaggacttcgacttctggctgagcgaggtggaggccctgctggccagcgaggactacggcaaggacctggccagcgtgaacaacctgctgaagaagcaccagctgctggaggccgacatcagcgcccacgaggacagactgaaggacctgaacagccaggccgacagcctgatgaccagcagcgccttcgacaccagccaggtgaaggacaagagagacaccatcaacggcagattccagaagatcaagagcatggccgccagcagaagagccaagctgaacgagagccacagactgcaccagttcttcagagacatggacgacgaggagagctggatcaaggagaagaagctgctggtgggcagcgaggactacggcagagacctgaccggcgtgcagaacctgagaaagaagcacaagagactggaggccgagctggccgcccacgagcccgccatccagggcgtgctggacaccggcaagaagctgagcgacgacaacaccatcggcaaggaggagatccagcagagactggcccagttcgtggagcactggaaggagctgaagcagctggccgccgccagaggccagagactggaggagagcctggagtaccagcagttcgtggccaacgtggaggaggaggaggcctggatcaacgagaagatgaccctggtggccagcgaggactacggcgacaccctggccgccatccagggcctgctgaagaagcacgaggccttcgagaccgacttcaccgtgcacaaggacagagtgaacgacgtgtgcaccaacggccaggacctgatcaagaagaacaaccaccacgaggagaacatcagcagcaagatgaagggcctgaacggcaaggtgagcgacctggagaaggccgccgcccagagaaaggccaagctggacgagaacagcgccttcctgcagttcaactggaaggccgacgtggtggagagctggatcggcgagaaggagaacagcctgaagaccgacgactacggcagagacctgagcagcgtgcagaccctgctgaccaagcaggagaccttcgacgccggcctgcaggccttccagcaggagggcatcgccaacatcaccgccctgaaggaccagctgctggccgccaagcacgtgcagagcaaggccatcgaggccagacacgccagcctgatgaagagatggagccagctgctggccaacagcgccgccagaaagaagaagctgctggaggcccagagccacttcagaaaggtggaggacctgttcctgaccttcgccaagaaggccagcgccttcaacagctggttcgagaacgccgaggaggacctgaccgaccccgtgagatgcaacagcctggaggagatcaaggccctgagagaggcccacgacgccttcagaagcagcctgagcagcgcccaggccgacttcaaccagctggccgagctggacagacagatcaagagcttcagagtggccagcaacccctacacctggttcaccatggaggccctggaggagacctggagaaacctgcagaagatcatcaaggagagagagctggagctgcagaaggagcagagaagacaggaggagaacgacaagctgagacaggagttcgcccagcacgccaacgccttccaccagtggatccaggagaccagaacctacctgctggacggcagctgcatggtggaggagagcggcaccctggagagccagctggaggccaccaagagaaagcaccaggagatcagagccatgagaagccagctgaagaagatcgaggacctgggcgccgccatggaggaggccctgatcctggacaacaagtacaccgagcacagcaccgtgggcctggcccagcagtgggaccagctggaccagctgggcatgagaatgcagcacaacctggagcagcagatccaggccagaaacaccaccggcgtgaccgaggaggccctgaaggagttcagcatgatgttcaagcacttcgacaaggacaagagcggcagactgaaccaccaggagttcaagagctgcctgagaagcctgggctacgacctgcccatggtggaggagggcgagcccgaccccgagttcgaggccatcctggacaccgtggaccccaacagagacggccacgtgagcctgcaggagtacatggccttcatgatcagcagagagaccgagaacgtgaagagcagcgaggagatcgagagcgccttcagagccctgagcagcgagggcaagccctacgtgaccaaggaggagctgtaccagaacctgaccagagagcaggccgactactgcgtgagccacatgaagccctacgtggacggcaagggcagagagctgcccaccgccttcgactacgtggagttcaccagaagcctgttcgtgaactag

SEQ ID NO: 100497 - DNA, 7434 bp, Artificial Sequence
  Description of Artificial Sequence: Synthetic coding sequence
atggaccccagcggcgtgaaggtgctggagaccgccgaggacatccaggagagaagacagcaggtgctggacagataccacagattcaaggagctgagcaccctgagaagacagaagctggaggacagctacagattccagttcttccagagagacgccgaggagctggagaagtggatccaggagaagctgcagatcgccagcgacgagaactacaaggaccccaccaacctgcagggcaagctgcagaagcaccaggccttcgaggccgaggtgcaggccaacagcggcgccatcgtgaagctggacgagaccggcaacctgatgatcagcgagggccacttcgccagcgagaccatcagaaccagactgatggagctgcacagacagtgggagctgctgctggagaagatgagagagaagggcatcaagctgctgcaggcccagaagctggtgcagtacctgagagagtgcgaggacgtgatggactggatcaacgacaaggaggccatcgtgaccagcgaggagctgggccaggacctggagcacgtggaggtgctgcagaagaagttcgaggagttccagaccgacatggccgcccacgaggagagagtgaacgaggtgaaccagttcgccgccaagctgatccaggagcagcaccccgaggaggagctgatcaagaccaagcaggacgaggtgaacgccgcctggcagagactgaagggcctggccctgcagagacagggcaagctgttcggcgccgccgaggtgcagagattcaacagagacgtggacgagaccatcagctggatcaaggagaaggagcagctgatggccagcgacgacttcggcagagacctggccagcgtgcaggccctgctgagaaagcacgagggcctggagagagacctggccgccctggaggacaaggtgaaggccctgtgcgccgaggccgacagactgcagcagagccaccccctgagcgccacccagatccaggtgaagagagaggagctgatcaccaactgggagcagatcagaaccctggccgccgagagacacgccagactgaacgacagctacagactgcagagattcctggccgacttcagagacctgaccagctgggtgaccgagatgaaggccctgatcaacgccgacgagctggccagcgacgtggccggcgccgaggccctgctggacagacaccaggagcacaagggcgagatcgacgcccacgaggacagcttcaagagcgccgacgagagcggccaggccctgctggccgccggccactacgccagcgacgaggtgagagagaagctgaccgtgctgagcgaggagagagccgccctgctggagctgtgggagctgagaagacagcagtacgagcagtgcatggacctgcagctgttctacagagacaccgagcaggtggacaactggatgagcaagcaggaggccttcctgctgaacgaggacctgggcgacagcctggacagcgtggaggccctgctgaagaagcacgaggacttcgagaagagcctgagcgcccaggaggagaagatcaccgccctggacgagttcgccaccaagctgatccagaacaaccactacgccatggaggacgtggccaccagaagagacgccctgctgagcagaagaaacgccctgcacgagagagccatgagaagaagagcccagctggccgacagcttccacctgcagcagttcttcagagacagcgacgagctgaagagctgggtgaacgagaagatgaagaccgccaccgacgaggcctacaaggaccccagcaacctgcagggcaaggtgcagaagcaccaggccttcgaggccgagctgagcgccaaccagagcagaatcgacgccctggagaaggccggccagaagctgatcgacgtgaaccactacgccaaggacgaggtggccgccagaatgaacgaggtgatcagcctgtggaagaagctgctggaggccaccgagctgaagggcatcaagctgagagaggccaaccagcagcagcagttcaacagaaacgtggaggacatcgagctgtggctgtacgaggtggagggccacctggccagcgacgactacggcaaggacctgaccaacgtgcagaacctgcagaagaagcacgccctgctggaggccgacgtggccgcccaccaggacagaatcgacggcatcaccatccaggccagacagttccaggacgccggccacttcgacgccgagaacatcaagaagaagcaggaggccctggtggccagatacgaggccctgaaggagcccatggtggccagaaagcagaagctggccgacagcctgagactgcagcagctgttcagagacgtggaggacgaggagacctggatcagagagaaggagcccatcgccgccagcaccaacagaggcaaggacctgatcggcgtgcagaacctgctgaagaagcaccaggccctgcaggccgagatcgccggccacgagcccagaatcaaggccgtgacccagaagggcaacgccatggtggaggagggccacttcgccgccgaggacgtgaaggccaagctgcacgagctgaaccagaagtgggaggccctgaaggccaaggccagccagagaagacaggacctggaggacagcctgcaggcccagcagtacttcgccgacgccaacgaggccgagagctggatgagagagaaggagcccatcgtgggcagcaccgactacggcaaggacgaggacagcgccgaggccctgctgaagaagcacgaggccctgatgagcgacctgagcgcctacggcagcagcatccaggccctgagagagcaggcccagagctgcagacagcaggtggcccccaccgacgacgagaccggcaaggagctggtgctggccctgtacgactaccaggagaagagccccagagaggtgaccatgaagaagggcgacatcctgaccctgctgaacagcaccaacaaggactggtggaaggtggaggtgaacgacagacagggcttcgtgcccgccgcctacgtgaagaagctggaccccgcccagagcgccagcagagagaacctgctggaggagcagggcagcatcgccctgagacaggagcagatcgacaaccagaccagaatcaccaaggaggccggcagcgtgagcctgagaatgaagcaggtggaggagctgtaccacagcctgctggagctgggcgagaagagaaagggcatgctggagaagagctgcaagaagttcatgctgttcagagaggccaacgagctgcagcagtggatcaacgagaaggaggccgccctgaccagcgaggaggtgggcgccgacctggagcaggtggaggtgctgcagaagaagttcgacgacttccagaaggacctgaaggccaacgagagcagactgaaggacatcaacaaggtggccgaggacctggagagcgagggcctgatggccgaggaggtgcaggccgtgcagcagcaggaggtgtacggcatgatgcccagagacgagaccgacagcaagaccgccagcccctggaagagcgccagactgatggtgcacaccgtggccaccttcaacagcatcaaggagctgaacgagagatggagaagcctgcagcagctggccgaggagagaagccagctgctgggcagcgcccacgaggtgcagagattccacagagacgccgacgagaccaaggagtggatcgaggagaagaaccaggccctgaacaccgacaactacggccacgacctggccagcgtgcaggccctgcagagaaagcacgagggcttcgagagagacctggccgccctgggcgacaaggtgaacagcctgggcgagaccgccgagagactgatccagagccaccccgagagcgccgaggacctgcaggagaagtgcaccgagctgaaccaggcctggagcagcctgggcaagagagccgaccagagaaaggccaagctgggcgacagccacgacctgcagagattcctgagcgacttcagagacctgatgagctggatcaacggcatcagaggcctggtgagcagcgacgagctggccaaggacgtgaccggcgccgaggccctgctggagagacaccaggagcacagaaccgagatcgacgccagagccggcaccttccaggccttcgagcagttcggccagcagctgctggcccacggccactacgccagccccgagatcaagcagaagctggacatcctggaccaggagagagccgacctggagaaggcctgggtgcagagaagaatgatgctggaccagtgcctggagctgcagctgttccacagagactgcgagcaggccgagaactggatggccgccagagaggccttcctgaacaccgaggacaagggcgacagcctggacagcgtggaggccctgatcaagaagcacgaggacttcgacaaggccatcaacgtgcaggaggagaagatcgccgccctgcaggccttcgccgaccagctgatcgccgccggccactacgccaagggcgacatcagcagcagaagaaacgaggtgctggacagatggagaagactgaaggcccagatgatcgagaagagaagcaagctgggcgagagccagaccctgcagcagttcagcagagacgtggacgagatcgaggcctggatcagcgagaagctgcagaccgccagcgacgagagctacaaggaccccaccaacatccagctgagcaagctgctgagcaagcaccagaagcaccaggccttcgaggccgagctgcacgccaacgccgacagaatcagaggcgtgatcgacatgggcaacagcctgatcgagagaggcgcctgcgccggcagcgaggacgccgtgaaggccagactggccgccctggccgaccagtggcagttcctggtgcagaagagcgccgagaagagccagaagctgaaggaggccaacaagcagcagaacttcaacaccggcatcaaggacttcgacttctggctgagcgaggtggaggccctgctggccagcgaggactacggcaaggacctggccagcgtgaacaacctgctgaagaagcaccagctgctggaggccgacatcagcgcccacgaggacagactgaaggacctgaacagccaggccgacagcctgatgaccagcagcgccttcgacaccagccaggtgaaggacaagagagacaccatcaacggcagattccagaagatcaagagcatggccgccagcagaagagccaagctgaacgagagccacagactgcaccagttcttcagagacatggacgacgaggagagctggatcaaggagaagaagctgctggtgggcagcgaggactacggcagagacctgaccggcgtgcagaacctgagaaagaagcacaagagactggaggccgagctggccgcccacgagcccgccatccagggcgtgctggacaccggcaagaagctgagcgacgacaacaccatcggcaaggaggagatccagcagagactggcccagttcgtggagcactggaaggagctgaagcagctggccgccgccagaggccagagactggaggagagcctggagtaccagcagttcgtggccaacgtggaggaggaggaggcctggatcaacgagaagatgaccctggtggccagcgaggactacggcgacaccctggccgccatccagggcctgctgaagaagcacgaggccttcgagaccgacttcaccgtgcacaaggacagagtgaacgacgtgtgcaccaacggccaggacctgatcaagaagaacaaccaccacgaggagaacatcagcagcaagatgaagggcctgaacggcaaggtgagcgacctggagaaggccgccgcccagagaaaggccaagctggacgagaacagcgccttcctgcagttcaactggaaggccgacgtggtggagagctggatcggcgagaaggagaacagcctgaagaccgacgactacggcagagacctgagcagcgtgcagaccctgctgaccaagcaggagaccttcgacgccggcctgcaggccttccagcaggagggcatcgccaacatcaccgccctgaaggaccagctgctggccgccaagcacgtgcagagcaaggccatcgaggccagacacgccagcctgatgaagagatggagccagctgctggccaacagcgccgccagaaagaagaagctgctggaggcccagagccacttcagaaaggtggaggacctgttcctgaccttcgccaagaaggccagcgccttcaacagctggttcgagaacgccgaggaggacctgaccgaccccgtgagatgcaacagcctggaggagatcaaggccctgagagaggcccacgacgccttcagaagcagcctgagcagcgcccaggccgacttcaaccagctggccgagctggacagacagatcaagagcttcagagtggccagcaacccctacacctggttcaccatggaggccctggaggagacctggagaaacctgcagaagatcatcaaggagagagagctggagctgcagaaggagcagagaagacaggaggagaacgacaagctgagacaggagttcgcccagcacgccaacgccttccaccagtggatccaggagaccagaacctacctgctggacggcagctgcatggtggaggagagcggcaccctggagagccagctggaggccaccaagagaaagcaccaggagatcagagccatgagaagccagctgaagaagatcgaggacctgggcgccgccatggaggaggccctgatcctggacaacaagtacaccgagcacagcaccgtgggcctggcccagcagtgggaccagctggaccagctgggcatgagaatgcagcacaacctggagcagcagatccaggccagaaacaccaccggcgtgaccgaggaggccctgaaggagttcagcatgatgttcaagcacttcgacaaggacaagagcggcagactgaaccaccaggagttcaagagctgcctgagaagcctgggctacgacctgcccatggtggaggagggcgagcccgaccccgagttcgaggccatcctggacaccgtggaccccaacagagacggccacgtgagcctgcaggagtacatggccttcatgatcagcagagagaccgagaacgtgaagagcagcgaggagatcgagagcgccttcagagccctgagcagcgagggcaagccctacgtgaccaaggaggagctgtaccagaacctgaccagagagcaggccgactactgcgtgagccacatgaagccctacgtggacggcaagggcagagagctgcccaccgccttcgactacgtggagttcaccagaagcctgttcgtgaactag

SEQ ID NO: 100498 - DNA, 3444 bp, Artificial Sequence
  Description of Artificial Sequence: Synthetic coding sequence
atggagaacaacagagacaaggtgctgagccccgtggacagcggcaacaagctggtggccgagggcaacctgtacagcgacaagatcaaggagaaggtgcagctgatcgaggacagacacagaaagaacaacgagaaggcccaggaggccagcgtgctgctgagagacaacctggagctgcagaacttcctgcagaactgccaggagctgaccctgtggatcaacgacaagctgctgaccagccaggacgtgagctacgacgaggccagaaacctgcacaacaagtggctgaagcaccaggccttcgtggccgagctggccagccacgagggctggctggagaacatcgacgccgagggcaagcagctgatggacgagaagccccagttcaccgccctggtgagccagaagctggaggccctgcacagactgtgggacgagctgcaggccaccaccaaggagaagacccagcacctgagcgccgccagaagcagcgacctgagactgcagacccacgccgacctgaacaagtggatcagcgccatggaggaccagctgagaagcgacgaccccggcaaggacctgaccagcgtgaacagaatgctggccaagctgaagagagtggaggaccaggtgaacgtgagaaaggaggagctgggcgagctgttcgcccaggtgcccagcatgggcgaggagggcggcgacgccgacctgagcatcgagaagagattcctggacctgctggagcccctgggcagaagaaagaagcagctggagagcagcagagccaagctgcagatcagcagagacctggaggacgagaccctgtgggtggaggagagactgcccctggcccagagcgccgactacggcaccaacctgcagaccgtgcagctgttcatgaagaagaaccagaccctgcagaacgagatcctgggccacacccccagagtggaggacgtgctgcagagaggccagcagctggtggaggccgccgagatcgactgccaggacctggaggagagactgggccacctgcagagcagctgggacagactgagagaggccgccgccggcagactgcagagactgagagacgccaacgaggcccagcagtactacctggacgccgacgaggccgaggcctggatcggcgagcaggagctgtacgtgatcagcgacgagatccccaaggacgaggagggcgccatcgtgatgctgaagagacacctgagacagcagagagccgtggaggactacggcagaaacatcaagcagctggccagcagagcccagggcctgctgagcgccggccaccccgagggcgagcagatcatcagactgcagggccaggtggacaagcactacgccggcctgaaggacgtggccgaggagagaaagagaaagctggagaacatgtaccacctgttccagctgaagagagagaccgacgacctggagcagtggatcagcgagaaggagctggtggccagcagccccgagatgggccaggacttcgaccacgtgaccctgctgagagacaagttcagagacttcgccagagagaccggcgccatcggccaggagagagtggacaacgtgaacgccttcatcgagagactgatcgacgccggccacagcgaggccgccaccatcgccgagtggaaggacggcctgaacgagatgtgggccgacctgctggagctgatcgacaccagaatgcagctgctggccgccagctacgacctgcacagatacttctacaccggcgccgagatcctgggcctgatcgacgagaagcacagagagctgcccgaggacgtgggcctggacgccagcaccgccgagagcttccacagagtgcacaccgccttcgagagagagctgcacctgctgggcgtgcaggtgcagcagttccaggacgtggccaccagactgcagaccgcctacgccggcgagaaggccgaggccatccagaacaaggagcaggaggtgagcgccgcctggcaggccctgctggacgcctgcgccggcagaagaacccagctggtggacaccgccgacaagttcagattcttcagcatggccagagacctgctgagctggatggagagcatcatcagacagatcgagacccaggagagacccagagacgtgagcagcgtggagctgctgatgaagtaccaccagggcatcaacgccgagatcgagaccagaagcaagaacttcagcgcctgcctggagctgggcgagagcctgctgcagagacagcaccaggccagcgaggagatcagagagaagctgcagcaggtgatgagcagaagaaaggagatgaacgagaagtgggaggccagatgggagagactgagaatgctgctggaggtgtgccagttcagcagagacgccagcgtggccgaggcctggctgatcgcccaggagccctacctggccagcggcgacttcggccacaccgtggacagcgtggagaagctgatcaagagacacgaggccttcgagaagagcaccgccagctgggccgagagattcgccgccctggagaagcccaccaccctggagctgaaggagagacagatcgccgagagacccgccgaggagaccggcccccaggaggaggagggcgagaccgccggcgaggcccccgtgagccaccacgccgccaccgagagaaccagccccggcgaggaggagggcacctggccccagaacctgcagcagccccccccccccggccagcacaaggacggccagaagagcaccggcgacgagagacccaccaccgagcccctgttcaaggtgctggacacccccctgagcgagggcgacgagcccgccaccctgcccgcccccagagaccacggccagagcgtgcagatggagggctacctgggcagaaagcacgacctggagggccccaacaagaaggccagcaacagcaagggcgaggagggcgaggagagaagagagaccgaggaggaggacgaggaggaggaggagaccgagagcgtggccgtggagatgcagcagcacgccagccacgtgagctggaacaacctgtactgcgtgctgagaaacagcgagctgaccttctacaaggacgccaagaacctggccctgggcatgccctaccacggcgaggagcccctggccctgagacacgccatctgcgagatcgccgccaactacaagaagaagaagcacgtgttcaagctgagactgagcaacggcagcgagtggctgttccacggcaaggacgaggaggagatgctgagctggctgcagggcgtgagcaccgccatcaacgagagccagagcatcagagtgaaggcccagagcctgcccctgcccagcctgagcggccccgacgccagcctgggcaagaaggacaaggagaagagattcagcttcttccccaagaagaagtag

SEQ ID NO: 100499 - DNA, 6321 bp, Artificial Sequence
  Description of Artificial Sequence: Synthetic coding sequence
atgaccagcgccaccgagttcgagaacgtgggcaaccagcccccctacagcagaatcaacgccagatgggacgcccccgacgacgagctggacaacgacaacagcagcgccagactgttcgagagaagcagaatcaaggccctggccgacgagagagaggtggtgcagaagaagaccttcaccaagtgggtgaacagccacctggccagagtgagctgcagaatcaccgacctgtacaaggacctgagagacggcagaatgctgatcaagctgctggaggtgctgagcggcgagatgctgcccaagcccaccaagggcaagatgagaatccactgcctggagaacgtggacaaggccctgcagttcctgaaggagcagagagtgcacctggagaacatgggcagccacgacatcgtggacggcaaccacagactggtgctgggcctgatctggaccatcatcctgagattccagatccaggacatcgtggtgcagacccaggagggcagagagaccagaagcgccaaggacgccctgctgctgtggtgccagatgaagaccgccggctacccccacgtgaacgtgaccaacttcaccagcagctggaaggacggcctggccttcaacgccctgatccacaagcacagacccgacctgatcgacttcgacaagctgaaggacagcaacgccagacacaacctggagcacgccttcaacgtggccgagagacagctgggcatcatccccctgctggaccccgaggacgtgttcaccgagaaccccgacgagaagagcatcatcacctacgtggtggccttctaccactacttcagcaagatgaaggtgctggccgtggagggcaagagagtgggcaaggtgatcgaccacgccatcgagaccgagaagatgatcgagaagtacagcggcctggccagcgacctgctgacctggatcgagcagaccatcaccgtgctgaacagcagaaagttcgccaacagcctgaccggcgtgcagcagcagctgcaggccttcagcacctacagaaccgtggagaagccccccaagttccaggagaagggcaacctggaggtgctgctgttcaccatccagagcagaatgagagccaacaaccagaaggtgtacaccccccacgacggcaagctggtgagcgacatcaacagagcctgggagagcctggaggaggccgagtacagaagagagctggccctgagaaacgagctgatcagacaggagaagctggagcagctggccagaagattcgacagaaaggccgccatgagagagacctggctgagcgagaaccagagactggtggcccaggacaacttcggctacgacctggccgccgtggaggccgccaagaagaagcacgaggccatcgagaccgacaccgccgcctacgaggagagagtgagagccctggaggacctggcccaggagctggagaaggagaactaccacgaccagaagagaatcaccgccagaaaggacaacatcctgagactgtggagctacctgcaggagctgctgcagagcagaagacagagactggagaccaccctggccctgcagaagctgttccaggacatgctgcacagcatcgactggatggacgagatcaaggcccacctgctgagcgccgagttcggcaagcacctgctggaggtggaggacctgctgcagaagcacaagctgatggaggccgacatcgccatccagggcgacaaggtgaaggccatcaccgccgccaccctgaagttcaccgagggcaagggctaccagccctgcgacccccaggtgatccaggacagaatcagccacctggagcagtgcttcgaggagctgagcaacatggccgccggcagaaaggcccagctggagcagagcaagagactgtggaagttcttctgggagatggacgaggccgagagctggatcaaggagaaggagcagatctacagcagcctggactacggcaaggacctgaccagcgtgctgatcctgcagagaaagcacaaggccttcgaggacgagctgagaggcctggacgcccacctggagcagatcttccaggaggcccacggcatggtggccagaaagcagttcggccacccccagatcgaggccagaatcaaggaggtgagcgcccagtgggaccagctgaaggacctggccgccttctgcaagaagaacctgcaggacgccgagaacttcttccagttccagggcgacgccgacgacctgaaggcctggctgcaggacgcccacagactgctgagcggcgaggacgtgggccaggacgagggcgccaccagagccctgggcaagaagcacaaggacttcctggaggagctggaggagagcagaggcgtgatggagcacctggagcagcaggcccagggcttccccgaggagttcagagacagccccgacgtgacccacagactgcaggccctgagagagctgtaccagcaggtggtggcccaggccgacctgagacagcagagactgcaggaggccctggacctgtacaccgtgttcggcgagaccgacgcctgcgagctgtggatgggcgagaaggagaagtggctggccgagatggagatgcccgacaccctggaggacctggaggtggtgcagcacagattcgacatcctggaccaggagatgaagaccctgatgacccagatcgacggcgtgaacctggccgccaacagcctggtggagagcggccaccccagaagcagagaggtgaagcagtaccaggaccacctgaacaccagatggcaggccttccagaccctggtgagcgagagaagagaggccgtggacagcgccctgagagtgcacaactactgcgtggactgcgaggagaccagcaagtggatcaccgacaagaccaaggtggtggagagcaccaaggacctgggcagagacctggccggcatcatcgccatccagagaaagctgagcggcctggagagagacgtggccgccatccaggccagagtggacgccctggagagagagagccagcagctgatggacagccaccccgagcagaaggaggacatcggccagagacagaagcacctggaggagctgtggcagggcctgcagcagagcctgcagggccaggaggacctgctgggcgaggtgagccagctgcaggccttcctgcaggacctggacgacttccaggcctggctgagcatcacccagaaggccgtggccagcgaggacatgcccgagagcctgcccgaggccgagcagctgctgcagcagcacgccggcatcaaggacgagatcgacggccaccaggacagctaccagagagtgaaggagagcggcgagaaggtgatccagggccagaccgaccccgagtacctgctgctgggccagagactggagggcctggacaccggctggaacgccctgggcagaatgtgggagagcagaagccacaccctggcccagtgcctgggcttccaggagttccagaaggacgccaagcaggccgaggccatcctgagcaaccaggagtacaccctggcccacctggagccccccgacagcctggaggccgccgaggccggcatcagaaagttcgaggacttcctgggcagcatggagaacaacagagacaaggtgctgagccccgtggacagcggcaacaagctggtggccgagggcaacctgtacagcgacaagatcaaggagaaggtgcagctgatcgaggacagacacagaaagaacaacgagaaggcccaggaggccagcgtgctgctgagagacaacctggagctgcagaacttcctgcagaactgccaggagctgaccctgtggatcaacgacaagctgctgaccagccaggacgtgagctacgacgaggccagaaacctgcacaacaagtggctgaagcaccaggccttcgtggccgagctggccagccacgagggctggctggagaacatcgacgccgagggcaagcagctgatggacgagaagccccagttcaccgccctggtgagccagaagctggaggccctgcacagactgtgggacgagctgcaggccaccaccaaggagaagacccagcacctgagcgccgccagaagcagcgacctgagactgcagacccacgccgacctgaacaagtggatcagcgccatggaggaccagctgagaagcgacgaccccggcaaggacctgaccagcgtgaacagaatgctggccaagctgaagagagtggaggaccaggtgaacgtgagaaaggaggagctgggcgagctgttcgcccaggtgcccagcatgggcgaggagggcggcgacgccgacctgagcatcgagaagagattcctggacctgctggagcccctgggcagaagaaagaagcagctggagagcagcagagccaagctgcagatcagcagagacctggaggacgagaccctgtgggtggaggagagactgcccctggcccagagcgccgactacggcaccaacctgcagaccgtgcagctgttcatgaagaagaaccagaccctgcagaacgagatcctgggccacacccccagagtggaggacgtgctgcagagaggccagcagctggtggaggccgccgagatcgactgccaggacctggaggagagactgggccacctgcagagcagctgggacagactgagagaggccgccgccggcagactgcagagactgagagacgccaacgaggcccagcagtactacctggacgccgacgaggccgaggcctggatcggcgagcaggagctgtacgtgatcagcgacgagatccccaaggacgaggagggcgccatcgtgatgctgaagagacacctgagacagcagagagccgtggaggactacggcagaaacatcaagcagctggccagcagagcccagggcctgctgagcgccggccaccccgagggcgagcagatcatcagactgcagggccaggtggacaagcactacgccggcctgaaggacgtggccgaggagagaaagagaaagctggagaacatgtaccacctgttccagctgaagagagagaccgacgacctggagcagtggatcagcgagaaggagctggtggccagcagccccgagatgggccaggacttcgaccacgtgaccctgctgagagacaagttcagagacttcgccagagagaccggcgccatcggccaggagagagtggacaacgtgaacgccttcatcgagagactgatcgacgccggccacagcgaggccgccaccatcgccgagtggaaggacggcctgaacgagatgtgggccgacctgctggagctgatcgacaccagaatgcagctgctggccgccagctacgacctgcacagatacttctacaccggcgccgagatcctgggcctgatcgacgagaagcacagagagctgcccgaggacgtgggcctggacgccagcaccgccgagagcttccacagagtgcacaccgccttcgagagagagctgcacctgctgggcgtgcaggtgcagcagttccaggacgtggccaccagactgcagaccgcctacgccggcgagaaggccgaggccatccagaacaaggagcaggaggtgagcgccgcctggcaggccctgctggacgcctgcgccggcagaagaacccagctggtggacaccgccgacaagttcagattcttcagcatggccagagacctgctgagctggatggagagcatcatcagacagatcgagacccaggagagacccagagacgtgagcagcgtggagctgctgatgaagtaccaccagggcatcaacgccgagatcgagaccagaagcaagaacttcagcgcctgcctggagctgggcgagagcctgctgcagagacagcaccaggccagcgaggagatcagagagaagctgcagcaggtgatgagcagaagaaaggagatgaacgagaagtgggaggccagatgggagagactgagaatgctgctggaggtgtgccagttcagcagagacgccagcgtggccgaggcctggctgatcgcccaggagccctacctggccagcggcgacttcggccacaccgtggacagcgtggagaagctgatcaagagacacgaggccttcgagaagagcaccgccagctgggccgagagattcgccgccctggagaagcccaccaccgccagcagaggcggcagaagagacagcagaggcggcagcagcttccccccctgcggccacagagagaacgtgcccggccagagcctggtgagcttcgtgtag

SEQ ID NO: 100500 - DNA, 6414 bp, Artificial Sequence
  Description of Artificial Sequence: Synthetic coding sequence
atgaccagcgccaccgagttcgagaacgtgggcaaccagcccccctacagcagaatcaacgccagatgggacgcccccgacgacgagctggacaacgacaacagcagcgccagactgttcgagagaagcagaatcaaggccctggccgacgagagagaggtggtgcagaagaagaccttcaccaagtgggtgaacagccacctggccagagtgagctgcagaatcaccgacctgtacaaggacctgagagacggcagaatgctgatcaagctgctggaggtgctgagcggcgagatgctgcccaagcccaccaagggcaagatgagaatccactgcctggagaacgtggacaaggccctgcagttcctgaaggagcagagagtgcacctggagaacatgggcagccacgacatcgtggacggcaaccacagactggtgctgggcctgatctggaccatcatcctgagattccagatccaggacatcgtggtgcagacccaggagggcagagagaccagaagcgccaaggacgccctgctgctgtggtgccagatgaagaccgccggctacccccacgtgaacgtgaccaacttcaccagcagctggaaggacggcctggccttcaacgccctgatccacaagcacagacccgacctgatcgacttcgacaagctgaaggacagcaacgccagacacaacctggagcacgccttcaacgtggccgagagacagctgggcatcatccccctgctggaccccgaggacgtgttcaccgagaaccccgacgagaagagcatcatcacctacgtggtggccttctaccactacttcagcaagatgaaggtgctggccgtggagggcaagagagtgggcaaggtgatcgaccacgccatcgagaccgagaagatgatcgagaagtacagcggcctggccagcgacctgctgacctggatcgagcagaccatcaccgtgctgaacagcagaaagttcgccaacagcctgaccggcgtgcagcagcagctgcaggccttcagcacctacagaaccgtggagaagccccccaagttccaggagaagggcaacctggaggtgctgctgttcaccatccagagcagaatgagagccaacaaccagaaggtgtacaccccccacgacggcaagctggtgagcgacatcaacagagcctgggagagcctggaggaggccgagtacagaagagagctggccctgagaaacgagctgatcagacaggagaagctggagcagctggccagaagattcgacagaaaggccgccatgagagagacctggctgagcgagaaccagagactggtggcccaggacaacttcggctacgacctggccgccgtggaggccgccaagaagaagcacgaggccatcgagaccgacaccgccgcctacgaggagagagtgagagccctggaggacctggcccaggagctggagaaggagaactaccacgaccagaagagaatcaccgccagaaaggacaacatcctgagactgtggagctacctgcaggagctgctgcagagcagaagacagagactggagaccaccctggccctgcagaagctgttccaggacatgctgcacagcatcgactggatggacgagatcaaggcccacctgctgagcgccgagttcggcaagcacctgctggaggtggaggacctgctgcagaagcacaagctgatggaggccgacatcgccatccagggcgacaaggtgaaggccatcaccgccgccaccctgaagttcaccgagggcaagggctaccagccctgcgacccccaggtgatccaggacagaatcagccacctggagcagtgcttcgaggagctgagcaacatggccgccggcagaaaggcccagctggagcagagcaagagactgtggaagttcttctgggagatggacgaggccgagagctggatcaaggagaaggagcagatctacagcagcctggactacggcaaggacctgaccagcgtgctgatcctgcagagaaagcacaaggccttcgaggacgagctgagaggcctggacgcccacctggagcagatcttccaggaggcccacggcatggtggccagaaagcagttcggccacccccagatcgaggccagaatcaaggaggtgagcgcccagtgggaccagctgaaggacctggccgccttctgcaagaagaacctgcaggacgccgagaacttcttccagttccagggcgacgccgacgacctgaaggcctggctgcaggacgcccacagactgctgagcggcgaggacgtgggccaggacgagggcgccaccagagccctgggcaagaagcacaaggacttcctggaggagctggaggagagcagaggcgtgatggagcacctggagcagcaggcccagggcttccccgaggagttcagagacagccccgacgtgacccacagactgcaggccctgagagagctgtaccagcaggtggtggcccaggccgacctgagacagcagagactgcaggaggccctggacctgtacaccgtgttcggcgagaccgacgcctgcgagctgtggatgggcgagaaggagaagtggctggccgagatggagatgcccgacaccctggaggacctggaggtggtgcagcacagattcgacatcctggaccaggagatgaagaccctgatgacccagatcgacggcgtgaacctggccgccaacagcctggtggagagcggccaccccagaagcagagaggtgaagcagtaccaggaccacctgaacaccagatggcaggccttccagaccctggtgagcgagagaagagaggccgtggacagcgccctgagagtgcacaactactgcgtggactgcgaggagaccagcaagtggatcaccgacaagaccaaggtggtggagagcaccaaggacctgggcagagacctggccggcatcatcgccatccagagaaagctgagcggcctggagagagacgtggccgccatccaggccagagtggacgccctggagagagagagccagcagctgatggacagccaccccgagcagaaggaggacatcggccagagacagaagcacctggaggagctgtggcagggcctgcagcagagcctgcagggccaggaggacctgctgggcgaggtgagccagctgcaggccttcctgcaggacctggacgacttccaggcctggctgagcatcacccagaaggccgtggccagcgaggacatgcccgagagcctgcccgaggccgagcagctgctgcagcagcacgccggcatcaaggacgagatcgacggccaccaggacagctaccagagagtgaaggagagcggcgagaaggtgatccagggccagaccgaccccgagtacctgctgctgggccagagactggagggcctggacaccggctggaacgccctgggcagaatgtgggagagcagaagccacaccctggcccagtgcctgggcttccaggagttccagaaggacgccaagcaggccgaggccatcctgagcaaccaggagtacaccctggcccacctggagccccccgacagcctggaggccgccgaggccggcatcagaaagttcgaggacttcctgggcagcatggagaacaacagagacaaggtgctgagccccgtggacagcggcaacaagctggtggccgagggcaacctgtacagcgacaagatcaaggagaaggtgcagctgatcgaggacagacacagaaagaacaacgagaaggcccaggaggccagcgtgctgctgagagacaacctggagctgcagaacttcctgcagaactgccaggagctgaccctgtggatcaacgacaagctgctgaccagccaggacgtgagctacgacgaggccagaaacctgcacaacaagtggctgaagcaccaggccttcgtggccgagctggccagccacgagggctggctggagaacatcgacgccgagggcaagcagctgatggacgagaagccccagttcaccgccctggtgagccagaagctggaggccctgcacagactgtgggacgagctgcaggccaccaccaaggagaagacccagcacctgagcgccgccagaagcagcgacctgagactgcagacccacgccgacctgaacaagtggatcagcgccatggaggaccagctgagaagcgacgaccccggcaaggacctgaccagcgtgaacagaatgctggccaagctgaagagagtggaggaccaggtgaacgtgagaaaggaggagctgggcgagctgttcgcccaggtgcccagcatgggcgaggagggcggcgacgccgacctgagcatcgagaagagattcctggacctgctggagcccctgggcagaagaaagaagcagctggagagcagcagagccaagctgcagatcagcagagacctggaggacgagaccctgtgggtggaggagagactgcccctggcccagagcgccgactacggcaccaacctgcagaccgtgcagctgttcatgaagaagaaccagaccctgcagaacgagatcctgggccacacccccagagtggaggacgtgctgcagagaggccagcagctggtggaggccgccgagatcgactgccaggacctggaggagagactgggccacctgcagagcagctgggacagactgagagaggccgccgccggcagactgcagagactgagagacgccaacgaggcccagcagtactacctggacgccgacgaggccgaggcctggatcggcgagcaggagctgtacgtgatcagcgacgagatccccaaggacgaggagggcgccatcgtgatgctgaagagacacctgagacagcagagagccgtggaggactacggcagaaacatcaagcagctggccagcagagcccagggcctgctgagcgccggccaccccgagggcgagcagatcatcagactgcagggccaggtggacaagcactacgccggcctgaaggacgtggccgaggagagaaagagaaagctggagaacatgtaccacctgttccagctgaagagagagaccgacgacctggagcagtggatcagcgagaaggagctggtggccagcagccccgagatgggccaggacttcgaccacgtgaccctgctgagagacaagttcagagacttcgccagagagaccggcgccatcggccaggagagagtggacaacgtgaacgccttcatcgagagactgatcgacgccggccacagcgaggccgccaccatcgccgagtggaaggacggcctgaacgagatgtgggccgacctgctggagctgatcgacaccagaatgcagctgctggccgccagctacgacctgcacagatacttctacaccggcgccgagatcctgggcctgatcgacgagaagcacagagagctgcccgaggacgtgggcctggacgccagcaccgccgagagcttccacagagtgcacaccgccttcgagagagagctgcacctgctgggcgtgcaggtgcagcagttccaggacgtggccaccagactgcagaccgcctacgccggcgagaaggccgaggccatccagaacaaggagcaggaggtgagcgccgcctggcaggccctgctggacgcctgcgccggcagaagaacccagctggtggacaccgccgacaagttcagattcttcagcatggccagagacctgctgagctggatggagagcatcatcagacagatcgagacccaggagagacccagagacgtgagcagcgtggagctgctgatgaagtaccaccagggcatcaacgccgagatcgagaccagaagcaagaacttcagcgcctgcctggagctgggcgagagcctgctgcagagacagcaccaggccagcgaggagatcagagagaagctgcagcaggtgatgagcagaagaaaggagatgaacgagaagtgggaggccagatgggagagactgagaatgctgctggaggtgtgccagttcagcagagacgccagcgtggccgaggcctggctgatcgcccaggagccctacctggccagcggcgacttcggccacaccgtggacagcgtggagaagctgatcaagagacacgaggccttcgagaagagcaccgccagctgggccgagagattcgccgccctggagaagcccaccaccctggagctgaaggagagacagatcgccgagagacccgccgaggagaccggcccccaggaggaggagggcgagaccgccggcgaggcccccgtgagccaccacgccgccaccgagagaaccagccccgtgagcctgtggagcagactgagcagcagctgggagagcctgcagcccgagcccagccacccctactag

SEQ ID NO: 100501 - DNA, 6987 bp, Artificial Sequence
  Description of Artificial Sequence: Synthetic coding sequence
atgaccagcgccaccgagttcgagaacgtgggcaaccagcccccctacagcagaatcaacgccagatgggacgcccccgacgacgagctggacaacgacaacagcagcgccagactgttcgagagaagcagaatcaaggccctggccgacgagagagaggtggtgcagaagaagaccttcaccaagtgggtgaacagccacctggccagagtgagctgcagaatcaccgacctgtacaaggacctgagagacggcagaatgctgatcaagctgctggaggtgctgagcggcgagatgctgcccaagcccaccaagggcaagatgagaatccactgcctggagaacgtggacaaggccctgcagttcctgaaggagcagagagtgcacctggagaacatgggcagccacgacatcgtggacggcaaccacagactggtgctgggcctgatctggaccatcatcctgagattccagatccaggacatcgtggtgcagacccaggagggcagagagaccagaagcgccaaggacgccctgctgctgtggtgccagatgaagaccgccggctacccccacgtgaacgtgaccaacttcaccagcagctggaaggacggcctggccttcaacgccctgatccacaagcacagacccgacctgatcgacttcgacaagctgaaggacagcaacgccagacacaacctggagcacgccttcaacgtggccgagagacagctgggcatcatccccctgctggaccccgaggacgtgttcaccgagaaccccgacgagaagagcatcatcacctacgtggtggccttctaccactacttcagcaagatgaaggtgctggccgtggagggcaagagagtgggcaaggtgatcgaccacgccatcgagaccgagaagatgatcgagaagtacagcggcctggccagcgacctgctgacctggatcgagcagaccatcaccgtgctgaacagcagaaagttcgccaacagcctgaccggcgtgcagcagcagctgcaggccttcagcacctacagaaccgtggagaagccccccaagttccaggagaagggcaacctggaggtgctgctgttcaccatccagagcagaatgagagccaacaaccagaaggtgtacaccccccacgacggcaagctggtgagcgacatcaacagagcctgggagagcctggaggaggccgagtacagaagagagctggccctgagaaacgagctgatcagacaggagaagctggagcagctggccagaagattcgacagaaaggccgccatgagagagacctggctgagcgagaaccagagactggtggcccaggacaacttcggctacgacctggccgccgtggaggccgccaagaagaagcacgaggccatcgagaccgacaccgccgcctacgaggagagagtgagagccctggaggacctggcccaggagctggagaaggagaactaccacgaccagaagagaatcaccgccagaaaggacaacatcctgagactgtggagctacctgcaggagctgctgcagagcagaagacagagactggagaccaccctggccctgcagaagctgttccaggacatgctgcacagcatcgactggatggacgagatcaaggcccacctgctgagcgccgagttcggcaagcacctgctggaggtggaggacctgctgcagaagcacaagctgatggaggccgacatcgccatccagggcgacaaggtgaaggccatcaccgccgccaccctgaagttcaccgagggcaagggctaccagccctgcgacccccaggtgatccaggacagaatcagccacctggagcagtgcttcgaggagctgagcaacatggccgccggcagaaaggcccagctggagcagagcaagagactgtggaagttcttctgggagatggacgaggccgagagctggatcaaggagaaggagcagatctacagcagcctggactacggcaaggacctgaccagcgtgctgatcctgcagagaaagcacaaggccttcgaggacgagctgagaggcctggacgcccacctggagcagatcttccaggaggcccacggcatggtggccagaaagcagttcggccacccccagatcgaggccagaatcaaggaggtgagcgcccagtgggaccagctgaaggacctggccgccttctgcaagaagaacctgcaggacgccgagaacttcttccagttccagggcgacgccgacgacctgaaggcctggctgcaggacgcccacagactgctgagcggcgaggacgtgggccaggacgagggcgccaccagagccctgggcaagaagcacaaggacttcctggaggagctggaggagagcagaggcgtgatggagcacctggagcagcaggcccagggcttccccgaggagttcagagacagccccgacgtgacccacagactgcaggccctgagagagctgtaccagcaggtggtggcccaggccgacctgagacagcagagactgcaggaggccctggacctgtacaccgtgttcggcgagaccgacgcctgcgagctgtggatgggcgagaaggagaagtggctggccgagatggagatgcccgacaccctggaggacctggaggtggtgcagcacagattcgacatcctggaccaggagatgaagaccctgatgacccagatcgacggcgtgaacctggccgccaacagcctggtggagagcggccaccccagaagcagagaggtgaagcagtaccaggaccacctgaacaccagatggcaggccttccagaccctggtgagcgagagaagagaggccgtggacagcgccctgagagtgcacaactactgcgtggactgcgaggagaccagcaagtggatcaccgacaagaccaaggtggtggagagcaccaaggacctgggcagagacctggccggcatcatcgccatccagagaaagctgagcggcctggagagagacgtggccgccatccaggccagagtggacgccctggagagagagagccagcagctgatggacagccaccccgagcagaaggaggacatcggccagagacagaagcacctggaggagctgtggcagggcctgcagcagagcctgcagggccaggaggacctgctgggcgaggtgagccagctgcaggccttcctgcaggacctggacgacttccaggcctggctgagcatcacccagaaggccgtggccagcgaggacatgcccgagagcctgcccgaggccgagcagctgctgcagcagcacgccggcatcaaggacgagatcgacggccaccaggacagctaccagagagtgaaggagagcggcgagaaggtgatccagggccagaccgaccccgagtacctgctgctgggccagagactggagggcctggacaccggctggaacgccctgggcagaatgtgggagagcagaagccacaccctggcccagtgcctgggcttccaggagttccagaaggacgccaagcaggccgaggccatcctgagcaaccaggagtacaccctggcccacctggagccccccgacagcctggaggccgccgaggccggcatcagaaagttcgaggacttcctgggcagcatggagaacaacagagacaaggtgctgagccccgtggacagcggcaacaagctggtggccgagggcaacctgtacagcgacaagatcaaggagaaggtgcagctgatcgaggacagacacagaaagaacaacgagaaggcccaggaggccagcgtgctgctgagagacaacctggagctgcagaacttcctgcagaactgccaggagctgaccctgtggatcaacgacaagctgctgaccagccaggacgtgagctacgacgaggccagaaacctgcacaacaagtggctgaagcaccaggccttcgtggccgagctggccagccacgagggctggctggagaacatcgacgccgagggcaagcagctgatggacgagaagccccagttcaccgccctggtgagccagaagctggaggccctgcacagactgtgggacgagctgcaggccaccaccaaggagaagacccagcacctgagcgccgccagaagcagcgacctgagactgcagacccacgccgacctgaacaagtggatcagcgccatggaggaccagctgagaagcgacgaccccggcaaggacctgaccagcgtgaacagaatgctggccaagctgaagagagtggaggaccaggtgaacgtgagaaaggaggagctgggcgagctgttcgcccaggtgcccagcatgggcgaggagggcggcgacgccgacctgagcatcgagaagagattcctggacctgctggagcccctgggcagaagaaagaagcagctggagagcagcagagccaagctgcagatcagcagagacctggaggacgagaccctgtgggtggaggagagactgcccctggcccagagcgccgactacggcaccaacctgcagaccgtgcagctgttcatgaagaagaaccagaccctgcagaacgagatcctgggccacacccccagagtggaggacgtgctgcagagaggccagcagctggtggaggccgccgagatcgactgccaggacctggaggagagactgggccacctgcagagcagctgggacagactgagagaggccgccgccggcagactgcagagactgagagacgccaacgaggcccagcagtactacctggacgccgacgaggccgaggcctggatcggcgagcaggagctgtacgtgatcagcgacgagatccccaaggacgaggagggcgccatcgtgatgctgaagagacacctgagacagcagagagccgtggaggactacggcagaaacatcaagcagctggccagcagagcccagggcctgctgagcgccggccaccccgagggcgagcagatcatcagactgcagggccaggtggacaagcactacgccggcctgaaggacgtggccgaggagagaaagagaaagctggagaacatgtaccacctgttccagctgaagagagagaccgacgacctggagcagtggatcagcgagaaggagctggtggccagcagccccgagatgggccaggacttcgaccacgtgaccctgctgagagacaagttcagagacttcgccagagagaccggcgccatcggccaggagagagtggacaacgtgaacgccttcatcgagagactgatcgacgccggccacagcgaggccgccaccatcgccgagtggaaggacggcctgaacgagatgtgggccgacctgctggagctgatcgacaccagaatgcagctgctggccgccagctacgacctgcacagatacttctacaccggcgccgagatcctgggcctgatcgacgagaagcacagagagctgcccgaggacgtgggcctggacgccagcaccgccgagagcttccacagagtgcacaccgccttcgagagagagctgcacctgctgggcgtgcaggtgcagcagttccaggacgtggccaccagactgcagaccgcctacgccggcgagaaggccgaggccatccagaacaaggagcaggaggtgagcgccgcctggcaggccctgctggacgcctgcgccggcagaagaacccagctggtggacaccgccgacaagttcagattcttcagcatggccagagacctgctgagctggatggagagcatcatcagacagatcgagacccaggagagacccagagacgtgagcagcgtggagctgctgatgaagtaccaccagggcatcaacgccgagatcgagaccagaagcaagaacttcagcgcctgcctggagctgggcgagagcctgctgcagagacagcaccaggccagcgaggagatcagagagaagctgcagcaggtgatgagcagaagaaaggagatgaacgagaagtgggaggccagatgggagagactgagaatgctgctggaggtgtgccagttcagcagagacgccagcgtggccgaggcctggctgatcgcccaggagccctacctggccagcggcgacttcggccacaccgtggacagcgtggagaagctgatcaagagacacgaggccttcgagaagagcaccgccagctgggccgagagattcgccgccctggagaagcccaccaccctggagctgaaggagagacagatcgccgagagacccgccgaggagaccggcccccaggaggaggagggcgagaccgccggcgaggcccccgtgagccaccacgccgccaccgagagaaccagccccggcgaggaggagggcacctggccccagaacctgcagcagccccccccccccggccagcacaaggacggccagaagagcaccggcgacgagagacccaccaccgagcccctgttcaaggtgctggacacccccctgagcgagggcgacgagcccgccaccctgcccgcccccagagaccacggccagagcgtgcagatggagggctacctgggcagaaagcacgacctggagggccccaacaagaaggccagcaacagaagctggaacaacctgtactgcgtgctgagaaacagcgagctgaccttctacaaggacgccaagaacctggccctgggcatgccctaccacggcgaggagcccctggccctgagacacgccatctgcgagatcgccgccaactacaagaagaagaagcacgtgttcaagctgagactgagcaacggcagcgagtggctgttccacggcaaggacgaggaggagatgctgagctggctgcagggcgtgagcaccgccatcaacgagagccagagcatcagagtgaaggcccagagcctgcccctgcccagcctgagcggccccgacgccagcctgggcaagaaggacaaggagaagagattcagcttcttccccaagaagaagtag

SEQ ID NO: 100502 - DNA, 6999 bp, Artificial Sequence
  Description of Artificial Sequence: Synthetic coding sequence
gagcccgccgacatgaccagcgccaccgagttcgagaacgtgggcaaccagcccccctacagcagaatcaacgccagatgggacgcccccgacgacgagctggacaacgacaacagcagcgccagactgttcgagagaagcagaatcaaggccctggccgacgagagagaggtggtgcagaagaagaccttcaccaagtgggtgaacagccacctggccagagtgagctgcagaatcaccgacctgtacaaggacctgagagacggcagaatgctgatcaagctgctggaggtgctgagcggcgagatgctgcccaagcccaccaagggcaagatgagaatccactgcctggagaacgtggacaaggccctgcagttcctgaaggagcagagagtgcacctggagaacatgggcagccacgacatcgtggacggcaaccacagactggtgctgggcctgatctggaccatcatcctgagattccagatccaggacatcgtggtgcagacccaggagggcagagagaccagaagcgccaaggacgccctgctgctgtggtgccagatgaagaccgccggctacccccacgtgaacgtgaccaacttcaccagcagctggaaggacggcctggccttcaacgccctgatccacaagcacagacccgacctgatcgacttcgacaagctgaaggacagcaacgccagacacaacctggagcacgccttcaacgtggccgagagacagctgggcatcatccccctgctggaccccgaggacgtgttcaccgagaaccccgacgagaagagcatcatcacctacgtggtggccttctaccactacttcagcaagatgaaggtgctggccgtggagggcaagagagtgggcaaggtgatcgaccacgccatcgagaccgagaagatgatcgagaagtacagcggcctggccagcgacctgctgacctggatcgagcagaccatcaccgtgctgaacagcagaaagttcgccaacagcctgaccggcgtgcagcagcagctgcaggccttcagcacctacagaaccgtggagaagccccccaagttccaggagaagggcaacctggaggtgctgctgttcaccatccagagcagaatgagagccaacaaccagaaggtgtacaccccccacgacggcaagctggtgagcgacatcaacagagcctgggagagcctggaggaggccgagtacagaagagagctggccctgagaaacgagctgatcagacaggagaagctggagcagctggccagaagattcgacagaaaggccgccatgagagagacctggctgagcgagaaccagagactggtggcccaggacaacttcggctacgacctggccgccgtggaggccgccaagaagaagcacgaggccatcgagaccgacaccgccgcctacgaggagagagtgagagccctggaggacctggcccaggagctggagaaggagaactaccacgaccagaagagaatcaccgccagaaaggacaacatcctgagactgtggagctacctgcaggagctgctgcagagcagaagacagagactggagaccaccctggccctgcagaagctgttccaggacatgctgcacagcatcgactggatggacgagatcaaggcccacctgctgagcgccgagttcggcaagcacctgctggaggtggaggacctgctgcagaagcacaagctgatggaggccgacatcgccatccagggcgacaaggtgaaggccatcaccgccgccaccctgaagttcaccgagggcaagggctaccagccctgcgacccccaggtgatccaggacagaatcagccacctggagcagtgcttcgaggagctgagcaacatggccgccggcagaaaggcccagctggagcagagcaagagactgtggaagttcttctgggagatggacgaggccgagagctggatcaaggagaaggagcagatctacagcagcctggactacggcaaggacctgaccagcgtgctgatcctgcagagaaagcacaaggccttcgaggacgagctgagaggcctggacgcccacctggagcagatcttccaggaggcccacggcatggtggccagaaagcagttcggccacccccagatcgaggccagaatcaaggaggtgagcgcccagtgggaccagctgaaggacctggccgccttctgcaagaagaacctgcaggacgccgagaacttcttccagttccagggcgacgccgacgacctgaaggcctggctgcaggacgcccacagactgctgagcggcgaggacgtgggccaggacgagggcgccaccagagccctgggcaagaagcacaaggacttcctggaggagctggaggagagcagaggcgtgatggagcacctggagcagcaggcccagggcttccccgaggagttcagagacagccccgacgtgacccacagactgcaggccctgagagagctgtaccagcaggtggtggcccaggccgacctgagacagcagagactgcaggaggccctggacctgtacaccgtgttcggcgagaccgacgcctgcgagctgtggatgggcgagaaggagaagtggctggccgagatggagatgcccgacaccctggaggacctggaggtggtgcagcacagattcgacatcctggaccaggagatgaagaccctgatgacccagatcgacggcgtgaacctggccgccaacagcctggtggagagcggccaccccagaagcagagaggtgaagcagtaccaggaccacctgaacaccagatggcaggccttccagaccctggtgagcgagagaagagaggccgtggacagcgccctgagagtgcacaactactgcgtggactgcgaggagaccagcaagtggatcaccgacaagaccaaggtggtggagagcaccaaggacctgggcagagacctggccggcatcatcgccatccagagaaagctgagcggcctggagagagacgtggccgccatccaggccagagtggacgccctggagagagagagccagcagctgatggacagccaccccgagcagaaggaggacatcggccagagacagaagcacctggaggagctgtggcagggcctgcagcagagcctgcagggccaggaggacctgctgggcgaggtgagccagctgcaggccttcctgcaggacctggacgacttccaggcctggctgagcatcacccagaaggccgtggccagcgaggacatgcccgagagcctgcccgaggccgagcagctgctgcagcagcacgccggcatcaaggacgagatcgacggccaccaggacagctaccagagagtgaaggagagcggcgagaaggtgatccagggccagaccgaccccgagtacctgctgctgggccagagactggagggcctggacaccggctggaacgccctgggcagaatgtgggagagcagaagccacaccctggcccagtgcctgggcttccaggagttccagaaggacgccaagcaggccgaggccatcctgagcaaccaggagtacaccctggcccacctggagccccccgacagcctggaggccgccgaggccggcatcagaaagttcgaggacttcctgggcagcatggagaacaacagagacaaggtgctgagccccgtggacagcggcaacaagctggtggccgagggcaacctgtacagcgacaagatcaaggagaaggtgcagctgatcgaggacagacacagaaagaacaacgagaaggcccaggaggccagcgtgctgctgagagacaacctggagctgcagaacttcctgcagaactgccaggagctgaccctgtggatcaacgacaagctgctgaccagccaggacgtgagctacgacgaggccagaaacctgcacaacaagtggctgaagcaccaggccttcgtggccgagctggccagccacgagggctggctggagaacatcgacgccgagggcaagcagctgatggacgagaagccccagttcaccgccctggtgagccagaagctggaggccctgcacagactgtgggacgagctgcaggccaccaccaaggagaagacccagcacctgagcgccgccagaagcagcgacctgagactgcagacccacgccgacctgaacaagtggatcagcgccatggaggaccagctgagaagcgacgaccccggcaaggacctgaccagcgtgaacagaatgctggccaagctgaagagagtggaggaccaggtgaacgtgagaaaggaggagctgggcgagctgttcgcccaggtgcccagcatgggcgaggagggcggcgacgccgacctgagcatcgagaagagattcctggacctgctggagcccctgggcagaagaaagaagcagctggagagcagcagagccaagctgcagatcagcagagacctggaggacgagaccctgtgggtggaggagagactgcccctggcccagagcgccgactacggcaccaacctgcagaccgtgcagctgttcatgaagaagaaccagaccctgcagaacgagatcctgggccacacccccagagtggaggacgtgctgcagagaggccagcagctggtggaggccgccgagatcgactgccaggacctggaggagagactgggccacctgcagagcagctgggacagactgagagaggccgccgccggcagactgcagagactgagagacgccaacgaggcccagcagtactacctggacgccgacgaggccgaggcctggatcggcgagcaggagctgtacgtgatcagcgacgagatccccaaggacgaggagggcgccatcgtgatgctgaagagacacctgagacagcagagagccgtggaggactacggcagaaacatcaagcagctggccagcagagcccagggcctgctgagcgccggccaccccgagggcgagcagatcatcagactgcagggccaggtggacaagcactacgccggcctgaaggacgtggccgaggagagaaagagaaagctggagaacatgtaccacctgttccagctgaagagagagaccgacgacctggagcagtggatcagcgagaaggagctggtggccagcagccccgagatgggccaggacttcgaccacgtgaccctgctgagagacaagttcagagacttcgccagagagaccggcgccatcggccaggagagagtggacaacgtgaacgccttcatcgagagactgatcgacgccggccacagcgaggccgccaccatcgccgagtggaaggacggcctgaacgagatgtgggccgacctgctggagctgatcgacaccagaatgcagctgctggccgccagctacgacctgcacagatacttctacaccggcgccgagatcctgggcctgatcgacgagaagcacagagagctgcccgaggacgtgggcctggacgccagcaccgccgagagcttccacagagtgcacaccgccttcgagagagagctgcacctgctgggcgtgcaggtgcagcagttccaggacgtggccaccagactgcagaccgcctacgccggcgagaaggccgaggccatccagaacaaggagcaggaggtgagcgccgcctggcaggccctgctggacgcctgcgccggcagaagaacccagctggtggacaccgccgacaagttcagattcttcagcatggccagagacctgctgagctggatggagagcatcatcagacagatcgagacccaggagagacccagagacgtgagcagcgtggagctgctgatgaagtaccaccagggcatcaacgccgagatcgagaccagaagcaagaacttcagcgcctgcctggagctgggcgagagcctgctgcagagacagcaccaggccagcgaggagatcagagagaagctgcagcaggtgatgagcagaagaaaggagatgaacgagaagtgggaggccagatgggagagactgagaatgctgctggaggtgtgccagttcagcagagacgccagcgtggccgaggcctggctgatcgcccaggagccctacctggccagcggcgacttcggccacaccgtggacagcgtggagaagctgatcaagagacacgaggccttcgagaagagcaccgccagctgggccgagagattcgccgccctggagaagcccaccaccctggagctgaaggagagacagatcgccgagagacccgccgaggagaccggcccccaggaggaggagggcgagaccgccggcgaggcccccgtgagccaccacgccgccaccgagagaaccagccccggcgaggaggagggcacctggccccagaacctgcagcagccccccccccccggccagcacaaggacggccagaagagcaccggcgacgagagacccaccaccgagcccctgttcaaggtgctggacacccccctgagcgagggcgacgagcccgccaccctgcccgcccccagagaccacggccagagcgtgcagatggagggctacctgggcagaaagcacgacctggagggccccaacaagaaggccagcaacagaagctggaacaacctgtactgcgtgctgagaaacagcgagctgaccttctacaaggacgccaagaacctggccctgggcatgccctaccacggcgaggagcccctggccctgagacacgccatctgcgagatcgccgccaactacaagaagaagaagcacgtgttcaagctgagactgagcaacggcagcgagtggctgttccacggcaaggacgaggaggagatgctgagctggctgcagggcgtgagcaccgccatcaacgagagccagagcatcagagtgaaggcccagagcctgcccctgcccagcctgagcggccccgacgccagcctgggcaagaaggacaaggagaagagattcagcttcttccccaagaagaagtag

SEQ ID NO: 100503 - DNA, 6414 bp, Artificial Sequence; identical to SEQ ID NO: 100500
  Description of Artificial Sequence: Synthetic coding sequence

SEQ ID NO: 100504 - DNA, 6987 bp, Artificial Sequence; identical to SEQ ID NO: 100501
  Description of Artificial Sequence: Synthetic coding sequence

SEQ ID NO: 100505 - DNA, 6468 bp, Artificial Sequence
  Description of Artificial Sequence: Synthetic coding sequence
atggagctgcagagaaccagcagcatcagcggccccctgagccccgcctacaccggccaggtgccctacaactacaaccagctggagggcagattcaagcagctgcaggacgagagagaggccgtgcagaagaagaccttcaccaagtgggtgaacagccacctggccagagtgagctgcagaatcaccgacctgtacaccgacctgagagacggcagaatgctgatcaagctgctggaggtgctgagcggcgagagactgcccaagcccaccaagggcagaatgagaatccactgcctggagaacgtggacaaggccctgcagttcctgaaggagcagagagtgcacctggagaacatgggcagccacgacatcgtggacggcaaccacagactgaccctgggcctgatctggaccatcatcctgagattccagatccaggacatcagcgtggagaccgaggacaacaaggagaagaagagcgccaaggacgccctgctgctgtggtgccagatgaagaccgccggctaccccaacgtgaacatccacaacttcaccaccagctggagagacggcatggccttcaacgccctgatccacaagcacagacccgacctgatcgacttcgacaagctgaagaagagcaacgcccactacaacctgcagaacgccttcaacctggccgagcagcacctgggcctgaccaagctgctggaccccgaggacatcagcgtggaccaccccgacgagaagagcatcatcacctacgtggtgacctactaccactacttcagcaagatgaaggccctggccgtggagggcaagagaatcggcaaggtgctggacaacgccatcgagaccgagaagatgatcgagaagtacgagagcctggccagcgacctgctggagtggatcgagcagaccatcatcatcctgaacaacagaaagttcgccaacagcctggtgggcgtgcagcagcagctgcaggccttcaacacctacagaaccgtggagaagccccccaagttcaccgagaagggcaacctggaggtgctgctgttcaccatccagagcaagatgagagccaacaaccagaaggtgtacatgcccagagagggcaagctgatcagcgacatcaacaaggcctgggagagactggagaaggccgagcacgagagagagctggccctgagaaacgagctgatcagacaggagaagctggagcagctggccagaagattcgacagaaaggccgccatgagagagacctggctgagcgagaaccagagactggtgagccaggacaacttcggcttcgacctgcccgccgtggaggccgccaccaagaagcacgaggccatcgagaccgacatcgccgcctacgaggagagagtgcaggccgtggtggccgtggccagagagctggaggccgagaactaccacgacatcaagagaatcaccgccagaaaggacaacgtgatcagactgtgggagtacctgctggagctgctgagagccagaagacagagactggagatgaacctgggcctgcagaagatcttccaggagatgctgtacatcatggactggatggacgagatgaaggtgctggtgctgagccaggactacggcaagcacctgctgggcgtggaggacctgctgcagaagcacaccctggtggaggccgacatcggcatccaggccgagagagtgagaggcgtgaacgccagcgcccagaagttcgccaccgacggcgagggctacaagccctgcgacccccaggtgatcagagacagagtggcccacatggagttctgctaccaggagctgtgccagctggccgccgagagaagagccagactggaggagagcagaagactgtggaagttcttctgggagatggccgaggaggagggctggatcagagagaaggagaagatcctgagcagcgacgactacggcaaggacctgaccagcgtgatgagactgctgagcaagcacagagccttcgaggacgagatgagcggcagaagcggccacttcgagcaggccatcaaggagggcgaggacatgatcgccgaggagcacttcggcagcgagaagatcagagagagaatcatctacatcagagagcagtgggccaacctggagcagctgagcgccatcagaaagaagagactggaggaggccagcctgctgcaccagttccaggccgacgccgacgacatcgacgcctggatgctggacatcctgaagatcgtgagcagcagcgacgtgggccacgacgagtacagcacccagagcctggtgaagaagcacaaggacgtggccgaggagatcgccaactacagacccaccctggacaccctgcacgagcaggccagcgccctgccccaggagcacgccgagagccccgacgtgagaggcagactgagcggcatcgaggagagatacaaggaggtggccgagctgaccagactgagaaagcaggccctgcaggacaccctggccctgtacaagatgttcagcgaggccgacgcctgcgagctgtggatcgacgagaaggagcagtggctgaacaacatgcagatccccgagaagctggaggacctggaggtgatccagcacagattcgagagcctggagcccgagatgaacaaccaggccagcagagtggccgtggtgaaccagatcgccagacagctgatgcacagcggccaccccagcgagaaggagatcaaggcccagcaggacaagctgaacaccagatggagccagttcagagagctggtggacagaaagaaggacgccctgctgagcgccctgagcatccagaactaccacctggagtgcaacgagaccaagagctggatcagagagaagaccaaggtgatcgagagcacccaggacctgggcaacgacctggccggcgtgatggccctgcagagaaagctgaccggcatggagagagacctggtggccatcgaggccaagctgagcgacctgcagaaggaggccgagaagctggagagcgagcaccccgaccaggcccaggccatcctgagcagactggccgagatcagcgacgtgtgggaggagatgaagaccaccctgaagaacagagaggccagcctgggcgaggccagcaagctgcagcagttcctgagagacctggacgacttccagagctggctgagcagaacccagaccgccatcgccagcgaggacatgcccaacaccctgaccgaggccgagaagctgctgacccagcacgagaacatcaagaacgagatcgacaactacgaggaggactaccagaagatgagagacatgggcgagatggtgacccagggccagaccgacgcccagtacatgttcctgagacagagactgcaggccctggacaccggctggaacgagctgcacaagatgtgggagaacagacagaacctgctgagccagagccacgcctaccagcagttcctgagagacaccaagcaggccgaggccttcctgaacaaccaggagtacgtgctggcccacaccgagatgcccaccaccctggagggcgccgaggccgccatcaagaagcaggaggacttcatgaccaccatggacgccaacgaggagaagatcaacgccgtggtggagaccggcagaagactggtgagcgacggcaacatcaacagcgacagaatccaggagaaggtggacagcatcgacgacagacacagaaagaacagagagaccgccagcgagctgctgatgagactgaaggacaacagagacctgcagaagttcctgcaggactgccaggagctgagcctgtggatcaacgagaagatgctgaccgcccaggacatgagctacgacgaggccagaaacctgcacagcaagtggctgaagcaccaggccttcatggccgagctggccagcaacaaggagtggctggacaagatcgagaaggagggcatgcagctgatcagcgagaagcccgagaccgaggccgtggtgaaggagaagctgaccggcctgcacaagatgtgggaggtgctggagagcaccacccagaccaaggcccagagactgttcgacgccaacaaggccgagctgttcacccagagctgcgccgacctggacaagtggctgcacggcctggagagccagatccagagcgacgactacggcaaggacctgaccagcgtgaacatcctgctgaagaagcagcagatgctggagaaccagatggaggtgagaaagaaggagatcgaggagctgcagagccaggcccaggccctgagccaggagggcaagagcaccgacgaggtggacagcaagagactgaccgtgcagaccaagttcatggagctgctggagcccctgaacgagagaaagcacaacctgctggccagcaaggagatccaccagttcaacagagacgtggaggacgagatcctgtgggtgggcgagagaatgcccctggccaccagcaccgaccacggccacaacctgcagaccgtgcagctgctgatcaagaagaaccagaccctgcagaaggagatccagggccaccagcccagaatcgacgacatcttcgagagaagccagaacatcgtgaccgacagcagcagcctgagcgccgaggccatcagacagagactggccgacctgaagcagctgtggggcctgctgatcgaggagaccgagaagagacacagaagactggaggaggcccacagagcccagcagtactacttcgacgccgccgaggccgaggcctggatgagcgagcaggagctgtacatgatgagcgaggagaaggccaaggacgagcagagcgccgtgagcatgctgaagaagcaccagatcctggagcaggccgtggaggactacgccgagaccgtgcaccagctgagcaagaccagcagagccctggtggccgacagccaccccgagagcgagagaatcagcatgagacagagcaaggtggacaagctgtacgccggcctgaaggacctggccgaggagagaagaggcaagctggacgagagacacagactgttccagctgaacagagaggtggacgacctggagcagtggatcgccgagagagaggtggtggccggcagccacgagctgggccaggactacgagcacgtgaccatgctgcaggagagattcagagagttcgccagagacaccggcaacatcggccaggagagagtggacaccgtgaaccacctggccgacgagctgatcaacagcggccacagcgacgccgccaccatcgccgagtggaaggacggcctgaacgaggcctgggccgacctgctggagctgatcgacaccagaacccagatcctggccgccagctacgagctgcacaagttctaccacgacgccaaggagatcttcggcagaatccaggacaagcacaagaagctgcccgaggagctgggcagagaccagaacaccgtggagaccctgcagagaatgcacaccaccttcgagcacgacatccaggccctgggcacccaggtgagacagctgcaggaggacgccgccagactgcaggccgcctacgccggcgacaaggccgacgacatccagaagagagagaacgaggtgctggaggcctggaagagcctgctggacgcctgcgagagcagaagagtgagactggtggacaccggcgacaagttcagattcttcagcatggtgagagacctgatgctgtggatggaggacgtgatcagacagatcgaggcccaggagaagcccagagacgtgagcagcgtggagctgctgatgaacaaccaccagggcatcaaggccgagatcgacgccagaaacgacagcttcaccacctgcatcgagctgggcaagagcctgctggccagaaagcactacgccagcgaggagatcaaggagaagctgctgcagctgaccgagaagagaaaggagatgatcgacaagtgggaggacagatgggagtggctgagactgatcctggaggtgcaccagttcagcagagacgccagcgtggccgaggcctggctgctgggccaggagccctacctgagcagcagagagatcggccagagcgtggacgaggtggagaagctgatcaagagacacgaggccttcgagaagagcgccgccacctgggacgagagattcagcgccctggagagactgaccaccctggagctgctggaggtgagaagacagcaggaggaggaggagagaaagagaagaccccccagccccgagcccagcaccaaggtgagcgaggaggccgagagccagcagcagtgggacaccagcaagggcgagcaggtgagccagaacggcctgcccgccgagcagggcagccccagagtgagctacagaagccagacctaccagaactacaagaacttcaacagcagaagaaccgccagcgaccagccctggagcggcctgtag

SEQ ID NO: 100506 - DNA, 7095 bp, Artificial Sequence
  Description of Artificial Sequence: Synthetic coding sequence
atgaccaccaccgtggccaccgactacgacaacatcgagatccagcagcagtacagcgacgtgaacaacagatgggacgtggacgactgggacaacgagaacagcagcgccagactgttcgagagaagcagaatcaaggccctggccgacgagagagaggccgtgcagaagaagaccttcaccaagtgggtgaacagccacctggccagagtgagctgcagaatcaccgacctgtacaccgacctgagagacggcagaatgctgatcaagctgctggaggtgctgagcggcgagagactgcccaagcccaccaagggcagaatgagaatccactgcctggagaacgtggacaaggccctgcagttcctgaaggagcagagagtgcacctggagaacatgggcagccacgacatcgtggacggcaaccacagactgaccctgggcctgatctggaccatcatcctgagattccagatccaggacatcagcgtggagaccgaggacaacaaggagaagaagagcgccaaggacgccctgctgctgtggtgccagatgaagaccgccggctaccccaacgtgaacatccacaacttcaccaccagctggagagacggcatggccttcaacgccctgatccacaagcacagacccgacctgatcgacttcgacaagctgaagaagagcaacgcccactacaacctgcagaacgccttcaacctggccgagcagcacctgggcctgaccaagctgctggaccccgaggacatcagcgtggaccaccccgacgagaagagcatcatcacctacgtggtgacctactaccactacttcagcaagatgaaggccctggccgtggagggcaagagaatcggcaaggtgctggacaacgccatcgagaccgagaagatgatcgagaagtacgagagcctggccagcgacctgctggagtggatcgagcagaccatcatcatcctgaacaacagaaagttcgccaacagcctggtgggcgtgcagcagcagctgcaggccttcaacacctacagaaccgtggagaagccccccaagttcaccgagaagggcaacctggaggtgctgctgttcaccatccagagcaagatgagagccaacaaccagaaggtgtacatgcccagagagggcaagctgatcagcgacatcaacaaggcctgggagagactggagaaggccgagcacgagagagagctggccctgagaaacgagctgatcagacaggagaagctggagcagctggccagaagattcgacagaaaggccgccatgagagagacctggctgagcgagaaccagagactggtgagccaggacaacttcggcttcgacctgcccgccgtggaggccgccaccaagaagcacgaggccatcgagaccgacatcgccgcctacgaggagagagtgcaggccgtggtggccgtggccagagagctggaggccgagaactaccacgacatcaagagaatcaccgccagaaaggacaacgtgatcagactgtgggagtacctgctggagctgctgagagccagaagacagagactggagatgaacctgggcctgcagaagatcttccaggagatgctgtacatcatggactggatggacgagatgaaggtgctggtgctgagccaggactacggcaagcacctgctgggcgtggaggacctgctgcagaagcacaccctggtggaggccgacatcggcatccaggccgagagagtgagaggcgtgaacgccagcgcccagaagttcgccaccgacggcgagggctacaagccctgcgacccccaggtgatcagagacagagtggcccacatggagttctgctaccaggagctgtgccagctggccgccgagagaagagccagactggaggagagcagaagactgtggaagttcttctgggagatggccgaggaggagggctggatcagagagaaggagaagatcctgagcagcgacgactacggcaaggacctgaccagcgtgatgagactgctgagcaagcacagagccttcgaggacgagatgagcggcagaagcggccacttcgagcaggccatcaaggagggcgaggacatgatcgccgaggagcacttcggcagcgagaagatcagagagagaatcatctacatcagagagcagtgggccaacctggagcagctgagcgccatcagaaagaagagactggaggaggccagcctgctgcaccagttccaggccgacgccgacgacatcgacgcctggatgctggacatcctgaagatcgtgagcagcagcgacgtgggccacgacgagtacagcacccagagcctggtgaagaagcacaaggacgtggccgaggagatcgccaactacagacccaccctggacaccctgcacgagcaggccagcgccctgccccaggagcacgccgagagccccgacgtgagaggcagactgagcggcatcgaggagagatacaaggaggtggccgagctgaccagactgagaaagcaggccctgcaggacaccctggccctgtacaagatgttcagcgaggccgacgcctgcgagctgtggatcgacgagaaggagcagtggctgaacaacatgcagatccccgagaagctggaggacctggaggtgatccagcacagattcgagagcctggagcccgagatgaacaaccaggccagcagagtggccgtggtgaaccagatcgccagacagctgatgcacagcggccaccccagcgagaaggagatcaaggcccagcaggacaagctgaacaccagatggagccagttcagagagctggtggacagaaagaaggacgccctgctgagcgccctgagcatccagaactaccacctggagtgcaacgagaccaagagctggatcagagagaagaccaaggtgatcgagagcacccaggacctgggcaacgacctggccggcgtgatggccctgcagagaaagctgaccggcatggagagagacctggtggccatcgaggccaagctgagcgacctgcagaaggaggccgagaagctggagagcgagcaccccgaccaggcccaggccatcctgagcagactggccgagatcagcgacgtgtgggaggagatgaagaccaccctgaagaacagagaggccagcctgggcgaggccagcaagctgcagcagttcctgagagacctggacgacttccagagctggctgagcagaacccagaccgccatcgccagcgaggacatgcccaacaccctgaccgaggccgagaagctgctgacccagcacgagaacatcaagaacgagatcgacaactacgaggaggactaccagaagatgagagacatgggcgagatggtgacccagggccagaccgacgcccagtacatgttcctgagacagagactgcaggccctggacaccggctggaacgagctgcacaagatgtgggagaacagacagaacctgctgagccagagccacgcctaccagcagttcctgagagacaccaagcaggccgaggccttcctgaacaaccaggagtacgtgctggcccacaccgagatgcccaccaccctggagggcgccgaggccgccatcaagaagcaggaggacttcatgaccaccatggacgccaacgaggagaagatcaacgccgtggtggagaccggcagaagactggtgagcgacggcaacatcaacagcgacagaatccaggagaaggtggacagcatcgacgacagacacagaaagaacagagagaccgccagcgagctgctgatgagactgaaggacaacagagacctgcagaagttcctgcaggactgccaggagctgagcctgtggatcaacgagaagatgctgaccgcccaggacatgagctacgacgaggccagaaacctgcacagcaagtggctgaagcaccaggccttcatggccgagctggccagcaacaaggagtggctggacaagatcgagaaggagggcatgcagctgatcagcgagaagcccgagaccgaggccgtggtgaaggagaagctgaccggcctgcacaagatgtgggaggtgctggagagcaccacccagaccaaggcccagagactgttcgacgccaacaaggccgagctgttcacccagagctgcgccgacctggacaagtggctgcacggcctggagagccagatccagagcgacgactacggcaaggacctgaccagcgtgaacatcctgctgaagaagcagcagatgctggagaaccagatggaggtgagaaagaaggagatcgaggagctgcagagccaggcccaggccctgagccaggagggcaagagcaccgacgaggtggacagcaagagactgaccgtgcagaccaagttcatggagctgctggagcccctgaacgagagaaagcacaacctgctggccagcaaggagatccaccagttcaacagagacgtggaggacgagatcctgtgggtgggcgagagaatgcccctggccaccagcaccgaccacggccacaacctgcagaccgtgcagctgctgatcaagaagaaccagaccctgcagaaggagatccagggccaccagcccagaatcgacgacatcttcgagagaagccagaacatcgtgaccgacagcagcagcctgagcgccgaggccatcagacagagactggccgacctgaagcagctgtggggcctgctgatcgaggagaccgagaagagacacagaagactggaggaggcccacagagcccagcagtactacttcgacgccgccgaggccgaggcctggatgagcgagcaggagctgtacatgatgagcgaggagaaggccaaggacgagcagagcgccgtgagcatgctgaagaagcaccagatcctggagcaggccgtggaggactacgccgagaccgtgcaccagctgagcaagaccagcagagccctggtggccgacagccaccccgagagcgagagaatcagcatgagacagagcaaggtggacaagctgtacgccggcctgaaggacctggccgaggagagaagaggcaagctggacgagagacacagactgttccagctgaacagagaggtggacgacctggagcagtggatcgccgagagagaggtggtggccggcagccacgagctgggccaggactacgagcacgtgaccatgctgcaggagagattcagagagttcgccagagacaccggcaacatcggccaggagagagtggacaccgtgaaccacctggccgacgagctgatcaacagcggccacagcgacgccgccaccatcgccgagtggaaggacggcctgaacgaggcctgggccgacctgctggagctgatcgacaccagaacccagatcctggccgccagctacgagctgcacaagttctaccacgacgccaaggagatcttcggcagaatccaggacaagcacaagaagctgcccgaggagctgggcagagaccagaacaccgtggagaccctgcagagaatgcacaccaccttcgagcacgacatccaggccctgggcacccaggtgagacagctgcaggaggacgccgccagactgcaggccgcctacgccggcgacaaggccgacgacatccagaagagagagaacgaggtgctggaggcctggaagagcctgctggacgcctgcgagagcagaagagtgagactggtggacaccggcgacaagttcagattcttcagcatggtgagagacctgatgctgtggatggaggacgtgatcagacagatcgaggcccaggagaagcccagagacgtgagcagcgtggagctgctgatgaacaaccaccagggcatcaaggccgagatcgacgccagaaacgacagcttcaccacctgcatcgagctgggcaagagcctgctggccagaaagcactacgccagcgaggagatcaaggagaagctgctgcagctgaccgagaagagaaaggagatgatcgacaagtgggaggacagatgggagtggctgagactgatcctggaggtgcaccagttcagcagagacgccagcgtggccgaggcctggctgctgggccaggagccctacctgagcagcagagagatcggccagagcgtggacgaggtggagaagctgatcaagagacacgaggccttcgagaagagcgccgccacctgggacgagagattcagcgccctggagagactgaccaccctggagctgctggaggtgagaagacagcaggaggaggaggagagaaagagaagaccccccagccccgagcccagcaccaaggtgagcgaggaggccgagagccagcagcagtgggacaccagcaagggcgagcaggtgagccagaacggcctgcccgccgagcagggcagccccagaatggccgagaccgtggacaccagcgagatggtgaacggcgccaccgagcagagaaccagcagcaaggagagcagccccatccccagccccaccagcgacagaaaggccaagaccgccctgcccgcccagagcgccgccaccctgcccgccagaacccaggagacccccagcgcccagatggagggcttcctgaacagaaagcacgagtgggaggcccacaacaagaaggccagcagcagaagctggcacaacgtgtactgcgtgatcaacaaccaggagatgggcttctacaaggacgccaagaccgccgccagcggcatcccctaccacagcgaggtgcccgtgagcctgaaggaggccgtgtgcgaggtggccctggactacaagaagaagaagcacgtgttcaagctgagactgaacgacggcaacgagtacctgttccaggccaaggacgacgaggagatgaacacctggatccaggccatcagcagcgccatcagcagcgacaagcacgaggtgagcgccagcacccagagcacccccgccagcagcagagcccagaccctgcccaccagcgtggtgaccatcaccagcgagagcagccccggcaagagagagaaggacaaggagaaggacaaggagaagagattcagcctgttcggcaagaagaagtag

SEQ ID NO: 100507 - DNA, 2073 bp, Artificial Sequence
  Description of Artificial Sequence: Synthetic coding sequence
atgaccaccaccgtggccaccgactacgacaacatcgagatccagcagcagtacagcgacgtgaacaacagatgggacgtggacgactgggacaacgagaacagcagcgccagactgttcgagagaagcagaatcaaggccctggccgacgagagagaggccgtgcagaagaagaccttcaccaagtgggtgaacagccacctggccagagtgagctgcagaatcaccgacctgtacaccgacctgagagacggcagaatgctgatcaagctgctggaggtgctgagcggcgagagactgcccaagcccaccaagggcagaatgagaatccactgcctggagaacgtggacaaggccctgcagttcctgaaggagcagagagtgcacctggagaacatgggcagccacgacatcgtggacggcaaccacagactgaccctgggcctgatctggaccatcatcctgagattccagatccaggacatcagcgtggagaccgaggacaacaaggagaagaagagcgccaaggacgccctgctgctgtggtgccagatgaagaccgccggctaccccaacgtgaacatccacaacttcaccaccagctggagagacggcatggccttcaacgccctgatccacaagcacagacccgacctgatcgacttcgacaagctgaagaagagcaacgcccactacaacctgcagaacgccttcaacctggccgagcagcacctgggcctgaccaagctgctggaccccgaggacatcagcgtggaccaccccgacgagaagagcatcatcacctacgtggtgacctactaccactacttcagcaagatgaaggccctggccgtggagggcaagagaatcggcaaggtgctggacaacgccatcgagaccgagaagatgatcgagaagtacgagagcctggccagcgacctgctggagtggatcgagcagaccatcatcatcctgaacaacagaaagttcgccaacagcctggtgggcgtgcagcagcagctgcaggccttcaacacctacagaaccgtggagaagccccccaagttcaccgagaagggcaacctggaggtgctgctgttcaccatccagagcaagatgagagccaacaaccagaaggtgtacatgcccagagagggcaagctgatcagcgacatcaacaaggcctgggagagactggagaaggccgagcacgagagagagctggccctgagaaacgagctgatcagacaggagaagctggagcagctggccagaagattcgacagaaaggccgccatgagagagacctggctgagcgagaaccagagactggtgagccaggacaacttcggcttcgacctgcccgccgtggaggccgccaccaagaagcacgaggccatcgagaccgacatcgccgcctacgaggagagagtgcaggccgtggtggccgtggccagagagctggaggccgagaactaccacgacatcaagagaatcaccgccagaaaggacaacgtgatcagactgtgggagtacctgctggagctgctgagagccagaagacagagactggagatgaacctgggcctgcagaagatcttccaggagatgctgtacatcatggactggatggacgagatgaaggtgctggtgctgagccaggactacggcaagcacctgctgggcgtggaggacctgctgcagaagcacaccctggtggaggccgacatcggcatccaggccgagagagtgagaggcgtgaacgccagcgcccagaagttcgccaccgacggcgagggctacaagccctgcgacccccaggtgatcagagacagagtggcccacatggagttctgctaccaggagctgtgccagctggccgccgagagaagagccagactggaggagagcagaagactgtggaagttcttctgggagatggccgaggaggagggctggatcagagagaaggagaagatcctgagcagcgacgactacggcaaggacctgaccagcgtgatgagactgctgagcaagcacagagccttcgaggacgagatgagcggcagatag

SEQ ID NO: 100508 - DNA, 7173 bp, Artificial Sequence
  Description of Artificial Sequence: Synthetic coding sequence
atgagcagcaccctgagccccaccgacttcgacagcctggagatccagggccagtacagcgacatcaacaacagatgggacctgcccgacagcgactgggacaacgacagcagcagcgccagactgttcgagagaagcagaatcaaggccctggccgacgagagagaggccgtgcagaagaagaccttcaccaagtgggtgaacagccacctggccagagtgacctgcagagtgggcgacctgtacagcgacctgagagacggcagaaacctgctgagactgctggaggtgctgagcggcgagatcctgcccaagcccaccaagggcagaatgagaatccactgcctggagaacgtggacaaggccctgcagttcctgaaggagcagaaggtgcacctggagaacatgggcagccacgacatcgtggacggcaaccacagactgaccctgggcctggtgtggaccatcatcctgagattccagatccaggacatcagcgtggagaccgaggacaacaaggagaagaagagcgccaaggacgccctgctgctgtggtgccagatgaagaccgccggctaccccaacgtgaacgtgcacaacttcaccaccagctggagagacggcctggccttcaacgccatcgtgcacaagcacagacccgacctgctggacttcgagagcctgaagaagtgcaacgcccactacaacctgcagaacgccttcaacctggccgagaaggagctgggcctgaccaagctgctggaccccgaggacgtgaacgtggaccagcccgacgagaagagcatcatcacctacgtggccacctactaccactacttcagcaagatgaaggccctggccgtggagggcaagagaatcggcaaggtgctggaccacgccatggaggccgagagactggtggagaagtacgagagcctggccagcgagctgctgcagtggatcgagcagaccatcgtgaccctgaacgacagacagctggccaacagcctgagcggcgtgcagaaccagctgcagagcttcaacagctacagaaccgtggagaagccccccaagttcaccgagaagggcaacctggaggtgctgctgttcaccatccagagcaagctgagagccaacaaccagaaggtgtacacccccagagagggcagactgatcagcgacatcaacaaggcctgggagagactggagaaggccgagcacgagagagagctggccctgagaaccgagctgatcagacaggagaagctggagcagctggccgccagattcgacagaaaggccgccatgagagagacctggctgagcgagaaccagagactggtgagccaggacaacttcggcctggagctggccgccgtggaggccgccgtgagaaagcacgaggccatcgagaccgacatcgtggcctacagcggcagagtgcaggccgtggacgccgtggccgccgagctggccgccgagagataccacgacatcaagagaatcgccgccagacagcacaacgtggccagactgtgggacttcctgagacagatggtggccgccagaagagagagactgctgctgaacctggagctgcagaaggtgttccaggacctgctgtacctgatggactggatggaggagatgaagggcagactgcagagccaggacctgggcagacacctggccggcgtggaggacctgctgcagctgcacgagctggtggaggccgacatcgccgtgcaggccgagagagtgagagccgtgagcgccagcgccctgagattctgcaaccccggcaaggagtacagaccctgcgacccccagctggtgagcgagagagtggccaagctggagcagagctacgaggccctgtgcgagctggccgccgccagaagagccagactggaggagagcagaagactgtggagattcctgtgggaggtgggcgaggccgaggcctgggtgagagagcagcagcacctgctggccagcgccgacaccggcagagacctgaccggcgccctgagactgctgaacaagcacaccgccctgagaggcgagatgagcggcagactgggccccctgaagctgaccctggagcagggccagcagctggtggccgagggccaccccggcgccagccaggccagcgccagagccgccgagctgcaggcccagtgggagagactggaggccctggccgaggagagagcccagagactggcccaggccgccagcctgtaccagttccaggccgacgccaacgacatggaggcctggctggtggacgccctgagactggtgagcagccccgagctgggccacgacgagttcagcacccaggccctggccagacagcacagagccctggaggaggagatcagaagccacagacccaccctggacgccctgagagagcaggccgccgccctgccccccaccctgagcagaacccccgaggtgcagagcagagtgcccaccctggagagacactacgaggagctgcaggccagagccggcgagagagccagagccctggaggccgccctggccctgtacaccatgctgagcgaggccggcgcctgcggcctgtgggtggaggagaaggagcagtggctgaacggcctggccctgcccgagagactggaggacctggaggtggtgcagcagagattcgagaccctggagcccgagatgaacaccctggccgcccagatcaccgccgtgaacgacatcgccgagcagctgctgaaggccaacccccccggcaaggacagaatcgtgaacacccaggagcagctgaaccacagatggcagcagttcagaagactggccgacggcaagaaggccgccctgaccagcgccctgagcatccagaactaccacctggagtgcaccgagacccaggcctggatgagagagaagaccaaggtgatcgagagcacccagggcctgggcaacgacctggccggcgtgctggccctgcagagaaagctggccggcaccgagagagacctggaggccatcgccgccagagtgggcgagctgaccagagaggccaacgccctggccgccggccaccccgcccaggccgtggccatcaacgccagactgagagaggtgcagaccggctgggaggacctgagagccaccatgagaagaagagaggagagcctgggcgaggccagaagactgcaggacttcctgagaagcctggacgacttccaggcctggctgggcagaacccagaccgccgtggccagcgaggagggccccgccaccctgcccgaggccgaggccctgctggcccagcacgccgccctgagaggcgaggtggagagagcccagagcgagtacagcagactgagagccctgggcgaggaggtgaccagagaccaggccgacccccagtgcctgttcctgagacagagactggaggccctgggcaccggctgggaggagctgggcagaatgtgggagagcagacagggcagactggcccaggcccacggcttccagggcttcctgagagacgccagacaggccgagggcgtgctgagcagccaggagtacgtgctgagccacaccgagatgcccggcaccctgcaggccgccgacgccgccatcaagaagctggaggacttcatgagcaccatggacgccaacggcgagagaatccacggcctgctggaggccggcagacagctggtgagcgagggcaacatccacgccgacaagatcagagagaaggccgacagcatcgagagaagacacaagaagaaccaggacgccgcccagcagttcctgggcagactgagagacaacagagagcagcagcacttcctgcaggactgccacgagctgaagctgtggatcgacgagaagatgctgaccgcccaggacgtgagctacgacgaggccagaaacctgcacaccaagtggcagaagcaccaggccttcatggccgagctggccgccaacaaggactggctggacaaggtggacaaggagggcagagagctgaccctggagaagcccgagctgaaggccctggtgagcgagaagctgagagacctgcacagaagatgggacgagctggagaccaccacccaggccaaggccagaagcctgttcgacgccaacagagccgagctgttcgcccagagctgctgcgccctggagagctggctggagagcctgcaggcccagctgcacagcgacgactacggcaaggacctgaccagcgtgaacatcctgctgaagaagcagcagatgctggagtgggagatggccgtgagagagaaggaggtggaggccatccaggcccaggccaaggccctggcccaggaggaccagggcgccggcgaggtggagagaaccagcagagccgtggaggagaagttcagagccctgtgccagcccatgagagagagatgcagaagactgcaggccagcagagagcagcaccagttccacagagacgtggaggacgagatcctgtgggtgaccgagagactgcccatggccagcagcatggagcacggcaaggacctgcccagcgtgcagctgctgatgaagaagaaccagaccctgcagaaggagatccagggccacgagcccagaatcgccgacctgagagagagacagagagccctgggcgccgccgccgccggccccgagctggccgagctgcaggagatgtggaagagactgggccacgagctggagctgagaggcaagagactggaggacgccctgagagcccagcagttctacagagacgccgccgaggccgaggcctggatgggcgagcaggagctgcacatgatgggccaggagaaggccaaggacgagctgagcgcccaggccgaggtgaagaagcaccaggtgctggagcaggccctggccgactacgcccagaccatccaccagctggccgccagcagccaggacatgatcgaccacgagcaccccgagagcaccagaatcagcatcagacaggcccaggtggacaagctgtacgccggcctgaaggagctggccggcgagagaagagagagactgcaggagcacctgagactgtgccagctgagaagagagctggacgacctggagcagtggatccaggagagagaggtggtggccgccagccacgagctgggccaggactacgagcacgtgaccatgctgagagacaagttcagagagttcagcagagacaccagcaccatcggccaggagagagtggacagcgccaacgccctggccaacggcctgatcgccggcggccacgccgccagagccaccgtggccgagtggaaggacagcctgaacgaggcctgggccgacctgctggagctgctggacaccagaggccaggtgctggccgccgcctacgagctgcagagattcctgcacggcgccagacaggccctggccagagtgcagcacaagcagcagcagctgcccgacggcaccggcagagacctgaacgccgccgaggccctgcagagaagacactgcgcctacgagcacgacatccaggccctgagcccccaggtgcagcaggtgcaggacgacggccacagactgcagaaggcctacgccggcgacaaggccgaggagatcggcagacacatgcaggccgtggccgaggcctgggcccagctgcagggcagcagcgccgccagaagacagctgctgctggacaccaccgacaagttcagattcttcaaggccgtgagagagctgatgctgtggatggacgaggtgaacctgcagatggacgcccaggagagacccagagacgtgagcagcgccgacctggtgatcaagaaccagcagggcatcaaggccgagatcgaggccagagccgacagattcagcagctgcatcgacatgggcaaggagctgctggccagaagccactacgccgccgaggagatcagcgagaagctgagccagctgcaggccagaagacaggagaccgccgagaagtggcaggagaagatggactggctgcagctggtgctggaggtgctggtgttcggcagagacgccggcatggccgaggcctggctgtgcagccaggagcccctggtgagaagcgccgagctgggctgcaccgtggacgaggtggagagcctgatcaagagacacgaggccttccagaagagcgccgtggcctgggaggagagattctgcgccctggagaagctgaccgccctggaggagagagagaaggagagaaagagaaagagagaggaggaggagagaagaaagcagccccccgcccccgagcccaccgccagcgtgccccccggcgacctggtgggcggccagaccgccagcgacaccacctgggacggcacccagcccagacccccccccagcacccaggcccccagcgtgaacggcgtgtgcaccgacggcgagcccagccagcccctgctgggccagcagagactggagcacagcagcttccccgagggccccggccccggcagcggcgacgaggccaacggccccagaggcgagagacagaccagaaccagaggccccgcccccagcgccatgccccagagcagaagcaccgagagcgcccacgccgccaccctgccccccagaggccccgagcccagcgcccaggagcagatggagggcatgctgtgcagaaagcaggagatggaggccttcggcaagaaggccgccaacagaagctggcagaacgtgtactgcgtgctgagaagaggcagcctgggcttctacaaggacgccaaggccgccagcgccggcgtgccctaccacggcgaggtgcccgtgagcctggccagagcccagggcagcgtggccttcgactacagaaagagaaagcacgtgttcaagctgggcctgcaggacggcaaggagtacctgttccaggccaaggacgaggccgagatgagcagctggctgagagtggtgaacgccgccatcgccaccgccagcagcgccagcggcgagcccgaggagcccgtggtgcccagcaccaccagaggcatgaccagagccatgaccatgccccccgtgagccccgtgggcgccgagggccccgtggtgctgagaagcaaggacggcagagagagagagagagagaagagattcagcttcttcaagaagaacaagtag

SEQ ID NO: 100509 - DNA, 2805 bp, Artificial Sequence
  Description of Artificial Sequence: Synthetic coding sequence
atgagcagcaccctgagccccaccgacttcgacagcctggagatccagggccagtacagcgacatcaacaacagatgggacctgcccgacagcgactgggacaacgacagcagcagcgccagactgttcgagagaagcagaatcaaggccctggccgacgagagagaggccgtgcagaagaagaccttcaccaagtgggtgaacagccacctggccagagtgacctgcagagtgggcgacctgtacagcgacctgagagacggcagaaacctgctgagactgctggaggtgctgagcggcgagatcctgcccaagcccaccaagggcagaatgagaatccactgcctggagaacgtggacaaggccctgcagttcctgaaggagcagaaggtgcacctggagaacatgggcagccacgacatcgtggacggcaaccacagactgaccctgggcctggtgtggaccatcatcctgagattccagatccaggacatcagcgtggagaccgaggacaacaaggagaagaagagcgccaaggacgccctgctgctgtggtgccagatgaagaccgccggctaccccaacgtgaacgtgcacaacttcaccaccagctggagagacggcctggccttcaacgccatcgtgcacaagcacagacccgacctgctggacttcgagagcctgaagaagtgcaacgcccactacaacctgcagaacgccttcaacctggccgagaaggagctgggcctgaccaagctgctggaccccgaggacgtgaacgtggaccagcccgacgagaagagcatcatcacctacgtggccacctactaccactacttcagcaagatgaaggccctggccgtggagggcaagagaatcggcaaggtgctggaccacgccatggaggccgagagactggtggagaagtacgagagcctggccagcgagctgctgcagtggatcgagcagaccatcgtgaccctgaacgacagacagctggccaacagcctgagcggcgtgcagaaccagctgcagagcttcaacagctacagaaccgtggagaagccccccaagttcaccgagaagggcaacctggaggtgctgctgttcaccatccagagcaagctgagagccaacaaccagaaggtgtacacccccagagagggcagactgatcagcgacatcaacaaggcctgggagagactggagaaggccgagcacgagagagagctggccctgagaaccgagctgatcagacaggagaagctggagcagctggccgccagattcgacagaaaggccgccatgagagagacctggctgagcgagaaccagagactggtgagccaggacaacttcggcctggagctggccgccgtggaggccgccgtgagaaagcacgaggccatcgagaccgacatcgtggcctacagcggcagagtgcaggccgtggacgccgtggccgccgagctggccgccgagagataccacgacatcaagagaatcgccgccagacagcacaacgtggccagactgtgggacttcctgagacagatggtggccgccagaagagagagactgctgctgaacctggagctgcagaaggtgttccaggacctgctgtacctgatggactggatggaggagatgaagggcagactgcagagccaggacctgggcagacacctggccggcgtggaggacctgctgcagctgcacgagctggtggaggccgacatcgccgtgcaggccgagagagtgagagccgtgagcgccagcgccctgagattctgcaaccccggcaaggagtacagaccctgcgacccccagctggtgagcgagagagtggccaagctgaccgccctggaggagagagagaaggagagaaagagaaagagagaggaggaggagagaagaaagcagccccccgcccccgagcccaccgccagcgtgccccccggcgacctggtgggcggccagaccgccagcgacaccacctgggacggcacccagcccagacccccccccagcacccaggcccccagcgtgaacggcgtgtgcaccgacggcgagcccagccagcccctgctgggccagcagagactggagcacagcagcttccccgagggccccggccccggcagcggcgacgaggccaacggccccagaggcgagagacagaccagaaccagaggccccgcccccagcgccatgccccagagcagaagcaccgagagcgcccacgccgccaccctgccccccagaggccccgagcccagcgcccaggagcagatggagggcatgctgtgcagaaagcaggagatggaggccttcggcaagaaggccgccaacagaagctggcagaacgtgtactgcgtgctgagaagaggcagcctgggcttctacaaggacgccaaggccgccagcgccggcgtgccctaccacggcgaggtgcccgtgagcctggccagagcccagggcagcgtggccttcgactacagaaagagaaagcacgtgttcaagctgggcctgcaggacggcaaggagtacctgttccaggccaaggacgaggccgagatgagcagctggctgagagtggtgaacgccgccatcgccaccgccagcagcgccagcggcgagcccgaggagcccgtggtgcccagcaccaccagaggcatgaccagagccatgaccatgccccccgtgagccccgtgggcgccgagggccccgtggtgctgagaagcaaggacggcagagagagagagagagagaagagattcagcttcttcaagaagaacaagtag

SEQ ID NO: 100510 - DNA, 354 bp, Artificial Sequence
  Description of Artificial Sequence: Synthetic coding sequence
atgagcagcaccctgagccccaccgacttcgacagcctggagatccagggccagtacagcgacatcaacaacagatgggacctgcccgacagcgactgggacaacgacagcagcagcgccagactgttcgagagaagcagaatcaaggccctggccgacgagagagaggccgtgcagaagaagaccttcaccaagtgggtgaacagccacctggccagagtgacctgcagagtgggcgacctgtacagcgacctgagagacggcagaaacctgctgagactgctggaggtgctgagcggcgagatcctgcccaagcccaccaagggcagaatgagaatccactgcctggagtag

SEQ ID NO: 100511 - DNA, 7098 bp, Artificial Sequence
  Description of Artificial Sequence: Synthetic coding sequence
atgagcagcaccctgagccccaccgacttcgacagcctggagatccagggccagtacagcgacatcaacaacagatgggacctgcccgacagcgactgggacaacgacagcagcagcgccagactgttcgagagaagcagaatcaaggccctggccgacgagagagaggccgtgcagaagaagaccttcaccaagtgggtgaacagccacctggccagagtgacctgcagagtgggcgacctgtacagcgacctgagagacggcagaaacctgctgagactgctggaggtgctgagcggcgagatcctgcccaagcccaccaagggcagaatgagaatccactgcctggagaacgtggacaaggccctgcagttcctgaaggagcagaaggtgcacctggagaacatgggcagccacgacatcgtggacggcaaccacagactgaccctgggcctggtgtggaccatcatcctgagattccagatccaggacatcagcgtggagaccgaggacaacaaggagaagaagagcgccaaggacgccctgctgctgtggtgccagatgaagaccgccggctaccccaacgtgaacgtgcacaacttcaccaccagctggagagacggcctggccttcaacgccatcgtgcacaagcacagacccgacctgctggacttcgagagcctgaagaagtgcaacgcccactacaacctgcagaacgccttcaacctggccgagaaggagctgggcctgaccaagctgctggaccccgaggacgtgaacgtggaccagcccgacgagaagagcatcatcacctacgtggccacctactaccactacttcagcaagatgaaggccctggccgtggagggcaagagaatcggcaaggtgctggaccacgccatggaggccgagagactggtggagaagtacgagagcctggccagcgagctgctgcagtggatcgagcagaccatcgtgaccctgaacgacagacagctggccaacagcctgagcggcgtgcagaaccagctgcagagcttcaacagctacagaaccgtggagaagccccccaagttcaccgagaagggcaacctggaggtgctgctgttcaccatccagagcaagctgagagccaacaaccagaaggtgtacacccccagagagggcagactgatcagcgacatcaacaaggcctgggagagactggagaaggccgagcacgagagagagctggccctgagaaccgagctgatcagacaggagaagctggagcagctggccgccagattcgacagaaaggccgccatgagagagacctggctgagcgagaaccagagactggtgagccaggacaacttcggcctggagctggccgccgtggaggccgccgtgagaaagcacgaggccatcgagaccgacatcgtggcctacagcggcagagtgcaggccgtggacgccgtggccgccgagctggccgccgagagataccacgacatcaagagaatcgccgccagacagcacaacgtggccagactgtgggacttcctgagacagatggtggccgccagaagagagagactgctgctgaacctggagctgcagaaggtgttccaggacctgctgtacctgatggactggatggaggagatgaagggcagactgcagagccaggacctgggcagacacctggccggcgtggaggacctgctgcagctgcacgagctggtggaggccgacatcgccgtgcaggccgagagagtgagagccgtgagcgccagcgccctgagattctgcaaccccggcaaggagtacagaccctgcgacccccagctggtgagcgagagagtggccaagctggagcagagctacgaggccctgtgcgagctggccgccgccagaagagccagactggaggagagcagaagactgtggagattcctgtgggaggtgggcgaggccgaggcctgggtgagagagcagcagcacctgctggccagcgccgacaccggcagagacctgaccggcgccctgagactgctgaacaagcacaccgccctgagaggcgagatgagcggcagactgggccccctgaagctgaccctggagcagggccagcagctggtggccgagggccaccccggcgccagccaggccagcgccagagccgccgagctgcaggcccagtgggagagactggaggccctggccgaggagagagcccagagactggcccaggccgccagcctgtaccagttccaggccgacgccaacgacatggaggcctggctggtggacgccctgagactggtgagcagccccgagctgggccacgacgagttcagcacccaggccctggccagacagcacagagccctggaggaggagatcagaagccacagacccaccctggacgccctgagagagcaggccgccgccctgccccccaccctgagcagaacccccgaggtgcagagcagagtgcccaccctggagagacactacgaggagctgcaggccagagccggcgagagagccagagccctggaggccgccctggccctgtacaccatgctgagcgaggccggcgcctgcggcctgtgggtggaggagaaggagcagtggctgaacggcctggccctgcccgagagactggaggacctggaggtggtgcagcagagattcgagaccctggagcccgagatgaacaccctggccgcccagatcaccgccgtgaacgacatcgccgagcagctgctgaaggccaacccccccggcaaggacagaatcgtgaacacccaggagcagctgaaccacagatggcagcagttcagaagactggccgacggcaagaaggccgccctgaccagcgccctgagcatccagaactaccacctggagtgcaccgagacccaggcctggatgagagagaagaccaaggtgatcgagagcacccagggcctgggcaacgacctggccggcgtgctggccctgcagagaaagctggccggcaccgagagagacctggaggccatcgccgccagagtgggcgagctgaccagagaggccaacgccctggccgccggccaccccgcccaggccgtggccatcaacgccagactgagagaggtgcagaccggctgggaggacctgagagccaccatgagaagaagagaggagagcctgggcgaggccagaagactgcaggacttcctgagaagcctggacgacttccaggcctggctgggcagaacccagaccgccgtggccagcgaggagggccccgccaccctgcccgaggccgaggccctgctggcccagcacgccgccctgagaggcgaggtggagagagcccagagcgagtacagcagactgagagccctgggcgaggaggtgaccagagaccaggccgacccccagtgcctgttcctgagacagagactggaggccctgggcaccggctgggaggagctgggcagaatgtgggagagcagacagggcagactggcccaggcccacggcttccagggcttcctgagagacgccagacaggccgagggcgtgctgagcagccaggagtacgtgctgagccacaccgagatgcccggcaccctgcaggccgccgacgccgccatcaagaagctggaggacttcatgagcaccatggacgccaacggcgagagaatccacggcctgctggaggccggcagacagctggtgagcgagggcaacatccacgccgacaagatcagagagaaggccgacagcatcgagagaagacacaagaagaaccaggacgccgcccagcagttcctgggcagactgagagacaacagagagcagcagcacttcctgcaggactgccacgagctgaagctgtggatcgacgagaagatgctgaccgcccaggacgtgagctacgacgaggccagaaacctgcacaccaagtggcagaagcaccaggccttcatggccgagctggccgccaacaaggactggctggacaaggtggacaaggagggcagagagctgaccctggagaagcccgagctgaaggccctggtgagcgagaagctgagagacctgcacagaagatgggacgagctggagaccaccacccaggccaaggccagaagcctgttcgacgccaacagagccgagctgttcgcccagagctgctgcgccctggagagctggctggagagcctgcaggcccagctgcacagcgacgactacggcaaggacctgaccagcgtgaacatcctgctgaagaagcagcagatgctggagtgggagatggccgtgagagagaaggaggtggaggccatccaggcccaggccaaggccctggcccaggaggaccagggcgccggcgaggtggagagaaccagcagagccgtggaggagaagttcagagccctgtgccagcccatgagagagagatgcagaagactgcaggccagcagagagcagcaccagttccacagagacgtggaggacgagatcctgtgggtgaccgagagactgcccatggccagcagcatggagcacggcaaggacctgcccagcgtgcagctgctgatgaagaagaaccagaccctgcagaaggagatccagggccacgagcccagaatcgccgacctgagagagagacagagagccctgggcgccgccgccgccggccccgagctggccgagctgcaggagatgtggaagagactgggccacgagctggagctgagaggcaagagactggaggacgccctgagagcccagcagttctacagagacgccgccgaggccgaggcctggatgggcgagcaggagctgcacatgatgggccaggagaaggccaaggacgagctgagcgcccaggccgaggtgaagaagcaccaggtgctggagcaggccctggccgactacgcccagaccatccaccagctggccgccagcagccaggacatgatcgaccacgagcaccccgagagcaccagaatcagcatcagacaggcccaggtggacaagctgtacgccggcctgaaggagctggccggcgagagaagagagagactgcaggagcacctgagactgtgccagctgagaagagagctggacgacctggagcagtggatccaggagagagaggtggtggccgccagccacgagctgggccaggactacgagcacgtgaccatgctgagagacaagttcagagagttcagcagagacaccagcaccatcggccaggagagagtggacagcgccaacgccctggccaacggcctgatcgccggcggccacgccgccagagccaccgtggccgagtggaaggacagcctgaacgaggcctgggccgacctgctggagctgctggacaccagaggccaggtgctggccgccgcctacgagctgcagagattcctgcacggcgccagacaggccctggccagagtgcagcacaagcagcagcagctgcccgacggcaccggcagagacctgaacgccgccgaggccctgcagagaagacactgcgcctacgagcacgacatccaggccctgagcccccaggtgcagcaggtgcaggacgacggccacagactgcagaaggcctacgccggcgacaaggccgaggagatcggcagacacatgcaggccgtggccgaggcctgggcccagctgcagggcagcagcgccgccagaagacagctgctgctggacaccaccgacaagttcagattcttcaaggccgtgagagagctgatgctgtggatggacgaggtgaacctgcagatggacgcccaggagagacccagagacgtgagcagcgccgacctggtgatcaagaaccagcagggcatcaaggccgagatcgaggccagagccgacagattcagcagctgcatcgacatgggcaaggagctgctggccagaagccactacgccgccgaggagatcagcgagaagctgagccagctgcaggccagaagacaggagaccgccgagaagtggcaggagaagatggactggctgcagctggtgctggaggtgctggtgttcggcagagacgccggcatggccgaggcctggctgtgcagccaggagcccctggtgagaagcgccgagctgggctgcaccgtggacgaggtggagagcctgatcaagagacacgaggccttccagaagagcgccgtggcctgggaggagagattctgcgccctggagaagctgaccgccctggaggagagagagaaggagagaaagagaaagagagaggaggaggagagaagaaagcagccccccgcccccgagcccaccgccagcgtgccccccggcgacctggtgggcggccagaccgccagcgacaccacctgggacggcacccagcccagacccccccccagcacccaggcccccagcgtgaacggcgtgtgcaccgacggcgagcccagccagcccctgctgggccagcagagactggagcacagcagcttccccgagggccccggccccggcagcggcgacgaggccaacggccccagaggcgagagacagaccagaaccagaggccccgcccccagcgccatgccccagagcagaagcaccgagagcgcccacgccgccaccctgccccccagaggccccgagcccagcgcccaggagcagatggagggcatgctgtgcagaaagcaggagatggaggccttcggcaagaaggccgccaacagaagctggcagaacgtgtactgcgtgctgagaagaggcagcctgggcttctacaaggacgccaaggccgccagcgccggcgtgccctaccacggcgaggtgcccgtgagcctggccagagcccagggcagcgtggccttcgactacagaaagagaaagcacgtgttcaagctgggcctgcaggacggcaaggagtacctgttccaggccaaggacgaggtgagctgccccagctgcagcagcctgagcgtgcccttccagaagctgcccgccgccgacagccccagcttccccgtgctgcccctgttccccggcctggtgctgtgcggcaagaccggctgcgtgagaagaccccaccaggccgccctgcccgtgtag

SEQ ID NO: 100512 - DNA, 7173 bp, Artificial Sequence; identical to SEQ ID NO: 100508
  Description of Artificial Sequence: Synthetic coding sequence

SEQ ID NO: 100513 - DNA, 6465 bp, Artificial Sequence
  Description of Artificial Sequence: Synthetic coding sequence
atggcccaggtgcccggcgaggtggacaacatggagggcctgcccgcccccaacaacaaccccgccgccagatgggagagccccgacagaggctgggagagagagcagcccgccgccagcaccgccgccgccagcctgttcgagtgcagcagaatcaaggccctggccgacgagagagaggccgtgcagaagaagaccttcaccaagtgggtgaacagccacctggccagagtgggctgccacatcggcgacctgtacgtggacctgagagacggcttcgtgctgaccagactgctggaggtgctgagcggcgagcagctgcccagacccaccagaggcagaatgagaatccacagcctggagaacgtggacaaggccctgcagttcctgaaggagcagagagtgcacctggagaacgtgggcagccacgacatcgtggacggcaaccacagactgaccctgggcctggtgtggaccatcatcctgagattccagatccaggtgatcaagatcgagaccgaggacaacagagagaccagaagcgccaaggacgccctgctgctgtggtgccagatgaagaccgccggctaccccgaggtgaacatccagaacttcaccaccagctggagagacggcctggccttcaacgccctgatccacagacacagacccgacctggtggacttcagcaagctgaccaagagcaacgccaactacaacctgcagagagccttcagaaccgccgagcagcacctgggcctggccagactgctggaccccgaggacgtgaacatggaggcccccgacgagaagagcatcatcacctacgtggtgagcttctaccactacttcagcaagatgaaggccctggccgtggagggcaagagaatcggcaaggtgctggaccaggtgctggaggtgggcaagatcatcgagagatacgaggagctggccgccgagctgctggcctggatccacagaaccgtgggcctgatcagcaaccagaagttcgccaacagcctgagcggcgtgcagcagcagctgcaggccttcaccgcctactgcaccctggagaagcccgtgaagttccaggagaagggcaacctggaggtgctgctgttcagcatccagagcaagctgagagcctgcaacagaagactgttcgtgcccagagagggctgcggcatctgggacatcgacaaggcctggggcgagctggagaaggccgagcacgagagagaggccgccctgagagccgagctgatcagacaggagaagctggagctgctggcccagagattcgaccacaaggtggccatgagagagagctggctgaacgagaaccagagactggtgagccaggacaacttcggctacgagctgcccgccgtggaggccgccatgaagaagcacgaggccatcgaggccgacatcgccgcctacgaggagagagtgcagggcgtggccgagctggcccaggccctggccgccgagggctactacgacatcagaagagtggccgcccagagagacagcgtgctgagacagtgggccctgctgaccggcctggtgggcgccagaagaaccagactggagcagaacctggccctgcagaaggtgttccaggagatggtgtacatggtggactggatggaggagatgcaggcccagctgctgagcagagagtgcggccagcacctggtggaggccgacgacctgctgcagaagcacggcctgctggagggcgacatcgccgcccagagcgagagagtggaggccctgaacgccgccgccctgagattcagccagctgcagggctaccagccctgcgacccccaggtgatctgcaacagagtgaaccacgtgcacggctgcctggccgagctgcaggagcaggccgccagaagaagagccgagctggaggccagcagaagcctgtgggccctgctgcaggagctggaggaggccgagagctgggccagagacaaggagagactgctggaggccgccggcggcggcggcgccgccggcgccgccggcgccgccggcaccgccggcggcgcccacgacctgagcagcaccgccagactgctggcccagcacaagatcctgcagggcgagctgggcggcagaagagccctgctgcagcaggccctgagatgcggcgaggagctggtggccgccggcggcgccgtgggccccggcgccgacaccgtgcacctggtgggcctggccgagagagccgccagcgccagaagaagatggcagagactggaggaggccgccgccagaagagagagaagactgcaggaggccagagccctgcaccagttcggcgccgacctggacggcctgctggactggctgagagacgcctacagactggccgccgccggcgacttcggccacgacgaggccagcagcagaagactggccagacagcacagagccctgaccggcgaggtggaggcccacagaggccccgtgagcggcctgagaagacagctggccaccctgggcggcgccagcggcgccggccccctggtggtggccctgcaggtgagagtggtggaggccgagcagctgttcgccgaggtgaccgaggtggccgccctgagaagacagtggctgagagacgccctggccgtgtacagaatgttcggcgaggtgcacgcctgcgagctgtggatcggcgagaaggagcagtggctgctgagcatgagagtgcccgacagcctggacgacgtggaggtggtgcagcacagattcgagagcctggaccaggagatgaacagcctgatgggcagagtgctggacgtgaaccacaccgtgcaggagctggtggagggcggccaccccagcagcgacgaggtgagaagctgccaggaccacctgaacagcagatggaacagaatcgtggagctggtggagcagagaaaggaggagatgagcgccgtgctgctggtggagaaccacgtgctggaggtggccgaggtgagagcccaggtgagagagaagagaagagccgtggagagcgcccccagagccggcggcgccctgcagtggagactgagcggcctggaggccgccctgcaggccctggagcccagacaggccgccctgctggaggaggccgccctgctggccgagagattccccgcccaggccgccagactgcaccagggcgccgaggagctgggcgccgagtggggcgccctggccagcgccgcccaggcctgcggcgaggccgtggccgccgccggcagactgcagagattcctgcacgacctggacgccttcctggactggctggtgagagcccaggaggccgccggcggcagcgagggccccctgcccaacagcctggaggaggccgacgccctgctggccagacacgccgccctgaaggaggaggtggaccagagagaggaggactacgccagaatcgtggccgccagcgaggccctgctggccgccgacggcgccgagctgggccccggcctggccctggacgagtggctgccccacctggagctgggctggcacaagctgctgggcctgtgggaggccagaagagaggccctggtgcaggcccacatctaccagctgttcctgagagacctgagacaggccctggtggtgctgagaaaccaggagatggccctgagcggcgccgagctgcccggcaccgtggagagcgtggaggaggccctgaagcagcacagagacttcctgaccaccatggagctgagccagcagaagatgcaggtggccgtgcaggccgccgagggcctgctgagacagggcaacatctacggcgagcaggcccaggaggccgtgaccagactgctggagaagaaccaggagaaccagctgagagcccagcagtggatgcagaagctgcacgaccagctggagctgcagcacttcctgagagactgccacgagctggacggctggatccacgagaagatgctgatggccagagacggcaccagagaggacaaccacaagctgcacaagagatggctgagacaccaggccttcatggccgagctggcccagaacaaggagtggctggagaagatcgagagagagggccagcagctgatgcaggagaagcccgagctggccgccagcgtgagaaagaagctgggcgagatcagacagtgctgggccgagctggagagcaccacccaggccaaggccagacagctgttcgaggccagcaaggccgaccagctggtgcagagcttcgccgagctggacaagaagctgctgcacatggagagccagctgcaggacgtggaccccggcggcgacctggccaccgtgaacagccagctgaagaagctgcagagcatggagagccaggtggaggagtggtacagagaggtgggcgagctgcaggcccagaccgccgccctgcccctggagcccgccagcaaggagctggtgggcgagagacagaacgccgtgggcgagagactggtgagactgctggagcccctgcaggagagaagaagactgctgctggccagcaaggagctgcaccaggtggcccacgacctggacgacgagctggcctgggtgcaggagagactgcccctggccatgcagaccgagagaggcaacggcctgcaggccgtgcagcagcacatcaagaagaaccagggcctgagaagagagatccaggcccacggccccagactggaggaggtgctggagagagccggcgccctggccagcctgagaagccccgaggccgaggccgtgagaagaggcctggagcagctgcagagcgcctgggccggcctgagagaggccgccgagagaagacagcaggtgctggacgccgccttccaggtggagcagtactacttcgacgtggccgaggtggaggcctggctgggcgagcaggagctgctgatgatgagcgaggacaagggcaaggacgagcagagcaccctgcagctgctgaagaagcacctgcagctggagcagggcgtggagaactacgaggagagcatcgcccagctgagcagacagtgcagagccctgctggagatgggccaccccgacagcgagcagatcagcagaagacagagccaggtggacagactgtacgtggccctgaaggagctgggcgaggagagaagagtggccctggagcagcagtactggctgtaccagctgagcagacaggtgagcgagctggagcactggatcgccgagaaggaggtggtggccggcagccccgagctgggccaggacttcgagcacgtgagcgtgctgcaggagaagttcagcgagttcgccagcgagaccggcatggccggcagagagagactggccgccgtgaaccagatggtggacgagctgatcgagtgcggccacaccgccgccgccaccatggccgagtggaaggacggcctgaacgaggcctgggccgagctgctggagctgatgggcaccagagcccagctgctggccgccagcagagagctgcacaagttcttcagcgacgccagagagctgcagggccagatcgaggagaagagaagaagactgcccagactgaccaccccccccgagcccagacccagcgccagcagcatgcagagaaccctgagagccttcgagcacgacctgcagctgctggtgagccaggtgagacagctgcaggagggcgccgcccagctgagaaccgtgtacgccggcgagcacgccgaggccatcgccagcagagagcaggaggtgctgcagggctggaaggagctgctgagcgcctgcgaggacgccagactgcacgtgagcagcaccgccgacgccctgagattccacagccaggtgagagacctgctgagctggatggacggcatcgccagccagatcggcgccgccgacaagcccagagacgtgagcagcgtggaggtgctgatgaactaccaccagggcctgaagaccgagctggaggccagagtgcccgagctgaccacctgccaggagctgggcagaagcctgctgctgaacaagagcgccatggccgacgagatccaggcccagctggacaagctgggcaccagaaaggaggaggtgagcgagaagtgggacagacactgggagtggctgcagcagatgctggaggtgcaccagttcgcccaggaggccgtggtggccgacgcctggctgaccgcccaggagcccctgctgcagagcagagagctgggcagcagcgtggacgaggtggagcagctgatcagaagacacgaggccttcagaaaggccgccgccgcctgggaggagagattcagcagcctgagaagactgaccacccccagaagagaggaccacctgaaccccggcgtgcaggaccagccctggcagcacaccgagaagcccagcctgcccaagcccaaggccaacaaggagaagaccgccagaagagacggcacctgcctgtag

SEQ ID NO: 100514 - DNA, 3930 bp, Artificial Sequence
  Description of Artificial Sequence: Synthetic coding sequence
atggcccaggtgcccggcgaggtggacaacatggagggcctgcccgcccccaacaacaaccccgccgccagatgggagagccccgacagaggctgggagagagagcagcccgccgccagcaccgccgccgccagcctgttcgagtgcagcagaatcaaggccctggccgacgagagagaggccgtgcagaagaagaccttcaccaagtgggtgaacagccacctggccagagtgggctgccacatcggcgacctgtacgtggacctgagagacggcttcgtgctgaccagactgctggaggtgctgagcggcgagcagctgcccagacccaccagaggcagaatgagaatccacagcctggagaacgtggacaaggccctgcagttcctgaaggagcagagagtgcacctggagaacgtgggcagccacgacatcgtggacggcaaccacagactgaccctgggcctggtgtggaccatcatcctgagattccagatccaggtgatcaagatcgagaccgaggacaacagagagaccagaagcgccaaggacgccctgctgctgtggtgccagatgaagaccgccggctaccccgaggtgaacatccagaacttcaccaccagctggagagacggcctggccttcaacgccctgatccacagacacagacccgacctggtggacttcagcaagctgaccaagagcaacgccaactacaacctgcagagagccttcagaaccgccgagcagcacctgggcctggccagactgctggaccccgaggacgtgaacatggaggcccccgacgagaagagcatcatcacctacgtggtgagcttctaccactacttcagcaagatgaaggccctggccgtggagggcaagagaatcggcaaggtgctggaccaggtgctggaggtgggcaagatcatcgagagatacgaggagctggccgccgagctgctggcctggatccacagaaccgtgggcctgatcagcaaccagaagttcgccaacagcctgagcggcgtgcagcagcagctgcaggccttcaccgcctactgcaccctggagaagcccgtgaagttccaggagaagggcaacctggaggtgctgctgttcagcatccagagcaagctgagagcctgcaacagaagactgttcgtgcccagagagggctgcggcatctgggacatcgacaaggcctggggcgagctggagaaggccgagcacgagagagaggccgccctgagagccgagctgatcagacaggagaagctggagctgctggcccagagattcgaccacaaggtggccatgagagagagctggctgaacgagaaccagagactggtgagccaggacaacttcggctacgagctgcccgccgtggaggccgccatgaagaagcacgaggccatcgaggccgacatcgccgcctacgaggagagagtgcagggcgtggccgagctggcccaggccctggccgccgagggctactacgacatcagaagagtggccgcccagagagacagcgtgctgagacagtgggccctgctgaccggcctggtgggcgccagaagaaccagactggagcagaacctggccctgcagaaggtgttccaggagatggtgtacatggtggactggatggaggagatgcaggcccagctgctgagcagagagtgcggccagcacctggtggaggccgacgacctgctgcagaagcacggcctgctggagggcgacatcgccgcccagagcgagagagtggaggccctgaacgccgccgccctgagattcagccagctgcagggctaccagccctgcgacccccaggtgatctgcaacagagtgaaccacgtgcacggctgcctggccgagctgcaggagcaggccgccagaagaagagccgagctggaggccagcagaagcctgtgggccctgctgcaggagctggaggaggccgagagctgggccagagacaaggagagactgctggaggccgccggcggcggcggcgccgccggcgccgccggcgccgccggcaccgccggcggcgcccacgacctgagcagcaccgccagactgctggcccagcacaagatcctgcagggcgagctgggcggcagaagagccctgctgcagcaggccctgagatgcggcgaggagctggtggccgccggcggcgccgtgggccccggcgccgacaccgtgcacctggtgggcctggccgagagagccgccagcgccagaagaagatggcagagactggaggaggccgccgccagaagagagagaagactgcaggaggccagagccctgcaccagttcggcgccgacctggacggcctgctggactggctgagagacgcctacagactggccgccgccggcgacttcggccacgacgaggccagcagcagaagactggccagacagcacagagccctgaccggcgaggtggaggcccacagaggccccgtgagcggcctgagaagacagctggccaccctgggcggcgccagcggcgccggccccctggtggtggccctgcaggtgagagtggtggaggccgagcagctgttcgccgaggtgaccgaggtggccgccctgagaagacagtggctgagagacgccctggccgtgtacagaatgttcggcgaggtgcacgcctgcgagctgtggatcggcgagaaggagcagtggctgctgagcatgagagtgcccgacagcctggacgacgtggaggtggtgcagcacagattcgagagcctggaccaggagatgaacagcctgatgggcagagtgctggacgtgaaccacaccgtgcaggagctggtggagggcggccaccccagcagcgacgaggtgagaagctgccaggaccacctgaacagcagatggaacagaatcgtggagctggtggagcagagaaaggaggagatgagcgccgtgctgctggtggagaaccacgtgctggaggtggccgaggtgagagcccaggtgagagagaagagaagagccgtggagagcgcccccagagccggcggcgccctgcagtggagactgagcggcctggaggccgccctgcaggccctggagcccagacaggccgccctgctggaggaggccgccctgctggccgagagattccccgcccaggccgccagactgcaccagggcgccgaggagctgggcgccgagtggggcgccctggccagcgccgcccaggcctgcggcgaggccgtggccgccgccggcagactgcagagattcctgcacgacctggacgccttcctggactggctggtgagagcccaggaggccgccggcggcagcgagggccccctgcccaacagcctggaggaggccgacgccctgctggccagacacgccgccctgaaggaggaggtggaccagagagaggaggactacgccagaatcgtggccgccagcgaggccctgctggccgccgacggcgccgagctgggccccggcctggccctggacgagtggctgccccacctggagctgggctggcacaagctgctgggcctgtgggaggccagaagagaggccctggtgcaggcccacatctaccagctgttcctgagagacctgagacaggccctggtggtgctgagaaaccaggagatggccctgagcggcgccgagctgcccggcaccgtggagagcgtggaggaggccctgaagcagcacagagacttcctgaccaccatggagctgagccagcagaagatgcaggtggccgtgcaggccgccgagggcctgctgagacagggcaacatctacggcgagcaggcccaggaggccgtgaccagactgctggagaagtgcctgatcatccaccccgccctgctgcaccccccctgggagccccccgacctgcccagaagcagcagctag

SEQ ID NO: 100515 - DNA, 7695 bp, Artificial Sequence
  Description of Artificial Sequence: Synthetic coding sequence
atggcccaggtgcccggcgaggtggacaacatggagggcctgcccgcccccaacaacaaccccgccgccagatgggagagccccgacagaggctgggagagagagcagcccgccgccagcaccgccgccgccagcctgttcgagtgcagcagaatcaaggccctggccgacgagagagaggccgtgcagaagaagaccttcaccaagtgggtgaacagccacctggccagagtgggctgccacatcggcgacctgtacgtggacctgagagacggcttcgtgctgaccagactgctggaggtgctgagcggcgagcagctgcccagacccaccagaggcagaatgagaatccacagcctggagaacgtggacaaggccctgcagttcctgaaggagcagagagtgcacctggagaacgtgggcagccacgacatcgtggacggcaaccacagactgaccctgggcctggtgtggaccatcatcctgagattccagatccaggtgatcaagatcgagaccgaggacaacagagagaccagaagcgccaaggacgccctgctgctgtggtgccagatgaagaccgccggctaccccgaggtgaacatccagaacttcaccaccagctggagagacggcctggccttcaacgccctgatccacagacacagacccgacctggtggacttcagcaagctgaccaagagcaacgccaactacaacctgcagagagccttcagaaccgccgagcagcacctgggcctggccagactgctggaccccgaggacgtgaacatggaggcccccgacgagaagagcatcatcacctacgtggtgagcttctaccactacttcagcaagatgaaggccctggccgtggagggcaagagaatcggcaaggtgctggaccaggtgctggaggtgggcaagatcatcgagagatacgaggagctggccgccgagctgctggcctggatccacagaaccgtgggcctgatcagcaaccagaagttcgccaacagcctgagcggcgtgcagcagcagctgcaggccttcaccgcctactgcaccctggagaagcccgtgaagttccaggagaagggcaacctggaggtgctgctgttcagcatccagagcaagctgagagcctgcaacagaagactgttcgtgcccagagagggctgcggcatctgggacatcgacaaggcctggggcgagctggagaaggccgagcacgagagagaggccgccctgagagccgagctgatcagacaggagaagctggagctgctggcccagagattcgaccacaaggtggccatgagagagagctggctgaacgagaaccagagactggtgagccaggacaacttcggctacgagctgcccgccgtggaggccgccatgaagaagcacgaggccatcgaggccgacatcgccgcctacgaggagagagtgcagggcgtggccgagctggcccaggccctggccgccgagggctactacgacatcagaagagtggccgcccagagagacagcgtgctgagacagtgggccctgctgaccggcctggtgggcgccagaagaaccagactggagcagaacctggccctgcagaaggtgttccaggagatggtgtacatggtggactggatggaggagatgcaggcccagctgctgagcagagagtgcggccagcacctggtggaggccgacgacctgctgcagaagcacggcctgctggagggcgacatcgccgcccagagcgagagagtggaggccctgaacgccgccgccctgagattcagccagctgcagggctaccagccctgcgacccccaggtgatctgcaacagagtgaaccacgtgcacggctgcctggccgagctgcaggagcaggccgccagaagaagagccgagctggaggccagcagaagcctgtgggccctgctgcaggagctggaggaggccgagagctgggccagagacaaggagagactgctggaggccgccggcggcggcggcgccgccggcgccgccggcgccgccggcaccgccggcggcgcccacgacctgagcagcaccgccagactgctggcccagcacaagatcctgcagggcgagctgggcggcagaagagccctgctgcagcaggccctgagatgcggcgaggagctggtggccgccggcggcgccgtgggccccggcgccgacaccgtgcacctggtgggcctggccgagagagccgccagcgccagaagaagatggcagagactggaggaggccgccgccagaagagagagaagactgcaggaggccagagccctgcaccagttcggcgccgacctggacggcctgctggactggctgagagacgcctacagactggccgccgccggcgacttcggccacgacgaggccagcagcagaagactggccagacagcacagagccctgaccggcgaggtggaggcccacagaggccccgtgagcggcctgagaagacagctggccaccctgggcggcgccagcggcgccggccccctggtggtggccctgcaggtgagagtggtggaggccgagcagctgttcgccgaggtgaccgaggtggccgccctgagaagacagtggctgagagacgccctggccgtgtacagaatgttcggcgaggtgcacgcctgcgagctgtggatcggcgagaaggagcagtggctgctgagcatgagagtgcccgacagcctggacgacgtggaggtggtgcagcacagattcgagagcctggaccaggagatgaacagcctgatgggcagagtgctggacgtgaaccacaccgtgcaggagctggtggagggcggccaccccagcagcgacgaggtgagaagctgccaggaccacctgaacagcagatggaacagaatcgtggagctggtggagcagagaaaggaggagatgagcgccgtgctgctggtggagaaccacgtgctggaggtggccgaggtgagagcccaggtgagagagaagagaagagccgtggagagcgcccccagagccggcggcgccctgcagtggagactgagcggcctggaggccgccctgcaggccctggagcccagacaggccgccctgctggaggaggccgccctgctggccgagagattccccgcccaggccgccagactgcaccagggcgccgaggagctgggcgccgagtggggcgccctggccagcgccgcccaggcctgcggcgaggccgtggccgccgccggcagactgcagagattcctgcacgacctggacgccttcctggactggctggtgagagcccaggaggccgccggcggcagcgagggccccctgcccaacagcctggaggaggccgacgccctgctggccagacacgccgccctgaaggaggaggtggaccagagagaggaggactacgccagaatcgtggccgccagcgaggccctgctggccgccgacggcgccgagctgggccccggcctggccctggacgagtggctgccccacctggagctgggctggcacaagctgctgggcctgtgggaggccagaagagaggccctggtgcaggcccacatctaccagctgttcctgagagacctgagacaggccctggtggtgctgagaaaccaggagatggccctgagcggcgccgagctgcccggcaccgtggagagcgtggaggaggccctgaagcagcacagagacttcctgaccaccatggagctgagccagcagaagatgcaggtggccgtgcaggccgccgagggcctgctgagacagggcaacatctacggcgagcaggcccaggaggccgtgaccagactgctggagaagaaccaggagaaccagctgagagcccagcagtggatgcagaagctgcacgaccagctggagctgcagcacttcctgagagactgccacgagctggacggctggatccacgagaagatgctgatggccagagacggcaccagagaggacaaccacaagctgcacaagagatggctgagacaccaggccttcatggccgagctggcccagaacaaggagtggctggagaagatcgagagagagggccagcagctgatgcaggagaagcccgagctggccgccagcgtgagaaagaagctgggcgagatcagacagtgctgggccgagctggagagcaccacccaggccaaggccagacagctgttcgaggccagcaaggccgaccagctggtgcagagcttcgccgagctggacaagaagctgctgcacatggagagccagctgcaggacgtggaccccggcggcgacctggccaccgtgaacagccagctgaagaagctgcagagcatggagagccaggtggaggagtggtacagagaggtgggcgagctgcaggcccagaccgccgccctgcccctggagcccgccagcaaggagctggtgggcgagagacagaacgccgtgggcgagagactggtgagactgctggagcccctgcaggagagaagaagactgctgctggccagcaaggagctgcaccaggtggcccacgacctggacgacgagctggcctgggtgcaggagagactgcccctggccatgcagaccgagagaggcaacggcctgcaggccgtgcagcagcacatcaagaagaaccagggcctgagaagagagatccaggcccacggccccagactggaggaggtgctggagagagccggcgccctggccagcctgagaagccccgaggccgaggccgtgagaagaggcctggagcagctgcagagcgcctgggccggcctgagagaggccgccgagagaagacagcaggtgctggacgccgccttccaggtggagcagtactacttcgacgtggccgaggtggaggcctggctgggcgagcaggagctgctgatgatgagcgaggacaagggcaaggacgagcagagcaccctgcagctgctgaagaagcacctgcagctggagcagggcgtggagaactacgaggagagcatcgcccagctgagcagacagtgcagagccctgctggagatgggccaccccgacagcgagcagatcagcagaagacagagccaggtggacagactgtacgtggccctgaaggagctgggcgaggagagaagagtggccctggagcagcagtactggctgtaccagctgagcagacaggtgagcgagctggagcactggatcgccgagaaggaggtggtggccggcagccccgagctgggccaggacttcgagcacgtgagcgtgctgcaggagaagttcagcgagttcgccagcgagaccggcatggccggcagagagagactggccgccgtgaaccagatggtggacgagctgatcgagtgcggccacaccgccgccgccaccatggccgagtggaaggacggcctgaacgaggcctgggccgagctgctggagctgatgggcaccagagcccagctgctggccgccagcagagagctgcacaagttcttcagcgacgccagagagctgcagggccagatcgaggagaagagaagaagactgcccagactgaccaccccccccgagcccagacccagcgccagcagcatgcagagaaccctgagagccttcgagcacgacctgcagctgctggtgagccaggtgagacagctgcaggagggcgccgcccagctgagaaccgtgtacgccggcgagcacgccgaggccatcgccagcagagagcaggaggtgctgcagggctggaaggagctgctgagcgcctgcgaggacgccagactgcacgtgagcagcaccgccgacgccctgagattccacagccaggtgagagacctgctgagctggatggacggcatcgccagccagatcggcgccgccgacaagcccagagacgtgagcagcgtggaggtgctgatgaactaccaccagggcctgaagaccgagctggaggccagagtgcccgagctgaccacctgccaggagctgggcagaagcctgctgctgaacaagagcgccatggccgacgagatccaggcccagctggacaagctgggcaccagaaaggaggaggtgagcgagaagtgggacagacactgggagtggctgcagcagatgctggaggtgcaccagttcgcccaggaggccgtggtggccgacgcctggctgaccgcccaggagcccctgctgcagagcagagagctgggcagcagcgtggacgaggtggagcagctgatcagaagacacgaggccttcagaaaggccgccgccgcctgggaggagagattcagcagcctgagaagactgaccaccatcgagaagatcaaggccgagcagagcaagcagccccccacccccctgctgggcagaaagttcttcggcgaccccaccgagctggccgccaaggccgcccccctgctgagacccggcggctacgagagaggcctggagcccctggccagaagagccagcgacaccctgagcgccgaggtgagaaccagagtgggctacgtgagacaggagctgaagcccgagagactgcagcccagaatcgacagactgcccgagatccccggcagagtggagcccgccgccctgcccgccgcccccgaggacgccgccgagacccccgccacccccgccgccgccgagcaggtgagacccagacccgagagacaggagagcgccgacagagccgaggagctgcccagaagaagaagacccgagagacaggagagcgtggaccagagcgaggaggccgccagaagaagaagacccgagagacaggagagcgccgagcacgaggccgcccacagcctgaccctgggcagatacgagcagatggagagaagaagagagagaagagagagaagactggagagacaggagagcagcgagcaggagatgcccatcagaggcgacctggtgaagggcaaggccaccctggccgacatcgtggagcagctgcaggagaaggaggccggccccggcctgcccgccggccccagcctgccccagcccagagagctgccccccggcagactgcccaacggcctggagctgcccgagagaacccccagacccgacagacccagagccagagacagacccaagcccagaagaagacccagacccagagagggcggcgagggcggcggcagcagaagaagcagaagcgcccccgcccagggcggcagcgcccccgcccccccccccccccccacccacaccgtgcagcacgagggcttcctgctgagaaagagagagctggacgccaacagaaagagcagcaacagaagctgggtgagcctgtactgcgtgctgagcaagggcgagctgggcttctacaaggacagcaagggccccgccagcggcagcacccacggcggcgagcccctgctgagcctgcacaaggccaccagcgaggtggccagcgactacaagaagaagaagcacgtgttcaagctgcagacccaggacggcagcgagttcctgctgcaggccaaggacgaggaggagatgaacggctggctggaggccgtggccagcagcgtggccgagcacgccgagatcgccagatggggccagaccctgcccaccaccagcagcaccgacgagggcaaccccaagagagagggcggcgacagaagagccagcggcagaagaaagtag

SEQ ID NO: 100516 - DNA, 2037 bp, Artificial Sequence
  Description of Artificial Sequence: Synthetic coding sequence
atgctgatggccagagacggcaccagagaggacaaccacaagctgcacaagagatggctgagacaccaggccttcatggccgagctggcccagaacaaggagtggctggagaagatcgagagagagggccagcagctgatgcaggagaagcccgagctggccgccagcgtgagaaagaagctgggcgagatcagacagtgctgggccgagctggagagcaccacccaggccaaggccagacagctgttcgaggccagcaaggccgaccagctggtgcagagcttcgccgagctggacaagaagctgctgcacatggagagccagctgcaggacgtggaccccggcggcgacctggccaccgtgaacagccagctgaagaagctgcagagcatggagagccaggtggaggagtggtacagagaggtgggcgagctgcaggcccagaccgccgccctgcccctggagcccgccagcaaggagctggtgggcgagagacagaacgccgtgggcgagagactggtgagactgctggagcccctgcaggagagaagaagactgctgctggccagcaaggagctgcaccaggtggcccacgacctggacgacgagctggcctgggtgcaggagagactgcccctggccatgcagaccgagagaggcaacggcctgcaggccgtgcagcagcacatcaagaagaaccagggcctgagaagagagatccaggcccacggccccagactggaggaggtgctggagagagccggcgccctggccagcctgagaagccccgaggccgaggccgtgagaagaggcctggagcagctgcagagcgcctgggccggcctgagagaggccgccgagagaagacagcaggtgctggacgccgccttccaggtggagcagtactacttcgacgtggccgaggtggaggcctggctgggcgagcaggagctgctgatgatgagcgaggacaagggcaaggacgagcagagcaccctgcagctgctgaagaagcacctgcagctggagcagggcgtggagaactacgaggagagcatcgcccagctgagcagacagtgcagagccctgctggagatgggccaccccgacagcgagcagatcagcagaagacagagccaggtggacagactgtacgtggccctgaaggagctgggcgaggagagaagagtggccctggagcagcagtactggctgtaccagctgagcagacaggtgagcgagctggagcactggatcgccgagaaggaggtggtggccggcagccccgagctgggccaggacttcgagcacgtgagcgtgctgcaggagaagttcagcgagttcgccagcgagaccggcatggccggcagagagagactggccgccgtgaaccagatggtggacgagctgatcgagtgcggccacaccgccgccgccaccatggccgagtggaaggacggcctgaacgaggcctgggccgagctgctggagctgatgggcaccagagcccagctgctggccgccagcagagagctgcacaagttcttcagcgacgccagagagctgcagggccagatcgaggagaagagaagaagactgcccagactgaccaccccccccgagcccagacccagcgccagcagcatgcagagaaccctgagagccttcgagcacgacctgcagctgctggtgagccaggtgagacagctgcaggagggcgccgcccagctgagaaccgtgtacgccggcgagcacgccgaggccatcgccagcagagagcaggaggtgctgcagggctggaaggagctgctgagcgcctgcgaggacgccagactgcacgtgagcagcaccgccgacgccctgagattccacagccaggtgagagacctgctgagctggatggacggcatcgccagccagatcggcgccgccgacaagcccagatgccccagcagcctgctgggcctgcccgccagcccctggtggcccacccccgccacccccagccccctgaccgcccccttcagcatggagtag

SEQ ID NO: 100517 - DNA, 3924 bp, Artificial Sequence
  Description of Artificial Sequence: Synthetic coding sequence
atgccccactaccccagctgcagcagcgcccccagcctgggcacccccagacccccccagatccagcagctggaggccagacacagaaaccaggagaaccagctgagagcccagcagtggatgcagaagctgcacgaccagctggagctgcagcacttcctgagagactgccacgagctggacggctggatccacgagaagatgctgatggccagagacggcaccagagaggacaaccacaagctgcacaagagatggctgagacaccaggccttcatggccgagctggcccagaacaaggagtggctggagaagatcgagagagagggccagcagctgatgcaggagaagcccgagctggccgccagcgtgagaaagaagctgggcgagatcagacagtgctgggccgagctggagagcaccacccaggccaaggccagacagctgttcgaggccagcaaggccgaccagctggtgcagagcttcgccgagctggacaagaagctgctgcacatggagagccagctgcaggacgtggaccccggcggcgacctggccaccgtgaacagccagctgaagaagctgcagagcatggagagccaggtggaggagtggtacagagaggtgggcgagctgcaggcccagaccgccgccctgcccctggagcccgccagcaaggagctggtgggcgagagacagaacgccgtgggcgagagactggtgagactgctggagcccctgcaggagagaagaagactgctgctggccagcaaggagctgcaccaggtggcccacgacctggacgacgagctggcctgggtgcaggagagactgcccctggccatgcagaccgagagaggcaacggcctgcaggccgtgcagcagcacatcaagaagaaccagggcctgagaagagagatccaggcccacggccccagactggaggaggtgctggagagagccggcgccctggccagcctgagaagccccgaggccgaggccgtgagaagaggcctggagcagctgcagagcgcctgggccggcctgagagaggccgccgagagaagacagcaggtgctggacgccgccttccaggtggagcagtactacttcgacgtggccgaggtggaggcctggctgggcgagcaggagctgctgatgatgagcgaggacaagggcaaggacgagcagagcaccctgcagctgctgaagaagcacctgcagctggagcagggcgtggagaactacgaggagagcatcgcccagctgagcagacagtgcagagccctgctggagatgggccaccccgacagcgagcagatcagcagaagacagagccaggtggacagactgtacgtggccctgaaggagctgggcgaggagagaagagtggccctggagcagcagtactggctgtaccagctgagcagacaggtgagcgagctggagcactggatcgccgagaaggaggtggtggccggcagccccgagctgggccaggacttcgagcacgtgagcgtgctgcaggagaagttcagcgagttcgccagcgagaccggcatggccggcagagagagactggccgccgtgaaccagatggtggacgagctgatcgagtgcggccacaccgccgccgccaccatggccgagtggaaggacggcctgaacgaggcctgggccgagctgctggagctgatgggcaccagagcccagctgctggccgccagcagagagctgcacaagttcttcagcgacgccagagagctgcagggccagatcgaggagaagagaagaagactgcccagactgaccaccccccccgagcccagacccagcgccagcagcatgcagagaaccctgagagccttcgagcacgacctgcagctgctggtgagccaggtgagacagctgcaggagggcgccgcccagctgagaaccgtgtacgccggcgagcacgccgaggccatcgccagcagagagcaggaggtgctgcagggctggaaggagctgctgagcgcctgcgaggacgccagactgcacgtgagcagcaccgccgacgccctgagattccacagccaggtgagagacctgctgagctggatggacggcatcgccagccagatcggcgccgccgacaagcccagagacgtgagcagcgtggaggtgctgatgaactaccaccagggcctgaagaccgagctggaggccagagtgcccgagctgaccacctgccaggagctgggcagaagcctgctgctgaacaagagcgccatggccgacgagatccaggcccagctggacaagctgggcaccagaaaggaggaggtgagcgagaagtgggacagacactgggagtggctgcagcagatgctggaggtgcaccagttcgcccaggaggccgtggtggccgacgcctggctgaccgcccaggagcccctgctgcagagcagagagctgggcagcagcgtggacgaggtggagcagctgatcagaagacacgaggccttcagaaaggccgccgccgcctgggaggagagattcagcagcctgagaagactgaccaccatcgagaagatcaaggccgagcagagcaagcagccccccacccccctgctgggcagaaagttcttcggcgaccccaccgagctggccgccaaggccgcccccctgctgagacccggcggctacgagagaggcctggagcccctggccagaagagccagcgacaccctgagcgccgaggtgagaaccagagtgggctacgtgagacaggagctgaagcccgagagactgcagcccagaatcgacagactgcccgagatccccggcagagtggagcccgccgccctgcccgccgcccccgaggacgccgccgagacccccgccacccccgccgccgccgagcaggtgagacccagacccgagagacaggagagcgccgacagagccgaggagctgcccagaagaagaagacccgagagacaggagagcgtggaccagagcgaggaggccgccagaagaagaagacccgagagacaggagagcgccgagcacgaggccgcccacagcctgaccctgggcagatacgagcagatggagagaagaagagagagaagagagagaagactggagagacaggagagcagcgagcaggagatgcccatcagaggcgacctggtgaagggcaaggccaccctggccgacatcgtggagcagctgcaggagaaggaggccggccccggcctgcccgccggccccagcctgccccagcccagagagctgccccccggcagactgcccaacggcctggagctgcccgagagaacccccagacccgacagacccagagccagagacagacccaagcccagaagaagacccagacccagagagggcggcgagggcggcggcagcagaagaagcagaagcgcccccgcccagggcggcagcgcccccgcccccccccccccccccacccacaccgtgcagcacgagggcttcctgctgagaaagagagagctggacgccaacagaaagagcagcaacagaagctgggtgagcctgtactgcgtgctgagcaagggcgagctgggcttctacaaggacagcaagggccccgccagcggcagcacccacggcggcgagcccctgctgagcctgcacaaggccaccagcgaggtggccagcgactacaagaagaagaagcacgtgttcaagctgcagacccaggacggcagcgagttcctgctgcaggccaaggacgaggaggagatgaacggctggctggaggccgtggccagcagcgtggccgagcacgccgagatcgccagatggggccagaccctgcccaccaccagcagcaccgacgagggcaaccccaagagagagggcggcgacagaagagccagcggcagaagaaagtag

SEQ ID NO: 100518 - DNA, 7695 bp, Artificial Sequence
  Description of Artificial Sequence: Synthetic coding sequence
atggcccaggtgcccggcgaggtggacaacatggagggcctgcccgcccccaacaacaaccccgccgccagatgggagagccccgacagaggctgggagagagagcagcccgccgccagcaccgccgccgccagcctgttcgagtgcagcagaatcaaggccctggccgacgagagagaggccgtgcagaagaagaccttcaccaagtgggtgaacagccacctggccagagtgggctgccacatcggcgacctgtacgtggacctgagagacggcttcgtgctgaccagactgctggaggtgctgagcggcgagcagctgcccagacccaccagaggcagaatgagaatccacagcctggagaacgtggacaaggccctgcagttcctgaaggagcagagagtgcacctggagaacgtgggcagccacgacatcgtggacggcaaccacagactgaccctgggcctggtgtggaccatcatcctgagattccagatccaggtgatcaagatcgagaccgaggacaacagagagaccagaagcgccaaggacgccctgctgctgtggtgccagatgaagaccgccggctaccccgaggtgaacatccagaacttcaccaccagctggagagacggcctggccttcaacgccctgatccacagacacagacccgacctggtggacttcagcaagctgaccaagagcaacgccaactacaacctgcagagagccttcagaaccgccgagcagcacctgggcctggccagactgctggaccccgaggacgtgaacatggaggcccccgacgagaagagcatcatcacctacgtggtgagcttctaccactacttcagcaagatgaaggccctggccgtggagggcaagagaatcggcaaggtgctggaccaggtgctggaggtgggcaagatcatcgagagatacgaggagctggccgccgagctgctggcctggatccacagaaccgtgggcctgatcagcaaccagaagttcgccaacagcctgagcggcgtgcagcagcagctgcaggccttcaccgcctactgcaccctggagaagcccgtgaagttccaggagaagggcaacctggaggtgctgctgttcagcatccagagcaagctgagagcctgcaacagaagactgttcgtgcccagagagggctgcggcatctgggacatcgacaaggcctggggcgagctggagaaggccgagcacgagagagaggccgccctgagagccgagctgatcagacaggagaagctggagctgctggcccagagattcgaccacaaggtggccatgagagagagctggctgaacgagaaccagagactggtgagccaggacaacttcggctacgagctgcccgccgtggaggccgccatgaagaagcacgaggccatcgaggccgacatcgccgcctacgaggagagagtgcagggcgtggccgagctggcccaggccctggccgccgagggctactacgacatcagaagagtggccgcccagagagacagcgtgctgagacagtgggccctgctgaccggcctggtgggcgccagaagaaccagactggagcagaacctggccctgcagaaggtgttccaggagatggtgtacatggtggactggatggaggagatgcaggcccagctgctgagcagagagtgcggccagcacctggtggaggccgacgacctgctgcagaagcacggcctgctggagggcgacatcgccgcccagagcgagagagtggaggccctgaacgccgccgccctgagattcagccagctgcagggctaccagccctgcgacccccaggtgatctgcaacagagtgaaccacgtgcacggctgcctggccgagctgcaggagcaggccgccagaagaagagccgagctggaggccagcagaagcctgtgggccctgctgcaggagctggaggaggccgagagctgggccagagacaaggagagactgctggaggccgccggcggcggcggcgccgccggcgccgccggcgccgccggcaccgccggcggcgcccacgacctgagcagcaccgccagactgctggcccagcacaagatcctgcagggcgagctgggcggcagaagagccctgctgcagcaggccctgagatgcggcgaggagctggtggccgccggcggcgccgtgggccccggcgccgacaccgtgcacctggtgggcctggccgagagagccgccagcgccagaagaagatggcagagactggaggaggccgccgccagaagagagagaagactgcaggaggccagagccctgcaccagttcggcgccgacctggacggcctgctggactggctgagagacgcctacagactggccgccgccggcgacttcggccacgacgaggccagcagcagaagactggccagacagcacagagccctgaccggcgaggtggaggcccacagaggccccgtgagcggcctgagaagacagctggccaccctgggcggcgccagcggcgccggccccctggtggtggccctgcaggtgagagtggtggaggccgagcagctgttcgccgaggtgaccgaggtggccgccctgagaagacagtggctgagagacgccctggccgtgtacagaatgttcggcgaggtgcacgcctgcgagctgtggatcggcgagaaggagcagtggctgctgagcatgagagtgcccgacagcctggacgacgtggaggtggtgcagcacagattcgagagcctggaccaggagatgaacagcctgatgggcagagtgctggacgtgaaccacaccgtgcaggagctggtggagggcggccaccccagcagcgacgaggtgagaagctgccaggaccacctgaacagcagatggaacagaatcgtggagctggtggagcagagaaaggaggagatgagcgccgtgctgctggtggagaaccacgtgctggaggtggccgaggtgagagcccaggtgagagagaagagaagagccgtggagagcgcccccagagccggcggcgccctgcagtggagactgagcggcctggaggccgccctgcaggccctggagcccagacaggccgccctgctggaggaggccgccctgctggccgagagattccccgcccaggccgccagactgcaccagggcgccgaggagctgggcgccgagtggggcgccctggccagcgccgcccaggcctgcggcgaggccgtggccgccgccggcagactgcagagattcctgcacgacctggacgccttcctggactggctggtgagagcccaggaggccgccggcggcagcgagggccccctgcccaacagcctggaggaggccgacgccctgctggccagacacgccgccctgaaggaggaggtggaccagagagaggaggactacgccagaatcgtggccgccagcgaggccctgctggccgccgacggcgccgagctgggccccggcctggccctggacgagtggctgccccacctggagctgggctggcacaagctgctgggcctgtgggaggccagaagagaggccctggtgcaggcccacatctaccagctgttcctgagagacctgagacaggccctggtggtgctgagaaaccaggagatggccctgagcggcgccgagctgcccggcaccgtggagagcgtggaggaggccctgaagcagcacagagacttcctgaccaccatggagctgagccagcagaagatgcaggtggccgtgcaggccgccgagggcctgctgagacagggcaacatctacggcgagcaggcccaggaggccgtgaccagactgctggagaagaaccaggagaaccagctgagagcccagcagtggatgcagaagctgcacgaccagctggagctgcagcacttcctgagagactgccacgagctggacggctggatccacgagaagatgctgatggccagagacggcaccagagaggacaaccacaagctgcacaagagatggctgagacaccaggccttcatggccgagctggcccagaacaaggagtggctggagaagatcgagagagagggccagcagctgatgcaggagaagcccgagctggccgccagcgtgagaaagaagctgggcgagatcagacagtgctgggccgagctggagagcaccacccaggccaaggccagacagctgttcgaggccagcaaggccgaccagctggtgcagagcttcgccgagctggacaagaagctgctgcacatggagagccagctgcaggacgtggaccccggcggcgacctggccaccgtgaacagccagctgaagaagctgcagagcatggagagccaggtggaggagtggtacagagaggtgggcgagctgcaggcccagaccgccgccctgcccctggagcccgccagcaaggagctggtgggcgagagacagaacgccgtgggcgagagactggtgagactgctggagcccctgcaggagagaagaagactgctgctggccagcaaggagctgcaccaggtggcccacgactggaccaccagctgggcctgggtgcaggagagactgcccctggccatgcagaccgagagaggcaacggcctgcaggccgtgcagcagcacatcaagaagaaccagggcctgagaagagagatccaggcccacggccccagactggaggaggtgctggagagagccggcgccctggccagcctgagaagccccgaggccgaggccgtgagaagaggcctggagcagctgcagagcgcctgggccggcctgagagaggccgccgagagaagacagcaggtgctggacgccgccttccaggtggagcagtactacttcgacgtggccgaggtggaggcctggctgggcgagcaggagctgctgatgatgagcgaggacaagggcaaggacgagcagagcaccctgcagctgctgaagaagcacctgcagctggagcagggcgtggagaactacgaggagagcatcgcccagctgagcagacagtgcagagccctgctggagatgggccaccccgacagcgagcagatcagcagaagacagagccaggtggacagactgtacgtggccctgaaggagctgggcgaggagagaagagtggccctggagcagcagtactggctgtaccagctgagcagacaggtgagcgagctggagcactggatcgccgagaaggaggtggtggccggcagccccgagctgggccaggacttcgagcacgtgagcgtgctgcaggagaagttcagcgagttcgccagcgagaccggcatggccggcagagagagactggccgccgtgaaccagatggtggacgagctgatcgagtgcggccacaccgccgccgccaccatggccgagtggaaggacggcctgaacgaggcctgggccgagctgctggagctgatgggcaccagagcccagctgctggccgccagcagagagctgcacaagttcttcagcgacgccagagagctgcagggccagatcgaggagaagagaagaagactgcccagactgaccaccccccccgagcccagacccagcgccagcagcatgcagagaaccctgagagccttcgagcacgacctgcagctgctggtgagccaggtgagacagctgcaggagggcgccgcccagctgagaaccgtgtacgccggcgagcacgccgaggccatcgccagcagagagcaggaggtgctgcagggctggaaggagctgctgagcgcctgcgaggacgccagactgcacgtgagcagcaccgccgacgccctgagattccacagccaggtgagagacctgctgagctggatggacggcatcgccagccagatcggcgccgccgacaagcccagagacgtgagcagcgtggaggtgctgatgaactaccaccagggcctgaagaccgagctggaggccagagtgcccgagctgaccacctgccaggagctgggcagaagcctgctgctgaacaagagcgccatggccgacgagatccaggcccagctggacaagctgggcaccagaaaggaggaggtgagcgagaagtgggacagacactgggagtggctgcagcagatgctggaggtgcaccagttcgcccaggaggccgtggtggccgacgcctggctgaccgcccaggagcccctgctgcagagcagagagctgggcagcagcgtggacgaggtggagcagctgatcagaagacacgaggccttcagaaaggccgccgccgcctgggaggagagattcagcagcctgagaagactgaccaccatcgagaagatcaaggccgagcagagcaagcagccccccacccccctgctgggcagaaagttcttcggcgaccccaccgagctggccgccaaggccgcccccctgctgagacccggcggctacgagagaggcctggagcccctggccagaagagccagcgacaccctgagcgccgaggtgagaaccagagtgggctacgtgagacaggagctgaagcccgagagactgcagcccagaatcgacagactgcccgagatccccggcagagtggagcccgccgccctgcccgccgcccccgaggacgccgccgagacccccgccacccccgccgccgccgagcaggtgagacccagacccgagagacaggagagcgccgacagagccgaggagctgcccagaagaagaagacccgagagacaggagagcgtggaccagagcgaggaggccgccagaagaagaagacccgagagacaggagagcgccgagcacgaggccgcccacagcctgaccctgggcagatacgagcagatggagagaagaagagagagaagagagagaagactggagagacaggagagcagcgagcaggagatgcccatcagaggcgacctggtgaagggcaaggccaccctggccgacatcgtggagcagctgcaggagaaggaggccggccccggcctgcccgccggccccagcctgccccagcccagagagctgccccccggcagactgcccaacggcctggagctgcccgagagaacccccagacccgacagacccagagccagagacagacccaagcccagaagaagacccagacccagagagggcggcgagggcggcggcagcagaagaagcagaagcgcccccgcccagggcggcagcgcccccgcccccccccccccccccacccacaccgtgcagcacgagggcttcctgctgagaaagagagagctggacgccaacagaaagagcagcaacagaagctgggtgagcctgtactgcgtgctgagcaagggcgagctgggcttctacaaggacagcaagggccccgccagcggcagcacccacggcggcgagcccctgctgagcctgcacaaggccaccagcgaggtggccagcgactacaagaagaagaagcacgtgttcaagctgcagacccaggacggcagcgagttcctgctgcaggccaaggacgaggaggagatgaacggctggctggaggccgtggccagcagcgtggccgagcacgccgagatcgccagatggggccagaccctgcccaccaccagcagcaccgacgagggcaaccccaagagagagggcggcgacagaagagccagcggcagaagaaagtag

SEQ ID NO: 100519 - DNA, 11025 bp, Artificial Sequence
  Description of Artificial Sequence: Synthetic coding sequence
atggccggccagccccacagccccagagagctgctgggcgccgccggccacagaagcagaagacccagcaccgagctgagagtgccccccagccccagcctgaccatggacagccagtacgagaccggccacatcagaaagctgcaggccagacacatgcagatgcaggagaagaccttcaccaagtggatcaacaacgtgttccagtgcggccaggccggcatcaagatcagaaacctgtacaccgagctggccgacggcatccacctgctgagactgctggagctgatcagcggcgaggccctgcccccccccagcagaggcagactgagagtgcacttcctggagaacagcagcagagccctggccttcctgagagccaaggtgcccgtgcccctgatcggccccgagaacatcgtggacggcgaccagaccctgatcctgggcctgatctgggtgatcatcctgagattccagatcagccacatcagcctggacaaggaggagttcggcgccagcgccgccctgctgagcaccaaggaggccctgctggtgtggtgccagagaaagaccgccagctacaccaacgtgaacatcaccgacttcagcagaagctggagcgacggcctgggcttcaacgccctgatccacgcccacagacccgacctgctggactacggcagcctgagacccgacagacccctgcacaacctggccttcgccttcctggtggccgagcaggagctgggcatcgcccagctgctggaccccgaggacgtggccgccgcccagcccgacgagagaagcatcatgacctacgtgagcctgtactaccactactgcagcagactgcaccagggccagaccgtgcagagaagactgaccaagatcctgctgcagctgcaggagaccgagctgctgcagacccagtacgagcagctggtggccgacctgctgagatggatcgccgagaagcagatgcagctggaggccagagacttccccgacagcctgcccgccatgagacagctgctggccgccttcaccatcttcagaacccaggagaagccccccagactgcagcagagaggcgccgccgaggccctgctgttcagactgcagaccgccctgcaggcccagaacagaagacccttcctgccccacgagggcctgggcctggccgagctgagccagtgctgggccggcctggagtgggccgaggccgccagaagccaggccctgcagcagagactgctgcagctgcagagactggagaccctggccagaagattccagcacaaggccgccctgagagagagcttcctgaaggacgccgagcaggtgctggaccaggccagagccccccccgccagcctggccaccgtggaggccgccgtgcagagactgggcatgctggaggccggcatcctgccccaggagggcagattccaggccctggccgagatcgccgacatcctgagacaggagcagtaccacagctgggccgacgtggccagaagacaggaggaggtgaccgtgagatggcagagactgctgcagcacctgcagggccagagaaagcaggtggccgacatgcaggccgtgctgagcctgctgcaggaggtggaggccgccagccaccagctggaggagctgcaggagcccgccagaagcaccgcctgcggccagcagctggccgaggtggtggagctgctgcagagacacgacctgctggaggcccaggtgagcgcccacggcgcccacgtgagccacctggcccagcagaccgccgagctggacagcagcctgggcaccagcgtggaggtgctgcaggccaaggccagaaccctggcccagctgcagcagagcctggtggccctggtgagagccagaagagccctgctggagcagaccctgcagagagccgagttcctgagaaactgcgaggaggaggaggcctggctgaaggagtgcggccagagagtgggcaacgccgccctgggcagagacctgagccagatcgccggcgccctgcagaagcacaaggccctggaggccgaggtgcacagacaccaggccgtgtgcgtggacctggtgagaagaggcagagacctgagcgccagaagaccccccacccagcccgaccccggcgagagagccgaggccgtgcagggcggctggcagctgctgcagaccagagtggtgggcagaggcgccagactgcagaccgccctgctggtgctgcagtacttcgccgacgccgccgaggccgccagctggctgagagagagaagaagcagcctggagagagccagctgcggccaggaccaggccgccgccgagaccctgctgagaagacacgtgagactggagagagtgctgagagccttcgccgccgagctgagaagactggaggagcagggcagagccgccagcgccagagccagcctgttcaccgtgaacagcgccctgagcccccccggcgagagcctgagaaaccccggcccctggagcgaggccagctgccaccccggccccggcgacgcctggaagatggccctgcccgccgagcccgaccccgacttcgaccccaacaccatcctgcagacccaggaccacctgagccaggactacgagagcctgagagccctggcccagctgagaagagccagactggaggaggccatggccctgttcggcttctgcagcagctgcggcgagctgcagctgtggctggagaagcagaccgtgctgctgcagagagtgcagccccaggccgacaccctggaggtgatgcagctgaagtacgagaacttcctgaccgccctggccgtgggcaagggcctgtgggccgaggtgagcagcagcgccgagcagctgagacagagataccccggcaacagcacccagatccagagacagcaggaggagctgagccagagatggggccagctggaggccctgaagagagagaaggccgtgcagctggcccacagcgtggaggtgtgcagcttcctgcaggagtgcggccccacccaggtgcagctgagagacgtgctgctgcagctggaggccctgcagcccggcagcagcgaggacacctgccacgccctgcagctggcccagaagaagaccctggtgctggagagaagagtgcacttcctgcagagcgtggtggtgaaggtggaggagcccggctacgccgagagccagcccctgcagggccaggtggagaccctgcagggcctgctgaagcaggtgcaggagcaggtggcccagagagccagaagacaggccgagacccaggccagacagagcttcctgcaggagagccagcagctgctgctgtgggccgagagcgtgcaggcccagctgagaagcaaggaggtgagcgtggacgtggccagcgcccagagactgctgagagagcaccaggacctgctggaggagatccacctgtggcaggagagactgcagcagctggacgcccagagccagcccatggccgccctggactgccccgacagccaggaggtgcccaacaccctgagagtgctgggccagcagggccaggagctgaaggtgctgtgggagcagagacagcagtggctgcaggagggcctggagctgcagaagttcggcagagaggtggacggcttcaccgccacctgcgccaaccaccaggcctggctgcacctggacaacctgggcgaggacgtgagagaggccctgagcctgctgcagcagcacagagagttcggcagactgctgagcaccctgggccccagagccgaggccctgagagcccacggcgagaagctggtgcagagccagcaccccgccgcccacaccgtgagagagcagctgcagagcatccaggcccagtggaccagactgcagggcagaagcgagcagagaagaagacagctgctggccagcctgcagctgcaggagtggaagcaggacgtggccgagctgatgcagtggatggaggagaagggcctgatggccgcccacgagcccagcggcgccagaagaaacatcctgcagaccctgaagagacacgaggccgccgagagcgagctgctggccaccagaagacacgtggaggccctgcagcaggtgggcagagagctgctgagcagaagaccctgcggccaggaggacatccagaccagactgcagggcctgagaagcaagtgggaggccctgaacagaaagatgaccgagagaggcgacgagctgcagcaggccggccagcaggagcagctgctgagacagctgcaggacgccaaggagcagctggagcagctggagggcgccctgcagagcagcgagaccggccaggacctgagaagcagccagagactgcagaagagacaccagcagctggagagcgagagcagaaccctggccgccaagatggccgccctggccagcatggcccacggcatggccgccagccccgccatcctggaggagacccagaagcacctgagaagactggagctgctgcagggccacctggccatcagaggcctgcagctgcaggccagcgtggagctgcaccagttctgccacctgagcaacatggagctgagctgggtggccgagcacatgccccacggcagccccaccagctacaccgagtgcctgaacggcgcccagagcctgcacagaaagcacaaggagctgcaggtggaggtgaaggcccaccagggccaggtgcagagagtgctgagcagcggcagaagcctggccgccagcggccacccccaggcccagcacatcgtggagcagtgccaggagctggagggccactgggccgagctggagagagcctgcgaggccagagcccagtgcctgcagcaggccgtgaccttccagcagtacttcctggacgtgagcgagctggagggctgggtggaggagaagagacccctggtgagcagcagagactacggcagagacgaggccgccaccctgagactgatcaacaagcaccaggccctgcaggaggagctggccatctactggagcagcatggaggagctggaccagaccgcccagaccctgaccggccccgaggtgcccgagcagcagagagtggtgcaggagagactgagagagcagctgagagccctgcaggagctggccgccaccagagacagagagctggagggcaccctgagactgcacgagttcctgagagaggccgaggacctgcagggctggctggccagccagaagcaggccgccaagggcggcgagagcctgggcgaggaccccgagcacgccctgcacctgtgcaccaagttcgccaagttccagcaccaggtggagatgggcagccagagagtggccgcctgcagactgctggccgagagcctgctggagagaggccacagcgccggccccatggtgagacagagacagcaggacctgcagaccgcctggagcgagctgtgggagctgacccaggccagaggccacgccctgagagacaccgagaccaccctgagagtgcacagagacctgctggaggtgctgacccaggtgcaggagaaggccaccagcctgcccaacaacgtggccagagacctgtgcggcctggaggcccagctgagaagccaccagggcctggagagagagctggtgggcaccgagagacagctgcaggagctgctggagaccgccggcagagtgcagaagctgtgccccggcccccaggcccacgccgtgcagcagagacagcaggccgtgacccaggcctgggccgtgctgcagagaagaatggagcagagaagagcccagctggagagagccagactgctggccagattcagaaccgccgtgagagactacgccagctgggccgccagagtgagacaggacctgcaggtggaggagagcagccaggagcccagcagcggccccctgaagctgagcgcccaccagtggctgagagccgagctggaggccagagagaagctgtggcagcaggccacccagctgggccagcaggccctgctggccgccggcacccccaccaaggaggtgcaggaggagctgagagccctgcaggaccagagagaccaggtgtaccagacctgggccagaaagcaggagagactgcaggccgagcagcaggagcagctgttcctgagagagtgcggcagactggaggagatcctggccgcccaggaggtgagcctgaagaccagcgccctgggcagcagcgtggaggaggtggagcagctgatcagaaagcacgaggtgttcctgaaggtgctgaccgcccaggacaagaaggaggccgccctgagagagagactgaagaccctgagaagacccagagtgagagacagactgcccatcctgctgcagagaagaatgagagtgaaggagctggccgagagcagaggccacgccctgcacgccagcctgctgatggccagcttcacccaggccgccacccaggccgaggactggatccaggcctgggcccagcagctgaaggagcccgtgccccccggcgacctgagagacaagctgaagcccctgctgaagcaccaggccttcgaggccgaggtgcaggcccacgaggaggtgatgaccagcgtggccaagaagggcgaggccctgctggcccagagccaccccagagccggcgaggtgagccagagactgcagggcctgagaaagcactgggaggacctgagacaggccatggccctgagaggccaggagctggaggacagaagaaacttcctggagttcctgcagagagtggacctggccgaggcctggatccaggagaaggaggtgaagatgaacgtgggcgacctgggccaggacctggagcactgcctgcagctgagaagaagactgagagagttcagaggcaacagcgccggcgacaccgtgggcgacgcctgcatcagaagcatcagcgacctgagcctgcagctgaagaacagagaccccgaggaggtgaagatcatctgccagagaagaagccagctgaacaacagatgggccagcttccacggcaacctgctgagataccagcagcagctggagggcgccctggagatccacgtgctgagcagagagctggacaacgtgaccaagagaatccaggagaaggaggccctgatccaggccctggactgcggcaaggacctggagagcgtgcagagactgctgagaaagcacgaggagctggagagagaggtgcaccccatccaggcccaggtggagagcctggagagagaggtgggcagactgtgccagagaagccccgaggccgcccacggcctgagacacagacagcaggaggtggccgagagctggtggcagctgagaagcagagcccagaagagaagagaggccctggacgccctgcaccaggcccagaagctgcaggccatgctgcaggagctgctggtgagcgcccagagactgagagcccagatggacaccagccccgcccccagaagccccgtggaggccagaagaatgctggaggagcaccaggagtgcaaggccgagctggacagctggaccgacagcatcagcctggccagaagcaccggccagcagctgctgaccgccggccaccccttcagcagcgacatcagacaggtgctggccggcctggagcaggagctgagcagcctggagggcgcctggcaggagcaccagctgcagctgcagcaggccctggagctgcagctgttcctgagcagcgtggagaagatggagagatggctgtgcagcaaggaggacagcctggccagcgagggcctgtgggaccccctggcccccatggagcccctgctgtggaagcacaagatgctggagtgggacctggaggtgcaggccggcaagatcagcgccctggaggccaccgccagaggcctgcaccagggcggccaccccgaggcccagagcgccctgggcagatgccaggccatgctgctgagaaaggaggccctgttcagacaggccggcaccagaagacacagactggaggagctgagacagctgcaggccttcctgcaggacagccaggaggtggccgcctggctgagagagaagaacctggtggccctggaggagggcctgctggacaccgccatgctgcccgcccagctgcagaagcagcagaacttccaggccgagctggacgccagcatgcaccagcagcaggagctgcagagagagggccagagactgctgcagggcggccaccccgccagcgaggccatccaggagagactggaggagctgggcgccctgtggggcgagctgcaggacaacagccagaagaaggtggccaagctgcagaaggcctgcgaggccctgagactgagaagaagcatggaggagctggagaactggctggagcccatcgaggtggagctgagagcccccaccgtgggccaggccctgcccggcgtgggcgagctgctgggcacccagagagagctggaggccgccgtggacaagaaggccagacaggccgaggccctgctgggccaggcccaggccttcgtgagagagggccactgcctggcccaggacgtggaggagcaggccagaagactgctgcagagattcaagagcctgagagagcccctgcaggagagaagaaccgccctggaggccagaagcctgctgctgaagttcttcagagacgccgacgaggagatggcctgggtgcaggagaagctgcccctggccgccgcccaggactacggccagagcctgagcgccgtgagacacctgcaggagcagcaccagaacctggagagcgagatgagcagccacgaggccctgaccagagtggtgctgggcaccggctacaagctggtgcaggccggccacttcgccgcccacgaggtggccgccagagtgcagcagctggagaaggccatggcccacctgagagccgaggccgccagaagaagactgctgctgcagcaggcccaggaggcccagcagttcctgaccgagctgctggaggccggcagctggctggccgagagaggccacgtgctggacagcgaggacatgggccacagcgccgaggccacccaggccctgctgagaagactggaggccaccaagagagacctggaggccttcagccccagaatcgagagactgcagcagaccgccgccctgctggagagcagaaagaaccccgagagccccaaggtgctggcccagctgcaggccgtgagagaggcccacgccgagctgctgagaagagccgaggccagaggccacggcctgcaggagcagctgcagctgcaccagctggagagagagaccctgctgctggacgcctggctgaccaccaaggccgccaccgccgagagccaggactacggccaggacctggagggcgtgaaggtgctggaggagaagttcgacgccttcagaaaggaggtgcagagcctgggccaggccaaggtgtacgccctgagaaagctggccggcaccctggagagaggcgcccccagaagatacccccacatccaggcccagagaagcagaatcgaggccgcctgggagagactggaccaggccatcaaggccagaaccgagaacctggccgccgcccacgaggtgcacagcttccagcaggccgccgccgagctgcagggcagaatgcaggagaagaccgccctgatgaagggcgaggacggcggccacagcctgagcagcgtgagaaccctgcagcagcagcacagaagactggagagagagctggaggccatggagaaggaggtggccagactgcagaccgaggcctgcagactgggccagctgcaccccgccgcccccggcggcctggccaaggtgcaggaggcctgggccaccctgcaggccaaggcccaggagagaggccagtggctggcccaggccgcccagggccacgccttcctgggcagatgccaggagctgctggcctgggcccaggagagacaggagctggccagcagcgaggagctggccgaggacgtggccggcgccgagcagctgctgggccagcacgaggagctgggccaggagatcagagagtgcagactgcaggcccaggacctgagacaggagggccagcagctggtggacaacagccacttcatgagcgccgaggtgaccgagtgcctgcaggagctggagggcagactgcaggagctggaggaggcctgggccctgagatggcagagatgcgccgagagctggggcctgcagaagctgagacagagactggagcaggccgaggcctggctggcctgctgggagggcctgctgctgaagcccgactacggccacagcgtgagcgacgtggagctgctgctgcacagacaccaggacctggagaagctgctggccgcccaggaggagaagttcgcccagatgcagaagaccgagatggagcaggagctgctgctgcagccccaggagctgaagcccggcagagccggcagcagcctgaccagcttccagtggagacccagcggccaccagggcctgggcgcccagctggccgagaccagagacccccaggacgccaagggcacccccaccatggagggcagcctggagttcaagcagcacctgctgcccggcggcagacagcccagcagcagcagctgggacagctgcagaggcaacctgcagggcagcagcctgagcctgttcctggacgagagaatggccgccgagaaggtggccagcatcgccctgctggacctgaccggcgccagatgcgagagactgagaggcagacacggcagaaagcacaccttcagcctgagactgaccagcggcgccgagatcctgttcgccgcccccagcgaggagcaggccgagagctggtggagagccctgggcagcaccgccgcccagagcctgagccccaagctgaaggccaagcccgtgagcagcctgaacgagtgcaccaccaaggacgccagacccggctgcctgctgagaagcgacccctag

SEQ ID NO: 100520 - DNA, 942 bp, Artificial Sequence
  Description of Artificial Sequence: Synthetic coding sequence
atgagacacaaccagatgtgctgcgagaccccccccaccgtgaccgtgtacgtgaagagcggcagcaacagaagccaccagcccaagaagcccatcaccctgaagagacccatctgcaaggacaactggcaggccttcgagaagaacacccacaacaacaacaagagcaagagacccaagggcccctgcctggtgatccagagacaggacatgaccgccttcttcaagctgttcgacgacgacctgatccaggacttcctgtggatggactgctgctgcaagatcgccgacaagtacctgctggccatgaccttcgtgtacttcaagagagccaagttcaccatcagcgagcacaccagaatcaacttcttcatcgccctgtacctggccaacaccgtggaggaggacgaggaggagaccaagtacgagatcttcccctgggccctgggcaagaactggagaaagctgttccccaacttcctgaagctgagagaccagctgtgggacagaatcgactacagagccatcgtgagcagaagatgctgcgaggaggtgatggccatcgcccccacccactacatctggcagagagagagaagcgtgcaccacagcggcgccgtgagaaactacaacagagacgaggtgcagctgcccagaggccccagcgccacccccgtggactgcagcctgtgcggcaagaagagaagatacgtgagactgggcctgagcagcagcagcagcctgagcagccacaccgccggcgtgaccgagaagcacagccaggacagctacaacagcctgagcatggacatcatcggcgaccccagccaggcctacaccggcagcgaggtggtgaacgaccaccagagcaacaagggcaagaagaccaacttcctgaagaaggacaagagcatggagtggttcaccggcagcgaggagtag

SEQ ID NO: 100521 - DNA, 942 bp, Artificial Sequence; identical to SEQ ID NO: 100520
  Description of Artificial Sequence: Synthetic coding sequence

SEQ ID NO: 100522 - DNA, 384 bp, Artificial Sequence
  Description of Artificial Sequence: Synthetic coding sequence
atgagacacaaccagatgtgctgcgagaccccccccaccgtgaccgtgtacgtgaagagcggcagcaacagaagccaccagcccaagaagcccatcaccctgaagagacccatctgcaaggacaactggcaggccttcgagaagaacacccacaacaacaacaagagcaagagacccaagggcccctgcctggtgatccagagacaggacatgaccgccttcttcaagctgttcgacgacgacctgatccaggacttcctgtggatggactgctgctgcaagatcgccgacaagtacctgctggccatgaccttcgtgtacttcaagagagccaagttcaccatcagcgagcacaccagaatcaacttcttcatcgccctgtag

SEQ ID NO: 100523 - DNA, 882 bp, Artificial Sequence
  Description of Artificial Sequence: Synthetic coding sequence
atgctgtgggccatccccgagctgggcagcccctgccccatcagcatcagctacgagatgagcgacagccaggaccccaccaccagccccgtggtgaccacccaggtggagctgggcggctgcagcagacagggcggcggcaacggcttcctgagattcagacagcaccaggaggtgcaggccttcctgagcctgctggaggacagcttcgtgcaggagttcctgagcaaggacccctgcttccagatcagcgacaagtacctgctggccatggtgctggtgtacttccagagagcccacctgaagctgagcgagtacacccacagcagcctgttcctggccctgtacctggccaacgacatggaggaggacctggagggccccaagtgcgagatcttcccctgggccctgggcaaggactggtgcctgagagtgggcaagttcctgcaccagagagacaagctgtgggccagaatgggcttcagagccgtggtgagcagacagtgctgcgaggaggtgatggccaaggagcccttccactgggcctggaccagagacagaagaccccaccacggcggcgtgcagagagtgtgcccccaggtgcccgtgagactgcccagaggccccggcctgagccccccccactgcagcccctgcggcctgccccagcactgcagcagccacctgctgaagcccgtgagcagcaagtgccccagcctgaccagcgagtgccacagaccccccagccagaactacctgagcagagtgaagaacgcctggggcggcgacttcctgatcgtgctgcccccccagatgcagctggagcccggcacctacagcctgagaatcttccccaagccccccgccagacccggccactag

SEQ ID NO: 100524 - DNA, 1122 bp, Artificial Sequence
  Description of Artificial Sequence: Synthetic coding sequence
atgaacgtggacaagttcctgatcgtgtgctacctgaagaaggaggtgtggggcttcgagagctacagcctgagcggcaccacctgcttccagtggaactacttcgtgtggagcctgagattcttcttcagctgcggcagcagcaagtaccacctgacccccctgcccatcaagaaggtggactacccccacaagagaggccagaactggggcagctacgtgcacaacagcctgcccagattcaactgggactacagaagctgcttccacacctggaagagagccagcgacaacagagagagagcctacgagcacagcgcctacggccaccacgagagaggcaccggcggcttcgacagaaccagacactacgaccaggactactacagagaccccagagagagaaccctgcagcacggcctgtactacgccagcagaagcagaagccccaacagattcgacgcccacgaccccagatacgagcccagagccagagagcagttcaccctgcccagcgtggtgcacagagacatctacagagacgacatcaccagagaggtgagaggcagaagacccgagagaaactaccagcacagcagaagcagaagcccccacagcagccagagcagaaaccagagcccccagagactggccagccaggccagcagacccaccagaagccccagcggcagcggcagcagaagcagaagcagcagcagcgacagcatcagcagcagcagcagcaccagcagcgacagcagcgacagcagcagcagcagcagcgacgacagccccgccagaagcgtgcagagcgccgccgtgcccgcccccaccagccagctgctgagcagcctggagaaggacgagcccagaaagagcttcggcatcaaggtgcagaacctgcccgtgagaagcaccgacaccagcctgaaggacggcctgttccacgagttcaagaagttcggcaaggtgaccagcgtgcagatccacggcaccagcgaggagagatacggcctggtgttcttcagacagcaggaggaccaggagaaggccctgaccgccagcaagggcaagctgttcttcggcatgcagatcgaggtgaccgcctggatcggcccctag

SEQ ID NO: 100525 - DNA, 10995 bp, Artificial Sequence
  Description of Artificial Sequence: Synthetic coding sequence
atggtgagagagaccagacacctgtgggtgggcaacctgcccgagaacgtgagagaggagaagatcatcgagcacttcaagagatacggcagagtggagagcgtgaagatcctgcccaagagaggcagcgagggcggcgtggccgccttcgtggacttcgtggacatcaagagcgcccagaaggcccacaacagcgtgaacaagatgggcgacagagacctgagaaccgactacaacgagcccggcaccatccccagcgccgccagaggcctggacgacaccgtgagcatcgccagcagaagcagagaggtgagcggcttcagaggcggcggcggcggccccgcctacggccccccccccagcctgcacgccagagagggcagatacgagagaagactggacggcgccagcgacaacagagagagagcctacgagcacagcgcctacggccaccacgagagaggcaccggcggcttcgacagaaccagacactacgaccaggactactacagagaccccagagagagaaccctgcagcacggcctgtactacgccagcagaagcagaagccccaacagattcgacgcccacgaccccagatacgagcccagagccagagagcagttcaccctgcccagcgtggtgcacagagacatctacagagacgacatcaccagagaggtgagaggcagaagacccgagagaaactaccagcacagcagaagcagaagcccccacagcagccagagcagaaaccagagcccccagagactggccagccaggccagcagacccaccagaagccccagcggcagcggcagcagaagcagaagcagcagcagcgacagcatcagcagcagcagcagcaccagcagcgacagcagcgacagcagcagcagcagcagcgacgacagccccgccagaagcgtgcagagcgccgccgtgcccgcccccaccagccagctgctgagcagcctggagaaggacgagcccagaaagagcttcggcatcaaggtgcagaacctgcccgtgagaagcaccgacaccagcctgaaggacggcctgttccacgagttcaagaagttcggcaaggtgaccagcgtgcagatccacggcaccagcgaggagagatacggcctggtgttcttcagacagcaggaggaccaggagaaggccctgaccgccagcaagggcaagctgttcttcggcatgcagatcgaggtgaccgcctggatcggccccgagaccgagagcgagaacgagttcagacccctggacgagagaatcgacgagttccaccccaaggccaccagaaccctgttcatcggcaacctggagaagaccaccacctaccacgacctgagaaacatcttccagagattcggcgagatcgtggacatcgacatcaagaaggtgaacggcgtgccccagtacgccttcctgcagtactgcgacatcgccagcgtgtgcaaggccatcaagaagatggacggcgagtacctgggcaacaacagactgaagctgggcttcggcaagagcatgcccaccaactgcgtgtggctggacggcctgagcagcaacgtgagcgaccagtacctgaccagacacttctgcagatacggccccgtggtgaaggtggtgttcgacagactgaagggcatggccctggtgctgtacaacgagatcgagtacgcccaggccgccgtgaaggagaccaagggcagaaagatcggcggcaacaagatcaaggtggacttcgccaacagagagagccagctggccttctaccactgcatggagaagagcggccaggacatcagagacttctacgagatgctggccgagagaagagaggagagaagagccagctacgactacaaccaggacagaacctactacgagagcgtgagaacccccggcacctaccccgaggacagcagaagagactaccccgccagaggcagagagttctacagcgagtgggagacctaccagggcgactactacgagagcagatactacgacgaccccagagagtacagagactacagaaacgacccctacgagcaggacatcagagagtacagctacagacagagagagagagagagagagagagagagattcgagagcgacagagacagagaccacgagagaagacccatcgagagaagccagagccccgtgcacctgagaagaccccagagccccggcgccagccccagccaggccgagagactgcccagcgacagcgagagaagactgtacagcagaagcagcgacagaagcggcagctgcagcagcctgagcccccccagatacgagaagctggacaagagcagactggagagatacaccaagaacgagaagaccgacaaggagagaaccttcgaccccgagagagtggagagagagagaagactgatcagaaaggagaaggtggagaaggacaagaccgacaagcagaagagaaagggcaaggtgcacagccccagcagccagagcagcgagaccgaccaggagaacgagagagagcagagccccgagaagcccagaagctgcaacaagctgagcagagagaaggccgacaaggagggcatcgccaagaacagactggagctgatgccctgcgtggtgctgaccagagtgaaggagaaggagggcaaggtgatcgaccacacccccgtggagaagctgaaggccaagctggacaacgacaccgtgaagagcagcgccctggaccagaagctgcaggtgagccagaccgagcccgccaagagcgacctgagcaagctggagagcgtgagaatgaaggtgcccaaggagaagggcctgagcagccacgtggaggtggtggagaaggagggcagactgaaggccagaaagcacctgaagcccgagcagcccgccgacggcgtgagcgccgtggacctggagaagctggaggccagaaagagaagattcgccgacagcaacctgaaggccgagaagcagaagcccgaggtgaagaagagcagccccgagatggaggacgccagagtgctgagcaagaagcagcccgacgtgagcagcagagaggtgatcctgctgagagagggcgaggccgagagaaagcccgtgagaaaggagatcctgaagagagagagcaagaagatcaagctggacagactgaacaccgtggccagccccaaggactgccaggagctggccagcatcagcgtgggcagcggcagcagacccagcagcgacctgcaggccagactgggcgagctggccggcgagagcgtggagaaccaggaggtgcagagcaagaagcccatccccagcaagccccagctgaagcagctgcaggtgctggacgaccagggccccgagagagaggacgtgagaaagaactactgcagcctgagagacgagacccccgagagaaagagcggccaggagaagagccacagcgtgaacaccgaggagaagatcggcatcgacatcgaccacacccagagctacagaaagcagatggagcagagcagaagaaagcagcagatggagatggagatcgccaagagcgagaagttcggcagccccaagaaggacgtggacgagtacgagagaagaagcctggtgcacgaggtgggcaagcccccccaggacgtgaccgacgacagcccccccagcaagaagaagagaatggaccacgtggacttcgacatctgcaccaagagagagagaaactacagaagcagcagacagatcagcgaggacagcgagagaaccggcggcagccccagcgtgagacacggcagcttccacgaggacgaggaccccatcggcagccccagactgctgagcgtgaagggcagccccaaggtggacgagaaggtgctgccctacagcaacatcaccgtgagagaggagagcctgaagttcaacccctacgacagcagcagaagagagcagatggccgacatggccaagatcaagctgagcgtgctgaacagcgaggacgagctgaacagatgggacagccagatgaagcaggacgccggcagattcgacgtgagcttccccaacagcatcatcaagagagacagcctgagaaagagaagcgtgagagacctggagcccggcgaggtgcccagcgacagcgacgaggacggcgagcacaagagccacagccccagagccagcgccctgtacgagagcagcagactgagcttcctgctgagagacagagaggacaagctgagagagagagacgagagactgagcagcagcctggagagaaacaagttctacagcttcgccctggacaagaccatcacccccgacaccaaggccctgctggagagagccaagagcctgagcagcagcagagaggagaactggagcttcctggactgggacagcagattcgccaacttcagaaacaacaaggacaaggagaaggtggacagcgcccccagacccatccccagctggtacatgaagaagaagaagatcagaaccgacagcgagggcaagatggacgacaagaaggaggaccacaaggaggaggagcaggagagacaggagctgttcgccagcagattcctgcacagcagcatcttcgagcaggacagcaagagactgcagcacctggagagaaaggaggaggacagcgacttcatcagcggcagaatctacggcaagcagaccagcgagggcgccaacagcaccaccgacagcatccaggagcccgtggtgctgttccacagcagattcatggagctgaccagaatgcagcagaaggagaaggagaaggaccagaagcccaaggaggtggagaagcaggaggacaccgagaaccaccccaagacccccgagagcgcccccgagaacaaggacagcgagctgaagaccccccccagcgtgggcccccccagcgtgaccgtggtgaccctggagagcgcccccagcgccctggagaagaccaccggcgacaagaccgtggaggcccccctggtgaccgaggagaagaccgtggagcccgccaccgtgagcgaggaggccaagcccgccagcgagcccgcccccgcccccgtggagcagctggagcaggtggacctgccccccggcgccgaccccgacaaggaggccgccatgatgcccgccggcgtggaggagggcagcagcggcgaccagcccccctacctggacgccaagccccccacccccggcgccagcttcagccaggccgagagcaacgtggaccccgagcccgacagcacccagcccctgagcaagcccgcccagaagagcgaggaggccaacgagcccaaggccgagaagcccgacgccaccgccgacgccgagcccgacgccaaccagaaggccgaggccgcccccgagagccagccccccgccagcgaggacctggaggtggacccccccgtggccgccaaggacaagaagcccaacaagagcaagagaagcaagacccccgtgcaggccgccgccgtgagcatcgtggagaagcccgtgaccagaaagagcgagagaatcgacagagagaagctgaagagaagcaacagccccagaggcgaggcccagaagctgctggagctgaagatggaggccgagaagatcaccagaaccgccagcaagaacagcgccgccgacctggagcaccccgagcccagcctgcccctgagcagaaccagaagaagaaacgtgagaagcgtgtacgccaccatgggcgaccacgagaacagaagccccgtgaaggagcccgtggagcagcccagagtgaccagaaagagactggagagagagctgcaggaggccgccgccgtgcccaccacccccagaagaggcagaccccccaagaccagaagaagagccgacgaggaggaggagaacgaggccaaggagcccgccgagaccctgaagccccccgagggctggagaagccccagaagccagaagaccgccgccggcggcggcccccagggcaagaagggcaagaacgagcccaaggtggacgccaccagacccgaggccaccaccgaggtgggcccccagatcggcgtgaaggagagcagcatggagcccaaggccgccgaggaggaggccggcagcgagcagaagagagacagaaaggacgccggcaccgacaagaacccccccgagaccgcccccgtggaggtggtggagaagaagcccgcccccgagaagaacagcaagagcaagagaggcagaagcagaaacagcagactggccgtggacaagagcgccagcctgaagaacgtggacgccgccgtgagccccagaggcgccgccgcccaggccggcgagagagagagcggcgtggtggccgtgagccccgagaagagcgagagcccccagaaggaggacggcctgagcagccagctgaagagcgaccccgtggaccccgacaaggagcccgagaaggaggacgtgagcgccagcggccccagccccgaggccacccagctggccaagcagatggagctggagcaggccgtggagcacatcgccaagctggccgaggccagcgccagcgccgcctacaaggccgacgcccccgagggcctggcccccgaggacagagacaagcccgcccaccaggccagcgagaccgagctggccgccgccatcggcagcatcatcaacgacatcagcggcgagcccgagaacttccccgccccccccccctaccccggcgagagccagaccgacctgcagccccccgccggcgcccaggccctgcagcccagcgaggagggcatggagaccgacgaggccgtgagcggcatcctggagaccgaggccgccaccgagagcagcagaccccccgtgaacgcccccgaccccagcgccggccccaccgacaccaaggaggccagaggcaacagcagcgagaccagccacagcgtgcccgaggccaagggcagcaaggaggtggaggtgaccctggtgagaaaggacaagggcagacagaagaccaccagaagcagaagaaagagaaacaccaacaagaaggtggtggcccccgtggagagccacgtgcccgagagcaaccaggcccagggcgagagccccgccgccaacgagggcaccaccgtgcagcaccccgaggccccccaggaggagaagcagagcgagaagccccacagcacccccccccagagctgcaccagcgacctgagcaagatccccagcaccgagaacagcagccaggagatcagcgtggaggagagaacccccaccaaggccagcgtgccccccgacctgcccccccccccccagcccgcccccgtggacgaggagccccaggccagattcagagtgcacagcatcatcgagagcgaccccgtgaccccccccagcgaccccagcatccccatccccaccctgcccagcgtgaccgccgccaagctgagcccccccgtggccagcggcggcatcccccaccagagcccccccaccaaggtgaccgagtggatcaccagacaggaggagcccagagcccagagcacccccagccccgccctgccccccgacaccaaggccagcgacgtggacaccagcagcagcaccctgagaaagatcctgatggaccccaagtacgtgagcgccaccagcgtgaccagcaccagcgtgaccaccgccatcgccgagcccgtgagcgccgccccctgcctgcacgaggccccccccccccccgtggacagcaagaagcccctggaggagaagaccgccccccccgtgaccaacaacagcgagatccaggccagcgaggtgctggtggccgccgacaaggagaaggtggcccccgtgatcgcccccaagatcaccagcgtgatcagcagaatgcccgtgagcatcgacctggagaacagccagaagatcaccctggccaagcccgccccccagaccctgaccggcctggtgagcgccctgaccggcctggtgaacgtgagcctggtgcccgtgaacgccctgaagggccccgtgaagggcagcgtgaccaccctgaagagcctggtgagcacccccgccggccccgtgaacgtgctgaagggccccgtgaacgtgctgaccggccccgtgaacgtgctgaccacccccgtgaacgccaccgtgggcaccgtgaacgccgcccccggcaccgtgaacgccgccgccagcgccgtgaacgccaccgccagcgccgtgaccgtgaccgccggcgccgtgaccgccgccagcggcggcgtgaccgccaccaccggcaccgtgaccatggccggcgccgtgatcgcccccagcaccaagtgcaagcagagagccagcgccaacgagaacagcagattccaccccggcagcatgcccgtgatcgacgacagacccgccgacgccggcagcggcgccggcctgagagtgaacaccagcgagggcgtggtgctgctgagctacagcggccagaagaccgagggcccccagagaatcagcgccaagatcagccagatcccccccgccagcgccatggacatcgagttccagcagagcgtgagcaagagccaggtgaagcccgacagcgtgaccgccagccagccccccagcaagggcccccaggcccccgccggctacgccaacgtggccacccacagcaccctggtgctgaccgcccagacctacaacgccagccccgtgatcagcagcgtgaaggccgacagacccagcctggagaagcccgagcccatccacctgagcgtgagcacccccgtgacccagggcggcaccgtgaaggtgctgacccagggcatcaacaccccccccgtgctggtgcacaaccagctggtgctgacccccagcatcgtgaccaccaacaagaagctggccgaccccgtgaccctgaagatcgagaccaaggtgctgcagcccgccaacctgggcagcaccctgaccccccaccacccccccgccctgcccagcaagctgcccaccgaggtgaaccacgtgcccagcggccccagcatccccgccgacagaaccgtgagccacctggccgccgccaagctggacgcccacagccccagacccagcggccccggccccagcagcttccccagagccagccaccccagcagcaccgccagcaccgccctgagcaccaacgccaccgtgatgctggccgccggcatccccgtgccccagttcatcagcagcatccaccccgagcagagcgtgatcatgcccccccacagcatcacccagaccgtgagcctgagccacctgagccagggcgaggtgagaatgaacacccccaccctgcccagcatcacctacagcatcagacccgaggccctgcacagccccagagcccccctgcagccccagcagatcgaggtgagagccccccagagagccagcaccccccagcccgcccccgccggcgtgcccgccctggccagccagcacccccccgaggaggaggtgcactaccacctgcccgtggccagagccaccgcccccgtgcagagcgaggtgctggtgatgcagagcgagtacagactgcacccctacaccgtgcccagagacgtgagaatcatggtgcacccccacgtgaccgccgtgagcgagcagcccagagccgccgacggcgtggtgaaggtgccccccgccagcaaggccccccagcagcccggcaaggaggccgccaagacccccgacgccaaggccgcccccacccccacccccgcccccgtgcccgtgcccgtgcccctgcccgcccccgcccccgccccccacggcgaggccagaatcctgaccgtgacccccagcaaccagctgcagggcctgcccctgaccccccccgtggtggtgacccacggcgtgcagatcgtgcacagcagcggcgagctgttccaggagtacagatacggcgacatcagaacctaccacccccccgcccagctgacccacacccagttccccgccgccagcagcgtgggcctgcccagcagaaccaagaccgccgcccagggccccccccccgagggcgagcccctgcagcccccccagcccgtgcagagcacccagcccgcccagcccgcccccccctgcccccccagccagctgggccagcccggccagccccccagcagcaagatgccccaggtgagccaggaggccaagggcacccagaccggcgtggagcagcccagactgcccgccggccccgccaacagaccccccgagccccacacccaggtgcagagagcccaggccgagaccggccccaccagcttccccagccccgtgagcgtgagcatgaagcccgacctgcccgtgagcctgcccacccagaccgcccccaagcagcccctgttcgtgcccaccaccagcggccccagcaccccccccggcctggtgctgccccacaccgagttccagcccgcccccaagcaggacagcagcccccacctgaccagccagagacccgtggacatggtgcagctgctgaagaagtaccccatcgtgtggcagggcctgctggccctgaagaacgacaccgccgccgtgcagctgcacttcgtgagcggcaacaacgtgctggcccacagaagcctgcccctgagcgagggcggcccccccctgagaatcgcccagagaatgagactggaggccacccagctggagggcgtggccagaagaatgaccgtggagaccgactactgcctgctgctggccctgccctgcggcagagaccaggaggacgtggtgagccagaccgagagcctgaaggccgccttcatcacctacctgcaggccaagcaggccgccggcatcatcaacgtgcccaaccccggcagcaaccagcccgcctacgtgctgcagatcttccccccctgcgagttcagcgagagccacctgagcagactggcccccgacctgctggccagcatcagcaacatcagcccccacctgatgatcgtgatcgccagcgtgtag

SEQ ID NO: 100526 - DNA, 1122 bp, Artificial Sequence; identical to SEQ ID NO: 100524
  Description of Artificial Sequence: Synthetic coding sequence

SEQ ID NO: 100527 - DNA, 894 bp, Artificial Sequence
  Description of Artificial Sequence: Synthetic coding sequence
tgacaggccagcagacccaccagaagccccagcggcagcggcagcagaagcagaagcagcagcagcgacagcatcagcagcagcagcagcaccagcagcgacagcgacagcagcagcagcagcagcgacgacagccccgccagaagcgtgcagagcgccgccgtgcccgcccccaccagccagctgctgagcagcctggagaaggacgagcccagaaagagcttcggcatcaaggtgcagaacctgcccgtgagaagcaccgacaccagcctgaaggacggcctgttccacgagttcaagaagttcggcaaggtgaccagcgtgcagatccacggcaccagcgaggagagatacggcctggtgttcttcagacagcaggaggaccaggagaaggccctgaccgccagcaagggcaagctgttcttcggcatgcagatcgaggtgaccgcctggatcggccccgagaccgagagcgagaacgagttcagacccctggacgagagaatcgacgagttccaccccaaggccaccagaaccctgttcatcggcaacctggagaagaccaccacctaccacgacctgagaaacatcttccagagattcggcgagatcgtggacatcgacatcaagaaggtgaacggcgtgccccagtacgccttcctgcagtactgcgacatcgccagcgtgtgcaaggccatcaagaagatggacggcgagtacctgggcaacaacagactgaagctgggcttcggcaagagcatgcccaccaactgcgtgtggctggacggcctgagcagcaacgtgagcgaccagtacctgaccagacacttctgcagatacggccccgtggtgaaggtggtgttcgacagactgaagggcatggccctggtgtag

SEQ ID NO: 100528 - DNA, 885 bp, Artificial Sequence
  Description of Artificial Sequence: Synthetic coding sequence
atgagccccagaggcaccggctgcagcgccggcctgctgatgaccgtgggctggctgctgctggccggcctgcagagcgccagaggcaccaacgtgaccgccgccgtgcaggacgccggcctggcccacgagggcgagggcgaggaggagaccgagaacaacgacagcgagaccgccgagaactacgccccccccgagaccgaggacgtgagcaacagaaacgtggtgaaggaggtggagttcggcatgtgcaccgtgacctgcggcatcggcgtgagagaggtgatcctgaccaacggctgccccggcggcgagagcaagtgcgtggtgagagtggaggagtgcagaggccccaccgactgcggctggggcaagcccatcagcgagagcctggagagcgtgagactggcctgcatccacaccagccccctgaacagattcaagtacatgtggaagctgctgagacaggaccagcagagcatcatcctggtgaacgacagcgccatcctggaggtgagaaaggagagccaccccctggccttcgagtgcgacaccctggacaacaacgagatcgtggccaccatcaagttcaccgtgtacaccagcagcgagctgcagatgagaagaagcagcctgcccgccaccgacgccgccctgatcttcgtgctgaccatcggcgtgatcatctgcgtgttcatcatcttcctgctgatcttcatcatcatcaactgggccgccgtgaaggccttctggggcgccaaggccagcacccccgaggtgcagagcgagcagagcagcgtgagatacaaggacagcaccagcctggaccagctgcccaccgagatgcccggcgaggacgacgccctgagcgagtggaacgagtag

SEQ ID NO: 100529 - DNA, 648 bp, Artificial Sequence
  Description of Artificial Sequence: Synthetic coding sequence
atggtgagcgccctgagaggcgcccccctgatcagagtgcacagcagccccgtgagcagccccagcgtgagcggccccagaagactggtgagctgcctgagcagccagagcagcgccctgagccagagcggcggcggcagcaccagcgccgccggcatcgaggccagaagcagagccctgagaagaagatggtgccccgccggcatcatgctgctggccctggtgtgcctgctgagctgcctgctgcccagcagcgaggccaagctgtacggcagatgcgagctggccagagtgctgcacgacttcggcctggacggctacagaggctacagcctggccgactgggtgtgcctggcctacttcaccagcggcttcaacgccgccgccctggactacgaggccgacggcagcaccaacaacggcatcttccagatcaacagcagaagatggtgcagcaacctgacccccaacgtgcccaacgtgtgcagaatgtactgcagcgacctgctgaaccccaacctgaaggacaccgtgatctgcgccatgaagatcacccaggagccccagggcctgggctactgggaggcctggagacaccactgccagggcaaggacctgaccgagtgggtggacggctgcgacttctag

SEQ ID NO: 100530 - DNA, 627 bp, Artificial Sequence
  Description of Artificial Sequence: Synthetic coding sequence
atgatccaggaggaccacgagggcagccaggacggcggcgtgcacagcagccccgtgagcagccccagcgtgagcggccccagaagactggtgagctgcctgagcagccagagcagcgccctgagccagagcggcggcggcagcaccagcgccgccggcatcgaggccagaagcagagccctgagaagaagatggtgccccgccggcatcatgctgctggccctggtgtgcctgctgagctgcctgctgcccagcagcgaggccaagctgtacggcagatgcgagctggccagagtgctgcacgacttcggcctggacggctacagaggctacagcctggccgactgggtgtgcctggcctacttcaccagcggcttcaacgccgccgccctggactacgaggccgacggcagcaccaacaacggcatcttccagatcaacagcagaagatggtgcagcaacctgacccccaacgtgcccaacgtgtgcagaatgtactgcagcgacctgctgaaccccaacctgaaggacaccgtgatctgcgccatgaagatcacccaggagccccagggcctgggctactgggaggcctggagacaccactgccagggcaaggacctgacctag

SEQ ID NO: 100531 - DNA, 339 bp, Artificial Sequence
  Description of Artificial Sequence: Synthetic coding sequence
atggtgagcgccctgagaggcgcccccctgatcagagtgtgcctggcctacttcaccagcggcttcaacgccgccgccctggactacgaggccgacggcagcaccaacaacggcatcttccagatcaacagcagaagatggtgcagcaacctgacccccaacgtgcccaacgtgtgcagaatgtactgcagcgacctgctgaaccccaacctgaaggacaccgtgatctgcgccatgaagatcacccaggagccccagggcctgggctactgggaggcctggagacaccactgccagggcaaggacctgaccgagtgggtggacggctgcgacttctag

SEQ ID NO: 100532 - DNA, 372 bp, Artificial Sequence
  Description of Artificial Sequence: Synthetic coding sequence
atgaccagcggctggaccgacaccggcgacaccgcctggctgaccgcctacgccctgccctacgccggcgtgtgcctggcctacttcaccagcggcttcaacgccgccgccctggactacgaggccgacggcagcaccaacaacggcatcttccagatcaacagcagaagatggtgcagcaacctgacccccaacgtgcccaacgtgtgcagaatgtactgcagcgacctgctgaaccccaacctgaaggacaccgtgatctgcgccatgaagatcacccaggagccccagggcctgggctactgggaggcctggagacaccactgccagggcaaggacctgaccgagtgggtggacggctgcgacttctag

SEQ ID NO: 100533 - DNA, 375 bp, Artificial Sequence
  Description of Artificial Sequence: Synthetic coding sequence
atggtgctgtgctggctgctgctgctggtgatggccctgccccccggcaccaccggcgtgaaggactgcgtgttctgcgagctgaccgacagcatgcagtgccccggcacctacatgcactgcggcgacgacgaggactgcttcaccggccacggcgtggcccccggcaccggccccgtgatcaacaagggctgcctgagagccaccagctgcggcctggaggagcccgtgagctacagaggcgtgacctacagcctgaccaccaactgctgcaccggcagactgtgcaacagagcccccagcagccagaccgtgggcgccaccaccagcctggccctgggcctgggcatgctgctgccccccagactgctgtag

SEQ ID NO: 100534 - DNA, 480 bp, Artificial Sequence
  Description of Artificial Sequence: Synthetic coding sequence
atgaaggcctggggcaccgtggtggtgaccctggccaccctgatggtggtgaccgtggacgccaagatctacgagagatgcgagctggccgccagactggagagagccggcctgaacggctacaagggctacggcgtgggcgactggctgtgcatggcccactacgagagcggcttcgacaccgccttcgtggaccacaaccccgacggcagcagcgagtacggcatcttccagctgaacagcgcctggtggtgcgacaacggcatcacccccaccaagaacctgtgccacatggactgccacgacctgctgaacagacacatcctggacgacatcagatgcgccaagcagatcgtgagcagccagaacggcctgagcgcctggaccagctggagactgcactgcagcggccacgacctgagcgagtggctgaagggctgcgacatgcacgtgaagatcgaccccaagatccacccctag

SEQ ID NO: 100535 - DNA, 480 bp, Artificial Sequence; identical to SEQ ID NO: 100534
  Description of Artificial Sequence: Synthetic coding sequence

SEQ ID NO: 100536 - DNA, 3207 bp, Artificial Sequence
  Description of Artificial Sequence: Synthetic coding sequence
atgagaagcgccgccaagccctggaaccccgccatcagagccggcggccacggccccgacagagtgagacccctgcccgccgccagcagcggcatgaagagcagcaagagcagcaccagcctggccttcgagagcagactgagcagactgaagagagccagcagcgaggacaccctgaacaagcccggcagcaccgccgccagcggcgtggtgagactgaagaagaccgccaccgccggcgccatcagcgagctgaccgagagcagactgagaagcggcaccggcgccttcaccaccaccaagagaaccggcatccccgcccccagagagttcagcgtgaccgtgagcagagagagaagcgtgcccagaggccccagcaaccccagaaagagcgtgagcagccccaccagcagcaacacccccacccccaccaagcacctgagaacccccagcaccaagcccaagcaggagaacgagggcggcgagaaggccgccctggagagccaggtgagagagctgctggccgaggccaaggccaaggacagcgagatcaacagactgagaagcgagctgaagaagtacaaggagaagagaaccctgaacgccgagggcaccgacgccctgggccccaacgtggacggcaccagcgtgagccccggcgacaccgagcccatgatcagagccctggaggagaagaacaagaacttccagaaggagctgagcgacctggaggaggagaacagagtgctgaaggagaagctgatctacctggagcacagccccaacagcgagggcgccgccagccacaccggcgacagcagctgccccaccagcatcacccaggagagcagcttcggcagccccaccggcaaccagatgagcagcgacatcgacgagtacaagaagaacatccacggcaacgccctgagaaccagcggcagcagcagcagcgacgtgaccaaggccagcctgagccccgacgccagcgacttcgagcacatcaccgccgagacccccagcagacccctgagcagcaccagcaaccccttcaagagcagcaagtgcagcaccgccggcagcagccccaacagcgtgagcgagctgagcctggccagcctgaccgagaagatccagaagatggaggagaaccaccacagcaccgccgaggagctgcaggccaccctgcaggagctgagcgaccagcagcagatggtgcaggagctgaccgccgagaacgagaagctggtggacgagaagaccatcctggagaccagcttccaccagcacagagagagagccgagcagctgagccaggagaacgagaagctgatgaacctgctgcaggagagagtgaagaacgaggagcccaccacccaggagggcaagatcatcgagctggagcagaagtgcaccggcatcctggagcagggcagattcgagagagagaagctgctgaacatccagcagcagctgacctgcagcctgagaaaggtggaggaggagaaccagggcgccctggagatgatcaagagactgaaggaggagaacgagaagctgaacgagttcctggagctggagagacacaacaacaacatgatggccaagaccctggaggagtgcagagtgaccctggagggcctgaagatggagaacggcagcctgaagagccacctgcagggcgagaagcagaaggccaccgaggccagcgccgtggagcagaccgccgagagctgcgaggtgcaggagatgctgaaggtggccagagccgagaaggacctgctggagctgagctgcaacgagctgagacaggagctgctgaaggccaacggcgagatcaagcacgtgagcagcctgctggccaaggtggagaaggactacagctacctgaaggagatctgcgaccaccaggccgagcagctgagcagaaccagcctgaagctgcaggagaaggccagcgagagcgacgccgagatcaaggacatgaaggagaccatcttcgagctggaggaccaggtggagcagcacagagccgtgaagctgcacaacaaccagctgatcagcgagctggagagcagcgtgatcaagctggaggagcagaagagcgacctggagagacagctgaagaccctgaccaagcagatgaaggaggagaccgaggagtggagaagattccaggccgacctgcagaccgccgtggtggtggccaacgacatcaagtgcgaggcccagcaggagctgagaaccgtgaagagaaagctgctggaggaggaggagaagaacgccagactgcagaaggagctgggcgacgtgcagggccacggcagagtggtgaccagcagagccgcccccccccccgtggacgaggagcccgagagcagcgaggtggacgccgccggcagatggcccggcgtgtgcgtgagcagaaccagccccaccccccccgagagcgccaccaccgtgaagagcctgatcaagagcttcgacctgggcagacccggcggcgccggccagaacatcagcgtgcacaagacccccagaagccccctgagcggcatccccgtgagaaccgcccccgccgccgccgtgagccccatgcagagacacagcacctacagcagcgtgagacccgccagcagaggcgtgacccagagactggacctgcccgacctgcccctgagcgacatcctgaagggcagaaccgagaccctgaagcccgacccccacctgagaaagagccccagcctggagagcctgagcagaccccccagcctgggcttcggcgacaccagactgctgagcgccagcaccagagcctggaagccccagagcaagctgagcgtggagagaaaggaccccctggccgccctggccagagagtacggcggcagcaagagaaacgccctgctgaagtggtgccagaagaagacccagggctacgccaacatcgacatcaccaacttcagcagcagctggagcgacggcctggccttctgcgccctgctgcacacctacctgcccgcccacatcccctaccaggagctgaacagccaggagaagaagagaaacctgctgctggccttcgaggccgccgagagcgtgggcatcaagcccagcctggagctgagcgagatgctgtacaccgacagacccgactggcagagcgtgatgcagtacgtggcccagatctacaagtacttcgagacctag

SEQ ID NO: 100537 - DNA, 2112 bp, Artificial Sequence
  Description of Artificial Sequence: Synthetic coding sequence
atgggcaaccacagcggcagacccgaggaccccgagcccggcgccttcaccaccaccaagagaaccggcatccccgcccccagagagttcagcgtgaccgtgagcagagagagaagcgtgcccagaggccccagcaaccccagaaagagcgtgagcagccccaccagcagcaacacccccacccccaccaagcacctgagaacccccagcaccaagcccaagcaggagaacgagggcggcgagaaggccgccctggagagccaggtgagagagctgctggccgaggccaaggccaaggacagcgagatcaacagactgagaagcgagctgaagaagtacaaggagaagagaaccctgaacgccgagggcaccgacgccctgggccccaacgtggacggcaccagcgtgagccccggcgacaccgagcccatgatcagagccctggaggagaagaacaagaacttccagaaggagctgagcgacctggaggaggagaacagagtgctgaaggagaagctgatctacctggagcacagccccaacagcgagggcgccgccagccacaccggcgacagcagctgccccaccagcatcacccaggagagcagcttcggcagccccaccggcaaccagatgagcagcgacatcgacgagtacaagaagaacatccacggcaacgccctgagaaccagcggcagcagcagcagcgacgtgaccaaggccagcctgagccccgacgccagcgacttcgagcacatcaccgccgagacccccagcagacccctgagcagcaccagcaaccccttcaagagcagcaagtgcagcaccgccggcagcagccccaacagcgtgagcgagctgagcctggccagcctgaccgagaagatccagaagatggaggagaaccaccacagcaccgccgaggagctgcaggccaccctgcaggagctgagcgaccagcagcagatggtgcaggagctgaccgccgagaacgagaagctggtggacgagaagaccatcctggagaccagcttccaccagcacagagagagagccgagcagctgagccaggagaacgagaagctgatgaacctgctgcaggagagagtgaagaacgaggagcccaccacccaggagggcaagatcatcgagctggagcagaagtgcaccggcatcctggagcagggcagattcgagagagagaagctgctgaacatccagcagcagctgacctgcagcctgagaaaggtggaggaggagaaccagggcgccctggagatgatcaagagactgaaggaggagaacgagaagctgaacgagttcctggagctggagagacacaacaacaacatgatggccaagaccctggaggagtgcagagtgaccctggagggcctgaagatggagaacggcagcctgaagagccacctgcagggcgagaagcagaaggccaccgaggccagcgccgtggagcagaccgccgagagctgcgaggtgcaggagatgctgaaggtggccagagccgagaaggacctgctggagctgagctgcaacgagctgagacaggagctgctgaaggccaacggcgagatcaagcacgtgagcagcctgctggccaaggtggagaaggactacagctacctgaaggagatctgcgaccaccaggccgagcagctgagcagaaccagcctgaagctgcaggagaaggccagcgagagcgacgccgagatcaaggacatgaaggagaccatcttcgagctggaggaccaggtggagcagcacagagccgtgaagctgcacaacaaccagctgatcagcgagctggagagcagcgtgatcaagctggaggagcagaagagcgacctggagagacagctgaagaccctgaccaagcagatgaaggaggagaccgaggagtggagaagattccaggccgacctgcagaccgccgtggtggtggccaacgacatcaagtgcgaggcccagcaggagctgagaaccgtgaagagaaagctgctggaggaggaggagaagaacgccagactgcagaaggagctgggcgacgtgcagggccacggcagagtggtgaccagcagagccgcccccccctag

SEQ ID NO: 100538 - DNA, 2130 bp, Artificial Sequence
  Description of Artificial Sequence: Synthetic coding sequence
atgggcaaccacagcggcagacccgaggaccccgagcccggcgccttcaccaccaccaagagaaccggcatccccgcccccagagagttcagcgtgaccgtgagcagagagagaagcgtgcccagaggccccagcaaccccagaaagagcgtgagcagccccaccagcagcaacacccccacccccaccaagcacctgagaacccccagcaccaagcccaagcaggagaacgagggcggcgagaaggccgccctggagagccaggtgagagagctgctggccgaggccaaggccaaggacagcgagatcaacagactgagaagcgagctgaagaagtacaaggagaagagaaccctgaacgccgagggcaccgacgccctgggccccaacgtggacggcaccagcgtgagccccggcgacaccgagcccatgatcagagccctggaggagaagaacaagaacttccagaaggagctgagcgacctggaggaggagaacagagtgctgaaggagaagctgatctacctggagcacagccccaacagcgagggcgccgccagccacaccggcgacagcagctgccccaccagcatcacccaggagagcagcttcggcagccccaccggcaaccagatgagcagcgacatcgacgagtacaagaagaacatccacggcaacgccctgagaaccagcggcagcagcagcagcgacgtgaccaaggccagcctgagccccgacgccagcgacttcgagcacatcaccgccgagacccccagcagacccctgagcagcaccagcaaccccttcaagagcagcaagtgcagcaccgccggcagcagccccaacagcgtgagcgagctgagcctggccagcctgaccgagaagatccagaagatggaggagaaccaccacagcaccgccgaggagctgcaggccaccctgcaggagctgagcgaccagcagcagatggtgcaggagctgaccgccgagaacgagaagctggtggacgagaagaccatcctggagaccagcttccaccagcacagagagagagccgagcagctgagccaggagaacgagaagctgatgaacctgctgcaggagagagtgaagaacgaggagcccaccacccaggagggcaagatcatcgagctggagcagaagtgcaccggcatcctggagcagggcagattcgagagagagaagctgctgaacatccagcagcagctgacctgcagcctgagaaaggtggaggaggagaaccagggcgccctggagatgatcaagagactgaaggaggagaacgagaagctgaacgagttcctggagctggagagacacaacaacaacatgatggccaagaccctggaggagtgcagagtgaccctggagggcctgaagatggagaacggcagcctgaagagccacctgcagggcgagaagcagaaggccaccgaggccagcgccgtggagcagaccgccgagagctgcgaggtgcaggagatgctgaaggtggccagagccgagaaggacctgctggagctgagctgcaacgagctgagacaggagctgctgaaggccaacggcgagatcaagcacgtgagcagcctgctggccaaggtggagaaggactacagctacctgaaggagatctgcgaccaccaggccgagcagctgagcagaaccagcctgaagctgcaggagaaggccagcgagagcgacgccgagatcaaggacatgaaggagaccatcttcgagctggaggaccaggtggagcagcacagagccgtgaagctgcacaacaaccagctgatcagcgagctggagagcagcgtgatcaagctggaggagcagaagagcgacctggagagacagctgaagaccctgaccaagcagatgaaggaggagaccgaggagtggagaagattccaggccgacctgcagaccgccgtggtggtggccaacgacatcaagtgcgaggcccagcaggagctgagaaccgtgaagagaaagctgctggaggaggaggagaagaacgccagactgcagaaggagctgggcgacgtgcagggccacggcagagtggtgaccagcagagccgccccccccagcctgggcagcgtgagctag

SEQ ID NO: 100539 - DNA, 2964 bp, Artificial Sequence
  Description of Artificial Sequence: Synthetic coding sequence
atgggcaaccacagcggcagacccgaggaccccgagcccggcgccttcaccaccaccaagagaaccggcatccccgcccccagagagttcagcgtgaccgtgagcagagagagaagcgtgcccagaggccccagcaaccccagaaagagcgtgagcagccccaccagcagcaacacccccacccccaccaagcacctgagaacccccagcaccaagcccaagcaggagaacgagggcggcgagaaggccgccctggagagccaggtgagagagctgctggccgaggccaaggccaaggacagcgagatcaacagactgagaagcgagctgaagaagtacaaggagaagagaaccctgaacgccgagggcaccgacgccctgggccccaacgtggacggcaccagcgtgagccccggcgacaccgagcccatgatcagagccctggaggagaagaacaagaacttccagaaggagctgagcgacctggaggaggagaacagagtgctgaaggagaagctgatctacctggagcacagccccaacagcgagggcgccgccagccacaccggcgacagcagctgccccaccagcatcacccaggagagcagcttcggcagccccaccggcaaccagatgagcagcgacatcgacgagtacaagaagaacatccacggcaacgccctgagaaccagcggcagcagcagcagcgacgtgaccaaggccagcctgagccccgacgccagcgacttcgagcacatcaccgccgagacccccagcagacccctgagcagcaccagcaaccccttcaagagcagcaagtgcagcaccgccggcagcagccccaacagcgtgagcgagctgagcctggccagcctgaccgagaagatccagaagatggaggagaaccaccacagcaccgccgaggagctgcaggccaccctgcaggagctgagcgaccagcagcagatggtgcaggagctgaccgccgagaacgagaagctggtggacgagaagaccatcctggagaccagcttccaccagcacagagagagagccgagcagctgagccaggagaacgagaagctgatgaacctgctgcaggagagagtgaagaacgaggagcccaccacccaggagggcaagatcatcgagctggagcagaagtgcaccggcatcctggagcagggcagattcgagagagagaagctgctgaacatccagcagcagctgacctgcagcctgagaaaggtggaggaggagaaccagggcgccctggagatgatcaagagactgaaggaggagaacgagaagctgaacgagttcctggagctggagagacacaacaacaacatgatggccaagaccctggaggagtgcagagtgaccctggagggcctgaagatggagaacggcagcctgaagagccacctgcagggcgagaagcagaaggccaccgaggccagcgccgtggagcagaccgccgagagctgcgaggtgcaggagatgctgaaggtggccagagccgagaaggacctgctggagctgagctgcaacgagctgagacaggagctgctgaaggccaacggcgagatcaagcacgtgagcagcctgctggccaaggtggagaaggactacagctacctgaaggagatctgcgaccaccaggccgagcagctgagcagaaccagcctgaagctgcaggagaaggccagcgagagcgacgccgagatcaaggacatgaaggagaccatcttcgagctggaggaccaggtggagcagcacagagccgtgaagctgcacaacaaccagctgatcagcgagctggagagcagcgtgatcaagctggaggagcagaagagcgacctggagagacagctgaagaccctgaccaagcagatgaaggaggagaccgaggagtggagaagattccaggccgacctgcagaccgccgtggtggtggccaacgacatcaagtgcgaggcccagcaggagctgagaaccgtgaagagaaagctgctggaggaggaggagaagaacgccagactgcagaaggagctgggcgacgtgcagggccacggcagagtggtgaccagcagagccgcccccccccccgtggacgaggagcccgagagcagcgaggtggacgccgccggcagatggcccggcgtgtgcgtgagcagaaccagccccaccccccccgagagcgccaccaccgtgaagagcctgatcaagagcttcgacctgggcagacccggcggcgccggccagaacatcagcgtgcacaagacccccagaagccccctgagcggcatccccgtgagaaccgcccccgccgccgccgtgagccccatgcagagacacagcacctacagcagcgtgagacccgccagcagaggcgtgacccagagactggacctgcccgacctgcccctgagcgacatcctgaagggcagaaccgagaccctgaagcccgacccccacctgagaaagagccccagcctggagagcctgagcagaccccccagcctgggcttcggcgacaccagactgctgagcgccagcaccagagcctggaagccccagagcaagctgagcgtggagagaaaggaccccctggccgccctggccagagagtacggcggcagcaagagaaacgccctgctgaagtggtgccagaagaagacccagggctacgccaacatcgacatcaccaacttcagcagcagctggagcgacggcctggccttctgcgccctgctgcacacctacctgcccgcccacatcccctaccaggagctgaacagccaggagaagaagagaaacctgctgctggccttcgaggccgccgagagcgtgggcatcaagcccagcctggagctgagcgagatgctgtacaccgacagacccgactggcagagcgtgatgcagtacgtggcccagatctacaagtacttcgagacctag

SEQ ID NO: 100540 - DNA, 2373 bp, Artificial Sequence
  Description of Artificial Sequence: Synthetic coding sequence
atgagaagcgccgccaagccctggaaccccgccatcagagccggcggccacggccccgacagagtgagacccctgcccgccgccagcagcggcatgaagagcagcaagagcagcaccagcctggccttcgagagcagactgagcagactgaagagagccagcagcgaggacaccctgaacaagcccggcagcaccgccgccagcggcgtggtgagactgaagaagaccgccaccgccggcgccatcagcgagctgaccgagagcagactgagaagcggcaccggcgccttcaccaccaccaagagaaccggcatccccgcccccagagagttcagcgtgaccgtgagcagagagagaagcgtgcccagaggccccagcaaccccagaaagagcgtgagcagccccaccagcagcaacacccccacccccaccaagcacctgagaacccccagcaccaagcccaagcaggagaacgagggcggcgagaaggccgccctggagagccaggtgagagagctgctggccgaggccaaggccaaggacagcgagatcaacagactgagaagcgagctgaagaagtacaaggagaagagaaccctgaacgccgagggcaccgacgccctgggccccaacgtggacggcaccagcgtgagccccggcgacaccgagcccatgatcagagccctggaggagaagaacaagaacttccagaaggagctgagcgacctggaggaggagaacagagtgctgaaggagaagctgatctacctggagcacagccccaacagcgagggcgccgccagccacaccggcgacagcagctgccccaccagcatcacccaggagagcagcttcggcagccccaccggcaaccagatgagcagcgacatcgacgagtacaagaagaacatccacggcaacgccctgagaaccagcggcagcagcagcagcgacgtgaccaaggccagcctgagccccgacgccagcgacttcgagcacatcaccgccgagacccccagcagacccctgagcagcaccagcaaccccttcaagagcagcaagtgcagcaccgccggcagcagccccaacagcgtgagcgagctgagcctggccagcctgaccgagaagatccagaagatggaggagaaccaccacagcaccgccgaggagctgcaggccaccctgcaggagctgagcgaccagcagcagatggtgcaggagctgaccgccgagaacgagaagctggtggacgagaagaccatcctggagaccagcttccaccagcacagagagagagccgagcagctgagccaggagaacgagaagctgatgaacctgctgcaggagagagtgaagaacgaggagcccaccacccaggagggcaagatcatcgagctggagcagaagtgcaccggcatcctggagcagggcagattcgagagagagaagctgctgaacatccagcagcagctgacctgcagcctgagaaaggtggaggaggagaaccagggcgccctggagatgatcaagagactgaaggaggagaacgagaagctgaacgagttcctggagctggagagacacaacaacaacatgatggccaagaccctggaggagtgcagagtgaccctggagggcctgaagatggagaacggcagcctgaagagccacctgcagggcgagaagcagaaggccaccgaggccagcgccgtggagcagaccgccgagagctgcgaggtgcaggagatgctgaaggtggccagagccgagaaggacctgctggagctgagctgcaacgagctgagacaggagctgctgaaggccaacggcgagatcaagcacgtgagcagcctgctggccaaggtggagaaggactacagctacctgaaggagatctgcgaccaccaggccgagcagctgagcagaaccagcctgaagctgcaggagaaggccagcgagagcgacgccgagatcaaggacatgaaggagaccatcttcgagctggaggaccaggtggagcagcacagagccgtgaagctgcacaacaaccagctgatcagcgagctggagagcagcgtgatcaagctggaggagcagaagagcgacctggagagacagctgaagaccctgaccaagcagatgaaggaggagaccgaggagtggagaagattccaggccgacctgcagaccgccgtggtggtggccaacgacatcaagtgcgaggcccagcaggagctgagaaccgtgaagagaaagctgctggaggaggaggagaagaacgccagactgcagaaggagctgggcgacgtgcagggccacggcagagtggtgaccagcagagccgccccccccagcctgggcagcgtgagctag

SEQ ID NO: 100541 - DNA, 3090 bp, Artificial Sequence
  Description of Artificial Sequence: Synthetic coding sequence
atgagaagcgccgccaagccctggaaccccgccatcagagccggcggccacggccccgacagagtgagacccctgcccgccgccagcagcggcatgaagagcagcaagagcagcaccagcctggccttcgagagcagactgagcagactgaagagagccagcagcgaggacaccctgaacaagcccggcagcaccgccgccagcggcgtggtgagactgaagaagaccgccaccgccggcgccatcagcgagctgaccgagagcagactgagaagcggcaccggcgccttcaccaccaccaagagaaccggcatccccgcccccagagagttcagcgtgaccgtgagcagagagagaagcgtgcccagaggccccagcaaccccagaaagagcgtgagcagccccaccagcagcaacacccccacccccaccaagcacctgagaacccccagcaccaagcccaagcaggagaacgagggcggcgagaaggccgccctggagagccaggtgagagagctgctggccgaggccaaggccaaggacagcgagatcaacagactgagaagcgagctgaagaagtacaaggagaagagaaccctgaacgccgagggcaccgacgccctgggccccaacgtggacggcaccagcgtgagccccggcgacaccgagcccatgatcagagccctggaggagaagaacaagaacttccagaaggagctgagcgacctggaggaggagaacagagtgctgaaggagaagctgatctacctggagcacagccccaacagcgagggcgccgccagccacaccggcgacagcagctgccccaccagcatcacccaggagagcagcttcggcagccccaccggcaaccagatgagcagcgacatcgacgagtacaagaagaacatccacggcaacgccctgagaaccagcggcagcagcagcagcgacgtgaccaaggccagcctgagccccgacgccagcgacttcgagcacatcaccgccgagacccccagcagacccctgagcagcaccagcaaccccttcaagagcagcaagtgcagcaccgccggcagcagccccaacagcgtgagcgagctgagcctggccagcctgaccgagaagatccagaagatggaggagaaccaccacagcaccgccgaggagctgcaggccaccctgcaggagctgagcgaccagcagcagatggtgcaggagctgaccgccgagaacgagaagctggtggacgagaagaccatcctggagaccagcttccaccagcacagagagagagccgagcagctgagccaggagaacgagaagctgatgaacctgctgcaggagagagtgaagaacgaggagcccaccacccaggagggcaagatcatcgagctggagcagaagtgcaccggcatcctggagcagggcagattcgagagagagaagctgctgaacatccagcagcagctgacctgcagcctgagaaaggtggaggaggagaaccagggcgccctggagatgatcaagagactgaaggaggagaacgagaagctgaacgagttcctggagctggagagacacaacaacaacatgatggccaagaccctggaggagtgcagagtgaccctggagggcctgaagatggagaacggcagcctgaagagccacctgcagggcgagaagcagaaggccaccgaggccagcgccgtggagcagaccgccgagagctgcgaggtgcaggagatgctgaaggtggccagagccgagaaggacctgctggagctgagctgcaacgagctgagacaggagctgctgaaggccaacggcgagatcaagcacgtgagcagcctgctggccaaggtggagaaggactacagctacctgaaggagatctgcgaccaccaggccgagcagctgagcagaaccagcctgaagctgcaggagaaggccagcgagagcgacgccgagatcaaggacatgaaggagaccatcttcgagctggaggaccaggtggagcagcacagagccgtgaagctgcacaacaaccagctgatcagcgagctggagagcagcgtgatcaagctggaggagcagaagagcgacctggagagacagctgaagaccctgaccaagcagatgaaggaggagaccgaggagtggagaagattccaggccgacctgcagaccgccgtggtggtggccaacgacatcaagtgcgaggcccagcaggagctgagaaccgtgaagagaaagctgctggaggaggaggagaagaacgccagactgcagaaggagctgggcgacgtgcagggccacggcagagtggtgaccagcagagccgcccccccccccgtggacgaggagcccgagagcagcgaggtggacgccgccggcagatggcccggcgtgtgcgtgagcagaaccagccccaccccccccgagagcgccaccaccgtgaagagcctgatcaagagcttcgacctgggcagacccggcggcgccggccagaacatcagcgtgcacaagacccccagaagccccctgagcggcatccccgtgagaaccgcccccgccgccgccgtgagccccatgcagagacacagcacctacagcagcgtgagacccgccagcagaggcgtgacccagagactggacctgcccgacctgcccctgagcgacatcctgaagggcagaaccgagaccctgaagcccgacccccacctgagaaagagccccagcctggagagcctgagcagaccccccagcctgggcttcggcgacaccagactgctgagcgccagcaccagagcctggaagccccagagcaagctgagcgtggagagaaaggaccccctggccgccctggccagagagtacggcggcagcaagagaaacgccctgctgaagtggtgccagaagaagacccagggctacgccaagagaaacctgctgctggccttcgaggccgccgagagcgtgggcatcaagcccagcctggagctgagcgagatgctgtacaccgacagacccgactggcagagcgtgatgcagtacgtggcccagatctacaagtacttcgagacctag

SEQ ID NO: 100542 - DNA, 237 bp, Artificial Sequence
  Description of Artificial Sequence: Synthetic coding sequence
atgagaagcgccgccaagccctggaaccccgccatcagagccggcggccacggccccgacagagtgagacccctgcccgccgccagcagcggcatgaagagcagcaagagcagcaccagcctggccttcgagagcagactgagcagactgaagagagccagcagcgaggacaccctgaacaagcccggcagcaccgccgccagcggcgtggtgagactgaagaagaccgccacctag

SEQ ID NO: 100543 - DNA, 1227 bp, Artificial Sequence
  Description of Artificial Sequence: Synthetic coding sequence
atgaaggagaccatcttcgagctggaggaccaggtggagcagcacagagccgtgaagctgcacaacaaccagctgatcagcgagctggagagcagcgtgatcaagctggaggagcagaagagcgacctggagagacagctgaagaccctgaccaagcagatgaaggaggagaccgaggagtggagaagattccaggccgacctgcagaccgccgtggtggtggccaacgacatcaagtgcgaggcccagcaggagctgagaaccgtgaagagaaagctgctggaggaggaggagaagaacgccagactgcagaaggagctgggcgacgtgcagggccacggcagagtggtgaccagcagagccgcccccccccccgtggacgaggagcccgagagcagcgaggtggacgccgccggcagatggcccggcgtgtgcgtgagcagaaccagccccaccccccccgagagcgccaccaccgtgaagagcctgatcaagagcttcgacctgggcagacccggcggcgccggccagaacatcagcgtgcacaagacccccagaagccccctgagcggcatccccgtgagaaccgcccccgccgccgccgtgagccccatgcagagacacagcacctacagcagcgtgagacccgccagcagaggcgtgacccagagactggacctgcccgacctgcccctgagcgacatcctgaagggcagaaccgagaccctgaagcccgacccccacctgagaaagagccccagcctggagagcctgagcagaccccccagcctgggcttcggcgacaccagactgctgagcgccagcaccagagcctggaagccccagagcaagctgagcgtggagagaaaggaccccctggccgccctggccagagagtacggcggcagcaagagaaacgccctgctgaagtggtgccagaagaagacccagggctacgccaacatcgacatcaccaacttcagcagcagctggagcgacggcctggccttctgcgccctgctgcacacctacctgcccgcccacatcccctaccaggagctgaacagccaggagaagaagagaaacctgctgctggccttcgaggccgccgagagcgtgggcatcaagcccagcctggagctgagcgagatgctgtacaccgacagacccgactggcagagcgtgatgcagtacgtggcccagatctacaagtacttcgagacctag

SEQ ID NO: 100544 - DNA, 3354 bp, Artificial Sequence
  Description of Artificial Sequence: Synthetic coding sequence
atgaagaaggccagcagaagcgtgggcagcgtgcccaaggtgagcgccatcagcaagacccagaccgccgagaagatcaagcccgagaacagcagcagcgccagcaccggcggcaagctggtgaagcccggcaccgccgccagcctgagcaagaccaagagcagcgacgacctgctggccggcatggccggcggcgtgaccgtgaccaacggcgtgaagggcaagaagagcacctgccccagcgccgcccccagcgccagcgcccccgccatgaccaccgtggagaacaagagcaagatcagcaccggcaccgccagcagcaccaagagaagcaccagcaccggcaacaaggagagcagcagcaccagagagagactgagagagagaaccagactgaaccagagcaagaagctgcccagcgccggccagggcgccaacgacatggccctggccaagagaagcagaagcagaaccgccaccgagtgcgacgtgagaatgagcaagagcaagagcgacaaccagatcagcgacagagccgccctggaggccaaggtgaaggacctgctgaccctggccaagaccaaggacgtggagatcctgcacctgagaaacgagctgagagacatgagagcccagctgggcatcaacgaggaccacagcgagggcgacgagaagagcgagaaggagaccatcatggcccaccagcccaccgacgtggagagcaccctgctgcagctgcaggagcagaacaccgccatcagagaggagctgaaccagctgaagaacgagaacagaatgctgaaggacagactgaacgccctgggcttcagcctggagcagagactggacaacagcgagaagctgttcggctaccagagcctgagccccgagatcacccccgacaaccagagcgacggcggcggcaccctgaccagcagcgtggagggcagcgcccccggcagcgtggaggacctgctgagccaggacgagaacaccctgatggaccaccagcacagcaacagcatggacaacctggacagcgagtgcagcgaggtgtaccagcccctgaccagcagcgacgacgccctggacgcccccagcagcagcgagagcgagggcatccccagcatcgagagaagcagaaagggcagcagcggcaacgccagcgaggtgagcgtggcctgcctgaccgagagaatccaccagatggaggagaaccagcacagcaccagcgaggagctgcaggccaccctgcaggagctggccgacctgcagcagatcacccaggagctgaacagcgagaacgagagactgggcgaggagaaggtgatcctgatggagagcctgtgccagcagagcgacaagctggagcacttcagcagacagatcgagtacttcagaagcctgctggacgagcaccacatcagctacgtgatcgacgaggacgtgaagagcggcagatacatggagctggagcagagatacatggacctggccgagaacgccagattcgagagagagcagctgctgggcgtgcagcagcacctgagcaacaccctgaagatggccgagcaggacaacaaggaggcccaggagatgatcggcgccctgaaggagagaagccaccacatggagagaatcatcgagagcgagcagaagggcaaggccgccctggccgccaccctggaggagtacaaggccaccgtggccagcgaccagatcgagatgaacagactgaaggcccagctggagaacgagaagcagaaggtggccgagctgtacagcatccacaacagcggcgacaagagcgacatccaggacctgctggagagcgtgagactggacaaggagaaggccgagaccctggccagcagcctgcaggaggacctggcccacaccagaaacgacgccaacagactgcaggacgccatcgccaaggtggaggacgagtacagagccttccaggaggaggccaagaagcagatcgaggacctgaacatgaccctggagaagctgagaagcgacctggacgagaaggagaccgagagaagcgacatgaaggagaccatcttcgagctggaggacgaggtggagcagcacagagccgtgaagctgcacgacaacctgatcatcagcgacctggagaacaccgtgaagaagctgcaggaccagaagcacgacatggagagagagatcaagaccctgcacagaagactgagagaggagagcgccgagtggagacagttccaggccgacctgcagaccgccgtggtgatcgccaacgacatcaagagcgaggcccaggaggagatcggcgacctgaagagaagactgcacgaggcccaggagaagaacgagaagctgaccaaggagctggaggagatcaagagcagaaagcaggaggaggagagaggcagagtgtacaactacatgaacgccgtggagagagacctggccgccctgagacagggcatgggcctgagcagaagaagcagcaccagcagcgagcccacccccaccgtgaagaccctgatcaagagcttcgacagcgccagccaggtgcccaaccccgccgccgccgccatccccagaacccccctgagccccagccccatgaagaccccccccgccgccgccgtgagccccatgcagagacacagcatcagcggccccatcagcaccagcaagcccctgaccgccctgagcgacaagagacccaactacggcgagatccccgtgcaggagcacctgctgagaaccagcagcgccagcagacccgccagcctgcccagagtgcccgccatggagagcgccaagaccctgagcgtgagcagaagaagcagcgaggaggtgaagagagacatcagcgcccaggagggcgccagccccgccagcctgatggccatgggcaccaccagcccccagctgagcctgagcagcagccccaccgccagcgtgacccccaccaccagaagcagaatcagagaggagagaaaggaccccctgagcgccctggccagagagtacggcggcagcaagagaaacgccctgctgaagtggtgccagaagaagaccgagggctaccagaacatcgacatcaccaacttcagcagcagctggaacgacggcctggccttctgcgccctgctgcacacctacctgcccgcccacatcccctaccaggagctgaacagccaggacaagagaagaaacttcatgctggccttccaggccgccgagagcgtgggcatcaagagcaccctggacatcaacgagatggtgagaaccgagagacccgactggcagaacgtgatgctgtacgtgaccgccatctacaagtacttcgagacctag

SEQ ID NO: 100545 - DNA, 2820 bp, Artificial Sequence
  Description of Artificial Sequence: Synthetic coding sequence
gtgcccgaggccgtgagatggggctacttcatccccgagcagagccagttcgcctgcaagtgcatcaccaagagacagcccagaatgaagaaggccagcagaagcgtgggcagcgtgcccaaggtgagcgccatcagcaagacccagaccgccgagaagatcaagcccgagaacagcagcagcgccagcaccggcggcaagctggtgaagcccggcaccgccgccagcctgagcaagaccaagagcagcgacgacctgctggccggcatggccggcggcgtgaccgtgaccaacggcgtgaagggcaagaagagcacctgccccagcgccgcccccagcgccagcgcccccgccatgaccaccgtggagaacaagagcaagatcagcaccggcaccgccagcagcaccaagagaagcaccagcaccggcaacaaggagagcagcagcaccagagagagactgagagagagaaccagactgaaccagagcaagaagctgcccagcgccggccagggcgccaacgacatggccctggccaagagaagcagaagcagaaccgccaccgagtgcgacgtgagaatgagcaagagcaagagcgacaaccagatcagcgacagagccgccctggaggccaaggtgaaggacctgctgaccctggccaagaccaaggacgtggagatcctgcacctgagaaacgagctgagagacatgagagcccagctgggcatcaacgaggaccacagcgagggcgacgagaagagcgagaaggagaccatcatggcccaccagcccaccgacgtggagagcaccctgctgcagctgcaggagcagaacaccgccatcagagaggagctgaaccagctgaagaacgagaacagaatgctgaaggacagactgaacgccctgggcttcagcctggagcagagactggacaacagcgagaagctgttcggctaccagagcctgagccccgagatcacccccgacaaccagagcgacggcggcggcaccctgaccagcagcgtggagggcagcgcccccggcagcgtggaggacctgctgagccaggacgagaacaccctgatggaccaccagcacagcaacagcatggacaacctggacagcgagtgcagcgaggtgtaccagcccctgaccagcagcgacgacgccctggacgcccccagcagcagcgagagcgagggcatccccagcatcgagagaagcagaaagggcagcagcggcaacgccagcgaggtgagcgtggcctgcctgaccgagagaatccaccagatggaggagaaccagcacagcaccagcgaggagctgcaggccaccctgcaggagctggccgacctgcagcagatcacccaggagctgaacagcgagaacgagagactgggcgaggagaaggtgatcctgatggagagcctgtgccagcagagcgacaagctggagcacttcagcagacagatcgagtacttcagaagcctgctggacgagcaccacatcagctacgtgatcgacgaggacgtgaagagcggcagatacatggagctggagcagagatacatggacctggccgagaacgccagattcgagagagagcagctgctgggcgtgcagcagcacctgagcaacaccctgaagatggccgagcaggacaacaaggaggcccaggagatgatcggcgccctgaaggagagaagccaccacatggagagaatcatcgagagcgagcagaagggcaaggccgccctggccgccaccctggaggagtacaaggccaccgtggccagcgaccagatcgagatgaacagactgaaggcccagctggagaacgagaagcagaaggtggccgagctgtacagcatccacaacagcggcgacaagagcgacatccaggacctgctggagagcgtgagactggacaaggagaaggccgagaccctggccagcagcctgcaggaggacctggcccacaccagaaacgacgccaacagactgcaggacgccatcgccaaggtggaggacgagtacagagccttccaggaggaggccaagaagcagatcgaggacctgaacatgaccctggagaagctgagaagcgacctggacgagaaggagaccgagagaagcgacatgaaggagaccatcttcgagctggaggacgaggtggagcagcacagagccgtgaagctgcacgacaacctgatcatcagcgacctggagaacaccgtgaagaagctgcaggaccagaagcacgacatggagagagagatcaagaccctgcacagaagactgagagaggagagcgccgagtggagacagttccaggccgacctgcagaccgccgtggtgatcgccaacgacatcaagagcgaggcccaggaggagatcggcgacctgaagagaagactgcacgaggcccaggagaagaacgagaagctgaccaaggagctggaggagatcaagagcagaaagcaggaggaggagagaggcagagtgtacaactacatgaacgccgtggagagagacctggccgccctgagacagggcatgggcctgagcagaagaagcagcaccagcagcgagcccacccccaccgtgaagaccctgatcaagagcttcgacagcgccagccaggtgcccaaccccgccgccgccgccatccccagaacccccctgagccccagccccatgaagaccccccccgccgccgccgtgagccccatgcagatggagagcagcagcgtggcccacgccggcatgcagtggagagacctgggcagcctgcagcccctgccccccggcttcaagtag

SEQ ID NO: 100546 - DNA, 2370 bp, Artificial Sequence
  Description of Artificial Sequence: Synthetic coding sequence
atgaagaaggccagcagaagcgtgggcagcgtgcccaaggtgagcgccatcagcaagacccagaccgccgagaagatcaagcccgagaacagcagcagcgccagcaccggcggcaagctggtgaagcccggcaccgccgccagcctgagcaagaccaagagcagcgacgacctgctggccggcatggccggcggcgtgaccgtgaccaacggcgtgaagggcaagaagagcacctgccccagcgccgcccccagcgccagcgcccccgccatgaccaccgtggagaacaagagcaagatcagcaccggcaccgccagcagcaccaagagaagcaccagcaccggcaacaaggagagcagcagcaccagagagagactgagagagagaaccagactgaaccagagcaagaagctgcccagcgccggccagggcgccaacgacatggccctggccaagagaagcagaagcagaaccgccaccgagtgcgacgtgagaatgagcaagagcaagagcgacaaccagatcagcgacagagccgccctggaggccaaggtgaaggacctgctgaccctggccaagaccaaggacgtggagatcctgcacctgagaaacgagctgagagacatgagagcccagctgggcatcaacgaggaccacagcgagggcgacgagaagagcgagaaggagaccatcatggcccaccagcccaccgacgtggagagcaccctgctgcagctgcaggagcagaacaccgccatcagagaggagctgaaccagctgaagaacgagaacagaatgctgaaggacagactgaacgccctgggcttcagcctggagcagagactggacaacagcgagaagctgttcggctaccagagcctgagccccgagatcacccccgacaaccagagcgacggcggcggcaccctgaccagcagcgtggagggcagcgcccccggcagcgtggaggacctgctgagccaggacgagaacaccctgatggaccaccagcacagcaacagcatggacaacctggacagcgagtgcagcgaggtgtaccagcccctgaccagcagcgacgacgccctggacgcccccagcagcagcgagagcgagggcatccccagcatcgagagaagcagaaagggcagcagcggcaacgccagcgaggtgagcgtggcctgcctgaccgagagaatccaccagatggaggagaaccagcacagcaccagcgaggagctgcaggccaccctgcaggagctggccgacctgcagcagatcacccaggagctgaacagcgagaacgagagactgggcgaggagaaggtgatcctgatggagagcctgtgccagcagagcgacaagctggagcacttcagcagacagatcgagtacttcagaagcctgctggacgagcaccacatcagctacgtgatcgacgaggacgtgaagagcggcagatacatggagctggagcagagatacatggacctggccgagaacgccagattcgagagagagcagctgctgggcgtgcagcagcacctgagcaacaccctgaagatggccgagcaggacaacaaggaggcccaggagatgatcggcgccctgaaggagagaagccaccacatggagagaatcatcgagagcgagcagaagggcaaggccgccctggccgccaccctggaggagtacaaggccaccgtggccagcgaccagatcgagatgaacagactgaaggcccagctggagaacgagaagcagaaggtggccgagctgtacagcatccacaacagcggcgacaagagcgacatccaggacctgctggagagcgtgagactggacaaggagaaggccgagaccctggccagcagcctgcaggaggacctggcccacaccagaaacgacgccaacagactgcaggacgccatcgccaaggtggaggacgagtacagagccttccaggaggaggccaagaagcagatcgaggacctgaacatgaccctggagaagctgagaagcgacctggacgagaaggagaccgagagaagcgacatgaaggagaccatcttcgagctggaggacgaggtggagcagcacagagccgtgaagctgcacgacaacctgatcatcagcgacctggagaacaccgtgaagaagctgcaggaccagaagcacgacatggagagagagatcaagaccctgcacagaagactgagagaggagagcgccgagtggagacagttccaggccgacctgcagaccgccgtggtgatcgccaacgacatcaagagcgaggcccaggaggagatcggcgacctgaagagaagactgcacgaggcccaggagaagaacgagaagctgacctag

SEQ ID NO: 100547 - DNA, 3354 bp, Artificial Sequence; identical to SEQ ID NO: 100544
  Description of Artificial Sequence: Synthetic coding sequence

SEQ ID NO: 100548 - DNA, 3237 bp, Artificial Sequence
  Description of Artificial Sequence: Synthetic coding sequence
atgaagaaggccagcagaagcgtgggcagcgtgcccaaggtgagcgccatcagcaagacccagaccgccgagaagatcaagcccgagaacagcagcagcgccagcaccggcggcaagctggtgaagcccggcaccgccgccagcctgagcaagaccaagagcagcgacgacctgctggccggcatggccggcggcgtgaccgtgaccaacggcgtgaagggcaagaagagcacctgccccagcgccgcccccagcgccagcgcccccgccatgaccaccgtggagaacaagagcaagatcagcaccggcaccgccagcagcaccaagagaagcaccagcaccggcaacaaggagagcagcagcaccagagagagactgagagagagaaccagactgaaccagagcaagaagctgcccagcgccggccagggcgccaacgacatggccctggccaagagaagcagaagcagaaccgccaccgagtgcgacgtgagaatgagcaagagcaagagcgacaaccagatcagcgacagagccgccctggaggccaaggtgaaggacctgctgaccctggccaagaccaaggacgtggagatcctgcacctgagaaacgagctgagagacatgagagcccagctgggcatcaacgaggaccacagcgagggcgacgagaagagcgagaaggagaccatcatggcccaccagcccaccgacgtggagagcaccctgctgcagctgcaggagcagaacaccgccatcagagaggagctgaaccagctgaagaacgagaacagaatgctgaaggacagactgaacgccctgggcttcagcctggagcagagactggacaacagcgagaagctgttcggctaccagagcctgagccccgagatcacccccgacaaccagagcgacggcggcggcaccctgaccagcagcgtggagggcagcgcccccggcagcgtggaggacctgctgagccaggacgagaacaccctgatggaccaccagcacagcaacagcatggacaacctggacagcgagtgcagcgaggtgtaccagcccctgaccagcagcgacgacgccctggacgcccccagcagcagcgagagcgagggcatccccagcatcgagagaagcagaaagggcagcagcggcaacgccagcgaggtgagcgtggcctgcctgaccgagagaatccaccagatggaggagaaccagcacagcaccagcgaggagctgcaggccaccctgcaggagctggccgacctgcagcagatcacccaggagctgaacagcgagaacgagagactgggcgaggagaaggtgatcctgatggagagcctgtgccagcagagcgacaagctggagcacttcagcagacagatcgagtacttcagaagcctgctggacgagcaccacatcagctacgtgatcgacgaggacgtgaagagcggcagatacatggagctggagcagagatacatggacctggccgagaacgccagattcgagagagagcagctgctgggcgtgcagcagcacctgagcaacaccctgaagatggccgagcaggacaacaaggaggcccaggagatgatcggcgccctgaaggagagaagccaccacatggagagaatcatcgagagcgagcagaagggcaaggccgccctggccgccaccctggaggagtacaaggccaccgtggccagcgaccagatcgagatgaacagactgaaggcccagctggagaacgagaagcagaaggtggccgagctgtacagcatccacaacagcggcgacaagagcgacatccaggacctgctggagagcgtgagactggacaaggagaaggccgagaccctggccagcagcctgcaggaggacctggcccacaccagaaacgacgccaacagactgcaggacgccatcgccaaggtggaggacgagtacagagccttccaggaggaggccaagaagcagatcgaggacctgaacatgaccctggagaagctgagaagcgacctggacgagaaggagaccgagagaagcgacatgaaggagaccatcttcgagctggaggacgaggtggagcagcacagagccgtgaagctgcacgacaacctgatcatcagcgacctggagaacaccgtgaagaagctgcaggaccagaagcacgacatggagagagagatcaagaccctgcacagaagactgagagaggagagcgccgagtggagacagttccaggccgacctgcagaccgccgtggtgatcgccaacgacatcaagagcgaggcccaggaggagatcggcgacctgaagagaagactgcacgaggcccaggagaagaacgagaagctgaccaaggagctggaggagatcaagagcagaaagcaggaggaggagagaggcagagtgtacaactacatgaacgccgtggagagagacctggccgccctgagacagggcatgggcctgagcagaagaagcagcaccagcagcgagcccacccccaccgtgaagaccctgatcaagagcttcgacagcgccagccaggtgcccaaccccgccgccgccgccatccccagaacccccctgagccccagccccatgaagaccccccccgccgccgccgtgagccccatgcagagacacagcatcagcggccccatcagcaccagcaagcccctgaccgccctgagcgacaagagacccaactacggcgagatccccgtgcaggagcacctgctgagaaccagcagcgccagcagacccgccagcctgcccagagtgcccgccatggagagcgccaagaccctgagcgtgagcagaagaagcagcgaggaggtgaagagagacatcagcgcccaggagggcgccagccccgccagcctgatggccatgggcaccaccagcccccagctgagcctgagcagcagccccaccgccagcgtgacccccaccaccagaagcagaatcagagaggagagaaaggaccccctgagcgccctggccagagagtacggcggcagcaagagaaacgccctgctgaagtggtgccagaagaagaccgagggctaccagagaagaaacttcatgctggccttccaggccgccgagagcgtgggcatcaagagcaccctggacatcaacgagatggtgagaaccgagagacccgactggcagaacgtgatgctgtacgtgaccgccatctacaagtacttcgagacctag

SEQ ID NO: 100549 - DNA, 2781 bp, Artificial Sequence
  Description of Artificial Sequence: Synthetic coding sequence
atgaccaccaaggactaccccagcctgtggggcttcggcaccaccaagaccttcaagatccccatcgagcacctggacttcaagtacatcgagaagtgcagcgacgtgaagcacctggagaagatcctgtgcgtgctgagaagcggcgaggagggctactaccccgagctgaccgagttctgcgagaagcacctgcaggccctggcccccgagagcagagccctgagaaaggacaagcccgccgccaccgccgccagcttcaccgccgaggagtgggagaagatcgacggcgacatcaagagctgggtgagcgagatcaagaaggaggaggacaagatgcacttccacgagaccgagaccttccccgccatgaaggacaacctgccccccgtgagaggcagcaacagctgcctgcacgtgggcaaggagaagtacagcaagagacccaccaagaagaagacccccagagactacgccgagtgggacaagttcgacgtggagaaggagtgcctgaagatcgacgaggactacaaggagaagaccgtgatcgacaagagccacctgagcaagatcgagaccagaatcgacaccgccggcctgaccgagaaggagaaggacttcctggccaccagagagaaggagaagggcaacgaggccttcaacagcggcgactacgaggaggccgtgatgtactacaccagaagcatcagcgccctgcccaccgtggtggcctacaacaacagagcccaggccgagatcaagctgcagaactggaacagcgccttccaggactgcgagaaggtgctggagctggagcccggcaacgtgaaggccctgctgagaagagccaccacctacaagcaccagaacaagctgagagaggccaccgaggacctgagcaaggtgctggacgtggagcccgacaacgacctggccaagaagaccctgagcgaggtggagagagacctgaagaacagcgaggccgccagcgagacccagaccaagggcaagagaatggtgatccaggagatcgagaacagcgaggacgaggagggcaagagcggcagaaagcacgaggacggcggcggcgacaagaagcccgccgagcccgccggcgccgccagagccgcccagccctgcgtgatgggcaacatccagaagaagctgaccggcaaggccgagggcggcaagagacccgccagaggcgccccccagagaggccagacccccgaggccggcgccgacaagagaagccccagaagagccagcgccgccgccgccgccggcggcggcgccaccggccaccccggcggcggccagggcgccgagaaccccgccggcctgaagagccagggcaacgagctgttcagaagcggccagttcgccgaggccgccggcaagtacagcgccgccatcgccctgctggagcccgccggcagcgagatcgccgacgacctgagcatcctgtacagcaacagagccgcctgctacctgaaggagggcaactgcagcggctgcatccaggactgcaacagagccctggagctgcaccccttcagcatgaagcccctgctgagaagagccatggcctacgagaccctggagcagtacggcaaggcctacgtggactacaagaccgtgctgcagatcgactgcggcctgcagctggccaacgacagcgtgaacagactgagcagaatcctgatggagctggacggccccaactggagagagaagctgagccccatccccgccgtgcccgccagcgtgcccctgcaggcctggcaccccgccaaggagatgatcagcaagcaggccggcgacagcagcagccacagacagcagggcatcaccgacgagaagaccttcaaggccctgaaggaggagggcaaccagtgcgtgaacgacaagaactacaaggacgccctgagcaagtacagcgagtgcctgaagatcaacaacaaggagtgcgccatctacaccaacagagccctgtgctacctgaagctgtgccagttcgaggaggccaagcaggactgcgaccaggccctgcagctggccgacggcaacgtgaaggccttctacagaagagccctggcccacaagggcctgaagaactaccagaagagcctgatcgacctgaacaaggtgatcctgctggaccccagcatcatcgaggccaagatggagctggaggaggtgaccagactgctgaacctgaaggacaagaccgcccccttcaacaaggagaaggagagaagaaagatcgagatccaggaggtgaacgagggcaaggaggagcccggcagacccgccggcgaggtgagcatgggctgcctggccagcgagaagggcggcaagagcagcagaagccccgaggaccccgagaagctgcccatcgccaagcccaacaacgcctacgagttcggccagatcatcaacgccctgagcaccagaaaggacaaggaggcctgcgcccacctgctggccatcaccgcccccaaggacctgcccatgttcctgagcaacaagctggagggcgacaccttcctgctgctgatccagagcctgaagaacaacctgatcgagaaggaccccagcctggtgtaccagcacctgctgtacctgagcaaggccgagagattcaagatgatgctgaccctgatcagcaagggccagaaggagctgatcgagcagctgttcgaggacctgagcgacacccccaacaaccacttcaccctggaggacatccaggccctgaagagacagtacgagctgtag

SEQ ID NO: 100550 - DNA, 2781 bp, Artificial Sequence; identical to SEQ ID NO: 100549
  Description of Artificial Sequence: Synthetic coding sequence

SEQ ID NO: 100551 - DNA, 1044 bp, Artificial Sequence
  Description of Artificial Sequence: Synthetic coding sequence
atggccgcccagagaggcatgcccagcagcgccgtgagagtgctggaggaggccctgggcatgggcctgaccgccgccggcgacgccagagacaccgccgacgccgtggccgccgagggcgcctactacctggagcaggtgaccatcaccgaggccagcgaggacgactacgagtacgaggagatccccgacgacaacttcagcatccccgagggcgaggaggacctggccaaggccatccagatggcccaggagcaggccaccgacaccgagatcctggagagaaagaccgtgctgcccagcaagcacgccgtgcccgaggtgatcgaggacttcctgtgcaacttcctgatcaagatgggcatgaccagaaccctggactgcttccagagcgagtggtacgagctgatccagaagggcgtgaccgagctgagaaccgtgggcaacgtgcccgacgtgtacacccagatcatgctgctggagaacgagaacaagaacctgaagaaggacctgaagcactacaagcaggccgccgacaaggccagagaggacctgctgaagatccagaaggagagagacttccacagaatgcaccacaagagaatcgtgcaggagaagaacaagctgatcaacgacctgaagggcctgaagctgcactacgccagctacgagcccaccatcagagtgctgcacgagaagcaccacaccctgctgaaggagaagatgctgaccagcctggagagagacaaggtggtgggccagatcagcggcctgcaggagaccctgaagaagctgcagagaggccacagctaccacggcccccagatcaaggtggaccacagcagagagaaggagaacgcccccgagggccccacccagaagggcctgagagaggccagagagcagaacaagtgcaagaccaagatgaagggcaacaccaagcagtggaccggcaacagccagacctggaacaagaccgtgcccctgcaggacaccatcggcagaagacaggagaacaacagcgcccaccagcacatcgactag

SEQ ID NO: 100552 - DNA, 1896 bp, Artificial Sequence
  Description of Artificial Sequence: Synthetic coding sequence
atggccgcccagagaggcatgcccagcagcgccgtgagagtgctggaggaggccctgggcatgggcctgaccgccgccggcgacgccagagacaccgccgacgccgtggccgccgagggcgcctactacctggagcaggtgaccatcaccgaggccagcgaggacgactacgagtacgaggagatccccgacgacaacttcagcatccccgagggcgaggaggacctggccaaggccatccagatggcccaggagcaggccaccgacaccgagatcctggagagaaagaccgtgctgcccagcaagcacgccgtgcccgaggtgatcgaggacttcctgtgcaacttcctgatcaagatgggcatgaccagaaccctggactgcttccagagcgagtggtacgagctgatccagaagggcgtgaccgagctgagaaccgtgggcaacgtgcccgacgtgtacacccagatcatgctgctggagaacgagaacaagaacctgaagaaggacctgaagcactacaagcaggccgccgacaaggccagagaggacctgctgaagatccagaaggagagagacttccacagaatgcaccacaagagaatcgtgcaggagaagaacaagctgatcaacgacctgaagggcctgaagctgcactacgccagctacgagcccaccatcagagtgctgcacgagaagcaccacaccctgctgaaggagaagatgctgaccagcctggagagagacaaggtggtgggccagatcagcggcctgcaggagaccctgaagaagctgcagagaggccacagctaccacggcccccagatcaaggtggaccacagcagagagaaggagaacgcccccgagggccccacccagaagggcctgagagaggccagagagcagaacaagtgcaagaccaagatgaagggcaacaccaaggacagcgagttccccatcgacatgcagcccaaccccaacctgaacgtgagcaaggagagcctgagccccgccaagttcgactacaagctgaagaacatcttcagactgcacgagctgcccgtgagctgcgtgagcatgcagccccacaaggacatcctggtgagctgcggcgaggacagactgtggaaggtgctgggcctgcccaagtgcaacgtgctgctgaccggcttcggccacaccgactggctgagcgactgctgcttccaccccagcggcgacaagctggccaccagcagcggcgacaccaccgtgaagctgtgggacctgtgcaagggcgactgcatcctgaccttcgagggccacagcagagccgtgtggagctgcacctggcacagctgcggcaacttcgtggccagcagcagcctggacaagaccagcaagatctgggacgtgaacagcgagagatgcagatgcaccctgtacggccacaccgacagcgtgaacagcatcgagttcttccccttcagcaacaccctgctgaccagcagcgccgacaagaccctgagcatctgggacgccagaaccggcatctgcgagcagagcctgtacggccacatgcacagcatcaacgacgccatcttcgaccccagaggccacatgatcgccagctgcgacgcctgcggcgtgaccaagctgtgggacttcagaaagctgctgcccatcgtgagcatcgacatcggccccagccccggcaacgaggtgaacttcgacagcagcggcagagtgctggcccaggccagcggcaacggcgtgatccacctgctggacctgaagagcggcgagatccacaagctgatgggccacgagaacgaggcccacaccgtggtgttcagccacgacggcgagatcctgttcagcggcggcagcgacggcaccgtgagaacctggagctag

SEQ ID NO: 100553 - DNA, 1614 bp, Artificial Sequence
  Description of Artificial Sequence: Synthetic coding sequence
atgaccatgaacatgaagagataccagatgaccatcctggccagccagaaggtgaagaagatctggcagaagcagttcagatggcccaagaacagactgcagatcctgaagttctggtacgagctgatccagaagggcgtgaccgagctgagaaccgtgggcaacgtgcccgacgtgtacacccagatcatgctgctggagaacgagaacaagaacctgaagaaggacctgaagcactacaagcaggccgccgacaaggccagagaggacctgctgaagatccagaaggagagagacttccacagaatgcaccacaagagaatcgtgcaggagaagaacaagctgatcaacgacctgaagggcctgaagctgcactacgccagctacgagcccaccatcagagtgctgcacgagaagcaccacaccctgctgaaggagaagatgctgaccagcctggagagagacaaggtggtgggccagatcagcggcctgcaggagaccctgaagaagctgcagagaggccacagctaccacggcccccagatcaaggtggaccacagcagagagaaggagaacgcccccgagggccccacccagaagggcctgagagaggccagagagcagaacaagtgcaagaccaagatgaagggcaacaccaaggacagcgagttccccatcgacatgcagcccaaccccaacctgaacgtgagcaaggagagcctgagccccgccaagttcgactacaagctgaagaacatcttcagactgcacgagctgcccgtgagctgcgtgagcatgcagccccacaaggacatcctggtgagctgcggcgaggacagactgtggaaggtgctgggcctgcccaagtgcaacgtgctgctgaccggcttcggccacaccgactggctgagcgactgctgcttccaccccagcggcgacaagctggccaccagcagcggcgacaccaccgtgaagctgtgggacctgtgcaagggcgactgcatcctgaccttcgagggccacagcagagccgtgtggagctgcacctggcacagctgcggcaacttcgtggccagcagcagcctggacaagaccagcaagatctgggacgtgaacagcgagagatgcagatgcaccctgtacggccacaccgacagcgtgaacagcatcgagttcttccccttcagcaacaccctgctgaccagcagcgccgacaagaccctgagcatctgggacgccagaaccggcatctgcgagcagagcctgtacggccacatgcacagcatcaacgacgccatcttcgaccccagaggccacatgatcgccagctgcgacgcctgcggcgtgaccaagctgtgggacttcagaaagctgctgcccatcgtgagcatcgacatcggccccagccccggcaacgaggtgaacttcgacagcagcggcagagtgctggcccaggccagcggcaacggcgtgatccacctgctggacctgaagagcggcgagatccacaagctgatgggccacgagaacgaggcccacaccgtggtgttcagccacgacggcgagatcctgttcagcggcggcagcgacggcaccgtgagaacctggagctag

SEQ ID NO: 100554 - DNA, 756 bp, Artificial Sequence
  Description of Artificial Sequence: Synthetic coding sequence
atgggcgtgggcaccaaggccagagccagccactggagaagactgctgagcctgggcgccacccccgaggagcccctgctggacttcaagatccccgacgacaacttcagcatccccgagggcgaggaggacctggccaaggccatccagatggcccaggagcaggccaccgacaccgagatcctggagagaaagaccgtgctgcccagcaagcacgccgtgcccgaggtgatcgaggacttcctgtgcaacttcctgatcaagatgggcatgaccagaaccctggactgcttccagagcgagtggtacgagctgatccagaagggcgtgaccgagctgagaaccgtgggcaacgtgcccgacgtgtacacccagatcatgctgctggagaacgagaacaagaacctgaagaaggacctgaagcactacaagcaggccgccgacaaggccagagaggacctgctgaagatccagaaggagagagacttccacagaatgcaccacaagagaatcgtgcaggagaagaacaagctgatcaacgacctgaagggcctgaagctgcactacgccagctacgagcccaccatcagagtgctgcacgagaagcaccacaccctgctgaaggagaagatgctgaccagcctggagagagacaaggtggtgggccagatcagcggcctgcaggagaccctgaagaagctgcagagaggccacagctaccacggcccccagatcaagggcaagtgcaagatgtag

SEQ ID NO: 100555 - DNA, 552 bp, Artificial Sequence
  Description of Artificial Sequence: Synthetic coding sequence
atggccgcccagagaggcatgcccagcagcgccgtgagagtgctggaggaggccctgggcatgggcctgaccgccgccggcgacgccagagacaccgccgacgccgtggccgccgagggcgcctactacctggagcaggtgaccatcaccgaggccagcgaggacgactacgagtacgaggagatccccgacgacaacttcagcatccccgagggcgaggaggacctggccaaggccatccagatggcccaggagcaggccaccgacaccgagatcctggagagaaagaccgtgctgcccagcaagcacgccgtgcccgaggtgatcgaggacttcctgtgcaacttcctgatcaagatgggcatgaccagaaccctggactgcttccagagcgagtggtacgagctgatccagaagggcgtgaccgagctgagaaccgtgggcaacgtgcccgacgtgtacacccagatcatgctgctggagaacgagaacaagaacctgaagaaggacctgaagcactacaagcaggccgccgagtacgtgatcttctag

SEQ ID NO: 100556 - DNA, 768 bp, Artificial Sequence
  Description of Artificial Sequence: Synthetic coding sequence
gacagcgagttccccatcgacatgcagcccaaccccaacctgaacgtgagcaaggagagcctgagccccgccaagttcgactacaagctgaagaacatcttcagactgcacgagctgcccgtgagctgcgtgagcatgcagccccacaaggacatcctggtgagctgcggcgaggacagactgtggaaggtgctgggcctgcccaagtgcaacgtgctgctgaccggcttcggccacaccgactggctgagcgactgctgcttccaccccagcgagagatgcagatgcaccctgtacggccacaccgacagcgtgaacagcatcgagttcttccccttcagcaacaccctgctgaccagcagcgccgacaagaccctgagcatctgggacgccagaaccggcatctgcgagcagagcctgtacggccacatgcacagcatcaacgacgccatcttcgaccccagaggccacatgatcgccagctgcgacgcctgcggcgtgaccaagctgtgggacttcagaaagctgctgcccatcgtgagcatcgacatcggccccagccccggcaacgaggtgaacttcgacagcagcggcagagtgctggcccaggccagcggcaacggcgtgatccacctgctggacctgaagagcggcgagatccacaagctgatgggccacgagaacgaggcccacaccgtggtgttcagccacgacggcgagatcctgttcagcggcggcagcgacggcaccgtgagaacctggagctag

SEQ ID NO: 100557 - DNA, 1314 bp, Artificial Sequence
  Description of Artificial Sequence: Synthetic coding sequence
atgagaagaagcagcagacccggcagcgccagcagcagcagaaagcacacccccaacttcttcagcgagaacagcagcatgagcatcaccagcgaggacagcaagggcctgagaagcgccgagcccggccccggcgagcccgagggcagaagagccagaggccccagctgcggcgagcccgccctgagcgccggcgtgcccggcggcaccacctgggccggcagcagccagcagaagcccgcccccagaagccacaactggcagaccgcctgcggcgccgccaccgtgagaggcggcgccagcgagcccaccggcagccccgtggtgagcgaggagcccctggacctgctgcccaccctggacctgagacaggagatgcccccccccagagtgttcaagagcttcctgagcctgctgttccagggcctgagcgtgctgctgagcctggccggcgacgtgctggtgagcatgtacagagaggtgtgcagcatcagattcctgttcaccgccgtgagcctgctgagcctgttcctgagcgccttctggctgggcctgctgtacctggtgagccccctggagaacgagcccaaggagatgctgaccctgagcgagtaccacgagagagtgagaagccagggccagcagctgcagcagctgcaggccgagctggacaagctgcacaaggaggtgagcaccgtgagagccgccaacagcgagagagtggccaagctggtgttccagagactgaacgaggacttcgtgagaaagcccgactacgccctgagcagcgtgggcgccagcatcgacctgcagaagaccagccacgactacgccgacagaaacaccgcctacttctggaacagattcagcttctggaactacgccagaccccccaccgtgatcctggagccccacgtgttccccggcaactgctgggccttcgagggcgaccagggccaggtggtgatccagctgcccggcagagtgcagctgagcgacatcaccctgcagcaccccccccccagcgtggagcacaccggcggcgccaacagcgcccccagagacttcgccgtgttcggcctgcaggtgtacgacgagaccgaggtgagcctgggcaagttcaccttcgacgtggagaagagcgagatccagaccttccacctgcagaacgacccccccgccgccttccccaaggtgaagatccagatcctgagcaactggggccaccccagattcacctgcctgtacagagtgagagcccacggcgtgagaaccagcgagggcgccgagggcagcgcccagggcccccactag

SEQ ID NO: 100558 - DNA, 1377 bp, Artificial Sequence
  Description of Artificial Sequence: Synthetic coding sequence
atgagccagagacaggtgctgcaggtgttcgagcagtaccagaaggccagaacccagttcgtgcagatggtggccgagctggccaccagaccccagaacatcgagaccctgcagaacgccggcgtgatgagcctgctgagaaccctgctgctggacgtggtgcccaccatccagcagaccgccgccctggccctgggcagactggccaactacaacgacgacctggccgaggccgtggtgaagtgcgacatcctgccccagctggtgtacagcctggccgagcagaacagattctacaagaaggccgccgccttcgtgctgagagccgtgggcaagcacagcccccagctggcccaggccatcgtggactgcggcgccctggacaccctggtgatctgcctggaggacttcgaccccggcgtgaaggaggccgccgcctgggccctgagatacatcgccagacacaacgccgagctgagccaggccgtggtggacgccggcgccgtgcccctgctggtgctgtgcatccaggagcccgagatcgccctgaagagaatcgccgccagcgccctgagcgacatcgccaagcacagccccgagctggcccagaccgtggtggacgccggcgccgtggcccacctggcccagatgatcctgaaccccgacgccaagctgaagcaccagatcctgagcgccctgagccaggtgagcaagcacagcgtggacctggccgagatggtggtggaggccgagatcttccccgtggtgctgacctgcctgaaggacaaggacgagtacgtgaagaagaacgccagcaccctgatcagagagatcgccaagcacacccccgagctgagccagctggtggtgaacgccggcggcgtggccgccgtgatcgactgcatcggcagctgcaagggcaacaccagactgcccggcatcatgatgctgggctacgtggccgcccacagcgagaacctggccatggccgtgatcatcagcaagggcgtgccccagctgagcgtgtgcctgagcgaggagcccgaggaccacatcaaggccgccgccgcctgggccctgggccagatcggcagacacacccccgagcacgccagagccgtggccgtgaccaacaccctgcccgtgctgctgagcctgtacatgagcaccgagagcagcgaggacctgcaggtgaagagcaagaaggccatcaagaacatcctgcagaagtgcacctacctgcccgccctggagcccttcctgtacgacgccccccccaacatcctgaagcacgtggtgggccagttcagcaaggtgctgttcccctggatcttcagatacaccagcgccgagggcggccagctgagcaccacctag

SEQ ID NO: 100559 - DNA, 813 bp, Artificial Sequence
  Description of Artificial Sequence: Synthetic coding sequence
atgagccagagacaggtgctgcaggtgttcgagcagtaccagaaggccagaacccagttcgtgcagatggtggccgagctggccaccagaccccagaacatcgagaccctgcagaacgccggcgtgatgagcctgctgagaaccctgctgctggacgtggtgcccaccatccagcagaccgccgccctggccctgggcagactggccaactacaacgacgacctggccgaggccgtggtgaagtgcgacatcctgccccagctggtgtacagcctggccgagcagaacggcgtgccccagctgagcgtgtgcctgagcgaggagcccgaggaccacatcaaggccgccgccgcctgggccctgggccagatcggcagacacacccccgagcacgccagagccgtggccgtgaccaacaccctgcccgtgctgctgagcctgtacatgagcaccgagagcagcgaggacctgcaggtgaagagcaagaaggccatcaagaacatcctgcagaagtgcacctacctgcccgccctggagcccttcctgtacgacgccccccccaacatcctgaagcacgtggtgggccagttcagcaaggtgctgccccacgacagcaaggccagaagactgttcgtgaccagcggcggcctgaagaaggtgcaggagatcaaggccgagcccggcagcctgctgcaggagtacatcaacagcatcaacagctgctaccccgaggagatcgtgagatactacagccccggctacagcgacaccctgctgcagagagtggacagctaccagcccctgaacaactag

SEQ ID NO: 100560 - DNA, 1758 bp, Artificial Sequence
  Description of Artificial Sequence: Synthetic coding sequence
atgagccagagacaggtgctgcaggtgttcgagcagtaccagaaggccagaacccagttcgtgcagatggtggccgagctggccaccagaccccagaacatcgagaccctgcagaacgccggcgagcccggcgccagaacccccgtggcccccagagccctgagccccagaagactgagacccgccgccctgcccgtggagctgctgggcagcagaagcgtgggcaccggcgtgagaaagagcatccacagcttccagagagtgttcggcggccaggccgagagagtgaagctgcccgacggctgcggcagatgcgccctgagcctgttccccagcagcctgcacaccggcgtgatgagcctgctgagaaccctgctgctggacgtggtgcccaccatccagcagaccgccgccctggccctgggcagactggccaactacaacgacgacctggccgaggccgtggtgaagtgcgacatcctgccccagctggtgtacagcctggccgagcagaacagattctacaagaaggccgccgccttcgtgctgagagccgtgggcaagcacagcccccagctggcccaggccatcgtggactgcggcgccctggacaccctggtgatctgcctggaggacttcgaccccggcgtgaaggaggccgccgcctgggccctgagatacatcgccagacacaacgccgagctgagccaggccgtggtggacgccggcgccgtgcccctgctggtgctgtgcatccaggagcccgagatcgccctgaagagaatcgccgccagcgccctgagcgacatcgccaagcacagccccgagctggcccagaccgtggtggacgccggcgccgtggcccacctggcccagatgatcctgaaccccgacgccaagctgaagcaccagatcctgagcgccctgagccaggtgagcaagcacagcgtggacctggccgagatggtggtggaggccgagatcttccccgtggtgctgacctgcctgaaggacaaggacgagtacgtgaagaagaacgccagcaccctgatcagagagatcgccaagcacacccccgagctgagccagctggtggtgaacgccggcggcgtggccgccgtgatcgactgcatcggcagctgcaagggcaacaccagactgcccggcatcatgatgctgggctacgtggccgcccacagcgagaacctggccatggccgtgatcatcagcaagggcgtgccccagctgagcgtgtgcctgagcgaggagcccgaggaccacatcaaggccgccgccgcctgggccctgggccagatcggcagacacacccccgagcacgccagagccgtggccgtgaccaacaccctgcccgtgctgctgagcctgtacatgagcaccgagagcagcgaggacctgcaggtgaagagcaagaaggccatcaagaacatcctgcagaagtgcacctacctgcccgccctggagcccttcctgtacgacgccccccccaacatcctgaagcacgtggtgggccagttcagcaaggtgctgccccacgacagcaaggccagaagactgttcgtgaccagcggcggcctgaagaaggtgcaggagatcaaggccgagcccggcagcctgctgcaggagtacatcaacagcatcaacagctgctaccccgaggagatcgtgagatactacagccccggctacagcgacaccctgctgcagagagtggacagctaccagcccctgaacaactag

SEQ ID NO: 100561 - DNA, 1530 bp, Artificial Sequence
  Description of Artificial Sequence: Synthetic coding sequence
atgagccagagacaggtgctgcaggtgttcgagcagtaccagaaggccagaacccagttcgtgcagatggtggccgagctggccaccagaccccagaacatcgagaccctgcagaacgccggcgtgatgagcctgctgagaaccctgctgctggacgtggtgcccaccatccagcagaccgccgccctggccctgggcagactggccaactacaacgacgacctggccgaggccgtggtgaagtgcgacatcctgccccagctggtgtacagcctggccgagcagaacagattctacaagaaggccgccgccttcgtgctgagagccgtgggcaagcacagcccccagctggcccaggccatcgtggactgcggcgccctggacaccctggtgatctgcctggaggacttcgaccccggcgtgaaggaggccgccgcctgggccctgagatacatcgccagacacaacgccgagctgagccaggccgtggtggacgccggcgccgtgcccctgctggtgctgtgcatccaggagcccgagatcgccctgaagagaatcgccgccagcgccctgagcgacatcgccaagcacagccccgagctggcccagaccgtggtggacgccggcgccgtggcccacctggcccagatgatcctgaaccccgacgccaagctgaagcaccagatcctgagcgccctgagccaggtgagcaagcacagcgtggacctggccgagatggtggtggaggccgagatcttccccgtggtgctgacctgcctgaaggacaaggacgagtacgtgaagaagaacgccagcaccctgatcagagagatcgccaagcacacccccgagctgagccagctggtggtgaacgccggcggcgtggccgccgtgatcgactgcatcggcagctgcaagggcaacaccagactgcccggcatcatgatgctgggctacgtggccgcccacagcgagaacctggccatggccgtgatcatcagcaagggcgtgccccagctgagcgtgtgcctgagcgaggagcccgaggaccacatcaaggccgccgccgcctgggccctgggccagatcggcagacacacccccgagcacgccagagccgtggccgtgaccaacaccctgcccgtgctgctgagcctgtacatgagcaccgagagcagcgaggacctgcaggtgaagagcaagaaggccatcaagaacatcctgcagaagtgcacctacctgcccgccctggagcccttcctgtacgacgccccccccaacatcctgaagcacgtggtgggccagttcagcaaggtgctgccccacgacagcaaggccagaagactgttcgtgaccagcggcggcctgaagaaggtgcaggagatcaaggccgagcccggcagcctgctgcaggagtacatcaacagcatcaacagctgctaccccgaggagatcgtgagatactacagccccggctacagcgacaccctgctgcagagagtggacagctaccagcccctgaacaactag

SEQ ID NO: 100562 - DNA, 741 bp, Artificial Sequence
  Description of Artificial Sequence: Synthetic coding sequence
atgagccagagacaggtgctgcaggtgttcgagcagtaccagaaggccagaacccagttcgtgcagatggtggccgagctggccaccagaccccagaacatcgagaccctgcagaacgccggcgagcccggcgccagaacccccgtggcccccagagccctgagccccagaagactgagacccgccgccctgcccgtggagctgctgggcagcagaagcgtgggcaccggcgtgagaaagagcatccacagcttccagagagtgttcggcggccaggccgagagagtgaagctgcccgacggctgcggcagatgcgccctgagcctgttccccagcagcctgcacaccggcgtgatgagcctgctgagaaccctgctgctggacgtggtgcccaccatccagcagaccgccgccctggccctgggcagactggccaactacaacgacgacctggccgaggccgtggtgaagtgcgacatcctgccccagctggtgtacagcctggccgagcagaacagattctacaagaaggccgccgccttcgtgctgagagccgtgggcaagcacagcccccagctggcccaggccatcgtggactgcggcgccctggacaccctggtgatctgcctggaggacttcgaccccggcgtgaaggaggccgccgcctgggccctgagatacatcgccagacacaacgccgagctgagccaggccgtggtggacgccggcgccgtgccctag

SEQ ID NO: 100563 - DNA, 576 bp, Artificial Sequence
  Description of Artificial Sequence: Synthetic coding sequence
atgagccagagacaggtgctgcaggtgttcgagcagtaccagaaggccagaacccagttcgtgcagatggtggccgagctggccaccagaccccagaacatcgagaccctgcagaacgccggcgtgatgagcctgctgagaaccctgctgctggacgtggtgcccaccatccagcagaccgccgccctggccctgggcagactggccaactacaacgacgacctggccgaggccgtggtgaagtgcgacatcctgccccagctggtgtacagcctggccgagcagaacggcgtgccccagctgagcgtgtgcctgagcgaggagcccgaggaccacatcaaggccgccgccgcctgggccctgggccagatcggcagacacacccccgagcacgccagagccgtggccgtgaccaacaccctgcccgtgctgctgagcctgtacatgagcaccgagagcagcgaggacctgcaggtgaagagcaagaaggccatcaagaacatcctgcagaagtgcacctacctgcccgccctggagcccttcctgtacgacgccccccccaacatcctgaagtag

SEQ ID NO: 100564 - DNA, 1455 bp, Artificial Sequence
  Description of Artificial Sequence: Synthetic coding sequence
atgcacagcctgaccatggacctgtggatccccaacggccaggccggcgtgatgagcctgctgagaaccctgctgctggacgtggtgcccaccatccagcagaccgccgccctggccctgggcagactggccaactacaacgacgacctggccgaggccgtggtgaagtgcgacatcctgccccagctggtgtacagcctggccgagcagaacagattctacaagaaggccgccgccttcgtgctgagagccgtgggcaagcacagcccccagctggcccaggccatcgtggactgcggcgccctggacaccctggtgatctgcctggaggacttcgaccccggcgtgaaggaggccgccgcctgggccctgagatacatcgccagacacaacgccgagctgagccaggccgtggtggacgccggcgccgtgcccctgctggtgctgtgcatccaggagcccgagatcgccctgaagagaatcgccgccagcgccctgagcgacatcgccaagcacagccccgagctggcccagaccgtggtggacgccggcgccgtggcccacctggcccagatgatcctgaaccccgacgccaagctgaagcaccagatcctgagcgccctgagccaggtgagcaagcacagcgtggacctggccgagatggtggtggaggccgagatcttccccgtggtgctgacctgcctgaaggacaaggacgagtacgtgaagaagaacgccagcaccctgatcagagagatcgccaagcacacccccgagctgagccagctggtggtgaacgccggcggcgtggccgccgtgatcgactgcatcggcagctgcaagggcaacaccagactgcccggcatcatgatgctgggctacgtggccgcccacagcgagaacctggccatggccgtgatcatcagcaagggcgtgccccagctgagcgtgtgcctgagcgaggagcccgaggaccacatcaaggccgccgccgcctgggccctgggccagatcggcagacacacccccgagcacgccagagccgtggccgtgaccaacaccctgcccgtgctgctgagcctgtacatgagcaccgagagcagcgaggacctgcaggtgaagagcaagaaggccatcaagaacatcctgcagaagtgcacctacctgcccgccctggagcccttcctgtacgacgccccccccaacatcctgaagcacgtggtgggccagttcagcaaggtgctgccccacgacagcaaggccagaagactgttcgtgaccagcggcggcctgaagaaggtgcaggagatcaaggccgagcccggcagcctgctgcaggagtacatcaacagcatcaacagctgctaccccgaggagatcgtgagatactacagccccggctacagcgacaccctgctgcagagagtggacagctaccagcccctgaacaactag

SEQ ID NO: 100565 - DNA, 1506 bp, Artificial Sequence
  Description of Artificial Sequence: Synthetic coding sequence
atggagaccaacgagagcaccgagggcagcagaagcagaagcagaagcctggacatccagcccagcagcgagggcctgggccccaccagcgagcccttccccagcagcgacgacagccccagaagcgccctggccgccgccaccgccgccgccgccgccgccgccagcgccgccgccgccaccgccgccttcaccaccgccaaggccgccgccctgagcaccaagacccccgccccctgcagcgagttcatggagcccagcagcgaccccagcctgctgggcgagccctgcgccggccccggcttcacccacaacatcgcccacggcagcctgggcttcgagcccgtgtacgtgagctgcatcgcccaggacacctgcaccaccaccgaccacagcagcaaccccggccccgtgcccggcagcagcagcggccccgtgctgggcagcagcagcggcgccggccacggcagcggcagcggcagcggccccggctgcggcagcgtgcccggcagcggcagcggccccggccccggcagcggccccggcagcggccccggccacggcagcggcagccaccccggccccgccagcggccccggccccgacaccggccccgacagcgagctgagcccctgcatcccccccggcttcagaaacctggtggccgacagagtgcccaactacaccagctggagccagcactgcccctgggagccccagaagcagcccccctgggagttcctgcaggtgctggagcccggcgccagaggcctgtggaagccccccgacatcaagggcaagctgatggtgtgctacgagaccctgcccagaggccagtgcctgctgtacaactgggaggaggagagagccaccaaccacctggaccaggtgcccagcatgcaggacggcagcgagagcttcttcttcagacacggccacagaggcctgctgaccatgcagctgaagagccccatgcccagcagcaccacccagaaggacagctaccagccccccggcaacgtgtactggcccctgagaggcaagagagaggccatgctggagatgctgctgcagcaccagatctgcaaggaggtgcaggccgagcaggagcccaccagaaagctgttcgaggtggagagcgtgacccaccacgactacagaatggagctggcccaggccggcacccccgcccccaccaagccccacgactacagacaggagcagcccgagaccttctggatccagagagccccccagctgcccacctggtggcccctgcccacccaggtgcccgccgccgaggactacctgacctggaaggagtggggcttcaccggcgtgcaggaggtgctgagcgccctgctgagagccacccccggcgagtacagcgtgaacatctgcggcatgaacgagcaccccgtgtgcagcagaacctggaccaacagactgtgccaccaggagatgggcagcaagaagaccgtgacccaggaggacagaggctggtag

SEQ ID NO: 100566 - DNA, 1458 bp, Artificial Sequence
  Description of Artificial Sequence: Synthetic coding sequence
atggagaccaacgagagcaccgagggcagcagaagcagaagcagaagcctggacatccagcccagcagcgagggcctgggccccaccagcgagcccttccccagcagcgacgacagccccagaagcgccctggccgccgccaccgccgccgccgccgccgccgccagcgccgccgccgccaccgccgccttcaccaccgccaaggccgccgccctgagcaccaagacccccgccccctgcagcgagttcatggagcccagcagcgaccccagcctgctgggcgagccctgcgccggccccggcttcacccacaacatcgcccacggcagcctgggcttcgagcccgtgtacgtgagctgcatcgcccaggacacctgcaccaccaccgaccacagcagcaaccccggccccgtgcccggcagcagcagcggccccgtgctgggcagcagcagcggcgccggccacggcagcggcagcggcagcggccccggctgcggcagcgtgcccggcagcggcagcggccccggccccggcagcggccccggcagcggccccggccacggcagcggcagccaccccggccccgccagcggccccggccccgacaccggccccgacagcgagctgagcccctgcatcccccccggcttcagaaacctggtggccgacagagtgcccaactacaccagctggagccagcactgcccctgggagccccagaagcagcccccctgggagttcctgcaggtgctggagcccggcgccagaggcctgtggaagccccccgacatcaagggcaagctgatggtgtgctacgagaccctgcccagaggccagtgcctgctgtacaactgggaggaggagagagccaccaaccacctggaccaggtgcccagcatgcaggacggcagcgagagcttcttcttcagacacggccacagaggcctgctgaccatgcagctgaagagccccatgcccagcagcaccacccagaaggacagctaccagccccccggcaacgtgtactggcccctgagaggcaagagagaggccatgctggagatgctgctgcagcaccagatctgcaaggaggtgcaggccgagcaggagcccaccagaaagctgttcgaggtggagagcgtgacccaccacgactacagaatggagctggcccaggccggcacccccgcccccaccaagccccacgactacagacaggagcagcccgagaccttctggatccagagagccccccagctgcccggcgtgagcaacatcagaaccctggacacccccttcagaaagaactgcagcttcagcacccccgtgcccctgagcctgggcaagctgctgccctacgagcccgagaactacccctaccagctgggcgagatcagcagcctgccctgccccggcggcagactgggcggcggcggcggcagaatgacccccttctag

SEQ ID NO: 100567 - DNA, 1281 bp, Artificial Sequence
  Description of Artificial Sequence: Synthetic coding sequence
atggagaccaacgagagcaccgagggcagcagaagcagaagcagaagcctggacatccagcccagcagcgagggcctgggccccaccagcgagcccttccccagcagcgacgacagccccagaagcgccctggccgccgccaccgccgccgccgccgccgccgccagcgccgccgccgccaccgccgccttcaccaccgccaaggccgccgccctgagcaccaagacccccgccccctgcagcgagttcatggagcccagcagcgaccccagcctgctgggcgagccctgcgccggccccggcttcacccacaacatcgcccacggcagcctgggcttcgagcccgtgtacgtgagctgcatcgcccaggacacctgcaccaccaccgaccacagcagcaaccccggccccgtgcccggcagcagcagcggccccgtgctgggcagcagcagcggcgccggccacggcagcggcagcggcagcggccccggctgcggcagcgtgcccggcagcggcagcggccccggccccggcagcggccccggcagcggccccggccacggcagcggcagccaccccggccccgccagcggccccggccccgacaccggccccgacagcgagctgagcccctgcatcccccccggcttcagaaacctggtggccgacagagtgcccaactacaccagctggagccagcactgcccctgggagccccagaagcagcccccctgggagttcctgcaggtgctggagcccggcgccagaggcctgtggaagccccccgacatcaagggcaagctgatggtgtgctacgagaccctgcccagaggccagtgcctgctgtacaactgggaggaggagagagccaccaaccacctggaccaggtgcccagcatgcaggacggcagcgagagcttcttcttcagacacggccacagaggcctgctgaccatgcagctgaagagccccatgcccagcagcaccacccagaaggacagctaccagccccccggcaacgtgtactggcccctgagaggcaagagagaggccatgctggagatgctgctgcagcaccagatctgcaaggaggtgcaggccgagcaggagcccaccagaaagctgttcgaggtggagagcgtgacccaccacgactacagaatggagctggcccaggccggcacccccgcccccaccaagccccacgactacagacaggagcagcccgagaccttctggatccagagagccccccagctgcccgtgtgcgagggcgactag

SEQ ID NO: 100568 - DNA, 3966 bp, Artificial Sequence
  Description of Artificial Sequence: Synthetic coding sequence
atggagctggaggacggcgtggtgtaccaggaggagcccggcggcagcggcgccgtgatgagcgagagagtgagcggcctggccggcagcatctacagagagttcgagagactgatcggcagatacgacgaggaggtggtgaaggagctgatgcccctggtggtggccgtgctggagaacctggacagcgtgttcgcccaggaccaggagcaccaggtggagctggagctgctgagagacgacaacgagcagctgatcacccagtacgagagagagaaggccctgagaaagcacgccgaggagaagttcatcgagttcgaggacagccaggagcaggagaagaaggacctgcagaccagagtggagagcctggagagccagaccagacagctggagctgaaggccaagaactacgccgaccagatcagcagactggaggagagagaggccgagctgaagaaggagtacaacgccctgcaccagagacacaccgagatgatccacaactacatggagcacctggagagaaccaagctgcaccagctgagcggcagcgaccagctggagagcaccgcccacagcagaatcagaaaggagagacccatcagcctgggcatcttccccctgcccgccggcgacggcctgctgacccccgacgcccagaagggcggcgagacccccggcagcgagcagtggaagttccaggagctgagccagcccagaagccacaccagcctgaaggtgagcaacagccccgagccccagaaggccgtggagcaggaggacgagctgagcgacgtgagccagggcggcagcaaggccaccacccccgccagcaccgccaacagcgacgtggccaccatccccaccgacacccccctgaaggaggagaacgagggcttcgtgaaggtgaccgacgcccccaacaagagcgagatcagcaagcacatcgaggtgcaggtggcccaggagaccagaaacgtgagcaccggcagcgccgagaacgaggagaagagcgaggtgcaggccatcatcgagagcacccccgagctggacatggacaaggacctgagcggctacaagggcagcagcacccccaccaagggcatcgagaacaaggccttcgacagaaacaccgagagcctgttcgaggagctgagcagcgccggcagcggcctgatcggcgacgtggacgagggcgccgacctgctgggcatgggcagagaggtggagaacctgatcctggagaacacccagctgctggagaccaagaacgccctgaacatcgtgaagaacgacctgatcgccaaggtggacgagctgacctgcgagaaggacgtgctgcagggcgagctggaggccgtgaagcaggccaagctgaagctggaggagaagaacagagagctggaggaggagctgagaaaggccagagccgaggccgaggacgccagacagaaggccaaggacgacgacgacagcgacatccccaccgcccagagaaagagattcaccagagtggagatggccagagtgctgatggagagaaaccagtacaaggagagactgatggagctgcaggaggccgtgagatggaccgagatgatcagagccagcagagagaaccccgccatgcaggagaagaagagaagcagcatctggcagttcttcagcagactgttcagcagcagcagcaacaccaccaagaagcccgagccccccgtgaacctgaagtacaacgcccccaccagccacgtgacccccagcgtgaagaagagaagcagcaccctgagccagctgcccggcgacaagagcaaggccttcgacttcctgagcgaggagaccgaggccagcctggccagcagaagagagcagaagagagagcagtacagacaggtgaaggcccacgtgcagaaggaggacggcagagtgcaggccttcggctggagcctgccccagaagtacaagcaggtgaccaacggccagggcgagaacaagatgaagaacctgcccgtgcccgtgtacctgagacccctggacgagaaggacaccagcatgaagctgtggtgcgccgtgggcgtgaacctgagcggcggcaagaccagagacggcggcagcgtggtgggcgccagcgtgttctacaaggacgtggccggcctggacaccgagggcagcaagcagagaagcgccagccagagcagcctggacaagctggaccaggagctgaaggagcagcagaaggagctgaagaaccaggaggagctgagcagcctggtgtggatctgcaccagcacccacagcgccaccaaggtgctgatcatcgacgccgtgcagcccggcaacatcctggacagcttcaccgtgtgcaacagccacgtgctgtgcatcgccagcgtgcccggcgccagagagaccgactaccccgccggcgaggacctgagcgagagcggccaggtggacaaggccagcctgtgcggcagcatgaccagcaacagcagcgccgagaccgacagcctgctgggcggcatcaccgtggtgggctgcagcgccgagggcgtgaccggcgccgccaccagccccagcaccaacggcgccagccccgtgatggacaagccccccgagatggaggccgagaacagcgaggtggacgagaacgtgcccaccgccgaggaggccaccgaggccaccgagggcaacgccggcagcgccgaggacaccgtggacatcagccagaccggcgtgtacaccgagcacgtgttcaccgaccccctgggcgtgcagatccccgaggacctgagccccgtgtaccagagcagcaacgacagcgacgcctacaaggaccagatcagcgtgctgcccaacgagcaggacctggtgagagaggaggcccagaagatgagcagcctgctgcccaccatgtggctgggcgcccagaacggctgcctgtacgtgcacagcagcgtggcccagtggagaaagtgcctgcacagcatcaagctgaaggacagcatcctgagcatcgtgcacgtgaagggcatcgtgctggtggccctggccgacggcaccctggccatcttccacagaggcgtggacggccagtgggacctgagcaactaccacctgctggacctgggcagaccccaccacagcatcagatgcatgaccgtggtgcacgacaaggtgtggtgcggctacagaaacaagatctacgtggtgcagcccaaggccatgaagatcgagaagagcttcgacgcccaccccagaaaggagagccaggtgagacagctggcctgggtgggcgacggcgtgtgggtgagcatcagactggacagcaccctgagactgtaccacgcccacacctaccagcacctgcaggacgtggacatcgagccctacgtgagcaagatgctgggcaccggcaagctgggcttcagcttcgtgagaatcaccgccctgatggtgagctgcaacagactgtgggtgggcaccggcaacggcgtgatcatcagcatccccctgaccgagaccaacaagaccagcggcgtgcccggcaacagacccggcagcgtgatcagagtgtacggcgacgagaacagcgacaaggtgacccccggcaccttcatcccctactgcagcatggcccacgcccagctgtgcttccacggccacagagacgccgtgaagttcttcgtggccgtgcccggccaggtgatcagcccccagagcagcagcagcggcaccgacctgaccggcgacaaggccggccccagcgcccaggagcccggcagccagacccccctgaagagcatgctggtgatcagcggcggcgagggctacatcgacttcagaatgggcgacgagggcggcgagagcgagctgctgggcgaggacctgcccctggagcccagcgtgaccaaggccgagagaagccacctgatcgtgtggcaggtgatgtacggcaacgagtag

SEQ ID NO: 100569 - DNA, 3924 bp, Artificial Sequence
  Description of Artificial Sequence: Synthetic coding sequence
atggagctggaggacggcgtggtgtaccaggaggagcccggcggcagcggcgccgtgatgagcgagagagtgagcggcctggccggcagcatctacagagagttcgagagactgatcggcagatacgacgaggaggtggtgaaggagctgatgcccctggtggtggccgtgctggagaacctggacagcgtgttcgcccaggaccaggagcaccaggtggagctggagctgctgagagacgacaacgagcagctgatcacccagtacgagagagagaaggccctgagaaagcacgccgaggagaagttcatcgagttcgaggacagccaggagcaggagaagaaggacctgcagaccagagtggagagcctggagagccagaccagacagctggagctgaaggccaagaactacgccgaccagatcagcagactggaggagagagaggccgagctgaagaaggagtacaacgccctgcaccagagacacaccgagatgatccacaactacatggagcacctggagagaaccaagctgcaccagctgagcggcagcgaccagctggagagcaccgcccacagcagaatcagaaaggagagacccatcagcctgggcatcttccccctgcccgccggcgacggcctgctgacccccgacgcccagaagggcggcgagacccccggcagcgagcagtggaagttccaggagctgagccagcccagaagccacaccagcctgaaggacgagctgagcgacgtgagccagggcggcagcaaggccaccacccccgccagcaccgccaacagcgacgtggccaccatccccaccgacacccccctgaaggaggagaacgagggcttcgtgaaggtgaccgacgcccccaacaagagcgagatcagcaagcacatcgaggtgcaggtggcccaggagaccagaaacgtgagcaccggcagcgccgagaacgaggagaagagcgaggtgcaggccatcatcgagagcacccccgagctggacatggacaaggacctgagcggctacaagggcagcagcacccccaccaagggcatcgagaacaaggccttcgacagaaacaccgagagcctgttcgaggagctgagcagcgccggcagcggcctgatcggcgacgtggacgagggcgccgacctgctgggcatgggcagagaggtggagaacctgatcctggagaacacccagctgctggagaccaagaacgccctgaacatcgtgaagaacgacctgatcgccaaggtggacgagctgacctgcgagaaggacgtgctgcagggcgagctggaggccgtgaagcaggccaagctgaagctggaggagaagaacagagagctggaggaggagctgagaaaggccagagccgaggccgaggacgccagacagaaggccaaggacgacgacgacagcgacatccccaccgcccagagaaagagattcaccagagtggagatggccagagtgctgatggagagaaaccagtacaaggagagactgatggagctgcaggaggccgtgagatggaccgagatgatcagagccagcagagagaaccccgccatgcaggagaagaagagaagcagcatctggcagttcttcagcagactgttcagcagcagcagcaacaccaccaagaagcccgagccccccgtgaacctgaagtacaacgcccccaccagccacgtgacccccagcgtgaagaagagaagcagcaccctgagccagctgcccggcgacaagagcaaggccttcgacttcctgagcgaggagaccgaggccagcctggccagcagaagagagcagaagagagagcagtacagacaggtgaaggcccacgtgcagaaggaggacggcagagtgcaggccttcggctggagcctgccccagaagtacaagcaggtgaccaacggccagggcgagaacaagatgaagaacctgcccgtgcccgtgtacctgagacccctggacgagaaggacaccagcatgaagctgtggtgcgccgtgggcgtgaacctgagcggcggcaagaccagagacggcggcagcgtggtgggcgccagcgtgttctacaaggacgtggccggcctggacaccgagggcagcaagcagagaagcgccagccagagcagcctggacaagctggaccaggagctgaaggagcagcagaaggagctgaagaaccaggaggagctgagcagcctggtgtggatctgcaccagcacccacagcgccaccaaggtgctgatcatcgacgccgtgcagcccggcaacatcctggacagcttcaccgtgtgcaacagccacgtgctgtgcatcgccagcgtgcccggcgccagagagaccgactaccccgccggcgaggacctgagcgagagcggccaggtggacaaggccagcctgtgcggcagcatgaccagcaacagcagcgccgagaccgacagcctgctgggcggcatcaccgtggtgggctgcagcgccgagggcgtgaccggcgccgccaccagccccagcaccaacggcgccagccccgtgatggacaagccccccgagatggaggccgagaacagcgaggtggacgagaacgtgcccaccgccgaggaggccaccgaggccaccgagggcaacgccggcagcgccgaggacaccgtggacatcagccagaccggcgtgtacaccgagcacgtgttcaccgaccccctgggcgtgcagatccccgaggacctgagccccgtgtaccagagcagcaacgacagcgacgcctacaaggaccagatcagcgtgctgcccaacgagcaggacctggtgagagaggaggcccagaagatgagcagcctgctgcccaccatgtggctgggcgcccagaacggctgcctgtacgtgcacagcagcgtggcccagtggagaaagtgcctgcacagcatcaagctgaaggacagcatcctgagcatcgtgcacgtgaagggcatcgtgctggtggccctggccgacggcaccctggccatcttccacagaggcgtggacggccagtgggacctgagcaactaccacctgctggacctgggcagaccccaccacagcatcagatgcatgaccgtggtgcacgacaaggtgtggtgcggctacagaaacaagatctacgtggtgcagcccaaggccatgaagatcgagaagagcttcgacgcccaccccagaaaggagagccaggtgagacagctggcctgggtgggcgacggcgtgtgggtgagcatcagactggacagcaccctgagactgtaccacgcccacacctaccagcacctgcaggacgtggacatcgagccctacgtgagcaagatgctgggcaccggcaagctgggcttcagcttcgtgagaatcaccgccctgatggtgagctgcaacagactgtgggtgggcaccggcaacggcgtgatcatcagcatccccctgaccgagaccaacaagaccagcggcgtgcccggcaacagacccggcagcgtgatcagagtgtacggcgacgagaacagcgacaaggtgacccccggcaccttcatcccctactgcagcatggcccacgcccagctgtgcttccacggccacagagacgccgtgaagttcttcgtggccgtgcccggccaggtgatcagcccccagagcagcagcagcggcaccgacctgaccggcgacaaggccggccccagcgcccaggagcccggcagccagacccccctgaagagcatgctggtgatcagcggcggcgagggctacatcgacttcagaatgggcgacgagggcggcgagagcgagctgctgggcgaggacctgcccctggagcccagcgtgaccaaggccgagagaagccacctgatcgtgtggcaggtgatgtacggcaacgagtag

SEQ ID NO: 100570 - DNA, 1908 bp, Artificial Sequence
  Description of Artificial Sequence: Synthetic coding sequence
agcctgaaggacgagctgagcgacgtgagccagggcggcagcaaggccaccacccccgccagcaccgccaacagcgacgtggccaccatccccaccgacacccccctgaaggaggagaacgagggcttcgtgaaggtgaccgacgcccccaacaagagcgagatcagcaagcacatcgaggtgcaggtggcccaggagaccagaaacgtgagcaccggcagcgccgagaacgaggagaagagcgaggtgcaggccatcatcgagagcacccccgagctggacatggacaaggacctgagcggctacaagggcagcagcacccccaccaagggcatcgagaacaaggccttcgacagaaacaccgagagcctgttcgagaagagaagcagcaccctgagccagctgcccggcgacaagagcaaggccttcgacttcctgagcgaggagaccgaggccagcctggccagcagaagagagcagaagagagagcagtacagacaggtgaaggcccacgtgcagaaggaggacggcagagtgcaggccttcggctggagcctgccccagaagtacaagcaggtgaccaacggccagggcgagaacaagatgaagaacctgcccgtgcccgtgtacctgagacccctggacgagaaggacaccagcatgaagaagctgtggtgcgccgtgggcgtgaacctgagcggcggcaagaccagagacggcggcagcgtggtgggcgccagcgtgttctacaaggacgtggccggcctggacaccgagggcagcaagcagagaagcgccagccagagcagcctggacaagctggaccaggagctgaaggagcagcagaaggagctgaagaaccaggaggagctgagcagcctggtgtggatctgcaccagcacccacagcgccaccaaggtgctgatcatcgacgccgtgcagcccggcaacatcctggacagcttcaccgtgtgcaacagccacgtgctgtgcatcgccagcgtgcccggcgccagagagaccgactaccccgccggcgaggacctgagcgagagcggccaggtggacaaggccagcctgtgcggcagcatgaccagcaacagcagcgccgagaccgacagcctgctgggcggcatcaccgtggtgggctgcagcgccgagggcgtgaccggcgccgccaccagccccagcaccaacggcgccagccccgtgatggacaagccccccgagatggaggccgagaacagcgaggtggacgagaacgtgcccaccgccgaggaggccaccgaggccaccgagggcaacgccggcagcgccgaggacaccgtggacatcagccagaccggcgtgtacaccgagcacgtgttcaccgaccccctgggcgtgcagatccccgaggacctgagccccgtgtaccagagcagcaacgacagcgacgcctacaaggaccagatcagcgtgctgcccaacgagcaggacctggtgagagaggaggcccagaagatgagcagcctgctgcccaccatgtggctgggcgcccagaacggctgcctgtacgtgcacagcagcgtggcccagtggagaaagtgcctgcacagcatcaagctgaaggacagcatcctgagcatcgtgcacgtgaagggcatcgtgctggtggccctggccgacggcaccctggccatcttccacagaggcgtggacggccagtgggacctgagcaactaccacctgctggacctgggcagaccccaccacagcatcagatgcatgaccgtggtgcacgacaaggtgtggtgcggctacagaaacaagatctacgtgctgcacagcagcctgggcgacggcgccagaccctgcctgaagaccgacaagcaggccaagaacagactgaagagcggcttccactag

SEQ ID NO: 100571 - DNA, 3207 bp, Artificial Sequence
  Description of Artificial Sequence: Synthetic coding sequence
agcctgaaggacgagctgagcgacgtgagccagggcggcagcaaggccaccacccccgccagcaccgccaacagcgacgtggccaccatccccaccgacacccccctgaaggaggagaacgagggcttcgtgaaggtgaccgacgcccccaacaagagcgagatcagcaagcacatcgaggtgcaggtggcccaggagaccagaaacgtgagcaccggcagcgccgagaacgaggagaagagcgaggtgcaggccatcatcgagagcacccccgagctggacatggacaaggacctgagcggctacaagggcagcagcacccccaccaagggcatcgagaacaaggccttcgacagaaacaccgagagcctgttcgaggagctgagcagcgccggcagcggcctgatcggcgacgtggacgagggcgccgacctgctgggcatgggcagagaggtggagaacctgatcctggagaacacccagctgctggagaccaagaacgccctgaacatcgtgaagaacgacctgatcgccaaggtggacgagctgacctgcgagaaggacgtgctgcagggcgagctggaggccgtgaagcaggccaagctgaagctggaggagaagaacagagagctggaggaggagctgagaaaggccagagccgaggccgaggacgccagacagaaggccaaggacgacgacgacagcgacatccccaccgcccagagaaagagattcaccagagtggagatggccagagtgctgatggagagaaaccagtacaaggagagactgatggagctgcaggaggccgtgagatggaccgagatgatcagagccagcagagagaaccccgccatgcaggagaagaagagaagcagcatctggcagttcgtgcccaccagattcagcagactgttcagcagcagcagcaacaccaccaagaagcccgagccccccgtgaacctgaagtacaacgcccccaccagccacgtgacccccagcgtgaagaagagaagcagcaccctgagccagctgcccggcgacaagagcaaggccttcgacttcctgagcgaggagaccgaggccagcctggccagcagaagagagcagaagagagagcagtacagacaggtgaaggcccacgtgcagaaggaggacggcagagtgcaggccttcggctggagcctgccccagaagtacaagcaggtgaccaacggccagggcgagaacaagatgaagaacctgcccgtgcccgtgtacctgagacccctggacgagaaggacaccagcatgaagaagctgtggtgcgccgtgggcgtgaacctgagcggcggcaagaccagagacggcggcagcgtggtgggcgccagcgtgttctacaaggacgtggccggcctggacaccgagggcagcaagcagagaagcgccagccagagcagcctggacaagctggaccaggagctgaaggagcagcagaaggagctgaagaaccaggaggagctgagcagcctggtgtggatctgcaccagcacccacagcgccaccaaggtgctgatcatcgacgccgtgcagcccggcaacatcctggacagcttcaccgtgtgcaacagccacgtgctgtgcatcgccagcgtgcccggcgccagagagaccgactaccccgccggcgaggacctgagcgagagcggccaggtggacaaggccagcctgtgcggcagcatgaccagcaacagcagcgccgagaccgacagcctgctgggcggcatcaccgtggtgggctgcagcgccgagggcgtgaccggcgccgccaccagccccagcaccaacggcgccagccccgtgatggacaagccccccgagatggaggccgagaacagcgaggtggacgagaacgtgcccaccgccgaggaggccaccgaggccaccgagggcaacgccggcagcgccgaggacaccgtggacatcagccagaccggcgtgtacaccgagcacgtgttcaccgaccccctgggcgtgcagatccccgaggacctgagccccgtgtaccagagcagcaacgacagcgacgcctacaaggaccagatcagcgtgctgcccaacgagcaggacctggtgagagaggaggcccagaagatgagcagcctgctgcccaccatgtggctgggcgcccagaacggctgcctgtacgtgcacagcagcgtggcccagtggagaaagtgcctgcacagcatcaagctgaaggacagcatcctgagcatcgtgcacgtgaagggcatcgtgctggtggccctggccgacggcaccctggccatcttccacagaggcgtggacggccagtgggacctgagcaactaccacctgctggacctgggcagaccccaccacagcatcagatgcatgaccgtggtgcacgacaaggtgtggtgcggctacagaaacaagatctacgtggtgcagcccaaggccatgaagatcgagaagagcttcgacgcccaccccagaaaggagagccaggtgagacagctggcctgggtgggcgacggcgtgtgggtgagcatcagactggacagcaccctgagactgtaccacgcccacacctaccagcacctgcaggacgtggacatcgagccctacgtgagcaagatgctgggcaccggcaagctgggcttcagcttcgtgagaatcaccgccctgatggtgagctgcaacagactgtgggtgggcaccggcaacggcgtgatcatcagcatccccctgaccgagaccaacaagaccagcggcgtgcccggcaacagacccggcagcgtgatcagagtgtacggcgacgagaacagcgacaaggtgacccccggcaccttcatcccctactgcagcatggcccacgcccagctgtgcttccacggccacagagacgccgtgaagttcttcgtggccgtgcccggccaggtgatcagcccccagagcagcagcagcggcaccgacctgaccggcgacaaggccggccccagcgcccaggagcccggcagccagacccccctgaagagcatgctggtgatcagcggcggcgagggctacatcgacttcagaatgggcgacgagggcggcgagagcgagctgctgggcgaggacctgcccctggagcccagcgtgaccaaggccgagagaagccacctgatcgtgtggcaggtgatgtacggcaacgagtag

SEQ ID NO: 100572 - DNA, 3237 bp, Artificial Sequence
  Description of Artificial Sequence: Synthetic coding sequence
agcgtgaaggtgagcaacagccccgagccccagaaggccgtggagcaggaggacgagctgagcgacgtgagccagggcggcagcaaggccaccacccccgccagcaccgccaacagcgacgtggccaccatccccaccgacacccccctgaaggaggagaacgagggcttcgtgaaggtgaccgacgcccccaacaagagcgagatcagcaagcacatcgaggtgcaggtggcccaggagaccagaaacgtgagcaccggcagcgccgagaacgaggagaagagcgaggtgcaggccatcatcgagagcacccccgagctggacatggacaaggacctgagcggctacaagggcagcagcacccccaccaagggcatcgagaacaaggccttcgacagaaacaccgagagcctgttcgaggagctgagcagcgccggcagcggcctgatcggcgacgtggacgagggcgccgacctgctgggcatgggcagagaggtggagaacctgatcctggagaacacccagctgctggagaccaagaacgccctgaacatcgtgaagaacgacctgatcgccaaggtggacgagctgacctgcgagaaggacgtgctgcagggcgagctggaggccgtgaagcaggccaagctgaagctggaggagaagaacagagagctggaggaggagctgagaaaggccagagccgaggccgaggacgccagacagaaggccaaggacgacgacgacagcgacatccccaccgcccagagaaagagattcaccagagtggagatggccagagtgctgatggagagaaaccagtacaaggagagactgatggagctgcaggaggccgtgagatggaccgagatgatcagagccagcagagagaaccccgccatgcaggagaagaagagaagcagcatctggcagttcttcagcagactgttcagcagcagcagcaacaccaccaagaagcccgagccccccgtgaacctgaagtacaacgcccccaccagccacgtgacccccagcgtgaagaagagaagcagcaccctgagccagctgcccggcgacaagagcaaggccttcgacttcctgagcgaggagaccgaggccagcctggccagcagaagagagcagaagagagagcagtacagacaggtgaaggcccacgtgcagaaggaggacggcagagtgcaggccttcggctggagcctgccccagaagtacaagcaggtgaccaacggccagggcgagaacaagatgaagaacctgcccgtgcccgtgtacctgagacccctggacgagaaggacaccagcatgaagaagctgtggtgcgccgtgggcgtgaacctgagcggcggcaagaccagagacggcggcagcgtggtgggcgccagcgtgttctacaaggacgtggccggcctggacaccgagggcagcaagcagagaagcgccagccagagcagcctggacaagctggaccaggagctgaaggagcagcagaaggagctgaagaaccaggaggagctgagcagcctggtgtggatctgcaccagcacccacagcgccaccaaggtgctgatcatcgacgccgtgcagcccggcaacatcctggacagcttcaccgtgtgcaacagccacgtgctgtgcatcgccagcgtgcccggcgccagagagaccgactaccccgccggcgaggacctgagcgagagcggccaggtggacaaggccagcctgtgcggcagcatgaccagcaacagcagcgccgagaccgacagcctgctgggcggcatcaccgtggtgggctgcagcgccgagggcgtgaccggcgccgccaccagccccagcaccaacggcgccagccccgtgatggacaagccccccgagatggaggccgagaacagcgaggtggacgagaacgtgcccaccgccgaggaggccaccgaggccaccgagggcaacgccggcagcgccgaggacaccgtggacatcagccagaccggcgtgtacaccgagcacgtgttcaccgaccccctgggcgtgcagatccccgaggacctgagccccgtgtaccagagcagcaacgacagcgacgcctacaaggaccagatcagcgtgctgcccaacgagcaggacctggtgagagaggaggcccagaagatgagcagcctgctgcccaccatgtggctgggcgcccagaacggctgcctgtacgtgcacagcagcgtggcccagtggagaaagtgcctgcacagcatcaagctgaaggacagcatcctgagcatcgtgcacgtgaagggcatcgtgctggtggccctggccgacggcaccctggccatcttccacagaggcgtggacggccagtgggacctgagcaactaccacctgctggacctgggcagaccccaccacagcatcagatgcatgaccgtggtgcacgacaaggtgtggtgcggctacagaaacaagatctacgtggtgcagcccaaggccatgaagatcgagaagagcttcgacgcccaccccagaaaggagagccaggtgagacagctggcctgggtgggcgacggcgtgtgggtgagcatcagactggacagcaccctgagactgtaccacgcccacacctaccagcacctgcaggacgtggacatcgagccctacgtgagcaagatgctgggcaccggcaagctgggcttcagcttcgtgagaatcaccgccctgatggtgagctgcaacagactgtgggtgggcaccggcaacggcgtgatcatcagcatccccctgaccgagaccaacaagaccagcggcgtgcccggcaacagacccggcagcgtgatcagagtgtacggcgacgagaacagcgacaaggtgacccccggcaccttcatcccctactgcagcatggcccacgcccagctgtgcttccacggccacagagacgccgtgaagttcttcgtggccgtgcccggccaggtgatcagcccccagagcagcagcagcggcaccgacctgaccggcgacaaggccggccccagcgcccaggagcccggcagccagacccccctgaagagcatgctggtgatcagcggcggcgagggctacatcgacttcagaatgggcgacgagggcggcgagagcgagctgctgggcgaggacctgcccctggagcccagcgtgaccaaggccgagagaagccacctgatcgtgtggcaggtgatgtacggcaacgagtag

SEQ ID NO: 100573 - DNA, 3936 bp, Artificial Sequence
  Description of Artificial Sequence: Synthetic coding sequence
atggagctggaggacggcgtggtgtaccaggaggagcccggcggcagcggcgccgtgatgagcgagagagtgagcggcctggccggcagcatctacagagagttcgagagactgatcggcagatacgacgaggaggtggtgaaggagctgatgcccctggtggtggccgtgctggagaacctggacagcgtgttcgcccaggaccaggagcaccaggtggagctggagctgctgagagacgacaacgagcagctgatcacccagtacgagagagagaaggccctgagaaagcacgccgaggagaagttcatcgagttcgaggacagccaggagcaggagaagaaggacctgcagaccagagtggagagcctggagagccagaccagacagctggagctgaaggccaagaactacgccgaccagatcagcagactggaggagagagaggccgagctgaagaaggagtacaacgccctgcaccagagacacaccgagatgatccacaactacatggagcacctggagagaaccaagctgcaccagctgagcggcagcgaccagctggagagcaccgcccacagcagaatcagaaaggagagacccatcagcctgggcatcttccccctgcccgccggcgacggcctgctgacccccgacgcccagaagggcggcgagacccccggcagcgagcagtggaagttccaggagctgagccagcccagaagccacaccagcctgaaggacgagctgagcgacgtgagccagggcggcagcaaggccaccacccccgccagcaccgccaacagcgacgtggccaccatccccaccgacacccccctgaaggaggagaacgagggcttcgtgaaggtgaccgacgcccccaacaagagcgagatcagcaagcacatcgaggtgcaggtggcccaggagaccagaaacgtgagcaccggcagcgccgagaacgaggagaagagcgaggtgcaggccatcatcgagagcacccccgagctggacatggacaaggacctgagcggctacaagggcagcagcacccccaccaagggcatcgagaacaaggccttcgacagaaacaccgagagcctgttcgaggagctgagcagcgccggcagcggcctgatcggcgacgtggacgagggcgccgacctgctgggcatgggcagagaggtggagaacctgatcctggagaacacccagctgctggagaccaagaacgccctgaacatcgtgaagaacgacctgatcgccaaggtggacgagctgacctgcgagaaggacgtgctgcagggcgagctggaggccgtgaagcaggccaagctgaagctggaggagaagaacagagagctggaggaggagctgagaaaggccagagccgaggccgaggacgccagacagaaggccaaggacgacgacgacagcgacatccccaccgcccagagaaagagattcaccagagtggagatggccagagtgctgatggagagaaaccagtacaaggagagactgatggagctgcaggaggccgtgagatggaccgagatgatcagagccagcagagagaaccccgccatgcaggagaagaagagaagcagcatctggcagttcgtgcccaccagattcagcagactgttcagcagcagcagcaacaccaccaagaagcccgagccccccgtgaacctgaagtacaacgcccccaccagccacgtgacccccagcgtgaagaagagaagcagcaccctgagccagctgcccggcgacaagagcaaggccttcgacttcctgagcgaggagaccgaggccagcctggccagcagaagagagcagaagagagagcagtacagacaggtgaaggcccacgtgcagaaggaggacggcagagtgcaggccttcggctggagcctgccccagaagtacaagcaggtgaccaacggccagggcgagaacaagatgaagaacctgcccgtgcccgtgtacctgagacccctggacgagaaggacaccagcatgaagctgtggtgcgccgtgggcgtgaacctgagcggcggcaagaccagagacggcggcagcgtggtgggcgccagcgtgttctacaaggacgtggccggcctggacaccgagggcagcaagcagagaagcgccagccagagcagcctggacaagctggaccaggagctgaaggagcagcagaaggagctgaagaaccaggaggagctgagcagcctggtgtggatctgcaccagcacccacagcgccaccaaggtgctgatcatcgacgccgtgcagcccggcaacatcctggacagcttcaccgtgtgcaacagccacgtgctgtgcatcgccagcgtgcccggcgccagagagaccgactaccccgccggcgaggacctgagcgagagcggccaggtggacaaggccagcctgtgcggcagcatgaccagcaacagcagcgccgagaccgacagcctgctgggcggcatcaccgtggtgggctgcagcgccgagggcgtgaccggcgccgccaccagccccagcaccaacggcgccagccccgtgatggacaagccccccgagatggaggccgagaacagcgaggtggacgagaacgtgcccaccgccgaggaggccaccgaggccaccgagggcaacgccggcagcgccgaggacaccgtggacatcagccagaccggcgtgtacaccgagcacgtgttcaccgaccccctgggcgtgcagatccccgaggacctgagccccgtgtaccagagcagcaacgacagcgacgcctacaaggaccagatcagcgtgctgcccaacgagcaggacctggtgagagaggaggcccagaagatgagcagcctgctgcccaccatgtggctgggcgcccagaacggctgcctgtacgtgcacagcagcgtggcccagtggagaaagtgcctgcacagcatcaagctgaaggacagcatcctgagcatcgtgcacgtgaagggcatcgtgctggtggccctggccgacggcaccctggccatcttccacagaggcgtggacggccagtgggacctgagcaactaccacctgctggacctgggcagaccccaccacagcatcagatgcatgaccgtggtgcacgacaaggtgtggtgcggctacagaaacaagatctacgtggtgcagcccaaggccatgaagatcgagaagagcttcgacgcccaccccagaaaggagagccaggtgagacagctggcctgggtgggcgacggcgtgtgggtgagcatcagactggacagcaccctgagactgtaccacgcccacacctaccagcacctgcaggacgtggacatcgagccctacgtgagcaagatgctgggcaccggcaagctgggcttcagcttcgtgagaatcaccgccctgatggtgagctgcaacagactgtgggtgggcaccggcaacggcgtgatcatcagcatccccctgaccgagaccaacaagaccagcggcgtgcccggcaacagacccggcagcgtgatcagagtgtacggcgacgagaacagcgacaaggtgacccccggcaccttcatcccctactgcagcatggcccacgcccagctgtgcttccacggccacagagacgccgtgaagttcttcgtggccgtgcccggccaggtgatcagcccccagagcagcagcagcggcaccgacctgaccggcgacaaggccggccccagcgcccaggagcccggcagccagacccccctgaagagcatgctggtgatcagcggcggcgagggctacatcgacttcagaatgggcgacgagggcggcgagagcgagctgctgggcgaggacctgcccctggagcccagcgtgaccaaggccgagagaagccacctgatcgtgtggcaggtgatgtacggcaacgagtag

SEQ ID NO: 100574 - DNA, 3534 bp, Artificial Sequence
  Description of Artificial Sequence: Synthetic coding sequence
atgagccccggctgcatgctgctgttcgtgttcggcttcgtgggcggcgccgtggtgatcaacagcgccatcctggtgagcctgagcgtgctgctgctggtgcacttcagcatcagcaccggcgtgcccgccctgacccagaacctgcccagaatcctgagaaaggagagacccatcagcctgggcatcttccccctgcccgccggcgacggcctgctgacccccgacgcccagaagggcggcgagacccccggcagcgagcagtggaagttccaggagctgagccagcccagaagccacaccagcctgaaggacgagctgagcgacgtgagccagggcggcagcaaggccaccacccccgccagcaccgccaacagcgacgtggccaccatccccaccgacacccccctgaaggaggagaacgagggcttcgtgaaggtgaccgacgcccccaacaagagcgagatcagcaagcacatcgaggtgcaggtggcccaggagaccagaaacgtgagcaccggcagcgccgagaacgaggagaagagcgaggtgcaggccatcatcgagagcacccccgagctggacatggacaaggacctgagcggctacaagggcagcagcacccccaccaagggcatcgagaacaaggccttcgacagaaacaccgagagcctgttcgaggagctgagcagcgccggcagcggcctgatcggcgacgtggacgagggcgccgacctgctgggcatgggcagagaggtggagaacctgatcctggagaacacccagctgctggagaccaagaacgccctgaacatcgtgaagaacgacctgatcgccaaggtggacgagctgacctgcgagaaggacgtgctgcagggcgagctggaggccgtgaagcaggccaagctgaagctggaggagaagaacagagagctggaggaggagctgagaaaggccagagccgaggccgaggacgccagacagaaggccaaggacgacgacgacagcgacatccccaccgcccagagaaagagattcaccagagtggagatggccagagtgctgatggagagaaaccagtacaaggagagactgatggagctgcaggaggccgtgagatggaccgagatgatcagagccagcagagagaaccccgccatgcaggagaagaagagaagcagcatctggcagttcttcagcagactgttcagcagcagcagcaacaccaccaagaagcccgagccccccgtgaacctgaagtacaacgcccccaccagccacgtgacccccagcgtgaagaagagaagcagcaccctgagccagctgcccggcgacaagagcaaggccttcgacttcctgagcgaggagaccgaggccagcctggccagcagaagagagcagaagagagagcagtacagacaggtgaaggcccacgtgcagaaggaggacggcagagtgcaggccttcggctggagcctgccccagaagtacaagcaggtgaccaacggccagggcgagaacaagatgaagaacctgcccgtgcccgtgtacctgagacccctggacgagaaggacaccagcatgaagctgtggtgcgccgtgggcgtgaacctgagcggcggcaagaccagagacggcggcagcgtggtgggcgccagcgtgttctacaaggacgtggccggcctggacaccgagggcagcaagcagagaagcgccagccagagcagcctggacaagctggaccaggagctgaaggagcagcagaaggagctgaagaaccaggaggagctgagcagcctggtgtggatctgcaccagcacccacagcgccaccaaggtgctgatcatcgacgccgtgcagcccggcaacatcctggacagcttcaccgtgtgcaacagccacgtgctgtgcatcgccagcgtgcccggcgccagagagaccgactaccccgccggcgaggacctgagcgagagcggccaggtggacaaggccagcctgtgcggcagcatgaccagcaacagcagcgccgagaccgacagcctgctgggcggcatcaccgtggtgggctgcagcgccgagggcgtgaccggcgccgccaccagccccagcaccaacggcgccagccccgtgatggacaagccccccgagatggaggccgagaacagcgaggtggacgagaacgtgcccaccgccgaggaggccaccgaggccaccgagggcaacgccggcagcgccgaggacaccgtggacatcagccagaccggcgtgtacaccgagcacgtgttcaccgaccccctgggcgtgcagatccccgaggacctgagccccgtgtaccagagcagcaacgacagcgacgcctacaaggaccagatcagcgtgctgcccaacgagcaggacctggtgagagaggaggcccagaagatgagcagcctgctgcccaccatgtggctgggcgcccagaacggctgcctgtacgtgcacagcagcgtggcccagtggagaaagtgcctgcacagcatcaagctgaaggacagcatcctgagcatcgtgcacgtgaagggcatcgtgctggtggccctggccgacggcaccctggccatcttccacagaggcgtggacggccagtgggacctgagcaactaccacctgctggacctgggcagaccccaccacagcatcagatgcatgaccgtggtgcacgacaaggtgtggtgcggctacagaaacaagatctacgtggtgcagcccaaggccatgaagatcgagaagagcttcgacgcccaccccagaaaggagagccaggtgagacagctggcctgggtgggcgacggcgtgtgggtgagcatcagactggacagcaccctgagactgtaccacgcccacacctaccagcacctgcaggacgtggacatcgagccctacgtgagcaagatgctgggcaccggcaagctgggcttcagcttcgtgagaatcaccgccctgatggtgagctgcaacagactgtgggtgggcaccggcaacggcgtgatcatcagcatccccctgaccgagaccgtgatcctgcaccagggcagactgctgggcctgagagccaacaagaccagcggcgtgcccggcaacagacccggcagcgtgatcagagtgtacggcgacgagaacagcgacaaggtgacccccggcaccttcatcccctactgcagcatggcccacgcccagctgtgcttccacggccacagagacgccgtgaagttcttcgtggccgtgcccggccaggtgatcagcccccagagcagcagcagcggcaccgacctgaccggcgacaaggccggccccagcgcccaggagcccggcagccagacccccctgaagagcatgctggtgatcagcggcggcgagggctacatcgacttcagaatgggcgacgagggcggcgagagcgagctgctgggcgaggacctgcccctggagcccagcgtgaccaaggccgagagaagccacctgatcgtgtggcaggtgatgtacggcaacgagtag

SEQ ID NO: 100575 - DNA, 2760 bp, Artificial Sequence
  Description of Artificial Sequence: Synthetic coding sequence
atggtgatgagatggggcgagagaaacgacgtgatcgcctgggagctgctgcaggacggcgtggagaacgccctgaacatcgtgaagaacgacctgatcgccaaggtggacgagctgacctgcgagaaggacgtgctgcagggcgagctggaggccgtgaagcaggccaagctgaagctggaggagaagaacagagagctggaggaggagctgagaaaggccagagccgaggccgaggacgccagacagaaggccaaggacgacgacgacagcgacatccccaccgcccagagaaagagattcaccagagtggagatggccagagtgctgatggagagaaaccagtacaaggagagactgatggagctgcaggaggccgtgagatggaccgagatgatcagagccagcagagagaaccccgccatgcaggagaagaagagaagcagcatctggcagttcttcagcagactgttcagcagcagcagcaacaccaccaagaagcccgagccccccgtgaacctgaagtacaacgcccccaccagccacgtgacccccagcgtgaagaagagaagcagcaccctgagccagctgcccggcgacaagagcaaggccttcgacttcctgagcgaggagaccgaggccagcctggccagcagaagagagcagaagagagagcagtacagacaggtgaaggcccacgtgcagaaggaggacggcagagtgcaggccttcggctggagcctgccccagaagtacaagcaggtgaccaacggccagggcgagaacaagatgaagaacctgcccgtgcccgtgtacctgagacccctggacgagaaggacaccagcatgaagctgtggtgcgccgtgggcgtgaacctgagcggcggcaagaccagagacggcggcagcgtggtgggcgccagcgtgttctacaaggacgtggccggcctggacaccgagggcagcaagcagagaagcgccagccagagcagcctggacaagctggaccaggagctgaaggagcagcagaaggagctgaagaaccaggaggagctgagcagcctggtgtggatctgcaccagcacccacagcgccaccaaggtgctgatcatcgacgccgtgcagcccggcaacatcctggacagcttcaccgtgtgcaacagccacgtgctgtgcatcgccagcgtgcccggcgccagagagaccgactaccccgccggcgaggacctgagcgagagcggccaggtggacaaggccagcctgtgcggcagcatgaccagcaacagcagcgccgagaccgacagcctgctgggcggcatcaccgtggtgggctgcagcgccgagggcgtgaccggcgccgccaccagccccagcaccaacggcgccagccccgtgatggacaagccccccgagatggaggccgagaacagcgaggtggacgagaacgtgcccaccgccgaggaggccaccgaggccaccgagggcaacgccggcagcgccgaggacaccgtggacatcagccagaccggcgtgtacaccgagcacgtgttcaccgaccccctgggcgtgcagatccccgaggacctgagccccgtgtaccagagcagcaacgacagcgacgcctacaaggaccagatcagcgtgctgcccaacgagcaggacctggtgagagaggaggcccagaagatgagcagcctgctgcccaccatgtggctgggcgcccagaacggctgcctgtacgtgcacagcagcgtggcccagtggagaaagtgcctgcacagcatcaagctgaaggacagcatcctgagcatcgtgcacgtgaagggcatcgtgctggtggccctggccgacggcaccctggccatcttccacagaggcgtggacggccagtgggacctgagcaactaccacctgctggacctgggcagaccccaccacagcatcagatgcatgaccgtggtgcacgacaaggtgtggtgcggctacagaaacaagatctacgtggtgcagcccaaggccatgaagatcgagaagagcttcgacgcccaccccagaaaggagagccaggtgagacagctggcctgggtgggcgacggcgtgtgggtgagcatcagactggacagcaccctgagactgtaccacgcccacacctaccagcacctgcaggacgtggacatcgagccctacgtgagcaagatgctgggcaccggcaagctgggcttcagcttcgtgagaatcaccgccctgatggtgagctgcaacagactgtgggtgggcaccggcaacggcgtgatcatcagcatccccctgaccgagaccaacaagaccagcggcgtgcccggcaacagacccggcagcgtgatcagagtgtacggcgacgagaacagcgacaaggtgacccccggcaccttcatcccctactgcagcatggcccacgcccagctgtgcttccacggccacagagacgccgtgaagttcttcgtggccgtgcccggccaggtgatcagcccccagagcagcagcagcggcaccgacctgaccggcgacaaggccggccccagcgcccaggagcccggcagccagacccccctgaagagcatgctggtgatcagcggcggcgagggctacatcgacttcagaatgggcgacgagggcggcgagagcgagctgctgggcgaggacctgcccctggagcccagcgtgaccaaggccgagagaagccacctgatcgtgtggcaggtgatgtacggcaacgagtag

SEQ ID NO: 100576 - DNA, 825 bp, Artificial Sequence
  Description of Artificial Sequence: Synthetic coding sequence
atggagctggaggacggcgtggtgtaccaggaggagcccggcggcagcggcgccgtgatgagcgagagagtgagcggcctggccggcagcatctacagagagttcgagagactgatcggcagatacgacgaggaggtggtgaaggagctgatgcccctggtggtggccgtgctggagaacctggacagcgtgttcgcccaggaccaggagcaccaggtggagctggagctgctgagagacgacaacgagcagctgatcacccagtacgagagagagaaggccctgagaaagcacgccgaggagaagttcatcgagttcgaggacagccaggagcaggagaagaaggacctgcagaccagagtggagagcctggagagccagaccagacagctggagctgaaggccaagaactacgccgaccagagcgccatgagccccggctgcatgctgctgttcgtgttcggcttcgtgggcggcgccgtggtgatcaacagcgccatcctggtgagcctgagcgtgctgctgctggtgcacttcagcatcagcaccggcgtgcccgccctgacccagaacctgcccagaatcctgagaaaggagagacccatcagcctgggcatcttccccctgcccgccggcgacggcctgctgacccccgacgcccagaagggcggcgagacccccggcagcgagcagtggaagttccaggagctgagccagcccagaagccacaccagcctgaaggtgagcaacagccccgagccccagaaggccgtggagcaggaggtgagaatggtgctgctgaacatcctgcagaaggtgtactag

SEQ ID NO: 100577 - DNA, 1053 bp, Artificial Sequence
  Description of Artificial Sequence: Synthetic coding sequence
atgaagcccctggtgctgctggtggccctgctgctgtggcccagcagcgtgcccgcctaccccagcatcaccgtgacccccgacgaggagcagaacctgaaccactacatccaggtgctggagaacctggtgagaagcgtgcccagcggcgagcccggcagagagaagaagagcaacagccccaagcacgtgtacagcatcgccagcaagggcagcaagttcaaggagctggtgacccacggcgacgccagcaccgagaacgacgtgctgaccaaccccatcagcgaggagaccaccaccttccccaccggcggcttcacccccgagatcggcaagaagaagcacaccgagagcacccccttctggagcatcaagcccaacaacgtgagcatcgtgctgcacgccgaggagccctacatcgagaacgaggagcccgagcccgagcccgagcccgccgccaagcagaccgaggcccccagaatgctgcccgtggtgaccgagagcagcaccagcccctacgtgaccagctacaagagccccgtgaccaccctggacaagagcaccggcatcggcatcagcaccgagagcgaggacgtgccccagctgagcggcgagaccgccatcgagaagcccgaggagttcggcaagcaccccgagagctggaacaacgacgacatcctgaagaagatcctggacatcaacagccaggtgcagcaggccctgctgagcgacaccagcaaccccgcctacagagaggacatcgaggccagcaaggaccacctgaagagaagcctggccctggccgccgccgccgagcacaagctgaagaccatgtacaagagccagctgctgcccgtgggcagaaccagcaacaagatcgacgacatcgagaccgtgatcaacatgctgtgcaacagcagaagcaagctgtacgagtacctggacatcaagtgcgtgccccccgagatgagagagaaggccgccaccgtgttcaacaccctgaagaacatgtgcagaagcagaagagtgaccgccctgctgaaggtgtactag

SEQ ID NO: 100578 - DNA, 711 bp, Artificial Sequence
  Description of Artificial Sequence: Synthetic coding sequence
atggccagcagcgtggacgaggaggccctgcaccagctgtacctgtgggtggacaacatccccctgagcagacccaagagaaacctgagcagagacttcagcgacggcgtgctggtggccgaggtgatcaagttctacttccccaagatggtggagatgcacaactacgtgcccgccaacagcctgcagcagaagctgagcaactggggccacctgaacagaaaggtgctgaagagactgaacttcagcgtgcccgacgacgtgatgagaaagatcgcccagtgcgcccccggcgtggtggagctggtgctgatccccctgagacagagactggaggagagacagagaagaagaaagcagggcgccggcagcctgcaggagctggccccccaggacggcagcggctacatggacgtgggcgtgagccagaaggccagaggcgagggcgtgcccgacccccagggcggcggccagctgagctgggacagaccccccgcccccagaccccccgcctacaacagagccctgcagggcgaccccagcttcgtgctgcagatcgccgagaaggagcaggagctgctggccagccaggagaccgtgcaggtgctgcagatgaaggtgagaagactggagcacctgctgcagctgaagaacgtgagaatcgaggacctgagcagaagactgcagcaggccgagagaaagcagagatag

SEQ ID NO: 100579 - DNA, 351 bp, Artificial Sequence
  Description of Artificial Sequence: Synthetic coding sequence
atgtgcgaccagaccaagcacagcaagtgctgccccgccaagggcaaccagtgctgccccccccagcagaaccagtgctgccagagcaagggcaaccagtgctgcccccccaagcagaaccagtgctgccagcccaagggcagccagtgctgcccccccaagcacaaccactgctgccagcccaagcccccctgctgcatccaggccagatgctgcggcctggagaccaagcccgaggtgagccccctgaacatggagagcgagcccaacagcccccagacccaggacaagggctgccagacccagcagcagccccacagcccccagaacgagagcagacccagcaagtag

SEQ ID NO: 100580 - DNA, 294 bp, Artificial Sequence; identical to SEQ ID NO: 100422
  Description of Artificial Sequence: Synthetic coding sequence

SEQ ID NO: 100581 - DNA, 2019 bp, Artificial Sequence
  Description of Artificial Sequence: Synthetic coding sequence
atgagaagcatcagaagcttcgccaacgacgacagacacgtgatggtgaagcacagcaccatctaccccagccccgaggagctggaggccgtgcagaacatggtgagcaccgtggagtgcgccctgaagcacgtgagcgactggctggacgagaccaacaagggcaccaagaccgagggcgagaccgaggtgaagaaggacgaggccggcgagaactacagcaaggaccagggcggcagaaccctgtgcggcgtgatgagaatcggcctggtggccaagggcctgctgatcaaggacgacatggacctggagctggtgctgatgtgcaaggacaagcccaccgagaccctgctgaacaccgtgaaggacaacctgcccatccagatccagaagctgaccgaggagaagtaccaggtggagcagtgcgtgaacgaggccagcatcatcatcagaaacaccaaggagcccaccctgaccctgaaggtgatcctgaccagccccctgatcagagacgagctggagaagaaggacggcgagaacgtgagcatgaaggacccccccgacctgctggacagacagaagtgcctgaacgccctggccagcctgagacacgccaagtggttccaggccagagccaacggcctgaagagctgcgtgatcgtgctgagaatcctgagagacctgtgcaacagagtgcccacctgggcccccctgaagggctggcccctggagctgatctgcgagaagagcatcggcacctgcaacagacccctgggcgccggcgaggccctgagaagagtgatggagtgcctggccagcggcatcctgctgcccggcggccccggcctgcacgacccctgcgagagagaccccaccgacgccctgagctacatgaccatccagcagaaggaggacatcacccacagcgcccagcacgccctgagactgagcgccttcggccagatctacaaggtgctggagatggaccccctgcccagcagcaagcccttccagaagtacagctggagcgtgaccgacaaggagggcgccggcagcagcgccctgaagagacccttcgaggacggcctgggcgacgacaaggaccccaacaagaagatgaagagaaacctgagaaagatcctggacagcaaggccatcgacctgatgaacgccctgatgagactgaaccagatcagacccggcctgcagtacaagctgctgagccagagcggccccgtgcacgcccccgtgttcaccatgagcgtggacgtggacggcaccacctacgaggccagcggccccagcaagaagaccgccaagctgcacgtggccgtgaaggtgctgcaggccatgggctaccccaccggcttcgacgccgacatcgagtgcatgagcagcgacgagaagagcgacaacgagagcaagaacgagaccgtgagcagcaacagcagcaacaacaccggcaacagcaccaccgagaccagcagcaccctggaggtgagaacccagggccccatcctgaccgccagcggcaagaaccccgtgatggagctgaacgagaagagaagaggcctgaagtacgagctgatcagcgagaccggcggcagccacgacaagagattcgtgatggaggtggaggtggacggccagaagttcagaggcgccggccccaacaagaaggtggccaaggccagcgccgccctggccgccctggagaagctgttcagcggccccaacgccgccaacaacaagaagaagaagatcatcccccaggccaagggcgtggtgaacaccgccgtgagcgccgccgtgcaggccgtgagaggcagaggcagaggcaccctgaccagaggcgccttcgtgggcgccaccgccgcccccggctacatcgcccccggctacggcaccccctacggctacagcaccgccgcccccgcctacggcctgcccaagagaatggtgctgctgcccgtgatgaagttccccacctaccccgtgccccactacagcttcttctag

SEQ ID NO: 100582 - DNA, 1977 bp, Artificial Sequence
  Description of Artificial Sequence: Synthetic coding sequence
atggtgaagcacagcaccatctaccccagccccgaggagctggaggccgtgcagaacatggtgagcaccgtggagtgcgccctgaagcacgtgagcgactggctggacgagaccaacaagggcaccaagaccgagggcgagaccgaggtgaagaaggacgaggccggcgagaactacagcaaggaccagggcggcagaaccctgtgcggcgtgatgagaatcggcctggtggccaagggcctgctgatcaaggacgacatggacctggagctggtgctgatgtgcaaggacaagcccaccgagaccctgctgaacaccgtgaaggacaacctgcccatccagatccagaagctgaccgaggagaagtaccaggtggagcagtgcgtgaacgaggccagcatcatcatcagaaacaccaaggagcccaccctgaccctgaaggtgatcctgaccagccccctgatcagagacgagctggagaagaaggacggcgagaacgtgagcatgaaggacccccccgacctgctggacagacagaagtgcctgaacgccctggccagcctgagacacgccaagtggttccaggccagagccaacggcctgaagagctgcgtgatcgtgctgagaatcctgagagacctgtgcaacagagtgcccacctgggcccccctgaagggctggcccctggagctgatctgcgagaagagcatcggcacctgcaacagacccctgggcgccggcgaggccctgagaagagtgatggagtgcctggccagcggcatcctgctgcccggcggccccggcctgcacgacccctgcgagagagaccccaccgacgccctgagctacatgaccatccagcagaaggaggacatcacccacagcgcccagcacgccctgagactgagcgccttcggccagatctacaaggtgctggagatggaccccctgcccagcagcaagcccttccagaagtacagctggagcgtgaccgacaaggagggcgccggcagcagcgccctgaagagacccttcgaggacggcctgggcgacgacaaggaccccaacaagaagatgaagagaaacctgagaaagatcctggacagcaaggccatcgacctgatgaacgccctgatgagactgaaccagatcagacccggcctgcagtacaagctgctgagccagagcggccccgtgcacgcccccgtgttcaccatgagcgtggacgtggacggcaccacctacgaggccagcggccccagcaagaagaccgccaagctgcacgtggccgtgaaggtgctgcaggccatgggctaccccaccggcttcgacgccgacatcgagtgcatgagcagcgacgagaagagcgacaacgagagcaagaacgagaccgtgagcagcaacagcagcaacaacaccggcaacagcaccaccgagaccagcagcaccctggaggtgagaacccagggccccatcctgaccgccagcggcaagaaccccgtgatggagctgaacgagaagagaagaggcctgaagtacgagctgatcagcgagaccggcggcagccacgacaagagattcgtgatggaggtggaggtggacggccagaagttcagaggcgccggccccaacaagaaggtggccaaggccagcgccgccctggccgccctggagaagctgttcagcggccccaacgccgccaacaacaagaagaagaagatcatcccccaggccaagggcgtggtgaacaccgccgtgagcgccgccgtgcaggccgtgagaggcagaggcagaggcaccctgaccagaggcgccttcgtgggcgccaccgccgcccccggctacatcgcccccggctacggcaccccctacggctacagcaccgccgcccccgcctacggcctgcccaagagaatggtgctgctgcccgtgatgaagttccccacctaccccgtgccccactacagcttcttctag

SEQ ID NO: 100583 - DNA, 285 bp, Artificial Sequence
  Description of Artificial Sequence: Synthetic coding sequence
atgagaagcatcagaagcttcgccaacgacgacagacacgtgatggtgaagcacagcaccatctaccccagccccgaggagctggaggccgtgcagaacatggtgagcaccgtggagtgcgccctgaagcacgtgagcgactggctggacgagaccaacaagggcaccaagaccgagggcgagaccgaggtgaagaaggacgaggccggcgagaactacagcaagtggagcgacatcgtgtggtgcaacgaggactggcccggctgcaagagactggccgactag

SEQ ID NO: 100584 - DNA, 2019 bp, Artificial Sequence; identical to SEQ ID NO: 100581
  Description of Artificial Sequence: Synthetic coding sequence

SEQ ID NO: 100585 - DNA, 225 bp, Artificial Sequence
  Description of Artificial Sequence: Synthetic coding sequence
atgagaagcatcagaagcttcgccaacgacgacagacacgtgatggtgaagcacagcaccatctaccccagccccgaggagctggaggccgtgcagaacatggtgagcaccgtggagtgcgccctgaagcacgtgagcgactggctggacgagaccaacaagggcaccaagaccgagggcgagaccgaggtgaagaaggacgaggccggcgagaactacagctag

SEQ ID NO: 100586 - DNA, 1776 bp, Artificial Sequence
  Description of Artificial Sequence: Synthetic coding sequence
atgagcctgctgaccaactacgagggcctgagacaccagatcgagagactggtgagagagaacgaggagctgaagaagctggtgagactgatcagagagaaccacgagctgaagagcgccatcaagacccaggccggcggcctgggcatcagcggcttcaccagcggcctgggcgaggccaccgccggcctgagcagcagacagaacaacggcgtgttcctgccccccagccccgccgtggccaacgagagagtgctggaggaggtgggcatcatggccctggcccccctggccgagatgctgaccagcctgcagcccagcgccacccccggcagcctgatgagccccctgaccggcaccctgagcaccctgctgagcggccccgcccccaccagccagagcagccccctgaccagcttcctgaccagccccatcgccggccccctgaccggcaccctggccagcagcctgggcctgcccagcaccggcaccctgacccccagcagcctggtggccggccccgtggccatgagccagagcagccccctgatcgcccccgtgatgggcaccgtggccgtgagcctgagcagccccctgctgagcagcaccgccaccccccccggcgtgagccagaacctgctggccaaccccatgagcaacctggtgctgcccgaggcccccagactgagactggccgagcccctgagaggcggccccaccggcccccagagccccgcctgcgtggtgcccaccgccaccaccaaggtgcccctgagcaccgagcccccccagagcacccaggaccccgagcccctgagcatggccttcgccggcgcccccctgcagaccagcacccccatcggcgccatgggcacccccgcccccaagaccgccttcagcttcaacaccagcgacacccaggcccagcccagcgccgcccaggagcaggtggtgcccgccagcgtgcccaccagccccaccaccagccccaccgtgaccgtgctggccagcgcccccgccctggccccccaggtggccaccagctacacccccagcagcaccacccacatcgcccagggcgccccccacccccccagcagaatgcacaacagccccacccagaacctgcccgtgccccactgccccccccacaacgcccacagcccccccagaaccagcagcagccccgccagcgtgaacgacagcagaggccccagaaccaccgagcccagcaccaagagcatgatggaggtggagagaaagctggcccacagaaagaccagcaagttccccgagaaccccagagagagcaagcagctggcctgggagagactggtgggcgagatcgccttccagctggacagaagaatcctgagcagcatcttccccgagagagtgagactgtacggcttcaccgtgagcaacatccccgagaagatcatccaggccagcctgaaccccagcgaccacaagctggacgagaagctgtgccagagactgacccagagatacgtgagcgtgatgaacagactgcagagcctgggctacaacggcagagtgcaccccgccctgaccgagcagctggtgaacgcctacggcatcctgagagagagacccgagctggccgccagcgagggcggcccctacaccgtggacttcctgcagagagtggtggtggagaccgtgcaccccggcatgctggccgacgccctgctgctgctgagctgcctgagccagctggcccacgacgacggcaagcccatgttcatctggtag

SEQ ID NO: 100587 - DNA, 1326 bp, Artificial Sequence
  Description of Artificial Sequence: Synthetic coding sequence
atgagcctgctgaccaactacgagggcctgagacaccagatcgagagactggtgagagagaacgaggagctgaagaagctggtgagactgatcagagagaaccacgagctgaagagcgccatcaagacccaggccggcggcctgggcatcagcggcttcaccagcggcctgggcgaggccaccgccggcctgagcagcagacagaacaacggcgtgttcctgccccccagccccgccgtggccaacgagagagtgctggaggaggtgggcatcatggccctggcccccctggccgagatgctgaccagcctgcagcccagcgccacccccggcagcctgatgagccccctgaccggcaccctgagcaccctgctgagcggccccgcccccaccagccagagcagccccctgaccagcttcctgaccagccccatcgccggccccctgaccggcaccctggccagcagcctgggcctgcccagcaccggcaccctgacccccagcagcctggtggccggccccgtggccatgagccagagcagccccctgatcgcccccgtgatgggcaccgtggccgtgagcctgagcagccccctgctgagcagcaccgccaccccccccggcgtgagccagaacctgctggccaaccccatgagcaacctggtgctgcccgaggcccccagactgagactggccgagcccctgagaggcggccccaccggcccccagagccccgcctgcgtggtgcccaccgccaccaccaaggtgcccctgagcaccgagcccccccagagcacccaggaccccgagcccctgagcatggccttcgccggcgcccccctgcagaccagcacccccatcggcgccatgggcacccccgcccccaagaccgccttcagcttcaacaccagcgacacccaggcccagcccagcgccgcccaggagcaggtggtgcccgccagcgtgcccaccagccccaccaccagccccaccgtgaccgtgctggccagcgcccccgccctggccccccaggtggccaccagctacacccccagcagcaccacccacatcgcccagggcgccccccacccccccagcagaatgcacaacagccccacccagaacctgcccgtgccccactgccccccccacaacgcccacagcccccccagaaccagcagcagccccgccagcgtgaacgacagcagaggccccagaaccaccgagcccagcaccaagagcatgatggaggtggagagaaagctggcccacagaaagaccagcaagttccccgagaaccccagaggcttccccgagccccagtag

SEQ ID NO: 100588 - DNA, 573 bp, Artificial Sequence
  Description of Artificial Sequence: Synthetic coding sequence
atgagcagcagcgccctgacctgcggcagcaccctggagaagagcggcgacacctgggagatgaaggccctggacagcagcagactggtgccctggccccccagaggcctgggcagcagcacccagcaccccaacaagccccactgcgccctggccagctgccagggccccggcgtgctgcccggcgccgccagcgccctgcccgagctgaccttccagggcgacgtgtgccagagcgagacctgccagagatacctgcaggccgccatcagcctggacatcgccgtgagccagatcaacctgctgggcagacccagcagcccccccgccctgctgatccagcagggcagctgcgagcaggtgatccacaacagcaccccccagttcctgggcatggaggacggcgacaacgagagaaccaccggctggctgtggagactgtgcgaggacatcgacgccgagcccagcagcaccggctgcagcagaagcaaccagctgaccttcaccgagggctgcttcgtgagaagcctgagcaccgtgtacagcaacacccacatccacacccacctgtag

SEQ ID NO: 100589 - DNA, 1791 bp, Artificial Sequence
  Description of Artificial Sequence: Synthetic coding sequence
atgggcttcatcatccacatccagcaggtgaagaagcagagaaagaagctggaccagggcctgatcctgaagaaggagaagtacagaaaggagaagaagtgcgccagcctgagcttcgaggtgagcagcgacggcggcaccgagcccagcgccctggtggacgacaacggcagcgaggaggacttcagctacgaggacctgtgccaggccagccccagatacctgcagcccggcggcgagcagctggccatcaacgagctgatcagcgacggcaacgtggtgtgcgccgaggccctgtgggaccacgtgaccatggacgaccaggagctgggcttcaaggccggcgacgtgatccaggtgctggaggccagcaacaaggactggtggtggggcagaagcgaggacaaggaggcctggttccccgccagcttcgtgagactgagagtgaaccaggaggagctgagcgagaacagcagcagcacccccagcgaggagcaggacgaggaggccagccagagcagacacagacactgcgagaacaagcagcagatgagaaccaacgtgatcagagagatcatggacaccgagagagtgtacatcaagcacctgagagacatctgcgagggctacatcagacagtgcagaaagcacaccggcatgttcaccgtggcccagctggccaccatcttcggcaacatcgaggacatctacaagttccagagaaagttcctgaaggacctggagaagcagtacaacaaggaggagccccacctgagcgagatcggcagctgcttcctgcagaaccaggagggcttcgccatctacagcgagtactgcaacaaccaccccggcgcctgcctggagctggccaacctgatgaagcagggcaagtacagacacttcttcgaggcctgcagactgctgcagcagatgatcgacatcgccatcgacggcttcctgctgacccccgtgcagaagatctgcaagtaccccctgcagctggccgagctgctgaagtacaccacccaggagcacggcgactacagcaacatcaaggccgcctacgaggccatgaagaacgtggcctgcctgatcaacgagagaaagagaaagctggagagcatcgacaagatcgccagatggcaggtgagcatcgtgggctgggagggcctggacatcctggacagaagcagcgagctgatccacagcggcgagctgaccaagatcaccaagcagggcaagagccagcagagaaccttcttcctgttcgaccaccagctggtgagctgcaagaaggacctgctgagaagagacatgctgtactacaagggcagactggacatggacgagatggagctggtggacctgggcgacggcagagacaaggactgcaacctgagcgtgaagaacgccttcaagctggtgagcagaaccaccgacgaggtgtacctgttctgcgccaagaagcaggaggacaaggccagatggctgcaggcctgcgccgacgagagaagaagagtgcaggaggacaaggagatgggcatggagatcagcgagaaccagaagaagctggccatgctgaacgcccagaaggccggccacggcaagagcaagggctacaacagatgccccgtggcccccccccaccagggcctgcaccccatccaccagagacacatcaccatgcccaccagcgtgccccagcagcaggtgttcggcctggccgagcccaagagaaagagcagcctgttctggcacaccttcaacagactgacccccttcagaaagtag

SEQ ID NO: 100590 - DNA, 1959 bp, Artificial Sequence
  Description of Artificial Sequence: Synthetic coding sequence
atgaccagcgccagccccgaggaccagaacgcccccgtgggctgccccaagggcgccagaagaagaagacccatcagcgtgatcggcggcgtgagcctgtacggcaccaaccagaccgaggagctggacaacctgctgacccagcccgccagcagaccccccatgcccgcccaccaggtgcccccctacaaggccgtgagcgccagattcagacccttcaccttcagccagagcacccccatcggcctggacagagtgggcagaagaagacagatgagagccagcaacgtgagcagcgacggcggcaccgagcccagcgccctggtggacgacaacggcagcgaggaggacttcagctacgaggacctgtgccaggccagccccagatacctgcagcccggcggcgagcagctggccatcaacgagctgatcagcgacggcaacgtggtgtgcgccgaggccctgtgggaccacgtgaccatggacgaccaggagctgggcttcaaggccggcgacgtgatccaggtgctggaggccagcaacaaggactggtggtggggcagaagcgaggacaaggaggcctggttccccgccagcttcgtgagactgagagtgaaccaggaggagctgagcgagaacagcagcagcacccccagcgaggagcaggacgaggaggccagccagagcagacacagacactgcgagaacaagcagcagatgagaaccaacgtgatcagagagatcatggacaccgagagagtgtacatcaagcacctgagagacatctgcgagggctacatcagacagtgcagaaagcacaccggcatgttcaccgtggcccagctggccaccatcttcggcaacatcgaggacatctacaagttccagagaaagttcctgaaggacctggagaagcagtacaacaaggaggagccccacctgagcgagatcggcagctgcttcctgcagaaccaggagggcttcgccatctacagcgagtactgcaacaaccaccccggcgcctgcctggagctggccaacctgatgaagcagggcaagtacagacacttcttcgaggcctgcagactgctgcagcagatgatcgacatcgccatcgacggcttcctgctgacccccgtgcagaagatctgcaagtaccccctgcagctggccgagctgctgaagtacaccacccaggagcacggcgactacagcaacatcaaggccgcctacgaggccatgaagaacgtggcctgcctgatcaacgagagaaagagaaagctggagagcatcgacaagatcgccagatggcaggtgagcatcgtgggctgggagggcctggacatcctggacagaagcagcgagctgatccacagcggcgagctgaccaagatcaccaagcagggcaagagccagcagagaaccttcttcctgttcgaccaccagctggtgagctgcaagaaggacctgctgagaagagacatgctgtactacaagggcagactggacatggacgagatggagctggtggacctgggcgacggcagagacaaggactgcaacctgagcgtgaagaacgccttcaagctggtgagcagaaccaccgacgaggtgtacctgttctgcgccaagaagcaggaggacaaggccagatggctgcaggcctgcgccgacgagagaagaagagtgcaggaggacaaggagatgggcatggagatcagcgagaaccagaagaagctggccatgctgaacgcccagaaggccggccacggcaagagcaagggctacaacagatgccccgtggcccccccccaccagggcctgcaccccatccaccagagacacatcaccatgcccaccagcgtgccccagcagcaggtgttcggcctggccgagcccaagagaaagagcagcctgttctggcacaccttcaacagactgacccccttcagaaagtag

SEQ ID NO: 100591 - DNA, 3834 bp, Artificial Sequence
  Description of Artificial Sequence: Synthetic coding sequence
atgacccaggccgccgtgagaccctgggccccctgcctggagaacatgaccaccgcccccaacggcctgggccccggccccgccgccccctgcgccggcagcgacctgaaggacgccaagatggtgaccagcctggcctgcggcaacggcgtgtgcggctgcagccccggcggcgacaccgacacccaggaggccaagctgagccccgccaagctggtgagactgttcagcaccagcagaaagagaaccggcgcccaccccgagagaccccacagcatggtgctggtgggcaacagcagcacctggaacaccctggccagcttcagaaagatgggcagcttcaagaagctgaagagcagcgtgctgaagggcatccagagcagagagggcagcaacgcctgcagcaagggcgaggccagcgagcacggcctgggcaagagcatccccaacggcgccgtgcccggcgcccaggccagcagaggcagccccctggcccccggccccgcctgcggcgccctgagacccgccgagtggggcaccctggacggcagcgacctggaggacaccgacgacgccttccagagaagcacccacagaagcagaagcctgagaagagcctacggcctgggcagaatctgcctgctggacgccccccagaaccacgccacccccaccatcgccaccggccaggtgcccgccgtgtgcgagatcctggtgagagaccccgagaacaacagcatgggctacagaagaagcaagagcaccgacaacctggccttcctgaagaagagcagcttcaagagaaagagcaccagcaacctggccgacctgagaaccgcccacgacgccagagtgccccagagaaccctgagcagcagcagcaccgacagccagaagctgggcagcggcagaaccaagagatggagaagccccatcagagccaaggacttcgacagagtgttcaagctggtgagcaacgtgaccgaggccgcctggagaagagagagccccagaagcggcgcccccagccccggcgaggccagcctgagactgcaggcccacagcagactgcacgacgactacagcagaagagtgagcagaagcaccgagcaggacagcagaagaggcggcgccgtgatgcacggcaccaccgccacctgcaccgtggcccccggcttcggcagcgccaccagcaagggcccccacctggacgccgacaccgccgtgttccccctggagaccaagagcagctgggccgtggagagcgacagcagctgcacctgcagcagcctgcccagccccatcgtgcaggacgtgctgagcaaggacagctgcgaccccaacgccggcagccagctgaccttcgaccccgagcagccccccacccccctgagacccaccacccccaagccccagagcccccagagcccccagagccccggcgccggcagcgccagctgccacagcaaccacagcgccctgagcgccaacagcgaggagagcgagggcagagccgaggagcccgcccagagagagcccggccccgtgagcctgcaggaccccctggaggccacccacggcgacgagggcagcaaggacctgctggtgaacatcggcgtggccgccggccccgaggagaaggagaaggaggaggtggtgcccgacggcccctggagaagaagcagcagccaggacgaggagagaaccgaggcccagagaacccccaagagaagatggggcagcggcagaagacccagacccagacccttcagcgactacggccagctggccagcagaagcctgagcatccccgaggacagcgtggccgccgacccccagaaggaggacagagtggacgaggacccccaggccagcatgaccagcgccagccccgaggaccagaacgcccccgtgggctgccccaagggcgccagaagaagaagacccatcagcgtgatcggcggcgtgagcctgtacggcaccaaccagaccgaggagctggacaacctgctgacccagcccgccagcagaccccccatgcccgcccaccaggtgcccccctacaaggccgtgagcgccagattcagacccttcaccttcagccagagcacccccatcggcctggacagagtgggcagaagaagacagatgagagccagcaacgtgagcagcgacggcggcaccgagcccagcgccctggtggacgacaacggcagcgaggaggacttcagctacgaggacctgtgccaggccagccccagatacctgcagcccggcggcgagcagctggccatcaacgagctgatcagcgacggcaacgtggtgtgcgccgaggccctgtgggaccacgtgaccatggacgaccaggagctgggcttcaaggccggcgacgtgatccaggtgctggaggccagcaacaaggactggtggtggggcagaagcgaggacaaggaggcctggttccccgccagcttcgtgagactgagagtgaaccaggaggagctgagcgagaacagcagcagcacccccagcgaggagcaggacgaggaggccagccagagcagacacagacactgcgagaacaagcagcagatgagaaccaacgtgatcagagagatcatggacaccgagagagtgtacatcaagcacctgagagacatctgcgagggctacatcagacagtgcagaaagcacaccggcatgttcaccgtggcccagctggccaccatcttcggcaacatcgaggacatctacaagttccagagaaagttcctgaaggacctggagaagcagtacaacaaggaggagccccacctgagcgagatcggcagctgcttcctgcagaaccaggagggcttcgccatctacagcgagtactgcaacaaccaccccggcgcctgcctggagctggccaacctgatgaagcagggcaagtacagacacttcttcgaggcctgcagactgctgcagcagatgatcgacatcgccatcgacggcttcctgctgacccccgtgcagaagatctgcaagtaccccctgcagctggccgagctgctgaagtacaccacccaggagcacggcgactacagcaacatcaaggccgcctacgaggccatgaagaacgtggcctgcctgatcaacgagagaaagagaaagctggagagcatcgacaagatcgccagatggcaggtgagcatcgtgggctgggagggcctggacatcctggacagaagcagcgagctgatccacagcggcgagctgaccaagatcaccaagcagggcaagagccagcagagaaccttcttcctgttcgaccaccagctggtgagctgcaagaaggacctgctgagaagagacatgctgtactacaagggcagactggacatggacgagatggagctggtggacctgggcgacggcagagacaaggactgcaacctgagcgtgaagaacgccttcaagctggtgagcagaaccaccgacgaggtgtacctgttctgcgccaagaagcaggaggacaaggccagatggctgcaggcctgcgccgacgagagaagaagagtgcaggaggacaaggagatgggcatggagatcagcgagaaccagaagaagctggccatgctgaacgcccagaaggccggccacggcaagagcaagggctacaacagatgccccgtggcccccccccaccagggcctgcaccccatccaccagagacacatcaccatgcccaccagcgtgccccagcagcaggtgttcggcctggccgagcccaagagaaagagcagcctgttctggcacaccttcaacagactgacccccttcagaaagtag

SEQ ID NO: 100592 - DNA, 3948 bp, Artificial Sequence
  Description of Artificial Sequence: Synthetic coding sequence
tgacccgtggccacccaggagcccgacgtgcagggcagatgcgagtgccaggacggcatccccggcgacgagggcctggagctgagaagcgccgacagcgccgtgcccgtggccatgacccaggccgccgtgagaccctgggccccctgcctggagaacatgaccaccgcccccaacggcctgggccccggccccgccgccccctgcgccggcagcgacctgaaggacgccaagatggtgaccagcctggcctgcggcaacggcgtgtgcggctgcagccccggcggcgacaccgacacccaggaggccaagctgagccccgccaagctggtgagactgttcagcaccagcagaaagagaaccggcgcccaccccgagagaccccacagcatggtgctggtgggcaacagcagcacctggaacaccctggccagcttcagaaagatgggcagcttcaagaagctgaagagcagcgtgctgaagggcatccagagcagagagggcagcaacgcctgcagcaagggcgaggccagcgagcacggcctgggcaagagcatccccaacggcgccgtgcccggcgcccaggccagcagaggcagccccctggcccccggccccgcctgcggcgccctgagacccgccgagtggggcaccctggacggcagcgacctggaggacaccgacgacgccttccagagaagcacccacagaagcagaagcctgagaagagcctacggcctgggcagaatctgcctgctggacgccccccagaaccacgccacccccaccatcgccaccggccaggtgcccgccgtgtgcgagatcctggtgagagaccccgagaacaacagcatgggctacagaagaagcaagagcaccgacaacctggccttcctgaagaagagcagcttcaagagaaagagcaccagcaacctggccgacctgagaaccgcccacgacgccagagtgccccagagaaccctgagcagcagcagcaccgacagccagaagctgggcagcggcagaaccaagagatggagaagccccatcagagccaaggacttcgacagagtgttcaagctggtgagcaacgtgaccgaggccgcctggagaagagagagccccagaagcggcgcccccagccccggcgaggccagcctgagactgcaggcccacagcagactgcacgacgactacagcagaagagtgagcagaagcaccgagcaggacagcagaagaggcggcgccgtgatgcacggcaccaccgccacctgcaccgtggcccccggcttcggcagcgccaccagcaagggcccccacctggacgccgacaccgccgtgttccccctggagaccaagagcagctgggccgtggagagcgacagcagctgcacctgcagcagcctgcccagccccatcgtgcaggacgtgctgagcaaggacagctgcgaccccaacgccggcagccagctgaccttcgaccccgagcagccccccacccccctgagacccaccacccccaagccccagagcccccagagcccccagagccccggcgccggcagcgccagctgccacagcaaccacagcgccctgagcgccaacagcgaggagagcgagggcagagccgaggagcccgcccagagagagcccggccccgtgagcctgcaggaccccctggaggccacccacggcgacgagggcagcaaggacctgctggtgaacatcggcgtggccgccggccccgaggagaaggagaaggaggaggtggtgcccgacggcccctggagaagaagcagcagccaggacgaggagagaaccgaggcccagagaacccccaagagaagatggggcagcggcagaagacccagacccagacccttcagcgactacggccagctggccagcagaagcctgagcatccccgaggacagcgtggccgccgacccccagaaggaggacagagtggacgaggacccccaggccagcatgaccagcgccagccccgaggaccagaacgcccccgtgggctgccccaagggcgccagaagaagaagacccatcagcgtgatcggcggcgtgagcctgtacggcaccaaccagaccgaggagctggacaacctgctgacccagcccgccagcagaccccccatgcccgcccaccaggtgcccccctacaaggccgtgagcgccagattcagacccttcaccttcagccagagcacccccatcggcctggacagagtgggcagaagaagacagatgagagccagcaacgtgagcagcgacggcggcaccgagcccagcgccctggtggacgacaacggcagcgaggaggacttcagctacgaggacctgtgccaggccagccccagatacctgcagcccggcggcgagcagctggccatcaacgagctgatcagcgacggcaacgtggtgtgcgccgaggccctgtgggaccacgtgaccatggacgaccaggagctgggcttcaaggccggcgacgtgatccaggtgctggaggccagcaacaaggactggtggtggggcagaagcgaggacaaggaggcctggttccccgccagcttcgtgagactgagagtgaaccaggaggagctgagcgagaacagcagcagcacccccagcgaggagcaggacgaggaggccagccagagcagacacagacactgcgagaacaagcagcagatgagaaccaacgtgatcagagagatcatggacaccgagagagtgtacatcaagcacctgagagacatctgcgagggctacatcagacagtgcagaaagcacaccggcatgttcaccgtggcccagctggccaccatcttcggcaacatcgaggacatctacaagttccagagaaagttcctgaaggacctggagaagcagtacaacaaggaggagccccacctgagcgagatcggcagctgcttcctgcagaaccaggagggcttcgccatctacagcgagtactgcaacaaccaccccggcgcctgcctggagctggccaacctgatgaagcagggcaagtacagacacttcttcgaggcctgcagactgctgcagcagatgatcgacatcgccatcgacggcttcctgctgacccccgtgcagaagatctgcaagtaccccctgcagctggccgagctgctgaagtacaccacccaggagcacggcgactacagcaacatcaaggccgcctacgaggccatgaagaacgtggcctgcctgatcaacgagagaaagagaaagctggagagcatcgacaagatcgccagatggcaggtgagcatcgtgggctgggagggcctggacatcctggacagaagcagcgagctgatccacagcggcgagctgaccaagatcaccaagcagggcaagagccagcagagaaccttcttcctgttcgaccaccagctggtgagctgcaagaaggacctgctgagaagagacatgctgtactacaagggcagactggacatggacgagatggagctggtggacctgggcgacggcagagacaaggactgcaacctgagcgtgaagaacgccttcaagctggtgagcagaaccaccgacgaggtgtacctgttctgcgccaagaagcaggaggacaaggccagatggctgcaggcctgcgccgacgagagaagaagagtgcaggaggacaaggagatgggcatggagatcagcgagaaccagaagaagctggccatgctgaacgcccagaaggccggccacggcaagagcaagggctacaacagatgccccgtggcccccccccaccagggcctgcaccccatccaccagagacacatcaccatgcccaccagcgtgccccagcagcaggtgttcggcctggccgagcccaagagaaagagcagcctgttctggcacaccttcaacagactgacccccttcagaaagtag

SEQ ID NO: 100593 - DNA, 1851 bp, Artificial Sequence
  Description of Artificial Sequence: Synthetic coding sequence
atgcccgcccaccaggtgcccccctacaaggccgtgagcgccagattcagacccttcaccttcagccagagcacccccatcggcctggacagagtgggcagaagaagacagatgagagccagcaacgtgagcagcgacggcggcaccgagcccagcgccctggtggacgacaacggcagcgaggaggacttcagctacgaggacctgtgccaggccagccccagatacctgcagcccggcggcgagcagctggccatcaacgagctgatcagcgacggcaacgtggtgtgcgccgaggccctgtgggaccacgtgaccatggacgaccaggagctgggcttcaaggccggcgacgtgatccaggtgctggaggccagcaacaaggactggtggtggggcagaagcgaggacaaggaggcctggttccccgccagcttcgtgagactgagagtgaaccaggaggagctgagcgagaacagcagcagcacccccagcgaggagcaggacgaggaggccagccagagcagacacagacactgcgagaacaagcagcagatgagaaccaacgtgatcagagagatcatggacaccgagagagtgtacatcaagcacctgagagacatctgcgagggctacatcagacagtgcagaaagcacaccggcatgttcaccgtggcccagctggccaccatcttcggcaacatcgaggacatctacaagttccagagaaagttcctgaaggacctggagaagcagtacaacaaggaggagccccacctgagcgagatcggcagctgcttcctgcagaaccaggagggcttcgccatctacagcgagtactgcaacaaccaccccggcgcctgcctggagctggccaacctgatgaagcagggcaagtacagacacttcttcgaggcctgcagactgctgcagcagatgatcgacatcgccatcgacggcttcctgctgacccccgtgcagaagatctgcaagtaccccctgcagctggccgagctgctgaagtacaccacccaggagcacggcgactacagcaacatcaaggccgcctacgaggccatgaagaacgtggcctgcctgatcaacgagagaaagagaaagctggagagcatcgacaagatcgccagatggcaggtgagcatcgtgggctgggagggcctggacatcctggacagaagcagcgagctgatccacagcggcgagctgaccaagatcaccaagcagggcaagagccagcagagaaccttcttcctgttcgaccaccagctggtgagctgcaagaaggacctgctgagaagagacatgctgtactacaagggcagactggacatggacgagatggagctggtggacctgggcgacggcagagacaaggactgcaacctgagcgtgaagaacgccttcaagctggtgagcagaaccaccgacgaggtgtacctgttctgcgccaagaagcaggaggacaaggccagatggctgcaggcctgcgccgacgagagaagaagagtgcaggaggacaaggagatgggcatggagatcagcgagaaccagaagaagctggccatgctgaacgcccagaaggccggccacggcaagagcaaggtgagactgcagcaggtgccctgcggccccaccgcccccggccccgccccccacccccccgccccccaccactacgcccacaagagaccccccgccgccggcctgtggcccggcggcacccaggaggaggtgctggccctgctggcccacctgcagcaggcccaccccctgcccgagatgaagaccggcggctgcgccagcatggagctgggcgtgaagagaagaaactag

SEQ ID NO: 100594 - DNA, 1710 bp, Artificial Sequence
  Description of Artificial Sequence: Synthetic coding sequence
atggacgccggcagcagcagaagcctggagaacgccgtgaacagaatctaccacgaccagctggtgcccaagatcaacaccagcaagaagatgagcaccctggcccacccccccaacatcctggagatgagccaggagatcaagaagaactgcggcggcaagcaggtggagatcaccctggagagaaccaagatgaccaagggcatcaaggagaagcagagcaacgacctggagaaggccgccttcaagagaaaggccgagggcgaggagaagcccaccagaaagaagcaggccaagatcaccgagctggacaaccagctgatcaccatgcccctgccccacatccccctgaagaacatcatggacgtggagatgaagctggtgtacatcgacgagatgggcgtgagatacgagttcgtggagagcttcatgagcaccggcagccagcccacctgccaggccgccgagatcgtggaccccctgagcgtgcacaacttcagcttcctgccccagatcgacaagtggctgcaggtggccctgaaggacgccagcagctgctacagacagaagaagtacgccctggccgccggccagttcagaaccgccctggagctgtgcagcaagggcgccgtgctgggcgagcccttcgacgcccccgccgaggacatcgccagcgtggccagcttcatcgagaccaagctggtgacctgctacctgagaatgagaaagcccgacctggccctgaaccacgcccacagaagcatcgtgctgaaccccgcctacttcagaaaccacctgagacaggccaccgtgttcagatgcctggagagatacagcgaggccgccagaagcgccatgatcgccgactacatgttctggctgggcggcggcagagaggagagcatcagcaagctgatcaagctgtactggcaggccatgatcgaggaggccatcaccagagccgagagcttcagcgtgatgtacacccccttcgccaccaagatcagagccgacaagatcgagaaggtgaaggacgccttcaccaagacccaccccgcctacgccgagtacatgtacaccgacctgcaggccctgcacatgctgccccagaccgtggactggagcagcttccccccccagcagtacctgctgaccctgggcttcaagaacaaggacgacggcaagttcctggagaagatcagcagcagaaagctgcccatcttcaccgagcacaagacccccttcggcctgaccagagaggacaccgtgagacagatggagaccatgggcaagagaatcctgcccatcctggacttcatcagaagcacccagctgaacggcagcttccccgccagcagcggcgtgatggagaagctgcagtacgccagcctgctgagccagctgcagagagtgaaggagcagagccaggtgatcaaccaggccatggccgagctggccaccatcccctacctgcaggacatcagccagcaggaggccgagctgctgcagagcctgatggccgacgccatggacaccctggagggcagaagaaacaacaacgagagagtgtggaacatgatccagaaggtgggccagatcgaggacttcctgtaccagctggaggacagcttcctgaagaccaagaagctgagaaccgccagaagacagaagaccaagatgaagagactgcagaccgtgcagcagagatag

SEQ ID NO: 100595 - DNA, 1086 bp, Artificial Sequence
  Description of Artificial Sequence: Synthetic coding sequence
atggccaccctggccagactgcaggccagaagcagcaccgtgggcaaccagtactacttcagaaacagcgtggtggaccccttcagaaagaaggagaacgacgccgccgtgaagatccagagctggttcagaggctgccaggtgagagcctacatcagacacctgaacagaatcgtgaccatcatccagaagtggtggagaagcttcctgggcagaaagcagtaccagctgaccgtgcaggtggcctactacaccatgatgatgaacctgtacaacgccatggccgtgagaatccagagaagatggagaggctacagagtgagaaagtacctgttcaactactactacctgaaggagtacctgaaggtggtgagcgagaccaacgacgccatcagaaaggccctggaggagttcgccgagatgaaggagagagaggagaagaaggccaacctggagagagaggagaagaagagagactaccaggccagaaagatgcactacctgctgagcaccaagcagatccccggcatctacaacagccccttcagaaaggagcccgacccctgggagctgcagctgcagaaggccaagcccctgacccacagaagacccaaggtgaagcagaaggacagcaccagcctgaccgactggctggcctgcaccagcgccagaagcttccccagaagcgagatcctgccccccatcaacagaaagcagtgccagggccccttcagagacatcaccgaggtgctggagcagagatacagacccctggagcccaccctgagagtggccgagcccatcgacgagctgaagctggccagagaggagctgagaagagaggagtggctgcagaacgtgaacgacaacatgttcctgcccttcagcagctaccacaagaacgagaagtacatccccagcatgcacctgagcagcaagtacggccccatcagctacaaggagcagttcagaagcgagaaccccaagaagtggatctgcgacaaggacttccagaccgtgctgcccagcttcgagctgttcagcaagtacggcaagctgtacagcaaggccggccagatcgtgtag

SEQ ID NO: 100596 - DNA, 1617 bp, Artificial Sequence
  Description of Artificial Sequence: Synthetic coding sequence
atggccgagaacctgaagagactggtgagcaacgagaccctgagaaccctgcaggagaagctggacttctggctgaaggagtacaacaccaacacctgcgaccagaacctgaaccactgcctggagctgatcgagcaggtggccaaggtgcagggccagctgttcggcatcctgaccgccgccgcccaggagggcggcagaaacgacggcgtggagaccatcaagagcagactgctgccctggctggaggccagcttcaccgccgccagcctgggcaagagcgtggacagcaaggtgcccagcctgcaggacaccttcgacagagagagacacaaggaccccagccccagagacagagacatgcagcagctggacagcaacctgaacagcaccagaagccagtgcaaccaggtgcaggacgacctggtggagaccgagaagaacctggaggagagcaagaacagaagcgccatcagcctgctggccgccgaggaggagatcaaccagctgaagaagcagctgaagagcctgcaggcccaggaggacgccagacacagaaacaccgaccagagaagcagcgagaacagaagaagcgagccctggagcctggaggagagaaagagagagcagtggaacagcctgaagcagaacgccgaccagcaggacaccgaggccatgagcgactacaagaagcagctgagaaacctgaaggaggagatcgccgtgctgagcgccgagaagagcgccctgcagggcagaagcagcagaagcagaagccccagccccgcccccagaagcagaagctgcagcagaagcagaagcgccagccccagcaccgccgtgaaggtgagaagacccagccccaacagaagcaagctgagcaacgtggccagaaaggccgccctgctgagcagattcagcgacagctacagccaggccagactggacgcccagtgcctgctgagaagatgcatcgacaaggccgagaccgtgcagagaatcatctacatcgccaccgtggaggccttccacgtggccaagatggccttcagacacttcaagatccacgtgagaaagagcctgacccccagctacgtgggcagcaacgacttcgagaacgccgtgctggactacgtgatctgccacctggacctgtacgacagccagagcagcgtgaacgacgtgatcagagccatgaacgtgaaccccaagatcagcttcccccccgtggtggacttctgcctgctgagcgacttcatccaggagatctgctgcatcgccttcgccatgcaggccctggagccccccctggacatcgcctacggcgccgacggcgaggtgttcaacgactgcaagtacagaagaagctacgacagcgacttcaccgcccccctggtgctgtaccacgtgtggcccgccctgatggagaacgactgcgtgatcatgaagggcgaggccgtgaccagaagaggcgccttctggaacagcgtgagaagcgtgagcagatgcagaagcagaagcctgagccccatctgccccagaagccagatcggcctgaacaccatgagcagaagcagaagccccagccccatcagatgcggcctgcccagattctag

SEQ ID NO: 100597 - DNA, 504 bp, Artificial Sequence
  Description of Artificial Sequence: Synthetic coding sequence
atgatcatcaccacctggatcgtgtacatcctggccagaaagggcgtgggcctgcccttcctgcccatcaccagcagcgacatcgacgtggtggagagcgaggccgtgagcgtgctgcaccactggctgaagaagaccgaggaggaggccagcagaggcatcaaggagaagctgagcatcaaccaccccagccagggcgtgagagagaagatgagcaccgacagcccccccacccacggccaggacatccacgtgaccagagacgtggtgaagcaccacctgagcaagagcgacctgctggccaaccagagccaggaggtgctggaggagagaaccagaatccagttcatcagatggagccacaccagaatcttccaggtgcccagcgagatgaccgaggacatcatgagagacagaatcgagcaggtgagaagaagcatcagcagactgaccgacgtgagcgcccaggacttcagcatgagacccagcagcagcgactgctag

SEQ ID NO: 100598 - DNA, 504 bp, Artificial Sequence; identical to SEQ ID NO: 100597
  Description of Artificial Sequence: Synthetic coding sequence

SEQ ID NO: 100599 - DNA, 1563 bp, Artificial Sequence
  Description of Artificial Sequence: Synthetic coding sequence
atgggcaagcccagcagcatggacaccaagttcaaggacgacctgttcagaaagtacgtgcagttccacgagagcaaggtggacaccaccaccagcagacagagacccggcagcgacgagtgcctgagagtggccgccagcaccctgctgagcctgcacaaggtggaccccttctacagattcagactgatccagttctacgaggtggtggagagcagcctgagaagcctgagcagcagcagcctgagagccctgcacggcgccttcagcatgctggagaccgtgggcatcaacctgttcctgtacccctggaagaaggagttcagaagcatcaagacctacaccggccccttcgtgtactacgtgaagagcaccctgctggaggaggacatcagagccatcctgagctgcatgggctacacccccgagctgggcaccgcctacaagctgagagagctggtggagaccctgcaggtgaagatggtgagcttcgagctgttcctggccaaggtggagtgcgagcagatgctggagatccacagccaggtgaaggacaagggctacagcgagctggacatcgtgagcgagagaaagagcagcgccgaggacgtgagaggctgcagcgacgccctgagaagaagagccgagggcagagagcacctgaccgccagcatgagcagagtggccctgcagaagagcgccagcgagagagccgccaaggactactacaagcccagagtgaccaagcccagcagaagcgtggacgcctacgacagctactgggagagcagaaagccccccctgaaggccagcctgagcctgagaaaggagcccgtggccaccgacgtgggcgacgacctgaaggacgagatcatcagacccagccccagcctgctgaccatggccagcagcccccacggcagccccgacgtgctgccccccgccagccccagcaacggccccgccctgctgagaggcacctacttcagcacccaggacgacgtggacctgtacaccgacagcgagcccagagccacctacagaagacaggacgccctgagacccgacgtgtggctgctgagaaacgacgcccacagcctgtaccacaagagaagcccccccgccaaggagagcgccctgagcaagtgccagagctgcggcctgagctgcagcagcagcctgtgccagagatgcgacagcctgctgacctgcccccccgccagcaagcccagcgccttccccagcaaggccagcacccacgacagcctggcccacggcgccagcctgagagagaagtaccccggccagacccagggcctggacagactgccccacctgcacagcaagagcaagcccagcaccacccccaccagcagatgcggcttctgcaacagacccggcgccaccaacacctgcacccagtgcagcaaggtgagctgcgacgcctgcctgagcgcctaccactacgacccctgctacaagaagagcgagctgcacaagttcatgcccaacaaccagctgaactacaagagcacccagctgagccacctggtgtacagatag

SEQ ID NO: 100600 - DNA, 1563 bp, Artificial Sequence; identical to SEQ ID NO: 100599
  Description of Artificial Sequence: Synthetic coding sequence

SEQ ID NO: 100601 - DNA, 1152 bp, Artificial Sequence
  Description of Artificial Sequence: Synthetic coding sequence
atgggctacacccccgagctgggcaccgcctacaagctgagagagctggtggagaccctgcaggtgaagatggtgagcttcgagctgttcctggccaaggtggagtgcgagcagatgctggagatccacagccaggtgaaggacaagggctacagcgagctggacatcgtgagcgagagaaagagcagcgccgaggacgtgagaggctgcagcgacgccctgagaagaagagccgagggcagagagcacctgaccgccagcatgagcagagtggccctgcagaagagcgccagcgagagagccgccaaggactactacaagcccagagtgaccaagcccagcagaagcgtggacgcctacgacagctactgggagagcagaaagccccccctgaaggccagcctgagcctgagaaaggagcccgtggccaccgacgtgggcgacgacctgaaggacgagatcatcagacccagccccagcctgctgaccatggccagcagcccccacggcagccccgacgtgctgccccccgccagccccagcaacggccccgccctgctgagaggcacctacttcagcacccaggacgacgtggacctgtacaccgacagcgagcccagagccacctacagaagacaggacgccctgagacccgacgtgtggctgctgagaaacgacgcccacagcctgtaccacaagagaagcccccccgccaaggagagcgccctgagcaagtgccagagctgcggcctgagctgcagcagcagcctgtgccagagatgcgacagcctgctgacctgcccccccgccagcaagcccagcgccttccccagcaaggccagcacccacgacagcctggcccacggcgccagcctgagagagaagtaccccggccagacccagggcctggacagactgccccacctgcacagcaagagcaagcccagcaccacccccaccagcagatgcggcttctgcaacagacccggcgccaccaacacctgcacccagtgcagcaaggtgagctgcgacgcctgcctgagcgcctaccactacgacccctgctacaagaagagcgagctgcacaagttcatgcccaacaaccagctgaactacaagagcacccagctgagccacctggtgtacagatag

SEQ ID NO: 100602 - DNA, 2409 bp, Artificial Sequence
  Description of Artificial Sequence: Synthetic coding sequence
atgctgggcgccagagcctggctgggcagagtgctgctgctgcccagagccggcgccggcctggccgccagcagaagatgccccggcgtgtggcccagaacctggccccacagaagccccagcagaggcagcagcagcagagacaaggacagaagcgccaccgtgagcagcagcgtgcccatgcccgccggcggcaagggcagccaccccagcagcaccccccagagagtgcccaacagactgatccacgagaagagcccctacctgctgcagcacgcctacaaccccgtggactggtacccctggggccaggaggccttcgacaaggccagaaaggagaacaagcccatcttcctgagcgtgggctacagcacctgccactggtgccacatgatggaggaggagagcttccagaacgaggagatcggcagactgctgagcgaggacttcgtgagcgtgaaggtggacagagaggagagacccgacgtggacaaggtgtacatgaccttcgtgcaggccaccagcagcggcggcggctggcccatgaacgtgtggctgacccccaacctgcagcccttcgtgggcggcacctacttcccccccgaggacggcctgaccagagtgggcttcagaaccgtgctgctgagaatcagagagcagtggaagcagaacaagaacaccctgctggagaacagccagagagtgaccaccgccctgctggccagaagcgagatcagcgtgggcgacagacagctgccccccagcgccgccaccgtgaacaacagatgcttccagcagctggacgagggctacgacgaggagtacggcggcttcgccgaggcccccaagttccccacccccgtgatcctgagcttcctgttcagctactggctgagccacagactgacccaggacggcagcagagcccagcagatggccctgcacaccctgaagatgatggccaacggcggcatcagagaccacgtgggccagggcttccacagatacagcaccgacagacagtggcacgtgccccacttcgagaagatgctgtacgaccaggcccagctggccgtggcctacagccaggccttccagctgagcggcgacgagttctacagcgacgtggccaagggcatcctgcagtacgtggccagaagcctgagccacagaagcggcggcttctacagcgccgaggacgccgacagcccccccgagagaggccagagacccaaggagggcgcctactacgtgtggaccgtgaaggaggtgcagcagctgctgcccgagcccgtgctgggcgccaccgagcccctgaccagcggccagctgctgatgaagcactacggcctgaccgaggccggcaacatcagccccagccaggaccccaagggcgagctgcagggccagaacgtgctgaccgtgagatacagcctggagctgaccgccgccagattcggcctggacgtggaggccgtgagaaccctgctgaacagcggcctggagaagctgttccaggccagaaagcacagacccaagccccacctggacagcaagatgctggccgcctggaacggcctgatggtgagcggctacgccgtgaccggcgccgtgctgggccaggacagactgatcaactacgccaccaacggcgccaagttcctgaagagacacatgttcgacgtggccagcggcagactgatgagaacctgctacaccggccccggcggcaccgtggagcacagcaaccccccctgctggggcttcctggaggactacgccttcgtggtgagaggcctgctggacctgtacgaggccagccaggagagcgcctggctggagtgggccctgagactgcaggacacccaggacaagctgttctgggacagccagggcggcggctacttctgcagcgaggccgagctgggcgccggcctgcccctgagactgaaggacgaccaggacggcgccgagcccagcgccaacagcgtgagcgcccacaacctgctgagactgcacggcttcaccggccacaaggactggatggacaagtgcgtgtgcctgctgaccgccttcagcgagagaatgagaagagtgcccgtggccctgcccgagatggtgagagccctgagcgcccagcagcagaccctgaagcagatcgtgatctgcggcgacagacaggccaaggacaccaaggccctggtgcagtgcgtgcacagcgtgtacatccccaacaaggtgctgatcctggccgacggcgaccccagcagcttcctgagcagacagctgcccttcctgagcaccctgagaagactggaggaccaggccaccgcctacgtgtgcgagaaccaggcctgcagcgtgcccatcaccgacccctgcgagctgagaaagctgctgcacccctag

SEQ ID NO: 100603 - DNA, 2361 bp, Artificial Sequence
  Description of Artificial Sequence: Synthetic coding sequence
atgctgggcgccagagcctggctgggcagagtgctgctgctgcccagagccggcgccggcctggccgccagcagaagaggcagcagcagcagagacaaggacagaagcgccaccgtgagcagcagcgtgcccatgcccgccggcggcaagggcagccaccccagcagcaccccccagagagtgcccaacagactgatccacgagaagagcccctacctgctgcagcacgcctacaaccccgtggactggtacccctggggccaggaggccttcgacaaggccagaaaggagaacaagcccatcttcctgagcgtgggctacagcacctgccactggtgccacatgatggaggaggagagcttccagaacgaggagatcggcagactgctgagcgaggacttcgtgagcgtgaaggtggacagagaggagagacccgacgtggacaaggtgtacatgaccttcgtgcaggccaccagcagcggcggcggctggcccatgaacgtgtggctgacccccaacctgcagcccttcgtgggcggcacctacttcccccccgaggacggcctgaccagagtgggcttcagaaccgtgctgctgagaatcagagagcagtggaagcagaacaagaacaccctgctggagaacagccagagagtgaccaccgccctgctggccagaagcgagatcagcgtgggcgacagacagctgccccccagcgccgccaccgtgaacaacagatgcttccagcagctggacgagggctacgacgaggagtacggcggcttcgccgaggcccccaagttccccacccccgtgatcctgagcttcctgttcagctactggctgagccacagactgacccaggacggcagcagagcccagcagatggccctgcacaccctgaagatgatggccaacggcggcatcagagaccacgtgggccagggcttccacagatacagcaccgacagacagtggcacgtgccccacttcgagaagatgctgtacgaccaggcccagctggccgtggcctacagccaggccttccagctgagcggcgacgagttctacagcgacgtggccaagggcatcctgcagtacgtggccagaagcctgagccacagaagcggcggcttctacagcgccgaggacgccgacagcccccccgagagaggccagagacccaaggagggcgcctactacgtgtggaccgtgaaggaggtgcagcagctgctgcccgagcccgtgctgggcgccaccgagcccctgaccagcggccagctgctgatgaagcactacggcctgaccgaggccggcaacatcagccccagccaggaccccaagggcgagctgcagggccagaacgtgctgaccgtgagatacagcctggagctgaccgccgccagattcggcctggacgtggaggccgtgagaaccctgctgaacagcggcctggagaagctgttccaggccagaaagcacagacccaagccccacctggacagcaagatgctggccgcctggaacggcctgatggtgagcggctacgccgtgaccggcgccgtgctgggccaggacagactgatcaactacgccaccaacggcgccaagttcctgaagagacacatgttcgacgtggccagcggcagactgatgagaacctgctacaccggccccggcggcaccgtggagcacagcaaccccccctgctggggcttcctggaggactacgccttcgtggtgagaggcctgctggacctgtacgaggccagccaggagagcgcctggctggagtgggccctgagactgcaggacacccaggacaagctgttctgggacagccagggcggcggctacttctgcagcgaggccgagctgggcgccggcctgcccctgagactgaaggacgaccaggacggcgccgagcccagcgccaacagcgtgagcgcccacaacctgctgagactgcacggcttcaccggccacaaggactggatggacaagtgcgtgtgcctgctgaccgccttcagcgagagaatgagaagagtgcccgtggccctgcccgagatggtgagagccctgagcgcccagcagcagaccctgaagcagatcgtgatctgcggcgacagacaggccaaggacaccaaggccctggtgcagtgcgtgcacagcgtgtacatccccaacaaggtgctgatcctggccgacggcgaccccagcagcttcctgagcagacagctgcccttcctgagcaccctgagaagactggaggaccaggccaccgcctacgtgtgcgagaaccaggcctgcagcgtgcccatcaccgacccctgcgagctgagaaagctgctgcacccctag

SEQ ID NO: 100604 - DNA, 2229 bp, Artificial Sequence
  Description of Artificial Sequence: Synthetic coding sequence
atgcccgccggcggcaagggcagccaccccagcagcaccccccagagagtgcccaacagactgatccacgagaagagcccctacctgctgcagcacgcctacaaccccgtggactggtacccctggggccaggaggccttcgacaaggccagaaaggagaacaagcccatcttcctgagcgtgggctacagcacctgccactggtgccacatgatggaggaggagagcttccagaacgaggagatcggcagactgctgagcgaggacttcgtgagcgtgaaggtggacagagaggagagacccgacgtggacaaggtgtacatgaccttcgtgcaggccaccagcagcggcggcggctggcccatgaacgtgtggctgacccccaacctgcagcccttcgtgggcggcacctacttcccccccgaggacggcctgaccagagtgggcttcagaaccgtgctgctgagaatcagagagcagtggaagcagaacaagaacaccctgctggagaacagccagagagtgaccaccgccctgctggccagaagcgagatcagcgtgggcgacagacagctgccccccagcgccgccaccgtgaacaacagatgcttccagcagctggacgagggctacgacgaggagtacggcggcttcgccgaggcccccaagttccccacccccgtgatcctgagcttcctgttcagctactggctgagccacagactgacccaggacggcagcagagcccagcagatggccctgcacaccctgaagatgatggccaacggcggcatcagagaccacgtgggccagggcttccacagatacagcaccgacagacagtggcacgtgccccacttcgagaagatgctgtacgaccaggcccagctggccgtggcctacagccaggccttccagctgagcggcgacgagttctacagcgacgtggccaagggcatcctgcagtacgtggccagaagcctgagccacagaagcggcggcttctacagcgccgaggacgccgacagcccccccgagagaggccagagacccaaggagggcgcctactacgtgtggaccgtgaaggaggtgcagcagctgctgcccgagcccgtgctgggcgccaccgagcccctgaccagcggccagctgctgatgaagcactacggcctgaccgaggccggcaacatcagccccagccaggaccccaagggcgagctgcagggccagaacgtgctgaccgtgagatacagcctggagctgaccgccgccagattcggcctggacgtggaggccgtgagaaccctgctgaacagcggcctggagaagctgttccaggccagaaagcacagacccaagccccacctggacagcaagatgctggccgcctggaacggcctgatggtgagcggctacgccgtgaccggcgccgtgctgggccaggacagactgatcaactacgccaccaacggcgccaagttcctgaagagacacatgttcgacgtggccagcggcagactgatgagaacctgctacaccggccccggcggcaccgtggagcacagcaaccccccctgctggggcttcctggaggactacgccttcgtggtgagaggcctgctggacctgtacgaggccagccaggagagcgcctggctggagtgggccctgagactgcaggacacccaggacaagctgttctgggacagccagggcggcggctacttctgcagcgaggccgagctgggcgccggcctgcccctgagactgaaggacgaccaggacggcgccgagcccagcgccaacagcgtgagcgcccacaacctgctgagactgcacggcttcaccggccacaaggactggatggacaagtgcgtgtgcctgctgaccgccttcagcgagagaatgagaagagtgcccgtggccctgcccgagatggtgagagccctgagcgcccagcagcagaccctgaagcagatcgtgatctgcggcgacagacaggccaaggacaccaaggccctggtgcagtgcgtgcacagcgtgtacatccccaacaaggtgctgatcctggccgacggcgaccccagcagcttcctgagcagacagctgcccttcctgagcaccctgagaagactggaggaccaggccaccgcctacgtgtgcgagaaccaggcctgcagcgtgcccatcaccgacccctgcgagctgagaaagctgctgcacccctag

SEQ ID NO: 100605 - DNA, 228 bp, Artificial Sequence
  Description of Artificial Sequence: Synthetic coding sequence
ggccagggccaccagggccccggccagtgcgtgcacagcgtgtacatccccaacaaggtgctgatcctggccgacggcgaccccagcagcttcctgagcagacagctgcccttcctgagcaccctgagaagactggaggaccaggccaccgcctacgtgtgcgagaaccaggcctgcagcgtgcccatcaccgacccctgcgagctgagaaagctgctgcacccctag

SEQ ID NO: 100606 - DNA, 132 bp, Artificial Sequence
  Description of Artificial Sequence: Synthetic coding sequence
atgctgggcgccagagcctggctgggcagagtgctgctgctgcccagagccggcgccggcctggccgccagcagaagaagcgcctgcagccccaccagcagactgaacagcctgagaagcctgatcccctag

SEQ ID NO: 100607 - DNA, 918 bp, Artificial Sequence
  Description of Artificial Sequence: Synthetic coding sequence
atggccgccgccggccaggagaagggctacctgacccagaccgccgccgccctggacaagagccccagcctgagcccccagctggccgcccccatcagaggcagacccaagaagtgcctggtgtacccccacgcccccaagagcagcagactgagcagaagcgtgctgagatggctgcagggcctggacctgagcttcttccccagaaacatcaacagagacttcagcaacggcttcctgatcgccgagatcttctgcatctactacccctgggagctggagctgagcagcttcgagaacggcaccagcctgaaggtgaagctggacaactgggcccagctggagaagttcctggccagaaagaagttcaagctgcccaaggagctgatccacggcaccatccactgcaaggccggcgtgcccgagatcctgatcgaggaggtgtacaccctgctgacccacagagagatcaagagcatccaggacgacttcgtgaacttcaccgactacagctaccagatgagactgcccctggtgagcagaagcaccgtgagcaagagcatcaaggacaacatcagactgagcgagctgctgagcaaccccaacatgctgaccaacgagctgaaggccgagttcctgatcctgctgcacatgctgcagagaaagctgggcagaaagctgaaccccgagtggttcgacgtgaagcccaccgtgggcgaggtgaccctgaaccacctgcccgcccaggccagcggcagaagatacaacctgaaggtgaagagaggcagagtggtgcccgtgctgcccaacatcggcagcggcggcagcagccacagagagatccacgtgaagcaggccggccagcacagctactacagcgccatgaagcccatcagaaacatggacaagaagccctag

SEQ ID NO: 100608 - DNA, 2682 bp, Artificial Sequence
  Description of Artificial Sequence: Synthetic coding sequence
atgagcagcaagaagaacagaaagagactgaaccagagcgccgagaacggcagcagcctgcccagcgccgccagcagctgcgccgaggccagagcccccagcgccggcagcgacttcgccgccaccagcggcaccctgaccgtgaccaacctgctggagaaggtggacgacaagatccccaagaccttccagaacagcctgatccacctgggcctgaacaccatgaagagcgccaacatctgcatcggcagacccgtgctgctgaccagcctgaacggcaagcaggaggtgtacaccgcctggcccatggccggcttccccggcggcaaggtgggcctgagcgagatggcccagaagaacgtgggcgtgagacccggcgacgccatccaggtgcagcccctggtgggcgccgtgctgcaggccgaggagatggacgtggccctgagcgacaaggacatggagatcaacgaggaggagctgaccggctgcatcctgagaaagctggacggcaagatcgtgctgcccggcaacttcctgtactgcaccttctacggcagaccctacaagctgcaggtgctgagagtgaagggcgccgacggcatgatcctgggcggcccccagagcgacagcgacaccgacgcccagagaatggccttcgagcagagcagcatggagaccagcagcctggagctgagcctgcagctgagccagctggacctggaggacacccagatccccaccagcagaagcaccccctacaagcccatcgacgacagaatcaccaacaaggccagcgacgtgctgctggacgtgacccagagccccggcgacggcagcggcctgatgctggaggaggtgaccggcctgaagtgcaacttcgagagcgccagagagggcaacgagcagctgaccgaggaggagagactgctgaagttcagcatcggcgccaagtgcaacaccgacaccttctacttcatcagcagcaccaccagagtgaacttcaccgagatcgacaagaacagcaaggagcaggacaaccagttcaaggtgacctacgacatgatcggcggcctgagcagccagctgaaggccatcagagagatcatcgagctgcccctgaagcagcccgagctgttcaagagctacggcatccccgcccccagaggcgtgctgctgtacggcccccccggcaccggcaagaccatgatcgccagagccgtggccaacgaggtgggcgcctacgtgagcgtgatcaacggccccgagatcatcagcaagttctacggcgagaccgaggccaagctgagacagatcttcgccgaggccaccctgagacaccccagcatcatcttcatcgacgagctggacgccctgtgccccaagagagagggcgcccagaacgaggtggagaagagagtggtggccagcctgctgaccctgatggacggcatcggcagcgaggtgagcgagggccaggtgctggtgctgggcgccaccaacagaccccacgccctggacgccgccctgagaagacccggcagattcgacaaggagatcgagatcggcgtgcccaacgcccaggacagactggacatcctgcagaagctgctgagaagagtgccccacctgctgaccgaggccgagctgctgcagctggccaacagcgcccacggctacgtgggcgccgacctgaaggtgctgtgcaacgaggccggcctgtgcgccctgagaagaatcctgaagaagcagcccaacctgcccgacgtgaaggtggccggcctggtgaagatcaccctgaaggacttcctgcaggccatgaacgacatcagacccagcgccatgagagagatcgccatcgacgtgcccaacgtgagctggagcgacatcggcggcctggagagcatcaagctgaagctggagcaggccgtggagtggcccctgaagcaccccgagagcttcatcagaatgggcatccagccccccaagggcgtgctgctgtacggcccccccggctgcagcaagaccatgatcgccaaggccctggccaacgagagcggcctgaacttcctggccatcaagggccccgagctgatgaacaagtacgtgggcgagagcgagagagccgtgagagagaccttcagaaaggccagagccgtggcccccagcatcatcttcttcgacgagctggacgccctggccgtggagagaggcagcagcctgggcgccggcaacgtggccgacagagtgctggcccagctgctgaccgagatggacggcatcgagcagctgaaggacgtgaccatcctggccgccaccaacagacccgacagaatcgacaaggccctgatgagacccggcagaatcgacagaatcatctacgtgcccctgcccgacgccgccaccagaagagagatcttcaagctgcagttccacagcatgcccgtgagcaacgaggtggacctggacgagctgatcctgcagaccgacgcctacagcggcgccgagatcgtggccgtgtgcagagaggccgccctgctggccctggaggaggacatccaggccaacctgatcatgaagagacacttcacccaggccctgagcaccgtgacccccagaatccccgagagcctgagaagattctacgaggactaccaggagaagagcggcctgcacaccctgtag

SEQ ID NO: 100609 - DNA, 750 bp, Artificial Sequence
  Description of Artificial Sequence: Synthetic coding sequence
atgcagctggacaagttcatctaccacctggcccccgtggagaagagccacggcagactgcagaacagaaccagcagaagccagaagaagaagagcaagagccccgagagaagcaagtactgcatcaacgccaagaactacgagcagcccaccatcagcagcaagagccacagccccagcccctacaccaagagaagaatgtgcgagctgagcgaggacaccagaagaagactggcccacctgaacctgggcccctacgagttcaagaaggagaccgacaagccccccttcgtgatcagacacgtggacccccccagccccagagccgacaccctgctgggcagcagcggcagagactgcgagagagacggctggagcagagtgcacaacgaccacagccacctgggctgctgcagacccaaggactacaaggtgatcagaaccccccacggcagagacttcgacgacagcctggagaagtgcgaggagtacctgagccccagaagctgcagcaagcccagacacagcgccagaaccctgctggtgcacagcgcccccagcaccatgcccaagcacagccccagccccgtgctgaacagagccagcctgagagagagattccacagcgactggtgcagccccagcaactgcgacgagatccacgacagagacgagagagacctggagaaggacgacgagctggagctgaagagaagcctgctgtgcagagacagcgcctacgacagctag

SEQ ID NO: 100610 - DNA, 1419 bp, Artificial Sequence
  Description of Artificial Sequence: Synthetic coding sequence
atgcccaaggtgaaggccctgcagtgcgccctggccctggagatcagcagcgtgacctgccccggcgtggtgctgaaggacaaggaggacatctacctgagcatctgcgtgttcggccagtacaagaagacccagtgcgtgcccgccaccttccccctggtgttcaacgccagaatggtgttcgagaaggtgttccccgacgccgtggaccccggcgacgtggtgacccagctggagtacgacaccgccgtgttcgagctgatccagctggtgccccccgtgggcgagaccctgagcacctacgacgagaacaccagagacttcatgttccccggccccaaccagatgagcggccaccacgacagcaacagacaggtgaccatgagaagaatcagcggcctgagaggcaacgcccccagactggagttcagcaccaccagcgtgatcaccgagtgcctgatcagcagcagaaagtgccacacccaggacaagttcatctaccacctggcccccgtggagaagagccacggcagactgcagaacagaaccagcagaagccagaagaagaagagcaagagccccgagagaagcaagtactgcatcaacgccaagaactacgagcagcccaccatcagcagcaagagccacagccccagcccctacaccaagagaagaatgtgcgagctgagcgaggacaccagaagaagactggcccacctgaacctgggcccctacgagttcaagaaggagaccgacaagccccccttcgtgatcagacacgtggacccccccagccccagagccgacaccctgctgggcagcagcggcagagactgcgagagagacggctggagcagagtgcacaacgaccacagccacctgggctgctgcagacccaaggactacaaggtgatcagaaccccccacggcagagacttcgacgacagcctggagaagtgcgaggagtacctgagccccagaagctgcagcaagcccagacacagcgccagaaccctgctggtgcacagcgcccccagcaccatgcccaagcacagccccagccccgtgctgaacagagccagcctgagagagagattccacagcgactggtgcagccccagcaactgcgacgagatccacgacagagacgagagagacctggagaaggacgacgagctggagctgaagagaagcctgctgtgcagagacagcgcctacgacagcgaccccgagtacagcagctgccagcagcccagaggcaccttccacctggacgacggcgagtactggagcaacagagccgccagctacaagggcaagagccacagacccatcttcgagaacagcatggacaagatgtacagaaacctgtacaagaaggcctgcagcagcgccagccacacccaggagagcttctag

SEQ ID NO: 100611 - DNA, 1467 bp, Artificial Sequence
  Description of Artificial Sequence: Synthetic coding sequence
atgcccaaggtgaaggccctgcagtgcgccctggccctggagatcagcagcgtgacctgccccggcgtggtgctgaaggacaaggaggacatctacctgagcatctgcgtgttcggccagtacaagaagacccagtgcgtgcccgccaccttccccctggtgttcaacgccagaatggtgttcgagaaggtgttccccgacgccgtggaccccggcgacgtggtgacccagctggagtacgacaccgccgtgttcgagctgatccagctggtgccccccgtgggcgagaccctgagcacctacgacgagaacaccagagacttcatgttccccggccccaaccagatgagcggccaccacgacagcaacagacaggtgaccatgagaagaatcagcggcctgagaggcaacgcccccagactggagttcagcaccaccagcgtgatcaccgagtgcctgatcagcagcagaaagtgccacacccaggacaagttcatctaccacctggcccccgtggagaagagccacggcagactgcagaacagaaccagcagaagccagaagaagaagagcaagagccccgagagaagcaagtactgcatcaacgccaagaactacgagcagcccaccatcagcagcaagagccacagccccagcccctacaccaagagaagaatgtgcgagctgagcgaggacaccagaagaagactggcccacctgaacctgggcccctacgagttcaagaaggagaccgacaagccccccttcgtgatcagacacgtggacccccccagccccagagccgacaccctgctgggcagcagcggcagagactgcgagagagacggctggagcagagtgcacaacgaccacagccacctgggctgctgcagacccaaggactacaaggtgatcagaaccccccacggcagagacttcgacgacagcctggagaagtgcgaggagtacctgagccccagaagctgcagcaagcccagacacagcgccagaaccctgctggtgcacagcgcccccagcaccatgcccaagcacagccccagccccgtgctgaacagagccagcctgagagagagattccacagcgactggtgcagccccagcaactgcgacgagatccacgacagagtgaagaacgtgctgaagagccaccaggcccaccagagacacctgtacgacgagagagacctggagaaggacgacgagctggagctgaagagaagcctgctgtgcagagacagcgcctacgacagcgaccccgagtacagcagctgccagcagcccagaggcaccttccacctggacgacggcgagtactggagcaacagagccgccagctacaagggcaagagccacagacccatcttcgagaacagcatggacaagatgtacagaaacctgtacaagaaggcctgcagcagcgccagccacacccaggagagcttctag

SEQ ID NO: 100612 - DNA, 1251 bp, Artificial Sequence
  Description of Artificial Sequence: Synthetic coding sequence
atggtgttcgagaaggtgttccccgacgccgtggaccccggcgacgtggtgacccagctggagctgggcgagaccctgagcacctacgacgagaacaccagagacttcatgttccccggccccaaccagatgagcggccaccacgacagcaacagacaggtgaccatgagaagaatcagcggcctgagaggcaacgcccccagactggagttcagcaccaccagcgtgatcaccgagtgcctgatcagcagcagaaagtgccacacccaggacaagttcatctaccacctggcccccgtggagaagagccacggcagactgcagaacagaaccagcagaagccagaagaagaagagcaagagccccgagagaagcaagtactgcatcaacgccaagaactacgagcagcccaccatcagcagcaagagccacagccccagcccctacaccaagagaagaatgtgcgagctgagcgaggacaccagaagaagactggcccacctgaacctgggcccctacgagttcaagaaggagaccgacaagccccccttcgtgatcagacacgtggacccccccagccccagagccgacaccctgctgggcagcagcggcagagactgcgagagagacggctggagcagagtgcacaacgaccacagccacctgggctgctgcagacccaaggactacaaggtgatcagaaccccccacggcagagacttcgacgacagcctggagaagtgcgaggagtacctgagccccagaagctgcagcaagcccagacacagcgccagaaccctgctggtgcacagcgcccccagcaccatgcccaagcacagccccagccccgtgctgaacagagccagcctgagagagagattccacagcgactggtgcagccccagcaactgcgacgagatccacgacagagtgaagaacgtgctgaagagccaccaggcccaccagagacacctgtacgacgagagagacctggagaaggacgacgagctggagctgaagagaagcctgctgtgcagagacagcgcctacgacagcgaccccgagtacagcagctgccagcagcccagaggcaccttccacctggacgacggcgagtactggagcaacagagccgccagctacaagggcaagagccacagacccatcttcgagaacagcatggacaagatgtacagaaacctgtacaagaaggcctgcagcagcgccagccacacccaggagagcttctag

SEQ ID NO: 100613 - DNA, 1377 bp, Artificial Sequence
  Description of Artificial Sequence: Synthetic coding sequence
atggacggcagcagaagagtgagagccaccagcgtgctgcccagatacggccccccctgcctgttcaagggccacctgagcaccaagagcaacgccttctgcaccgacagcagcagcctgagactgagcaccctgcagctggtgaagaaccacatggccgtgcactacaacaagatcctgagcgccaaggccgccgtggactgcagcgtgcccgtgagcgtgagcaccagcatcaagtacgccgaccagcagagaagagagaagctgaagaaggagctggcccagtgcgagaaggagttcaagctgaccaagaccgccatgagagccaactacaagaacaacagcaagagcctgttcaacaccctgcagaagcccagcggcgagccccagatcgaggacgacatgctgaaggaggagatgaacggcttcagcagcttcgccagaagcctggtgcccagcagcgagagactgcacctgagcctgcacaagagcagcaaggtgatcaccaacggccccgagaagaacagcagcagcagccccagcagcgtggactacgccgccagcggccccagaaagctgagcagcggcgccctgtacggcagaagacccagaagcaccttccccaacagccacagattccagctggtgatcagcaaggcccccagcggcgacctgctggacaagcacagcgagctgttcagcaacaagcagctgcccttcacccccagaaccctgaagaccgaggccaagagcttcctgagccagtacagatactacacccccgccaagagaaagaaggacttcaccgaccagagaatcgaggccgagacccagaccgagctgagcttcaagagcgagctgggcaccgccgagaccaagaacatgaccgacagcgagatgaacatcaagcaggccagcaactgcgtgacctacgacgccaaggagaagatcgcccccctgcccctggagggccacgacagcacctgggacgagatcaaggacgacgccctgcagcacagcagccccagagccatgtgccagtacagcctgaagccccccagcaccagaaagatctacagcgacgaggaggagctgctgtacctgagcttcatcgaggacgtgaccgacgagatcctgaagctgggcctgttcagcaacagattcctggagagactgttcgagagacacatcaagcagaacaagcacctggaggaggagaagatgagacacctgctgcacgtgctgaaggtggacctgggctgcaccagcgaggagaacagcttcagcagcgtgaagggcgacaacaaccacgacatggagctgagcaccctgaagatcatggagatgagcatcgaggactgccccctggacgtgtag

SEQ ID NO: 100614 - DNA, 1704 bp, Artificial Sequence
  Description of Artificial Sequence: Synthetic coding sequence
atggacggcagcagaagagtgagagccaccagcgtgctgcccagatacggccccccctgcctgttcaagggccacctgagcaccaagagcaacgccgccgtggactgcagcgtgcccgtgagcgtgagcaccagcatcaagtacgccgaccagcagagaagagagaagctgaagaaggagctggcccagtgcgagaaggagttcaagctgaccaagaccgccatgagagccaactacaagaacaacagcaagagcctgttcaacaccctgcagaagcccagcggcgagccccagatcgaggacgacatgctgaaggaggagatgaacggcttcagcagcttcgccagaagcctggtgcccagcagcgagagactgcacctgagcctgcacaagagcagcaaggtgatcaccaacggccccgagaagaacagcagcagcagccccagcagcgtggactacgccgccagcggccccagaaagctgagcagcggcgccctgtacggcagaagacccagaagcaccttccccaacagccacagattccagctggtgatcagcaaggcccccagcggcgacctgctggacaagcacagcgagctgttcagcaacaagcagctgcccttcacccccagaaccctgaagaccgaggccaagagcttcctgagccagtacagatactacacccccgccaagagaaagaaggacttcaccgaccagagaatcgaggccgagacccagaccgagctgagcttcaagagcgagctgggcaccgccgagaccaagaacatgaccgacagcgagatgaacatcaagcaggccagcaactgcgtgacctacgacgccaaggagaagatcgcccccctgcccctggagggccacgacagcacctgggacgagatcaaggacgacgccctgcagcacagcagccccagagccatgtgccagtacagcctgaagccccccagcaccagaaagatctacagcgacgaggaggagctgctgtacctgagcttcatcgaggacgtgaccgacgagatcctgaagctgggcctgttcagcaacagattcctggagagactgttcgagagacacatcaagcagaacaagcacctggaggaggagaagatgagacacctgctgcacgtgctgaaggtggacctgggctgcaccagcgaggagaacagcgtgaagcagaacgacgtggacatgctgaacgtgttcgacttcgagaaggccggcaacagcgagcccaacgagctgaagaacgagagcgaggtgaccatccagcaggagagacagcagtaccagaaggccctggacatgctgctgagcgcccccaaggacgagaacgagatcttccccagccccaccgagttcttcatgcccatctacaagagcaagcacagcgagggcgtgatcatccagcaggtgaacgacgagaccaacctggagaccagcaccctggacgagaaccaccccagcatcagcgacagcctgaccgacagagagaccagcgtgaacgtgatcgagggcgacagcgaccccgagaaggtggagatcagcaacggcctgtgcggcctgaacaccagccccagccagagcgtgcagttcagcagcgtgaagggcgacaacaaccacgacatggagctgagcaccctgaagatcatggagatgagcatcgaggactgccccctggacgtgtag

SEQ ID NO: 100615 - DNA, 1800 bp, Artificial Sequence
  Description of Artificial Sequence: Synthetic coding sequence
atggacggcagcagaagagtgagagccaccagcgtgctgcccagatacggccccccctgcctgttcaagggccacctgagcaccaagagcaacgccttctgcaccgacagcagcagcctgagactgagcaccctgcagctggtgaagaaccacatggccgtgcactacaacaagatcctgagcgccaaggccgccgtggactgcagcgtgcccgtgagcgtgagcaccagcatcaagtacgccgaccagcagagaagagagaagctgaagaaggagctggcccagtgcgagaaggagttcaagctgaccaagaccgccatgagagccaactacaagaacaacagcaagagcctgttcaacaccctgcagaagcccagcggcgagccccagatcgaggacgacatgctgaaggaggagatgaacggcttcagcagcttcgccagaagcctggtgcccagcagcgagagactgcacctgagcctgcacaagagcagcaaggtgatcaccaacggccccgagaagaacagcagcagcagccccagcagcgtggactacgccgccagcggccccagaaagctgagcagcggcgccctgtacggcagaagacccagaagcaccttccccaacagccacagattccagctggtgatcagcaaggcccccagcggcgacctgctggacaagcacagcgagctgttcagcaacaagcagctgcccttcacccccagaaccctgaagaccgaggccaagagcttcctgagccagtacagatactacacccccgccaagagaaagaaggacttcaccgaccagagaatcgaggccgagacccagaccgagctgagcttcaagagcgagctgggcaccgccgagaccaagaacatgaccgacagcgagatgaacatcaagcaggccagcaactgcgtgacctacgacgccaaggagaagatcgcccccctgcccctggagggccacgacagcacctgggacgagatcaaggacgacgccctgcagcacagcagccccagagccatgtgccagtacagcctgaagccccccagcaccagaaagatctacagcgacgaggaggagctgctgtacctgagcttcatcgaggacgtgaccgacgagatcctgaagctgggcctgttcagcaacagattcctggagagactgttcgagagacacatcaagcagaacaagcacctggaggaggagaagatgagacacctgctgcacgtgctgaaggtggacctgggctgcaccagcgaggagaacagcgtgaagcagaacgacgtggacatgctgaacgtgttcgacttcgagaaggccggcaacagcgagcccaacgagctgaagaacgagagcgaggtgaccatccagcaggagagacagcagtaccagaaggccctggacatgctgctgagcgcccccaaggacgagaacgagatcttccccagccccaccgagttcttcatgcccatctacaagagcaagcacagcgagggcgtgatcatccagcaggtgaacgacgagaccaacctggagaccagcaccctggacgagaaccaccccagcatcagcgacagcctgaccgacagagagaccagcgtgaacgtgatcgagggcgacagcgaccccgagaaggtggagatcagcaacggcctgtgcggcctgaacaccagccccagccagagcgtgcagttcagcagcgtgaagggcgacaacaaccacgacatggagctgagcaccctgaagatcatggagatgagcatcgaggactgccccctggacgtgtag

SEQ ID NO: 100616 - DNA, 1704 bp, Artificial Sequence; identical to SEQ ID NO: 100614
  Description of Artificial Sequence: Synthetic coding sequence

SEQ ID NO: 100617 - DNA, 318 bp, Artificial Sequence
  Description of Artificial Sequence: Synthetic coding sequence
atggcccccgccggcatgagcggcgcccaggacaacagctgcctgtaccaggagatcgcccccagcttccagagactgccctgccccagaaccagcagcagacacttcagcgaggccatgacctgcccctgcggctggagacccttcaagggcggccccggcggcctgaagggccccgtgtggcccgccaaggaggagaacagctgcagccacggcagaatccagagagtgcagagaagaagagtgcccagcgccagccccctgatccagaagatcaacagaagaagcgtgctgttccacccctactgctggagctag

SEQ ID NO: 100618 - DNA, 1638 bp, Artificial Sequence
  Description of Artificial Sequence: Synthetic coding sequence
atgagcagaaagcagaaccagaaggacagcagcggcttcatcttcgacctgcagagcaacaccgtgctggcccagggcggcgccttcgagaacatgaaggagaagatcaacgccgtgagagccatcgtgcccaacaagagcaacaacgagatcatcctggtgctgcagcacttcgacaactgcgtggacaagaccgtgcaggccttcatggagggcagcgccagcgaggtgctgaaggagtggaccgtgaccggcaagaagaagaacaagaagaagaagaacaagcccaagcccgccgccgagcccagcaacggcatccccgacagcagcaagagcgtgagcatccaggaggagcagagcgcccccagcagcgagaagggcggcatgaacggctaccacgtgaacggcgccatcaacgacaccgagagcgtggacagcctgagcgagggcctggagaccctgagcatcgacgccagagagctggaggaccccgagagcgccatgctggacaccctggacagaaccggcagcatgctgcagaacggcgtgagcgacttcgagaccaagagcctgaccatgcacagcatccacaacagccagcagcccagaaacgccgccaagagcctgagcagacccaccaccgagacccagttcagcaacatgggcatggaggacgtgcccctggccaccagcaagaagctgagcagcaacatcgagaagagcgtgaaggacctgcagagatgcaccgtgagcctggccagatacagagtggtggtgaaggaggagatggacgccagcatcaagaagatgaagcaggccttcgccgagctggagagctgcctgatggacagagaggtggccctgctggccgagatggacaaggtgaaggccgaggccatggagatcctgctgagcagacagaagaaggccgagctgctgaagaagatgacccacgtggccgtgcagatgagcgagcagcagctggtggagctgagagccgacatcaagcacttcgtgagcgagagaaagtacgacgaggacctgggcagagtggccagattcacctgcgacgtggagaccctgaagaagagcatcgacagcttcggccaggtgagccaccccaagaacagctacagcaccagaagcagatgcagcagcgtgaccagcgtgagcctgagcagccccagcgacgccagcgccgccagcagcagcacctgcgccagcccccccagcctgaccagcgccaacaagaagaacttcgcccccggcgagacccccgccgccatcgccaacagcagcggccagccctaccagcccctgagagaggtgctgcccggcaacagaagaggcggccagggctacagaccccagggccagaagagcaacgaccccatgaaccagggcagacacgacagcatgggcagatacagaaacagcagctggtacagcagcggcagcagataccagagcgcccccagccaggcccccggcaacaccatcgagagaggccagacccacagcgccggcaccaacggcaccggcgtgagcatggagcccagcccccccacccccagcttcaagaagggcctgccccagagaaagcccagaaccagccagaccgaggccgtgaacagctag

SEQ ID NO: 100619 - DNA, 1638 bp, Artificial Sequence
  Description of Artificial Sequence: Synthetic coding sequence
gtgagcaagaagaagaagaagaaggacagcagcggcttcatcttcgacctgcagagcaacaccgtgctggcccagggcggcgccttcgagaacatgaaggagaagatcaacgccgtgagagccatcgtgcccaacaagagcaacaacgagatcatcctggtgctgcagcacttcgacaactgcgtggacaagaccgtgcaggccttcatggagggcagcgccagcgaggtgctgaaggagtggaccgtgaccggcaagaagaagaacaagaagaagaagaacaagcccaagcccgccgccgagcccagcaacggcatccccgacagcagcaagagcgtgagcatccaggaggagcagagcgcccccagcagcgagaagggcggcatgaacggctaccacgtgaacggcgccatcaacgacaccgagagcgtggacagcctgagcgagggcctggagaccctgagcatcgacgccagagagctggaggaccccgagagcgccatgctggacaccctggacagaaccggcagcatgctgcagaacggcgtgagcgacttcgagaccaagagcctgaccatgcacagcatccacaacagccagcagcccagaaacgccgccaagagcctgagcagacccaccaccgagacccagttcagcaacatgggcatggaggacgtgcccctggccaccagcaagaagctgagcagcaacatcgagaagagcgtgaaggacctgcagagatgcaccgtgagcctggccagatacagagtggtggtgaaggaggagatggacgccagcatcaagaagatgaagcaggccttcgccgagctggagagctgcctgatggacagagaggtggccctgctggccgagatggacaaggtgaaggccgaggccatggagatcctgctgagcagacagaagaaggccgagctgctgaagaagatgacccacgtggccgtgcagatgagcgagcagcagctggtggagctgagagccgacatcaagcacttcgtgagcgagagaaagtacgacgaggacctgggcagagtggccagattcacctgcgacgtggagaccctgaagaagagcatcgacagcttcggccaggtgagccaccccaagaacagctacagcaccagaagcagatgcagcagcgtgaccagcgtgagcctgagcagccccagcgacgccagcgccgccagcagcagcacctgcgccagcccccccagcctgaccagcgccaacaagaagaacttcgcccccggcgagacccccgccgccatcgccaacagcagcggccagccctaccagcccctgagagaggtgctgcccggcaacagaagaggcggccagggctacagaccccagggccagaagagcaacgaccccatgaaccagggcagacacgacagcatgggcagatacagaaacagcagctggtacagcagcggcagcagataccagagcgcccccagccaggcccccggcaacaccatcgagagaggccagacccacagcgccggcaccaacggcaccggcgtgagcatggagcccagcccccccacccccagcttcaagaagggcctgccccagagaaagcccagaaccagccagaccgaggccgtgaacagctag

SEQ ID NO: 100620 - DNA, 27 bp, Artificial Sequence
  Description of Artificial Sequence: Synthetic coding sequence
atgagcagaaagcagaaccagaagtag

SEQ ID NO: 100621 - DNA, 27 bp, Artificial Sequence
  Description of Artificial Sequence: Synthetic coding sequence
atgagcagaaagcagaaccagaagtag

SEQ ID NO: 100622 - DNA, 204 bp, Artificial Sequence
  Description of Artificial Sequence: Synthetic coding sequence
atgagcagaaagcagaaccagaaggacagcagcggcttcatcttcgacctgcagagcaacaccgtgctggcccagggcggcgccttcgagaacatgaaggagaagatcaacgccgtgagagccatcgtgcccaacaagagcaacaacgagatcatcctggtgctgcagcacttcgacaactgcgtggacaagaccgtgcagtag

SEQ ID NO: 100623 - DNA, 102 bp, Artificial Sequence
  Description of Artificial Sequence: Synthetic coding sequence
atgagcagaaagcagaaccagaaggacagcagcggcttcatcttcgacctgcagagcaacaccgtgctggcccagggcggcgccttcgagaacatgaagtag

SEQ ID NO: 100624 - DNA, 18 bp, Artificial Sequence
  Description of Artificial Sequence: Synthetic coding sequence
atgagcagaaagcagtag

SEQ ID NO: 100625 - DNA, 111 bp, Artificial Sequence
  Description of Artificial Sequence: Synthetic coding sequence
atgagcagaaagcagaaccagaaggacagcagcggcttcatcttcgacctgcagagcaacaccgtgctggcccagggcggcgccttcgagaacatgaaggagaaggtgtag

SEQ ID NO: 100626 - DNA, 201 bp, Artificial Sequence
  Description of Artificial Sequence: Synthetic coding sequence
atgagcagaaagcagaaccagaaggacagcagcggcttcatcttcgacctgcagagcaacaccgtgctggcccagggcggcgccttcgagaacatgaaggagaagatcaacgccgtgagagccatcgtgcccaacaagagcaacaacgagatcatcctggtgctgcagcacttcgacaactgcgtggacaagaccgtgtag

SEQ ID NO: 100627 - DNA, 105 bp, Artificial Sequence
  Description of Artificial Sequence: Synthetic coding sequence
atgagcagaaagcagaaccagaaggacagcagcggcttcatcttcgacctgcagagcaacaccgtgctggcccagggcggcgccttcgagaacatgaaggagtag

SEQ ID NO: 100628 - DNA, 297 bp, Artificial Sequence
  Description of Artificial Sequence: Synthetic coding sequence
atgagcagaaagcagaaccagaaggacagcagcggcttcatcttcgacctgcagagcaacaccgtgctggcccagggcggcgccttcgagaacatgaaggagaagatcaacgccgtgagagccatcgtgcccaacaagagcaacaacgagatcatcctggtgctgcagcacttcgacaactgcgtggacaagaccgtgcaggccttcatggagggcagcgccagcgaggtgctgaaggagtggaccgtgaccggcaagaagaagaacaagaagaagaagaacaagcccaagccctag

SEQ ID NO: 100629 - DNA, 225 bp, Artificial Sequence
  Description of Artificial Sequence: Synthetic coding sequence
atgagcagaaagcagaaccagaaggacagcagcggcttcatcttcgacctgcagagcaacaccgtgctggcccagggcggcgccttcgagaacatgaaggagaagatcaacgccgtgagagccatcgtgcccaacaagagcaacaacgagatcatcctggtgctgcagcacttcgacaactgcgtggacaagaccgtgcaggccttcatggagggcagcgcctag

SEQ ID NO: 100630 - DNA, 33 bp, Artificial Sequence
  Description of Artificial Sequence: Synthetic coding sequence
atgagcagaaagcagaaccagaaggacagctag

SEQ ID NO: 100631 - DNA, 1638 bp, Artificial Sequence; identical to SEQ ID NO: 100618
  Description of Artificial Sequence: Synthetic coding sequence

SEQ ID NO: 100632 - DNA, 1638 bp, Artificial Sequence; identical to SEQ ID NO: 100618
  Description of Artificial Sequence: Synthetic coding sequence

SEQ ID NO: 100633 - DNA, 1677 bp, Artificial Sequence
  Description of Artificial Sequence: Synthetic coding sequence
atggccgagctgaacacccacgtgaacgtgaaggagaagatctacgccgtgagaagcgtggtgcccaacaagagcaacaacgagatcgtgctggtgctgcagcagttcgacttcaacgtggacaaggccgtgcaggccttcgtggacggcagcgccatccaggtgctgaaggagtggaacatgaccggcaagaagaagaacaacaagagaaagagaagcaagagcaagcagcaccagggcaacaaggacgccaaggacaaggtggagagacccgaggccggccccctgcagccccagcccccccagatccagaacggccccatgaacggctgcgagaaggacagcagcagcaccgacagcgccaacgagaagcccgccctgatccccagagagaagaagatcagcatcctggaggagcccagcaaggccctgagaggcgtgaccgagggcaacagactgctgcagcagaagctgagcctggacggcaaccccaagcccatccacggcaccaccgagagaagcgacggcctgcagtggagcgccgagcagccctgcaaccccagcaagcccaaggccaagaccagccccgtgaagagcaacacccccgccgcccacctggagatcaagcccgacgagctggccaagaagagaggccccaacatcgagaagagcgtgaaggacctgcagagatgcaccgtgagcctgaccagatacagagtgatgatcaaggaggaggtggacagcagcgtgaagaagatcaaggccgccttcgccgagctgcacaactgcatcatcgacaaggaggtgagcctgatggccgagatggacaaggtgaaggaggaggccatggagatcctgaccgccagacagaagaaggccgaggagctgaagagactgaccgacctggccagccagatggccgagatgcagctggccgagctgagagccgagatcaagcacttcgtgagcgagagaaagtacgacgaggagctgggcaaggccgccagattcagctgcgacatcgagcagctgaaggcccagatcatgctgtgcggcgagatcacccaccccaagaacaactacagcagcagaaccccctgcagcagcctgctgcccctgctgaacgcccacgccgccaccagcggcaagcagagcaacttcagcagaaagagcagcacccacaacaagcccagcgagggcaaggccgccaaccccaagatggtgagcagcctgcccagcaccgccgaccccagccaccagaccatgcccgccaacaagcagaacggcagcagcaaccagagaagaagattcaacccccagtaccacaacaacagactgaacggccccgccaagagccagggcagcggcaacgaggccgagcccctgggcaagggcaacagcagacacgagcacagaagacagccccacaacggcttcagacccaagaacaagggcggcgccaagaaccaggaggccagcctgggcatgaagacccccgaggcccccgcccacagcgagaagcccagaagaagacagcacgccgccgacaccagcgaggccagacccttcagaggcagcgtgggcagagtgagccagtgcaacctgtgccccaccagaatcgaggtgagcaccgacgccgccgtgctgagcgtgcccgccgtgaccctggtggcctag

SEQ ID NO: 100634 - DNA, 1470 bp, Artificial Sequence
  Description of Artificial Sequence: Synthetic coding sequence
atggccgagctgaacacccacgtgaacgtgaaggagaagatctacgccgtgagaagcgtggtgcccaacaagagcaacaacgagatcgtgctggtgctgcagcagttcgacttcaacgtggacaaggccgtgcaggccttcgtggacggcagcgccatccaggtgctgaaggagtggaacatgaccggcaagaagaagaacaacaagagaaagagaagcaagagcaagcagcaccagggcaacaaggacgccaaggacaaggtggagagacccgaggccggccccctgcagccccagcccccccagatccagaacggccccatgaacggctgcgagaaggacagcagcagcaccgacagcgccaacgagaagcccgccctgatccccagagagaagaagatcagcatcctggaggagcccagcaaggccctgagaggcgtgaccggccccaacatcgagaagagcgtgaaggacctgcagagatgcaccgtgagcctgaccagatacagagtgatgatcaaggaggaggtggacagcagcgtgaagaagatcaaggccgccttcgccgagctgcacaactgcatcatcgacaaggaggtgagcctgatggccgagatggacaaggtgaaggaggaggccatggagatcctgaccgccagacagaagaaggccgaggagctgaagagactgaccgacctggccagccagatggccgagatgcagctggccgagctgagagccgagatcaagcacttcgtgagcgagagaaagtacgacgaggagctgggcaaggccgccagattcagctgcgacatcgagcagctgaaggcccagatcatgctgtgcggcgagatcacccaccccaagaacaactacagcagcagaaccccctgcagcagcctgctgcccctgctgaacgcccacgccgccaccagcggcaagcagagcaacttcagcagaaagagcagcacccacaacaagcccagcgagggcaaggccgccaaccccaagatggtgagcagcctgcccagcaccgccgaccccagccaccagaccatgcccgccaacaagcagaacggcagcagcaaccagagaagaagattcaacccccagtaccacaacaacagactgaacggccccgccaagagccagggcagcggcaacgaggccgagcccctgggcaagggcaacagcagacacgagcacagaagacagccccacaacggcttcagacccaagaacaagggcggcgccaagaaccaggaggccagcctgggcatgaagacccccgaggcccccgcccacagcgagaagcccagaagaagacagcacgccgccgacaccagcgaggccagacccttcagaggcagcgtgggcagagtgagccagtgcaacctgtgccccaccagaatcgaggtgagcaccgacgccgccgtgctgagcgtgcccgccgtgaccctggtggcctag

SEQ ID NO: 100635 - DNA, 1677 bp, Artificial Sequence; identical to SEQ ID NO: 100633
  Description of Artificial Sequence: Synthetic coding sequence

SEQ ID NO: 100636 - DNA, 1701 bp, Artificial Sequence
  Description of Artificial Sequence: Synthetic coding sequence
atggcctacagcaccagaagcaagatggccgagctgaacacccacgtgaacgtgaaggagaagatctacgccgtgagaagcgtggtgcccaacaagagcaacaacgagatcgtgctggtgctgcagcagttcgacttcaacgtggacaaggccgtgcaggccttcgtggacggcagcgccatccaggtgctgaaggagtggaacatgaccggcaagaagaagaacaacaagagaaagagaagcaagagcaagcagcaccagggcaacaaggacgccaaggacaaggtggagagacccgaggccggccccctgcagccccagcccccccagatccagaacggccccatgaacggctgcgagaaggacagcagcagcaccgacagcgccaacgagaagcccgccctgatccccagagagaagaagatcagcatcctggaggagcccagcaaggccctgagaggcgtgaccgagggcaacagactgctgcagcagaagctgagcctggacggcaaccccaagcccatccacggcaccaccgagagaagcgacggcctgcagtggagcgccgagcagccctgcaaccccagcaagcccaaggccaagaccagccccgtgaagagcaacacccccgccgcccacctggagatcaagcccgacgagctggccaagaagagaggccccaacatcgagaagagcgtgaaggacctgcagagatgcaccgtgagcctgaccagatacagagtgatgatcaaggaggaggtggacagcagcgtgaagaagatcaaggccgccttcgccgagctgcacaactgcatcatcgacaaggaggtgagcctgatggccgagatggacaaggtgaaggaggaggccatggagatcctgaccgccagacagaagaaggccgaggagctgaagagactgaccgacctggccagccagatggccgagatgcagctggccgagctgagagccgagatcaagcacttcgtgagcgagagaaagtacgacgaggagctgggcaaggccgccagattcagctgcgacatcgagcagctgaaggcccagatcatgctgtgcggcgagatcacccaccccaagaacaactacagcagcagaaccccctgcagcagcctgctgcccctgctgaacgcccacgccgccaccagcggcaagcagagcaacttcagcagaaagagcagcacccacaacaagcccagcgagggcaaggccgccaaccccaagatggtgagcagcctgcccagcaccgccgaccccagccaccagaccatgcccgccaacaagcagaacggcagcagcaaccagagaagaagattcaacccccagtaccacaacaacagactgaacggccccgccaagagccagggcagcggcaacgaggccgagcccctgggcaagggcaacagcagacacgagcacagaagacagccccacaacggcttcagacccaagaacaagggcggcgccaagaaccaggaggccagcctgggcatgaagacccccgaggcccccgcccacagcgagaagcccagaagaagacagcacgccgccgacaccagcgaggccagacccttcagaggcagcgtgggcagagtgagccagtgcaacctgtgccccaccagaatcgaggtgagcaccgacgccgccgtgctgagcgtgcccgccgtgaccctggtggcctag

SEQ ID NO: 100637 - DNA, 801 bp, Artificial Sequence
  Description of Artificial Sequence: Synthetic coding sequence
atggccgagctgaacacccacgtgaacgtgaaggagaagatctacgccgtgagaagcgtggtgcccaacaagagcaacaacgagatcgtgctggtgctgcagcagttcgacttcaacgtggacaaggccgtgcaggccttcgtggacggcagcgccatccaggtgctgaaggagtggaacatgaccggcaagaagaagaacaacaagagaaagagaagcaagagcaagcagcaccagggcaacaaggacgccaaggacaaggtggagagacccgaggccggccccctgcagccccagcccccccagatccagaacggccccatgaacggctgcgagaaggacagcagcagcaccgacagcgccaacgagaagcccgccctgatccccagagagaagaagatcagcatcctggaggagcccagcaaggccctgagaggcgtgaccggccccaacatcgagaagagcgtgaaggacctgcagagatgcaccgtgagcctgaccagatacagagtgatgatcaaggaggaggtggacagcagcgtgaagaagatcaaggccgccttcgccgagctgcacaactgcatcatcgacaaggaggtgagcctgatggccgagatggacaaggtgaaggaggaggccatggagatcctgaccgccagacagaagaaggccgaggagctgaagagactgaccgacctggccagccagatggccgagatgcagctggccgagctgagagccgagatcaagcacttcgtgagcgagagaaagtacgacgaggagctgggcaaggccgcctag

SEQ ID NO: 100638 - DNA, 1677 bp, Artificial Sequence; identical to SEQ ID NO: 100633
  Description of Artificial Sequence: Synthetic coding sequence

SEQ ID NO: 100639 - DNA, 1767 bp, Artificial Sequence
  Description of Artificial Sequence: Synthetic coding sequence
atggaccccttctgccacagcagcagcgagaccagactgctgagcggcaccctgctgtggatccccagagcctacagcaccagaagcaagatggccgagctgaacacccacgtgaacgtgaaggagaagatctacgccgtgagaagcgtggtgcccaacaagagcaacaacgagatcgtgctggtgctgcagcagttcgacttcaacgtggacaaggccgtgcaggccttcgtggacggcagcgccatccaggtgctgaaggagtggaacatgaccggcaagaagaagaacaacaagagaaagagaagcaagagcaagcagcaccagggcaacaaggacgccaaggacaaggtggagagacccgaggccggccccctgcagccccagcccccccagatccagaacggccccatgaacggctgcgagaaggacagcagcagcaccgacagcgccaacgagaagcccgccctgatccccagagagaagaagatcagcatcctggaggagcccagcaaggccctgagaggcgtgaccgagggcaacagactgctgcagcagaagctgagcctggacggcaaccccaagcccatccacggcaccaccgagagaagcgacggcctgcagtggagcgccgagcagccctgcaaccccagcaagcccaaggccaagaccagccccgtgaagagcaacacccccgccgcccacctggagatcaagcccgacgagctggccaagaagagaggccccaacatcgagaagagcgtgaaggacctgcagagatgcaccgtgagcctgaccagatacagagtgatgatcaaggaggaggtggacagcagcgtgaagaagatcaaggccgccttcgccgagctgcacaactgcatcatcgacaaggaggtgagcctgatggccgagatggacaaggtgaaggaggaggccatggagatcctgaccgccagacagaagaaggccgaggagctgaagagactgaccgacctggccagccagatggccgagatgcagctggccgagctgagagccgagatcaagcacttcgtgagcgagagaaagtacgacgaggagctgggcaaggccgccagattcagctgcgacatcgagcagctgaaggcccagatcatgctgtgcggcgagatcacccaccccaagaacaactacagcagcagaaccccctgcagcagcctgctgcccctgctgaacgcccacgccgccaccagcggcaagcagagcaacttcagcagaaagagcagcacccacaacaagcccagcgagggcaaggccgccaaccccaagatggtgagcagcctgcccagcaccgccgaccccagccaccagaccatgcccgccaacaagcagaacggcagcagcaaccagagaagaagattcaacccccagtaccacaacaacagactgaacggccccgccaagagccagggcagcggcaacgaggccgagcccctgggcaagggcaacagcagacacgagcacagaagacagccccacaacggcttcagacccaagaacaagggcggcgccaagaaccaggaggccagcctgggcatgaagacccccgaggcccccgcccacagcgagaagcccagaagaagacagcacgccgccgacaccagcgaggccagacccttcagaggcagcgtgggcagagtgagccagtgcaacctgtgccccaccagaatcgaggtgagcaccgacgccgccgtgctgagcgtgcccgccgtgaccctggtggcctag

SEQ ID NO: 100640 - DNA, 1677 bp, Artificial Sequence; identical to SEQ ID NO: 100633
  Description of Artificial Sequence: Synthetic coding sequence

SEQ ID NO: 100641 - DNA, 465 bp, Artificial Sequence
  Description of Artificial Sequence: Synthetic coding sequence
atggccgagctgaacacccacgtgaacgtgaaggagaagatctacgccgtgagaagcgtggtgcccaacaagagcaacaacgagatcgtgctggtgctgcagcagttcgacttcaacgtggacaaggccgtgcaggccttcgtggacggcagcgccatccaggtgctgaaggagtggaacatgaccggcaagaagaagaacaacaagagaaagagaagcaagagcaagcagcaccagggcaacaaggacgccaaggacaaggtggagagacccgaggccggccccctgcagccccagcccccccagatccagaacggccccatgaacggctgcgagaaggacagcagcagcaccgacagcgccaacgagaagcccgccctgatccccagagagaagaagatcagcatcctggaggagcccagcaaggccctgagaggcgtgaccgagggcaacagactgctgtag

SEQ ID NO: 100642 - DNA, 423 bp, Artificial Sequence
  Description of Artificial Sequence: Synthetic coding sequence
atggccgagctgaacacccacgtgaacgtgaaggagaagatctacgccgtgagaagcgtggtgcccaacaagagcaacaacgagatcgtgctggtgctgcagcagttcgacttcaacgtggacaaggccgtgcaggccttcgtggacggcagcgccatccaggtgctgaaggagtggaacatgaccggcaagaagaagaacaacaagagaaagagaagcaagagcaagcagcaccagggcaacaaggacgccaaggacaaggtggagagacccgaggccggccccctgcagccccagcccccccagatccagaacggccccatgaacggctgcgagaaggacagcagcagcaccgacagcgccaacgagaagcccgccctgatccccagagagaagaagatcagcatcctggaggagccctag

SEQ ID NO: 100643 - DNA, 42 bp, Artificial Sequence
  Description of Artificial Sequence: Synthetic coding sequence
atggccgagctgaacacccacgtgaacgtgaaggagaagtag

SEQ ID NO: 100644 - DNA, 285 bp, Artificial Sequence
  Description of Artificial Sequence: Synthetic coding sequence
atggccgagctgaacacccacgtgaacgtgaaggagaagatctacgccgtgagaagcgtggtgcccaacaagagcaacaacgagatcgtgctggtgctgcagcagttcgacttcaacgtggacaaggccgtgcaggccttcgtggacggcagcgccatccaggtgctgaaggagtggaacatgaccggcaagaagaagaacaacaagagaaagagaagcaagagcaagcagcaccagggcaacaaggacgccaaggacaaggtggagagacccgaggccggctag

SEQ ID NO: 100645 - DNA, 348 bp, Artificial Sequence
  Description of Artificial Sequence: Synthetic coding sequence
atggccgagctgaacacccacgtgaacgtgaaggagaagatctacgccgtgagaagcgtggtgcccaacaagagcaacaacgagatcgtgctggtgctgcagcagttcgacttcaacgtggacaaggccgtgcaggccttcgtggacggcagcgccatccaggtgctgaaggagtggaacatgaccggcaagaagaagaacaacaagagaaagagaagcaagagcaagcagcaccagggcaacaaggacgccaaggacaaggtggagagacccgaggccggccccctgcagccccagcccccccagatccagaacggccccatgaacggctgcgagaaggacagctag

SEQ ID NO: 100646 - DNA, 72 bp, Artificial Sequence
  Description of Artificial Sequence: Synthetic coding sequence
atggccgagctgaacacccacgtgaacgtgaaggagaagatctacgccgtgagaagcgtggtgcccaactag

SEQ ID NO: 100647 - DNA, 522 bp, Artificial Sequence
  Description of Artificial Sequence: Synthetic coding sequence
atggccgagctgaacacccacgtgaacgtgaaggagaagatctacgccgtgagaagcgtggtgcccaacaagagcaacaacgagatcgtgctggtgctgcagcagttcgacttcaacgtggacaaggccgtgcaggccttcgtggacggcagcgccatccaggtgctgaaggagtggaacatgaccggcaagaagaagaacaacaagagaaagagaagcaagagcaagcagcaccagggcaacaaggacgccaaggacaaggtggagagacccgaggccggccccctgcagccccagcccccccagatccagaacggccccatgaacggctgcgagaaggacagcagcagcaccgacagcgccaacgagaagcccgccctgatccccagagagaagaagatcagcatcctggaggagcccagcaaggccctgagaggcgtgaccggccccaacatcgagaagagcgtgaaggacctgcagagatgcaccgtgagcctgaccagatacagagtgatgatctag

SEQ ID NO: 100648 - DNA, 1677 bp, Artificial Sequence; identical to SEQ ID NO: 100633
  Description of Artificial Sequence: Synthetic coding sequence

SEQ ID NO: 100649 - DNA, 567 bp, Artificial Sequence
  Description of Artificial Sequence: Synthetic coding sequence
atggccgagctgaacacccacgtgaacgtgaaggagaagatctacgccgtgagaagcgtggtgcccaacaagagcaacaacgagatcgtgctggtgctgcagcagttcgacttcaacgtggacaaggccgtgcaggccttcgtggacggcagcgccatccaggtgctgaaggagtggaacatgaccggcaagaagaagaacaacaagagaaagagaagcaagagcaagcagcaccagggcaacaaggacgccaaggacaaggtggagagacccgaggccggccccctgcagccccagcccccccagatccagaacggccccatgaacggctgcgagaaggacagcagcagcaccgacagcgccaacgagaagcccgccctgatccccagagagaagaagatcagcatcctggaggagcccagcaaggccctgagaggcgtgaccgagggcaacagactgctgcagcagaagctgagcctggacggcaaccccaagcccatccacggcaccaccgagagaagcgacggcctgcagtggagcgccgagcagccctgcaaccccagctag

SEQ ID NO: 100650 - DNA, 909 bp, Artificial Sequence
  Description of Artificial Sequence: Synthetic coding sequence
atggagcccggccccgacggccccgccgccagcggccccgccgccatcagagagggctggttcagagagacctgcagcctgtggcccggccaggccctgagcctgcaggtggagcagctgctgcaccacagaagaagcagataccaggacatcctggtgttcagaagcaagacctacggcaacgtgctggtgctggacggcgtgatccagtgcaccgagagagacgagttcagctaccaggagatgatcgccaacctgcccctgtgcagccaccccaaccccagaaaggtgctgatcatcggcggcggcgacggcggcgtgctgagagaggtggtgaagcaccccagcgtggagagcgtggtgcagtgcgagatcgacgaggacgtgatccaggtgagcaagaagttcctgcccggcatggccatcggctacagcagcagcaagctgaccctgcacgtgggcgacggcttcgagttcatgaagcagaaccaggacgccttcgacgtgatcatcaccgacagcagcgaccccatgggccccgccgagagcctgttcaaggagagctactaccagctgatgaagaccgccctgaaggaggacggcgtgctgtgctgccagggcgagtgccagtggctgcacctggacctgatcaaggagatgagacagttctgccagagcctgttccccgtggtggcctacgcctactgcaccatccccacctaccccagcggccagatcggcttcatgctgtgcagcaagaaccccagcaccaacttccaggagcccgtgcagcccctgacccagcagcaggtggcccagatgcagctgaagtactacaacagcgacgtgcacagagccgccttcgtgctgcccgagttcgccagaaaggccctgaacgacgtgagctag

SEQ ID NO: 100651 - DNA, 600 bp, Artificial Sequence
  Description of Artificial Sequence: Synthetic coding sequence
gaggagccccccccccccaccgtgcaggtgcagggccccggcccccagagagaggagaagcagaagaccaagatggccaagttcgtgatcagacccgccaccgccgccgactgcagcgacatcctgagactgatcaaggagctggccaagtacgagtacatggaggagcaggtgatcctgaccgagaaggacctgctggaggacggcttcggcgagcaccccttctaccactgcctggtggccgaggtgcccaaggagcactggacccccgagggcaaccccagccccttccccgaggccagagagaccaagtgctactacttcacctacgacccctggatcggcaagctgctgtacctggaggacttcttcgtgatgagcgactacagaggcctgtggcacagaatcagaaacagcgaggagagcaagcccggctgcaacgaggtgagcctggccgcctgcaccagctgggccgagtggaacgagcccagcatcaacttctacaagagaagaggcgccagcgacctgagcagcgaggagggctggagactgttcaagatcgacaaggagtacctgctgaagatggccaccgaggagtag

SEQ ID NO: 100652 - DNA, 453 bp, Artificial Sequence
  Description of Artificial Sequence: Synthetic coding sequence
atggccaagttcgtgatcagacccgccaccgccgccgactgcagcgacatcctgagactgatcaaggagctggccaagtacgagtacatggaggagcaggtgatcctgaccgagaagggcaacagcaccgtggccggcagaggcaccagcgtgagatgcctgagccccagccccagacccctgccccccctgctgcccctgctggccgacctgctggaggacggcttcggcgagcaccccttctaccactgcctggtggccgaggtgcccaaggagcactggacccccgagggcaaccccagccccttccccgaggccagagagaccaagtgctacgtgagaagcagcgtgggctgcgtggagcccctgaccacccaggccgaggtgaccgagaacctggacagaaagaacagccagcaggtgttcaagctgctgagaaagaagaagaactag

SEQ ID NO: 100653 - DNA, 363 bp, Artificial Sequence
  Description of Artificial Sequence: Synthetic coding sequence
atggccaagttcgtgatcagacccgccaccgccgccgactgcagcgacatcctgagactgatcaaggagctggccaagtacgagtacatggaggagcaggtgatcctgaccgagaaggacctgctggaggacggcttcggcgagcaccccttctaccactgcctggtggccgaggtgcccaaggagcactggacccccgagggcaaccccagccccttccccgaggccagagagaccaagtgctacgtgagaagcagcgtgggctgcgtggagcccctgaccacccaggccgaggtgaccgagaacctggacagaaagaacagccagcaggtgttcaagctgctgagaaagaagaagaactag

SEQ ID NO: 100654 - DNA, 432 bp, Artificial Sequence
  Description of Artificial Sequence: Synthetic coding sequence
atggccaagttcgtgatcagacccgccaccgccgccgactgcagcgacatcctgagactgatcaaggagctggccaagtacgagtacatggaggagcaggtgatcctgaccgagaagggccacagcatcgtgggcttcgccatgtactacttcacctacgacccctggatcggcaagctgctgtacctggaggacttcttcgtgatgagcgactacagaggcttcggcatcggcagcgagatcctgaagaacctgagccaggtggccatgagatgcagatgcagcagcatgcacttcctggtggccgagtggaacgagcccagcatcaacttctacaagagaagaggcgccagcgacctgagcagcgaggagggctggagactgttcaagatcgacaaggagtacctgctgaagatggccaccgaggagtag

SEQ ID NO: 100655 - DNA, 516 bp, Artificial Sequence
  Description of Artificial Sequence: Synthetic coding sequence
atggccaagttcgtgatcagacccgccaccgccgccgactgcagcgacatcctgagactgatcaaggagctggccaagtacgagtacatggaggagcaggtgatcctgaccgagaaggacctgctggaggacggcttcggcgagcaccccttctaccactgcctggtggccgaggtgcccaaggagcactggacccccgagggccacagcatcgtgggcttcgccatgtactacttcacctacgacccctggatcggcaagctgctgtacctggaggacttcttcgtgatgagcgactacagaggcttcggcatcggcagcgagatcctgaagaacctgagccaggtggccatgagatgcagatgcagcagcatgcacttcctggtggccgagtggaacgagcccagcatcaacttctacaagagaagaggcgccagcgacctgagcagcgaggagggctggagactgttcaagatcgacaaggagtacctgctgaagatggccaccgaggagtag

SEQ ID NO: 100656 - DNA, 513 bp, Artificial Sequence
  Description of Artificial Sequence: Synthetic coding sequence
atggccagcgtgagaatcagagaggccaaggagggcgactgcggcgacatcctgagactgatcagagagctggccgagttcgagaagctgagcgaccaggtgaagatcagcgaggaggccctgagagccgacggcttcggcgacaaccccttctaccactgcctggtggccgagatcctgcccgcccccggcaagctgctgggcccctgcgtggtgggctacggcatctactacttcatctacagcacctggaagggcagaaccatctacctggaggacatctacgtgatgcccgagtacagaggccagggcatcggcagcaagatcatcaagaaggtggccgaggtggccctggacaagggctgcagccagttcagactggccgtgctggactggaaccagagagccatggacctgtacaaggccctgggcgcccaggacctgaccgaggccgagggctggcacttcttctgcttccagggcgaggccaccagaaagctggccggcaagtag

SEQ ID NO: 100657 - DNA, 750 bp, Artificial Sequence
  Description of Artificial Sequence: Synthetic coding sequence
atgcccggccagagaatcgccagcctggcctacagcctgctgccctacggcgccggcatccccgcccccctgaccagacccagactgcccagaagaccccccagactgcccccccccagaagcctgagactgttcagaatccaggtgagaagacccttcaagggcagcagctgcagactgagaggccccggcaccctggtgcccgacagcggcgaccccgacggcttcagagccgaccccagaggccagggcggcagactgtggagataccccgaggccgacagcggcgaggactgcagacccgagctggccgagttcgagaagctgagcgaccaggtgaagatcagcgaggaggccctgagagccgacggcttcggcgacaaccccttctaccactgcctggtggccgagatcctgcccgcccccggcaagctgctgggcccctgcgtggtgggctacggcatctactacttcatctacagcacctggaagggcagaaccatctacctggaggacatctacgtgatgcccgagtacagaggccagggcatcggcagcaagatcatcaagaaggtggccgaggtggccctggacaagggctgcagccagttcagactggccgtgctggactggaaccagagagccatggacctgtacaaggccctgggcgcccaggacctgaccgaggccgagggctggcacttcttctgcttccagggcgaggccaccagaaagctggccggcaagtag

SEQ ID NO: 100658 - DNA, 942 bp, Artificial Sequence
  Description of Artificial Sequence: Synthetic coding sequence
atggccgccgccagacacagcaccctggacttcatgctgggcgccaaggccgacggcgagaccatcctgaagggcctgcagagcatcttccaggagcagggcatggccgagagcgtgcacacctggcaggaccacggctacctggccacctacaccaacaagaacggcagactgccccccatcgtgagaggcggcgccatcgacagatactggcccaccgccgacggcagactggtggagtacgacatcgacgaggtggtgtacgacgaggacagcccctaccagaacatcaagatcctgcacagcaagcagttcggcaacatcctgatcctgagcggcgacgtgaacctggccgagagcgacctggcctacaccagagccatcatgggcagcggcaaggaggactacaccggcaaggacgtgctgatcctgggcggcggcgacggcggcatcctgtgcgagatcgtgaagctgaagcccaagatggtgaccatggtggagatcgaccagatggtgatcgacggctgcaagaagtacatgagaaagacctgcggcgacgtgctggacaacctgaagggcgactgctaccaggtgctgatcgaggactgcatccccgtgctgaagagatacgccaaggagggcagagagttcgactacgtgatcaacgacctgaccgccgtgcccatcagcaccagccccgaggaggacagcacctgggagttcctgagactgatcctggacctgagcatgaaggtgctgaagcaggacggcaagtacttcacccagggcaactgcgtgaacctgaccgaggccctgagcctgtacgaggagcagctgggcagactgtactgccccgtggagttcagcaaggagatcgtgtgcgtgcccagctacctggagctgtgggtgttctacaccgtgtggaagaaggccaagccctag

SEQ ID NO: 100659 - DNA, 1101 bp, Artificial Sequence
  Description of Artificial Sequence: Synthetic coding sequence
atggccgccgccagacacagcaccctggacttcatgctgggcgccaaggccgacggcgagaccatcctgaagggcctgcagagcatcttccaggagcagggcatggccgagagcgtgcacacctggcaggaccacggctacctggccacctacaccaacaagaacggcagcttcgccaacctgagaatctacccccacggcctggtgctgctggacctgcagagctacgacggcgacgcccagggcaaggaggagatcgacagcatcctgaacaaggtggaggagagaatgaaggagctgagccaggacagcaccggcagagtgaagagactgccccccatcgtgagaggcggcgccatcgacagatactggcccaccgccgacggcagactggtggagtacgacatcgacgaggtggtgtacgacgaggacagcccctaccagaacatcaagatcctgcacagcaagcagttcggcaacatcctgatcctgagcggcgacgtgaacctggccgagagcgacctggcctacaccagagccatcatgggcagcggcaaggaggactacaccggcaaggacgtgctgatcctgggcggcggcgacggcggcatcctgtgcgagatcgtgaagctgaagcccaagatggtgaccatggtggagatcgaccagatggtgatcgacggctgcaagaagtacatgagaaagacctgcggcgacgtgctggacaacctgaagggcgactgctaccaggtgctgatcgaggactgcatccccgtgctgaagagatacgccaaggagggcagagagttcgactacgtgatcaacgacctgaccgccgtgcccatcagcaccagccccgaggaggacagcacctgggagttcctgagactgatcctggacctgagcatgaaggtgctgaagcaggacggcaagtacttcacccagggcaactgcgtgaacctgaccgaggccctgagcctgtacgaggagcagctgggcagactgtactgccccgtggagttcagcaaggagatcgtgtgcgtgcccagctacctggagctgtgggtgttctacaccgtgtggaagaaggccaagccctag

SEQ ID NO: 100660 - DNA, 828 bp, Artificial Sequence
  Description of Artificial Sequence: Synthetic coding sequence
atgaaggagctgagccaggacagcaccggcagagtgaagagactgccccccatcgtgagaggcggcgccatcgacagatactggcccaccgccgacggcagactggtggagtacgacatcgacgaggtggtgtacgacgaggacagcccctaccagaacatcaagatcctgcacagcaagcagttcggcaacatcctgatcctgagcggcgacgtgaacctggccgagagcgacctggcctacaccagagccatcatgggcagcggcaaggaggactacaccggcaaggacgtgctgatcctgggcggcggcgacggcggcatcctgtgcgagatcgtgaagctgaagcccaagatggtgaccatggtggagatcgaccagatggtgatcgacggctgcaagaagtacatgagaaagacctgcggcgacgtgctggacaacctgaagggcgactgctaccaggtgctgatcgaggactgcatccccgtgctgaagagatacgccaaggagggcagagagttcgactacgtgatcaacgacctgaccgccgtgcccatcagcaccagccccgaggaggacagcacctgggagttcctgagactgatcctggacctgagcatgaaggtgctgaagcaggacggcaagtacttcacccagggcaactgcgtgaacctgaccgaggccctgagcctgtacgaggagcagctgggcagactgtactgccccgtggagttcagcaaggagatcgtgtgcgtgcccagctacctggagctgttcctgctgcagttctggagagtgagaagcagcaagtgcgccctggagggctag

SEQ ID NO: 100661 - DNA, 936 bp, Artificial Sequence
  Description of Artificial Sequence: Synthetic coding sequence
tgaggcggcagagccgaggccgccctgctgctggcccccagaagcgtgcccgccgccgccagaggcctgcagggccagagcagagtgcccgccggcagagccgccctgcccggccccggcagaccccccgccctgcccagaggcctggccgccttcgccctgcccctgggcgagagccccggctgcagagccagagccgaccccccctgggacgagggctgcagagactgcggcggcgccagaagagaccccagaggcgagcccggcctgggcgcctgcgccgagagaggctgccccagagacctgttcctgttcctgcaggccgccgacggcgagaccatcctgaagggcctgcagagcatcttccaggagcagggcatggccgagagcgtgcacacctggcaggaccacggctacctggccacctacaccaacaagaacggcagcttcgccaacctgagaatctacccccacggcctggtgctgctggacctgcagagctacgacggcgacgcccagggcaaggaggagatcgacagcatcctgaacaaggtggaggagagaatgaaggagctgagccaggacagcaccggcagagtgaagagactgccccccatcgtgagaggcggcgccatcgacagatactggcccaccgccgacggcagactggtggagtacgacatcgacgaggtggtgtacgacgaggacagcccctaccagaacatcaagatcctgcacagcaagcagttcggcaacatcctgatcctgagcggcgacgtgaacctggccgagagcgacctggcctacaccagagccatcatgggcagcggcaaggaggactacaccggcaaggacgtgctgatcctgggcggcggcgacggcggcatcctgtgcgagatcgtgaagctgaagcccaagatggtgaccatggtgtag

SEQ ID NO: 100662 - DNA, 3801 bp, Artificial Sequence
  Description of Artificial Sequence: Synthetic coding sequence
agagaggccaccccccccctgagaggcctgcccgccccccccagacacgcccccttccccgccggcagattcgagccccccagaaccaagcagggcggcagaggcagccacaccccctgggtgtacgtgatcaacgacctgggcatcgaggagaacctgaagaacgacggcaagcccaagtgccagaccggcggcaagagcaagagaaccatccagggcacccacaagaccaccaagcagcagagcaccgccgtggactgcaagatcaccagcagcaccaccggcgacaagcacttcgacaagagccccaccaagaccagacaccccagaaagatcgacctgagagccagatactgggccttcctgttcgacaacctgagaagagccgtggacgagatctacgtgacctgcgagagcgaccagagcgtggtggagtgcaaggaggtgctgatgatgctggacaactacgtgagagacttcaaggccctgatcgactggatccagctgcaggagaagctggagaagaccgacgcccagagcagacccaccagcctggcctgggaggtgaagaagatgagccccggcagacacgtgatccccagccccagcaccgacagaatcaacgtgaccagcaacgccagaagaagcctgaacttcggcggcagcaccggcaccgtgcccgcccccagactggcccccaccggcgtgagctgggccgacaaggtgaaggcccaccacaccggcagcaccgccagcagcgagatcacccccgcccagagctgcccccccatgaccgtgcagaaggccagcagaaagaacgagagaaaggacgccgagggctgggagaccgtgcagagaggcagacccatcagaagcagaagcaccgccgtgatgcccaaggtgagcctggccaccgaggccaccagaagcaaggacgacagcgacaaggagaacgtgtgcctgctgcccgacgagagcatccagaagggccagttcgtgggcgacggcaccagcaacaccatcgagagccaccccaaggacagcctgcacagctgcgaccaccccctggccgagaagacccagttcaccgtgagcaccctggacgacgtgaagaacagcggcagcatcagagacaactacgtgagaaccagcgagatcagcgccgtgcacatcgacaccgagtgcgtgagcgtgatgctgcaggccggcaccccccccctgcaggtgaacgaggagaagttccccgccgagaaggccagaatcgagaacgagatggaccccagcgacatcagcaacgtgagcgccgccaacctgagcatggccgaggtgctggccaagaaggaggagctggccgacagactggagaaggccaacgaggaggccatcgccagcgccatcgccgaggaggagcagctgaccagagagatcgaggccgaggagaacaacgacatcaacatcgagaccgacaacgacagcgacttcagcgccagcatgggcagcggcagcgtgagcttctgcggcatgagcatggactggaacgacgtgctggccgactacgaggccagagagagctggagacagaacaccagctggggcgacatcgtggaggaggagcccgccagaccccccggccacggcatccacatgcacgagaagctgagcagccccagcagaaagagaaccatcgccgagagcaagaagaagcacgaggagaagcagatgaaggcccagcagctgagagagaagctgagagaggagaagaccctgaagctgcagaagctgctggagagagagaaggacgtgagaaagtggaaggaggagctgctggaccagagaagaagaatgatggaggagaagctgctgcacgccgagttcaagagagaggtgcagctgcaggccatcgtgaagaaggcccaggaggaggaggccaaggtgaacgagatcgccttcatcaacaccctggaggcccagaacaagagacacgacgtgctgagcaagctgaaggagtacgagcagagactgaacgagctgcaggaggagagacagagaagacaggaggagaagcaggccagagacgaggccgtgcaggagagaaagagagccctggaggccgagagacaggccagagtggaggagctgctgatgaagagaaaggagcaggaggccagaatcgagcagcagagacaggagaaggagaaggccagagaggacgccgccagagagagagccagagacagagaggagagactggccgccctgaccgccgcccagcaggaggccatggaggagctgcagaagaagatccagctgaagcacgacgagagcatcagaagacacatggagcagatcgagcagagaaaggagaaggccgccgagctgagcagcggcagacacgccaacaccgactacgcccccaagctgaccccctacgagagaaagaagcagtgcagcctgtgcaacgtgctgatcagcagcgaggtgtacctgttcagccacgtgaagggcagaaagcaccagcaggccgtgagagagaacaccagcatccagggcagagagctgagcgacgaggaggtggagcacctgagcctgaagaagtacatcatcgacatcgtggtggagagcaccgcccccgccgaggccctgaaggacggcgaggagagacagaagaacaagaagaaggccaagaagatcaaggccagaatgaacttcagagccaaggagtacgagagcctgatggagaccaagaacagcggcagcgacagcccctacaaggccaagctgcagagactggccaaggacctgctgaagcaggtgcaggtgcaggacagcggcagctgggccaacaacaaggtgagcgccctggacagaaccctgggcgagatcaccagaatcctggagaaggagaacgtggccgaccagatcgccttccaggccgccggcggcctgaccgccctggagcacatcctgcaggccgtggtgcccgccaccaacgtgaacaccgtgctgagaatcccccccaagagcctgtgcaacgccatcaacgtgtacaacctgacctgcaacaactgcagcgagaactgcagcgacgtgctgttcagcaacaagatcaccttcctgatggacctgctgatccaccagctgaccgtgtacgtgcccgacgagaacaacaccatcctgggcagaaacaccaacaagcaggtgttcgagggcctgaccaccggcctgctgaaggtgagcgccgtggtgctgggctgcctgatcgccaacagacccgacggcaactgccagcccgccacccccaagatccccacccaggagatgaagaacaagcccagccagggcgaccccttcaacaacagagtgcaggacctgatcagctacgtggtgaacatgggcctgatcgacaagctgtgcgcctgcttcctgagcgtgcagggccccgtggacgagaaccccaagatggccatcttcctgcagcacgccgccggcctgctgcacgccatgtgcaccctgtgcttcgccgtgaccggcagaagctacagcatcttcgacaacaacagacaggaccccaccggcctgaccgccgccctgcaggccaccgacctggccggcgtgctgcacatgctgtactgcgtgctgttccacggcaccatcctggaccccagcaccgccagccccaaggagaactacacccagaacaccatccaggtggccatccagagcctgagattcttcaacagcttcgccgccctgcacctgcccgccttccaggtgcccagcatcggcctgtacagatgctag

SEQ ID NO: 100663 - DNA, 4203 bp, Artificial Sequence
  Description of Artificial Sequence: Synthetic coding sequence
atgatggccagcttccagagaagcaacagccacgacaaggtgagaagaatcgtggccgaggagggcagaaccgccagaaacctgatcgcctggagcgtgcccctggagagcaaggacgacgacggcaagcccaagtgccagaccggcggcaagagcaagagaaccatccagggcacccacaagaccaccaagcagagcaccgccgtggactgcaagatcaccagcagcaccaccggcgacaagcacttcgacaagagccccaccaagaccagacaccccagaaagatcgacctgagagccagatactgggccttcctgttcgacaacctgagaagagccgtggacgagatctacgtgacctgcgagagcgaccagagcgtggtggagtgcaaggaggtgctgatgatgctggacaactacgtgagagacttcaaggccctgatcgactggatccagctgcaggagaagctggagaagaccgacgcccagagcagacccaccagcctggcctgggaggtgaagaagatgagccccggcagacacgtgatccccagccccagcaccgacagaatcaacgtgaccagcaacgccagaagaagcctgaacttcggcggcagcaccggcaccgtgcccgcccccagactggcccccaccggcgtgagctgggccgacaaggtgaaggcccaccacaccggcagcaccgccagcagcgagatcacccccgcccagagctgcccccccatgaccgtgcagaaggccagcagaaagaacgagagaaaggacgccgagggctgggagaccgtgcagagaggcagacccatcagaagcagaagcaccgccgtgatgcccaaggtgagcctggccaccgaggccaccagaagcaaggacgacagcgacaaggagaacgtgtgcctgctgcccgacgagagcatccagaagggccagttcgtgggcgacggcaccagcaacaccatcgagagccaccccaaggacagcctgcacagctgcgaccaccccctggccgagaagacccagttcaccgtgagcaccctggacgacgtgaagaacagcggcagcatcagagacaactacgtgagaaccagcgagatcagcgccgtgcacatcgacaccgagtgcgtgagcgtgatgctgcaggccggcaccccccccctgcaggtgaacgaggagaagttccccgccgagaaggccagaatcgagaacgagatggaccccagcgacatcagcaacagcatggccgaggtgctggccaagaaggaggagctggccgacagactggagaaggccaacgaggaggccatcgccagcgccatcgccgaggaggagcagctgaccagagagatcgaggccgaggagaacaacgacatcaacatcgagaccgacaacgacagcgacttcagcgccagcatgggcagcggcagcgtgagcttctgcggcatgagcatggactggaacgacgtgctggccgactacgaggccagagagagctggagacagaacaccagctggggcgacatcgtggaggaggagcccgccagaccccccggccacggcatccacatgcacgagaagctgagcagccccagcagaaagagaaccatcgccgagagcaagaagaagcacgaggagaagcagatgaaggcccagcagctgagagagaagctgagagaggagaagaccctgaagctgcagaagctgctggagagagagaaggacgtgagaaagtggaaggaggagctgctggaccagagaagaagaatgatggaggagaagctgctgcacgccgagttcaagagagaggtgcagctgcaggccatcgtgaagaaggcccaggaggaggaggccaaggtgaacgagatcgccttcatcaacaccctggaggcccagaacaagagacacgacgtgctgagcaagctgaaggagtacgagcagagactgaacgagctgcaggaggagagacagagaagacaggaggagaagcaggccagagacgaggccgtgcaggagagaaagagagccctggaggccgagagacaggccagagtggaggagctgctgatgaagagaaaggagcaggaggccagaatcgagcagcagagacaggagaaggagaaggccagagaggacgccgccagagagagagccagagacagagaggagagactggccgccctgaccgccgcccagcaggaggccatggaggagctgcagaagaagatccagctgaagcacgacgagagcatcagaagacacatggagcagatcgagcagagaaaggagaaggccgccgagctgagcagcggcagacacgccaacaccgactacgcccccaagctgaccccctacgagagaaagaagcagtgcagcctgtgcaacgtgctgatcagcagcgaggtgtacctgttcagccacgtgaagggcagaaagcaccagcaggccgtgagagagaacaccagcatccagggcagagagctgagcgacgaggaggtggagcacctgagcctgaagaagtacatcatcgacatcgtggtggagagcaccgcccccgccgaggccctgaaggacggcgaggagagacagaagaacaagaagaaggccaagaagatcaaggccagaatgaacttcagagccaaggagtacgagagcctgatggagaccaagaacagcggcagcgacagcccctacaaggccaagctgcagagactggccaaggacctgctgaagcaggtgcaggtgcaggacagcggcagctgggccaacaacaaggtgagcgccctggacagaaccctgggcgagatcaccagaatcctggagaaggagaacgtggccgaccagatcgccttccaggccgccggcggcctgaccgccctggagcacatcctgcaggccgtggtgcccgccaccaacgtgaacaccgtgctgagaatcccccccaagagcctgtgcaacgccatcaacgtgtacaacctgacctgcaacaactgcagcgagaactgcagcgacgtgctgttcagcaacaagatcaccttcctgatggacctgctgatccaccagctgaccgtgtacgtgcccgacgagaacaacaccatcctgggcagaaacaccaacaagcaggtgttcgagggcctgaccaccggcctgctgaaggtgagcgccgtggtgctgggctgcctgatcgccaacagacccgacggcaactgccagcccgccacccccaagatccccacccaggagatgaagaacaagcccagccagggcgaccccttcaacaacagagtgcaggacctgatcagctacgtggtgaacatgggcctgatcgacaagctgtgcgcctgcttcctgagcgtgcagggccccgtggacgagaaccccaagatggccatcttcctgcagcacgccgccggcctgctgcacgccatgtgcaccctgtgcttcgccgtgaccggcagaagctacagcatcttcgacaacaacagacaggaccccaccggcctgaccgccgccctgcaggccaccgacctggccggcgtgctgcacatgctgtactgcgtgctgttccacggcaccatcctggaccccagcaccgccagccccaaggagaactacacccagaacaccatccaggtggccatccagagcctgagattcttcaacagcttcgccgccctgcacctgcccgccttccagagcatcgtgggcgccgagggcctgagcctggccttcagacacatggccagcagcctgctgggccactgcagccaggtgagctgcgagagcctgctgcacgaggtgatcgtgtgcgtgggctacttcaccgtgaaccaccccgacaaccaggtgatcgtgcagagcggcagacaccccaccgtgctgcagaagctgtgccagctgcccttccagtacttcagcgaccccagactgatcaaggtgctgttccccagcctgatcgccgcctgctacaacaaccaccagaacaagatcatcctggagcaggagatgagctgcgtgctgctggccaccttcatccaggacctggcccagacccccggccaggccgagaaccagccctaccagcccaagggcaagtgcctgggcagccaggactacctggagctggccaacagattcccccagcaggcctgggaggaggccagacagttcttcctgaagaaggagaagaagtag

SEQ ID NO: 100664 - DNA, 3465 bp, Artificial Sequence
  Description of Artificial Sequence: Synthetic coding sequence
atgaagaccaagtacatcttctgcaacatcaccgagagaaaggacgccgagggctgggagaccgtgcagagaggcagacccatcagaagcagaagcaccgccgtgatgcccaaggtgagcctggccaccgaggccaccagaagcaaggacgacagcgacaaggagaacgtgtgcctgctgcccgacgagagcatccagaagggccagttcgtgggcgacggcaccagcaacaccatcgagagccaccccaaggacagcctgcacagctgcgaccaccccctggccgagaagacccagttcaccgtgagcaccctggacgacgtgaagaacagcggcagcatcagagacaactacgtgagaaccagcgagatcagcgccgtgcacatcgacaccgagtgcgtgagcgtgatgctgcaggccggcaccccccccctgcaggtgaacgaggagaagttccccgccgagaaggccagaatcgagaacgagatggaccccagcgacatcagcaacagcatggccgaggtgctggccaagaaggaggagctggccgacagactggagaaggccaacgaggaggccatcgccagcgccatcgccgaggaggagcagctgaccagagagatcgaggccgaggagaacaacgacatcaacatcgagaccgacaacgacagcgacttcagcgccagcatgggcagcggcagcgtgagcttctgcggcatgagcatggactggaacgacgtgctggccgactacgaggccagagagagctggagacagaacaccagctggggcgacatcgtggaggaggagcccgccagaccccccggccacggcatccacatgcacgagaagctgagcagccccagcagaaagagaaccatcgccgagagcaagaagaagcacgaggagaagcagatgaaggcccagcagctgagagagaagctgagagaggagaagaccctgaagctgcagaagctgctggagagagagaaggacgtgagaaagtggaaggaggagctgctggaccagagaagaagaatgatggaggagaagctgctgcacgccgagttcaagagagaggtgcagctgcaggccatcgtgaagaaggcccaggaggaggaggccaaggtgaacgagatcgccttcatcaacaccctggaggcccagaacaagagacacgacgtgctgagcaagctgaaggagtacgagcagagactgaacgagctgcaggaggagagacagagaagacaggaggagaagcaggccagagacgaggccgtgcaggagagaaagagagccctggaggccgagagacaggccagagtggaggagctgctgatgaagagaaaggagcaggaggccagaatcgagcagcagagacaggagaaggagaaggccagagaggacgccgccagagagagagccagagacagagaggagagactggccgccctgaccgccgcccagcaggaggccatggaggagctgcagaagaagatccagctgaagcacgacgagagcatcagaagacacatggagcagatcgagcagagaaaggagaaggccgccgagctgagcagcggcagacacgccaacaccgactacgcccccaagctgaccccctacgagagaaagaagcagtgcagcctgtgcaacgtgctgatcagcagcgaggtgtacctgttcagccacgtgaagggcagaaagcaccagcaggccgtgagagagaacaccagcatccagggcagagagctgagcgacgaggaggtggagcacctgagcctgaagaagtacatcatcgacatcgtggtggagagcaccgcccccgccgaggccctgaaggacggcgaggagagacagaagaacaagaagaaggccaagaagatcaaggccagaatgaacttcagagccaaggagtacgagagcctgatggagaccaagaacagcggcagcgacagcccctacaaggccaagctgcagagactggccaaggacctgctgaagcaggtgcaggtgcaggacagcggcagctgggccaacaacaaggtgagcgccctggacagaaccctgggcgagatcaccagaatcctggagaaggagaacgtggccgaccagatcgccttccaggccgccggcggcctgaccgccctggagcacatcctgcaggccgtggtgcccgccaccaacgtgaacaccgtgctgagaatcccccccaagagcctgtgcaacgccatcaacgtgtacaacctgacctgcaacaactgcagcgagaactgcagcgacgtgctgttcagcaacaagatcaccttcctgatggacctgctgatccaccagctgaccgtgtacgtgcccgacgagaacaacaccatcctgggcagaaacaccaacaagcaggtgttcgagggcctgaccaccggcctgctgaaggtgagcgccgtggtgctgggctgcctgatcgccaacagacccgacggcaactgccagcccgccacccccaagatccccacccaggagatgaagaacaagcccagccagggcgaccccttcaacaacagagtgcaggacctgatcagctacgtggtgaacatgggcctgatcgacaagctgtgcgcctgcttcctgagcgtgcagggccccgtggacgagaaccccaagatggccatcttcctgcagcacgccgccggcctgctgcacgccatgtgcaccctgtgcttcgccgtgaccggcagaagctacagcatcttcgacaacaacagacaggaccccaccggcctgaccgccgccctgcaggccaccgacctggccggcgtgctgcacatgctgtactgcgtgctgttccacggcaccatcctggaccccagcaccgccagccccaaggagaactacacccagaacaccatccaggtggccatccagagcctgagattcttcaacagcttcgccgccctgcacctgcccgccttccagagcatcgtgggcgccgagggcctgagcctggccttcagacacatggccagcagcctgctgggccactgcagccaggtgagctgcgagagcctgctgcacgaggtgatcgtgtgcgtgggctacttcaccgtgaaccaccccgacaaccaggtgatcgtgcagagcggcagacaccccaccgtgctgcagaagctgtgccagctgcccttccagtacttcagcgaccccagactgatcaaggtgctgttccccagcctgatcgccgcctgctacaacaaccaccagaacaagatcatcctggagcaggagatgagctgcgtgctgctggccaccttcatccaggacctggcccagacccccggccaggccgagaaccagccctaccagcccaagggcaagtgcctgggcagccaggactacctggagctggccaacagattcccccagcaggcctgggaggaggccagacagttcttcctgaagaaggagaagaagtag

SEQ ID NO: 100665 - DNA, 4203 bp, Artificial Sequence; identical to SEQ ID NO: 100663
  Description of Artificial Sequence: Synthetic coding sequence

SEQ ID NO: 100666 - DNA, 1233 bp, Artificial Sequence
  Description of Artificial Sequence: Synthetic coding sequence
atgcacagaaagcacctgcaggagatccccgacctgagcagcaacgtggccaccagcttcacctggggctgggacagcagcaagaccagcgagctgctgagcggcatgggcgtgagcgccctggagaaggaggagcccgacagcgagaacatcccccaggagctgctgagcaacctgggccaccccgagagcccccccagaaagagactgaagagcaagggcagcgacaaggacttcgtgatcgtgagaagacccaagctgaacagagagaacttccccggcgtgagctgggacagcctgcccgacgagctgctgctgggcatcttcagctgcctgtgcctgcccgagctgctgaaggtgagcggcgtgtgcaagagatggtacagactggccagcgacgagagcctgtggcagaccctggacctgaccggcaagaacctgcaccccgacgtgaccggcagactgctgagccagggcgtgatcgccttcagatgccccagaagcttcatggaccagcccctggccgagcacttcagccccttcagagtgcagcacatggacctgagcaacagcgtgatcgaggtgagcaccctgcacggcatcctgagccagtgcagcaagctgcagaacctgagcctggagggcctgagactgagcgaccccatcgtgaacaccctggccaagaacagcaacctggtgagactgaacctgagcggctgcagcggcttcagcgagttcgccctgcagaccctgctgagcagctgcagcagactggacgagctgaacctgagctggtgcttcgacttcaccgagaagcacgtgcaggtggccgtggcccacgtgagcgagaccatcacccagctgaacctgagcggctacagaaagaacctgcagaagagcgacctgagcaccctggtgagaagatgccccaacctggtgcacctggacctgagcgacagcgtgatgctgaagaacgactgcttccaggagttcttccagctgaactacctgcagcacctgagcctgagcagatgctacgacatcatccccgagaccctgctgctggtgaccagagccggcgtgagaatcagactggacagcgacatcggctgcccccagacctacagaaccagcaagctgaagagcagccacaagctgttctgccagcacgtgagagtgatctgcatcttcgtgtgcgacttctacttctacagactggtgctgaagcagtag

SEQ ID NO: 100667 - DNA, 1275 bp, Artificial Sequence
  Description of Artificial Sequence: Synthetic coding sequence
atgcacagaaagcacctgcaggagatccccgacctgagcagcaacgtggccaccagcttcacctggggctgggacagcagcaagaccagcgagctgctgagcggcatgggcgtgagcgccctggagaaggaggagcccgacagcgagaacatcccccaggagctgctgagcaacctgggccaccccgagagcccccccagaaagagactgaagagcaagggcagcgacaaggacttcgtgatcgtgagaagacccaagctgaacagagagaacttccccggcgtgagctgggacagcctgcccgacgagctgctgctgggcatcttcagctgcctgtgcctgcccgagctgctgaaggtgagcggcgtgtgcaagagatggtacagactggccagcgacgagagcctgtggcagaccctggacctgaccggcaagaacctgcaccccgacgtgaccggcagactgctgagccagggcgtgatcgccttcagatgccccagaagcttcatggaccagcccctggccgagcacttcagccccttcagagtgcagcacatggacctgagcaacagcgtgatcgaggtgagcaccctgcacggcatcctgagccagtgcagcaagctgcagaacctgagcctggagggcctgagactgagcgaccccatcgtgaacaccctggccaagaacagcaacctggtgagactgaacctgagcggctgcagcggcttcagcgagttcgccctgcagaccctgctgagcagctgcagcagactggacgagctgaacctgagctggtgcttcgacttcaccgagaagcacgtgcaggtggccgtggcccacgtgagcgagaccatcacccagctgaacctgagcggctacagaaagaacctgcagaagagcgacctgagcaccctggtgagaagatgccccaacctggtgcacctggacctgagcgacagcgtgatgctgaagaacgactgcttccaggagttcttccagctgaactacctgcagcacctgagcctgagcagatgctacgacatcatccccgagaccctgctggagctgggcgagatccccaccctgaagaccctgcaggtgttcggcatcgtgcccgacggcaccctgcagctgctgaaggaggccctgccccacctgcagatcaactgcagccacttcaccaccatcgccagacccaccatcggcaacaagaagaaccaggagatctggggcatcaagtgcagactgaccctgcagaagcccagctgcctgtag

SEQ ID NO: 100668 - DNA, 1173 bp, Artificial Sequence
  Description of Artificial Sequence: Synthetic coding sequence
atgcacagaaagcacctgcaggagaaggaggagcccgacagcgagaacatcccccaggagctgctgagcaacctgggccaccccgagagcccccccagaaagagactgaagagcaagggcagcgacaaggacttcgtgatcgtgagaagacccaagctgaacagagagaacttccccggcgtgagctgggacagcctgcccgacgagctgctgctgggcatcttcagctgcctgtgcctgcccgagctgctgaaggtgagcggcgtgtgcaagagatggtacagactggccagcgacgagagcctgtggcagaccctggacctgaccggcaagaacctgcaccccgacgtgaccggcagactgctgagccagggcgtgatcgccttcagatgccccagaagcttcatggaccagcccctggccgagcacttcagccccttcagagtgcagcacatggacctgagcaacagcgtgatcgaggtgagcaccctgcacggcatcctgagccagtgcagcaagctgcagaacctgagcctggagggcctgagactgagcgaccccatcgtgaacaccctggccaagaacagcaacctggtgagactgaacctgagcggctgcagcggcttcagcgagttcgccctgcagaccctgctgagcagctgcagcagactggacgagctgaacctgagctggtgcttcgacttcaccgagaagcacgtgcaggtggccgtggcccacgtgagcgagaccatcacccagctgaacctgagcggctacagaaagaacctgcagaagagcgacctgagcaccctggtgagaagatgccccaacctggtgcacctggacctgagcgacagcgtgatgctgaagaacgactgcttccaggagttcttccagctgaactacctgcagcacctgagcctgagcagatgctacgacatcatccccgagaccctgctggagctgggcgagatccccaccctgaagaccctgcaggtgttcggcatcgtgcccgacggcaccctgcagctgctgaaggaggccctgccccacctgcagatcaactgcagccacttcaccaccatcgccagacccaccatcggcaacaagaagaaccaggagatctggggcatcaagtgcagactgaccctgcagaagcccagctgcctgtag

SEQ ID NO: 100669 - DNA, 633 bp, Artificial Sequence
  Description of Artificial Sequence: Synthetic coding sequence
atggaccagcccctggccgagcacttcagcaccctggccaagaacagcaacctggtgagactgaacctgagcggctgcagcggcttcagcgagttcgccctgcagaccctgctgagcagctgcagcagactggacgagctgaacctgagctggtgcttcgacttcaccgagaagcacgtgcaggtggccgtggcccacgtgagcgagaccatcacccagctgaacctgagcggctacagaaagaacctgcagaagagcgacctgagcaccctggtgagaagatgccccaacctggtgcacctggacctgagcgacagcgtgatgctgaagaacgactgcttccaggagttcttccagctgaactacctgcagcacctgagcctgagcagatgctacgacatcatccccgagaccctgctggagctgggcgagatccccaccctgaagaccctgcaggtgttcggcatcgtgcccgacggcaccctgcagctgctgaaggaggccctgccccacctgcagatcaactgcagccacttcaccaccatcgccagacccaccatcggcaacaagaagaaccaggagatctggggcatcaagtgcagactgaccctgcagaagcccagctgcctgtag

SEQ ID NO: 100670 - DNA, 1362 bp, Artificial Sequence
  Description of Artificial Sequence: Synthetic coding sequence
atggccctggtgagagccctggtgtgctgcctgctgaccgcctggcactgcagaagcggcctgggcctgcccgtggcccccgccggcggcagaaaccccccccccgccatcggccagttctggcacgtgaccgacctgcacctggaccccacctaccacatcaccgacgaccacaccaaggtgtgcgccagcagcaagggcgccaacgccagcaaccccggccccttcggcgacgtgctgtgcgacagcccctaccagctgatcctgagcgccttcgacttcatcaagaacagcggccaggaggccagcttcatgatctggaccggcgacagccccccccacgtgcccgtgcccgagctgagcaccgacaccgtgatcaacgtgatcaccaacatgaccaccaccatccagagcctgttccccaacctgcaggtgttccccgccctgggcaaccacgactactggccccaggaccagctgcccgtggtgaccagcaaggtgtacaacgccgtggccaacctgtggaagccctggctggacgaggaggccatcagcaccctgagaaagggcggcttctacagccagaaggtgaccaccaaccccaacctgagaatcatcagcctgaacaccaacctgtactacggccccaacatcatgaccctgaacaagaccgaccccgccaaccagttcgagtggctggagagcaccctgaacaacagccagcagaacaaggagaaggtgtacatcatcgcccacgtgcccgtgggctacctgcccagcagccagaacatcaccgccatgagagagtactacaacgagaagctgatcgacatcttccagaagtacagcgacgtgatcgccggccagttctacggccacacccacagagacagcatcatggtgctgagcgacaagaagggcagccccgtgaacagcctgttcgtggcccccgccgtgacccccgtgaagagcgtgctggagaagcagaccaacaaccccggcatcagactgttccagtacgaccccagagactacaagctgctggacatgctgcagtactacctgaacctgaccgaggccaacctgaagggcgagagcatctggaagctggagtacatcctgacccagacctacgacatcgaggacctgcagcccgagagcctgtacggcctggccaagcagttcaccatcctggacagcaagcagttcatcaagtactacaactacttcttcgtgagctacgacagcagcgtgacctgcgacaagacctgcaaggccttccagatctgcgccatcatgaacctggacaacatcagctacgccgactgcctgaagcagctgtacatcaagcacaactactag

SEQ ID NO: 100671 - DNA, 969 bp, Artificial Sequence
  Description of Artificial Sequence: Synthetic coding sequence
atgaccaccaccatccagagcctgttccccaacctgcaggtgttccccgccctgggcaaccacgactactggccccaggaccagctgcccgtggtgaccagcaaggtgtacaacgccgtggccaacctgtggaagccctggctggacgaggaggccatcagcaccctgagaaagggcggcttctacagccagaaggtgaccaccaaccccaacctgagaatcatcagcctgaacaccaacctgtactacggccccaacatcatgaccctgaacaagaccgaccccgccaaccagttcgagtggctggagagcaccctgaacaacagccagcagaacaaggagaaggtgtacatcatcgcccacgtgcccgtgggctacctgcccagcagccagaacatcaccgccatgagagagtactacaacgagaagctgatcgacatcttccagaagtacagcgacgtgatcgccggccagttctacggccacacccacagagacagcatcatggtgctgagcgacaagaagggcagccccgtgaacagcctgttcgtggcccccgccgtgacccccgtgaagagcgtgctggagaagcagaccaacaaccccggcatcagactgttccagtacgaccccagagactacaagctgctggacatgctgcagtactacctgaacctgaccgaggccaacctgaagggcgagagcatctggaagctggagtacatcctgacccagacctacgacatcgaggacctgcagcccgagagcctgtacggcctggccaagcagttcaccatcctggacagcaagcagttcatcaagtactacaactacttcttcgtgagctacgacagcagcgtgacctgcgacaagacctgcaaggccttccagatctgcgccatcatgaacctggacaacatcagctacgccgactgcctgaagcagctgtacatcaagcacaactactag

SEQ ID NO: 100672 - DNA, 726 bp, Artificial Sequence
  Description of Artificial Sequence: Synthetic coding sequence
atgaaggaggtggtgtactggagccccaagaaggtggccgactggctgctggagaacgccatgcccgagtactgcgagcccctggagcacttcaccggccaggacctgatcaacctgacccaggaggacttcaagaagccccccctgtgcagagtgagcagcgacaacggccagagactgctggacatgatcgagaccctgaagatggagcaccacctggaggcccacaagaacggccacgccaacggccacctgaacatcggcgtggacatccccacccccgacggcagcttcagcatcaagatcaagcccaacggcatgcccaacggctacagaaaggagatgatcaagatccccatgcccgagctggagagaagccagtaccccatggagtggggcaagaccttcctggccttcctgtacgccctgagctgcttcgtgctgaccaccgtgatgatcagcgtggtgcacgagagagtgccccccaaggaggtgcagccccccctgcccgacaccttcttcgaccacttcaacagagtgcagtgggccttcagcatctgcgagatcaacggcatgatcctggtgggcctgtggctgatccagtggctgctgctgaagtacaaggacgtgggcaacgagagcagagtggtgatgatcttcctgagcatcgtgcaccccgtgctgctgctgggcagcatcgccggcttcctgagcctgagcctgtag

SEQ ID NO: 100673 - DNA, 1242 bp, Artificial Sequence
  Description of Artificial Sequence: Synthetic coding sequence
atgaaggaggtggtgtactggagccccaagaaggtggccgactggctgctggagaacgccatgcccgagtactgcgagcccctggagcacttcaccggccaggacctgatcaacctgacccaggaggacttcaagaagccccccctgtgcagagtgagcagcgacaacggccagagactgctggacatgatcgagaccctgaagatggagcaccacctggaggcccacaagaacggccacgccaacggccacctgaacatcggcgtggacatccccacccccgacggcagcttcagcatcaagatcaagcccaacggcatgcccaacggctacagaaaggagatgatcaagatccccatgcccgagctggagagaagccagtaccccatggagtggggcaagaccttcctggccttcctgtacgccctgagctgcttcgtgctgaccaccgtgatgatcagcgtggtgcacgagagagtgccccccaaggaggtgcagccccccctgcccgacaccttcttcgaccacttcaacagagtgcagtgggccttcagcatctgcgagatcaacggcatgatcctggtgggcctgtggctgatccagtggctgctgctgaagtacaagagcatcatcagcagaagattcttctgcatcgtgggcaccctgtacctgtacagatgcatcaccatgtacgtgaccaccctgcccgtgcccggcatgcacttcaactgcagccccaagctgttcggcgactgggaggcccagctgagaagaatcatgaagctgatcgccggcggcggcctgagcatcaccggcagccacaacatgtgcggcgactacctgtacagcggccacaccgtgatgctgaccctgacctacctgttcatcaaggagtacagccccagaagactgtggtggtaccactggatctgctggctgctgagcgtggtgggcatcttctgcatcctgctggcccacgaccactacaccgtggacgtggtggtggcctactacatcaccaccagactgttctggtggtaccacaccatggccaaccagcaggtgctgaaggaggccagccagatgaacctgctggccagagtgtggtggtacagacccttccagtacttcgagaagaacgtgcagggcatcgtgcccagaagctaccactggcccttcccctggcccgtggtgcacctgagcagacaggtgaagtacagcagactggtgaacgacacctag

SEQ ID NO: 100674 - DNA, 642 bp, Artificial Sequence
  Description of Artificial Sequence: Synthetic coding sequence
acctacatgtacatcagcaacaagagcatcatcagcagaagattcttctgcatcgtgggcaccctgtacctgtacagatgcatcaccatgtacgtgaccaccctgcccgtgcccggcatgcacttcaactgcagccccaagctgttcggcgactgggaggcccagctgagaagaatcatgaagctgatcgccggcggcggcctgagcatcaccggcagccacaacatgtgcggcgactacctgtacagcggccacaccgtgatgctgaccctgacctacctgttcatcaaggagtacagccccagaagactgtggtggtaccactggatctgctggctgctgagcgtggtgggcatcttctgcatcctgctggcccacgaccactacaccgtggacgtggtggtggcctactacatcaccaccagactgttctggtggtaccacaccatggccaaccagcaggtgctgaaggaggccagccagatgaacctgctggccagagtgtggtggtacagacccttccagtacttcgagaagaacgtgcagggcatcgtgcccagaagctaccactggcccttcccctggcccgtggtgcacctgagcagacaggtgaagtacagcagactggtgaacgacacctag

SEQ ID NO: 100675 - DNA, 735 bp, Artificial Sequence
  Description of Artificial Sequence: Synthetic coding sequence
atgggcggcagaggcggcggcggcagaagcagacagctgcccggcagattcagagcccccgccgccagatggcccggcggcagatggctgcccggcgcccccagaaccgtgacctggagcatcatcagcagaagattcttctgcatcgtgggcaccctgtacctgtacagatgcatcaccatgtacgtgaccaccctgcccgtgcccggcatgcacttcaactgcagccccaagctgttcggcgactgggaggcccagctgagaagaatcatgaagctgatcgccggcggcggcctgagcatcaccggcagccacaacatgtgcggcgactacctgtacagcggccacaccgtgatgctgaccctgacctacctgttcatcaaggagtacagccccagaagactgtggtggtaccactggatctgctggctgctgagcgtggtgggcatcttctgcatcctgctggcccacgaccactacaccgtggacgtggtggtggcctactacatcaccaccagactgttctggtggtaccacaccatggccaaccagcaggtgctgaaggaggccagccagatgaacctgctggccagagtgtggtggtacagacccttccagtacttcgagaagaacgtgcagggcatcgtgcccagaagctaccactggcccttcccctggcccgtggtgcacctgagcagacaggtgaagtacagcagactggtgaacgacacctag

SEQ ID NO: 100676 - DNA, 1098 bp, Artificial Sequence
  Description of Artificial Sequence: Synthetic coding sequence
atggacatcatcgagaccgccaagctggaggagcacctggagaaccagcccagcgaccccaccaacacctacgccagacccgccgagcccgtggaggaggagaacaagaacggcaacggcaagcccaagagcctgagcagcggcctgagaaagggcaccaagaagtaccccgactacatccagatcgccatgcccaccgagagcagaaacaagttccccctggagtggtggaagaccggcatcgccttcatctacgccgtgttcaacctggtgctgaccaccgtgatgatcaccgtggtgcacgagagagtgccccccaaggagctgagcccccccctgcccgacaagttcttcgactacatcgacagagtgaagtgggccttcagcgtgagcgagatcaacggcatcatcctggtgggcctgtggatcacccagtggctgttcctgagatacaagagcatcgtgggcagaagattctgcttcatcatcggcaccctgtacctgtacagatgcatcaccatgtacgtgaccaccctgcccgtgcccggcatgcacttccagtgcgcccccaagctgaacggcgacagccaggccaaggtgcagagaatcctgagactgatcagcggcggcggcctgagcatcaccggcagccacatcctgtgcggcgacttcctgttcagcggccacaccgtgaccctgaccctgacctacctgttcatcaaggagtacagccccagacacttctggtggtaccacctgatctgctggctgctgagcgccgccggcatcatctgcatcctggtggcccacgagcactacaccatcgacgtgatcatcgcctactacatcaccaccagactgttctggtggtaccacagcatggccaacgagaagaacctgaaggtgagcagccagaccaacttcctgagcagagcctggtggttccccatcttctacttcttcgagaagaacgtgcagggcagcatcccctgctgcttcagctggcccctgagctggccccccggctgcttcaagagcagctgcaagaagtacagcagagtgcagaagatcggcgaggacaacgagaagagcacctag

SEQ ID NO: 100677 - DNA, 1098 bp, Artificial Sequence; identical to SEQ ID NO: 100676
  Description of Artificial Sequence: Synthetic coding sequence

SEQ ID NO: 100678 - DNA, 1098 bp, Artificial Sequence; identical to SEQ ID NO: 100676
  Description of Artificial Sequence: Synthetic coding sequence

SEQ ID NO: 100679 - DNA, 135 bp, Artificial Sequence
  Description of Artificial Sequence: Synthetic coding sequence
atggacatcatcgagaccgccaagctggaggagcacctggagaaccagcccagcgaccccaccaacacctacgccagacccgccgagcccgtggaggaggagaacaagaacggcaacggcaagcccaagagctag

SEQ ID NO: 100680 - DNA, 105 bp, Artificial Sequence
  Description of Artificial Sequence: Synthetic coding sequence
atggacatcatcgagaccgccaagctggaggagcacctggagaaccagcccagcgaccccaccaacacctacgccagacccgccgagcccgtggaggaggagtag

SEQ ID NO: 100681 - DNA, 1326 bp, Artificial Sequence
  Description of Artificial Sequence: Synthetic coding sequence
atgagcctgagacagagactggcccagctggtgggcagactgcaggacccccagaaggtggccagattccagagactgtgcggcgtggaggccccccccagaagaagcgccgacagaagagaggacgagaaggccgaggcccccctggccggcgaccccagactgagaggcagacagcccggcgcccccggcggcccccagccccccggcagcgacagaaaccagtgccccgccaagcccgacggcggcggcgcccccaacggcgtgagaaacggcctggccgccgagctgggccccgccagccccagaagagccggcgccctgagaagaaacagcctgaccggcgaggagggccagctggccagagtgagcaactggcccctgtactgcctgttctgcttcggcaccgagctgggcaacgagctgttctacatcctgttcttccccttctggatctggaacctggaccccctggtgggcagaagactggtggtgatctgggtgctggtgatgtacctgggccagtgcaccaaggacatcatcagatggcccagacccgccagcccccccgtggtgaagctggaggtgttctacaacagcgagtacagcatgcccagcacccacgccatgagcggcaccgccatccccatcagcatggtgctgctgacctacggcagatggcagtaccccctgatctacggcctgatcctgatcccctgctggtgcagcctggtgtgcctgagcagaatctacatgggcatgcacagcatcctggacatcatcgccggcttcctgtacaccatcctgatcctggccgtgttctaccccttcgtggacctgatcgacaacttcaaccagacccacaagtacgcccccttcatcatcatcggcctgcacctggccctgggcatcttcagcttcaccctggacacctggagcaccagcagaggcgacaccgccgagatcctgggcagcggcgccggcatcgcctgcggcagccacgtgacctacaacatgggcctggtgctggaccccagcctggacaccctgcccctggccggcccccccatcaccgtgaccctgttcggcaaggccatcctgagaatcctgatcggcatggtgttcgtgctgatcatcagagacgtgatgaagaagatcaccatccccctggcctgcaagatcttcaacatcccctgcgacgacatcagaaaggccagacagcacatggaggtggagctgccctacagatacatcacctacggcatggtgggcttcagcatcaccttcttcgtgccctacatcttcttcttcatcggcatcagctag

SEQ ID NO: 100682 - DNA, 1200 bp, Artificial Sequence
  Description of Artificial Sequence: Synthetic coding sequence
atggccgagctgctgagaagcctgcaggacagccagctggtggccagattccagagaagatgcggcctgttccccgcccccgacgagggccccagagagaacggcgccgaccccaccgagagagccgccagagtgcccggcgtggagcacctgcccgccgccaacggcaagggcggcgaggcccccgccaacggcctgagaagagccgccgcccccgaggcctacgtgcagaagtacgtggtgaagaactacttctactactacctgttccagttcagcgccgccctgggccaggaggtgttctacatcaccttcctgcccttcacccactggaacatcgacccctacctgagcagaagactgatcatcatctgggtgctggtgatgtacatcggccaggtggccaaggacgtgctgaagtggcccagacccagcagcccccccgtggtgaagctggagaagagactgatcgccgagtacggcatgcccagcacccacgccatggccgccaccgccatcgccttcaccctgctgatcagcaccatggacagataccagtaccccttcgtgctgggcctggtgatggccgtggtgttcagcaccctggtgtgcctgagcagactgtacaccggcatgcacaccgtgctggacgtgctgggcggcgtgctgatcaccgccctgctgatcgtgctgacctaccccgcctggaccttcatcgactgcctggacagcgccagccccctgttccccgtgtgcgtgatcgtggtgcccttcttcctgtgctacaactaccccgtgagcgactactacagccccaccagagccgacaccaccaccatcctggccgccggcgccggcgtgaccatcggcttctggatcaaccacttcttccagctggtgagcaagcccgccgagagcctgcccgtgatccagaacatcccccccctgaccacctacatgctggtgctgggcctgaccaagttcgccgtgggcatcgtgctgatcctgctggtgagacagctggtgcagaacctgagcctgcaggtgctgtacagctggttcaaggtggtgaccagaaacaaggaggccagaagaagactggagatcgaggtgccctacaagttcgtgacctacaccagcgtgggcatctgcgccaccaccttcgtgcccatgctgcacagattcctgggcctgccctag

SEQ ID NO: 100683 - DNA, 1062 bp, Artificial Sequence
  Description of Artificial Sequence: Synthetic coding sequence
atgggcagcctgtacagcgagtacctgaaccccaacaaggtgcaggagcactacaactacaccaaggagaccctggagacccaggagaccaccagcagacaggtggccagcgccttcatcgtgatcctgtgctgcgccatcgtggtggagaacctgctggtgctgatcgccgtggccagaaacagcaagttccacagcgccatgtacctgttcctgggcaacctggccgccagcgacctgctggccggcgtggccttcgtggccaacaccctgctgagcggcagcgtgaccctgagactgacccccgtgcagtggttcgccagagagggcagcgccttcatcaccctgagcgccagcgtgttcagcctgctggccatcgccatcgagagacacgtggccatcgccaaggtgaagctgtacggcagcgacaagagctgcagaatgctgctgctgatcggcgccagctggctgatcagcctggtgctgggcggcctgcccatcctgggctggaactgcctgggccacctggaggcctgcagcaccgtgctgcccctgtacgccaagcactacgtgctgtgcgtggtgaccatcttcagcatcatcctgctggccatcgtggccctgtacgtgagaatctactgcgtggtgagaagcagccacgccgacatggccgccccccagaccctggccctgctgaagaccgtgaccatcgtgctgggcgtgttcatcgtgtgctggctgcccgccttcagcatcctgctgctggactacgcctgccccgtgcacagctgccccatcctgtacaaggcccactacttcttcgccgtgagcaccctgaacagcctgctgaaccccgtgatctacacctggagaagcagagacctgagaagagaggtgctgagacccctgcagtgctggagacccggcgtgggcgtgcagggcagaagaagaggcggcacccccggccaccacctgctgcccctgagaagcagcagcagcctggagagaggcatgcacatgcccaccagccccaccttcctggagggcaacaccgtggtgtag

SEQ ID NO: 100684 - DNA, 1137 bp, Artificial Sequence
  Description of Artificial Sequence: Synthetic coding sequence
atggccaccgccctgccccccagactgcagcccgtgagaggcaacgagaccctgagagagcactaccagtacgtgggcaagctggccggcagactgaaggaggccagcgagggcagcaccctgaccaccgtgctgttcctggtgatctgcagcttcatcgtgctggagaacctgatggtgctgatcgccatctggaagaacaacaagttccacaacagaatgtacttcttcatcggcaacctggccctgtgcgacctgctggccggcatcgcctacaaggtgaacatcctgatgagcggcaagaagaccttcagcctgagccccaccgtgtggttcctgagagagggcagcatgttcgtggccctgggcgccagcacctgcagcctgctggccatcgccatcgagagacacctgaccatgatcaagatgagaccctacgacgccaacaagagacacagagtgttcctgctgatcggcatgtgctggctgatcgccttcaccctgggcgccctgcccatcctgggctggaactgcctgcacaacctgcccgactgcagcaccatcctgcccctgtacagcaagaagtacatcgccttctgcatcagcatcttcaccgccatcctggtgaccatcgtgatcctgtacgccagaatctacttcctggtgaagagcagcagcagaaaggtggccaaccacaacaacagcgagagaagcatggccctgctgagaaccgtggtgatcgtggtgagcgtgttcatcgcctgctggagccccctgttcatcctgttcctgatcgacgtggcctgcagagtgcaggcctgccccatcctgttcaaggcccagtggttcatcgtgctggccgtgctgaacagcgccatgaaccccgtgatctacaccctggccagcaaggagatgagaagagccttcttcagactggtgtgcaactgcctggtgagaggcagaggcgccagagccagccccatccagcccgccctggaccccagcagaagcaagagcagcagcagcaacaacagcagccacagccccaaggtgaaggaggacctgccccacaccgcccccagcagctgcatcatggacaagaacgccgccctgcagaacggcatcttctgcaactag

SEQ ID NO: 100685 - DNA, 1137 bp, Artificial Sequence; identical to SEQ ID NO: 100684
  Description of Artificial Sequence: Synthetic coding sequence

SEQ ID NO: 100686 - DNA, 1155 bp, Artificial Sequence
  Description of Artificial Sequence: Synthetic coding sequence
atgaacgccaccggcacccccgtggcccccgagagctgccagcagctggccgccggcggccacagcagactgatcgtgctgcactacaaccacagcggcagactggccggcagaggcggccccgaggacggcggcctgggcgccctgagaggcctgagcgtggccgccagctgcctggtggtgctggagaacctgctggtgctggccgccatcaccagccacatgagaagcagaagatgggtgtactactgcctggtgaacatcaccctgagcgacctgctgaccggcgccgcctacctggccaacgtgctgctgagcggcgccagaaccttcagactggcccccgcccagtggttcctgagagagggcctgctgttcaccgccctggccgccagcaccttcagcctgctgttcaccgccggcgagagattcgccaccatggtgagacccgtggccgagagcggcgccaccaagaccagcagagtgtacggcttcatcggcctgtgctggctgctggccgccctgctgggcatgctgcccctgctgggctggaactgcctgtgcgccttcgacagatgcagcagcctgctgcccctgtacagcaagagatacatcctgttctgcctggtgatcttcgccggcgtgctggccaccatcatgggcctgtacggcgccatcttcagactggtgcaggccagcggccagaaggcccccagacccgccgccagaagaaaggccagaagactgctgaagaccgtgctgatgatcctgctggccttcctggtgtgctggggccccctgttcggcctgctgctggccgacgtgttcggcagcaacctgtgggcccaggagtacctgagaggcatggactggatcctggccctggccgtgctgaacagcgccgtgaaccccatcatctacagcttcagaagcagagaggtgtgcagagccgtgctgagcttcctgtgctgcggctgcctgagactgggcatgagaggccccggcgactgcctggccagagccgtggaggcccacagcggcgccagcaccaccgacagcagcctgagacccagagacagcttcagaggcagcagaagcctgagcttcagaatgagagagcccctgagcagcatcagcagcgtgagaagcatctag

SEQ ID NO: 100687 - DNA, 1197 bp, Artificial Sequence
  Description of Artificial Sequence: Synthetic coding sequence
atggagagcggcctgctgagacccgcccccgtgagcgaggtgatcgtgctgcactacaactacaccggcaagctgagaggcgccagataccagcccggcgccggcctgagagccgacgccgtggtgtgcctggccgtgtgcgccttcatcgtgctggagaacctggccgtgctgctggtgctgggcagacaccccagattccacgcccccatgttcctgctgctgggcagcctgaccctgagcgacctgctggccggcgccgcctacgccgccaacatcctgctgagcggccccctgaccctgaagctgagccccgccctgtggttcgccagagagggcggcgtgttcgtggccctgaccgccagcgtgctgagcctgctggccatcgccctggagagaagcctgaccatggccagaagaggccccgcccccgtgagcagcagaggcagaaccctggccatggccgccgccgcctggggcgtgagcctgctgctgggcctgctgcccgccctgggctggaactgcctgggcagactggacgcctgcagcaccgtgctgcccctgtacgccaaggcctacgtgctgttctgcgtgctggccttcgtgggcatcctggccgccatctgcgccctgtacgccagaatctactgccaggtgagagccaacgccagaagactgcccgccagacccggcaccgccggcaccaccagcaccagagccagaagaaagcccagaagcctggccctgctgagaaccctgagcgtggtgctgctggccttcgtggcctgctggggccccctgttcctgctgctgctgctggacgtggcctgccccgccagaacctgccccgtgctgctgcaggccgaccccttcctgggcctggccatggccaacagcctgctgaaccccatcatctacaccctgaccaacagagacctgagacacgccctgctgagactggtgtgctgcggcagacacagctgcggcagagaccccagcggcagccagcagagcgccagcgccgccgaggccagcggcggcctgagaagatgcctgccccccggcctggacggcagcttcagcggcagcgagagaagcagcccccagagagacggcctggacaccagcggcagcaccggcagccccggcgcccccaccgccgccagaaccctggtgagcgagcccgccgccgactag

SEQ ID NO: 100688 - DNA, 933 bp, Artificial Sequence
  Description of Artificial Sequence: Synthetic coding sequence
atggagagcggcctgctgagacccgcccccgtgagcgaggtgatcgtgctgcactacaactacaccggcaagctgagaggcgccagataccagcccggcgccggcctgagagccgacgccgtggtgtgcctggccgtgtgcgccttcatcgtgctggagaacctggccgtgctgctggtgctgggcagacaccccagattccacgcccccatgttcctgctgctgggcagcctgaccctgagcgacctgctggccggcgccgcctacgccgccaacatcctgctgagcggccccctgaccctgaagctgagccccgccctgtggttcgccagagagggcggcgtgttcgtggccctgaccgccagcgtgctgagcctgctggccatcgccctggagagaagcctgaccatggccagaagaggccccgcccccgtgagcagcagaggcagaaccctggccatggccgccgccgcctggggcgtgagcctgctgctgggcctgctgcccgccctgggctggaactgcctgggcagactggacgcctgcagcaccgtgctgcccctgtacgccaaggcctacgtgctgttctgcgtgctggccttcgtgggcatcctggccgccatctgcgccctgtacgccctggccggcctggccgcccacgcccagagaggcgcccccggcctgtgcggcatgctgggcccccccctgcccgccgccgtggccagaagaggcgtgcccggcgcccacctgagctgcacccccgccggcagaagcctgcccggcaccggccacggccagctgaccagcgagccccaccacctgcacgcccaccagcccagacccgcccccagagcccccgcccccggcctgctgagaacccccctgctgagacagagacccgagtggctgcccgccgtgggcgagagaggctag

SEQ ID NO: 100689 - DNA, 1197 bp, Artificial Sequence; identical to SEQ ID NO: 100687
  Description of Artificial Sequence: Synthetic coding sequence

SEQ ID NO: 100690 - DNA, 5016 bp, Artificial Sequence
  Description of Artificial Sequence: Synthetic coding sequence
atggacggcaacagcctgctgagcgtgcccagcaacctggagagcagcagaatgtacgacgtgctggagccccagcagggcagaggctgcggcagcagcggcagcggccccggcaacagcatcaccgcctgcaagaaggtgctgagaagcaacagcctgctggagagcaccgactactggctgcagaaccagagaatgccctgccagatcggcttcgtggaggacaagagcgagaactgcgccagcgtgtgcttcgtgaacctggacgtgaacaaggacgagtgcagcaccgagcacctgcagcagaagctggtgaacgtgagccccgacctgcccaagctgatcagcagcatgaacgtgcagcagcccaaggagaacgagatcgtggtgctgagcggcctggccagcggcaacctgcaggccgacttcgaggtgagccagtgcccctggctgcccgacatctgcctggtgcagtgcgccagaggcaacagacccaacagcaccaactgcatcatcttcgagatcaacaagttcctgatcggcctggagctggtgcaggagagacagctgcacctggagaccaacatcctgaagctggaggacgacaccaactgcagcctgagcagcatcgaggaggacttcctgaccgccagcgagcacctggaggaggagagcgaggtggacgagagcagaaacgactacgagaacatcaacgtgagcgccaacgtgctggagagcaagcagctgaagggcgccacccaggtggagtggaactgcaacaaggagaagtggctgtacgccctggaggacaagtacatcaacaagtaccccacccccctgatcaagaccgagagaagccccgagaacctgaccaagaacaccgccctgcagagcctggaccccagcgccaagcccagccagtggaagagagaggccgtgggcaacggcagacaggccacccactactaccacagcgaggccttcaagggccagatggagaagagccaggccctgtacatccccaaggacgcctacttcagcatgatggacaaggacgtgcccagcgcctgcgccgtggccgagcagagaagcaacctgaaccccggcgaccacgaggacaccagaaacgccctgccccccagacaggacggcgaggtgaccaccggcaagtacgccaccaacctggccgagagcgtgctgcaggacgccttcatcagactgagccagagccagagcaccctgccccaggagagcgccgtgagcgtgagcgtgggcagcagcctgctgcccagctgctacagcaccaaggacaccgtggtgagcagaagctggaacgagctgcccaagatcgtggtggtgcagagccccgacggcagcgacgccgccccccagcccggcatcagcagctggcccgagatggaggtgagcgtggagaccagcagcatcctgagcggcgagaacagcagcagacagccccagagcgccctggaggtggccctggcctgcgccgccaccgtgatcggcaccatcagcagcccccaggccaccgagagactgaagatggagcaggtggtgagcaacttcccccccggcagcagcggcgccctgcagacccaggccccccagggcctgaaggagcccagcatcaacgagtacagcttccccagcgccctgtgcggcatgacccaggtggccagcgccgtggccgtgtgcggcctgggcgagagagaggaggtgacctgcagcgtggcccccagcggcagcctgccccccgccgccgaggccagcgaggccatgccccccctgtgcggcctggccagcatggagctgggcaaggaggccatcgccaagggcctgctgaaggaggccgccctggtgctgaccagacccaacacctacagcagcatcggcgacttcctggacagcatgaacagaagaatcatggagaccgccagcaagagccagaccctgtgcagcgagaacgtggtgagaaacgagctggcccacaccctgagcaacgtgatcctgagacacagcatcgacgaggtgcaccacaagaacatgatcatcgaccccaacgacaacagacacagcagcgagatcctggacaccctgatggagagcaccaaccagctgctgctggacgtgatctgcttcaccttcaagaagatgagccacatcgtgagactgggcgagtgccccgccgtgctgagcaaggagaccatcagaagaagagagaccgagcccagctgccagcccagcgaccccggcgccagccaggcctggaccaaggccaccgagagcagcagcagcagccccctgagcaacagccacaacaccagcctggtgatcaacaacctggtggacggcatgtacagcaagcaggacaagggcggcgtgagacccggcctgttcaagaaccccaccctgcagagccagctgagcagaagccacagagtgcccgacagcagcaccgccaccaccagcagcaaggagatctacctgaagggcatcgccggcgaggacaccaagagcccccaccacagcgagaacgagtgcagagccagcagcgagggccagagaagccccaccgtgagccagagcagaagcggcagccaggaggccgaggagagcatccaccccaacacccaggagaagtacaactgcgccaccagcagaatcaacgaggtgcaggtgaacctgagcctgctgggcgacgacctgctgctgcccgcccagagcaccctgcagaccaagcaccccgacatctactgcatcaccgacttcgccgaggagctggccgacaccgtggtgagcatggccaccgagatcgccgccatctgcctggacaacagcagcggcaagcagccctggttctgcgcctggaagagaggcagcgagttcctgatgacccccaacgtgccctgcagaagcctgaagagaaagaaggagagccagggcagcggcaccgccgtgagaaagcacaagccccccagactgagcgagatcaagagaaagaccgacgagcaccccgagctgaaggagaagctgatgaacagagtggtggacgagagcatgaacctggaggacgtgcccgacagcgtgaacctgttcgccaacgaggtggccgccaagatcatgaacctgaccgagttcagcatggtggacggcatgtggcaggcccagggctaccccagaaacagactgctgagcggcgacagatggagcagactgaaggccagcagctgcgagagcatccccgaggaggacagcgaggccagagcctacgtgaacagcctgggcctgatgagcaccctgagccagcccgtgagcagagccagcagcgtgagcaagcagagcagctgcgagagcatcaccgacgagttcagcagattcatggtgaaccagatggagaacgagggcagaggcttcgagctgctgctggactactacgccggcaagaacgccagcagcatcctgaacagcgccatgcagcaggcctgcagaaagagcgaccacctgagcgtgagacccagctgccccagcaagcagagcagcaccgagagcatcaccgaggagttctacagatacatgctgagagacatcgagagagacagcagagagagcgccagcagcagaagaagcagccaggactggaccgccggcctgctgagccccagcctgagaagccccgtgtgccacagacagagcagcatgcccgacagcagaagcccctgcagcagactgaccgtgaacgtgcccatcaaggccaacagcctggacggcttcgcccagaactgcccccaggacttcctgagcgtgcagcccgtgagcagcgccagcagcagcggcctgtgcaagagcgacagctgcctgtacagaagaggcggcaccgaccacatcaccaacatgctgatccacgagacctgggccagcagcatcgaggccctgatgagaaagaacaagatcatcgtggacgacgccgaggaggccgacaccgagcccgtgagcggcggcagccccagccaggccgagaagtgcgccaacagactggccgccagcagaatgtgcagcggccccaccctgctggtgcaggagagcctggactgccccagaaaggacagcgtgaccgagtgcaagcagccccccgtgagcagcctgagcaagaccgccagcctgaccaaccacagccccctggacagcaagaaggagaccagcagctgccaggaccccgtgcccatcaaccacaagagaagaagcctgtgcagcagagaggtgcccctgatccagatcgagaccgaccagagagaggcctgcgccggcgagcccgagcccttcctgagcaagagcagcctgctggaggaggccgagggccacagcaacgacaagaacatccccgacgtggtgagaggcggcgacaccgccgtgagcgcctgccagatccacagcgacagcctggacaccagagacgtgcccgaggccgaggccagcaccgaggccagagcccccgacgaggcccccaacccccccagcagcagcgaggagagcaccggcagctggacccagctggccaacgaggaggacaaccccgacgacaccagcagcttcctgcagctgagcgagagaagcatgagcgagctggtggaggagaagaagatcctgaagggccagagcgagagcaccgaggcccccgccagcggcccccccaccggcaccgccagcccccagagaagcctgctggtgatcaacttcgacctggagcccgagtgccccgacgccgagctgagagccaccctgcagtggatcgccgccagcgagctgggcatccccaccatctacttcaagaagagccaggagaacagaatcgagaagttcctggacgtggtgcagctggtgcacagaaagagctggaaggtgggcgacatcttccacgccgtggtgcagtactgcaagatgcacgaggagcagaaggacggcagactgagcctgttcgactggctgctggagctgggctag

SEQ ID NO: 100691 - DNA, 5103 bp, Artificial Sequence
  Description of Artificial Sequence: Synthetic coding sequence
atggacggcaacagcctgctgagcgtgcccagcaacctggagagcagcagaatgtacgacgtgctggagccccagcagggcagaggctgcggcagcagcggcagcggccccggcaacagcatcaccgcctgcaagaaggtgctgagaagcaacagcctgctggagagcaccgactactggctgcagaaccagagaatgccctgccagatcggcttcgtggaggacaagagcgagaactgcgccagcgtgtgcttcgtgaacctggacgtgaacaaggacgagtgcagcaccgagcacctgcagcagaagctggtgaacgtgagccccgacctgcccaagctgatcagcagcatgaacgtgcagcagcccaaggagaacgagatcgtggtgctgagcggcctggccagcggcaacctgcaggccgacttcgaggtgagccagtgcccctggctgcccgacatctgcctggtgcagtgcgccagaggcaacagacccaacagcaccaactgcatcatcttcgagatcaacaagttcctgatcggcctggagctggtgcaggagagacagctgcacctggagaccaacatcctgaagctggaggacgacaccaactgcagcctgagcagcatcgaggaggacttcctgaccgccagcgagcacctggaggaggagagcgaggtggacgagagcagaaacgactacgagaacatcaacgtgagcgccaacgtgctggagagcaagcagctgaagggcgccacccaggtggagtggaactgcaacaaggagaagtggctgtacgccctggaggacaagtacatcaacaagtaccccacccccctgatcaagaccgagagaagccccgagaacctgaccaagaacaccgccctgcagagcctggaccccagcgccaagcccagccagtggaagagagaggccgtgggcaacggcagacaggccacccactactaccacagcgaggccttcaagggccagatggagaagagccaggccctgtacatccccaaggacgcctacttcagcatgatggacaaggacgtgcccagcgcctgcgccgtggccgagcagagaagcaacctgaaccccggcgaccacgaggacaccagaaacgccctgccccccagacaggacggcgaggtgaccaccggcaagtacgccaccaacctggccgagagcgtgctgcaggacgccttcatcagactgagccagagccagagcaccctgccccaggagagcgccgtgagcgtgagcgtgggcagcagcctgctgcccagctgctacagcaccaaggacaccgtggtgagcagaagctggaacgagctgcccaagatcgtggtggtgcagagccccgacggcagcgacgccgccccccagcccggcatcagcagctggcccgagatggaggtgagcgtggagaccagcagcatcctgagcggcgagaacagcagcagacagccccagagcgccctggaggtggccctggcctgcgccgccaccgtgatcggcaccatcagcagcccccaggccaccgagagactgaagatggagcaggtggtgagcaacttcccccccggcagcagcggcgccctgcagacccaggccccccagggcctgaaggagcccagcatcaacgagtacagcttccccagcgccctgtgcggcatgacccaggtggccagcgccgtggccgtgtgcggcctgggcgagagagaggaggtgacctgcagcgtggcccccagcggcagcctgccccccgccgccgaggccagcgaggccatgccccccctgtgcggcctggccagcatggagctgggcaaggaggccatcgccaagggcctgctgaaggaggccgccctggtgctgaccagacccaacacctacagcagcatcggcgacttcctggacagcatgaacagaagaatcatggagaccgccagcaagagccagaccctgtgcagcgagaacgtggtgagaaacgagctggcccacaccctgagcaacgtgatcctgagacacagcatcgacgaggtgcaccacaagaacatgatcatcgaccccaacgacaacagacacagcagcgagatcctggacaccctgatggagagcaccaaccagctgctgctggacgtgatctgcttcaccttcaagaagatgagccacatcgtgagactgggcgagtgccccgccgtgctgagcaaggagaccatcagaagaagagagaccgagcccagctgccagcccagcgaccccggcgccagccaggcctggaccaaggccaccgagagcagcagcagcagccccctgagcaacagccacaacaccagcctggtgatcaacaacctggtggacggcatgtacagcaagcaggacaagggcggcgtgagacccggcctgttcaagaaccccaccctgcagagccagctgagcagaagccacagagtgcccgacagcagcaccgccaccaccagcagcaaggagatctacctgaagggcatcgccggcgaggacaccaagagcccccaccacagcgagaacgagtgcagagccagcagcgagggccagagaagccccaccgtgagccagagcagaagcggcagccaggaggccgaggagagcatccaccccaacacccaggagaagtacaactgcgccaccagcagaatcaacgaggtgcaggtgaacctgagcctgctgggcgacgacctgctgctgcccgcccagagcaccctgcagaccaagcaccccgacatctactgcatcaccgacttcgccgaggagctggccgacaccgtggtgagcatggccaccgagatcgccgccatctgcctggacaacagcagcggcaagcagccctggttctgcgcctggaagagaggcagcgagttcctgatgacccccaacgtgccctgcagaagcctgaagagaaagaaggagagccagggcagcggcaccgccgtgagaaagcacaagccccccagactgagcgagatcaagagaaagaccgacgagcaccccgagctgaaggagaagctgatgaacagagtggtggacgagagcatgaacctggaggacgtgcccgacagcgtgaacctgttcgccaacgaggtggccgccaagatcatgaacctgaccgagttcagcatggtggacggcatgtggcaggcccagggctaccccagaaacagactgctgagcggcgacagatggagcagactgaaggccagcagctgcgagagcatccccgaggaggacagcgaggccagagcctacgtgaacagcctgggcctgatgagcaccctgagccagcccgtgagcagagccagcagcgtgagcaagcagagcagctgcgagagcatcaccgacgagttcagcagattcatggtgaaccagatggagaacgagggcagaggcttcgagctgctgctggactactacgccggcaagaacgccagcagcatcctgaacagcgccatgcagcaggcctgcagaaagagcgaccacctgagcgtgagacccagctgccccagcaagcagagcagcaccgagagcatcaccgaggagttctacagatacatgctgagagacatcgagagagacagcagagagagcgccagcagcagaagaagcagccaggactggaccgccggcctgctgagccccagcctgagaagccccgtgtgccacagacagagcagcatgcccgacagcagaagcccctgcagcagactgaccgtgaacgtgcccatcaaggccaacagcctggacggcttcgcccagaactgcccccaggacttcctgagcgtgcagcccgtgagcagcgccagcagcagcggcctgtgcaagagcgacagctgcctgtacagaagaggcggcaccgaccacatcaccaacatgctgatccacgagacctgggccagcagcatcgaggccctgatgagaaagaacaagatcatcgtggacgacgccgaggaggccgacaccgagcccgtgagcggcggcagccccagccaggccgagaagtgcgccaacagactggccgccagcagaatgtgcagcggccccaccctgctggtgcaggagagcctggactgccccagaaaggacagcgtgaccgagtgcaagcagccccccgtgagcagcctgagcaagaccgccagcctgaccaaccacagccccctggacagcaagaaggagaccagcagctgccaggaccccgtgcccatcaaccacaagagaagaagcctgtgcagcagagaggtgcccctgatccagatcgagaccgaccagagagaggcctgcgccggcgagcccgagcccttcctgagcaagagcagcctgctggaggaggccgagggccacagcaacgacaagaacatccccgacgtggtgagaggcggcgacaccgccgtgagcgcctgccagatccacagcgacagcctggacaccagagacgtgcccgaggccgaggccagcaccgaggccagagcccccgacgaggcccccaacccccccagcagcagcgaggagagcaccggcagctggacccagctggccaacgaggaggacaaccccgacgacaccagcagcttcctgcagctgagcgagagaagcatgagcaacggcaacagcagcgccaccagcagcctgggcatcatggacctggacatctaccaggagagcatgcccagcagccccatgatcaacgagctggtggaggagaagaagatcctgaagggccagagcgagagcaccgaggcccccgccagcggcccccccaccggcaccgccagcccccagagaagcctgctggtgatcaacttcgacctggagcccgagtgccccgacgccgagctgagagccaccctgcagtggatcgccgccagcgagctgggcatccccaccatctacttcaagaagagccaggagaacagaatcgagaagttcctggacgtggtgcagctggtgcacagaaagagctggaaggtgggcgacatcttccacgccgtggtgcagtactgcaagatgcacgaggagcagaaggacggcagactgagcctgttcgactggctgctggagctgggctag

SEQ ID NO: 100692 - DNA, 789 bp, Artificial Sequence
  Description of Artificial Sequence: Synthetic coding sequence
atgctggccctggaggccgcccagctggacggcccccacttcagctgcctgtaccccgacggcgtgttctacgacctggacagctgcaagcacagcagctaccccgacagcgagggcgcccccgacagcctgtgggactggaccgtggccccccccgtgcccgccaccccctacgaggccttcgaccccgccgccgccgccttcagccacccccaggccgcccagctgtgctacgagccccccacctacagccccgccggcaacctggagctggcccccagcctggaggcccccggccccggcctgcccgcctaccccaccgagaacttcgccagccagaccctggtgccccccgcctacgccccctaccccagccccgtgctgagcgaggaggaggacctgcccctggacagccccgccctggaggtgagcgacagcgagagcgacgaggccctggtggccggccccgagggcaagggcagcgaggccggcaccagaaagaagctgagactgtaccagttcctgctgggcctgctgaccagaggcgacatgagagagtgcgtgtggtgggtggagcccggcgccggcgtgttccagttcagcagcaagcacaaggagctgctggccagaagatggggccagcagaagggcaacagaaagagaatgacctaccagaagctggccagagccctgagaaactacgccaagaccggcgagatcagaaaggtgaagagaaagctgacctaccagttcgacagcgccctgctgcccgccgtgagaagagcctag

SEQ ID NO: 100693 - DNA, 516 bp, Artificial Sequence
  Description of Artificial Sequence: Synthetic coding sequence
atggccagcagcatgacctggaccgccgccagcatccccgccaccctgatccagagaggcctgctgaccctggtgccccccgcctacgccccctaccccagccccgtgctgagcgaggaggaggacctgcccctggacagccccgccctggaggtgagcgacagcgagagcgacgaggccctggtggccggccccgagggcaagggcagcgaggccggcaccagaaagaagctgagactgtaccagttcctgctgggcctgctgaccagaggcgacatgagagagtgcgtgtggtgggtggagcccggcgccggcgtgttccagttcagcagcaagcacaaggagctgctggccagaagatggggccagcagaagggcaacagaaagagaatgacctaccagaagctggccagagccctgagaaactacgccaagaccggcgagatcagaaaggtgaagagaaagctgacctaccagttcgacagcgccctgctgcccgccgtgagaagagcctag

SEQ ID NO: 100694 - DNA, 747 bp, Artificial Sequence
  Description of Artificial Sequence: Synthetic coding sequence
atgacctgcgtggagcaggacaagctgggccaggccttcgaggacgccttcgaggtgctgagacagcacagcaccggcgacctgcagtacagccccgactacagaaactacctggccctgatcaaccacagaccccacgtgaagggcaacagcagctgctacggcgtgctgcccaccgaggagcccgtgtacaactggagaaccgtgatcaacagcgccgccgacttctacttcgagggcaacatccaccagagcctgcagaacatcaccgagaaccagctggtgcagcccaccctgctgcagcagaagggcggcaagggcagaaagaagctgagactgttcgagtacctgcacgagagcctgtacaaccccgagatggccagctgcatccagtgggtggacaagaccaagggcatcttccagttcgtgagcaagaacaaggagaagctggccgagctgtggggcaagagaaagggcaacagaaagaccatgacctaccagaagatggccagagccctgagaaactacggcagaagcggcgagatcaccaagatcagaagaaagctgacctaccagttcagcgaggccatcctgcagagactgagccccagctacttcctgggcaaggagatcttctacagccagtgcgtgcagcccgaccaggagtacctgagcctgaacaactggaacgccaactacaactacacctacgccaactaccacgagctgaaccaccacgactgctag

SEQ ID NO: 100695 - DNA, 747 bp, Artificial Sequence; identical to SEQ ID NO: 100694
  Description of Artificial Sequence: Synthetic coding sequence

SEQ ID NO: 100696 - DNA, 2568 bp, Artificial Sequence
  Description of Artificial Sequence: Synthetic coding sequence
atgagcttcgtgagagtgaacagatgcggccccagagtgggcgtgagaaagacccccaaggtgaagaagaagaagaccagcgtgaagcaggagtgggacaacaccgtgaccgacctgaccgtgcacagagccacccccgaggacctggtgagaagacacgagatccacaagagcaagaacagagccctggtgcactgggagctgcaggagaaggccctgaagagaaagtggagaaagcagaagcccgagaccctgaacctggagaagagaagactgagcatcatgaaggagatcctgagcgaccagtaccagatgcaggacgtgctggagaagagcgaccacctgatcgccgccgccaaggagctgttccccagaagaagaaccggcttccccaacgtgaccgtggcccccgacagcagccagggccccatcgtggtgaaccaggaccccatcacccagagcatcttcaacgagagcgtgatcgagccccaggccctgaacgacgtggacggcgaggaggagggcaccgtgaacagccagagcggcgagagcgagaacgagaacgagctggacaacagcctgaacagccagagcaacaccaacaccgacagattcctgcagcagctgaccgaggagaacttcgagctgatcagcaagctgtggaccgacatccagcagaagatcgccacccagagccagatcaccccccccggcacccccagcagcgccctgagcagcggcgagcagagagccgccctgaacgccaccaacgccgtgaagagactgcagaccagactgcagcccgaggagagcaccgagaccctggacagcagctacgtggtgggccacgtgctgaacagcagaaagcagaagcagctgctgaacaaggtgaagagaaagcccaacctgcacgccctgagcaagcccaagaagaacatcagcagcggcagcaccaccagcgccgacctgcccaacagaaccaacagcaacctggacgtgctgaagcacatgatccacgaggtggagcacgagatggaggagtacgagagatggaccggcagagaggtgaagggcctgcagagcagccagggcctgaccggcttcaccctgagcctggtgagcagcctgtgcagactggtgagatacctgaaggagagcgagatccagctgagaaaggaggtggagaccagacagcagctggagcaggtgctgggcgaccacagagagctgatcgacgccctgaccgccgagatcctgagactgagagaggagaacgccgccacccaggccagactgcagcagtacatggtgaccaccgacgagcagctgatcagcctgacccacgccatcaagaactgccccgtgatcaacaacagacaggagatccaggccagcgagagcggcgccaccggcagaagagtgatggacagccccgagagacccgtggtgaacgccaacgtgagcgtgcccctgatgttcagagaggaggtggccgagttcccccaggaggagctgcccgtgaagctgagccaggtgcccgacccccccgacaacatgaacctggccaagaacttccccgcccacatcttcgagcccgccgtgctgctgaccccccccagacagaagagcaacctgaagttcagccccctgcaggacgtgctgagaagaaccgtgcagaccagacccgcccccagactgccccccaccgtggagatcatcgagaaggagcagaactgggaggagaagaccctgcccatcgacaccgacatccagaacagcagcgaggagaacagactgttcacccagagatggagagtgagccacatgggcgaggacctggagaacaagacccaggcccccttcgtgaacctgagccagcccctgtgcaacagccacagcaacacccagcagagcagaagccccaccttcagcgaggagctgcccgtgctgggcgacggccagcagctgagaaccaacgagagcctgatccagagaaaggacatcatgaccagaatcgccgacctgaccctgcagaacagcgccatcaaggcccacatgaacaacatcatcgagcccagaggcgagcagggcgacggcctgagagagctgaacaagcaggagagcgccagcgacatgaccagcaccttccccgtggcccagagcctgacccccggcagcatggaggagagaatcgccgagctgaacagacagagcatggaggccagaggcaagctgctgcagctgatcgagcagcagaagctggtgggcctgaacctgagcccccccatgagccccgtgcagctgcccctgagagcctggaccgagggcgccaagagaaccatcgaggtgagcatccccggcgccgaggcccccgagagcagcaagtgcagcaccgtgagccccgtgagcggcatcaacaccagaagaagcagcggcgccaccggcaacagctgcagccccctgaacgccaccagcggcagcggcagattcacccccctgaaccccagagccaagatcgagaagcagaacgaggagggctggttcgccctgagcacccacgtgagctag

SEQ ID NO: 100697 - DNA, 483 bp, Artificial Sequence
  Description of Artificial Sequence: Synthetic coding sequence
atgagcttcgtgagagtgaacagatgcggccccagagtgggcgtgagaaagacccccaaggtgaagaagaagaagaccagcgtgaagcaggagtgggacaacaccgtgaccgacctgaccgtgcacagagccacccccgaggacctggtgagaagacacgagatccacaagagcaagaacagagccctggtgcactgggagctgcaggagaaggccctgaagagaaagtggagaaagcagaagcccgagaccctgaacctggagaagagaagactgagcatcatgaaggagatcctgagcgaccagtaccagatgcaggacgtgctggagaagagcgaccacctgatcgccgccgccaaggagctgttccccagaagaagaaccggcttccccaacgtgaccgtggcccccgacagcagccagggccccatcgtggtgaaccaggaccccatcacccagagcatcttcaacgagagcgtgtag

SEQ ID NO: 100698 - DNA, 522 bp, Artificial Sequence
  Description of Artificial Sequence: Synthetic coding sequence
atgagcttcgtgagagtgaacagatgcggccccagagtgggcgtgagaaagacccccaaggtgaagaagaagaagaccagcgtgaagcaggagtgggacaacaccgtgaccgacctgaccgtgcacagagccacccccgaggacctggtgagaagacacgagatccacaagagcaagaacagagccctggtgcactgggagctgcaggagaaggccctgaagagaaagtggagaaagcagaagcccgagaccctgaacctggagaagagaagactgagcatcatgaaggagatcctgagcgaccagtaccagatgcaggacgtgctggagaagagcgaccacctgatcgccgccgccaaggagctgttccccagaagaagaaccggcttccccaacgtgaccgtggcccccgacagcagccagggccccatcgtggtgaaccaggaccccatcacccagagcatcttcaacgagagcgtgatcgagccccaggccctgaacgacgtggacggcgaggagtag

SEQ ID NO: 100699 - DNA, 60 bp, Artificial Sequence
  Description of Artificial Sequence: Synthetic coding sequence
atgagcttcgtgagagtgaacagatgcggccccagagtgggcgtgagaaagaccccctag

SEQ ID NO: 100700 - DNA, 789 bp, Artificial Sequence
  Description of Artificial Sequence: Synthetic coding sequence
atgaagacccccttcggcaagacccccggccagagaagcagagccgacgccggccacgccggcgtgagcgccaacatgatgaagaagagaaccagccacaagaagcacagaagcagcgtgggccccagcaagcccgtgagccagcccagaagaaacatcgtgggctgcagaatccagcacggctggaaggagggcaacggccccgtgacccagtggaagggcaccgtgctggaccaggtgcccgtgaaccccagcctgtacctgatcaagtacgacggcttcgactgcgtgtacggcctggagctgaacaaggacgagagagtgagcgccctggaggtgctgcccgacagagtggccaccagcagaatcagcgacgcccacctggccgacaccatgatcggcaaggccgtggagcacatgttcgagaccgaggacggcagcaaggacgagtggagaggcatggtgctggccagagcccccgtgatgaacacctggttctacatcacctacgagaaggaccccgtgctgtacatgtaccagctgctggacgactacaaggagggcgacctgagaatcatgcccgacagcaacgacagcccccccgccgagagagagcccggcgaggtggtggacagcctggtgggcaagcaggtggagtacgccaaggaggacggcagcaagagaaccggcatggtgatccaccaggtggaggccaagcccagcgtgtacttcatcaagttcgacgacgacttccacatctacgtgtacgacctggtgaagaccagctag

SEQ ID NO: 100701 - DNA, 789 bp, Artificial Sequence; identical to SEQ ID NO: 100700
  Description of Artificial Sequence: Synthetic coding sequence

SEQ ID NO: 100702 - DNA, 1587 bp, Artificial Sequence
  Description of Artificial Sequence: Synthetic coding sequence
atggccggcagcgacaccgcccccttcctgagccaggccgacgaccccgacgacggccccgtgcccggcacccccggcctgcccggcagcaccggcaaccccaagagcgaggagcccgaggtgcccgaccaggagggcctgcagagaatcaccggcctgagccccggcagaagcgccctgatcgtggccgtgctgtgctacatcaacctgctgaactacatggacagattcaccgtggccggcgtgctgcccgacatcgagcagttcttcaacatcggcgacagcagcagcggcctgatccagaccgtgttcatcagcagctacatggtgctggcccccgtgttcggctacctgggcgacagatacaacagaaagtacctgatgtgcggcggcatcgccttctggagcctggtgaccctgggcagcagcttcatccccggcgagcacttctggctgctgctgctgaccagaggcctggtgggcgtgggcgaggccagctacagcaccatcgcccccaccctgatcgccgacctgttcgtggccgaccagagaagcagaatgctgagcatcttctacttcgccatccccgtgggcagcggcctgggctacatcgccggcagcaaggtgaaggacatggccggcgactggcactgggccctgagagtgacccccggcctgggcgtggtggccgtgctgctgctgttcctggtggtgagagagccccccagaggcgccgtggagagacacagcgacctgccccccctgaaccccaccagctggtgggccgacctgagagccctggccagaaaccccagcttcgtgctgagcagcctgggcttcaccgccgtggccttcgtgaccggcagcctggccctgtgggcccccgccttcctgctgagaagcagagtggtgctgggcgagacccccccctgcctgcccggcgacagctgcagcagcagcgacagcctgatcttcggcctgatcacctgcctgaccggcgtgctgggcgtgggcctgggcgtggagatcagcagaagactgagacacagcaaccccagagccgaccccctggtgtgcgccaccggcctgctgggcagcgcccccttcctgttcctgagcctggcctgcgccagaggcagcatcgtggccacctacatcttcatcttcatcggcgagaccctgctgagcatgaactgggccatcgtggccgacatcctgctgtacgtggtgatccccaccagaagaagcaccgccgaggccttccagatcgtgctgagccacctgctgggcgacgccggcagcccctacctgatcggcctgatcagcgacagactgagaagaaactggccccccagcttcctgagcgagttcagagccctgcagttcagcctgatgctgtgcgccttcgtgggcgccctgggcggcgccgccttcctgggcaccgccatcttcatcgaggccgacagaagaagagcccagctgcacgtgcagggcctgctgcacgaggccggcagcaccgacgacagaatcgtggtgccccagagaggcagaagcaccagagtgcccgtggccagcgtgctgatctag

SEQ ID NO: 100703 - DNA, 1368 bp, Artificial Sequence
  Description of Artificial Sequence: Synthetic coding sequence
atggacagattcaccgtggccggcgtgctgcccgacatcgagcagttcttcaacatcggcgacagcagcagcggcctgatccagaccgtgttcatcagcagctacatggtgctggcccccgtgttcggctacctgggcgacagatacaacagaaagtacctgatgtgcggcggcatcgccttctggagcctggtgaccctgggcagcagcttcatccccggcgagcacttctggctgctgctgctgaccagaggcctggtgggcgtgggcgaggccagctacagcaccatcgcccccaccctgatcgccgacctgttcgtggccgaccagagaagcagaatgctgagcatcttctacttcgccatccccgtgggcagcggcctgggctacatcgccggcagcaaggtgaaggacatggccggcgactggcactgggccctgagagtgacccccggcctgggcgtggtggccgtgctgctgctgttcctggtggtgagagagccccccagaggcgccgtggagagacacagcgacctgccccccctgaaccccaccagctggtgggccgacctgagagccctggccagaaaccccagcttcgtgctgagcagcctgggcttcaccgccgtggccttcgtgaccggcagcctggccctgtgggcccccgccttcctgctgagaagcagagtggtgctgggcgagacccccccctgcctgcccggcgacagctgcagcagcagcgacagcctgatcttcggcctgatcacctgcctgaccggcgtgctgggcgtgggcctgggcgtggagatcagcagaagactgagacacagcaaccccagagccgaccccctggtgtgcgccaccggcctgctgggcagcgcccccttcctgttcctgagcctggcctgcgccagaggcagcatcgtggccacctacatcttcatcttcatcggcgagaccctgctgagcatgaactgggccatcgtggccgacatcctgctgtacgtggtgatccccaccagaagaagcaccgccgaggccttccagatcgtgctgagccacctgctgggcgacgccggcagcccctacctgatcggcctgatcagcgacagactgagaagaaactggccccccagcttcctgagcgagttcagagccctgcagttcagcctgatgctgtgcgccttcgtgggcgccctgggcggcgccgccttcctgggcaccgccatcttcatcgaggccgacagaagaagagcccagctgcacgtgcagggcctgctgcacgaggccggcagcaccgacgacagaatcgtggtgccccagagaggcagaagcaccagagtgcccgtggccagcgtgctgatctag

SEQ ID NO: 100704 - DNA, 1431 bp, Artificial Sequence
  Description of Artificial Sequence: Synthetic coding sequence
atggccggcagcgacaccgcccccttcctgagccaggccgacgaccccgacgacggccccgtgcccggcacccccggcctgcccggcagcaccggcaaccccaagagcgaggagcccgaggtgcccgaccaggagggcctgcagagaatcaccggcctgagccccggcagaagcgccctgatcgtggccgtgctgtgctacatcaacctgctgaactacatggacagattcaccgtggccggcgtgctgcccgacatcgagcagttcttcaacatcggcgacagcagcagcggcctgatccagaccgtgttcatcagcagctacatggtgctggcccccgtgttcggctacctgggcgacagatacaacagaaagtacctgatgtgcggcggcatcgccttctggagcctggtgaccctgggcagcagcttcatccccggcgagcacttctggctgctgctgctgaccagaggcctggtgggcgtgggcgaggccagctacagcaccatcgcccccaccctgatcgccgacctgttcgtggccgaccagagaagcagaatgctgagcatcttctacttcgccatccccgtgggcagcggcctgggctacatcgccggcagcaaggtgaaggacatggccggcgactggcactgggccctgagagtgacccccggcctgggcgtggtggccgtgctgctgctgttcctggtggtgagagagccccccagaggcgccgtggagagacacagcgacctgccccccctgaaccccaccagctggtgggccgacctgagagccctggccagaaacctgatcttcggcctgatcacctgcctgaccggcgtgctgggcgtgggcctgggcgtggagatcagcagaagactgagacacagcaaccccagagccgaccccctggtgtgcgccaccggcctgctgggcagcgcccccttcctgttcctgagcctggcctgcgccagaggcagcatcgtggccacctacatcttcatcttcatcggcgagaccctgctgagcatgaactgggccatcgtggccgacatcctgctgtacgtggtgatccccaccagaagaagcaccgccgaggccttccagatcgtgctgagccacctgctgggcgacgccggcagcccctacctgatcggcctgatcagcgacagactgagaagaaactggccccccagcttcctgagcgagttcagagccctgcagttcagcctgatgctgtgcgccttcgtgggcgccctgggcggcgccgccttcctgggcaccgccatcttcatcgaggccgacagaagaagagcccagctgcacgtgcagggcctgctgcacgaggccggcagcaccgacgacagaatcgtggtgccccagagaggcagaagcaccagagtgcccgtggccagcgtgctgatctag

SEQ ID NO: 100705 - DNA, 1365 bp, Artificial Sequence
  Description of Artificial Sequence: Synthetic coding sequence
atggccggcagcgacaccgcccccttcctgagccaggccgacgaccccgacgacggccccgtgcccggcacccccggcctgcccggcagcaccggcaaccccaagagcgaggagcccgaggtgcccgaccaggagggcctgcagagaatcaccggcctgagccccggcagaagcgccctgatcgtggccgtgctgtgctacatcaacctgctgaactacatggacagattcaccgtggccgtgttcatcagcagctacatggtgctggcccccgtgttcggctacctgggcgacagatacaacagaaagtacctgatgtgcggcggcatcgccttctggagcctggtgaccctgggcagcagcttcatccccggcgagcacttctggctgctgctgctgaccagaggcctggtgggcgtgggcgaggccagctacagcaccatcgcccccaccctgatcgccgacctgttcgtggccgaccagagaagcagaatgctgagcatcttctacttcgccatccccgtgggcagcggcctgggctacatcgccggcagcaaggtgaaggacatggccggcgactggcactgggccctgagagtgacccccggcctgggcgtggtggccgtgctgctgctgttcctggtggtgagagagccccccagaggcgccgtggagagacacagcgacctgccccccctgaaccccaccagctggtgggccgacctgagagccctggccagaaacctgatcttcggcctgatcacctgcctgaccggcgtgctgggcgtgggcctgggcgtggagatcagcagaagactgagacacagcaaccccagagccgaccccctggtgtgcgccaccggcctgctgggcagcgcccccttcctgttcctgagcctggcctgcgccagaggcagcatcgtggccacctacatcttcatcttcatcggcgagaccctgctgagcatgaactgggccatcgtggccgacatcctgctgtacgtggtgatccccaccagaagaagcaccgccgaggccttccagatcgtgctgagccacctgctgggcgacgccggcagcccctacctgatcggcctgatcagcgacagactgagaagaaactggccccccagcttcctgagcgagttcagagccctgcagttcagcctgatgctgtgcgccttcgtgggcgccctgggcggcgccgccttcctgggcaccgccatcttcatcgaggccgacagaagaagagcccagctgcacgtgcagggcctgctgcacgaggccggcagcaccgacgacagaatcgtggtgccccagagaggcagaagcaccagagtgcccgtggccagcgtgctgatctag

SEQ ID NO: 100706 - DNA, 1650 bp, Artificial Sequence
  Description of Artificial Sequence: Synthetic coding sequence
atgatgtgcctggagtgcgccagcgccgccgccggcggcgccgaggaggaggaggccgacgccgagagaagaagaagaagaagaggcgcccagagaggcgccggcggcagcggctgctgcggcgccagaggcgccggcggcgccggcgtgagcgccgccggcgacgaggtgcagaccctgagcggcagcgtgagaagagcccccaccggcccccccggcacccccggcacccccggctgcgccgccaccgccaagggccccggcgcccagcagcccaagcccgccagcctgggcagaggcagaggcgccgccgccgccatcctgagcctgggcaacgtgctgaactacctggacagatacaccgtggccggcgtgctgctggacatccagcagcacttcggcgtgaaggacagaggcgccggcctgctgcagagcgtgttcatctgcagcttcatggtggccgcccccatcttcggctacctgggcgacagattcaacagaaaggtgatcctgagctgcggcatcttcttctggagcgccgtgaccttcagcagcagcttcatcccccagcagtacttctggctgctggtgctgagcagaggcctggtgggcatcggcgaggccagctacagcaccatcgcccccaccatcatcggcgacctgttcaccaagaacaccagaaccctgatgctgagcgtgttctacttcgccatccccctgggcagcggcctgggctacatcaccggcagcagcgtgaagcaggccgccggcgactggcactgggccctgagagtgagccccgtgctgggcatgatcaccggcaccctgatcctgatcctggtgcccgccaccaagagaggccacgccgaccagctgggcgaccagctgaaggccagaaccagctggctgagagacatgaaggccctgatcagaaacagaagctacgtgttcagcagcctggccaccagcgccgtgagcttcgccaccggcgccctgggcatgtggatccccctgtacctgcacagagcccaggtggtgcagaagaccgccgagacctgcaacagccccccctgcggcgccaaggacagcctgatcttcggcgccatcacctgcttcaccggcttcctgggcgtggtgaccggcgccggcgccaccagatggtgcagactgaagacccagagagccgaccccctggtgtgcgccgtgggcatgctgggcagcgccatcttcatctgcctgatcttcgtggccgccaagagcagcatcgtgggcgcctacatctgcatcttcgtgggcgagaccctgctgttcagcaactgggccatcaccgccgacatcctgatgtacgtggtgatccccaccagaagagccaccgccgtggccctgcagagcttcaccagccacctgctgggcgacgccggcagcccctacctgatcggcttcatcagcgacctgatcagacagagcaccaaggacagccccctgtgggagttcctgagcctgggctacgccctgatgctgtgccccttcgtggtggtgctgggcggcatgttcttcctggccaccgccctgttcttcgtgagcgacagagccagagccgagcagcaggtgaaccagctggccatgccccccgccagcgtgaaggtgtag

SEQ ID NO: 100707 - DNA, 1158 bp, Artificial Sequence
  Description of Artificial Sequence: Synthetic coding sequence
atgctggtgtgcttcagactgtacagctggctgttcttcctgagcagaggcatcgtgggcaccggcagcgccagctacagcaccatcgcccccaccgtgctgggcgacctgttcgtgagagaccagagaaccagagtgctggccgtgttctacatcttcatccccgtgggcagcggcctgggctacgtgctgggcagcgccgtgaccatgctgaccggcaactggagatgggccctgagagtgatgccctgcctggaggccgtggccctgatcctgctgatcctgctggtgcccgacccccccagaggcgccgccgagacccagggcgagggcgccgtgggcggcttcagaagcagctggtgcgaggacgtgagatacctgggcaagaactggagcttcgtgtggagcaccctgggcgtgaccgccatggccttcgtgaccggcgccctgggcttctgggcccccaagttcctgctggaggccagagtggtgcacggcctgcagcccccctgcttccaggagccctgcagcaaccccgacagcctgatcttcggcgccctgaccatcatgaccggcgtgatcggcgtgatcctgggcgccgaggccgccagaagatacaagaaggtgatccccggcgccgagcccctgatctgcgccagcagcctgctggccaccgccccctgcctgtacctggccctggtgctggcccccaccaccctgctggccagctacgtgttcctgggcctgggcgagctgctgctgagctgcaactgggccgtggtggccgacatcctgctgagcgtggtggtgcccagatgcagaggcaccgccgaggccctgcagatcaccgtgggccacatcctgggcgacgccggcagcccctacctgaccggcctgatcagcagcgtgctgagagccagaagacccgacagctacctgcagagattcagaagcctgcagcagagcttcctgtgctgcgccttcgtgatcgccctgggcggcggctgcttcctgctgaccgccctgtacctggagagagacgagaccagagcctggcagcccgtgaccggcacccccgacagcaacgacgtggacagcaacgacctggagagacagggcctgctgagcggcgccggcgccagcaccgaggagccctag

SEQ ID NO: 100708 - DNA, 1539 bp, Artificial Sequence
  Description of Artificial Sequence: Synthetic coding sequence
atggccggcggcatgagcgccgagtgccccgagcccggccccggcggcctgcagggccagagccccggccccggcagacagtgccccccccccatcacccccaccagctggagcctgcccccctggagagcctacgtggccgccgccgtgctgtgctacatcaacctgctgaactacatgaactggttcatcatcgccggcgtgctgctggacatccaggaggtgttccagatcagcgacaaccacgccggcctgctgcagaccgtgttcgtgagctgcctgctgctgagcgcccccgtgttcggctacctgggcgacagacacagcagaaaggccaccatgagcttcggcatcctgctgtggagcggcgccggcctgagcagcagcttcatcagccccagatacagctggctgttcttcctgagcagaggcatcgtgggcaccggcagcgccagctacagcaccatcgcccccaccgtgctgggcgacctgttcgtgagagaccagagaaccagagtgctggccgtgttctacatcttcatccccgtgggcagcggcctgggctacgtgctgggcagcgccgtgaccatgctgaccggcaactggagatgggccctgagagtgatgccctgcctggaggccgtggccctgatcctgctgatcctgctggtgcccgacccccccagaggcgccgccgagacccagggcgagggcgccgtgggcggcttcagaagcagctggtgcgaggacgtgagatacctgggcaagaactggagcttcgtgtggagcaccctgggcgtgaccgccatggccttcgtgaccggcgccctgggcttctgggcccccaagttcctgctggaggccagagtggtgcacggcctgcagcccccctgcttccaggagccctgcagcaaccccgacagcctgatcttcggcgccctgaccatcatgaccggcgtgatcggcgtgatcctgggcgccgaggccgccagaagatacaagaaggtgatccccggcgccgagcccctgatctgcgccagcagcctgctggccaccgccccctgcctgtacctggccctggtgctggcccccaccaccctgctggccagctacgtgttcctgggcctgggcgagctgctgctgagctgcaactgggccgtggtggccgacatcctgctgagcgtggtggtgcccagatgcagaggcaccgccgaggccctgcagatcaccgtgggccacatcctgggcgacgccggcagcccctacctgaccggcctgatcagcagcgtgctgagagccagaagacccgacagctacctgcagagattcagaagcctgcagcagagcttcctgtgctgcgccttcgtgatcgccctgggcggcggctgcttcctgctgaccgccctgtacctggagagagacgagaccagagcctggcagcccgtgaccggcacccccgacagcaacgacgtggacagcaacgacctggagagacagggcctgctgagcggcgccggcgccagcaccgaggagccctag

SEQ ID NO: 100709 - DNA, 249 bp, Artificial Sequence
  Description of Artificial Sequence: Synthetic coding sequence
atgggccagaccgccctggccggcggcagcagcagcacccccaccccccaggccctgtaccccgacctgagctgccccgagggcctggaggagctgctgagcgcccccccccccgacctgggcgcccagagaagacacggctggaaccccaaggactgcagcgagaacatcgaggtgaaggagggcggcctgtacttcgagagaagacccgtggcccagagcaccgacggcgccagaggcaagagatag

SEQ ID NO: 100710 - DNA, 792 bp, Artificial Sequence
  Description of Artificial Sequence: Synthetic coding sequence
atgggccagaccgccctggccggcggcagcagcagcacccccaccccccaggccctgtaccccgacctgagctgccccgagggcctggaggagctgctgagcgcccccccccccgacctgggcgcccagagaagacacggctggaaccccaaggactgcagcgagaacatcgaggtgaaggagggcggcctgtacttcgagagaagacccgtggcccagagcaccgacggcgccagaggcaagagaggctacagcagaggcctgcacgcctgggagatcagctggcccctggagcagagaggcacccacgccgtggtgggcgtggccaccgccctggcccccctgcagaccgaccactacgccgccctgctgggcagcaacagcgagagctggggctgggacatcggcagaggcaagctgtaccaccagagcaagggccccggcgccccccagtaccccgccggcacccagggcgagcagctggaggtgcccgagagactgctggtggtgctggacatggaggagggcaccctgggctacgccatcggcggcacctacctgggccccgccttcagaggcctgaagggcagaaccctgtaccccgccgtgagcgccgtgtggggccagtgccaggtgagaatcagatacctgggcgagagaagagccgagccccacagcctgctgcacctgagcagactgtgcgtgagacacaacctgggcgacaccagactgggccaggtgagcgccctgcccctgccccccgccatgaagagatacctgctgtaccagtag

SEQ ID NO: 100711 - DNA, 792 bp, Artificial Sequence; identical to SEQ ID NO: 100710
  Description of Artificial Sequence: Synthetic coding sequence

SEQ ID NO: 100712 - DNA, 1068 bp, Artificial Sequence
  Description of Artificial Sequence: Synthetic coding sequence
atggccagaagacccagaaacagcagagcctggcacttcgtgctgagcgccgccagaagagacgccgacgccagagccgtggccctggccggcagcaccaactggggctacgacagcgacggccagcacagcgacagcgacagcgaccccgagtacagcaccctgccccccagcatccccagcgccgtgcccgtgaccggcgagagcttctgcgactgcgccggccagagcgaggccagcttctgcagcagcctgcacagcgcccacagaggcagagactgcagatgcggcgaggaggacgagtacttcgactgggtgtgggacgacctgaacaagagcagcgccaccctgctgagctgcgacaacagaaaggtgagcttccacatggagtacagctgcggcaccgccgccatcagaggcaccaaggagctgggcgagggccagcacttctgggagatcaagatgaccagccccgtgtacggcaccgacatgatggtgggcatcggcaccagcgacgtggacctggacaagtacagacacaccttctgcagcctgctgggcagagacgaggacagctggggcctgagctacaccggcctgctgcaccacaagggcgacaagaccagcttcagcagcagattcggccagggcagcatcatcggcgtgcacctggacacctggcacggcaccctgaccttcttcaagaacagaaagtgcatcggcgtggccgccaccaagctgcagaacaagagattctaccccatggtgtgcagcaccgccgccagaagcagcatgaaggtgaccagaagctgcgccagcgccaccagcctgcagtacctgtgctgccacagactgagacagctgagacccgacagcggcgacaccctggagggcctgcccctgccccccggcctgaagcaggtgctgcacaacaagctgggctgggtgctgagcatgagctgcagcagaagaaaggcccccgtgagcgacccccaggccgccaccagcgcccaccccagcagcagagagcccagaccctgccagagaaagagatgcagaagaacctag

SEQ ID NO: 100713 - DNA, 480 bp, Artificial Sequence
  Description of Artificial Sequence: Synthetic coding sequence
atggagtacagctgcggcaccgccgccatcagaggcaccaaggagctgggcgagggccagcacttctgggagatcaagatgaccagccccgtgtacggcaccctgaccttcttcaagaacagaaagtgcatcggcgtggccgccaccaagctgcagaacaagagattctaccccatggtgtgcagcaccgccgccagaagcagcatgaaggtgaccagaagctgcgccagcgccaccagcctgcagtacctgtgctgccacagactgagacagctgagacccgacagcggcgacaccctggagggcctgcccctgccccccggcctgaagcaggtgctgcacaacaagctgggctgggtgctgagcatgagctgcagcagaagaaaggcccccgtgagcgacccccaggccgccaccagcgcccaccccagcagcagagagcccagaccctgccagagaaagagatgcagaagaacctag

SEQ ID NO: 100714 - DNA, 1068 bp, Artificial Sequence; identical to SEQ ID NO: 100712
  Description of Artificial Sequence: Synthetic coding sequence

SEQ ID NO: 100715 - DNA, 822 bp, Artificial Sequence
  Description of Artificial Sequence: Synthetic coding sequence
atgggccagaagctgagcggcagcctgaagagcgtggaggtgagagagcccgccctgagacccgccaagagagagctgagaggcgccgagcccggcagacccgccagactggaccagctgctggacatgcccgccgccggcctggccgtgcagctgagacacgcctggaaccccgaggacagaagcctgaacgtgttcgtgaaggacgacgacagactgaccttccacagacaccccgtggcccagagcaccgacggcatcagaggcaaggtgggccacgccagaggcctgcacgcctggcagatcaactggcccgccagacagagaggcacccacgccgtggtgggcgtggccaccgccagagcccccctgcacagcgtgggctacaccgccctggtgggcagcgacgccgagagctggggctgggacctgggcagaagcagactgtaccacgacggcaagaaccagcccggcgtggcctaccccgccttcctgggccccgacgaggccttcgccctgcccgacagcctgctggtggtgctggacatggacgagggcaccctgagcttcatcgtggacggccagtacctgggcgtggccttcagaggcctgaagggcaagaagctgtaccccgtggtgagcgccgtgtggggccactgcgaggtgaccatgagatacatcaacggcctggaccccgagcccctgcccctgatggacctgtgcagaagaagcatcagaagcgccctgggcagacagagactgcaggacatcagcagcctgcccctgccccagagcctgaagaactacctgcagtaccagtag

SEQ ID NO: 100716 - DNA, 1908 bp, Artificial Sequence
  Description of Artificial Sequence: Synthetic coding sequence
atggccagcagcggcatggccgacagcgccaaccacctgcccttcttcttcggcaacatcaccagagaggaggccgaggactacctggtgcagggcggcatgagcgacggcctgtacctgctgagacagagcagaaactacctgggcggcttcgccctgagcgtggcccacggcagaaaggcccaccactacaccatcgagagagagctgaacggcacctacgccatcgccggcggcagaacccacgccagccccgccgacctgtgccactaccacagccaggagagcgacggcctggtgtgcctgctgaagaagcccttcaacagaccccagggcgtgcagcccaagaccggccccttcgaggacctgaaggagaacctgatcagagagtacgtgaagcagacctggaacctgcagggccaggccctggagcaggccatcatcagccagaagccccagctggagaagctgatcgccaccaccgcccacgagaagatgccctggttccacggcaagatcagcagagaggagagcgagcagatcgtgctgatcggcagcaagaccaacggcaagttcctgatcagagccagagacaacaacggcagctacgccctgtgcctgctgcacgagggcaaggtgctgcactacagaatcgacaaggacaagaccggcaagctgagcatccccgagggcaagaagttcgacaccctgtggcagctggtggagcactacagctacaaggccgacggcctgctgagagtgctgaccgtgccctgccagaagatcggcacccagggcaacgtgaacttcggcggcagaccccagctgcccggcagccaccccgccacctggagcgccggcggcatcatcagcagaatcaagagctacagcttccccaagcccggccacagaaagagcagccccgcccagggcaacagacaggagagcaccgtgagcttcaacccctacgagcccgagctggccccctgggccgccgacaagggcccccagagagaggccctgcccatggacaccgaggtgtacgagagcccctacgccgaccccgaggagatcagacccaaggaggtgtacctggacagaaagctgctgaccctggaggacaaggagctgggcagcggcaacttcggcaccgtgaagaagggctactaccagatgaagaaggtggtgaagaccgtggccgtgaagatcctgaagaacgaggccaacgaccccgccctgaaggacgagctgctggccgaggccaacgtgatgcagcagctggacaacccctacatcgtgagaatgatcggcatctgcgaggccgagagctggatgctggtgatggagatggccgagctgggccccctgaacaagtacctgcagcagaacagacacgtgaaggacaagaacatcatcgagctggtgcaccaggtgagcatgggcatgaagtacctggaggagagcaacttcgtgcacagagacctggccgccagaaacgtgctgctggtgacccagcactacgccaagatcagcgacttcggcctgagcaaggccctgagagccgacgagaactactacaaggcccagacccacggcaagtggcccgtgaagtggtacgcccccgagtgcatcaactactacaagttcagcagcaagagcgacgtgtggagcttcggcgtgctgatgtgggaggccttcagctacggccagaagccctacagaggcatgaagggcagcgaggtgaccgccatgctggagaagggcgagagaatgggctgccccgccggctgccccagagagatgtacgacctgatgaacctgtgctggacctacgacgtggagaacagacccggcttcgccgccgtggagctgagactgagaaactactactacgacgtggtgaactag

SEQ ID NO: 100717 - DNA, 1839 bp, Artificial Sequence
  Description of Artificial Sequence: Synthetic coding sequence
atggccagcagcggcatggccgacagcgccaaccacctgcccttcttcttcggcaacatcaccagagaggaggccgaggactacctggtgcagggcggcatgagcgacggcctgtacctgctgagacagagcagaaactacctgggcggcttcgccctgagcgtggcccacggcagaaaggcccaccactacaccatcgagagagagctgaacggcacctacgccatcgccggcggcagaacccacgccagccccgccgacctgtgccactaccacagccaggagagcgacggcctggtgtgcctgctgaagaagcccttcaacagaccccagggcgtgcagcccaagaccggccccttcgaggacctgaaggagaacctgatcagagagtacgtgaagcagacctggaacctgcagggccaggccctggagcaggccatcatcagccagaagccccagctggagaagctgatcgccaccaccgcccacgagaagatgccctggttccacggcaagatcagcagagaggagagcgagcagatcgtgctgatcggcagcaagaccaacggcaagttcctgatcagagccagagacaacaacggcagctacgccctgtgcctgctgcacgagggcaaggtgctgcactacagaatcgacaaggacaagaccggcaagctgagcatccccgagggcaagaagttcgacaccctgtggcagctggtggagcactacagctacaaggccgacggcctgctgagagtgctgaccgtgccctgccagaagatcggcacccagggcaacgtgaacttcggcggcagaccccagctgcccggcagccaccccgccagcagccccgcccagggcaacagacaggagagcaccgtgagcttcaacccctacgagcccgagctggccccctgggccgccgacaagggcccccagagagaggccctgcccatggacaccgaggtgtacgagagcccctacgccgaccccgaggagatcagacccaaggaggtgtacctggacagaaagctgctgaccctggaggacaaggagctgggcagcggcaacttcggcaccgtgaagaagggctactaccagatgaagaaggtggtgaagaccgtggccgtgaagatcctgaagaacgaggccaacgaccccgccctgaaggacgagctgctggccgaggccaacgtgatgcagcagctggacaacccctacatcgtgagaatgatcggcatctgcgaggccgagagctggatgctggtgatggagatggccgagctgggccccctgaacaagtacctgcagcagaacagacacgtgaaggacaagaacatcatcgagctggtgcaccaggtgagcatgggcatgaagtacctggaggagagcaacttcgtgcacagagacctggccgccagaaacgtgctgctggtgacccagcactacgccaagatcagcgacttcggcctgagcaaggccctgagagccgacgagaactactacaaggcccagacccacggcaagtggcccgtgaagtggtacgcccccgagtgcatcaactactacaagttcagcagcaagagcgacgtgtggagcttcggcgtgctgatgtgggaggccttcagctacggccagaagccctacagaggcatgaagggcagcgaggtgaccgccatgctggagaagggcgagagaatgggctgccccgccggctgccccagagagatgtacgacctgatgaacctgtgctggacctacgacgtggagaacagacccggcttcgccgccgtggagctgagactgagaaactactactacgacgtggtgaactag

SEQ ID NO: 100718 - DNA, 1839 bp, Artificial Sequence; identical to SEQ ID NO: 100717
  Description of Artificial Sequence: Synthetic coding sequence

SEQ ID NO: 100719 - DNA, 1908 bp, Artificial Sequence; identical to SEQ ID NO: 100716
  Description of Artificial Sequence: Synthetic coding sequence

SEQ ID NO: 100720 - DNA, 990 bp, Artificial Sequence
  Description of Artificial Sequence: Synthetic coding sequence
atggtgagcaagagcagatggaagctgctggccatgctggccctggtgctggtggtgatggtgtggtacagcatcagcagagaggacagcttctacttccccatccccgagaagaaggagccctgcctgcagggcgaggccgagagcaaggccagcaagctgttcggcaactacagcagagaccagcccatcttcctgagactggaggactacttctgggtgaagacccccagcgcctacgagctgccctacggcaccaagggcagcgaggacctgctgctgagagtgctggccatcaccagcagcagcatccccaagaacatccagagcctgagatgcagaagatgcgtggtggtgggcaacggccacagactgagaaacagcagcctgggcgacgccatcaacaagtacgacgtggtgatcagactgaacaacgcccccgtggccggctacgagggcgacgtgggcagcaagaccaccatgagactgttctaccccgagagcgcccacttcgaccccaaggtggagaacaaccccgacaccctgctggtgctggtggccttcaaggccatggacttccactggatcgagaccatcctgagcgacaagaagagagtgagaaagggcttctggaagcagccccccctgatctgggacgtgaaccccaagcagatcagaatcctgaaccccttcttcatggagatcgccgccgacaagctgctgagcctgcccatgcagcagcccagaaagatcaagcagaagcccaccaccggcctgctggccatcaccctggccctgcacctgtgcgacctggtgcacatcgccggcttcggctaccccgacgcctacaacaagaagcagaccatccactactacgagcagatcaccctgaagagcatggccggcagcggccacaacgtgagccaggaggccctggccatcaagagaatgctggagatgggcgccatcaagaacctgaccagcttctag

SEQ ID NO: 100721 - DNA, 1917 bp, Artificial Sequence
  Description of Artificial Sequence: Synthetic coding sequence
atggccaccggcgccaacgccacccccctggacttccccagcaagaagagaaagagaagcagatggaaccaggacaccatggagcagaagaccgtgatccccggcatgcccaccgtgatcccccccggcctgaccagagagcaggagagagcctacatcgtgcagctgcagatcgaggacctgaccagaaagctgagaaccggcgacctgggcatcccccccaaccccgaggacagaagccccagccccgagcccatctacaacagcgagggcaagagactgaacaccagagagttcagaaccagaaagaagctggaggaggagagacacaacctgatcaccgagatggtggccctgaaccccgacttcaagccccccgccgactacaagccccccgccaccagagtgagcgacaaggtgatgatcccccaggacgagtaccccgagatcaacttcgtgggcctgctgatcggccccagaggcaacaccctgaagaacatcgagaaggagtgcaacgccaagatcatgatcagaggcaagggcagcgtgaaggagggcaaggtgggcagaaaggacggccagatgctgcccggcgaggacgagcccctgcacgccctggtgaccgccaacaccatggagaacgtgaagaaggccgtggagcagatcagaaacatcctgaagcagggcatcgagacccccgaggaccagaacgacctgagaaagatgcagctgagagagctggccagactgaacggcaccctgagagaggacgacaacagaatcctgagaccctggcagagcagcgagaccagaagcatcaccaacaccaccgtgtgcaccaagtgcggcggcgccggccacatcgccagcgactgcaagttccagagacccggcgacccccagagcgcccaggacaaggccagaatggacaaggagtacctgagcctgatggccgagctgggcgaggcccccgtgcccgccagcgtgggcagcaccagcggccccgccaccacccccctggccagcgcccccagacccgccgcccccgccaacaacccccccccccccagcctgatgagcaccacccagagcagacccccctggatgaacagcggccccagcgagagcagaccctaccacggcatgcacggcggcggccccggcggccccggcggcggcccccacagcttcccccaccccctgcccagcctgaccggcggccacggcggccaccccatgcagcacaaccccaacggccccccccccccctggatgcagcccccccccccccccatgaaccagggcccccacccccccggccaccacggccccccccccatggaccagtacctgggcagcacccccgtgggcagcggcgtgtacagactgcaccagggcaagggcatgatgccccccccccccatgggcatgatgcccccccccccccccccccccagcggccagcccccccccccccccagcggccccctgcccccctggcagcagcagcagcagcagcccccccccccccccccccccagcagcagcatggccagcagcacccccctgccctggcagcagaacaccaccaccaccaccaccagcgccggcaccggcagcatccccccctggcagcagcagcaggccgccgccgccgccagccccggcgccccccagatgcagggcaaccccaccatggtgcccctgccccccggcgtgcagccccccctgccccccggcgcccccccccccccccccccccccccccccggcagcgccggcatgatgatcccccccagaggcggcgacggccccagccacgagagcgaggacttccccagacccctggtgaccctgcccggcagacagccccagcagagaccctggtggaccggctggttcggcaaggccgcctag

SEQ ID NO: 100722 - DNA, 1920 bp, Artificial Sequence
  Description of Artificial Sequence: Synthetic coding sequence
atggccaccggcgccaacgccacccccctggacttccccagcaagaagagaaagagaagcagatggaaccaggacaccatggagcagaagaccgtgatccccggcatgcccaccgtgatcccccccggcctgaccagagagcaggagagagcctacatcgtgcagctgcagatcgaggacctgaccagaaagctgagaaccggcgacctgggcatcccccccaaccccgaggacagaagccccagccccgagcccatctacaacagcgagggcaagagactgaacaccagagagttcagaaccagaaagaagctggaggaggagagacacaacctgatcaccgagatggtggccctgaaccccgacttcaagccccccgccgactacaagccccccgccaccagagtgagcgacaaggtgatgatcccccaggacgagtaccccgagatcaacttcgtgggcctgctgatcggccccagaggcaacaccctgaagaacatcgagaaggagtgcaacgccaagatcatgatcagaggcaagggcagcgtgaaggagggcaaggtgggcagaaaggacggccagatgctgcccggcgaggacgagcccctgcacgccctggtgaccgccaacaccatggagaacgtgaagaaggccgtggagcagatcagaaacatcctgaagcagggcatcgagacccccgaggaccagaacgacctgagaaagatgcagctgagagagctggccagactgaacggcaccctgagagaggacgacaacagaatcctgagaccctggcagagcagcgagaccagaagcatcaccaacaccaccgtgtgcaccaagtgcggcggcgccggccacatcgccagcgactgcaagttccagagacccggcgacccccagagcgcccaggacaaggccagaatggacaaggagtacctgagcctgatggccgagctgggcgaggcccccgtgcccgccagcgtgggcagcaccagcggccccgccaccacccccctggccagcgcccccagacccgccgcccccgccaacaacccccccccccccagcctgatgagcaccacccagagcagacccccctggatgaacagcggccccagcgagagcagaccctaccacggcatgcacggcggcggccccggcggccccggcggcggcccccacagcttcccccaccccctgcccagcctgaccggcggccacggcggccaccccatgcagcacaaccccaacggccccccccccccctggatgcagcccccccccccccccatgaaccagggcccccacccccccggccaccacggccccccccccatggaccagtacctgggcagcacccccgtgggcagcggcgtgtacagactgcaccagggcaagggcatgatgccccccccccccatgggcatgatgcccccccccccccccccccccagcggccagcccccccccccccccagcggccccctgcccccctggcagcagcagcagcagcagcccccccccccccccccccccagcagcagcatggccagcagcacccccctgccctggcagcagaacaccaccaccaccaccaccagcgccggcaccggcagcatccccccctggcagcagcagcaggccgccgccgccgccagccccggcgccccccagatgcagggcaaccccaccatggtgcccctgccccccggcgtgcagccccccctgccccccggcgcccccccccccccccccccccccccccccggcagcgccggcatgatgtacgccccccccccccccccccccccccccatggaccccagcaacttcgtgaccatgatgggcatgggcgtggccggcatgccccccttcggcatgccccccgcccccccccccccccccccccagaactag

SEQ ID NO: 100723 - DNA, 1716 bp, Artificial Sequence
  Description of Artificial Sequence: Synthetic coding sequence
atggccaccggcgccaacgccacccccctggacttccccagcaagaagagaaagagaagcagatggaaccaggacaccatggagcagaagaccgtgatccccggcatgcccaccgtgatcccccccggcctgaccagagagcaggagagagcctacatcgtgcagctgcagatcgaggacctgaccagaaagctgagaaccggcgacctgggcatcccccccaaccccgaggacagaagccccagccccgagcccatctacaacagcgagggcaagagactgaacaccagagagttcagaaccagaaagaagctggaggaggagagacacaacctgatcaccgagatggtggccctgaaccccgacttcaagccccccgccgactacaagccccccgccaccagagtgagcgacaaggtgatgatcccccaggacgagtaccccgagatcaacttcgtgggcctgctgatcggccccagaggcaacaccctgaagaacatcgagaaggagtgcaacgccaagatcatgatcagaggcaagggcagcgtgaaggagggcaaggtgggcagaaaggacggccagatgctgcccggcgaggacgagcccctgcacgccctggtgaccgccaacaccatggagaacgtgaagaaggccgtggagcagatcagaaacatcctgaagcagggcatcgagacccccgaggaccagaacgacctgagaaagatgcagctgagagagctggccagactgaacggcaccctgagagaggacgacaacagaatcctgagaccctggcagagcagcgagaccagaagcatcaccaacaccaccgtgtgcaccaagtgcggcggcgccggccacatcgccagcgactgcaagttccagagacccggcgacccccagagcgcccaggacaaggccagaatggacaaggagtacctgagcctgatggccgagctgggcgaggcccccgtgcccgccagcgtgggcagcaccagcggccccgccaccacccccctggccagcgcccccagacccgccgcccccgccaacaacccccccccccccagcctgatgagcaccacccagagcagacccccctggatgaacagcggccccagcgagagcagaccctaccacggcatgcacggcggcggccccggcggccccggcggcggcccccacagcttcccccaccccctgcccagcctgaccggcggccacggcggccaccccatgcagcacaaccccaacggccccccccccccctggatgcagcccccccccccccccatgaaccagggcccccacccccccggccaccacggccccccccccatgggcaagagcgtgcccggcaagtacgcctgcggcctgtggggcctgagccccgccagcagaaagagatacgacgccgccaccacctacggccacgacgccgccgccgccgccgccagccagtgggccgcccccacccccagcctgtggagcagcagccccatggccaccaccgccgccgccgccagcgccacccccagcgcccagcagcagtacggcttccagtaccccctggccatggccgccaagatcccccccagaggcggcgacggccccagccacgagagcgaggacttccccagacccctggtgaccctgcccggcagacagccccagcagagaccctggtggaccggctggttcggcaaggccgcctag

SEQ ID NO: 100724 - DNA, 1302 bp, Artificial Sequence
  Description of Artificial Sequence: Synthetic coding sequence
atggtggccctgaaccccgacttcaagccccccgccgactacaagccccccgccaccagagtgagcgacaaggtgatgatcccccaggacgagtaccccgagatcaacttcgtgggcctgctgatcggccccagaggcaacaccctgaagaacatcgagaaggagtgcaacgccaagatcatgatcagaggcaagggcagcgtgaaggagggcaaggtgggcagaaaggacggccagatgctgcccggcgaggacgagcccctgcacgccctggtgaccgccaacaccatggagaacgtgaagaaggccgtggagcagatcagaaacatcctgaagcagggcatcgagacccccgaggaccagaacgacctgagaaagatgcagctgagagagctggccagactgaacggcaccctgagagaggacgacaacagaatcctgagaccctggcagagcagcgagaccagaagcatcaccaacaccaccgtgtgcaccaagtgcggcggcgccggccacatcgccagcgactgcaagttccagagacccggcgacccccagagcgcccaggacaaggccagaatggacaaggagtacctgagcctgatggccgagctgggcgaggcccccgtgcccgccagcgtgggcagcaccagcggccccgccaccacccccctggccagcgcccccagacccgccgcccccgccaacaacccccccccccccagcctgatgagcaccacccagagcagacccccctggatgaacagcggccccagcgagagcagaccctaccacggcatgcacggcggcggccccggcggccccggcggcggcccccacagcttcccccaccccctgcccagcctgaccggcggccacggcggccaccccatgcagcacaaccccaacggccccccccccccctggatgcagcccccccccccccccatgaaccagggcccccacccccccggccaccacggccccccccccatggaccagtacctgggcagcacccccgtgggcagcggcgtgtacagactgcaccagggcaagggcatgatgccccccccccccatgggcatgatgcccccccccccccccccccccagcggccagcccccccccccccccagcggccccctgcccccctggcagcagcagcagcagcagcccccccccccccccccccccagcagcagcatggccagcagcacccccctgccctggcagcagagaagcctgcccgccgccgccatggccagagccatgagagtgagaaccttcagagcccactggtag

SEQ ID NO: 100725 - DNA, 2022 bp, Artificial Sequence
  Description of Artificial Sequence: Synthetic coding sequence
atggccaccggcgccaacgccacccccctgggcaagctgggcccccccggcctgccccccctgcccggccccaagggcggcttcgagcccggccccccccccgcccccggccccggcgccggcctgctggcccccggcccccccccccccccccccgtgggcagcatgggcgccctgaccgccgccttccccttcgccgccctgcccccccccccccccccccccccccccccccccccccagcagccccccccccccccccccccccccagccccggcgccagctacccccccccccagccccccccccccccccccctgtaccagagagtgagccccccccagcccccccccccccagccccccagaaaggaccagcagcccggccccgccggcggcggcggcgacttccccagcaagaagagaaagagaagcagatggaaccaggacaccatggagcagaagaccgtgatccccggcatgcccaccgtgatcccccccggcctgaccagagagcaggagagagcctacatcgtgcagctgcagatcgaggacctgaccagaaagctgagaaccggcgacctgggcatcccccccaaccccgaggacagaagccccagccccgagcccatctacaacagcgagggcaagagactgaacaccagagagttcagaaccagaaagaagctggaggaggagagacacaacctgatcaccgagatggtggccctgaaccccgacttcaagccccccgccgactacaagccccccgccaccagagtgagcgacaaggtgatgatcccccaggacgagtaccccgagatcaacttcgtgggcctgctgatcggccccagaggcaacaccctgaagaacatcgagaaggagtgcaacgccaagatcatgatcagaggcaagggcagcgtgaaggagggcaaggtgggcagaaaggacggccagatgctgcccggcgaggacgagcccctgcacgccctggtgaccgccaacaccatggagaacgtgaagaaggccgtggagcagatcagaaacatcctgaagcagggcatcgagacccccgaggaccagaacgacctgagaaagatgcagctgagagagctggccagactgaacggcaccctgagagaggacgacaacagaatcctgagaccctggcagagcagcgagaccagaagcatcaccaacaccaccgtgtgcaccaagtgcggcggcgccggccacatcgccagcgactgcaagttccagagacccggcgacccccagagcgcccaggacaaggccagaatggacaaggagtacctgagcctgatggccgagctgggcgaggcccccgtgcccgccagcgtgggcagcaccagcggccccgccaccacccccctggccagcgcccccagacccgccgcccccgccaacaacccccccccccccagcctgatgagcaccacccagagcagacccccctggatgaacagcggccccagcgagagcagaccctaccacggcatgcacggcggcggccccggcggccccggcggcggcccccacagcttcccccaccccctgcccagcctgaccggcggccacggcggccaccccatgcagcacaaccccaacggccccccccccccctggatgcagcccccccccccccccatgaaccagggcccccacccccccggccaccacggccccccccccatggaccagtacctgggcagcacccccgtgggcagcggcgtgtacagactgcaccagggcaagggcatgatgccccccccccccatgggcatgatgcccccccccccccccccccccagcggccagcccccccccccccccagcggccccctgcccccctggcagcagcagcagcagcagcccccccccccccccccccccagcagcagcatggccagcagcacccccctgccctggcagcagagaagcctgcccgccgccgccatggccagagccatgagagtgagaaccttcagagcccactggtag

SEQ ID NO: 100726 - DNA, 1842 bp, Artificial Sequence
  Description of Artificial Sequence: Synthetic coding sequence
atggagcagaagaccgtgatccccggcatgcccaccgtgatcccccccggcctgaccagagagcaggagagagcctacatcgtgcagctgcagatcgaggacctgaccagaaagctgagaaccggcgacctgggcatcccccccaaccccgaggacagaagccccagccccgagcccatctacaacagcgagggcaagagactgaacaccagagagttcagaaccagaaagaagctggaggaggagagacacaacctgatcaccgagatggtggccctgaaccccgacttcaagccccccgccgactacaagccccccgccaccagagtgagcgacaaggtgatgatcccccaggacgagtaccccgagatcaacttcgtgggcctgctgatcggccccagaggcaacaccctgaagaacatcgagaaggagtgcaacgccaagatcatgatcagaggcaagggcagcgtgaaggagggcaaggtgggcagaaaggacggccagatgctgcccggcgaggacgagcccctgcacgccctggtgaccgccaacaccatggagaacgtgaagaaggccgtggagcagatcagaaacatcctgaagcagggcatcgagacccccgaggaccagaacgacctgagaaagatgcagctgagagagctggccagactgaacggcaccctgagagaggacgacaacagaatcctgagaccctggcagagcagcgagaccagaagcatcaccaacaccaccgtgtgcaccaagtgcggcggcgccggccacatcgccagcgactgcaagttccagagacccggcgacccccagagcgcccaggacaaggccagaatggacaaggagtacctgagcctgatggccgagctgggcgaggcccccgtgcccgccagcgtgggcagcaccagcggccccgccaccacccccctggccagcgcccccagacccgccgcccccgccaacaacccccccccccccagcctgatgagcaccacccagagcagacccccctggatgaacagcggccccagcgagagcagaccctaccacggcatgcacggcggcggccccggcggccccggcggcggcccccacagcttcccccaccccctgcccagcctgaccggcggccacggcggccaccccatgcagcacaaccccaacggccccccccccccctggatgcagcccccccccccccccatgaaccagggcccccacccccccggccaccacggccccccccccatggaccagtacctgggcagcacccccgtgggcagcggcgtgtacagactgcaccagggcaagggcatgatgccccccccccccatgggcatgatgcccccccccccccccccccccagcggccagcccccccccccccccagcggccccctgcccccctggcagcagcagcagcagcagcccccccccccccccccccccagcagcagcatggccagcagcacccccctgccctggcagcagaacaccaccaccaccaccaccagcgccggcaccggcagcatccccccctggcagcagcagcaggccgccgccgccgccagccccggcgccccccagatgcagggcaaccccaccatggtgcccctgccccccggcgtgcagccccccctgccccccggcgcccccccccccccccccccccccccccccggcagcgccggcatgatgtacgccccccccccccccccccccccccccatggaccccagcaacttcgtgaccatgatgggcatgggcgtggccggcatgccccccttcggcatgccccccgcccccccccccccccccccccagaactag

SEQ ID NO: 100727 - DNA, 1527 bp, Artificial Sequence
  Description of Artificial Sequence: Synthetic coding sequence
atggccaagagcaacggcgagaacggccccagagcccccgccgccggcgagagcctgagcggcaccagagagagcctggcccagggccccgacgccgccaccaccgacgagctgagcagcctgggcagcgacagcgaggccaacggcttcgccgagagaagaatcgacaagttcggcttcatcgtgggcagccagggcgccgagggcgccctggaggaggtgcccctggaggtgctgagacagagagagagcaagtggctggacatgctgaacaactgggacaagtggatggccaagaagcacaagaagatcagactgagatgccagaagggcatcccccccagcctgagaggcagagcctggcagtacctgagcggcggcaaggtgaagctgcagcagaaccccggcaagttcgacgagctggacatgagccccggcgaccccaagtggctggacgtgatcgagagagacctgcacagacagttccccttccacgagatgttcgtgagcagaggcggccacggccagcaggacctgttcagagtgctgaaggcctacaccctgtacagacccgaggagggctactgccaggcccaggcccccatcgccgccgtgctgctgatgcacatgcccgccgagcaggccttctggtgcctggtgcagatctgcgagaagtacctgcccggctactacagcgagaagctggaggccatccagctggacggcgagatcctgttcagcctgctgcagaaggtgagccccgtggcccacaagcacctgagcagacagaagatcgaccccctgctgtacatgaccgagtggttcatgtgcgccttcagcagaaccctgccctggagcagcgtgctgagagtgtgggacatgttcttctgcgagggcgtgaagatcatcttcagagtgggcctggtgctgctgaagcacgccctgggcagccccgagaaggtgaaggcctgccagggccagtacgagaccatcgagagactgagaagcctgagccccaagatcatgcaggaggccttcctggtgcaggaggtggtggagctgcccgtgaccgagagacagatcgagagagagcacctgatccagctgagaagatggcaggagaccagaggcgagctgcagtgcagaagcccccccagactgcacggcgccaaggccatcctggacgccgagcccggccccagacccgccctgcagcccagccccagcatcagactgcccctggacgcccccctgcccggcagcaaggccaagcccaagccccccaagcaggcccagaaggagcagagaaagcagatgaagggcagaggccagctggagaagccccccgcccccaaccaggccatggtggtggccgccgccggcgacgcctgccccccccagcacgtgccccccaaggacagcgcccccaaggacagcgccccccaggacctggccccccaggtgagcgcccaccacagaagccaggagagcctgaccagccaggagagcgaggacacctacctgtag

SEQ ID NO: 100728 - DNA, 2187 bp, Artificial Sequence
  Description of Artificial Sequence: Synthetic coding sequence
atgcccgccggccccgtgcaggccgtgcccccccccccccccgtgcccaccgagcccaagcagcccaccgaggaggaggccagcagcaaggaggacagcgcccccagcaagcccgtggtgggcatcatctaccccccccccgaggtgagaaacatcgtggacaagaccgccagcttcgtggccagaaacggccccgagttcgaggccagaatcagacagaacgagatcaacaaccccaagttcaacttcctgaaccccaacgacccctaccacgcctactacagacacaaggtgagcgagttcaaggagggcaaggcccagttcgtggccagaaacggcagacagttcctgacccagctgatgcagaaggagcagagaaactaccagttcgacttcctgagaccccagcacagcctgttcaactacttcaccaagctggtggagcagtacaccaagatcctgatcccccccaagggcctgttcagcaagctgaagaaggaggccgagaaccccagagaggtgctggaccaggtgtgctacagagtggagtgggccaagttccaggagagagagagaaagaaggaggaggaggagaaggagaaggagagagtggcctacgcccagatcgactggcacgacttcgtggtggtggagaccgtggacttccagcccaacgagcagggcaacttccccccccccaccacccccgaggagctgggcgccagaatcctgatccaggagagatacgagaagttcggcgagagcgaggaggtggagatggaggtggagagcgacgaggaggacgacaagcaggagaaggccgaggagccccccagccagctggaccaggacacccaggtgcaggacatggacgagggcagcgacgacgaggaggagggccagaaggtgccccccccccccgagacccccatgcccccccccctgccccccacccccgaccaggtgatcgtgagaaaggactacgaccccaaggccagcaagcccctgccccccgcccccgcccccgacgagtacctggtgagccccatcaccggcgagaagatccccgccagcaagatgcaggagcacatgagaatcggcctgctggaccccagatggctggagcagagagacagaagcatcagagagaagcagagcgacgacgaggtgtacgcccccggcctggacatcgagagcagcctgaagcagctggccgagagaagaaccgacatcttcggcgtggaggagaccgccatcggcaagaagatcggcgaggaggagatccagaagcccgaggagaaggtgacctgggacggccacagcggcagcatggccagaacccagcaggccgcccaggccaacatcaccctgcaggagcagatcgaggccatccacaaggccaagggcctggtgcccgaggacgacaccaaggagaagatcggccccagcaagcccaacgagatcccccagcagccccccccccccagcagcgccaccaacatccccagcagcgccccccccatcaccagcgtgcccagaccccccaccatgcccccccccgtgagaaccaccgtggtgagcgccgtgcccgtgatgcccagaccccccatggccagcgtggtgagactgccccccggcagcgtgatcgcccccatgccccccatcatccacgcccccagaatcaacgtggtgcccatgccccccagcgccccccccatcatggcccccagacccccccccatgatcgtgcccaccgccttcgtgcccgccccccccgtggcccccgtgcccgcccccgcccccatgccccccgtgcacccccccccccccatggaggacgagcccaccagcaagaagctgaagaccgaggacagcctgatgcccgaggaggagttcctgagaagaaacaagggccccgtgagcatcaaggtgcaggtgcccaacatgcaggacaagaccgagtggaagctgaacggccaggtgctggtgttcaccctgcccctgaccgaccaggtgagcgtgatcaaggtgaagatccacgaggccaccggcatgcccgccggcaagcagaagctgcagtacgagggcatcttcatcaaggacagcaacagcctggcctactacaacatggccaacggcgccgtgatccacctggccctgaaggagagaggcggcagaaagaagtag

SEQ ID NO: 100729 - DNA, 2073 bp, Artificial Sequence
  Description of Artificial Sequence: Synthetic coding sequence
atgaccctgaccatgcccaccaccgccatccccaaggtgatgcagcagcagcagcagaccacccagcagcagctgccccagaaggtgcaggcccaggtgatccaggagaccatcgtgcccaaggagcccccccccgagttcgagttcatcgccgacccccccagcatcagcgccttcgacctggacgtggtgaagctgaccgcccagttcgtggccagaaacggcagacagttcctgacccagctgatgcagaaggagcagagaaactaccagttcgacttcctgagaccccagcacagcctgttcaactacttcaccaagctggtggagcagtacaccaagatcctgatcccccccaagggcctgttcagcaagctgaagaaggaggccgagaaccccagagaggtgctggaccaggtgtgctacagagtggagtgggccaagttccaggagagagagagaaagaaggaggaggaggagaaggagaaggagagagtggcctacgcccagatcgactggcacgacttcgtggtggtggagaccgtggacttccagcccaacgagcagggcaacttccccccccccaccacccccgaggagctgggcgccagaatcctgatccaggagagatacgagaagttcggcgagagcgaggaggtggagatggaggtggagagcgacgaggaggacgacaagcaggagaaggccgaggagccccccagccagctggaccaggacacccaggtgcaggacatggacgagggcagcgacgacgaggaggagggccagaaggtgccccccccccccgagacccccatgcccccccccctgccccccacccccgaccaggtgatcgtgagaaaggactacgaccccaaggccagcaagcccctgccccccgcccccgcccccgacgagtacctggtgagccccatcaccggcgagaagatccccgccagcaagatgcaggagcacatgagaatcggcctgctggaccccagatggctggagcagagagacagaagcatcagagagaagcagagcgacgacgaggtgtacgcccccggcctggacatcgagagcagcctgaagcagctggccgagagaagaaccgacatcttcggcgtggaggagaccgccatcggcaagaagatcggcgaggaggagatccagaagcccgaggagaaggtgacctgggacggccacagcggcagcatggccagaacccagcaggccgcccaggccaacatcaccctgcaggagcagatcgaggccatccacaaggccaagggcctggtgcccgaggacgacaccaaggagaagatcggccccagcaagcccaacgagatcccccagcagccccccccccccagcagcgccaccaacatccccagcagcgccccccccatcaccagcgtgcccagaccccccaccatgcccccccccgtgagaaccaccgtggtgagcgccgtgcccgtgatgcccagaccccccatggccagcgtggtgagactgccccccggcagcgtgatcgcccccatgccccccatcatccacgcccccagaatcaacgtggtgcccatgccccccagcgccccccccatcatggcccccagacccccccccatgatcgtgcccaccgccttcgtgcccgccccccccgtggcccccgtgcccgcccccgcccccatgccccccgtgcacccccccccccccatggaggacgagcccaccagcaagaagctgaagaccgaggacagcctgatgcccgaggaggagttcctgagaagaaacaagggccccgtgagcatcaaggtgcaggtgcccaacatgcaggacaagaccgagtggaagctgaacggccaggtgctggtgttcaccctgcccctgaccgaccaggtgagcgtgatcaaggtgaagatccacgaggccaccggcatgcccgccggcaagcagaagctgcagtacgagggcatcttcatcaaggacagcaacagcctggcctactacaacatggccaacggcgccgtgatccacctggccctgaaggagagaggcggcagaaagaagtag

SEQ ID NO: 100730 - DNA, 900 bp, Artificial Sequence
  Description of Artificial Sequence: Synthetic coding sequence
atggacctgagcgagctggagagagacaacaccggcagatgcagactgagcagccccgtgcccgccgtgtgcagaaaggagccctgcgtgctgggcgtggacgaggccggcagaggccccgtgctgggccccatggtgtacgccatctgctactgccccctgcccagactggccgacctggaggccctgaaggtggccgacagcaagaccctgctggagagcgagagagagagactgttcgccaagatggaggacaccgacttcgtgggctgggccctggacgtgctgagccccaacctgatcagcaccagcatgctgggcagagtgaagtacaacctgaacagcctgagccacgacaccgccaccggcctgatccagtacgccctggaccagggcgtgaacgtgacccaggtgttcgtggacaccgtgggcatgcccgagacctaccaggccagactgcagcagagcttccccggcatcgaggtgaccgtgaaggccaaggccgacgccctgtaccccgtggtgagcgccgccagcatctgcgccaaggtggccagagaccaggccgtgaagaagtggcagttcgtggagaagctgcaggacctggacaccgactacggcagcggctaccccaacgaccccaagaccaaggcctggctgaaggagcacgtggagcccgtgttcggcttcccccagttcgtgagattcagctggagaaccgcccagaccatcctggagaaggaggccgaggacgtgatctgggaggacagcgccagcgagaaccaggagggcctgagaaagatcaccagctacttcctgaacgagggcagccaggccagacccagaagcagccacagatacttcctggagagaggcctggagagcgccaccagcctgtag

SEQ ID NO: 100731 - DNA, 3915 bp, Artificial Sequence
  Description of Artificial Sequence: Synthetic coding sequence
atggccaagatcgccaagacccacgaggacatcgaggcccagatcagagagatccagggcaagaaggccgccctggacgaggcccagggcgtgggcctggacagcaccggctactacgaccaggagatctacggcggcagcgacagcagattcgccggctacgtgaccagcatcgccgccaccgagctggaggacgacgacgacgactacagcagcagcaccagcctgctgggccagaagaagcccggctaccacgcccccgtggccctgctgaacgacatcccccagagcaccgagcagtacgaccccttcgccgagcacagaccccccaagatcgccgacagagaggacgagtacaagaagcacagaagaaccatgatcatcagccccgagagactggaccccttcgccgacggcggcaagacccccgaccccaagatgaacgccagaacctacatggacgtgatgagagagcagcacctgaccaaggaggagagagagatcagacagcagctggccgagaaggccaaggccggcgagctgaaggtggtgaacggcgccgccgccagccagccccccagcaagagaaagagaagatgggaccagaccgccgaccagacccccggcgccacccccaagaagctgagcagctgggaccaggccgagacccccggccacacccccagcctgagatgggacgagacccccggcagagccaagggcagcgagacccccggcgccacccccggcagcaagatctgggaccccacccccagccacacccccgccggcgccgccacccccggcagaggcgacacccccggccacgccacccccggccacggcggcgccaccagcagcgccagaaagaacagatgggacgagacccccaagaccgagagagacacccccggccacggcagcggctgggccgagacccccagaaccgacagaggcggcgacagcatcggcgagacccccacccccggcgccagcaagagaaagagcagatgggacgagacccccgccagccagatgggcggcagcacccccgtgctgacccccggcaagacccccatcggcacccccgccatgaacatggccacccccacccccggccacatcatgagcatgacccccgagcagctgcaggcctggagatgggagagagagatcgacgagagaaacagacccctgagcgacgaggagctggacgccatgttccccgagggctacaaggtgctgcccccccccgccggctacgtgcccatcagaacccccgccagaaagctgaccgccacccccacccccctgggcggcatgaccggcttccacatgcagaccgaggacagaaccatgaagagcgtgaacgaccagcccagcggcaacctgcccttcctgaagcccgacgacatccagtacttcgacaagctgctggtggacgtggacgagagcaccctgagccccgaggagcagaaggagagaaagatcatgaagctgctgctgaagatcaagaacggcaccccccccatgagaaaggccgccctgagacagatcaccgacaaggccagagagttcggcgccggccccctgttcaaccagatcctgcccctgctgatgagccccaccctggaggaccaggagagacacctgctggtgaaggtgatcgacagaatcctgtacaagctggacgacctggtgagaccctacgtgcacaagatcctggtggtgatcgagcccctgctgatcgacgaggactactacgccagagtggagggcagagagatcatcagcaacctggccaaggccgccggcctggccaccatgatcagcaccatgagacccgacatcgacaacatggacgagtacgtgagaaacaccaccgccagagccttcgccgtggtggccagcgccctgggcatccccagcctgctgcccttcctgaaggccgtgtgcaagagcaagaagagctggcaggccagacacaccggcatcaagatcgtgcagcagatcgccatcctgatgggctgcgccatcctgccccacctgagaagcctggtggagatcatcgagcacggcctggtggacgagcagcagaaggtgagaaccatcagcgccctggccatcgccgccctggccgaggccgccaccccctacggcatcgagagcttcgacagcgtgctgaagcccctgtggaagggcatcagacagcacagaggcaagggcctggccgccttcctgaaggccatcggctacctgatccccctgatggacgccgagtacgccaactactacaccagagaggtgatgctgatcctgatcagagagttccagagccccgacgaggagatgaagaagatcgtgctgaaggtggtgaagcagtgctgcggcaccgacggcgtggaggccaactacatcaagaccgagatcctgccccccttcttcaagcacttctggcagcacagaatggccctggacagaagaaactacagacagctggtggacaccaccgtggagctggccaacaaggtgggcgccgccgagatcatcagcagaatcgtggacgacctgaaggacgaggccgagcagtacagaaagatggtgatggagaccatcgagaagatcatgggcaacctgggcgccgccgacatcgaccacaagctggaggagcagctgatcgacggcatcctgtacgccttccaggagcagaccaccgaggacagcgtgatgctgaacggcttcggcaccgtggtgaacgccctgggcaagagagtgaagccctacctgccccagatctgcggcaccgtgctgtggagactgaacaacaagagcgccaaggtgagacagcaggccgccgacctgatcagcagaaccgccgtggtgatgaagacctgccaggaggagaagctgatgggccacctgggcgtggtgctgtacgagtacctgggcgaggagtaccccgaggtgctgggcagcatcctgggcgccctgaaggccatcgtgaacgtgatcggcatgcacaagatgaccccccccatcaaggacctgctgcccagactgacccccatcctgaagaacagacacgagaaggtgcaggagaactgcatcgacctggtgggcagaatcgccgacagaggcgccgagtacgtgagcgccagagagtggatgagaatctgcttcgagctgctggagctgctgaaggcccacaagaaggccatcagaagagccaccgtgaacaccttcggctacatcgccaaggccatcggcccccacgacgtgctggccaccctgctgaacaacctgaaggtgcaggagagacagaacagagtgtgcaccaccgtggccatcgccatcgtggccgagacctgcagccccttcaccgtgctgcccgccctgatgaacgagtacagagtgcccgagctgaacgtgcagaacggcgtgctgaagagcctgagcttcctgttcgagtacatcggcgagatgggcaaggactacatctacgccgtgacccccctgctggaggacgccctgatggacagagacctggtgcacagacagaccgccagcgccgtggtgcagcacatgagcctgggcgtgtacggcttcggctgcgaggacagcctgaaccacctgctgaactacgtgtggcccaacgtgttcgagaccagcccccacgtgatccaggccgtgatgggcgccctggagggcctgagagtggccatcggcccctgcagaatgctgcagtactgcctgcagggcctgttccaccccgccagaaaggtgagagacgtgtactggaagatctacaacagcatctacatcggcagccaggacgccctgatcgcccactaccccagaatctacaacgacgacaagaacacctacatcagatacgagctggactacatcctgtag

SEQ ID NO: 100732 - DNA, 435 bp, Artificial Sequence
  Description of Artificial Sequence: Synthetic coding sequence
atggccaagatcgccaagacccacgaggacatcgaggcccagatcagagagatccagggcaagaaggccgccctggacgaggcccagggcgtgggcctggacagcaccggctactacgaccaggagatctacggcggcagcgacagcagattcgccggctacgtgaccagcatcgccgccaccgagctggaggacgacgacgacgactacagcagcagcaccagcctgctgggccagaagaagcccggctaccacgcccccgtggccctgctgaacgacatcccccagagcaccgagcagtacgaccccttcgccgagcacagaccccccaagatcgccgacagagaggacgagtacaagaagcacagaagaaccatgatcatcagccccgagagactggaccccttcgccgacggcttctacagcgccgcctag

SEQ ID NO: 100733 - DNA, 435 bp, Artificial Sequence; identical to SEQ ID NO: 100732
  Description of Artificial Sequence: Synthetic coding sequence

SEQ ID NO: 100734 - DNA, 2688 bp, Artificial Sequence
  Description of Artificial Sequence: Synthetic coding sequence
atggccaccgagcaccccgagccccccaaggccgagctgcagctgccccccccccccccccccggccactacggcgcctgggccgcccaggagctgcaggccaagctggccgagatcggcgcccccatccagggcaacagagaggagctggtggagagactgcagagctacaccagacagaccggcatcgtgctgaacagacccgtgctgagaggcgaggacggcgacaaggccgcccccccccccatgagcgcccagctgcccggcatccccatgccccccccccccctgggcctgccccccctgcagccccccccccccccccccccccccccccccggcctgggcctgggcttccccatggcccacccccccaacctgggcccccccccccccctgagagtgggcgagcccgtggccctgagcgaggaggagagactgaagctggcccagcagcaggccgccctgctgatgcagcaggaggagagagccaagcagcagggcgaccacagcctgaaggagcacgagctgctggagcagcagaagagagccgccgtgctgctggagcaggagagacagcaggagatcgccaagatgggcacccccgtgcccagacccccccaggacatgggccagatcggcgtgagaacccccctgggccccagagtggccgcccccgtgggccccgtgggccccacccccaccgtgctgcccatgggcgcccccgtgcccagacccagaggccccccccccccccccggcgacgagaacagagagatggacgaccccagcgtgggccccaagatcccccaggccctggagaagatcctgcagctgaaggagagcagacaggaggagatgaacagccagcaggaggaggaggagatggagaccgacgccagaagcagcctgggccagagcgccagcgagaccgaggaggacaccgtgagcgtgagcaagaaggagaagaacagaaagagaagaaacagaaagaagaagaagaagccccagagagtgagaggcgtgagcagcgagagcagcggcgacagagagaaggacagcaccagaagcagaggcagcgacagccccgccgccgacgtggagatcgagtacgtgaccgaggagcccgagatctacgagcccaacttcatcttcttcaagagaatcttcgaggccttcaagctgaccgacgacgtgaagaaggagaaggagaaggagcccgagaagctggacaagctggagaacagcgccgcccccaagaagaagggcttcgaggaggagcacaaggacagcgacgacgacagcagcgacgacgagcaggagaagaagcccgaggcccccaagctgagcaagaagaagctgagaagaatgaacagattcaccgtggccgagctgaagcagctggtggccagacccgacgtggtggagatgcacgacgtgaccgcccaggaccccaagctgctggtgcacctgaaggccaccagaaacagcgtgcccgtgcccagacactggtgcttcaagagaaagtacctgcagggcaagagaggcatcgagaagccccccttcgagctgcccgacttcatcaagagaaccggcatccaggagatgagagaggccctgcaggagaaggaggagcagaagaccatgaagagcaagatgagagagaaggtgagacccaagatgggcaagatcgacatcgactaccagaagctgcacgacgccttcttcaagtggcagaccaagcccaagctgaccatccacggcgacctgtactacgagggcaaggagttcgagaccagactgaaggagaagaagcccggcgacctgagcgacgagctgagaatcagcctgggcatgcccgtgggccccaacgcccacaaggtgccccccccctggctgatcgccatgcagagatacggccccccccccagctaccccaacctgaagatccccggcctgaacagccccatccccgagagctgcagcttcggctaccacgccggcggctggggcaagccccccgtggacgagaccggcaagcccctgtacggcgacgtgttcggcaccaacgccgccgagttccagaccaagaccgaggaggaggagatcgacagaaccccctggggcgagctggagcccagcgacgaggagagcagcgaggaggaggaggaggaggagagcgacgaggacaagcccgacgagaccggcttcatcacccccgccgacagcggcctgatcacccccggcggcttcagcagcgtgcccgccggcatggagacccccgagctgatcgagctgagaaagaagaagatcgaggaggccatggacggcagcgagaccccccagctgttcaccgtgctgcccgagaagagaaccgccaccgtgggcggcgccatgatgggcagcacccacatctacgacatgagcaccgtgatgagcagaaagggccccgcccccgagctgcagggcgtggaggtggccctggcccccgaggagctggagctggaccccatggccatgacccagaagtacgaggagcacgtgagagagcagcaggcccaggtggagaaggaggacttcagcgacatggtggccgagcacgccgccaagcagaagcagaagaagagaaaggcccagccccaggacagcagaggcggcagcaagaagtacaaggagttcaagttctag

SEQ ID NO: 100735 - DNA, 2400 bp, Artificial Sequence
  Description of Artificial Sequence: Synthetic coding sequence
gccaagatggccaccgagcaccccgagccccccaaggccgagctgcagctgccccccccccccccccccggccactacggcgcctgggccgcccaggagctgcaggccaagctggccgagatcggcgcccccatccagggcaacagagaggagctggtggagagactgcagagctacaccagacagaccggcatcgtgctgaacagacccgtgctgagaggcgaggacggcgacaaggccgcccccccccccatgagcgcccagctgcccggcatccccatgccccccccccccctgggcctgccccccctgcagccccccccccccccccccccccccccccccggcctgggcctgggcttccccatggcccacccccccaacctgggcccccccccccccctgagagtgggcgagcccgtggccctgagcgaggaggagagactgaagctggcccagcagcaggccgccctgctgatgcagcaggaggagagagccaagcagggcgaccacagcctgaaggagcacgagctgctggagcagcagaagagagccgccgtgctgctggagcaggagagacagcaggaggaggaggagatggagaccgacgccagaagcagcctgggccagagcgccagcgagaccgaggaggacaccgtgagcgtgagcaagaaggagaagaacagaaagagaagaaacagaaagaagaagaagaagccccagagagtgagaggcgtgagcagcgagagcagcggcgacagagagaaggacagcaccagaagcagaggcagcgacagccccgccgccgacgtggagatcgagtacgtgaccgaggagcccgagatctacgagcccaacttcatcttcttcaagagaatcttcgaggccttcaagctgaccgacgacgtgaagaaggagaaggagaaggagcccgagaagctggacaagctggagaacagcgccgcccccaagaagaagggcttcgaggaggagcacaaggacagcgacgacgacagcagcgacgacgagcaggagaagaagcccgaggcccccaagctgagcaagaagaagctgagaagaatgaacagattcaccgtggccgagctgaagcagctggtggccagacccgacgtggtggagatgcacgacgtgaccgcccaggaccccaagctgctggtgcacctgaaggccaccagaaacagcgtgcccgtgcccagacactggtgcttcaagagaaagtacctgcagggcaagagaggcatcgagaagccccccttcgagctgcccgacttcatcaagagaaccggcatccaggagatgagagaggccctgcaggagaaggaggagcagaagaccatgaagagcaagatgagagagaaggtgagacccaagatgggcaagatcgacatcgactaccagaagctgcacgacgccttcttcaagtggcagaccaagcccaagctgaccatccacggcgacctgtactacgagggcaaggagttcgagaccagactgaaggagaagaagcccggcgacctgagcgacgagctgagaatcagcctgggcatgcccgtgggccccaacgcccacaaggtgccccccccctggctgatcgccatgcagagatacggccccccccccagctaccccaacctgaagatccccggcctgaacagccccatccccgagagctgcagcttcggctaccacgccggcggctggggcaagccccccgtggacgagaccggcaagcccctgtacggcgacgtgttcggcaccaacgccgccgagttccagaccaagaccgaggaggaggagatcgacagaaccccctggggcgagctggagcccagcgacgaggagagcagcgaggaggaggaggaggaggagagcgacgaggacaagcccgacgagaccggcttcatcacccccgccgacagcggcctgatcacccccggcggcttcagcagcgtgcccgccggcatggagacccccgagctgatcgagctgagaaagaagaagatcgaggaggccatggacggcagcgagaccccccagctgttcaccgtgctgcccgagaagagaaccgccaccgtgggcggcgccatgatgggcagcacccacatctacgacatgagcaccgtgatgagcagaaagggccccgcccccgagctgcagggcgtggaggtggccctggcccccgaggagctggagctggaccccatggccatgacccagaagtacgaggagcacgtgagagagcagcaggcccaggtggagaaggaggacttcagcgacatggtggccgagcacgccgccaagcagaagcagaagaagagaaaggcccagccccaggacagcagaggcggcagcaagaagtacaaggagttcaagttctag

SEQ ID NO: 100736 - DNA, 3654 bp, Artificial Sequence
  Description of Artificial Sequence: Synthetic coding sequence
atgttcctgtacaacctgaccctgcagagagccaccggcatcagcttcgccatccacggcaacttcagcggcaccaagcagcaggagatcgtggtgagcagaggcaagatcctggagctgctgagacccgaccccaacaccggcaaggtgcacaccctgctgaccgtggaggtgttcggcgtgatcagaagcctgatggccttcagactgaccggcggcaccaaggactacatcgtggtgggcagcgacagcggcagaatcgtgatcctggagtaccagcccagcaagaacatgttcgagaagatccaccaggagaccttcggcaagagcggctgcagaagaatcgtgcccggccagttcctggccgtggaccccaagggcagagccgtgatgatcagcgccatcgagaagcagaagctggtgtacatcctgaacagagacgccgccgccagactgaccatcagcagccccctggaggcccacaaggccaacaccctggtgtaccacgtggtgggcgtggacgtgggcttcgagaaccccatgttcgcctgcctggagatggactacgaggaggccgacaacgaccccaccggcgaggccgccgccaacacccagcagaccctgaccttctacgagctggacctgggcctgaaccacgtggtgagaaagtacagcgagcccctggaggagcacggcaacttcctgatcaccgtgcccggcggcagcgacggccccagcggcgtgctgatctgcagcgagaactacatcacctacaagaacttcggcgaccagcccgacatcagatgccccatccccagaagaagaaacgacctggacgaccccgagagaggcatgatcttcgtgtgcagcgccacccacaagaccaagagcatgttcttcttcctggcccagaccgagcagggcgacatcttcaagatcaccctggagaccgacgaggacatggtgaccgagatcagactgaagtacttcgacaccgtgcccgtggccgccgccatgtgcgtgctgaagaccggcttcctgttcgtggccagcgagttcggcaaccactacctgtaccagatcgcccacctgggcgacgacgacgaggagcccgagttcagcagcgccatgcccctggaggagggcgacaccttcttcttccagcccagacccctgaagaacctggtgctggtggacgagctggacagcctgagccccatcctgttctgccagatcgccgacctggccaacgaggacaccccccagctgtacgtggcctgcggcagaggccccagaagcagcctgagagtgctgagacacggcctggaggtgagcgagatggccgtgagcgagctgcccggcaaccccaacgccgtgtggaccgtgagaagacacatcgaggacgagttcgacgcctacatcatcgtgagcttcgtgaacgccaccctggtgctgagcatcggcgagaccgtggaggaggtgaccgacagcggcttcctgggcaccacccccaccctgagctgcagcctgctgggcgacgacgccctggtgcaggtgtaccccgacggcatcagacacatcagagccgacaagagagtgaacgagtggaagacccccggcaagaagaccatcgtgaagtgcgccgtgaaccagagacaggtggtgatcgccctgaccggcggcgagctggtgtacttcgagatggaccccagcggccagctgaacgagtacaccgagagaaaggagatgagcgccgacgtggtgtgcatgagcctggccaacgtgccccccggcgagcagagaagcagattcctggccgtgggcctggtggacaacaccgtgagaatcatcagcctggaccccagcgactgcctgcagcccctgagcatgcaggccctgcccgcccagcccgagagcctgtgcatcgtggagatgggcggcaccgagaagcaggacgagctgggcgagagaggcagcatcggcttcctgtacctgaacatcggcctgcagaacggcgtgctgctgagaaccgtgctggaccccgtgaccggcgacctgagcgacaccagaaccagatacctgggcagcagacccgtgaagctgttcagagtgagaatgcagggccaggaggccgtgctggccatgagcagcagaagctggctgagctacagctaccagagcagattccacctgacccccctgagctacgagaccctggagttcgccagcggcttcgccagcgagcagtgccccgagggcatcgtggccatcagcaccaacaccctgagaatcctggccctggagaagctgggcgccgtgttcaaccaggtggccttccccctgcagtacacccccagaaagttcgtgatccaccccgagagcaacaacctgatcatcatcgagaccgaccacaacgcctacaccgaggccaccaaggcccagagaaagcagcagatggccgaggagatggtggaggccgccggcgaggacgagagagagctggccgccgagatggccgccgccttcctgaacgagaacctgcccgagagcatcttcggcgcccccaaggccggcaacggccagtgggccagcgtgatcagagtgatgaaccccatccagggcaacaccctggacctggtgcagctggagcagaacgaggccgccttcagcgtggccgtgtgcagattcagcaacaccggcgaggactggtacgtgctggtgggcgtggccaaggacctgatcctgaaccccagaagcgtggccggcggcttcgtgtacacctacaagctggtgaacaacggcgagaagctggagttcctgcacaagacccccgtggaggaggtgcccgccgccatcgcccccttccagggcagagtgctgatcggcgtgggcaagctgctgagagtgtacgacctgggcaagaagaagctgctgagaaagtgcgagaacaagcacatcgccaactacatcagcggcatccagaccatcggccacagagtgatcgtgagcgacgtgcaggagagcttcatctgggtgagatacaagagaaacgagaaccagctgatcatcttcgccgacgacacctaccccagatgggtgaccaccgccagcctgctggactacgacaccgtggccggcgccgacaagttcggcaacatctgcgtggtgagactgccccccaacaccaacgacgaggtggacgaggaccccaccggcaacaaggccctgtgggacagaggcctgctgaacggcgccagccagaaggccgaggtgatcatgaactaccacgtgggcgagaccgtgctgagcctgcagaagaccaccctgatccccggcggcagcgagagcctggtgtacaccaccctgagcggcggcatcggcatcctggtgcccttcaccagccacgaggaccacgacttcttccagcacgtggagatgcacctgagaagcgagcacccccccctgtgcggcagagaccacctgagcttcagaagctactacttccccgtgaagaacgtgatcgacggcgacctgtgcgagcagttcaacagcatggagcccaacaagcagaagaacgtgagcgaggagctggacagaaccccccccgaggtgagcaagaagctggaggacatcagaaccagatacgccttctag

SEQ ID NO: 100737 - DNA, 828 bp, Artificial Sequence
  Description of Artificial Sequence: Synthetic coding sequence
atgttcctgtacaacctgaccctgcagagagccaccggcatcagcttcgccatccacggcaacttcagcggcaccaagcagcaggagatcgtggtgagcagaggcaagatcctggagctgctgagacccgaccccaacaccggcaaggtgcacaccctgctgaccgtggaggtgttcggcgtgatcagaagcctgatggccttcagactgaccggcggcaccaaggactacatcgtggtgggcagcgacagcggcagaatcgtgatcctggagtaccagcccagcaagaacatgttcgagaagatccaccaggagaccttcggcaagagcggctgcagaagaatcgtgcccggccagttcctggccgtggaccccaagggcagagccgtgatgatcagcgccatcgagaagcagaagctggtgtacatcctgaacagagacgccgccgccagactgaccatcagcagccccctggaggcccacaaggccaacaccctggtgtaccacgtggtgggcgtggacgtgggcttcgagaaccccatgttcgcctgcctggagatggactacgaggaggccgacaacgaccccaccggcgaggccgccgccaacacccagcagaccctgaccttctacgagctggacctgggcctgaaccacgtggtgagaaagtacagcgagcccctggaggagcacggcaacttcctgatcaccgtgcccggcggcagcgacggccccagcggcgtgctgaacctgagcccccccttccccaaggccatccccgccctgatctgcctggacagccccgtgtacttctgcacccacccctag

SEQ ID NO: 100738 - DNA, 1275 bp, Artificial Sequence
  Description of Artificial Sequence: Synthetic coding sequence
atggccgccggccccatcagcgagagaaaccaggacgccaccgtgtacgtgggcggcctggacgagaaggtgagcgagcccctgctgtgggagctgttcctgcaggccggccccgtggtgaacacccacatgcccaaggacagagtgaccggccagcaccagggctacggcttcgtggagttcctgagcgaggaggacgccgactacgccatcaagatcatgaacatgatcaagctgtacggcaagcccatcagagtgaacaaggccagcgcccacaacaagaacctggacgtgggcgccaacatcttcatcggcaacctggaccccgagatcgacgagaagctgctgtacgacaccttcagcgccttcggcgtgatcctgcagacccccaagatcatgagagaccccgacaccggcaacagcaagggctacgccttcatcaacttcgccagcttcgacgccagcgacgccgccatcgaggccatgaacggccagtacctgtgcaacagacccatcaccgtgagctacgccttcaagaaggacagcaagggcgagagacacggcagcgccgccgagagactgctggccgcccagaaccccctgagccaggccgacagaccccaccagctgttcgccgacgccccccccccccccagcgcccccaaccccgtggtgagcagcctgggcagcggcctgcccccccccggcatgcccccccccggcagcttccccccccccgtgcccccccccggcgccctgccccccggcatcccccccgccatgccccccccccccatgccccccggcgccgccggccacggcccccccagcgccggcacccccggcgccggccaccccggccacggccacagccacccccaccccttcccccccggcggcatgccccaccccggcatgagccagatgcagctggcccaccacggcccccacggcctgggccacccccacgccggcccccccggcagcggcggccagcccccccccagacccccccccggcatgccccaccccggccccccccccatgggcatgccccccagaggcccccccttcggcagccccatgggccaccccggccccatgcccccccacggcatgagaggccccccccccctgatgcccccccacggctacaccggcccccccagaccccccccctacggctaccagagaggccccctgcccccccccagacccacccccagaccccccgtgccccccagaggccccctgagaggccccctgccccagtag

SEQ ID NO: 100739 - DNA, 573 bp, Artificial Sequence
  Description of Artificial Sequence: Synthetic coding sequence
atgcccaaggacagagtgaccggccagcaccagggctacggcttcgtggagttcctgagcgaggaggacgccgactacgccatcaagatcatgaacatgatcaagctgtacggcaagcccatcagagtgaacaaggccagcgcccacaacaagaacctggacgtgggcgccaacatcttcatcggcaacctggaccccgagatcgacgagaagctgctgtacgacaccttcagcgccttcggcgtgatcctgcagacccccaagatcatgagagaccccgacaccggcaacagcaagggctacgccttcatcaacttcgccagcttcgacgccagcgacgccgccatcgaggccatgaacggccagtacctgtgcaacagacccatcaccgtgagctacgccttcaagaaggacagcaagggcgagagacacggcagcgccgccgagagactgctggccgcccagaaccccctgagccaggccgacagaccccaccagctgttcgccgacgccccccccccccccagcgcccccaaccccgtggtgagcagcctgggcagcggcctgccctag

SEQ ID NO: 100740 - DNA, 2124 bp, Artificial Sequence
  Description of Artificial Sequence: Synthetic coding sequence
atgagcagagacagattcagaagcagaggcggcggcggcggcggcttccacagaagaggcggcggcggcggcagaggcggcctgcacgacttcagaagccccccccccggcatgggcctgaaccagaacagaggccccatgggccccggccccggccagagcggccccaagccccccatcccccccccccccccccaccagcagcagcagcagccccccccccagcagccccccccccagcagccccccccccaccagccccccccccacccccagccccaccagcagcagcagccccccccccccccccaggacagcagcaagcccgtggtggcccagggccccggccccgcccccggcgtgggcagcgccccccccgccagcagcagcgccccccccgccaccccccccaccagcggcgccccccccggcagcggccccggccccacccccacccccccccccgccgtgaccagcgccccccccggcgcccccccccccaccccccccagcagcggcgtgcccaccacccccccccaggccggcggccccccccccccccccgccgccgtgcccggccccggccccggccccaagcagggccccggccccggcggccccaagggcggcaagatgcccggcggccccaagcccggcggcggccccggcctgagcacccccggcggccaccccaagcccccccacagaggcggcggcgagcccagaggcggcagacagcaccaccccccctaccaccagcagcaccaccagggccccccccccggcggccccggcggcagaagcgaggagaagatcagcgacagcgagggcttcaaggccaacctgagcctgctgagaagacccggcgagaagacctacacccagagatgcagactgttcgtgggcaacctgcccgccgacatcaccgaggacgagttcaagagactgttcgccaagtacggcgagcccggcgaggtgttcatcaacaagggcaagggcttcggcttcatcaagctggagagcagagccctggccgagatcgccaaggccgagctggacgacacccccatgagaggcagacagctgagagtgagattcgccacccacgccgccgccctgagcgtgagaaacctgagcccctacgtgagcaacgagctgctggaggaggccttcagccagttcggccccatcgagagagccgtggtgatcgtggacgacagaggcagaagcaccggcaagggcatcgtggagttcgccagcaagcccgccgccagaaaggccttcgagagatgcagcgagggcgtgttcctgctgaccaccacccccagacccgtgatcgtggagcccctggagcagctggacgacgaggacggcctgcccgagaagctggcccagaagaaccccatgtaccagaaggagagagagaccccccccagattcgcccagcacggcaccttcgagtacgagtacagccagagatggaagagcctggacgagatggagaagcagcagagagagcaggtggagaagaacatgaaggacgccaaggacaagctggagagcgagatggaggacgcctaccacgagcaccaggccaacctgctgagacaggacctgatgagaagacaggaggagctgagaagaatggaggagctgcacaaccaggagatgcagaagagaaaggagatgcagctgagacaggaggaggagagaagaagaagagaggaggagatgatgatcagacagagagagatggaggagcagatgagaagacagagagaggagagctacagcagaatgggctacatggaccccagagagagagacatgagaatgggcggcggcggcgccatgaacatgggcgacccctacggcagcggcggccagaagttcccccccctgggcggcggcggcggcatcggctacgaggccaaccccggcgtgccccccgccaccatgagcggcagcatgatgggcagcgacatgagaaccgagagattcggccagggcggcgccggccccgtgggcggccagggccccagaggcatgggccccggcacccccgccggctacggcagaggcagagaggagtacgagggccccaacaagaagcccagattctag

SEQ ID NO: 100741 - DNA, 1875 bp, Artificial Sequence
  Description of Artificial Sequence: Synthetic coding sequence
atgaacagcggcggcggcttcggcctgggcctgggcttcggcctgacccccaccagcgtgatccaggtgaccaacctgagcagcgccgtgaccagcgagcagatgagaaccctgttcagcttcctgggcgagatcgaggagctgagactgtacccccccgacaacgcccccctggccttcagcagcaaggtgtgctacgtgaagttcagagaccccagcagcgtgggcgtggcccagcacctgaccaacaccgtgttcatcgacagagccctgatcgtggtgccctgcgccgagggcaagatccccgaggagagcaaggccctgagcctgctggcccccgcccccaccatgaccagcctgatgcccggcgccggcctgctgcccatccccacccccaaccccctgaccaccctgggcgtgagcctgagcagcctgggcgccatccccgccgccgccctggaccccaacatcgccaccctgggcgagatcccccagccccccctgatgggcaacgtggaccccagcaagatcgacgagatcagaagaaccgtgtacgtgggcaacctgaacagccagaccaccaccgccgaccagctgctggagttcttcaagcaggtgggcgaggtgaagttcgtgagaatggccggcgacgagacccagcccaccagattcgccttcgtggagttcgccgaccagaacagcgtgcccagagccctggccttcaacggcgtgatgttcggcgacagacccctgaagatcaaccacagcaacaacgccatcgtgaagccccccgagatgaccccccaggccgccgccaaggagctggaggaggtgatgaagagagtgagagaggcccagagcttcatcagcgccgccatcgagcccgagagcggcaagagcaacgagagaaagggcggcagaagcagaagccacaccagaagcaagagcagaagcagcagcaagagccacagcagaagaaagagaagccagagcaagcacagaagcagaagccacaacagaagcagaagcagacagaaggacagaagaagaagcaagagcccccacaagaagagaagcaagagcagagagagaagaaagagcagaagcagaagccacagcagagacaagagaaaggacaccagagagaagatcaaggagaaggagagagtgaaggagaaggacagagagaaggagagagagagagagaaggagagagagaaggagaaggagagaggcaagaacaaggacagagacaaggagagagagaaggacagagagaaggacaaggagaaggacagagagagagagagagagaaggagcacgagaaggacagagacaaggagaaggagaaggagcaggacaaggagaaggagagagagaaggacagaagcaaggagatcgacgagaagagaaagaaggacaagaagagcagaaccccccccagaagctacaacgccagcagaagaagcagaagcagcagcagagagagaagaagaagaagaagcagaagcagcagcagaagccccagaaccagcaagaccatcaagagaaagagcagcagaagccccagccccagaagcagaaacaagaaggacaagaagagagagaaggagagagaccacatcagcgagagaagagagagagagagaagcaccagcatgagaaagagcagcaacgacagagacggcaaggagaagctggagaagaacagcaccagcctgaaggagaaggagcacaacaaggagcccgacagcagcgtgagcaaggaggtggacgacaaggacgcccccagaaccgaggagaacaagatccagcacaacggcaactgccagctgaacgaggagaacctgagcaccaagaccgaggccgtgtag

SEQ ID NO: 100742 - DNA, 1527 bp, Artificial Sequence
  Description of Artificial Sequence: Synthetic coding sequence
atgaccagcctgatgcccggcgccggcctgctgcccatccccacccccaaccccctgaccaccctgggcgtgagcctgagcagcctgggcgccatccccgccgccgccctggaccccaacatcgccaccctgggcgagatcccccagccccccctgatgggcaacgtggaccccagcaagatcgacgagatcagaagaaccgtgtacgtgggcaacctgaacagccagaccaccaccgccgaccagctgctggagttcttcaagcaggtgggcgaggtgaagttcgtgagaatggccggcgacgagacccagcccaccagattcgccttcgtggagttcgccgaccagaacagcgtgcccagagccctggccttcaacggcgtgatgttcggcgacagacccctgaagatcaaccacagcaacaacgccatcgtgaagccccccgagatgaccccccaggccgccgccaaggagctggaggaggtgatgaagagagtgagagaggcccagagcttcatcagcgccgccatcgagcccgagagcggcaagagcaacgagagaaagggcggcagaagcagaagccacaccagaagcaagagcagaagcagcagcaagagccacagcagaagaaagagaagccagagcaagcacagaagcagaagccacaacagaagcagaagcagacagaaggacagaagaagaagcaagagcccccacaagaagagaagcaagagcagagagagaagaaagagcagaagcagaagccacagcagagacaagagaaaggacaccagagagaagatcaaggagaaggagagagtgaaggagaaggacagagagaaggagagagagagagagaaggagagagagaaggagaaggagagaggcaagaacaaggacagagacaaggagagagagaaggacagagagaaggacaaggagaaggacagagagagagagagagagaaggagcacgagaaggacagagacaaggagaaggagaaggagcaggacaaggagaaggagagagagaaggacagaagcaaggagatcgacgagaagagaaagaaggacaagaagagcagaaccccccccagaagctacaacgccagcagaagaagcagaagcagcagcagagagagaagaagaagaagaagcagaagcagcagcagaagccccagaaccagcaagaccatcaagagaaagagcagcagaagccccagccccagaagcagaaacaagaaggacaagaagagagagaaggagagagaccacatcagcgagagaagagagagagagagaagcaccagcatgagaaagagcagcaacgacagagacggcaaggagaagctggagaagaacagcaccagcctgaaggagaaggagcacaacaaggagcccgacagcagcgtgagcaaggaggtggacgacaaggacgcccccagaaccgaggagaacaagatccagcacaacggcaactgccagctgaacgaggagaacctgagcaccaagaccgaggccgtgtag

SEQ ID NO: 100743 - DNA, 231 bp, Artificial Sequence
  Description of Artificial Sequence: Synthetic coding sequence
atgaccagcctgatgcccggcgccggcctgctgcccatccccacccccaaccccctgaccaccctgggcgtgagcctgagcagcctgggcgccatccccgccgccgccctggaccccaacatcgccaccctgggcgagatcccccagccccccctgatgggcaacgtggaccccagcaagatcgacgagatcagaagaaccgtgtacgtgggcaacctgaacagccagtag

SEQ ID NO: 100744 - DNA, 1545 bp, Artificial Sequence
  Description of Artificial Sequence: Synthetic coding sequence
atgaacagcggcggcggcttcggcctgggcctgggcttcggcctgacccccaccagcgtgatccaggtgaccaacctgagcagcgccgtgaccagcgagcagatgagaaccctgttcagcttcctgggcgagatcgaggagctgagactgtacccccccgacaacgcccccctggccttcagcagcaaggtgtgctacgtgaagttcagagaccccagcagcgtgggcgtggcccagcacctgaccaacaccgtgttcatcgacagagccctgatcgtggtgccctgcgccgagggcaagatccccgaggagagcaaggccctgagcctgctggcccccgcccccaccatgaccagcctgatgcccggcgccggcctgctgcccatccccacccccaaccccctgaccaccctgggcgtgagcctgagcagcctgggcgccatccccgccgccgccctggaccccaacatcgccaccctgggcgagatcccccagccccccctgatgggcaacgtggaccccagcaagatcgacgagatcagaagaaccgtgtacgtgggcaacctgaacagccagaccaccaccgccgaccagctgctggagttcttcaagcaggtgggcgaggtgaagttcgtgagaatggccggcgacgagacccagcccaccagattcgccttcgtggagttcgccgaccagaacagcgtgcccagagccctggccttcaacggcgtgatgttcggcgacagacccctgaagatcaaccacagcaacaacgccatcgtgaagccccccgagatgaccccccaggccgccgccaaggagctggaggaggtgatgaagagagtgagagaggcccagagcttcatcagcgccgccatcgagcccgagagcggcaagagcaacgagagaaagggcggcagaagcagaagccacaccagaagcaagagcagaagcagcagcaagagccacagcagaagaaagagaagccagagcaagcacagaagcagaagccacaacagaagcagaagcagacagaaggacagaagaagaagcaagagcccccacaagaagagaagcaagagcagagagagaagaaagagcagaagcagaagccacagcagagacaagagaaaggacaccagagagaagatcaaggagaaggagagagtgaaggagaaggacagagagaaggagagagagagagagaaggagagagagaaggagaaggagagaggcaagaacaaggacagagacaaggagagagagaaggacagagagaaggacaaggagaaggacagagagagagagagagagaaggagcacgagaaggacagagacaaggagaaggagaaggagcaggacaaggagaaggagagagagaaggacagaagcaaggagatcgacgagaagagaaagaaggacaagaaccccgagcaccaccccggcgtgaccatgcacagagaggacctggtggtgcccgccggcaagggcgtgggcggcggcgccggcgtgctgcccgacagacaggagcaccagaagccctag

SEQ ID NO: 100745 - DNA, 213 bp, Artificial Sequence
  Description of Artificial Sequence: Synthetic coding sequence
atgagcgagaagaagcagcccgtggacctgggcctgctggaggaggacgacgagttcgaggagttccccgccgaggactgggccggcctggacgaggacgaggacgcccacgtgtgggaggacaactgggacgacgacaacgtggaggacgacttcagcaaccagctgagagccgagctggagaagcacggctacaagatggagaccagctag

SEQ ID NO: 100746 - DNA, 1077 bp, Artificial Sequence
  Description of Artificial Sequence: Synthetic coding sequence
atggccttcgcccccatgggccccgaggccagcttcttcgacgtgctggacagacacagagagagcctgctggccgccctgagaagaggcggcagagagccccccaccggcggcagcagactggccagcagattcgaggacagcgtgggcctgcagatggtgagccactgcaccaccagaaagatcaagagcgacagccccaagagcgcccagaagttcagcctgatcctgaagatcctgagcatgatctacaagctggtgcagagcaacacctacgccaccaagagagacatctactacaccgacagccagctgttcggcaaccagaccgtggtggacaacatcatcaacgacatcagctgcatgctgaaggtgagcagaagaagcctgcacatcctgagcaccagcaagggcctgatcgccggcaacctgagatacatcgaggaggacggcaccaaggtgaactgcacctgcggcgccaccgccgtggccgtgcccagcaacatccagggcatcagaaacctggtgaccgacgccaagttcgtgctgatcgtggagaaggacgccaccttccagagactgctggacgacaacttctgcaacaagctgagcccctgcatcatgatcaccggcaagggcgtgcccgacctgaacaccagactgctggtgaagaagctgtgggacaccttccacgtgcccgtgttcaccctggtggacgccgacccccacggcatcgagatcatgtgcatctacaagtacggcagcatgagcatgagcttcgaggcccaccacctgaccgtgcccgccatcagatggctgggcctgctgcccagcgacctgaagagactgaacgtgcccaaggacagcctgatccccctgaccaagagagaccagatgaagctggacagcatcctgagaagaccctacgtgacctgccagcccttctggagaaaggagatggagatcatggccgacagcaagatgaaggccgagatccaggccctgaccttcctgagcagcgactacctgagcagagtgtacctgcccaacaagctgaagttcggcggctggatctag

SEQ ID NO: 100747 - DNA, 1065 bp, Artificial Sequence
  Description of Artificial Sequence: Synthetic coding sequence
atggccttcgcccccatgggccccgaggccagcttcttcgacgtgctggacagacacagagagagcctgctggccgccctgagaagaggcggcagagagccccccaccggcggcagcagactggccagcagattcgaggacagcgtgggcctgcagatggtgagccactgcaccaccagaaagatcaagagcgacagccccaagagcgcccagaagttcagcctgatcctgaagatcctgagcatgatctacaagctggtgcagagcaacacctacgccaccaagagagacatctactacaccgacagccagctgttcggcaaccagaccgtggtggacaacatcatcaacgacatcagctgcatgctgaaggtgagcagaagaagcctgcacatcctgagcaccagcaagggcctgatcgccggcaacctgagatacatcgaggaggacggcaccaaggtgaactgcacctgcggcgccaccgccgtggccgtgcccagcaacatccagggcatcagaaacgccaagttcgtgctgatcgtggagaaggacgccaccttccagagactgctggacgacaacttctgcaacaagctgagcccctgcatcatgatcaccggcaagggcgtgcccgacctgaacaccagactgctggtgaagaagctgtgggacaccttccacgtgcccgtgttcaccctggtggacgccgacccccacggcatcgagatcatgtgcatctacaagtacggcagcatgagcatgagcttcgaggcccaccacctgaccgtgcccgccatcagatggctgggcctgctgcccagcgacctgaagagactgaacgtgcccaaggacagcctgatccccctgaccaagagagaccagatgaagctggacagcatcctgagaagaccctacgtgacctgccagcccttctggagaaaggagatggagatcatggccgacagcaagatgaaggccgagatccaggccctgaccttcctgagcagcgactacctgagcagagtgtacctgcccaacaagctgaagttcggcggctggatctag

SEQ ID NO: 100748 - DNA, 1191 bp, Artificial Sequence
  Description of Artificial Sequence: Synthetic coding sequence
atggccttcgcccccatgggccccgaggccagcttcttcgacgtgctggacagacacagagagagcctgctggccgccctgagaagaggcggcagagagccccccaccggcggcagcagactggccagcagcagcgaggtgctggccagcatcgagaacatcatccaggacatcatcaccagcctggccagaaacgaggcccccgccttcaccatcgacaacagaagcagctgggagaacatcaagttcgaggacagcgtgggcctgcagatggtgagccactgcaccaccagaaagatcaagagcgacagccccaagagcgcccagaagttcagcctgatcctgaagatcctgagcatgatctacaagctggtgcagagcaacacctacgccaccaagagagacatctactacaccgacagccagctgttcggcaaccagaccgtggtggacaacatcatcaacgacatcagctgcatgctgaaggtgagcagaagaagcctgcacatcctgagcaccagcaagggcctgatcgccggcaacctgagatacatcgaggaggacggcaccaaggtgaactgcacctgcggcgccaccgccgtggccgtgcccagcaacatccagggcatcagaaacctggtgaccgacgccaagttcgtgctgatcgtggagaaggacgccaccttccagagactgctggacgacaacttctgcaacaagctgagcccctgcatcatgatcaccggcaagggcgtgcccgacctgaacaccagactgctggtgaagaagctgtgggacaccttccacgtgcccgtgttcaccctggtggacgccgacccccacggcatcgagatcatgtgcatctacaagtacggcagcatgagcatgagcttcgaggcccaccacctgaccgtgcccgccatcagatggctgggcctgctgcccagcgacctgaagagactgaacgtgcccaaggacagcctgatccccctgaccaagagagaccagatgaagctggacagcatcctgagaagaccctacgtgacctgccagcccttctggagaaaggagatggagatcatggccgacagcaagatgaaggccgagatccaggccctgaccttcctgagcagcgactacctgagcagagtgtacctgcccaacaagctgaagttcggcggctggatctag

SEQ ID NO: 100749 - DNA, 813 bp, Artificial Sequence
  Description of Artificial Sequence: Synthetic coding sequence
ctgctggccgccctgagaagaggcggcagagagccccccaccggcggcagcagactggccagcagcagcgaggtgctggccagcatcgagaacatcatccaggacatcatcaccagcctggccagaaacgaggcccccgccttcaccatcgacaacagaagcagctgggagaacatcaagttcgaggacagcgtgggcctgcagatggtgagccactgcaccaccagaaagatcaagagcgacagccccaagagcgcccagaagttcagcctgatcctgaagatcctgagcatgatctacaagctggtgcagagcaacacctacgccaccaagagagacatctactacaccgacagccagctgttcggcaaccagaccgtggtggacaacatcatcaacgacatcagctgcatgctgaaggtgagcagaagaagcctgcacatcctgagcaccagcaagggcctgatcgccggcaacctgagatacatcgaggaggacggcaccaaggtgaactgcacctgcggcgccaccgccgtggccgtgcccagcaacatccagggcatcagaatcaccgacgccaagttcgtgctgatcgtggagaaggacgccaccttccagagactgctggacgacaacttctgcaacaagctgagcccctgcatcatgatcaccggcaagggcgtgcccgacctgaacaccagactgctggtgaagaagctgtgggacaccttccacgtgcccgtgttcaccctggtggacgccgacccccacggcatcgagatcatgtgcatctacaagtacggcagcatgtag

SEQ ID NO: 100750 - DNA, 996 bp, Artificial Sequence
  Description of Artificial Sequence: Synthetic coding sequence
atggagaaccccagccccgccgccgccctgggcaaggccctgtgcgccctgctgctggccaccctgggcgccgccggccagcccctgggcggcgagagcatctgcagcgccagagccctggccaagtacagcatcaccttcaccggcaagtggagccagaccgccttccccaagcagtaccccctgttcagaccccccgcccagtggagcagcctgctgggcgccgcccacagcagcgactacagcatgtggagaaagaaccagtacgtgagcaacggcctgagagacttcgccgagagaggcgaggcctgggccctgatgaaggagatcgaggccgccggcgaggccctgcagagcgtgcacgccgtgttcagcgcccccgccgtgcccagcggcaccggccagaccagcgccgagctggaggtgcagagaagacacagcctggtgagcttcgtggtgagaatcgtgcccagccccgactggttcgtgggcgtggacagcctggacctgtgcgacggcgacagatggagagagcaggccgccctggacctgtacccctacgacgccggcaccgacagcggcttcaccttcagcagccccaacttcgccaccatcccccaggacaccgtgaccgagatcaccagcagcagccccagccaccccgccaacagcttctactaccccagactgaaggccctgccccccatcgccagagtgaccctggtgagactgagacagagccccagagccttcatcccccccgcccccgtgctgcccagcagagacaacgagatcgtggacagcgccagcgtgcccgagacccccctggactgcgaggtgagcctgtggagcagctggggcctgtgcggcggccactgcggcagactgggcaccaagagcagaaccagatacgtgagagtgcagcccgccaacaacggcagcccctgccccgagctggaggaggaggccgagtgcgtgcccgacaactgcgtgtag

SEQ ID NO: 100751 - DNA, 996 bp, Artificial Sequence; identical to SEQ ID NO: 100750
  Description of Artificial Sequence: Synthetic coding sequence

SEQ ID NO: 100752 - DNA, 186 bp, Artificial Sequence
  Description of Artificial Sequence: Synthetic coding sequence
atggagaaccccagccccgccgccgccctgggcaaggccctgtgcgccctgctgctggccaccctgggcgccgccggccagcccctgggcggcgagagcatctgcagcgccagagccctggccaagtacagcatcaccttcaccggcaagtggagccagaccgccttccccaagcagtacccctag

SEQ ID NO: 100753 - DNA, 327 bp, Artificial Sequence
  Description of Artificial Sequence: Synthetic coding sequence
atggagaaccccagccccgccgccgccctgggcaaggccctgtgcgccctgctgctggccaccctgggcgccgccggccagcccctgggcggcgagagcatctgcagcgccagagccctggccaagtacagcatcaccttcaccggcaagtggagccagaccgccttccccaagcagtaccccctgttcagaccccccgcccagtggagcagcctgctgggcgccgcccacagcagcgactacagcatgtggagaaagaaccagtacgtgagcaacggcctgagagacttcgccgagagaggcgaggcctgggccctgatgaagtag

SEQ ID NO: 100754 - DNA, 54 bp, Artificial Sequence
  Description of Artificial Sequence: Synthetic coding sequence
atggagaaccccagccccgccgccgccctgggcaaggccctgtgcgccctgtag

SEQ ID NO: 100755 - DNA, 27 bp, Artificial Sequence
  Description of Artificial Sequence: Synthetic coding sequence
atggagaaccccagccccgccgcctag

SEQ ID NO: 100756 - DNA, 51 bp, Artificial Sequence
  Description of Artificial Sequence: Synthetic coding sequence
atggagaaccccagccccgccgccgccctgggcaaggccctgtgcgcctag

SEQ ID NO: 100757 - DNA, 75 bp, Artificial Sequence
  Description of Artificial Sequence: Synthetic coding sequence
atggagaaccccagccccgccgccgccctgggcaaggccctgtgcgccctgctgctggccaccctgggcgcctag

SEQ ID NO: 100758 - DNA, 195 bp, Artificial Sequence
  Description of Artificial Sequence: Synthetic coding sequence
atggagaaccccagccccgccgccgccctgggcaaggccctgtgcgccctgctgctggccaccctgggcgccgccggccagcccctgggcggcgagagcatctgcagcgccagagccctggccaagtacagcatcaccttcaccggcaagtggagccagaccgccttccccaagcagtaccccctgttcagatag

SEQ ID NO: 100759 - DNA, 960 bp, Artificial Sequence
  Description of Artificial Sequence: Synthetic coding sequence
atggacccccagaaccagcacggcagcggcagcagcctggtggtgatccagcagcccagcctggacagcagacagagactggactacgagagagagatccagcccaccgccatcctgagcctggaccagatcaaggccatcagaggcagcaacgagtacaccgagggccccagcgtggtgaagagacccgcccccagaaccgcccccagacaggagaagcacgagagaacccacgagatcatccccatcaacgtgaacaacaactacgagcacagacacaccagccacctgggccacgccgtgctgcccagcaacgccagaggccccatcctgagcagaagcaccagcaccggcagcgccgccagcagcggcagcaacagcagcgccagcagcgagcagggcctgctgggcagaagcccccccaccagacccgtgcccggccacagaagcgagagagccatcagaacccagcccaagcagctgatcgtggacgacctgaagggcagcctgaaggaggacctgacccagcacaagttcatctgcgagcagtgcggcaagtgcaagtgcggcgagtgcaccgcccccagaaccctgcccagctgcctggcctgcaacagacagtgcctgtgcagcgccgagagcatggtggagtacggcacctgcatgtgcctggtgaagggcatcttctaccactgcagcaacgacgacgagggcgacagctacagcgacaacccctgcagctgcagccagagccactgctgcagcagatacctgtgcatgggcgccatgagcctgttcctgccctgcctgctgtgctacccccccgccaagggctgcctgaagctgtgcagaagatgctacgactggatccacagacccggctgcagatgcaagaacagcaacaccgtgtactgcaagctggagagctgccccagcagaggccagggcaagcccagctag

SEQ ID NO: 100760 - DNA, 960 bp, Artificial Sequence; identical to SEQ ID NO: 100759
  Description of Artificial Sequence: Synthetic coding sequence

SEQ ID NO: 100761 - DNA, 204 bp, Artificial Sequence
  Description of Artificial Sequence: Synthetic coding sequence
atggacccccagaaccagcacggcagcggcagcagcctggtggtgatccagcagcccagcctggacagcagacagagactggactacgagagagagatccagcccaccgccatcctgagcctggaccagatcaaggccatcagaggcagcaacgagtacaccgagggccccagcgtggtgaagagacccgcccccagaacctag

SEQ ID NO: 100762 - DNA, 630 bp, Artificial Sequence
  Description of Artificial Sequence: Synthetic coding sequence
atggacccccagaaccagcacggcagcggcagcagcctggtggtgatccagcagcccagcctggacagcagacagagactggactacgagagagagatccagcccaccgccatcctgagcctggaccagatcaaggccatcagaggcagcaacgagtacaccgagggccccagcgtggtgaagagacccgcccccagaaccgcccccagacaggagaagcacgagagaacccacgagatcatccccatcaacgtgaacaacaactacgagcacagacacaccagccacctgggccacgccgtgctgcccagcaacgccagaggccccatcctgagcagaagcaccagcaccggcagcgccgccagcagcggcagcaacagcagcgccagcagcgagcagggcctgctgggcagaagcccccccaccagacccgtgcccggccacagaagcgagagagccatcagaacccagcccaagcagctgatcgtggacgacctgaagggcagcctgaaggaggacctgacccagcacaagttcatctgcgagcagtgcggcaagtgcaagtgcggcgagtgcaccgcccccagaaccctgcccagctgcctggcctgcaacagacagtgcctgtag

SEQ ID NO: 100763 - DNA, 108 bp, Artificial Sequence
  Description of Artificial Sequence: Synthetic coding sequence
atggacccccagaaccagcacggcagcggcagcagcctggtggtgatccagcagcccagcctggacagcagacagagactggactacgagagagagatccagccctag

SEQ ID NO: 100764 - DNA, 948 bp, Artificial Sequence
  Description of Artificial Sequence: Synthetic coding sequence
atggaggccagagcccagagcggcaacggcagccagcccctgctgcagacccccagagacggcggcagacagagaggcgagcccgaccccagagacgccctgacccagcaggtgcacgtgctgagcctggaccagatcagagccatcagaaacaccaacgagtacaccgagggccccaccgtggtgcccagacccggcctgaagcccgcccccagacccagcacccagcacaagcacgagagactgcacggcctgcccgagcacagacagccccccagactgcagcacagccaggtgcacagcagcgccagagcccccctgagcagaagcatcagcaccgtgagcagcggcagcagaagcagcaccagaaccagcaccagcagcagcagcagcgagcagagactgctgggcagcagcttcagcagcggccccgtggccgacggcatcatcagagtgcagcccaagagcgagctgaagcccggcgagctgaagcccctgagcaaggaggacctgggcctgcacgcctacagatgcgaggactgcggcaagtgcaagtgcaaggagtgcacctaccccagacccctgcccagcgactggatctgcgacaagcagtgcctgtgcagcgcccagaacgtgatcgactacggcacctgcgtgtgctgcgtgaagggcctgttctaccactgcagcaacgacgacgaggacaactgcgccgacaacccctgcagctgcagccagagccactgctgcaccagatggagcgccatgggcgtgatgagcctgttcctgccctgcctgtggtgctacctgcccgccaagggctgcctgaagctgtgccagggctgctacgacagagtgaacagacccggctgcagatgcaagaacagcaacaccgtgtgctgcaaggtgcccaccgtgccccccagaaacttcgagaagcccacctag

SEQ ID NO: 100765 - DNA, 948 bp, Artificial Sequence; identical to SEQ ID NO: 100764
  Description of Artificial Sequence: Synthetic coding sequence

SEQ ID NO: 100766 - DNA, 948 bp, Artificial Sequence; identical to SEQ ID NO: 100764
  Description of Artificial Sequence: Synthetic coding sequence

SEQ ID NO: 100767 - DNA, 1062 bp, Artificial Sequence
  Description of Artificial Sequence: Synthetic coding sequence
atggaggccagagcccagagcggcaacggcagccagcccctgctgcagacccccagagacggcggcagacagagaggcgagcccgaccccagagacgccctgacccagcaggtgcacgtgctgagcctggaccagatcagagccatcagaaacaccaacgagtacaccgagggccccaccgtggtgcccagacccggcctgaagcccgcccccagacccagcacccagcacaagcacgagagactgcacggcctgcccgagcacagacagccccccagactgcagcacagccaggtgcacagcagcgccagagcccccctgagcagaagcatcagcaccgtgagcagcggcagcagaagcagcaccagaaccagcaccagcagcagcagcagcgagcagagactgctgggcagcagcttcagcagcggccccgtggccgacggcatcatcagagtgcagcccaagagcgagctgaagcccggcgagctgaagcccctgagcaaggaggacctgggcctgcacgcctacagatgcgaggactgcggcaagtgcaagtgcaaggagtgcacctaccccagacccctgcccagcgactggatctgcgacaagcagtgcctgtgcagcgcccagaacgtgatcgactacggcacctgcgtgtgctgcgtgaagggcctgttctaccactgcagcaacgacgacgaggacaactgcgccgacaacccctgcagctgcagccagagccactgctgcaccagatggagcgccatgggcgtgatgagcctgttcctgccctgcctgtggtgctacctgcccgccaagggctgcctgaagctgtgccagggctgctacgacagagtgaacagacccggctgcagatgcaagaacagcaacaccgtgtgctgcaaggtgcccaccgtgccccccagaaccctgaagaaccagcacagcatcatcaaccaggagtactacagcaacgaggacttcttcttcctgttcctgatccacatctgcaaccagctgaacagctacaacctgggcaccgtgaacagaaaggtgggctag

SEQ ID NO: 100768 - DNA, 867 bp, Artificial Sequence
  Description of Artificial Sequence: Synthetic coding sequence
atggacgccgccgtgaccgacgacttccagcagatcctgcccatcgagcagctgagaagcacccacgccagcaacgactacgtggagagaccccccgccccctgcaagcaggccctgagcagccccagcctgatcgtgcagacccacaagagcgactggagcctggccaccatgcccaccagcctgcccagaagcctgagccagtgccaccagctgcagcccctgccccagcacctgagccagagcagcatcgccagcagcatgagccacagcaccaccgccagcgaccagagactgctggccagcatcacccccagccccagcggccagagcatcatcagaacccagcccggcgccggcgtgcaccccaaggccgacggcgccctgaagggcgaggccgagcagagcgccggccaccccagcgagcacctgttcatctgcgaggagtgcggcagatgcaagtgcgtgccctgcaccgccgccagacccctgcccagctgctggctgtgcaaccagagatgcctgtgcagcgccgagagcctgctggactacggcacctgcctgtgctgcgtgaagggcctgttctaccactgcagcaccgacgacgaggacaactgcgccgacgagccctgcagctgcggccccagcagctgcttcgtgagatgggccgccatgagcctgatcagcctgttcctgccctgcctgtgctgctacctgcccaccagaggctgcctgcacctgtgccagcagggctacgacagcctgagaagacccggctgcagatgcaagagacacaccaacaccgtgtgcagaaagatcagcagcggcagcgcccccttccccaaggcccaggagaagagcgtgtag

SEQ ID NO: 100769 - DNA, 378 bp, Artificial Sequence
  Description of Artificial Sequence: Synthetic coding sequence
atggacgccgccgtgaccgacgacttccagcagatcctgcccatcgagcagctgagaagcacccacgccagcaacgactacgtggagagaccccccgccccctgcaagcaggccctgagcagccccagcctgatcgtgcagacccacaagagcgactggagcctggccaccatgcccaccagcctgcccagaagcctgagccagtgccaccagctgcagcccctgccccagcacctgagccagagcagcatcgccagcagcatgagccacagcaccaccgccagcagcaccaccgcccccctgatgatgaagaccaccgtgctgatgagccccgccctggtgggcctggtgctggccctgagcgccggccagccctag

SEQ ID NO: 100770 - DNA, 969 bp, Artificial Sequence
  Description of Artificial Sequence: Synthetic coding sequence
atgctgagccccctgcccaccggccccctggaggcctgcttcagcgtgcagagcagaaccagcagccccatggagccccccatcccccagagcgcccccctgacccccaacagcgtgatggtgcagcccctgctggacagcagaatgagccacagcagactgcagcaccccctgaccatcctgcccatcgaccaggtgaagaccagccacgtggagaacgactacatcgacaaccccagcctggccctgaccaccggccccaagagaaccagaggcggcgcccccgagctggcccccacccccgccagatgcgaccaggacgtgacccaccactggatcagcttcagcggcagacccagcagcgtgagcagcagcagcagcaccagcagcgaccagagactgctggaccacatggcccccccccccgtggccgaccaggccagccccagagccgtgagaatccagcccaaggtggtgcactgccagcccctggacctgaagggccccgccgtgccccccgagctggacaagcacttcctgctgtgcgaggcctgcggcaagtgcaagtgcaaggagtgcgccagccccagaaccctgcccagctgctgggtgtgcaaccaggagtgcctgtgcagcgcccagaccctggtgaactacggcacctgcatgtgcctggtgcagggcatcttctaccactgcaccaacgaggacgacgagggcagctgcgccgaccacccctgcagctgcagcagaagcaactgctgcgccagatggagcttcatgggcgccctgagcgtggtgctgccctgcctgctgtgctacctgcccgccaccggctgcgtgaagctggcccagagaggctacgacagactgagaagacccggctgcagatgcaagcacaccaacagcgtgatctgcaaggccgccagcggcgacgccaagaccagcagacccgacaagcccttctag

SEQ ID NO: 100771 - DNA, 321 bp, Artificial Sequence
  Description of Artificial Sequence: Synthetic coding sequence
atggagccccccatcccccagagcgcccccctgacccccaacagcgtgatggtgcagcccctgctggacagcagaatgagccacagcagactgcagcaccccctgaccatcctgcccatcgaccaggtgaagaccagccacgtggagaacgactacatcgacaaccccagcctggccctgaccaccggccccaagagaaccagaggcggcgcccccgagctggcccccacccccgccagatgcgaccaggacgtgacccaccactggatcagcttcagcggcagaccctgcagcgccacctgcctgccccccgccgcctag

SEQ ID NO: 100772 - DNA, 900 bp, Artificial Sequence
  Description of Artificial Sequence: Synthetic coding sequence
atggagccccccatcccccagagcgcccccctgacccccaacagcgtgatggtgcagcccctgctggacagcagaatgagccacagcagactgcagcaccccctgaccatcctgcccatcgaccaggtgaagaccagccacgtggagaacgactacatcgacaaccccagcctggccctgaccaccggccccaagagaaccagaggcggcgcccccgagctggcccccacccccgccagatgcgaccaggacgtgacccaccactggatcagcttcagcggcagacccagcagcgtgagcagcagcagcagcaccagcagcgaccagagactgctggaccacatggcccccccccccgtggccgaccaggccagccccagagccgtgagaatccagcccaaggtggtgcactgccagcccctggacctgaagggccccgccgtgccccccgagctggacaagcacttcctgctgtgcgaggcctgcggcaagtgcaagtgcaaggagtgcgccagccccagaaccctgcccagctgctgggtgtgcaaccaggagtgcctgtgcagcgcccagaccctggtgaactacggcacctgcatgtgcctggtgcagggcatcttctaccactgcaccaacgaggacgacgagggcagctgcgccgaccacccctgcagctgcagcagaagcaactgctgcgccagatggagcttcatgggcgccctgagcgtggtgctgccctgcctgctgtgctacctgcccgccaccggctgcgtgaagctggcccagagaggctacgacagactgagaagacccggctgcagatgcaagcacaccaacagcgtgatctgcaaggccgccagcggcgacgccaagaccagcagacccgacaagcccttctag

SEQ ID NO: 100773 - DNA, 153 bp, Artificial Sequence
  Description of Artificial Sequence: Synthetic coding sequence
atggagccccccatcccccagagcgcccccctgacccccaacagcgtgatggtgcagcccctgctggacagcagaatgagccacagcagactgcagcaccccctgaccatcctgcccatcgaccaggtgaagaccagccacgtggagaactag

SEQ ID NO: 100774 - DNA, 1335 bp, Artificial Sequence
  Description of Artificial Sequence: Synthetic coding sequence
atgagcgaggagaccgccaccagcgacaacgacaacagctacgccagagtgagagccgtggtgatgaccagagacgacagcagcggcggctggctgcccctgggcggcagcggcctgagcagcgtgaccgtgttcaaggtgccccaccaggaggagaacggctgcgccgacttcttcatcagaggcgagagactgagagacaagatggtggtgctggagtgcatgctgaagaaggacctgatctacaacaaggtgacccccaccttccaccactggaagatcgacgacaagaagttcggcctgaccttccagagccccgccgacgccagagccttcgacagaggcatcagaagagccatcgaggacatcagccagggctgccccgagagcaagaacgaggccgagggcgccgacgacctgcaggccaacgaggaggacagcagcagcagcctggtgaaggaccacctgttccagcaggagaccgtggtgaccagcgagccctacagaagcagcaacatcagacccagccccttcgaggacctgaacgccagaagagtgtacatgcagagccaggccaaccagatcaccttcggccagcccggcctggacatccagagcagaagcatggagtacgtgcagagacagatcagcaaggagtgcggcagcctgaagagccagaacagagtgcccctgaagagcatcagacacgtgagcttccaggacgaggacgagatcgtgagaatcaaccccagagacatcctgatcagaagatacgccgactacagacaccccgacatgtggaagaacgacctggagagagacgacgccgacagcagcatccagttcagcaagcccgacagcaagaagagcgactacctgtacagctgcggcgacgagaccaagctgagcagccccaaggacagcgtggtgttcaagacccagcccagcagcctgaagatcaagaagagcaagagaagaaaggaggacggcgagagaagcagatgcgtgtactgccaggagagattcaaccacgaggagaacgtgagaggcaagtgccaggacgcccccgaccccatcaagagatgcatctaccaggtgagctgcatgctgtgcgccgagagcatgctgtaccactgcatgagcgacagcgagggcgacttcagcgacccctgcagctgcgacaccagcgacgacaagttctgcctgagatggctggccctggtggccctgagcttcatcgtgccctgcatgtgctgctacgtgcccctgagaatgtgccacagatgcggcgaggcctgcggctgctgcggcggcaagcacaaggccgccggctag

SEQ ID NO: 100775 - DNA, 1257 bp, Artificial Sequence
  Description of Artificial Sequence: Synthetic coding sequence
atgaccgaggagacccaccccgacgacgacagctacatcgtgagagtgaaggccgtggtgatgaccagagacgacagcagcggcggctggttcccccaggagggcggcggcatcagcagagtgggcgtgtgcaaggtgatgcaccccgagggcaacggcagaagcggcttcctgatccacggcgagagacagaaggacaagctggtggtgctggagtgctacgtgagaaaggacctggtgtacaccaaggccaaccccaccttccaccactggaaggtggacaacagaaagttcggcctgaccttccagagccccgccgacgccagagccttcgacagaggcgtgagaaaggccatcgaggacctgatcgagggcagcaccaccagcagcagcaccatccacaacgaggccgagctgggcgacgacgacgtgttcaccaccgccaccgacagcagcagcaacagcagccagaagagagagcagcccaccagaaccatcagcagccccaccagctgcgagcacagaagaatctacaccctgggccacctgcacgacagctaccccaccgaccactaccacctggaccagcccatgcccagaccctacagacaggtgagcttccccgacgacgacgaggagatcgtgagaatcaaccccagagagaagatctggatgaccggctacgaggactacagacacgcccccgtgagaggcaagtaccccgaccccagcgaggacgccgacagcagctacgtgagattcgccaagggcgaggtgcccaagcacgactacaactacccctacgtggacagcagcgacttcggcctgggcgaggaccccaagggcagaggcggcagcgtgatcaagacccagcccagcagaggcaagagcagaagaagaaaggaggacggcgagagaagcagatgcgtgtactgcagagacatgttcaaccacgaggagaacagaagaggccactgccaggacgcccccgacagcgtgagaacctgcatcagaagagtgagctgcatgtggtgcgccgacagcatgctgtaccactgcatgagcgaccccgagggcgactacaccgacccctgcagctgcgacaccagcgacgagaagttctgcctgagatggatggccctgatcgccctgagcttcctggccccctgcatgtgctgctacctgcccctgagagcctgctaccactgcggcgtgatgtgcagatgctgcggcggcaagcacaaggccgccgcctag

SEQ ID NO: 100776 - DNA, 351 bp, Artificial Sequence
  Description of Artificial Sequence: Synthetic coding sequence
atgaccgaggagacccaccccgacgacgacagctacatcgtgagagtgaaggccgtggtgatgaccagagacgacagcagcggcggctggttcccccaggagggcggcggcatcagcagagtgggcgtgtgcaaggtgatgcaccccgagggcaacggcagaagcggcttcctgatccacggcgagagacagaaggacaagctggtggtgctggagtgctacgtgagaaaggacctggtgtacaccaaggccaaccccaccttccaccactggaaggtggacaacagaaagttcggcctgaccttccagagccccgccgacgccagagccttcgacagaggcgtgagatag

SEQ ID NO: 100777 - DNA, 1248 bp, Artificial Sequence
  Description of Artificial Sequence: Synthetic coding sequence
atggccagccccggcagcgacagctacatcgtgagagtgaaggccgtggtgatgaccagagacgacagcagcggcggctggttcccccaggagggcggcggcatcagcagagtgggcgtgtgcaaggtgatgcaccccgagggcaacggcagaagcggcttcctgatccacggcgagagacagaaggacaagctggtggtgctggagtgctacgtgagaaaggacctggtgtacaccaaggccaaccccaccttccaccactggaaggtggacaacagaaagttcggcctgaccttccagagccccgccgacgccagagccttcgacagaggcgtgagaaaggccatcgaggacctgatcgagggcagcaccaccagcagcagcaccatccacaacgaggccgagctgggcgacgacgacgtgttcaccaccgccaccgacagcagcagcaacagcagccagaagagagagcagcccaccagaaccatcagcagccccaccagctgcgagcacagaagaatctacaccctgggccacctgcacgacagctaccccaccgaccactaccacctggaccagcccatgcccagaccctacagacaggtgagcttccccgacgacgacgaggagatcgtgagaatcaaccccagagagaagatctggatgaccggctacgaggactacagacacgcccccgtgagaggcaagtaccccgaccccagcgaggacgccgacagcagctacgtgagattcgccaagggcgaggtgcccaagcacgactacaactacccctacgtggacagcagcgacttcggcctgggcgaggaccccaagggcagaggcggcagcgtgatcaagacccagcccagcagaggcaagagcagaagaagaaaggaggacggcgagagaagcagatgcgtgtactgcagagacatgttcaaccacgaggagaacagaagaggccactgccaggacgcccccgacagcgtgagaacctgcatcagaagagtgagctgcatgtggtgcgccgacagcatgctgtaccactgcatgagcgaccccgagggcgactacaccgacccctgcagctgcgacaccagcgacgagaagttctgcctgagatggatggccctgatcgccctgagcttcctggccccctgcatgtgctgctacctgcccctgagagcctgctaccactgcggcgtgatgtgcagatgctgcggcggcaagcacaaggccgccgcctag

SEQ ID NO: 100778 - DNA, 1233 bp, Artificial Sequence
  Description of Artificial Sequence: Synthetic coding sequence
atggtgagagtgagagccgtggtgatggccagagacgacagcagcggcggctggctgcccgtgggcggcggcggcctgagccaggtgagcgtgtgcagagtgagaggcgccagacccgagggcggcgccagacagggccactacgtgatccacggcgagagactgagagaccagaagaccaccctggagtgcaccctgaagcccggcctggtgtacaacaaggtgaaccccatcttccaccactggagcctgggcgactgcaagttcggcctgaccttccagagccccgccgaggccgacgagttccagaagagcctgctggccgccctggccgccctgggcagaggcagcctgacccccagcagcagcagcagcagcagcagccccagccaggacaccgccgagaccccctgccccctgaccagccacgtggacagcgacagcagcagcagccacagcagacaggagaccccccccagcgccgccgccgcccccatcatcaccatggagagcgccagcggcttcggccccaccacccccccccagagaagaagaagcagcgcccagagctacccccccctgctgcccttcaccggcatccccgagcccagcgagcccctggccggcgccggcggcctgggctggggcggcagaggctacgaggactacagaagaagcggcccccccgcccccctggccctgagcacctgcgtggtgagattcgccaagaccggcgccctgagaggcgccgccctgggcccccccgccgccctgcccgcccccctgaccgaggccgccccccccgccccccccgccagacccccccccggccccggccccagcagcgcccccgccaaggccagccccgaggccgaggaggccgccagatgcgtgcactgcagagccctgttcagaagaagagccgacggcagaggcggcagatgcgccgaggcccccgaccccggcagactgctggtgagaagactgagctgcctgtggtgcgccgagagcctgctgtaccactgcctgagcgacgccgagggcgacttcagcgacccctgcgcctgcgagcccggccaccccagacccgccgccagatgggccgccctggccgccctgagcctggccgtgccctgcctgtgctgctacgcccccctgagagcctgccactgggtggccgccagatgcggctgcgccggctgcggcggcagacacgaggaggccgccagatag

SEQ ID NO: 100779 - DNA, 459 bp, Artificial Sequence
  Description of Artificial Sequence: Synthetic coding sequence
atggtgagagtgagagccgtggtgatggccagagacgacagcagcggcggctggctgcccgtgggcggcggcggcctgagccaggtgagcgtgtgcagagtgagaggcgccagacccgagggcggcgccagacagggccactacgtgatccacggcgagagactgagagaccagaagaccaccctggagtgcaccctgaagcccggcctggtgtacaacaaggtgaaccccatcttccaccactggagcctgggcgactgcaagttcggcctgaccttccagagccccgccgaggccgacgagttccagaagagcctgctggccgccctggccgccctgggcagaggcagcctgacccccagcagcagcagcagcagcagcagccccagccaggacaccgccgagaccccctgccccctgaccctgagccagtacttcagacacatgctgtgcccctag

SEQ ID NO: 100780 - DNA, 1725 bp, Artificial Sequence
  Description of Artificial Sequence: Synthetic coding sequence
atgtggaccttcctgggcatcgccaccttcacctacttctacaagaagttcggcgacttcatcaccctggccaacagagaggtgctgctgtgcgtgctggtgttcctgagcctgggcctggtgctgagctacagatgcagacacagaaacggcggcctgctgggcagacagcagagcggcagccagttcgccctgttcagcgacatcctgagcggcctgcccttcatcggcttcttctgggccaagagcccccccgagagcgagaacaaggagcagctggaggccagaagaagaagaaagggcaccaacatcagcgagaccagcctgatcggcaccgccgcctgcaccagcaccagcagccagaacgaccccgaggtgatcatcgtgggcgccggcgtgctgggcagcgccctggccgccgtgctgagcagagacggcagaaaggtgaccgtgatcgagagagacctgaaggagcccgacagaatcgtgggcgagttcctgcagcccggcggctaccacgtgctgaaggacctgggcctgggcgacaccgtggagggcctggacgcccaggtggtgaacggctacatgatccacgaccaggagagcaagagcgaggtgcagatcccctaccccctgagcgagaacaaccaggtgcagagcggcagagccttccaccacggcagattcatcatgagcctgagaaaggccgccatggccgagcccaacgccaagttcatcgagggcgtggtgctgcagctgctggaggaggacgacgtggtgatgggcgtgcagtacaaggacaaggagaccggcgacatcaaggagctgcacgcccccctgaccgtggtggccgacggcctgttcagcaagttcagaaagagcctggtgagcaacaaggtgagcgtgagcagccacttcgtgggcttcctgatgaagaacgccccccagttcaaggccaaccacgccgagctgatcctggccaaccccagccccgtgctgatctaccagatcagcagcagcgagaccagagtgctggtggacatcagaggcgagatgcccagaaacctgagagagtacatggtggagaagatctacccccagatccccgaccacctgaaggagcccttcctggaggccaccgacaacagccacctgagaagcatgcccgccagcttcctgccccccagcagcgtgaagaagagaggcgtgctgctgctgggcgacgcctacaacatgagacaccccctgaccggcggcggcatgaccgtggccttcaaggacatcaagctgtggagaaagctgctgaagggcatccccgacctgtacgacgacgccgccatcttcgaggccaagaagagcttctactgggccagaaagaccagccacagcttcgtggtgaacatcctggcccaggccctgtacgagctgttcagcgccaccgacgacagcctgcaccagctgagaaaggcctgcttcctgtacttcaagctgggcggcgagtgcgtggccggccccgtgggcctgctgagcgtgctgagccccaaccccctggtgctgatcggccacttcttcgccgtggccatctacgccgtgtacttctgcttcaagagcgagccctggatcaccaagcccagagccctgctgagcagcggcgccgtgctgtacaaggcctgcagcgtgatcttccccctgatctacagcgagatgaagtacatggtgcactag

SEQ ID NO: 100781 - DNA, 1440 bp, Artificial Sequence
  Description of Artificial Sequence: Synthetic coding sequence
atgctgagaagaaagggcaccaacatcagcgagaccagcctgatcggcaccgccgcctgcaccagcaccagcagccagaacgaccccgaggtgatcatcgtgggcgccggcgtgctgggcagcgccctggccgccgtgctgagcagagacggcagaaaggtgaccgtgatcgagagagacctgaaggagcccgacagaatcgtgggcgagttcctgcagcccggcggctaccacgtgctgaaggacctgggcctgggcgacaccgtggagggcctggacgcccaggtggtgaacggctacatgatccacgaccaggagagcaagagcgaggtgcagatcccctaccccctgagcgagaacaaccaggtgcagagcggcagagccttccaccacggcagattcatcatgagcctgagaaaggccgccatggccgagcccaacgccaagttcatcgagggcgtggtgctgcagctgctggaggaggacgacgtggtgatgggcgtgcagtacaaggacaaggagaccggcgacatcaaggagctgcacgcccccctgaccgtggtggccgacggcctgttcagcaagttcagaaagagcctggtgagcaacaaggtgagcgtgagcagccacttcgtgggcttcctgatgaagaacgccccccagttcaaggccaaccacgccgagctgatcctggccaaccccagccccgtgctgatctaccagatcagcagcagcgagaccagagtgctggtggacatcagaggcgagatgcccagaaacctgagagagtacatggtggagaagatctacccccagatccccgaccacctgaaggagcccttcctggaggccaccgacaacagccacctgagaagcatgcccgccagcttcctgccccccagcagcgtgaagaagagaggcgtgctgctgctgggcgacgcctacaacatgagacaccccctgaccggcggcggcatgaccgtggccttcaaggacatcaagctgtggagaaagctgctgaagggcatccccgacctgtacgacgacgccgccatcttcgaggccaagaagagcttctactgggccagaaagaccagccacagcttcgtggtgaacatcctggcccaggccctgtacgagctgttcagcgccaccgacgacagcctgcaccagctgagaaaggcctgcttcctgtacttcaagctgggcggcgagtgcgtggccggccccgtgggcctgctgagcgtgctgagccccaaccccctggtgctgatcggccacttcttcgccgtggccatctacgccgtgtacttctgcttcaagagcgagccctggatcaccaagcccagagccctgctgagcagcggcgccgtgctgtacaaggcctgcagcgtgatcttccccctgatctacagcgagatgaagtacatggtgcactag

SEQ ID NO: 100782 - DNA, 1140 bp, Artificial Sequence
  Description of Artificial Sequence: Synthetic coding sequence
atgatccacgaccaggagagcaagagcgaggtgcagatcccctaccccctgagcgagaacaaccaggtgcagagcggcagagccttccaccacggcagattcatcatgagcctgagaaaggccgccatggccgagcccaacgccaagttcatcgagggcgtggtgctgcagctgctggaggaggacgacgtggtgatgggcgtgcagtacaaggacaaggagaccggcgacatcaaggagctgcacgcccccctgaccgtggtggccgacggcctgttcagcaagttcagaaagagcctggtgagcaacaaggtgagcgtgagcagccacttcgtgggcttcctgatgaagaacgccccccagttcaaggccaaccacgccgagctgatcctggccaaccccagccccgtgctgatctaccagatcagcagcagcgagaccagagtgctggtggacatcagaggcgagatgcccagaaacctgagagagtacatggtggagaagatctacccccagatccccgaccacctgaaggagcccttcctggaggccaccgacaacagccacctgagaagcatgcccgccagcttcctgccccccagcagcgtgaagaagagaggcgtgctgctgctgggcgacgcctacaacatgagacaccccctgaccggcggcggcatgaccgtggccttcaaggacatcaagctgtggagaaagctgctgaagggcatccccgacctgtacgacgacgccgccatcttcgaggccaagaagagcttctactgggccagaaagaccagccacagcttcgtggtgaacatcctggcccaggccctgtacgagctgttcagcgccaccgacgacagcctgcaccagctgagaaaggcctgcttcctgtacttcaagctgggcggcgagtgcgtggccggccccgtgggcctgctgagcgtgctgagccccaaccccctggtgctgatcggccacttcttcgccgtggccatctacgccgtgtacttctgcttcaagagcgagccctggatcaccaagcccagagccctgctgagcagcggcgccgtgctgtacaaggcctgcagcgtgatcttccccctgatctacagcgagatgaagtacatggtgcactag

SEQ ID NO: 100783 - DNA, 822 bp, Artificial Sequence
  Description of Artificial Sequence: Synthetic coding sequence
atgaagaagacccagacctggatcctgacctgcatctacctgcagctgctgctgttcaaccccctggtgaagaccgagggcatctgcagaaacagagtgaccaacaacgtgaaggacgtgaccaagctggtggccaacctgcccaaggactacatgatcaccctgaagtacgtgcccggcatggacgtgctgcccagccactgctggatcagcgagatggtggtgcagctgagcgacagcctgaccgacctgctggacaagttcagcaacatcagcgagggcctgagcaactacagcatcatcgacaagctggtgaacatcgtggacgacctggtggagtgcgtgaaggagaacagcagcaaggacctgaagaagagcttcaagagccccgagcccagactgttcacccccgaggagttcttcagaatcttcaacagaagcatcgacgccttcaaggacttcgtggtggccagcgagaccagcgactgcgtggtgagcagcaccctgagccccgagaaggacagcagagtgagcgtgaccaagcccttcatgctgccccccgtggccgccagcagcctgagaaacgacagcagcagcagcaacagaaaggccaagaacccccccggcgacagcagcctgcactgggccgccatggccctgcccgccctgttcagcctgatcatcggcttcgccttcggcgccctgtactggaagaagagacagcccagcctgaccagagccgtggagaacatccagatcaacgaggaggacaacgagatcagcatgctgcaggagaaggagagagagttccaggaggtgtag

SEQ ID NO: 100784 - DNA, 2100 bp, Artificial Sequence
  Description of Artificial Sequence: Synthetic coding sequence
atgagactgagaagactgggccagggcggcagatgctacagaggcctgtggcccctgagacacaccagaccctggagcagccccggcgagtacgagtgggagtacgacgaggaggaggagaagaaccagctggagatcgagagactggaggagcagctgagcatcaacgtgtacgactacaactgccacgtggacctgatcagactgctgagactggagggcgagctgaccaaggtgagaatggccagacagaagatgagcgagatcttccccctgaccgaggagctgtggctggagtggctgcacgacgagatcagcatggcccaggacggcctggacagagagcacgtgtacgacctgttcgagaaggccgtgaaggactacatctgccccaacatctggctggagtacggccagtacagcgtgggcggcatcggccagaagggcggcctggagaaggtgagaagcgtgttcgagagagccctgagcagcgtgggcctgcacatgaccaagggcctggccctgtgggaggcctacagagagttcgagagcgccatcgtggaggccgccagactggagaaggtgcacagcctgttcagaagacagctggccatccccctgtacgacatggaggccaccttcgccgagtacgaggagtggagcgaggaccccatccccgagagcgtgatccagaactacaacaaggccctgcagcagctggagaagtacaagccctacgaggaggccctgctgcaggccgaggcccccagactggccgagtaccaggcctacatcgacttcgagatgaagatcggcgaccccgccagaatccagctgatcttcgagagagccctggtggagaactgcctggtgcccgacctgtggatcagatacagccagtacctggacagacagctgaaggtgaaggacctggtgctgagcgtgcacaacagagccatcagaaactgcccctggaccgtggccctgtggagcagatacctgctggccatggagagacacggcgtggaccaccaggtgatcagcgtgaccttcgagaaggccctgaacgccggcttcatccaggccaccgactacgtggagatctggcaggcctacctggactacctgagaagaagagtggacttcaagcaggacagcagcaaggagctggaggagctgagagccgccttcaccagagccctggagtacctgaagcaggaggtggaggagagattcaacgagagcggcgaccccagctgcgtgatcatgcagaactgggccagaatcgaggccagactgtgcaacaacatgcagaaggccagagagctgtgggacagcatcatgaccagaggcaacgccaagtacgccaacatgtggctggagtactacaacctggagagagcccacggcgacacccagcactgcagaaaggccctgcacagagccgtgcagtgcaccagcgactaccccgagcacgtgtgcgaggtgctgctgaccatggagagaaccgagggcagcctggaggactgggacatcgccgtgcagaagaccgagaccagactggccagagtgaacgagcagagaatgaaggccgccgagaaggaggccgccctggtgcagcaggaggaggagaaggccgagcagagaaagagagccagagccgagaagaaggccctgaagaagaagaagaagatcagaggccccgagaagagaggcgccgacgaggacgacgagaaggagtggggcgacgacgaggaggccttccagacccagaagggcagagagcagcacccctgcagctggagaaacaccaagtgcagaagcagcagcagagccagatgggagatgtgctgcagaagatgcggcgcccccttcgaggccgagggcgagggcagcctgcccgaggagggccacgcccagggcgccgccagacagcagcagggccagcaccacagactgtgccagcagcccgccctgcagcacgccggcgccggccacgaggcccaggccaccctgagaggcctgtggggcggcggccccgaccccacccacctgcagcagccctggggcttccccagactgctgctgagaggcgtgtag

SEQ ID NO: 100785 - DNA, 2784 bp, Artificial Sequence
  Description of Artificial Sequence: Synthetic coding sequence
atggccaccgccgccgagaccagcgccagcgagcccgaggccgagagcaaggccggccccaaggccgacggcgaggaggacgaggtgaaggccgccagaaccagaagaaaggtgctgagcagagccgtggccgccgccacctacaagaccatgggccccgcctgggaccagcaggaggagggcgtgagcgagagcgacggcgacgagtacgccatggccagcagcgccgagagcagccccggcgagtacgagtgggagtacgacgaggaggaggagaagaaccagctggagatcgagagactggaggagcagctgagcatcaacgtgtacgactacaactgccacgtggacctgatcagactgctgagactggagggcgagctgaccaaggtgagaatggccagacagaagatgagcgagatcttccccctgaccgaggagctgtggctggagtggctgcacgacgagatcagcatggcccaggacggcctggacagagagcacgtgtacgacctgttcgagaaggccgtgaaggactacatctgccccaacatctggctggagtacggccagtacagcgtgggcggcatcggccagaagggcggcctggagaaggtgagaagcgtgttcgagagagccctgagcagcgtgggcctgcacatgaccaagggcctggccctgtgggaggcctacagagagttcgagagcgccatcgtggaggccgccagactggagaaggtgcacagcctgttcagaagacagctggccatccccctgtacgacatggaggccaccttcgccgagtacgaggagtggagcgaggaccccatccccgagagcgtgatccagaactacaacaaggccctgcagcagctggagaagtacaagccctacgaggaggccctgctgcaggccgaggcccccagactggccgagtaccaggcctacatcgacttcgagatgaagatcggcgaccccgccagaatccagctgatcttcgagagagccctggtggagaactgcctggtgcccgacctgtggatcagatacagccagtacctggacagacagctgaaggtgaaggacctggtgctgagcgtgcacaacagagccatcagaaactgcccctggaccgtggccctgtggagcagatacctgctggccatggagagacacggcgtggaccaccaggtgatcagcgacagcagcaaggagctggaggagctgagagccgccttcaccagagccctggagtacctgaagcaggaggtggaggagagattcaacgagagcggcgaccccagctgcgtgatcatgcagaactgggccagaatcgaggccagactgtgcaacaacatgcagaaggccagagagctgtgggacagcatcatgaccagaggcaacgccaagtacgccaacatgtggctggagtactacaacctggagagagcccacggcgacacccagcactgcagaaaggccctgcacagagccgtgcagtgcaccagcgactaccccgagcacgtgtgcgaggtgctgctgaccatggagagaaccgagggcagcctggaggactgggacatcgccgtgcagaagaccgagaccagactggccagagtgaacgagcagagaatgaaggccgccgagaaggaggccgccctggtgcagcaggaggaggagaaggccgagcagagaaagagagccagagccgagaagaaggccctgaagaagaagaagaagatcagaggccccgagaagagaggcgccgacgaggacgacgagaaggagtggggcgacgacgaggaggagcagcccagcaagagaagaagagtggagaacagcatccccgccgccggcgagacccagaacgtggaggtggccgccggccccgccggcaagtgcgccgccgtggacgtggagccccccagcaagcagaaggagaaggccgccagcctgaagagagacatgcccaaggtgctgcacgacagcagcaaggacagcatcaccgtgttcgtgagcaacctgccctacagcatgcaggagcccgacaccaagctgagacccctgttcgaggcctgcggcgaggtggtgcagatcagacccatcttcagcaacagaggcgacttcagaggctactgctacgtggagttcaaggaggagaagagcgccctgcaggccctggagatggacagaaagagcgtggagggcagacccatgttcgtgagcccctgcgtggacaagagcaagaaccccgacttcaaggtgttcagatacagcaccagcctggagaagcacaagctgttcatcagcggcctgcccttcagctgcaccaaggaggagctggaggagatctgcaaggcccacggcaccgtgaaggacctgagactggtgaccaacagagccggcaagcccaagggcctggcctacgtggagtacgagaacgagagccaggccagccaggccgtgatgaagatggacggcatgaccatcaaggagaacatcatcaaggtggccatcagcaaccccccccagagaaaggtgcccgagaagcccgagaccagaaaggcccccggcggccccatgctgctgccccagacctacggcgccagaggcaagggcagaacccagctgagcctgctgcccagagccctgcagagacccagcgccgccgccccccaggccgagaacggccccgccgccgcccccgccgtggccgcccccgccgccaccgaggcccccaagatgagcaacgccgacttcgccaagctgttcctgagaaagtag

SEQ ID NO: 100786 - DNA, 1587 bp, Artificial Sequence
  Description of Artificial Sequence: Synthetic coding sequence
atggagagacacggcgtggaccaccaggtgatcagcgacagcagcaaggagctggaggagctgagagccgccttcaccagagccctggagtacctgaagcaggaggtggaggagagattcaacgagagcggcgaccccagctgcgtgatcatgcagaactgggccagaatcgaggccagactgtgcaacaacatgcagaaggccagagagctgtgggacagcatcatgaccagaggcaacgccaagtacgccaacatgtggctggagtactacaacctggagagagcccacggcgacacccagcactgcagaaaggccctgcacagagccgtgcagtgcaccagcgactaccccgagcacgtgtgcgaggtgctgctgaccatggagagaaccgagggcagcctggaggactgggacatcgccgtgcagaagaccgagaccagactggccagagtgaacgagcagagaatgaaggccgccgagaaggaggccgccctggtgcagcaggaggaggagaaggccgagcagagaaagagagccagagccgagaagaaggccctgaagaagaagaagaagatcagaggccccgagaagagaggcgccgacgaggacgacgagaaggagtggggcgacgacgaggaggagcagcccagcaagagaagaagagtggagaacagcatccccgccgccggcgagacccagaacgtggaggtggccgccggccccgccggcaagtgcgccgccgtggacgtggagccccccagcaagcagaaggagaaggccgccagcctgaagagagacatgcccaaggtgctgcacgacagcagcaaggacagcatgcaggagcccgacaccaagctgagacccctgttcgaggcctgcggcgaggtggtgcagatcagacccatcttcagcaacagaggcgacttcagaggctactgctacgtggagttcaaggaggagaagagcgccctgcaggccctggagatggacagaaagagcgtggagggcagacccatgttcgtgagcccctgcgtggacaagagcaagaaccccgacttcaaggtgttcagatacagcaccagcctggagaagcacaagctgttcatcagcggcctgcccttcagctgcaccaaggaggagctggaggagatctgcaaggcccacggcaccgtgaaggacctgagactggtgaccaacagagccggcaagcccaagggcctggcctacgtggagtacgagaacgagagccaggccagccaggccgtgatgaagatggacggcatgaccatcaaggagaacatcatcaaggtggccatcagcaaccccccccagagaaaggtgcccgagaagcccgagaccagaaaggcccccggcggccccatgctgctgccccagacctacggcgccagaggcaagggcagaacccagctgagcctgctgcccagagccctgcagagacccagcgccgccgccccccaggccgagaacggccccgccgccgcccccgccgtggccgcccccgccgccaccgaggcccccaagatgagcaacgccgacttcgccaagctgttcctgagaaagtag

SEQ ID NO: 100787 - DNA, 390 bp, Artificial Sequence
  Description of Artificial Sequence: Synthetic coding sequence
atggccaccgccgccgagaccagcgccagcgagcccgaggccgagagcaaggccggccccaaggccgacggcgaggaggacgaggtgaaggccgccagaaccagaagaaaggtgctgagcagagccgtggccgccgccacctacaagaccatgggccccgcctgggaccagcaggaggagggcgtgagcgagagcgacggcgacgagtacgccatggccagcagcgccgagagcagccccggcgagtacgagtgggagtacgacgaggaggaggagaagaaccagctggagatcgagagactggaggagcaggtgggccccggcgtgggcagcggccacctgcccgtgttccaggtgctgggcagcccctgccccggcccccccccctag

SEQ ID NO: 100788 - DNA, 330 bp, Artificial Sequence
  Description of Artificial Sequence: Synthetic coding sequence
atggccgccagcgccgccagaggcgccgccgccctgagaagaagcatcaaccagcccgtggccttcgtgagaagaatcccctggaccgccgccagcagccagctgaaggagcacttcgcccagttcggccacgtgagaagatgcatcctgcccttcgacaaggagaccggcttccacagaggcctgggctgggtgcagttcagcagcgaggagggcctgagaaacgccctgcagcaggagaaccacatcatcgacggcgtgaaggtgcaggtgcacaccagaagacccaagctgccccagaccagcgacgacgagaagaaggacttctag

SEQ ID NO: 100789 - DNA, 894 bp, Artificial Sequence
  Description of Artificial Sequence: Synthetic coding sequence
atggccaagtggctgaacaagtacttcagcctgggcaacagcaagaccaagagccccccccagccccccagacccgactacagagagcagagaagaagaggcgagagacccagccagcccccccaggccgtgccccaggccagcagcgccgccagcgccagctgcggccccgccaccgccagctgcttcagcgccagcagcggcagcctgcccgacgacagcggcagcaccagcgacctgatcagagcctacagagcccagaaggagagagacttcgaggacccctacaacggccccggcagcagcctgagaaagctgagagccatgtgcagactggactactgcggcggcagcggcgagcccggcggcgtgcagagagccttcagcgccagcagcgccagcggcgccgccggctgctgctgcgccagcagcggcgccggcgccgccgccagcagcagcagcagcagcggcagcccccacctgtacagaagcagcagcgagagaagacccgccacccccgccgaggtgagatacatcagccccaagcacagactgatcaaggtggagagcgccgccggcggcggcgccggcgaccccctgggcggcgcctgcgccggcggcagaacctggagccccaccgcctgcggcggcaagaagctgctgaacaagtgcgccgccagcgccgccgaggagagcggcgccggcaagaaggacaaggtgaccatcgccgacgactacagcgaccccttcgacgccaagaacgacctgaagagcaaggccggcaagggcgagagcgccggctacatggagccctacgaggcccagagaatcatgaccggcctgcaggaggcctggagacacagccccagcggctgcttccccgtgggcccctag

SEQ ID NO: 100790 - DNA, 1530 bp, Artificial Sequence
  Description of Artificial Sequence: Synthetic coding sequence
atggccaagtggctgaacaagtacttcagcctgggcaacagcaagaccaagagccccccccagccccccagacccgactacagagagcagagaagaagaggcgagagacccagccagcccccccaggccgtgccccaggccagcagcgccgccagcgccagctgcggccccgccaccgccagctgcttcagcgccagcagcggcagcctgcccgacgacagcggcagcaccagcgacctgatcagagcctacagagcccagaaggagagagacttcgaggacccctacaacggccccggcagcagcctgagaaagctgagagccatgtgcagactggactactgcggcggcagcggcgagcccggcggcgtgcagagagccttcagcgccagcagcgccagcggcgccgccggctgctgctgcgccagcagcggcgccggcgccgccgccagcagcagcagcagcagcggcagcccccacctgtacagaagcagcagcgagagaagacccgccacccccgccgaggtgagatacatcagccccaagcacagactgatcaaggtggagagcgccgccggcggcggcgccggcgaccccctgggcggcgcctgcgccggcggcagaacctggagccccaccgcctgcggcggcaagaagctgctgaacaagtgcgccgccagcgccgccgaggagagcggcgccggcaagaaggacaaggtgaccatcgccgacgactacagcgaccccttcgacgccaagaacgacctgaagagcaaggccggcaagggcgagagcgccggctacatggagccctacgaggcccagagaatcatgaccgagttccagagacaggagagcgtgagaagccagcacaagggcatccagctgtacgacaccccctacgagcccgagggccagagcgtggacagcgacagcgagagcaccgtgagccccagactgagagagagcaagctgccccaggacgacgacagacccgccgacgagtacgaccagccctgggagtggaacagagtgaccatccccgccctggccgcccagttcaacggcaacgagaagagacagagcagccccagccccagcagagacagaagaagacagctgagagcccccggcggcggcttcaagcccatcaagcacggcagccccgagttctgcggcatcctgggcgagagagtggaccccgccgtgcccctggagaagcagatctggtaccacggcgccatcagcagaggcgacgccgagaacctgctgagactgtgcaaggagtgcagctacctggtgagaaacagccagaccagcaagcacgactacagcctgagcctgagaagcaaccagggcttcatgcacatgaagctggccaagaccaaggagaagtacgtgctgggccagaacagcccccccttcgacagcgtgcccgaggtgatccactactacaccaccagaaagctgcccatcaagggcgccgagcacctgagcctgctgtaccccgtggccgtgagaaccctgtag

SEQ ID NO: 100791 - DNA, 1080 bp, Artificial Sequence
  Description of Artificial Sequence: Synthetic coding sequence
atgcaggccgccgccctgcccgaggagatcagatggctgctggaggacgccgaggagttcctggccgagggcctgagaaacgagaacctgagcgccgtggccagagaccacagagaccacatcctgagaggcttccagcagatcaaggccagatactactgggacttccagccccagggcggcgacatcggccaggacagcagcgacgacaaccacagcggcaccctgggcctgagcctgaccagcgacgcccccttcctgagcgactaccaggacgagggcatggaggacatcgtgaagggcgcccaggagctggacaacgtgatcaagcagggctacctggagaagaagagcaaggaccacagcttcttcggcagcgagtggcagaagagatggtgcgtggtgagcagaggcctgttctactactacgccaacgagaagagcaagcagcccaagggcaccttcctgatcaagggctacggcgtgagaatggccccccacctgagaagagacagcaagaaggagagctgcttcgagctgaccagccaggacagaagaagctacgagttcaccgccaccagccccgccgaggccagagactgggtggaccagatcagcttcctgctgaaggacctgagcagcctgaccatcccctacgaggaggacgaggaggaggaggagaaggaggagacctacgacgacatcgacggcttcgacagccccagctgcggcagccagtgcagacccaccatcctgcccggcagcgtgggcatcaaggagcccaccgaggagaaggaggaggaggacatctacgaggtgctgcccgacgaggagcacgacctggaggaggacgagagcggcaccagaagaaagggcgtggactacgccagctactaccagggcctgtgggactgccacggcgaccagcccgacgagctgagcttccagagaggcgacctgatcagaatcctgagcaaggagtacaacatgtacggctggtgggtgggcgagctgaacagcctggtgggcatcgtgcccaaggagtacctgaccaccgccttcgaggtggaggagagatag

SEQ ID NO: 100792 - DNA, 831 bp, Artificial Sequence
  Description of Artificial Sequence: Synthetic coding sequence
atgggcaacagcatgaagagcacccccgcccccgccgagagacccctgcccaaccccgagggcctggacagcgacttcctggccgtgctgagcgactaccccagccccgacatcagcccccccatcttcagaagaggcgagaagctgagagtgatcagcgacgagggcggctggtggaaggccatcagcctgagcaccggcagagagagctacatccccggcatctgcgtggccagagtgtaccacggctggctgttcgagggcctgggcagagacaaggccgaggagctgctgcagctgcccgacaccaaggtgggcagcttcatgatcagagagagcgagaccaagaagggcttctacagcctgagcgtgagacacagacaggtgaagcactacagaatcttcagactgcccaacaactggtactacatcagccccagactgaccttccagtgcctggaggacctggtgaaccactacagcgaggtggccgacggcctgtgctgcgtgctgaccaccccctgcctgacccagagcaccgccgcccccgccgtgagagccagcagcagccccgtgaccctgagacagaagaccgtggactggagaagagtgagcagactgcaggaggaccccgagggcaccgagaaccccctgggcgtggacgagagcctgttcagctacggcctgagagagagcatcgccagctacctgagcctgaccagcgaggacaacaccagcttcgacagaaagaagaagagcatcagcctgatgtacggcggcagcaagagaaagagcagcttcttcagcagccccccctacttcgaggactag

SEQ ID NO: 100793 - DNA, 882 bp, Artificial Sequence
  Description of Artificial Sequence: Synthetic coding sequence
atgctgcacagactgtgggccagccccgccgcccccggcaagaagaaggagatgggcaacagcatgaagagcacccccgcccccgccgagagacccctgcccaaccccgagggcctggacagcgacttcctggccgtgctgagcgactaccccagccccgacatcagcccccccatcttcagaagaggcgagaagctgagagtgatcagcgacgagggcggctggtggaaggccatcagcctgagcaccggcagagagagctacatccccggcatctgcgtggccagagtgtaccacggctggctgttcgagggcctgggcagagacaaggccgaggagctgctgcagctgcccgacaccaaggtgggcagcttcatgatcagagagagcgagaccaagaagggcttctacagcctgagcgtgagacacagacaggtgaagcactacagaatcttcagactgcccaacaactggtactacatcagccccagactgaccttccagtgcctggaggacctggtgaaccactacagcgaggtggccgacggcctgtgctgcgtgctgaccaccccctgcctgacccagagcaccgccgcccccgccgtgagagccagcagcagccccgtgaccctgagacagaagaccgtggactggagaagagtgagcagactgcaggaggaccccgagggcaccgagaaccccctgggcgtggacgagagcctgttcagctacggcctgagagagagcatcgccagctacctgagcctgaccagcgaggacaacaccagcttcgacagaaagaagaagagcatcagcctgatgtacggcggcagcaagagaaagagcagcttcttcagcagccccccctacttcgaggactag

SEQ ID NO: 100794 - DNA, 951 bp, Artificial Sequence
  Description of Artificial Sequence: Synthetic coding sequence
atgctgagcaagctgggccacagccccctgggcggcctgagagccagactgaccttccccgtgtgcctgctgtaccacagactgtgggccagccccgccgcccccggcaagaagaaggagatgggcaacagcatgaagagcacccccgcccccgccgagagacccctgcccaaccccgagggcctggacagcgacttcctggccgtgctgagcgactaccccagccccgacatcagcccccccatcttcagaagaggcgagaagctgagagtgatcagcgacgagggcggctggtggaaggccatcagcctgagcaccggcagagagagctacatccccggcatctgcgtggccagagtgtaccacggctggctgttcgagggcctgggcagagacaaggccgaggagctgctgcagctgcccgacaccaaggtgggcagcttcatgatcagagagagcgagaccaagaagggcttctacagcctgagcgtgagacacagacaggtgaagcactacagaatcttcagactgcccaacaactggtactacatcagccccagactgaccttccagtgcctggaggacctggtgaaccactacagcgaggtggccgacggcctgtgctgcgtgctgaccaccccctgcctgacccagagcaccgccgcccccgccgtgagagccagcagcagccccgtgaccctgagacagaagaccgtggactggagaagagtgagcagactgcaggaggaccccgagggcaccgagaaccccctgggcgtggacgagagcctgttcagctacggcctgagagagagcatcgccagctacctgagcctgaccagcgaggacaacaccagcttcgacagaaagaagaagagcatcagcctgatgtacggcggcagcaagagaaagagcagcttcttcagcagccccccctacttcgaggactag

SEQ ID NO: 100795 - DNA, 276 bp, Artificial Sequence
  Description of Artificial Sequence: Synthetic coding sequence
atgggcaacagcatgaagagcacccccgcccccgccgagagacccctgcccaaccccgagggcctggacagcgacttcctggccgtgctgagcgactaccccagccccgacatcagcccccccatcttcagaagaggcgagaagctgagagtgatcagcgacgagggcggctggtggaaggccatcagcctgagcaccggcagagagagctacatccccggcatctgcgtggccagagtgtaccacggctggctgttcgagggcctgggcagatag

SEQ ID NO: 100796 - DNA, 45 bp, Artificial Sequence
  Description of Artificial Sequence: Synthetic coding sequence
atgggcaacagcatgaagagcacccccgcccccgccgagagatag

SEQ ID NO: 100797 - DNA, 150 bp, Artificial Sequence
  Description of Artificial Sequence: Synthetic coding sequence
atgggcaacagcatgaagagcacccccgcccccgccgagagacccctgcccaaccccgagggcctggacagcgacttcctggccgtgctgagcgactaccccagccccgacatcagcccccccatcttcagaagaggcgagaagctgtag

SEQ ID NO: 100798 - DNA, 477 bp, Artificial Sequence
  Description of Artificial Sequence: Synthetic coding sequence
atgggcaacagcatgaagagcacccccgcccccgccgagagacccctgcccaaccccgagggcctggacagcgacttcctggccgtgctgagcgactaccccagccccgacatcagcccccccatcttcagaagaggcgagaagctgagagtgatcagcgacgagggcggctggtggaaggccatcagcctgagcaccggcagagagagctacatccccggcatctgcgtggccagagtgtaccacggctggctgttcgagggcctgggcagagacaaggccgaggagctgctgcagctgcccgacaccaaggtgggcagcttcatgatcagagagagcgagaccaagaagggcttctacagcctgagcgtgagacacagacaggtgaagcactacagaatcttcagactgcccaacaactggtactacatcagccccagactgaccttccagtgcctggaggacctggtgaactag

SEQ ID NO: 100799 - DNA, 123 bp, Artificial Sequence
  Description of Artificial Sequence: Synthetic coding sequence
atgggcaacagcatgaagagcacccccgcccccgccgagagacccctgcccaaccccgagggcctggacagcgacttcctggccgtgctgagcgactaccccagccccgacatcagcccctag

SEQ ID NO: 100800 - DNA, 786 bp, Artificial Sequence
  Description of Artificial Sequence: Synthetic coding sequence
atgggcagcctgcccagcagaagaaagagcctgcccagccccagcctgagcagcagcgtgcagggccagggccccgtgaccatggaggccgagagaagcaaggccaccgccgtggccctgggcagcttccccgccggcggccccgccgagctgagcctgagactgggcgagcccctgaccatcgtgagcgaggacggcgactggtggaccgtgctgagcgaggtgagcggcagagagtacaacatccccagcgtgcacgtggccaaggtgagccacggctggctgtacgagggcctgagcagagagaaggccgaggagctgctgctgctgcccggcaaccccggcggcgccttcctgatcagagagagccagaccagaagaggcagctacagcctgagcgtgagactgagcagacccgccagctgggacagaatcagacactacagaatccactgcctggacaacggctggctgtacatcagccccagactgaccttccccagcctgcaggccctggtggaccactacagcgagctggccgacgacatctgctgcctgctgaaggagccctgcgtgctgcagagagccggccccctgcccggcaaggacatccccctgcccgtgaccgtgcagagaacccccctgaactggaaggagctggacagcagcctgctgttcagcgaggccgccaccggcgaggagagcctgctgagcgagggcctgagagagagcctgagcttctacatcagcctgaacgacgaggccgtgagcctggacgacgcctag

SEQ ID NO: 100801 - DNA, 633 bp, Artificial Sequence
  Description of Artificial Sequence: Synthetic coding sequence
atgggcagcctgcccagcagaagaaagagcctgcccagccccagcctgagcagcagcgtgcagggccagggccccgtgaccatggaggccgagagaagcaaggccaccgccgtggccctgggcagcttccccgccggcggccccgccgagctgagcctgagactgggcgagcccctgaccatcgtgagcgaggacggcgactggtggaccgtgctgagcgaggtgagcggcagagagtacaacatccccagcgtgcacgtggccaaggtgagccacggctggctgtacgagggcctgagcagagagaaggccgaggagctgctgctgctgcccggcaaccccggcggcgccttcctgatcagagagagccagaccagaagaggcagctacagcctgagcgtgagactgagcagacccgccagctgggacagaatcagacactacagaatccactgcctggacaacggctggctgtacatcagccccagactgaccttccccagcctgcaggccctggtggaccactacagcgagggctggcccgccccctggcagggctacacccccacctgcgactgcgccgaggacaccacccagctggagagagccggccagctgccccccgtgttctag

SEQ ID NO: 100802 - DNA, 3840 bp, Artificial Sequence
  Description of Artificial Sequence: Synthetic coding sequence
atgaccctgaccgagagactgagagagaagatcagcagagccttctacaaccacggcctgctgtgcgccagctaccccatccccatcatcctgttcaccggcttctgcatcctggcctgctgctaccccctgctgaagctgcccctgcccggcaccggccccgtggagttcaccacccccgtgaaggactacagccccccccccgtggacagcgacagaaagcagggcgagcccaccgagcagcccgagtggtacgtgggcgcccccgtggcctacgtgcagcagatcttcgtgaagagcagcgtgttcccctggcacaagaacctgctggccgtggacgtgttcagaagccccctgagcagagccttccagctggtggaggagatcagaaaccacgtgctgagagacagcagcggcatcagaagcctggaggagctgtgcctgcaggtgaccgacctgctgcccggcctgagaaagctgagaaacctgctgcccgagcacggctgcctgctgctgagccccggcaacttctggcagaacgactgggagagattccacgccgaccccgacatcatcggcaccatccaccagcacgagcccaagaccctgcagaccagcgccaccctgaaggacctgctgttcggcgtgcccggcaagtacagcggcgtgagcctgtacaccagaaagagaatggtgagctacaccatcaccctggtgttccagcactaccacgccaagttcctgggcagcctgagagccagactgatgctgctgcaccccagccccaactgcagcctgagagccgagagcctggtgcacgtgcacttcaaggaggagatcggcgtggccgagctgatccccctggtgaccacctacatcatcctgttcgcctacatctacttcagcaccagaaagatcgacatggtgaagagcaagtggggcctggccctggccgccgtggtgaccgtgctgagcagcctgctgatgagcgtgggcctgtgcaccctgttcggcctgacccccaccctgaacggcggcgagatcttcccctacctggtggtggtgatcggcctggagaacgtgctggtgctgaccaagagcgtggtgagcacccccgtggacctggaggtgaagctgagaatcgcccagggcctgagcagcgagagctggagcatcatgaagaacatggccaccgagctgggcatcatcctgatcggctacttcaccctggtgcccgccatccaggagttctgcctgttcgccgtggtgggcctggtgagcgacttcttcctgcagatgctgttcttcaccaccgtgctgagcatcgacatcagaagaatggagctggccgacctgaacaagagactgccccccgaggcctgcctgcccagcgccaagcccgtgggccagcccaccagatacgagagacagctggccgtgagacccagcaccccccacaccatcaccctgcagcccagcagcttcagaaacctgagactgcccaagagactgagagtggtgtacttcctggccagaaccagactggcccagagactgatcatggccggcaccgtggtgtggatcggcatcctggtgtacaccgaccccgccggcctgagaaactacctggccgcccaggtgaccgagcagagccccctgggcgagggcgccctggcccccatgcccgtgcccagcggcatgctgccccccagccaccccgaccccgccttcagcatcttcccccccgacgcccccaagctgcccgagaaccagaccagccccggcgagagccccgagagaggcggccccgccgaggtggtgcacgacagccccgtgcccgaggtgacctggggccccgaggacgaggagctgtggagaaagctgagcttcagacactggcccaccctgttcagctactacaacatcaccctggccaagagatacatcagcctgctgcccgtgatccccgtgaccctgagactgaaccccagagaggccctggagggcagacacccccaggacggcagaagcgcctggcccccccccggccccatccccgccggccactgggaggccggccccaagggccccggcggcgtgcaggcccacggcgacgtgaccctgtacaaggtggccgccctgggcctggccaccggcatcgtgctggtgctgctgctgctgtgcctgtacagagtgctgtgccccagaaactacggccagctgggcggcggccccggcagaagaagaagaggcgagctgccctgcgacgactacggctacgccccccccgagaccgagatcgtgcccctggtgctgagaggccacctgatggacatcgagtgcctggccagcgacggcatgctgctggtgagctgctgcctggccggccacgtgtgcgtgtgggacgcccagaccggcgactgcctgaccagaatccccagacccggcagacagagaagagacagcggcgtgggcagcggcctggaggcccaggagagctgggagagactgagcgacggcggcaaggccggccccgaggagcccggcgacagcccccccctgagacacagacccagaggcccccccccccccagcctgttcggcgaccagcccgacctgacctgcctgatcgacaccaacttcagcgcccagcccagaagcagccagcccacccagcccgagcccagacacagagccgtgtgcggcagaagcagagacagccccggctacgacttcagctgcctggtgcagagagtgtaccaggaggagggcctggccgccgtgtgcacccccgccctgagaccccccagccccggccccgtgctgagccaggcccccgaggacgagggcggcagccccgagaagggcagccccagcctggcctgggcccccagcgccgagggcagcatctggagcctggagctgcagggcaacctgatcgtggtgggcagaagcagcggcagactggaggtgtgggacgccatcgagggcgtgctgtgctgcagcagcgaggaggtgagcagcggcatcaccgccctggtgttcctggacaagagaatcgtggccgccagactgaacggcagcctggacttcttcagcctggagacccacaccgccctgagccccctgcagttcagaggcacccccggcagaggcagcagccccgccagccccgtgtacagcagcagcgacaccgtggcctgccacctgacccacaccgtgccctgcgcccaccagaagcccatcaccgccctgaaggccgccgccggcagactggtgaccggcagccaggaccacaccctgagagtgttcagactggaggacagctgctgcctgttcaccctgcagggccacagcggcgccatcaccaccgtgtacatcgaccagaccatggtgctggccagcggcggccaggacggcgccatctgcctgtgggacgtgctgaccggcagcagagtgagccacgtgttcgcccacagaggcgacgtgaccagcctgacctgcaccaccagctgcgtgatcagcagcggcctggacgacctgatcagcatctgggacagaagcaccggcatcaagttctacagcatccagcaggacctgggctgcggcgccagcctgggcgtgatcagcgacaacctgctggtgaccggcggccagggctgcgtgagcttctgggacctgaactacggcgacctgctgcagaccgtgtacctgggcaagaacagcgaggcccagcccgccagacagatcctggtgctggacaacgccgccatcgtgtgcaacttcggcagcgagctgagcctggtgtacgtgcccagcgtgctggagaagctggactag

SEQ ID NO: 100803 - DNA, 2316 bp, Artificial Sequence
  Description of Artificial Sequence: Synthetic coding sequence
atgaccctgaccgagagactgagagagaagatcagcagagccttctacaaccacggcctgctgtgcgccagctaccccatccccatcatcctgttcaccggcttctgcatcctggcctgctgctaccccctgctgaagctgcccctgcccggcaccggccccgtggagttcaccacccccgtgaaggactacagccccccccccgtggacagcgacagaaagcagggcgagcccaccgagcagcccgagtggtacgtgggcgcccccgtggcctacgtgcagcagatcttcgtgaagagcagcgtgttcccctggcacaagaacctgctggccgtggacgtgttcagaagccccctgagcagagccttccagctggtggaggagatcagaaaccacgtgctgagagacagcagcggcatcagaagcctggaggagctgtgcctgcaggtgaccgacctgctgcccggcctgagaaagctgagaaacctgctgcccgagcacggctgcctgctgctgagccccggcaacttctggcagaacgactgggagagattccacgccgaccccgacatcatcggcaccatccaccagcacgagcccaagaccctgcagaccagcgccaccctgaaggacctgctgttcggcgtgcccggcaagtacagcggcgtgagcctgtacaccagaaagagaatggtgagctacaccatcaccctggtgttccagcactaccacgccaagttcctgggcagcctgagagccagactgatgctgctgcaccccagccccaactgcagcctgagagccgagagcctggtgcacgtgcacttcaaggaggagatcggcgtggccgagctgatccccctggtgaccacctacatcatcctgttcgcctacatctacttcagcaccagaaagatcgacatggtgaagagcaagtggggcctggccctggccgccgtggtgaccgtgctgagcagcctgctgatgagcgtgggcctgtgcaccctgttcggcctgacccccaccctgaacggcggcgagatcttcccctacctggtggtggtgatcggcctggagaacgtgctggtgctgaccaagagcgtggtgagcacccccgtggacctggaggtgaagctgagaatcgcccagggcctgagcagcgagagctggagcatcatgaagaacatggccaccgagctgggcatcatcctgatcggctacttcaccctggtgcccgccatccaggagttctgcctgttcgccgtggtgggcctggtgagcgacttcttcctgcagatgctgttcttcaccaccgtgctgagcatcgacatcagaagaatggagctggccgacctgaacaagagactgccccccgaggcctgcctgcccagcgccaagcccgtgggccagcccaccagatacgagagaagcagcggcagactggaggtgtgggacgccatcgagggcgtgctgtgctgcagcagcgaggaggtgagcagcggcatcaccgccctggtgttcctggacaagagaatcgtggccgccagactgaacggcagcctggacttcttcagcctggagacccacaccgccctgagccccctgcagttcagaggcacccccggcagaggcagcagccccgccagccccgtgtacagcagcagcgacaccgtggcctgccacctgacccacaccgtgccctgcgcccaccagaagcccatcaccgccctgaaggccgccgccggcagactggtgaccggcagccaggaccacaccctgagagtgttcagactggaggacagctgctgcctgttcaccctgcagggccacagcggcgccatcaccaccgtgtacatcgaccagaccatggtgctggccagcggcggccaggacggcgccatctgcctgtgggacgtgctgaccggcagcagagtgagccacgtgttcgcccacagaggcgacgtgaccagcctgacctgcaccaccagctgcgtgatcagcagcggcctggacgacctgatcagcatctgggacagaagcaccggcatcaagttctacagcatccagcaggacctgggctgcggcgccagcctgggcgtgatcagcgacaacctgctggtgaccggcggccagggctgcgtgagcttctgggacctgaactacggcgacctgctgcagaccgtgtacctgggcaagaacagcgaggcccagcccgccagacagatcctggtgctggacaacgccgccatcgtgtgcaacttcggcagcgagctgagcctggtgtacgtgcccagcgtgctggagaagctggactag

SEQ ID NO: 100804 - DNA, 2718 bp, Artificial Sequence
  Description of Artificial Sequence: Synthetic coding sequence
atgaccctgaccgagagactgagagagaagatcagcagagccttctacaaccacggcctgctgtgcgccagctaccccatccccatcatcctgatcggctacttcaccctggtgcccgccatccaggagttctgcctgttcgccgtggtgggcctggtgagcgacttcttcctgcagatgctgttcttcaccaccgtgctgagcatcgacatcagaagaatggagctggccgacctgaacaagagactgccccccgaggcctgcctgcccagcgccaagcccgtgggccagcccaccagatacgagagacagctggccgtgagacccagcaccccccacaccatcaccctgcagcccagcagcttcagaaacctgagactgcccaagagactgagagtggtgtacttcctggccagaaccagactggcccagagactgatcatggccggcaccgtggtgtggatcggcatcctggtgtacaccgaccccgccggcctgagaaactacctggccgcccaggtgaccgagcagagccccctgggcgagggcgccctggcccccatgcccgtgcccagcggcatgctgccccccagccaccccgaccccgccttcagcatcttcccccccgacgcccccaagctgcccgagaaccagaccagccccggcgagagccccgagagaggcggccccgccgaggtggtgcacgacagccccgtgcccgaggtgacctggggccccgaggacgaggagctgtggagaaagctgagcttcagacactggcccaccctgttcagctactacaacatcaccctggccaagagatacatcagcctgctgcccgtgatccccgtgaccctgagactgaaccccagagaggccctggagggcagacacccccaggacggcagaagcgcctggcccccccccggccccatccccgccggccactgggaggccggccccaagggccccggcggcgtgcaggcccacggcgacgtgaccctgtacaaggtggccgccctgggcctggccaccggcatcgtgctggtgctgctgctgctgtgcctgtacagagtgctgtgccccagaaactacggccagctgggcggcggccccggcagaagaagaagaggcgagctgccctgcgacgactacggctacgccccccccgagaccgagatcgtgcccctggtgctgagaggccacctgatggacatcgagtgcctggccagcgacggcatgctgctggtgagctgctgcctggccggccacgtgtgcgtgtgggacgcccagaccggcgactgcctgaccagaatccccagacccggccagagaagagacagcggcgtgggcagcggcctggaggcccaggagagctgggagagactgagcgacggcggcaaggccggccccgaggagcccggcgacagcccccccctgagacacagacccagaggcccccccccccccagcctgttcggcgaccagcccgacctgacctgcctgatcgacaccaacttcagcgcccagcccagaagcagccagcccacccagcccgagcccagacacagagccgtgtgcggcagaagcagagacagccccggctacgacttcagctgcctggtgcagagagtgtaccaggaggagggcctggccgccgtgtgcacccccgccctgagaccccccagccccggccccgtgctgagccaggcccccgaggacgagggcggcagccccgagaagggcagccccagcctggcctgggcccccagcgccgagggcagcatctggagcctggagctgcagggcaacctgatcgtggtgggcagaagcagcggcagactggaggtgtgggacgccatcgagggcgtgctgtgctgcagcagcgaggaggtgagcagcggcatcaccgccctggtgttcctggacaagagaatcgtggccgccagactgaacggcagcctggacttcttcagcctggagacccacaccgccctgagccccctgcagttcagaggcacccccggcagaggcagcagccccgccagccccgtgtacagcagcagcgacaccgtggcctgccacctgacccacaccgtgccctgcgcccaccagaagcccatcaccgccctgaaggccgccgccggcagactggtgaccggcagccaggaccacaccctgagagtgttcagactggaggacagctgctgcctgttcaccctgcagggccacagcggcgccatcaccaccgtgtacatcgaccagaccatggtgctggccagcggcggccaggacggcgccatctgcctgtgggacgtgctgaccggcagcagagtgagccacgtgttcgcccacagaggcgacgtgaccagcctgacctgcaccaccagctgcgtgatcagcagcggcctggacgacctgatcagcatctgggacagaagcaccggcatcaagttctacagcatccagcaggacctgggctgcggcgccagcctgggcgtgatcagcgacaacctgctggtgaccggcggccagggctgcgtgagcttctgggacctgaactacggcgacctgctgcagaccgtgtacctgggcaagaacagcgaggcccagcccgccagacagatcctggtgctggacaacgccgccatcgtgtgcaacttcggcagcgagctgagcctggtgtacgtgcccagcgtgctggagaagctggactag

SEQ ID NO: 100805 - DNA, 1059 bp, Artificial Sequence
  Description of Artificial Sequence: Synthetic coding sequence
atggtgaagagcaagtggggcctggccctggccgccgtggtgaccgtgctgagcagcctgctgatgagcgtgggcctgtgcaccctgttcggcctgacccccaccctgaacggcggcgagatcttcccctacctggtggtggtgatcggcctggagaacgtgctggtgctgaccaagagcgtggtgagcacccccgtggacctggaggtgaagctgagaatcgcccagggcctgagcagcgagagctggagcatcatgaagaacatggccaccgagctgggcatcatcctgatcggctacttcaccctggtgcccgccatccaggagttctgcctgttcgccgtggtgggcctggtgagcgacttcttcctgcagatgctgttcttcaccaccgtgctgagcatcgacatcagaagaatggagctggccgacctgaacaagagactgccccccgaggcctgcctgcccagcgccaagcccgtgggccagcccaccagatacgagagacagctggccgtgagacccagcaccccccacaccatcaccctgcagcccagcagcttcagaaacctgagactgcccaagagactgagagtggtgtacttcctggcccccaccggcgcccacacctgctgggccctgggcagcagaacccagggccccagatggggcgccggcccctggagaagacacgccgtgcagggcggcggcgccggccccggccacagacacagactgggcgccgccgccgccctgcccctgcccagagccatgcccgcccagctgagagccgccggctggtgggccagagccgccgaggccagaggcgccgccctgagaagactgagactgtgcgccaccagagacggcgacagagccgcctgcgccgccagacccccccacggccacagagtgcccggccagagaagacacgccgccggcgagctgctgcccggcagacccagactgagagtgggcagagccgacagaggcctgcccaacgcccacagcgcccccagacaggccgcccccggccagtggagaggccagagagcctag

SEQ ID NO: 100806 - DNA, 411 bp, Artificial Sequence
  Description of Artificial Sequence: Synthetic coding sequence
atgaccctgaccgagagactgagagagaagatcagcagagccttctacaaccacggcctgctgtgcgccagctaccccatccccatcatcctgttcaccggcttctgcatcctggcctgctgctaccccctgctgaagctgcccctgcccggcaccggccccgtggagttcaccacccccgtgaaggactacagccccccccccgtggacagcgacagaaagcagggcgagcccaccgagcagcccgagtggtacgtgggcgcccccgtggcctacgtgcagcagatcttcgtgaagagcagcgtgttcccctggcacaagaacctgctggccgtggacgtgttcagaagccccctgagcagagccttccagctggtggaggagatcagaaaccacgtgctgagagactag

SEQ ID NO: 100807 - DNA, 3072 bp, Artificial Sequence
  Description of Artificial Sequence: Synthetic coding sequence
atgctgctgcaccccagccccaactgcagcctgagagccgagagcctggtgcacgtgcacttcaaggaggagatcggcgtggccgagctgatccccctggtgaccacctacatcatcctgttcgcctacatctacttcagcaccagaaagatcgacatggtgaagagcaagtggggcctggccctggccgccgtggtgaccgtgctgagcagcctgctgatgagcgtgggcctgtgcaccctgttcggcctgacccccaccctgaacggcggcgagatcttcccctacctggtggtggtgatcggcctggagaacgtgctggtgctgaccaagagcgtggtgagcacccccgtggacctggaggtgaagctgagaatcgcccagggcctgagcagcgagagctggagcatcatgaagaacatggccaccgagctgggcatcatcctgatcggctacttcaccctggtgcccgccatccaggagttctgcctgttcgccgtggtgggcctggtgagcgacttcttcctgcagatgctgttcttcaccaccgtgctgagcatcgacatcagaagaatggagctggccgacctgaacaagagactgccccccgaggcctgcctgcccagcgccaagcccgtgggccagcccaccagatacgagagacagctggccgtgagacccagcaccccccacaccatcaccctgcagcccagcagcttcagaaacctgagactgcccaagagactgagagtggtgtacttcctggccagaaccagactggcccagagactgatcatggccggcaccgtggtgtggatcggcatcctggtgtacaccgaccccgccggcctgagaaactacctggccgcccaggtgaccgagcagagccccctgggcgagggcgccctggcccccatgcccgtgcccagcggcatgctgccccccagccaccccgaccccgccttcagcatcttcccccccgacgcccccaagctgcccgagaaccagaccagccccggcgagagccccgagagaggcggccccgccgaggtggtgcacgacagccccgtgcccgaggtgacctggggccccgaggacgaggagctgtggagaaagctgagcttcagacactggcccaccctgttcagctactacaacatcaccctggccaagagatacatcagcctgctgcccgtgatccccgtgaccctgagactgaaccccagagaggccctggagggcagacacccccaggacggcagaagcgcctggcccccccccggccccatccccgccggccactgggaggccggccccaagggccccggcggcgtgcaggcccacggcgacgtgaccctgtacaaggtggccgccctgggcctggccaccggcatcgtgctggtgctgctgctgctgtgcctgtacagagtgctgtgccccagaaactacggccagctgggcggcggccccggcagaagaagaagaggcgagctgccctgcgacgactacggctacgccccccccgagaccgagatcgtgcccctggtgctgagaggccacctgatggacatcgagtgcctggccagcgacggcatgctgctggtgagctgctgcctggccggccacgtgtgcgtgtgggacgcccagaccggcgactgcctgaccagaatccccagacccggccagagaagagacagcggcgtgggcagcggcctggaggcccaggagagctgggagagactgagcgacggcggcaaggccggccccgaggagcccggcgacagcccccccctgagacacagacccagaggcccccccccccccagcctgttcggcgaccagcccgacctgacctgcctgatcgacaccaacttcagcgcccagcccagaagcagccagcccacccagcccgagcccagacacagagccgtgtgcggcagaagcagagacagccccggctacgacttcagctgcctggtgcagagagtgtaccaggaggagggcctggccgccgtgtgcacccccgccctgagaccccccagccccggccccgtgctgagccaggcccccgaggacgagggcggcagccccgagaagggcagccccagcctggcctgggcccccagcgccgagggcagcatctggagcctggagctgcagggcaacctgatcgtggtgggcagaagcagcggcagactggaggtgtgggacgccatcgagggcgtgctgtgctgcagcagcgaggaggtgagcagcggcatcaccgccctggtgttcctggacaagagaatcgtggccgccagactgaacggcagcctggacttcttcagcctggagacccacaccgccctgagccccctgcagttcagaggcacccccggcagaggcagcagccccgccagccccgtgtacagcagcagcgacaccgtggcctgccacctgacccacaccgtgccctgcgcccaccagaagcccatcaccgccctgaaggccgccgccggcagactggtgaccggcagccaggaccacaccctgagagtgttcagactggaggacagctgctgcctgttcaccctgcagggccacagcggcgccatcaccaccgtgtacatcgaccagaccatggtgctggccagcggcggccaggacggcgccatctgcctgtgggacgtgctgaccggcagcagagtgagccacgtgttcgcccacagaggcgacgtgaccagcctgacctgcaccaccagctgcgtgatcagcagcggcctggacgacctgatcagcatctgggacagaagcaccggcatcaagttctacagcatccagcaggacctgggctgcggcgccagcctgggcgtgatcagcgacaacctgctggtgaccggcggccagggctgcgtgagcttctgggacctgaactacggcgacctgctgcagaccgtgtacctgggcaagaacagcgaggcccagcccgccagacagatcctggtgctggacaacgccgccatcgtgtgcaacttcggcagcgagctgagcctggtgtacgtgcccagcgtgctggagaagctggactag

SEQ ID NO: 100808 - DNA, 267 bp, Artificial Sequence
  Description of Artificial Sequence: Synthetic coding sequence
atgaccctgaccgagagactgagagagaagatcagcagagccttctacaaccacggcctgctgtgcgccagctaccccatccccatcatcctgttcaccggcttctgcatcctggcctgctgctaccccctgctgaagctgcccctgcccggcaccggccccgtggagttcaccacccccgtgaaggactacagccccccccccgtggacagcgacagaaagcagggcgagcccaccgagcagcccgagtgggtgggcaccagatag

SEQ ID NO: 100809 - DNA, 399 bp, Artificial Sequence
  Description of Artificial Sequence: Synthetic coding sequence
atgaccctgaccgagagactgagagagaagatcagcagagccttctacaaccacggcctgctgtgcgccagctaccccatccccatcatcctgttcaccggcttctgcatcctggcctgctgctaccccctgctgaagctgcccctgcccggcaccggccccgtggagttcaccacccccgtgaaggactacagccccccccccgtggacagcgacagaaagcagggcgagcccaccgagcagcccgagtggtacgtgggcgcccccgtggcctacgtgcagcagatcttcgtgaagagcagcgtgttcccctggcacaagaacctgctggccgtggacgtgttcagaagccccctgagcagagccttccagctggtggaggagatcagaaaccactag

SEQ ID NO: 100810 - DNA, 2661 bp, Artificial Sequence
  Description of Artificial Sequence: Synthetic coding sequence
atgaagaacatggccaccgagctgggcatcatcctgatcggctacttcaccctggtgcccgccatccaggagttctgcctgttcgccgtggtgggcctggtgagcgacttcttcctgcagatgctgttcttcaccaccgtgctgagcatcgacatcagaagaatggagctggccgacctgaacaagagactgccccccgaggcctgcctgcccagcgccaagcccgtgggccagcccaccagatacgagagacagctggccgtgagacccagcaccccccacaccatcaccctgcagcccagcagcttcagaaacctgagactgcccaagagactgagagtggtgtacttcctggccagaaccagactggcccagagactgatcatggccggcaccgtggtgtggatcggcatcctggtgtacaccgaccccgccggcctgagaaactacctggccgcccaggtgaccgagcagagccccctgggcgagggcgccctggcccccatgcccgtgcccagcggcatgctgccccccagccaccccgaccccgccttcagcatcttcccccccgacgcccccaagctgcccgagaaccagaccagccccggcgagagccccgagagaggcggccccgccgaggtggtgcacgacagccccgtgcccgaggtgacctggggccccgaggacgaggagctgtggagaaagctgagcttcagacactggcccaccctgttcagctactacaacatcaccctggccaagagatacatcagcctgctgcccgtgatccccgtgaccctgagactgaaccccagagaggccctggagggcagacacccccaggacggcagaagcgcctggcccccccccggccccatccccgccggccactgggaggccggccccaagggccccggcggcgtgcaggcccacggcgacgtgaccctgtacaaggtggccgccctgggcctggccaccggcatcgtgctggtgctgctgctgctgtgcctgtacagagtgctgtgccccagaaactacggccagctgggcggcggccccggcagaagaagaagaggcgagctgccctgcgacgactacggctacgccccccccgagaccgagatcgtgcccctggtgctgagaggccacctgatggacatcgagtgcctggccagcgacggcatgctgctggtgagctgctgcctggccggccacgtgtgcgtgtgggacgcccagaccggcgactgcctgaccagaatccccagacccggccagagaagagacagcggcgtgggcagcggcctggaggcccaggagagctgggagagactgagcgacggcggcaaggccggccccgaggagcccggcgacagcccccccctgagacacagacccagaggcccccccccccccagcctgttcggcgaccagcccgacctgacctgcctgatcgacaccaacttcagcgcccagcccagaagcagccagcccacccagcccgagcccagacacagagccgtgtgcggcagaagcagagacagccccggctacgacttcagctgcctggtgcagagagtgtaccaggaggagggcctggccgccgtgtgcacccccgccctgagaccccccagccccggccccgtgctgagccaggcccccgaggacgagggcggcagccccgagaagggcagccccagcctggcctgggcccccagcgccgagggcagcatctggagcctggagctgcagggcaacctgatcgtggtgggcagaagcagcggcagactggaggtgtgggacgccatcgagggcgtgctgtgctgcagcagcgaggaggtgagcagcggcatcaccgccctggtgttcctggacaagagaatcgtggccgccagactgaacggcagcctggacttcttcagcctggagacccacaccgccctgagccccctgcagttcagaggcacccccggcagaggcagcagccccgccagccccgtgtacagcagcagcgacaccgtggcctgccacctgacccacaccgtgccctgcgcccaccagaagcccatcaccgccctgaaggccgccgccggcagactggtgaccggcagccaggaccacaccctgagagtgttcagactggaggacagctgctgcctgttcaccctgcagggccacagcggcgccatcaccaccgtgtacatcgaccagaccatggtgctggccagcggcggccaggacggcgccatctgcctgtgggacgtgctgaccggcagcagagtgagccacgtgttcgcccacagaggcgacgtgaccagcctgacctgcaccaccagctgcgtgatcagcagcggcctggacgacctgatcagcatctgggacagaagcaccggcatcaagttctacagcatccagcaggacctgggctgcggcgccagcctgggcgtgatcagcgacaacctgctggtgaccggcggccagggctgcgtgagcttctgggacctgaactacggcgacctgctgcagaccgtgtacctgggcaagaacagcgaggcccagcccgccagacagatcctggtgctggacaacgccgccatcgtgtgcaacttcggcagcgagctgagcctggtgtacgtgcccagcgtgctggagaagctggactag

SEQ ID NO: 100811 - DNA, 792 bp, Artificial Sequence
  Description of Artificial Sequence: Synthetic coding sequence
atgctgctggcctgggtgcaggccttcctggtgagcaacatgctgctggccgaggcctacggcagcggcggctgcttctgggacaacggccacctgtacagagaggaccagaccagccccgcccccggcctgagatgcctgaactggctggacgcccagagcggcctggccagcgcccccgtgagcggcgccggcaaccacagctactgcagaaaccccgacgaggaccccagaggcccctggtgctacgtgagcggcgaggccggcgtgcccgagaagagaccctgcgaggacctgagatgccccgagaccaccagccaggccctgcccgccttcaccaccgagatccaggaggccagcgagggccccggcgccgacgaggtgcaggtgttcgcccccgccaacgccctgcccgccagaagcgaggccgccgccgtgcagcccgtgatcggcatcagccagagagtgagaatgaacagcaaggagaagaaggacctgggcaccctgggctacgtgctgggcatcaccatgatggtgatcatcatcgccatcggcgccggcatcatcctgggctacagctacaagagaggcaaggacctgaaggagcagcacgaccagaaggtgtgcgagagagagatgcagagaatcaccctgcccctgagcgccttcaccaaccccacctgcgagatcgtggacgagaagaccgtggtggtgcacaccagccagacccccgtggacccccaggagggcaccacccccctgatgggccaggccggcacccccggcgcctag

SEQ ID NO: 100812 - DNA, 1176 bp, Artificial Sequence
  Description of Artificial Sequence: Synthetic coding sequence
atgtacagcatgatgatggagaccgacctgcacagccccggcggcgcccaggcccccaccaacctgagcggccccgccggcgccggcggcggcggcggcggcggcggcggcggcggcggcggcggcggcgccaaggccaaccaggacagagtgaagagacccatgaacgccttcatggtgtggagcagaggccagagaagaaagatggcccaggagaaccccaagatgcacaacagcgagatcagcaagagactgggcgccgagtggaaggtgatgagcgaggccgagaagagacccttcatcgacgaggccaagagactgagagccctgcacatgaaggagcaccccgactacaagtacagacccagaagaaagaccaagaccctgctgaagaaggacaagtacagcctggccggcggcctgctggccgccggcgccggcggcggcggcgccgccgtggccatgggcgtgggcgtgggcgtgggcgccgccgccgtgggccagagactggagagccccggcggcgccgccggcggcggctacgcccacgtgaacggctgggccaacggcgcctaccccggcagcgtggccgccgccgccgccgccgccgccatgatgcaggaggcccagctggcctacggccagcaccccggcgccggcggcgcccacccccacgcccaccccgcccacccccacccccaccacccccacgcccacccccacaacccccagcccatgcacagatacgacatgggcgccctgcagtacagccccatcagcaacagccagggctacatgagcgccagccccagcggctacggcggcctgccctacggcgccgccgccgccgccgccgccgccgccggcggcgcccaccagaacagcgccgtggccgccgccgccgccgccgccgccgccagcagcggcgccctgggcgccctgggcagcctggtgaagagcgagcccagcggcagcccccccgcccccgcccacagcagagccccctgccccggcgacctgagagagatgatcagcatgtacctgcccgccggcgagggcggcgaccccgccgccgccgccgccgccgccgcccagagcagactgcacagcctgccccagcactaccagggcgccggcgccggcgtgaacggcaccgtgcccctgacccacatctag

SEQ ID NO: 100813 - DNA, 1326 bp, Artificial Sequence
  Description of Artificial Sequence: Synthetic coding sequence
atggtgcagcaggccgagagcctggaggccgagagcaacctgcccagagaggccctggacaccgaggagggcgagttcatggcctgcagccccgtggccctggacgagagcgaccccgactggtgcaagaccgccagcggccacatcaagagacccatgaacgccttcatggtgtggagcaagatcgagagaagaaagatcatggagcagagccccgacatgcacaacgccgagatcagcaagagactgggcaagagatggaagatgctgaaggacagcgagaagatccccttcatcagagaggccgagagactgagactgaagcacatggccgactaccccgactacaagtacagacccagaaagaagcccaagatggaccccagcgccaagcccagcgccagccagagccccgagaagagcgccgccggcggcggcggcggcagcgccggcggcggcgccggcggcgccaagaccagcaagggcagcagcaagaagtgcggcaagctgaaggcccccgccgccgccggcgccaaggccggcgccggcaaggccgcccagagcggcgactacggcggcgccggcgacgactacgtgctgggcagcctgagagtgagcggcagcggcggcggcggcgccggcaagaccgtgaagtgcgtgttcctggacgaggacgacgacgacgacgacgacgacgacgagctgcagctgcagatcaagcaggagcccgacgaggaggacgaggagcccccccaccagcagctgctgcagccccccggccagcagcccagccagctgctgagaagatacaacgtggccaaggtgcccgccagccccaccctgagcagcagcgccgagagccccgagggcgccagcctgtacgacgaggtgagagccggcgccaccagcggcgccggcggcggcagcagactgtactacagcttcaagaacatcaccaagcagcaccccccccccctggcccagcccgccctgagccccgccagcagcagaagcgtgagcaccagcagcagcagcagcagcggcagcagcagcggcagcagcggcgaggacgccgacgacctgatgttcgacctgagcctgaacttcagccagagcgcccacagcgccagcgagcagcagctgggcggcggcgccgccgccggcaacctgagcctgagcctggtggacaaggacctggacagcttcagcgagggcagcctgggcagccacttcgagttccccgactactgcacccccgagctgagcgagatgatcgccggcgactggctggaggccaacttcagcgacctggtgttcacctactag

SEQ ID NO: 100814 - DNA, 948 bp, Artificial Sequence
  Description of Artificial Sequence: Synthetic coding sequence
atggtgcagcagagaggcgccagagccaagagagacggcggcccccccccccccggccccggccccgccgaggagggcgccagagagcccggctggtgcaagacccccagcggccacatcaagagacccatgaacgccttcatggtgtggagccagcacgagagaagaaagatcatggaccagtggcccgacatgcacaacgccgagatcagcaagagactgggcagaagatggcagctgctgcaggacagcgagaagatccccttcgtgagagaggccgagagactgagactgaagcacatggccgactaccccgactacaagtacagacccagaaagaagagcaagggcgcccccgccaaggccagacccagaccccccggcggcagcggcggcggcagcagactgaagcccggcccccagctgcccggcagaggcggcagaagagccgccggcggccccctgggcggcggcgccgccgcccccgaggacgacgacgaggacgacgacgaggagctgctggaggtgagactggtggagacccccggcagagagctgtggagaatggtgcccgccggcagagccgccagaggccaggccgagagagcccagggccccagcggcgagggcgccgccgccgccgccgccgccagccccacccccagcgaggacgaggagcccgaggaggaggaggaggaggccgccgccgccgaggagggcgaggaggagaccgtggccagcggcgaggagagcctgggcttcctgagcagactgccccccggccccgccggcctggactgcagcgccctggacagagaccccgacctgcagccccccagcggcaccagccacttcgagttccccgactactgcacccccgaggtgaccgagatgatcgccggcgactggagacccagcagcatcgccgacctggtgttcacctactag

SEQ ID NO: 100815 - DNA, 948 bp, Artificial Sequence; identical to SEQ ID NO: 100814
  Description of Artificial Sequence: Synthetic coding sequence

SEQ ID NO: 100816 - DNA, 1869 bp, Artificial Sequence
  Description of Artificial Sequence: Synthetic coding sequence
atgagcatgagaagccccatcagcgcccagctggccctggacggcgtgggcaccatggtgaactgcaccatcaagagcgaggagaagaaggagccctgccacgaggccccccagggcagcgccaccgccgccgagccccagcccggcgaccccgccagagccagccaggacagcgccgacccccaggcccccgcccagggcaacttcagaggcagctgggactgcagcagccccgagggcaacggcagccccgagcccaagagacccggcgtgagcgaggccgccagcggcagccaggagaagctggacttcaacagaaacctgaaggaggtggtgcccgccatcgagaagctgctgagcagcgactggaaggagagattcctgggcagaaacagcatggaggccaaggacgtgaagggcacccaggagagcctggccgagaaggagctgcagctgctggtgatgatccaccagctgagcaccctgagagaccagctgctgaccgcccacagcgagcagaagaacatggccgccatgctgttcgagaagcagcagcagcagatggagctggccagacagcagcaggagcagatcgccaagcagcagcagcagctgatccagcagcagcacaagatcaacctgctgcagcagcagatccagcaggtgaacatgccctacgtgatgatccccgccttcccccccagccaccagcccctgcccgtgacccccgacagccagctggccctgcccatccagcccatcccctgcaagcccgtggagtaccccctgcagctgctgcacagcccccccgcccccgtggtgaagagacccggcgccatggccacccaccaccccctgcaggagcccagccagcccctgaacctgaccgccaagcccaaggcccccgagctgcccaacaccagcagcagccccagcctgaagatgagcagctgcgtgcccagaccccccagccacggcggccccaccagagacctgcagagcagcccccccagcctgcccctgggcttcctgggcgagggcgacgccgtgaccaaggccatccaggacgccagacagctgctgcacagccacagcggcgccctggacggcagccccaacacccccttcagaaaggacctgatcagcctggacagcagccccgccaaggagagactggaggacggctgcgtgcaccccctggaggaggccatgctgagctgcgacatggacggcagcagacacttccccgagagcagaaacagcagccacatcaagagacccatgaacgccttcatggtgtgggccaaggacgagagaagaaagatcctgcaggccttccccgacatgcacaacagcagcatcagcaagatcctgggcagcagatggaagagcatgaccaaccaggagaagcagccctactacgaggagcaggccagactgagcagacagcacctggagaagtaccccgactacaagtacaagcccagacccaagagaacctgcatcgtggagggcaagagactgagagtgggcgagtacaaggccctgatgagaaccagaagacaggacgccagacagagctacgtgatccccccccaggccggccaggtgcagatgagcagcagcgacgtgctgtaccccagagccgccggcatgcccctggcccagcccctggtggagcactacgtgcccagaagcctggaccccaacatgcccgtgatcgtgaacacctgcagcctgagagaggagggcgagggcaccgacgacagacacagcgtggccgacggcgagatgtacagatacagcgaggacgaggacagcgagggcgaggagaagagcgacggcgagctggtggtgctgaccgactag

SEQ ID NO: 100817 - DNA, 174 bp, Artificial Sequence
  Description of Artificial Sequence: Synthetic coding sequence
atgagcatgagaagccccatcagcgcccagctggccctggacggcgtgggcaccatggtgaactgcaccatcaagagcgaggagaagaaggagccctgccacgaggccccccagggcagcgccaccgccgccgagccccagcccggcgaccccgccagagccagccaggactag

SEQ ID NO: 100818 - DNA, 543 bp, Artificial Sequence
  Description of Artificial Sequence: Synthetic coding sequence
atgagcatgagaagccccatcagcgcccagctggccctggacggcgtgggcaccatggtgaactgcaccatcaagagcgaggagaagaaggagccctgccacgaggccccccagggcagcgccaccgccgccgagccccagcccggcgaccccgccagagccagccaggacagcgccgacccccaggcccccgcccagggcaacttcagaggcagctgggactgcagcagccccgagggcaacggcagccccgagcccaagagacccggcgtgagcgaggccgccagcggcagccaggagaagctggacttcaacagaaacctgaaggaggtggtgcccgccatcgagaagctgctgagcagcgactggaaggagagattcctgggcagaaacagcatggaggccaaggacgtgaagggcacccaggagagcctggccgagaaggagctgcagctgctggtgatgatccaccagctgagcaccctgagagaccagctgctgaccgcccacagcgagcagaagaacatggccgccatgctgtag

SEQ ID NO: 100819 - DNA, 723 bp, Artificial Sequence
  Description of Artificial Sequence: Synthetic coding sequence
atgagcaagcccagcgaccacatcaagagacccatgaacgccttcatggtgtggagcagaggccagagaagaaagatggcccaggagaaccccaagatgcacaacagcgagatcagcaagagactgggcgccgagtggaagctgctgagcgaggccgagaagagaccctacatcgacgaggccaagagactgagagcccagcacatgaaggagcaccccgactacaagtacagacccagaagaaagcccaagaacctgctgaagaaggacagatacgtgttccccctgccctacctgggcgacaccgaccccctgaaggccgccggcctgcccgtgggcgccagcgacggcctgctgagcgcccccgagaaggccagagccttcctgccccccgccagcgccccctacagcctgctggaccccgcccagttcagcagcagcgccatccagaagatgggcgaggtgccccacaccctggccaccggcgccctgccctacgccagcaccctgggctaccagaacggcgccttcggcagcctgagctgccccagccagcacacccacacccaccccagccccaccaaccccggctacgtggtgccctgcaactgcaccgcctggagcgccagcaccctgcagccccccgtggcctacatcctgttccccggcatgaccaagaccggcatcgacccctacagcagcgcccacgccaccgccatgtag

SEQ ID NO: 100820 - DNA, 702 bp, Artificial Sequence
  Description of Artificial Sequence: Synthetic coding sequence
atggccctgcccggcagcagccaggaccaggcctggagcctggagccccccgccgccaccgccgccgccagcagcagcagcggcccccaggagagagagggcgccggcagccccgccgcccccggcaccctgcccctggagaaggtgaagagacccatgaacgccttcatggtgtggagcagcgcccagagaagacagatggcccagcagaaccccaagatgcacaacagcgagatcagcaagagactgggcgcccagtggaagctgctggacgaggacgagaagagacccttcgtggaggaggccaagagactgagagccagacacctgagagactaccccgactacaagtacagacccagaagaaaggccaagagcagcggcgccggccccagcagatgcggccagggcagaggcaacctggccagcggcggccccctgtggggccccggctacgccaccacccagcccagcagaggcttcggctacagaccccccagctacagcaccgcctacctgcccggcagctacggcagcagccactgcaagctggaggcccccagcccctgcagcctgccccagagcgaccccagactgcagggcgagctgctgcccacctacacccactacctgccccccggcagccccaccccctacaacccccccctggccggcgcccccatgcccctgacccacctgtag

SEQ ID NO: 100821 - DNA, 702 bp, Artificial Sequence; identical to SEQ ID NO: 100820
  Description of Artificial Sequence: Synthetic coding sequence

SEQ ID NO: 100822 - DNA, 1245 bp, Artificial Sequence
  Description of Artificial Sequence: Synthetic coding sequence
atgagcagccccgacgccggctacgccagcgacgaccagagccagacccagagcgccctgcccgccgtgatggccggcctgggcccctgcccctgggccgagagcctgagccccatcggcgacatgaaggtgaagggcgaggcccccgccaacagcggcgcccccgccggcgccgccggcagagccaagggcgagagcagaatcagaagacccatgaacgccttcatggtgtgggccaaggacgagagaaagagactggcccagcagaaccccgacctgcacaacgccgagctgagcaagatgctgggcaagagctggaaggccctgaccctggccgagaagagacccttcgtggaggaggccgagagactgagagtgcagcacatgcaggaccaccccaactacaagtacagacccagaagaagaaagcaggtgaagagactgaagagagtggagggcggcttcctgcacggcctggccgagccccaggccgccgccctgggccccgagggcggcagagtggccatggacggcctgggcctgcagttccccgagcagggcttccccgccggcccccccctgctgcccccccacatgggcggccactacagagactgccagagcctgggcgccccccccctggacggctaccccctgcccacccccgacaccagccccctggacggcgtggaccccgaccccgccttcttcgccgcccccatgcccggcgactgccccgccgccggcacctacagctacgcccaggtgagcgactacgccggcccccccgagccccccgccggccccatgcaccccagactgggccccgagcccgccggccccagcatccccggcctgctggccccccccagcgccctgcacgtgtactacggcgccatgggcagccccggcgccggcggcggcagaggcttccagatgcagccccagcaccagcaccagcaccagcaccagcaccacccccccggccccggccagcccagccccccccccgaggccctgccctgcagagacggcaccgaccccagccagcccgccgagctgctgggcgaggtggacagaaccgagttcgagcagtacctgcacttcgtgtgcaagcccgagatgggcctgccctaccagggccacgacagcggcgtgaacctgcccgacagccacggcgccatcagcagcgtggtgagcgacgccagcagcgccgtgtactactgcaactaccccgacgtgtag

SEQ ID NO: 100823 - DNA, 1155 bp, Artificial Sequence
  Description of Artificial Sequence: Synthetic coding sequence
atgcagagaagcccccccggctacggcgcccaggacgacccccccgccagaagagactgcgcctgggcccccggccacggcgccgccgccgacaccagaggcctggccgccggccccgccgccctggccgcccccgccgcccccgccagcccccccagcccccagagaagcccccccagaagccccgagcccggcagatacggcctgagccccgccggcagaggcgagagacaggccgccgacgagagcagaatcagaagacccatgaacgccttcatggtgtgggccaaggacgagagaaagagactggcccagcagaaccccgacctgcacaacgccgtgctgagcaagatgctgggcaaggcctggaaggagctgaacgccgccgagaagagacccttcgtggaggaggccgagagactgagagtgcagcacctgagagaccaccccaactacaagtacagacccagaagaaagaagcaggccagaaaggccagaagactggagcccggcctgctgctgcccggcctggcccccccccagcccccccccgagcccttccccgccgccagcggcagcgccagagccttcagagagctgccccccctgggcgccgagttcgacggcctgggcctgcccacccccgagagaagccccctggacggcctggagcccggcgaggccgccttcttccccccccccgccgcccccgaggactgcgccctgagacccttcagagccccctacgcccccaccgagctgagcagagaccccggcggctgctacggcgcccccctggccgaggccctgagaaccgccccccccgccgcccccctggccggcctgtactacggcaccctgggcacccccggcccctaccccggccccctgagccccccccccgaggccccccccctggagagcgccgagcccctgggccccgccgccgacctgtgggccgacgtggacctgaccgagttcgaccagtacctgaactgcagcagaaccagacccgacgcccccggcctgccctaccacgtggccctggccaagctgggccccagagccatgagctgccccgaggagagcagcctgatcagcgccctgagcgacgccagcagcgccgtgtactacagcgcctgcatcagcggctag

SEQ ID NO: 100824 - DNA, 831 bp, Artificial Sequence
  Description of Artificial Sequence: Synthetic coding sequence
atgagcaagcccgtggaccacgtgaagagacccatgaacgccttcatggtgtggagcagagcccagagaagaaagatggcccaggagaaccccaagatgcacaacagcgagatcagcaagagactgggcgccgagtggaagctgctgaccgagagcgagaagagacccttcatcgacgaggccaagagactgagagccatgcacatgaaggagcaccccgactacaagtacagacccagaagaaagcccaagaccctgctgaagaaggacaagttcgccttccccgtgccctacggcctgggcggcgtggccgacgccgagcaccccgccctgaaggccggcgccggcctgcacgccggcgccggcggcggcctggtgcccgagagcctgctggccaaccccgagaaggccgccgccgccgccgccgccgccgccgccagagtgttcttcccccagagcgccgccgccgccgccgccgccgccgccgccgccgccgccggcagcccctacagcctgctggacctgggcagcaagatggccgagatcagcagcagcagcagcggcctgccctacgccagcagcctgggctaccccaccgccggcgccggcgccttccacggcgccgccgccgccgccgccgccgccgccgccgccgccggcggccacacccacagccaccccagccccggcaaccccggctacatgatcccctgcaactgcagcgcctggcccagccccggcctgcagccccccctggcctacatcctgctgcccggcatgggcaagccccagctggacccctaccccgccgcctacgccgccgccctgtag

SEQ ID NO: 100825 - DNA, 1341 bp, Artificial Sequence
  Description of Artificial Sequence: Synthetic coding sequence
atgagacccgtgagagagaacagcagcggcgccagaagccccagagtgcccgccgacctggccagaagcatcctgatcagcctgcccttcccccccgacagcctggcccacagaccccccagcagcgcccccaccgagagccagggcctgttcaccgtggccgcccccgcccccggcgcccccagcccccccgccaccctggcccacctgctgcccgcccccgccatgtacagcctgctggagaccgagctgaagaaccccgtgggcacccccacccaggccgccggcaccggcggccccgccgcccccggcggcgccggcaagagcagcgccaacgccgccggcggcgccaacagcggcggcggcagcagcggcggcgccagcggcggcggcggcggcaccgaccaggacagagtgaagagacccatgaacgccttcatggtgtggagcagaggccagagaagaaagatggccctggagaaccccaagatgcacaacagcgagatcagcaagagactgggcgccgactggaagctgctgaccgacgccgagaagagacccttcatcgacgaggccaagagactgagagccgtgcacatgaaggagtaccccgactacaagtacagacccagaagaaagaccaagaccctgctgaagaaggacaagtacagcctgcccagcggcctgctgccccccggcgccgccgccgccgccgccgccgccgccgccgccgccgccgccgccagcagccccgtgggcgtgggccagagactggacacctacacccacgtgaacggctgggccaacggcgcctacagcctggtgcaggagcagctgggctacgcccagccccccagcatgagcagccccccccccccccccgccctgccccccatgcacagatacgacatggccggcctgcagtacagccccatgatgccccccggcgcccagagctacatgaacgtggccgccgccgccgccgccgccagcggctacggcggcatggcccccagcgccaccgccgccgccgccgccgcctacggccagcagcccgccaccgccgccgccgccgccgccgccgccgccgccatgagcctgggccccatgggcagcgtggtgaagagcgagcccagcagccccccccccgccatcgccagccacagccagagagcctgcctgggcgacctgagagacatgatcagcatgtacctgccccccggcggcgacgccgccgacgccgccagccccctgcccggcggcagactgcacggcgtgcaccagcactaccagggcgccggcaccgccgtgaacggcaccgtgcccctgacccacatctag

SEQ ID NO: 100826 - DNA, 2253 bp, Artificial Sequence
  Description of Artificial Sequence: Synthetic coding sequence
atgagcagcaagagacccgccagcccctacggcgaggccgacggcgaggtggccatggtgaccagcagacagaaggtggaggaggaggagagcgacggcctgcccgccttccacctgcccctgcacgtgagcttccccaacaagccccacagcgaggagttccagcccgtgagcctgctgacccaggagacctgcggccacagaacccccaccagccagcacaacaccatggaggtggacggcaacaaggtgatgagcagcttcgccccccacaacagcagcaccagcccccagaaggccgaggagggcggcagacagagcggcgagagcctgagcagcaccgccctgggcacccccgagagaagaaagggcagcctggccgacgtggtggacaccctgaagcagagaaagatggaggagctgatcaagaacgagcccgaggagacccccagcatcgagaagctgctgagcaaggactggaaggacaagctgctggccatgggcagcggcaacttcggcgagatcaagggcacccccgagagcctggccgagaaggagagacagctgatgggcatgatcaaccagctgaccagcctgagagagcagctgctggccgcccacgacgagcagaagaagctggccgccagccagatcgagaagcagagacagcagatggagctggccaagcagcagcaggagcagatcgccagacagcagcagcagctgctgcagcagcagcacaagatcaacctgctgcagcagcagatccaggtgcagggccagctgccccccctgatgatccccgtgttcccccccgaccagagaaccctggccgccgccgcccagcagggcttcctgctgccccccggcttcagctacaaggccggctgcagcgacccctaccccgtgcagctgatccccaccaccatggccgccgccgccgccgccacccccggcctgggccccctgcagctgcagcagctgtacgccgcccagctggccgccatgcaggtgagccccggcggcaagctgcccggcatcccccagggcaacctgggcgccgccgtgagccccaccagcatccacaccgacaagagcaccaacagccccccccccaagagcaaggacgaggtggcccagcccctgaacctgagcgccaagcccaagaccagcgacggcaagagccccaccagccccaccagcccccacatgcccgccctgagaatcaacagcggcgccggccccctgaaggccagcgtgcccgccgccctggccagccccagcgccagagtgagcaccatcggctacctgaacgaccacgacgccgtgaccaaggccatccaggaggccagacagatgaaggagcagctgagaagagagcagcaggtgctggacggcaaggtggccgtggtgaacagcctgggcctgaacaactgcagaaccgagaaggagaagaccaccctggagagcctgacccagcagctggccgtgaagcagaacgaggagggcaagttcagccacgccatgatggacttcaacctgagcggcgacagcgacggcagcgccggcgtgagcgagagcagaatctacagagagagcagaggcagaggcagcaacgagccccacatcaagagacccatgaacgccttcatggtgtgggccaaggacgagagaagaaagatcctgcaggccttccccgacatgcacaacagcaacatcagcaagatcctgggcagcagatggaaggccatgaccaacctggagaagcagccctactacgaggagcaggccagactgagcaagcagcacctggagaagtaccccgactacaagtacaagcccagacccaagagaacctgcctggtggacggcaagaagctgagaatcggcgagtacaaggccatcatgagaaacagaagacaggagatgagacagtacttcaacgtgggccagcaggcccagatccccatcgccaccgccggcgtggtgtaccccggcgccatcgccatggccggcatgcccagcccccacctgcccagcgagcacagcagcgtgagcagcagccccgagcccggcatgcccgtgatccagagcacctacggcgtgaagggcgaggagccccacatcaaggaggagatccaggccgaggacatcaacggcgagatctacgacgagtacgacgaggaggaggacgaccccgacgtggactacggcagcgacagcgagaaccacatcgccggccaggccaactag

SEQ ID NO: 100827 - DNA, 1929 bp, Artificial Sequence
  Description of Artificial Sequence: Synthetic coding sequence
atgagcagcaagagacccgccagcccctacggcgaggccgacggcgaggtggccatggtgaccagcagacagaaggtggaggaggaggagagcgacggcctgcccgccttccacctgcccctgcacgtgagcttccccaacaagccccacagcgaggagttccagcccgtgagcctgctgacccaggagacctgcggccacagaacccccaccagccagcacaacaccatggaggtggacggcaacaaggtgatgagcagcttcgccccccacaacagcagcaccagcccccagaaggccgaggagggcggcagacagagcggcgagagcctgagcagcaccgccctgggcacccccgagagaagaaagggcagcctggccgacgtggtggacaccctgaagcagagaaagatggaggagctgatcaagaacgagcccgaggagacccccagcatcgagaagctgctgagcaaggactggaaggacaagctgctggccatgggcagcggcaacttcggcgagatcaagggcacccccgagagcctggccgagaaggagagacagctgatgggcatgatcaaccagctgaccagcctgagagagcagctgctggccgcccacgacgagcagaagaagctggccgccagccagatcgagaagcagagacagcagatggagctggccaagcagcagcaggagcagatcgccagacagcagcagcagctgctgcagcagcagcacaagatcaacctgctgcagcagcagatccaggtgcagggccagctgccccccctgatgatccccgtgttcccccccgaccagagaaccctggccgccgccgcccagcagggcttcctgctgccccccggcttcagctacaaggccggctgcagcgacccctaccccgtgcagctgatccccaccaccatggccgccgccgccgccgccacccccggcctgggccccctgcagctgcagcagctgtacgccgcccagctggccgccatgcaggtgagccccggcggcaagctgcccggcatcccccagggcaacctgggcgccgccgtgagccccaccagcatccacaccgacaagagcaccaacagccccccccccaagagcaaggagaagaccaccctggagagcctgacccagcagctggccgtgaagcagaacgaggagggcaagttcagccacgccatgatggacttcaacctgagcggcgacagcgacggcagcgccggcgtgagcgagagcagaatctacagagagagcagaggcagaggcagcaacgagccccacatcaagagacccatgaacgccttcatggtgtgggccaaggacgagagaagaaagatcctgcaggccttccccgacatgcacaacagcaacatcagcaagatcctgggcagcagatggaaggccatgaccaacctggagaagcagccctactacgaggagcaggccagactgagcaagcagcacctggagaagtaccccgactacaagtacaagcccagacccaagagaacctgcctggtggacggcaagaagctgagaatcggcgagtacaaggccatcatgagaaacagaagacaggagatgagacagtacttcaacgtgggccagcaggcccagatccccatcgccaccgccggcgtggtgtaccccggcgccatcgccatggccggcatgcccagcccccacctgcccagcgagcacagcagcgtgagcagcagccccgagcccggcatgcccgtgatccagagcacctacggcgtgaagggcgaggagccccacatcaaggaggagatccaggccgaggacatcaacggcgagatctacgacgagtacgacgaggaggaggacgaccccgacgtggactacggcagcgacagcgagaaccacatcgccggccaggccaactag

SEQ ID NO: 100828 - DNA, 1134 bp, Artificial Sequence
  Description of Artificial Sequence: Synthetic coding sequence
atgcacgacgaggtggcccagcccctgaacctgagcgccaagcccaagaccagcgacggcaagagccccaccagccccaccagcccccacatgcccgccctgagaatcaacagcggcgccggccccctgaaggccagcgtgcccgccgccctggccagccccagcgccagagtgagcaccatcggctacctgaacgaccacgacgccgtgaccaaggccatccaggaggccagacagatgaaggagcagctgagaagagagcagcaggtgctggacggcaaggtggccgtggtgaacagcctgggcctgaacaactgcagaaccgagaaggagaagaccaccctggagagcctgacccagcagctggccgtgaagcagaacgaggagggcaagttcagccacgccatgatggacttcaacctgagcggcgacagcgacggcagcgccggcgtgagcgagagcagaatctacagagagagcagaggcagaggcagcaacgagccccacatcaagagacccatgaacgccttcatggtgtgggccaaggacgagagaagaaagatcctgcaggccttccccgacatgcacaacagcaacatcagcaagatcctgggcagcagatggaaggccatgaccaacctggagaagcagccctactacgaggagcaggccagactgagcaagcagcacctggagaagtaccccgactacaagtacaagcccagacccaagagaacctgcctggtggacggcaagaagctgagaatcggcgagtacaaggccatcatgagaaacagaagacaggagatgagacagtacttcaacgtgggccagcaggcccagatccccatcgccaccgccggcgtggtgtaccccggcgccatcgccatggccggcatgcccagcccccacctgcccagcgagcacagcagcgtgagcagcagccccgagcccggcatgcccgtgatccagagcacctacggcgtgaagggcgaggagccccacatcaaggaggagatccaggccgaggacatcaacggcgagatctacgacgagtacgacgaggaggaggacgaccccgacgtggactacggcagcgacagcgagaaccacatcgccggccaggccaactag

SEQ ID NO: 100829 - DNA, 1764 bp, Artificial Sequence
  Description of Artificial Sequence: Synthetic coding sequence
atgagcagcaagagacccgccagcccctacggcgaggccgacggcgaggtggccatggtgaccagcagacagaaggtggaggaggaggagagcgacggcctgcccgccttccacctgcccctgcacgaggtggacggcaacaaggtgatgagcagcttcgccccccacaacagcagcaccagcccccagaaggccgaggagggcggcagacagagcggcgagagcctgagcagcaccgccctgggcacccccgagagaagaaagggcagcctggccgacgtggtggacaccctgaagcagagaaagatggaggagctgatcaagaacgagcccgaggagacccccagcatcgagaagctgctgagcaaggactggaaggacaagctgctggccatgggcagcggcaacttcggcgagatcaagggcacccccgagagcctggccgagaaggagagacagctgatgggcatgatcaaccagctgaccagcctgagagagcagctgctggccgcccacgacgagcagaagaagctggccgccagccagatcgagaagcagagacagcagatggagctggccaagcagcagcaggagcagatcgccagacagcagcagcagctgctgcagcagcagcacaagatcaacctgctgcagcagcagatccaggtgcagggccagctgccccccctgatgatccccgtgttcccccccgaccagagaaccctggccgccgccgcccagcagggcttcctgctgccccccggcttcagctacaaggccggctgcagcgacccctaccccgtgcagctgatccccaccaccatggccgccgccgccgccgccacccccggcctgggccccctgcagctgcagcagctgtacgccgcccagctggccgccatgcaggtgagccccggcggcaagctgcccggcatcccccagggcaacctgggcgccgccgtgagccccaccagcatccacaccgacaagagcaccaacagccccccccccaagagcaaggacgaggtggcccagcccctgaacctgagcgccaagcccaagaccagcgacggcaagagccccaccagccccaccagcccccacatgcccgccctgagaatcaacagcggcgccggccccctgaaggccagcgtgcccgccgccctggccagccccagcgccagagtgagcaccatcggctacctgaacgaccacgacgccgtgaccaaggccatccaggaggccagacagatgaaggagcagctgagaagagagcagcaggtgctggacggcaaggtggccgtggtgaacagcctgggcctgaacaactgcagaaccgagaaggagaagaccaccctggagagcctgacccagcagctggccgtgaagcagaacgaggagggcaagttcagccacgccatgatggacttcaacctgagcggcgacagcgacggcagcgccggcgtgagcgagagcagaatctacagagagagcagaggcagaggcagcaacgagccccacatcaagagacccatgaacgccttcatggtgtgggccaaggacgagagaagaaagatcctgcaggccttccccgacctgggcttcctgtgcgtgtgcatgtacgtgatcatggtgctgatcatcggcatcaccctggaccactgcgagctgaacccccacctgggcatgaagagccacatcctgcccagcgactggagcagaaacaacctggacctggacttcgccctgcagatgaccacctag

SEQ ID NO: 100830 - DNA, 2292 bp, Artificial Sequence
  Description of Artificial Sequence: Synthetic coding sequence
atgctgaccgaccccgacctgccccaggagttcgagagaatgagcagcaagagacccgccagcccctacggcgaggccgacggcgaggtggccatggtgaccagcagacagaaggtggaggaggaggagagcgacggcctgcccgccttccacctgcccctgcacgtgagcttccccaacaagccccacagcgaggagttccagcccgtgagcctgctgacccaggagacctgcggccacagaacccccaccagccagcacaacaccatggaggtggacggcaacaaggtgatgagcagcttcgccccccacaacagcagcaccagcccccagaaggccgaggagggcggcagacagagcggcgagagcctgagcagcaccgccctgggcacccccgagagaagaaagggcagcctggccgacgtggtggacaccctgaagcagagaaagatggaggagctgatcaagaacgagcccgaggagacccccagcatcgagaagctgctgagcaaggactggaaggacaagctgctggccatgggcagcggcaacttcggcgagatcaagggcacccccgagagcctggccgagaaggagagacagctgatgggcatgatcaaccagctgaccagcctgagagagcagctgctggccgcccacgacgagcagaagaagctggccgccagccagatcgagaagcagagacagcagatggagctggccaagcagcagcaggagcagatcgccagacagcagcagcagctgctgcagcagcagcacaagatcaacctgctgcagcagcagatccaggtgcagggccagctgccccccctgatgatccccgtgttcccccccgaccagagaaccctggccgccgccgcccagcagggcttcctgctgccccccggcttcagctacaaggccggctgcagcgacccctaccccgtgcagctgatccccaccaccatggccgccgccgccgccgccacccccggcctgggccccctgcagctgcagcagctgtacgccgcccagctggccgccatgcaggtgagccccggcggcaagctgcccggcatcccccagggcaacctgggcgccgccgtgagccccaccagcatccacaccgacaagagcaccaacagccccccccccaagagcaaggacgaggtggcccagcccctgaacctgagcgccaagcccaagaccagcgacggcaagagccccaccagccccaccagcccccacatgcccgccctgagaatcaacagcggcgccggccccctgaaggccagcgtgcccgccgccctggccagccccagcgccagagtgagcaccatcggctacctgaacgaccacgacgccgtgaccaaggccatccaggaggccagacagatgaaggagcagctgagaagagagcagcaggtgctggacggcaaggtggccgtggtgaacagcctgggcctgaacaactgcagaaccgagaaggagaagaccaccctggagagcctgacccagcagctggccgtgaagcagaacgaggagggcaagttcagccacgccatgatggacttcaacctgagcggcgacagcgacggcagcgccggcgtgagcgagagcagaatctacagagagagcagaggcagaggcagcaacgagccccacatcaagagacccatgaacgccttcatggtgtgggccaaggacgagagaagaaagatcctgcaggccttccccgacatgcacaacagcaacatcagcaagatcctgggcagcagatggaaggccatgaccaacctggagaagcagccctactacgaggagcaggccagactgagcaagcagcacctggagaagtaccccgactacaagtacaagcccagacccaagagaacctgcctggtggacggcaagaagctgagaatcggcgagtacaaggccatcatgagaaacagaagacaggagatgagacagtacttcaacgtgggccagcaggcccagatccccatcgccaccgccggcgtggtgtaccccggcgccatcgccatggccggcatgcccagcccccacctgcccagcgagcacagcagcgtgagcagcagccccgagcccggcatgcccgtgatccagagcacctacggcgtgaagggcgaggagccccacatcaaggaggagatccaggccgaggacatcaacggcgagatctacgacgagtacgacgaggaggaggacgaccccgacgtggactacggcagcgacagcgagaaccacatcgccggccaggccaactag

SEQ ID NO: 100831 - DNA, 1929 bp, Artificial Sequence; identical to SEQ ID NO: 100827
  Description of Artificial Sequence: Synthetic coding sequence

SEQ ID NO: 100832 - DNA, 2253 bp, Artificial Sequence; identical to SEQ ID NO: 100826
  Description of Artificial Sequence: Synthetic coding sequence

SEQ ID NO: 100833 - DNA, 2427 bp, Artificial Sequence
  Description of Artificial Sequence: Synthetic coding sequence
atgagcagcaagcaggccaccagccccttcgcctgcgccgccgacggcgaggacgccatgacccaggacctgaccagcagagagaaggaggagggcagcgaccagcacgtggccagccacctgcccctgcaccccatcatgcacaacaagccccacagcgaggagctgcccaccctggtgagcaccatccagcaggacgccgactgggacagcgtgctgagcagccagcagagaatggagagcgagaacaacaagctgtgcagcctgtacagcttcagaaacaccagcaccagcccccacaagcccgacgagggcagcagagacagagagatcatgaccagcgtgaccttcggcacccccgagagaagaaagggcagcctggccgacgtggtggacaccctgaagcagaagaagctggaggagatgaccagaaccgagcaggaggacagcagctgcatggagaagctgctgagcaaggactggaaggagaagatggagagactgaacaccagcgagctgctgggcgagatcaagggcacccccgagagcctggccgagaaggagagacagctgagcaccatgatcacccagctgatcagcctgagagagcagctgctggccgcccacgacgagcagaagaagctggccgccagccagatcgagaagcagagacagcagatggacctggccagacagcagcaggagcagatcgccagacagcagcagcagctgctgcagcagcagcacaagatcaacctgctgcagcagcagatccaggtgcagggccacatgccccccctgatgatccccatcttcccccacgaccagagaaccctggccgccgccgccgccgcccagcagggcttcctgttcccccccggcatcacctacaagcccggcgacaactaccccgtgcagttcatccccagcaccatggccgccgccgccgccagcggcctgagccccctgcagctgcagaagggccacgtgagccacccccagatcaaccagagactgaagggcctgagcgacagattcggcagaaacctggacaccttcgagcacggcggcggccacagctacaaccacaagcagatcgagcagctgtacgccgcccagctggccagcatgcaggtgagccccggcgccaagatgcccagcaccccccagccccccaacaccgccggcaccgtgagccccaccggcatcaagaacgagaagagaggcaccagccccgtgacccaggtgaaggacgaggccgccgcccagcccctgaacctgagcagcagacccaagaccgccgagcccgtgaagagccccaccagccccacccagaacctgttccccgccagcaagaccagccccgtgaacctgcccaacaagagcagcatccccagccccatcggcggcagcctgggcagaggcagcagcctggacatcctgagcagcctgaacagccccgccctgttcggcgaccaggacaccgtgatgaaggccatccaggaggccagaaagatgagagagcagatccagagagagcagcagcagcagcagccccacggcgtggacggcaagctgagcagcatcaacaacatgggcctgaacagctgcagaaacgagaaggagagaaccagattcgagaacctgggcccccagctgaccggcaagagcaacgaggacggcaagctgggccccggcgtgatcgacctgaccagacccgaggacgccgagggcggcgccaccgtggccgaggccagagtgtacagagacgccagaggcagagccagcagcgagccccacatcaagagacccatgaacgccttcatggtgtgggccaaggacgagagaagaaagatcctgcaggccttccccgacatgcacaacagcaacatcagcaagatcctgggcagcagatggaagagcatgagcaaccaggagaagcagccctactacgaggagcaggccagactgagcaagatccacctggagaagtaccccaactacaagtacaagcccagacccaagagaacctgcatcgtggacggcaagaagctgagaatcggcgagtacaagcagctgatgagaagcagaagacaggagatgagacagttcttcaccgtgggccagcagccccagatccccatcaccaccggcaccggcgtggtgtaccccggcgccatcaccatggccaccaccacccccagcccccagatgaccagcgactgcagcagcaccagcgccagccccgagcccagcctgcccgtgatccagagcacctacggcatgaagaccgacggcggcagcctggccggcaacgagatgatcaacggcgaggacgagatggagatgtacgacgactacgaggacgaccccaagagcgactacagcagcgagaacgaggcccccgaggccgtgagcgccaactag

SEQ ID NO: 100834 - DNA, 2487 bp, Artificial Sequence
  Description of Artificial Sequence: Synthetic coding sequence
atgagcagcaagcaggccaccagccccttcgcctgcgccgccgacggcgaggacgccatgacccaggacctgaccagcagagagaaggaggagggcagcgaccagcacgtggccagccacctgcccctgcaccccatcatgcacaacaagccccacagcgaggagctgcccaccctggtgagcaccatccagcaggacgccgactgggacagcgtgctgagcagccagcagagaatggagagcgagaacaacaagctgtgcagcctgtacagcttcagaaacaccagcaccagcccccacaagcccgacgagggcagcagagacagagagatcatgaccagcgtgaccttcggcacccccgagagaagaaagggcagcctggccgacgtggtggacaccctgaagcagaagaagctggaggagatgaccagaaccgagcaggaggacagcagctgcatggagaagctgctgagcaaggactggaaggagaagatggagagactgaacaccagcgagctgctgggcgagatcaagggcacccccgagagcctggccgagaaggagagacagctgagcaccatgatcacccagctgatcagcctgagagagcagctgctggccgcccacgacgagcagaagaagctggccgccagccagatcgagaagcagagacagcagatggacctggccagacagcagcaggagcagatcgccagacagcagcagcagctgctgcagcagcagcacaagatcaacctgctgcagcagcagatccaggtgcagggccacatgccccccctgatgatccccatcttcccccacgaccagagaaccctggccgccgccgccgccgcccagcagggcttcctgttcccccccggcatcacctacaagcccggcgacaactaccccgtgcagttcatccccagcaccatggccgccgccgccgccagcggcctgagccccctgcagctgcagaagggccacgtgagccacccccagatcaaccagagactgaagggcctgagcgacagattcggcagaaacctggacaccttcgagcacggcggcggccacagctacaaccacaagcagatcgagcagctgtacgccgcccagctggccagcatgcaggtgagccccggcgccaagatgcccagcaccccccagccccccaacaccgccggcaccgtgagccccaccggcatcaagaacgagaagagaggcaccagccccgtgacccaggtgaaggacgaggccgccgcccagcccctgaacctgagcagcagacccaagaccgccgagcccgtgaagagccccaccagccccacccagaacctgttccccgccagcaagaccagccccgtgaacctgcccaacaagagcagcatccccagccccatcggcggcagcctgggcagaggcagcagcctggacatcctgagcagcctgaacagccccgccctgttcggcgaccaggacaccgtgatgaaggccatccaggaggccagaaagatgagagagcagatccagagagagcagcagcagcagcagccccacggcgtggacggcaagctgagcagcatcaacaacatgggcctgaacagctgcagaaacgagaaggagagaaccagattcgagaacctgggcccccagctgaccggcaagagcaacgaggacggcaagctgggccccggcgtgatcgacctgaccagacccgaggacgccgagggcagcaaggccatgaacggcagcgccgccaagctgcagcagtactactgctggcccaccggcggcgccaccgtggccgaggccagagtgtacagagacgccagaggcagagccagcagcgagccccacatcaagagacccatgaacgccttcatggtgtgggccaaggacgagagaagaaagatcctgcaggccttccccgacatgcacaacagcaacatcagcaagatcctgggcagcagatggaagagcatgagcaaccaggagaagcagccctactacgaggagcaggccagactgagcaagatccacctggagaagtaccccaactacaagtacaagcccagacccaagagaacctgcatcgtggacggcaagaagctgagaatcggcgagtacaagcagctgatgagaagcagaagacaggagatgagacagttcttcaccgtgggccagcagccccagatccccatcaccaccggcaccggcgtggtgtaccccggcgccatcaccatggccaccaccacccccagcccccagatgaccagcgactgcagcagcaccagcgccagccccgagcccagcctgcccgtgatccagagcacctacggcatgaagaccgacggcggcagcctggccggcaacgagatgatcaacggcgaggacgagatggagatgtacgacgactacgaggacgaccccaagagcgactacagcagcgagaacgaggcccccgaggccgtgagcgccaactag

SEQ ID NO: 100835 - DNA, 2427 bp, Artificial Sequence; identical to SEQ ID NO: 100833
  Description of Artificial Sequence: Synthetic coding sequence

SEQ ID NO: 100836 - DNA, 420 bp, Artificial Sequence
  Description of Artificial Sequence: Synthetic coding sequence
atgagcagcaagcaggccaccagccccttcgcctgcgccgccgacggcgaggacgccatgacccaggacctgaccagcagagagaaggaggagggcagcgaccagcacgtggccagccacctgcccctgcaccccatcatgcacaacaagccccacagcgaggagctgcccaccctggtgagcaccatccagcaggacgccgactgggacagcgtgctgagcagccagcagagaatggagagcgagaacaacaagctgtgcagcctgtacagcttcagaaacaccagcaccagcccccacaagcccgacgagggcagcagagacagagagatcatgaccagcgtgaccttcggcacccccgagagaagaaagggcagcctggccgacgtggtggacaccctgaagcagaagaagctgtag

SEQ ID NO: 100837 - DNA, 2406 bp, Artificial Sequence
  Description of Artificial Sequence: Synthetic coding sequence
atgagcagcaagcaggccaccagccccttcgcctgcgccgccgacggcgaggacgccatgacccaggacctgaccagcagagagaaggaggagggcagcgaccagcacgtggccagccacctgcccctgcaccccatcatgcacaacaagccccacagcgaggagctgcccaccctggtgagcaccatccagcaggacgccgactgggacagcgtgctgagcagccagcagagaatggagagcgagaacaacaagctgtgcagcctgtacagcttcagaaacaccagcaccagcccccacaagcccgacgagggcagcagagacagagagatcatgaccagcgtgaccttcggcacccccgagagaagaaagggcagcctggccgacgtggtggacaccctgaagcagaagaagctggaggagatgaccagaaccgagcaggaggacagcagctgcatggagaagctgctgagcaaggactggaaggagaagatggagagactgaacaccagcgagctgctgggcgagatcaagggcacccccgagagcctggccgagaaggagagacagctgagcaccatgatcacccagctgatcagcctgagagagcagctgctggccgcccacgacgagcagaagaagctggccgccagccagatcgagaagcagagacagcagatggacctggccagacagcagcaggagcagatcgccagacagcagcagcagctgctgcagcagcagcacaagatcaacctgctgcagcagcagatccaggtgcagggccacatgccccccctgatgatccccatcttcccccacgaccagagaaccctggccgccgccgccgccgcccagcagggcttcctgttcccccccggcatcacctacaagcccggcgacaactaccccgtgcagttcatccccagcaccatggccgccgccgccgccagcggcctgagccccctgcagctgcagcagctgtacgccgcccagctggccagcatgcaggtgagccccggcgccaagatgcccagcaccccccagccccccaacaccgccggcaccgtgagccccaccggcatcaagaacgagaagagaggcaccagccccgtgacccaggtgaaggacgaggccgccgcccagcccctgaacctgagcagcagacccaagaccgccgagcccgtgaagagccccaccagccccacccagaacctgttccccgccagcaagaccagccccgtgaacctgcccaacaagagcagcatccccagccccatcggcggcagcctgggcagaggcagcagcctgggcaagtggaagagccagcaccaggaggagacctacgagctggacatcctgagcagcctgaacagccccgccctgttcggcgaccaggacaccgtgatgaaggccatccaggaggccagaaagatgagagagcagatccagagagagcagcagcagcagcagccccacggcgtggacggcaagctgagcagcatcaacaacatgggcctgaacagctgcagaaacgagaaggagagaaccagattcgagaacctgggcccccagctgaccggcaagagcaacgaggacggcaagctgggccccggcgtgatcgacctgaccagacccgaggacgccgagggcagcaaggccatgaacggcagcgccgccaagctgcagcagtactactgctggcccaccggcggcgccaccgtggccgaggccagagtgtacagagacgccagaggcagagccagcagcgagccccacatcaagagacccatgaacgccttcatggtgtgggccaaggacgagagaagaaagatcctgcaggccttccccgacatgcacaacagcaacatcagcaagatcctgggcagcagatggaagagcatgagcaaccaggagaagcagccctactacgaggagcaggccagactgagcaagatccacctggagaagtaccccaactacaagtacaagcccagacccaagagaacctgcatcgtggacggcaagaagctgagaatcggcgagtacaagcagctgatgagaagcagaagacaggagatgagacagttcttcaccgtgggccagcagccccagatccccatcaccaccggcaccggcgtggtgtaccccggcgccatcaccatggccaccaccacccccagcccccagatgaccagcgactgcagcagcaccagcgccagccccgagcccagcctgcccgtgatccagagcacctacggcatgaagaccgacggcggcagcctggccggcaacgagatgatcaacggcgaggacgagatggagatgtacgacgactacgaggacgaccccaagagcgactacagcagcgagaacgaggcccccgaggccgtgagcgccaactag

SEQ ID NO: 100838 - DNA, 2487 bp, Artificial Sequence; identical to SEQ ID NO: 100834
  Description of Artificial Sequence: Synthetic coding sequence

SEQ ID NO: 100839 - DNA, 240 bp, Artificial Sequence
  Description of Artificial Sequence: Synthetic coding sequence
atgagcagcaagcaggccaccagccccttcgcctgcgccgccgacggcgaggacgccatgacccaggacctgaccagcagagagaaggaggagggcagcgaccagcacgtggccagccacctgcccctgcaccccatcatgcacaacaagccccacagcgaggagctgcccaccctggtgagcaccatccagcaggacgccgactgggacagcgtgctgagcagccagcagagaatgtag

SEQ ID NO: 100840 - DNA, 480 bp, Artificial Sequence
  Description of Artificial Sequence: Synthetic coding sequence
atgagcagcaagcaggccaccagccccttcgcctgcgccgccgacggcgaggacgccatgacccaggacctgaccagcagagagaaggaggagggcagcgaccagcacgtggccagccacctgcccctgcaccccatcatgcacaacaagccccacagcgaggagctgcccaccctggtgagcaccatccagcaggacgccgactgggacagcgtgctgagcagccagcagagaatggagagcgagaacaacaagctgtgcagcctgtacagcttcagaaacaccagcaccagcccccacaagcccgacgagggcagcagagacagagagatcatgaccagcgtgaccttcggcacccccgagagaagaaagggcagcctggccgacgtggtggacaccctgaagcagaagaagctggaggagatgaccagaaccgagcaggaggacagcagctgcatggagaagctgctgagcaagtag

SEQ ID NO: 100841 - DNA, 2415 bp, Artificial Sequence
  Description of Artificial Sequence: Synthetic coding sequence
atgggcagaatgagcagcaagcaggccaccagccccttcgcctgcgccgccgacggcgaggacgccatgacccaggacctgaccagcagagagaaggaggagggcagcgaccagcacgtggccagccacctgcccctgcaccccatcatgcacaacaagccccacagcgaggagctgcccaccctggtgagcaccatccagcaggacgccgactgggacagcgtgctgagcagccagcagagaatggagagcgagaacaacaagctgtgcagcctgtacagcttcagaaacaccagcaccagcccccacaagcccgacgagggcagcagagacagagagatcatgaccagcgtgaccttcggcacccccgagagaagaaagggcagcctggccgacgtggtggacaccctgaagcagaagaagctggaggagatgaccagaaccgagcaggaggacagcagctgcatggagaagctgctgagcaaggactggaaggagaagatggagagactgaacaccagcgagctgctgggcgagatcaagggcacccccgagagcctggccgagaaggagagacagctgagcaccatgatcacccagctgatcagcctgagagagcagctgctggccgcccacgacgagcagaagaagctggccgccagccagatcgagaagcagagacagcagatggacctggccagacagcagcaggagcagatcgccagacagcagcagcagctgctgcagcagcagcacaagatcaacctgctgcagcagcagatccaggtgcagggccacatgccccccctgatgatccccatcttcccccacgaccagagaaccctggccgccgccgccgccgcccagcagggcttcctgttcccccccggcatcacctacaagcccggcgacaactaccccgtgcagttcatccccagcaccatggccgccgccgccgccagcggcctgagccccctgcagctgcagcagctgtacgccgcccagctggccagcatgcaggtgagccccggcgccaagatgcccagcaccccccagccccccaacaccgccggcaccgtgagccccaccggcatcaagaacgagaagagaggcaccagccccgtgacccaggtgaaggacgaggccgccgcccagcccctgaacctgagcagcagacccaagaccgccgagcccgtgaagagccccaccagccccacccagaacctgttccccgccagcaagaccagccccgtgaacctgcccaacaagagcagcatccccagccccatcggcggcagcctgggcagaggcagcagcctgggcaagtggaagagccagcaccaggaggagacctacgagctggacatcctgagcagcctgaacagccccgccctgttcggcgaccaggacaccgtgatgaaggccatccaggaggccagaaagatgagagagcagatccagagagagcagcagcagcagcagccccacggcgtggacggcaagctgagcagcatcaacaacatgggcctgaacagctgcagaaacgagaaggagagaaccagattcgagaacctgggcccccagctgaccggcaagagcaacgaggacggcaagctgggccccggcgtgatcgacctgaccagacccgaggacgccgagggcagcaaggccatgaacggcagcgccgccaagctgcagcagtactactgctggcccaccggcggcgccaccgtggccgaggccagagtgtacagagacgccagaggcagagccagcagcgagccccacatcaagagacccatgaacgccttcatggtgtgggccaaggacgagagaagaaagatcctgcaggccttccccgacatgcacaacagcaacatcagcaagatcctgggcagcagatggaagagcatgagcaaccaggagaagcagccctactacgaggagcaggccagactgagcaagatccacctggagaagtaccccaactacaagtacaagcccagacccaagagaacctgcatcgtggacggcaagaagctgagaatcggcgagtacaagcagctgatgagaagcagaagacaggagatgagacagttcttcaccgtgggccagcagccccagatccccatcaccaccggcaccggcgtggtgtaccccggcgccatcaccatggccaccaccacccccagcccccagatgaccagcgactgcagcagcaccagcgccagccccgagcccagcctgcccgtgatccagagcacctacggcatgaagaccgacggcggcagcctggccggcaacgagatgatcaacggcgaggacgagatggagatgtacgacgactacgaggacgaccccaagagcgactacagcagcgagaacgaggcccccgaggccgtgagcgccaactag

SEQ ID NO: 100842 - DNA, 1167 bp, Artificial Sequence
  Description of Artificial Sequence: Synthetic coding sequence
atggccagcctgctgggcgcctacccctggcccgagggcctggagtgccccgccctggacgccgagctgagcgacggccagagcccccccgccgtgcccagaccccccggcgacaagggcagcgagagcagaatcagaagacccatgaacgccttcatggtgtgggccaaggacgagagaaagagactggccgtgcagaaccccgacctgcacaacgccgagctgagcaagatgctgggcaagagctggaaggccctgaccctgagccagaagagaccctacgtggacgaggccgagagactgagactgcagcacatgcaggactaccccaactacaagtacagacccagaagaaagaagcaggccaagagactgtgcaagagagtggaccccggcttcctgctgagcagcctgagcagagaccagaacgccctgcccgagaagagaagcggcagcagaggcgccctgggcgagaaggaggacagaggcgagtacagccccggcaccgccctgcccagcctgagaggctgctaccacgagggccccgccggcggcggcggcggcggcacccccagcagcgtggacacctacccctacggcctgcccaccccccccgagatgagccccctggacgtgctggagcccgagcagaccttcttcagcagcccctgccaggaggagcacggccaccccagaagaatcccccacctgcccggccacccctacagccccgagtacgcccccagccccctgcactgcagccaccccctgggcagcctggccctgggccagagccccggcgtgagcatgatgagccccgtgcccggctgcccccccagccccgcctactacagccccgccacctaccaccccctgcacagcaacctgcaggcccacctgggccagctgagccccccccccgagcaccccggcttcgacgccctggaccagctgagccaggtggagctgctgggcgacatggacagaaacgagttcgaccagtacctgaacacccccggccaccccgacagcgccaccggcgccatggccctgagcggccacgtgcccgtgagccaggtgacccccaccggccccaccgagaccagcctgatcagcgtgctggccgacgccaccgccacctactacaacagctacagcgtgagctag

SEQ ID NO: 100843 - DNA, 1323 bp, Artificial Sequence
  Description of Artificial Sequence: Synthetic coding sequence
atgagcatgctggccgagagaagaagaaagcagaagtgggccgtggacccccagaacaccgcctggagcaacgacgacagcaagttcggccagagaatgctggagaagatgggctggagcaagggcaagggcctgggcgcccaggagcagggcgccaccgaccacatcaaggtgcaggtgaagaacaaccacctgggcctgggcgccaccatcaacaacgaggacaactggatcgcccaccaggacgacttcaaccagctgctggccgagctgaacacctgccacggccaggagaccaccgacagcagcgacaagaaggagaagaagagcttcagcctggaggagaagagcaagatcagcaagaacagagtgcactacatgaagttcaccaagggcaagagctggaaggccctgaccctgagccagaagagaccctacgtggacgaggccgagagactgagactgcagcacatgcaggactaccccaactacaagtacagacccagaagaaagaagcaggccaagagactgtgcaagagagtggaccccggcttcctgctgagcagcctgagcagagaccagaacgccctgcccgagaagagaagcggcagcagaggcgccctgggcgagaaggaggacagaggcgagtacagccccggcaccgccctgcccagcctgagaggctgctaccacgagggccccgccggcggcggcggcggcggcacccccagcagcgtggacacctacccctacggcctgcccaccccccccgagatgagccccctggacgtgctggagcccgagcagaccttcttcagcagcccctgccaggaggagcacggccaccccagaagaatcccccacctgcccggccacccctacagccccgagtacgcccccagccccctgcactgcagccaccccctgggcagcctggccctgggccagagccccggcgtgagcatgatgagccccgtgcccggctgcccccccagccccgcctactacagccccgccacctaccaccccctgcacagcaacctgcaggcccacctgggccagctgagccccccccccgagcaccccggcttcgacgccctggaccagctgagccaggtggagctgctgggcgacatggacagaaacgagttcgaccagtacctgaacacccccggccaccccgacagcgccaccggcgccatggccctgagcggccacgtgcccgtgagccaggtgacccccaccggccccaccgagaccagcctgatcagcgtgctggccgacgccaccgccacctactacaacagctacagcgtgagctag

SEQ ID NO: 100844 - DNA, 1341 bp, Artificial Sequence
  Description of Artificial Sequence: Synthetic coding sequence
atgctggacatgagcgaggccagaagccagcccccctgcagccccagcggcaccgccagcagcatgagccacgtggaggacagcgacagcgacgccccccccagccccgccggcagcgagggcctgggcagagccggcgtggccgtgggcggcgccagaggcgaccccgccgaggccgccgacgagagattccccgcctgcatcagagacgccgtgagccaggtgctgaagggctacgactggagcctggtgcccatgcccgtgagaggcggcggcggcggcgccctgaaggccaagccccacgtgaagagacccatgaacgccttcatggtgtgggcccaggccgccagaagaaagctggccgaccagtacccccacctgcacaacgccgagctgagcaagaccctgggcaagctgtggagactgctgagcgagagcgagaagagacccttcgtggaggaggccgagagactgagagtgcagcacaagaaggaccaccccgactacaagtaccagcccagaagaagaaagagcgccaaggccggccacagcgacagcgacagcggcgccgagctgggcccccaccccggcggcggcgccgtgtacaaggccgaggccggcctgggcgacggccaccaccacggcgaccacaccggccagacccacggcccccccaccccccccaccacccccaagaccgagctgcagcaggccggcgccaagcccgagctgaagctggagggcagaagacccgtggacagcggcagacagaacatcgacttcagcaacgtggacatcagcgagctgagcagcgaggtgatgggcaccatggacgccttcgacgtgcacgagttcgaccagtacctgcccctgggcggccccgccccccccgagcccggccaggcctacggcggcgcctacttccacgccggcgccagccccgtgtgggcccacaagagcgcccccagcgccagcgccagccccaccgagaccggcccccccagaccccacatcaagaccgagcagcccagccccggccactacggcgaccagcccagaggcagccccgactacggcagctgcagcggccagagcagcgccacccccgccgcccccgccggccccttcgccggcagccagggcgactacggcgacctgcaggccagcagctactacggcgcctaccccggctacgcccccggcctgtaccagtacccctgcttccacagccccagaagaccctacgccagccccctgctgaacggcctggccctgccccccgcccacagccccaccagccactgggaccagcccgtgtacaccaccctgaccagaccctag

SEQ ID NO: 100845 - DNA, 1530 bp, Artificial Sequence
  Description of Artificial Sequence: Synthetic coding sequence
atgaacctgctggaccccttcatgaagatgaccgacgagcaggagaagggcctgagcggcgcccccagccccaccatgagcgaggacagcgccggcagcccctgccccagcggcagcggcagcgacaccgagaacaccagaccccaggagaacaccttccccaagggcgagcccgacctgaagaaggagagcgaggaggacaagttccccgtgtgcatcagagaggccgtgagccaggtgctgaagggctacgactggaccctggtgcccatgcccgtgagagtgaacggcagcagcaagaacaagccccacgtgaagagacccatgaacgccttcatggtgtgggcccaggccgccagaagaaagctggccgaccagtacccccacctgcacaacgccgagctgagcaagaccctgggcaagctgtggagactgctgaacgagagcgagaagagacccttcgtggaggaggccgagagactgagagtgcagcacaagaaggaccaccccgactacaagtaccagcccagaagaagaaagagcgtgaagaacggccaggccgaggccgaggaggccaccgagcagacccacatcagccccaacgccatcttcaaggccctgcaggccgacagcccccacagcagcagcggcatgagcgaggtgcacagccccggcgagcacagcggccagagccagggcccccccaccccccccaccacccccaagaccgacgtgcagcccggcaaggccgacctgaagagagagggcagacccctgcccgagggcggcagacagccccccatcgacttcagagacgtggacatcggcgagctgagcagcgacgtgatcagcaacatcgagaccttcgacgtgaacgagttcgaccagtacctgccccccaacggccaccccggcgtgcccgccacccacggccaggtgacctacaccggcagctacggcatcagcagcaccgccgccacccccgccagcgccggccacgtgtggatgagcaagcagcaggccccccccccccccccccagcagcccccccaggccccccccgccccccaggcccccccccagccccaggccgcccccccccagcagcccgccgcccccccccagcagccccaggcccacaccctgaccaccctgagcagcgagcccggccagagccagagaacccacatcaagaccgagcagctgagccccagccactacagcgagcagcagcagcacagcccccagcagatcgcctacagccccttcaacctgccccactacagccccagctacccccccatcaccagaagccagtacgactacaccgaccaccagaacagcagcagctactacagccacgccgccggccagggcaccggcctgtacagcaccttcacctacatgaaccccgcccagagacccatgtacacccccatcgccgacaccagcggcgtgcccagcatcccccagacccacagcccccagcactgggagcagcccgtgtacacccagctgaccagaccctag

SEQ ID NO: 100846 - DNA, 1338 bp, Artificial Sequence
  Description of Artificial Sequence: Synthetic coding sequence
atgaacctgctggaccccttcatgaagatgaccgacgagcaggagaagggcctgagcggcgcccccagccccaccatgagcgaggacagcgccggcagcccctgccccagcggcagcggcagcgacaccgagaacaccagaccccaggagaacaccttccccaagggcgagcccgacctgaagaaggagagcgaggaggacaagttccccgtgtgcatcagagaggccgtgagccaggtgctgaagggctacgactggaccctggtgcccatgcccgtgagagtgaacggcagcagcaagaacaagccccacgtgaagagacccatgaacgccttcatggtgtgggcccaggccgccagaagaaagctggccgaccagtacccccacctgcacaacgccgagctgagcaagaccctgggcaagctgtggagactgctgaacgagagcgagaagagacccttcgtggaggaggccgagagactgagagtgcagcacaagaaggaccaccccgactacaagtaccagcccagaagaagaaagagcgtgaagaacggccaggccgaggccgaggaggccaccgagcagacccacatcagccccaacgccatcttcaaggccctgcaggccgacagcccccacagcagcagcggcatgagcgaggtgcacagccccggcgagcacagcggccagagccagggcccccccaccccccccaccacccccaagaccgacgtgcagcccggcaaggccgacctgaagagagagggcagacccctgcccgagggcggcagacagccccccatcgacttcagagacgtggacatcggcgagctgagcagcgacgtgatcagcaacatcgagaccttcgacgtgaacgagttcgaccagtacctgccccccaacggccaccccggcgtgcccgccacccacggccaggtgacctacaccggcagctacggcatcagcagcaccgccgccacccccgccagcgccggccacgtgtggatgagcaagcagcaggccccccccccccccccccagcagcacagcccccagcagatcgcctacagccccttcaacctgccccactacagccccagctacccccccatcaccagaagccagtacgactacaccgaccaccagaacagcagcagctactacagccacgccgccggccagggcaccggcctgtacagcaccttcacctacatgaaccccgcccagagacccatgtacacccccatcgccgacaccagcggcgtgcccagcatcccccagacccacagcccccagcactgggagcagcccgtgtacacccagctgaccagaccctag

SEQ ID NO: 100847 - DNA, 273 bp, Artificial Sequence
  Description of Artificial Sequence: Synthetic coding sequence
atgagaggctacctggtggccatcttcctgagcgccgtgttcctgtactacgtgctgcactgcatcctgtggggcaccaacgtgtactgggtggcccccgtggagatgaagagaagaaacaagatccagccctgcctgagcaagcccgccttcgccagcctgctgagccagagcagcgcctacatcctgagaaagggcatcgaggagctgaaccagaccagcatcctgttcacccaggtgagcagcgtgagccccttcagcgtgtgcggctag

SEQ ID NO: 100848 - DNA, 273 bp, Artificial Sequence; identical to SEQ ID NO: 100847
  Description of Artificial Sequence: Synthetic coding sequence

SEQ ID NO: 100849 - DNA, 1335 bp, Artificial Sequence
  Description of Artificial Sequence: Synthetic coding sequence
atgggcctgctggtgttcgtgagaaacctgctgctggccctgtgcctgttcctggtgctgggcttcctgtactacagcgcctggaagctgcacctgctgcagtgggaggaggacagcagcaagtacagccacagcagcagcccccaggagaagcccgtggccgacagcgtggtgctgagcttcgacagcgccggccagaccctgggcagcgagtacgacagactgggcttcctgctgaacctggacagcaagctgagccccagaaccctgtgcaccgtggtgttcggcctggactgcatcctggagagccccggcgagcccaagaagctgctgatgcccgccagccaccccctggagatcctgaagagcctgagcgaggacaccgccttcgccctgggcttcctgaagctgcccagacccgccgagctggccaccaagtacgccaacttcagcgagggcgcctgcaagcccggctacgccagcgccctgatgaccgccatcttccccagattcagcaagcccgcccccatgttcctggacgacagcttcagaaagtgggccagaatcagagagttcgtgccccccttcggcatcaagggccaggacaacctgatcaaggccatcctgagcgtgaccaaggagtacagactgacccccgccctggacagcctgagatgcagaagatgcatcatcgtgggcaacggcggcgtgctggccaacaagagcctgggcagcagaatcgacgactacgacatcgtggtgagactgaacagcgcccccgtgaagggcttcgagaaggacgtgggcagcaagaccaccctgagaatcacctaccccgagggcgccatgcagagacccgagcagtacgagagagacagcctgttcgtgctggccggcttcaagtggcaggacttcaagtggctgaagtacatcgtgtacaaggagagagtgagcgccagcgacggcttctggaagagcgtggccaccagagtgcccaaggagccccccgagatcagaatcctgaacccctacttcatccaggaggccgccttcaccctgatcggcctgcccttcaacaacggcctgatgggcagaggcaacatccccaccctgggcagcgtggccgtgaccatggccctgcacggctgcgacgaggtggccgtggccggcttcggctacgacatgagcacccccaacgcccccctgcactactacgagaccgtgagaatggccgccatcaaggagagctggacccacaacatccagagagagaaggagttcctgagaaagctggtgaaggccagagtgatcaccgacctgagcagcggcatctag

SEQ ID NO: 100850 - DNA, 468 bp, Artificial Sequence
  Description of Artificial Sequence: Synthetic coding sequence
atgggcctgctggtgttcgtgagaaacctgctgctggccctgtgcctgttcctggtgctgggcttcctgtactacagcgcctggaagctgcacctgctgcagtgggaggaggacagcaacagcgtggtgctgagcttcgacagcgccggccagaccctgggcagcgagtacgacagactgggcttcctgctgaacctggacagcaagctgcccgccgagctggccaccaagtacgccaacttcagcgagggcgcctgcaagcccggctacgccagcgccctgatgaccgccatcttccccagattcagcaagcccgcccccatgttcctggacgacagcttcagaaagtgggccagaatcagagagttcgtgccccccttcggcatcaagggccaggtgctggacgcccagtaccccgccagagagagagtgagcgccgaggccggcgagagcagcagacaccactag

SEQ ID NO: 100851 - DNA, 1035 bp, Artificial Sequence
  Description of Artificial Sequence: Synthetic coding sequence
atgggcctgctggtgttcgtgagaaacctgctgctggccctgtgcctgttcctggtgctgggcttcctgtactacagcgcctggaagctgcacctgctgcagtgggaggaggacagcaacagcgtggtgctgagcttcgacagcgccggccagaccctgggcagcgagtacgacagactgggcttcctgctgaacctggacagcaagctgttcagcaagcccgcccccatgttcctggacgacagcttcagaaagtgggccagaatcagagagttcgtgccccccttcggcatcaagggccaggacaacctgatcaaggccatcctgagcgtgaccaaggagtacagactgacccccgccctggacagcctgagatgcagaagatgcatcatcgtgggcaacggcggcgtgctggccaacaagagcctgggcagcagaatcgacgactacgacatcgtggtgagactgaacagcgcccccgtgaagggcttcgagaaggacgtgggcagcaagaccaccctgagaatcacctaccccgagggcgccatgcagagacccgagcagtacgagagagacagcctgttcgtgctggccggcttcaagtggcaggacttcaagtggctgaagtacatcgtgtacaaggagagagtgagcgccagcgacggcttctggaagagcgtggccaccagagtgcccaaggagccccccgagatcagaatcctgaacccctacttcatccaggaggccgccttcaccctgatcggcctgcccttcaacaacggcctgatgggcagaggcaacatccccaccctgggcagcgtggccgtgaccatggccctgcacggctgcgacgaggtggccgtggccggcttcggctacgacatgagcacccccaacgcccccctgcactactacgagaccgtgagaatggccgccatcaaggagagctggacccacaacatccagagagagaaggagttcctgagaaagctggtgaaggccagagtgatcaccgacctgagcagcggcatctag

SEQ ID NO: 100852 - DNA, 687 bp, Artificial Sequence
  Description of Artificial Sequence: Synthetic coding sequence
atgggcctgctggtgttcgtgagaaacctgctgctggccctgtgcctgttcctggtgctgggcttcctgtactacagcgcctggaagctgcacctgctgcagtgggaggaggacagcaagtacgacagactgggcttcctgctgaacctggacagcaagctgcccgccgagctggccaccaagtacgccaacttcagcgagggcgcctgcaagcccggctacgccagcgccctgatgaccgccatcttccccagattcagcaagcccgcccccatgttcctggacgacagcttcagaaagtgggccagaatcagagagttcgtgccccccttcggcatcaagggccaggacaacctgatcaaggccatcctgagcgtgaccaaggagtacagactgacccccgccctggacagcctgagatgcagaagatgcatcatcgtgggcaacggcggcgtgctggccaacaagagcctgggcagcagaatcgacgactacgacatcgtggtgagagtgcacagaatggccagcggcaacctgtggcccctggagtgccccagaagccccctgagattcgagagcagcacccacatcagcagcagaagaccccccagccccagcctggcctgccccagcaccatggccagctgggccggcggcaccagcctgcccctggccgtgtggcagtag

SEQ ID NO: 100853 - DNA, 1173 bp, Artificial Sequence
  Description of Artificial Sequence: Synthetic coding sequence
atgggcctgctggtgttcgtgagaaacctgctgctggccctgtgcctgttcctggtgctgggcttcctgtactacagcgcctggaagctgcacctgctgcagtgggaggaggacagcagcaagtacagccacagcagcagcccccaggagaagcccgtggccgacagcgtggtgctgagcttcgacagcgccggccagaccctgggcagcgagtacgacagactgggcttcctgctgaacctggacagcaagctgcccgccgagctggccaccaagtacgccaacttcagcgagggcgcctgcaagcccggctacgccagcgccctgatgaccgccatcttccccagattcagcaagcccgcccccatgttcctggacgacagcttcagaaagtgggccagaatcagagagttcgtgccccccttcggcatcaagggccaggacaacctgatcaaggccatcctgagcgtgaccaaggagtacagactgacccccgccctggacagcctgagatgcagaagatgcatcatcgtgggcaacggcggcgtgctggccaacaagagcctgggcagcagaatcgacgactacgacatcgtggtgagactgaacagcgcccccgtgaagggcttcgagaaggacgtgggcagcaagaccaccctgagaatcacctaccccgagggcgccatgcagagacccgagcagtacgagagagacagcctgttcgtgctggccggcttcaagtggcaggacttcaagtggctgaagtacatcgtgtacaaggagagagtgagcgccagcgacggcttctggaagagcgtggccaccagagtgcccaaggagccccccgagatcagaatcctgaacccctacttcatccaggaggccgccttcaccctgatcggcctgcccttcaacaacggcctgatgggcagaggcaacatccccaccctgggcagcgtggccgtgaccatggccctgcacggctgcgacgaggtggccgtggccggcttcggctacgacatgagcacccccaacgcccccctgcactactacgagaccgtgagaatggccgccatcaaggagagctggacccacaacatccagagagagaaggagttcctgagaaagctggtgaaggccagagtgatcaccgacctgagcagcggcatctag

SEQ ID NO: 100854 - DNA, 1242 bp, Artificial Sequence
  Description of Artificial Sequence: Synthetic coding sequence
atgggcctgctggtgttcgtgagaaacctgctgctggccctgtgcctgttcctggtgctgggcttcctgtactacagcgcctggaagctgcacctgctgcagtgggaggaggacagcaagtacgacagactgggcttcctgctgaacctggacagcaagctgagccccagaaccctgtgcaccgtggtgttcggcctggactgcatcctggagagccccggcgagcccaagaagctgctgatgcccgccagccaccccctggagatcctgaagagcctgagcgaggacaccgccttcgccctgggcttcctgaagctgcccagacccgccgagctggccaccaagtacgccaacttcagcgagggcgcctgcaagcccggctacgccagcgccctgatgaccgccatcttccccagattcagcaagcccgcccccatgttcctggacgacagcttcagaaagtgggccagaatcagagagttcgtgccccccttcggcatcaagggccaggacaacctgatcaaggccatcctgagcgtgaccaaggagtacagactgacccccgccctggacagcctgagatgcagaagatgcatcatcgtgggcaacggcggcgtgctggccaacaagagcctgggcagcagaatcgacgactacgacatcgtggtgagactgaacagcgcccccgtgaagggcttcgagaaggacgtgggcagcaagaccaccctgagaatcacctaccccgagggcgccatgcagagacccgagcagtacgagagagacagcctgttcgtgctggccggcttcaagtggcaggacttcaagtggctgaagtacatcgtgtacaaggagagagtgagcgccagcgacggcttctggaagagcgtggccaccagagtgcccaaggagccccccgagatcagaatcctgaacccctacttcatccaggaggccgccttcaccctgatcggcctgcccttcaacaacggcctgatgggcagaggcaacatccccaccctgggcagcgtggccgtgaccatggccctgcacggctgcgacgaggtggccgtggccggcttcggctacgacatgagcacccccaacgcccccctgcactactacgagaccgtgagaatggccgccatcaaggagagctggacccacaacatccagagagagaaggagttcctgagaaagctggtgaaggccagagtgatcaccgacctgagcagcggcatctag

SEQ ID NO: 100855 - DNA, 834 bp, Artificial Sequence
  Description of Artificial Sequence: Synthetic coding sequence
atgggcctgctggtgttcgtgagaaacctgctgctggccctgtgcctgttcctggtgctgggcttcctgtactacagcgcctggaagctgcacctgctgcagtgggaggaggacagcaacagcgtggtgctgagcttcgacagcgccggccagaccctgggcagcgagtacgacagactgggcttcctgctgaacctggacagcaagctgcccgccgagctggccaccaagtacgccaacttcagcgagggcgcctgcaagcccggctacgccagcgccctgatgaccgccatcttccccagattcagcaagcccgcccccatgttcctggacgacagcttcagaaagtgggccagaatcagagagttcgtgccccccttcggcatcaagggccaggacaacctgatcaaggccatcctgagcgtgaccaaggagtacagactgacccccgccctggacagcctgagatgcagaagatgcatcatcgtgggcaacggcggcgtgctggccaacaagagcctgggcagcagaatcgacgactacgacatcgtggtgagactgaacagcgcccccgtgaagggcttcgagaaggacgtgggcagcaagaccaccctgagaatcacctaccccgagggcgccatgcagagacccgagcagtacgagagagacagcctgttcgtgctggccggcttcaagtggcaggacttcaagtggctgaagtacatcgtgtacaaggagagagtgagctggacccacaacatccagagagagaaggagttcctgagaaagctggtgaaggccagagtgatcaccgacctgagcagcggcatctag

SEQ ID NO: 100856 - DNA, 1128 bp, Artificial Sequence
  Description of Artificial Sequence: Synthetic coding sequence
atgggcctgctggtgttcgtgagaaacctgctgctggccctgtgcctgttcctggtgctgggcttcctgtactacagcgcctggaagctgcacctgctgcagtgggaggaggacagcaacagcgtggtgctgagcttcgacagcgccggccagaccctgggcagcgagtacgacagactgggcttcctgctgaacctggacagcaagctgcccgccgagctggccaccaagtacgccaacttcagcgagggcgcctgcaagcccggctacgccagcgccctgatgaccgccatcttccccagattcagcaagcccgcccccatgttcctggacgacagcttcagaaagtgggccagaatcagagagttcgtgccccccttcggcatcaagggccaggacaacctgatcaaggccatcctgagcgtgaccaaggagtacagactgacccccgccctggacagcctgagatgcagaagatgcatcatcgtgggcaacggcggcgtgctggccaacaagagcctgggcagcagaatcgacgactacgacatcgtggtgagactgaacagcgcccccgtgaagggcttcgagaaggacgtgggcagcaagaccaccctgagaatcacctaccccgagggcgccatgcagagacccgagcagtacgagagagacagcctgttcgtgctggccggcttcaagtggcaggacttcaagtggctgaagtacatcgtgtacaaggagagagtgagcgccagcgacggcttctggaagagcgtggccaccagagtgcccaaggagccccccgagatcagaatcctgaacccctacttcatccaggaggccgccttcaccctgatcggcctgcccttcaacaacggcctgatgggcagaggcaacatccccaccctgggcagcgtggccgtgaccatggccctgcacggctgcgacgaggtggccgtggccggcttcggctacgacatgagcacccccaacgcccccctgcactactacgagaccgtgagaatggccgccatcaaggagagctggacccacaacatccagagagagaaggagttcctgagaaagctggtgaaggccagagtgatcaccgacctgagcagcggcatctag

SEQ ID NO: 100857 - DNA, 1080 bp, Artificial Sequence
  Description of Artificial Sequence: Synthetic coding sequence
atgggcctgctggtgttcgtgagaaacctgctgctggccctgtgcctgttcctggtgctgggcttcctgtactacagcgcctggaagctgcacctgctgcagtgggaggaggacagcaagtacgacagactgggcttcctgctgaacctggacagcaagctgcccgccgagctggccaccaagtacgccaacttcagcgagggcgcctgcaagcccggctacgccagcgccctgatgaccgccatcttccccagattcagcaagcccgcccccatgttcctggacgacagcttcagaaagtgggccagaatcagagagttcgtgccccccttcggcatcaagggccaggacaacctgatcaaggccatcctgagcgtgaccaaggagtacagactgacccccgccctggacagcctgagatgcagaagatgcatcatcgtgggcaacggcggcgtgctggccaacaagagcctgggcagcagaatcgacgactacgacatcgtggtgagactgaacagcgcccccgtgaagggcttcgagaaggacgtgggcagcaagaccaccctgagaatcacctaccccgagggcgccatgcagagacccgagcagtacgagagagacagcctgttcgtgctggccggcttcaagtggcaggacttcaagtggctgaagtacatcgtgtacaaggagagagtgagcgccagcgacggcttctggaagagcgtggccaccagagtgcccaaggagccccccgagatcagaatcctgaacccctacttcatccaggaggccgccttcaccctgatcggcctgcccttcaacaacggcctgatgggcagaggcaacatccccaccctgggcagcgtggccgtgaccatggccctgcacggctgcgacgaggtggccgtggccggcttcggctacgacatgagcacccccaacgcccccctgcactactacgagaccgtgagaatggccgccatcaaggagagctggacccacaacatccagagagagaaggagttcctgagaaagctggtgaaggccagagtgatcaccgacctgagcagcggcatctag

SEQ ID NO: 100858 - DNA, 1335 bp, Artificial Sequence; identical to SEQ ID NO: 100849
  Description of Artificial Sequence: Synthetic coding sequence

SEQ ID NO: 100859 - DNA, 513 bp, Artificial Sequence
  Description of Artificial Sequence: Synthetic coding sequence
atgggcctgctggtgttcgtgagaaacctgctgctggccctgtgcctgttcctggtgctgggcttcctgtactacagcgcctggaagctgcacctgctgcagtgggaggaggacagcagcaagtacagccacagcagcagcccccaggagaagcccgtggccgacagcgtggtgctgagcttcgacagcgccggccagaccctgggcagcgagtacgacagactgggcttcctgctgaacctggacagcaagctgcccgccgagctggccaccaagtacgccaacttcagcgagggcgcctgcaagcccggctacgccagcgccctgatgaccgccatcttccccagattcagcaagcccgcccccatgttcctggacgacagcttcagaaagtgggccagaatcagagagttcgtgccccccttcggcatcaagggccaggtgctggacgcccagtaccccgccagagagagagtgagcgccgaggccggcgagagcagcagacaccactag

SEQ ID NO: 100860 - DNA, 468 bp, Artificial Sequence; identical to SEQ ID NO: 100850
  Description of Artificial Sequence: Synthetic coding sequence

SEQ ID NO: 100861 - DNA, 561 bp, Artificial Sequence
  Description of Artificial Sequence: Synthetic coding sequence
atgggcctgctggtgttcgtgagaaacctgctgctggccctgtgcctgttcctggtgctgggcttcctgtactacagcgcctggaagctgcacctgctgcagtgggaggaggacagcaacagcgtggtgctgagcttcgacagcgccggccagaccctgggcagcgagtacgacagactgggcttcctgctgaacctggacagcaagctgcccgccgagctggccaccaagtacgccaacttcagcgagggcgcctgcaagcccggctacgccagcgccctgatgaccgccatcttccccagattcagcaagcccgcccccatgttcctggacgacagcttcagaaagtgggccagaatcagagagttcgtgccccccttcggcatcaagggccaggacaacctgatcaaggccatcctgagcgtgaccaaggagtacagactgacccccgccctggacagcctgagatgcagaagatgcatcatcgtgggcaacggcggcgtgctggccaacaagagcctgggcagcagaatcgacgactacgacatcgtggtgagatag

SEQ ID NO: 100862 - DNA, 558 bp, Artificial Sequence
  Description of Artificial Sequence: Synthetic coding sequence
atgggcctgctggtgttcgtgagaaacctgctgctggccctgtgcctgttcctggtgctgggcttcctgtactacagcgcctggaagctgcacctgctgcagtgggaggaggacagcagcaagtacagccacagcagcagcccccaggagaagcccgtggccgagtacgacagactgggcttcctgctgaacctggacagcaagctgcccgccgagctggccaccaagtacgccaacttcagcgagggcgcctgcaagcccggctacgccagcgccctgatgaccgccatcttccccagattcagcaagcccgcccccatgttcctggacgacagcttcagaaagtgggccagaatcagagagttcgtgccccccttcggcatcaagggccaggacaacctgatcaaggccatcctgagcgtgaccaaggagtacagactgacccccgccctggacagcctgagatgcagaagatgcatcatcgtgggcaacggcggcgtgctggccaacaagagcctgggcagcagaatcgacgactacgacatcgtggtgagatag

SEQ ID NO: 100863 - DNA, 606 bp, Artificial Sequence
  Description of Artificial Sequence: Synthetic coding sequence
atgggcctgctggtgttcgtgagaaacctgctgctggccctgtgcctgttcctggtgctgggcttcctgtactacagcgcctggaagctgcacctgctgcagtgggaggaggacagcagcaagtacagccacagcagcagcccccaggagaagcccgtggccgagtacgacagactgggcttcctgctgaacctggacagcaagctgcccgccgagctggccaccaagtacgccaacttcagcgagggcgcctgcaagcccggctacgccagcgccctgatgaccgccatcttccccagattcagcaagcccgcccccatgttcctggacgacagcttcagaaagtgggccagaatcagagagttcgtgccccccttcggcatcaagggccaggacaacctgatcaaggccatcctgagcgtgaccaaggagtacagactgacccccgccctggacagcctgagatgcagaagatgcatcatcgtgggcaacggcggcgtgctggccaacaagagcctgggcagcagaatcgacgactacgacatcgtggtgagccccggcagaaccatcagcagcgagagaaagagcttctgcggcagctggtag

SEQ ID NO: 100864 - DNA, 1290 bp, Artificial Sequence
  Description of Artificial Sequence: Synthetic coding sequence
atgggcctgctggtgttcgtgagaaacctgctgctggccctgtgcctgttcctggtgctgggcttcctgtactacagcgcctggaagctgcacctgctgcagtgggaggaggacagcaacagcgtggtgctgagcttcgacagcgccggccagaccctgggcagcgagtacgacagactgggcttcctgctgaacctggacagcaagctgagccccagaaccctgtgcaccgtggtgttcggcctggactgcatcctggagagccccggcgagcccaagaagctgctgatgcccgccagccaccccctggagatcctgaagagcctgagcgaggacaccgccttcgccctgggcttcctgaagctgcccagacccgccgagctggccaccaagtacgccaacttcagcgagggcgcctgcaagcccggctacgccagcgccctgatgaccgccatcttccccagattcagcaagcccgcccccatgttcctggacgacagcttcagaaagtgggccagaatcagagagttcgtgccccccttcggcatcaagggccaggacaacctgatcaaggccatcctgagcgtgaccaaggagtacagactgacccccgccctggacagcctgagatgcagaagatgcatcatcgtgggcaacggcggcgtgctggccaacaagagcctgggcagcagaatcgacgactacgacatcgtggtgagactgaacagcgcccccgtgaagggcttcgagaaggacgtgggcagcaagaccaccctgagaatcacctaccccgagggcgccatgcagagacccgagcagtacgagagagacagcctgttcgtgctggccggcttcaagtggcaggacttcaagtggctgaagtacatcgtgtacaaggagagagtgagcgccagcgacggcttctggaagagcgtggccaccagagtgcccaaggagccccccgagatcagaatcctgaacccctacttcatccaggaggccgccttcaccctgatcggcctgcccttcaacaacggcctgatgggcagaggcaacatccccaccctgggcagcgtggccgtgaccatggccctgcacggctgcgacgaggtggccgtggccggcttcggctacgacatgagcacccccaacgcccccctgcactactacgagaccgtgagaatggccgccatcaaggagagctggacccacaacatccagagagagaaggagttcctgagaaagctggtgaaggccagagtgatcaccgacctgagcagcggcatctag

SEQ ID NO: 100865 - DNA, 1038 bp, Artificial Sequence
  Description of Artificial Sequence: Synthetic coding sequence
atgggcctgctggtgttcgtgagaaacctgctgctggccctgtgcctgttcctggtgctgggcttcctgtactacagcgcctggaagctgcacctgctgcagtgggaggaggacagcaacagcgtggtgctgagcttcgacagcgccggccagaccctgggcagcgagtacgacagactgggcttcctgctgaacctggacagcaagctgcccgccgagctggccaccaagtacgccaacttcagcgagggcgcctgcaagcccggctacgccagcgccctgatgaccgccatcttccccagattcagcaagcccgcccccatgttcctggacgacagcttcagaaagtgggccagaatcagagagttcgtgccccccttcggcatcaagggccaggacaacctgatcaaggccatcctgagcgtgaccaaggagtacagactgacccccgccctggacagcctgagatgcagaagatgcatcatcgtgggcaacggcggcgtgctggccaacaagagcctgggcagcagaatcgacgactacgacatcgtggtgagactgaacagcgcccccgtgaagggcttcgagaaggacgtgggcagcaagaccaccctgagaatcacctaccccgagggcgccatgcagagacccgagcagtacgagagagacagcctgttcgtgctggccggcttcaagtggcaggacttcaagtggctgaagtacatcgtgtacaaggagagagtggaggccgccttcaccctgatcggcctgcccttcaacaacggcctgatgggcagaggcaacatccccaccctgggcagcgtggccgtgaccatggccctgcacggctgcgacgaggtggccgtggccggcttcggctacgacatgagcacccccaacgcccccctgcactactacgagaccgtgagaatggccgccatcaaggagagctggacccacaacatccagagagagaaggagttcctgagaaagctggtgaaggccagagtgatcaccgacctgagcagcggcatctag

SEQ ID NO: 100866 - DNA, 1242 bp, Artificial Sequence; identical to SEQ ID NO: 100854
  Description of Artificial Sequence: Synthetic coding sequence

SEQ ID NO: 100867 - DNA, 1035 bp, Artificial Sequence; identical to SEQ ID NO: 100851
  Description of Artificial Sequence: Synthetic coding sequence

SEQ ID NO: 100868 - DNA, 1290 bp, Artificial Sequence; identical to SEQ ID NO: 100864
  Description of Artificial Sequence: Synthetic coding sequence

SEQ ID NO: 100869 - DNA, 456 bp, Artificial Sequence
  Description of Artificial Sequence: Synthetic coding sequence
atgggcctgctggtgttcgtgagaaacctgctgctggccctgtgcctgttcctggtgctgggcttcctgtactacagcgcctggaagctgcacctgctgcagtgggaggaggacagcaacagcgtggtgctgagcttcgacagcgccggccagaccctgggcagcgagtacgacagactgggcttcctgctgaacctggacagcaagctgcccgccgagctggccaccaagtacgccaacttcagcgagggcgcctgcaagcccggctacgccagcgccctgatgaccgccatcttccccagattcagcaagcccgcccccatgttcctggacgacagcttcagaaagtgggccagaatcagagagttcgtgccccccttcggcatcaagggccaggagtgcatcggctggctgctggagatctgcggccacagcagcgcccagggcgccccctag

SEQ ID NO: 100870 - DNA, 561 bp, Artificial Sequence
  Description of Artificial Sequence: Synthetic coding sequence
atgggcctgctggtgttcgtgagaaacctgctgctggccctgtgcctgttcctggtgctgggcttcctgtactacagcgcctggaagctgcacctgctgcagtgggaggaggacagcaagtacgacagactgggcttcctgctgaacctggacagcaagctgcccgccgagctggccaccaagtacgccaacttcagcgagggcgcctgcaagcccggctacgccagcgccctgatgaccgccatcttccccagattcagcaagcccgcccccatgttcctggacgacagcttcagaaagtgggccagaatcagagagttcgtgccccccttcggcatcaagggccaggacaacctgatcaaggccatcctgagcgtgaccaaggagtacagactgacccccgccctggacagcctgagatgcagaagatgcatcatcgtgggcaacggcggcgtgctggccaacaagagcctgggcagcagaatcgacgactacgacatcgtggtgagccccggcagaaccatcagcagcgagagaaagagcttctgcggcagctggtag

SEQ ID NO: 100871 - DNA, 420 bp, Artificial Sequence
  Description of Artificial Sequence: Synthetic coding sequence
atgggcctgctggtgttcgtgagaaacctgctgctggccctgtgcctgttcctggtgctgggcttcctgtactacagcgcctggaagctgcacctgctgcagtgggaggaggacagcaagtacgacagactgggcttcctgctgaacctggacagcaagctgcccgccgagctggccaccaagtacgccaacttcagcgagggcgcctgcaagcccggctacgccagcgccctgatgaccgccatcttccccagattcagcaagcccgcccccatgttcctggacgacagcttcagaaagtgggccagaatcagagagttcgtgccccccttcggcatcaagggccaggtgctggacgcccagtaccccgccagagagagagtgagcgccgaggccggcgagagcagcagacaccactag

SEQ ID NO: 100872 - DNA, 306 bp, Artificial Sequence
  Description of Artificial Sequence: Synthetic coding sequence
atgggcctgctggtgttcgtgagaaacctgctgctggccctgtgcctgttcctggtgctgggcttcctgtactacagcgcctggaagctgcacctgctgcagtgggaggaggacagcaagtacgacagactgggcttcctgctgaacctggacagcaagctgcccgccgagctggccaccaagtacgccaacttcagcgagggcgcctgcaagcccggctacgccagcgccctgatgaccgccatcttccccagacccggcagaaccatcagcagcgagagaaagagcttctgcggcagctggtag

SEQ ID NO: 100873 - DNA, 786 bp, Artificial Sequence
  Description of Artificial Sequence: Synthetic coding sequence
atgggcctgctggtgttcgtgagaaacctgctgctggccctgtgcctgttcctggtgctgggcttcctgtactacagcgcctggaagctgcacctgctgcagtgggaggaggacagcaagtacgacagactgggcttcctgctgaacctggacagcaagctgcccgccgagctggccaccaagtacgccaacttcagcgagggcgcctgcaagcccggctacgccagcgccctgatgaccgccatcttccccagattcagcaagcccgcccccatgttcctggacgacagcttcagaaagtgggccagaatcagagagttcgtgccccccttcggcatcaagggccaggacaacctgatcaaggccatcctgagcgtgaccaaggagtacagactgacccccgccctggacagcctgagatgcagaagatgcatcatcgtgggcaacggcggcgtgctggccaacaagagcctgggcagcagaatcgacgactacgacatcgtggtgagactgaacagcgcccccgtgaagggcttcgagaaggacgtgggcagcaagaccaccctgagaatcacctaccccgagggcgccatgcagagacccgagcagtacgagagagacagcctgttcgtgctggccggcttcaagtggcaggacttcaagtggctgaagtacatcgtgtacaaggagagagtgagctggacccacaacatccagagagagaaggagttcctgagaaagctggtgaaggccagagtgatcaccgacctgagcagcggcatctag

SEQ ID NO: 100874 - DNA, 834 bp, Artificial Sequence; identical to SEQ ID NO: 100855
  Description of Artificial Sequence: Synthetic coding sequence

SEQ ID NO: 100875 - DNA, 513 bp, Artificial Sequence; identical to SEQ ID NO: 100859
  Description of Artificial Sequence: Synthetic coding sequence

SEQ ID NO: 100876 - DNA, 642 bp, Artificial Sequence
  Description of Artificial Sequence: Synthetic coding sequence
atgagaaccagcgccgagtacttcagactggccctgagcaagctgcagagctgcgacctgttcgacgagttcgacaagatgaacaacggccccgtgctgggccacgaggaggaggtgggcagaagaaccaccttcagactgttctaccccgagagcgtgttcagcgaccccatccacaacgaccccaacaccaccgtgatcctgaccgccttcaagccccacgacctgagatggctgctggagctgctgatgggcgacaagatcaacaccaacggcttctggaagaagcccgccctgaacctgatctacaagccctaccagatcagaatcctggaccccttcatcatcagaaccgccgcctacgagctgctgcacttccccaaggtgttccccaagaaccagaagcccaagcaccccaccaccggcatcatcgccatcaccctggccttctacatctgccacgaggtgcacctggccggcttcaagtacaacttcagcgacctgaagagccccctgcactactacggcaacgccaccatgagcctgatgaacaagaacgcctaccacaacgtgaccgccgagcagctgttcctgaaggacatcatcgagaagaacctggtgatcaacctgacccaggactag

SEQ ID NO: 100877 - DNA, 996 bp, Artificial Sequence
  Description of Artificial Sequence: Synthetic coding sequence
atgagaggctacctggtggccatcttcctgagcgccgtgttcctgtactacgtgctgcactgcatcctgtggggcaccaacgtgtactgggtggcccccgtggagatgaagagaagaaacaagatccagccctgcctgagcaagcccgccttcgccagcctgctgagattccaccagttccaccccttcctgtgcgccgccgacttcagaaagatcgccagcctgtacggcagcgacaagttcgacctgccctacggcatgagaaccagcgccgagtacttcagactggccctgagcaagctgcagagctgcgacctgttcgacgagttcgacaacatcccctgcaagaagtgcgtggtggtgggcaacggcggcgtgctgaagaacaagaccctgggcgagaagatcgacagctacgacgtgatcatcagaatgaacaacggccccgtgctgggccacgaggaggaggtgggcagaagaaccaccttcagactgttctaccccgagagcgtgttcagcgaccccatccacaacgaccccaacaccaccgtgatcctgaccgccttcaagccccacgacctgagatggctgctggagctgctgatgggcgacaagatcaacaccaacggcttctggaagaagcccgccctgaacctgatctacaagccctaccagatcagaatcctggaccccttcatcatcagaaccgccgcctacgagctgctgcacttccccaaggtgttccccaagaaccagaagcccaagcaccccaccaccggcatcatcgccatcaccctggccttctacatctgccacgaggtgcacctggccggcttcaagtacaacttcagcgacctgaagagccccctgcactactacggcaacgccaccatgagcctgatgaacaagaacgcctaccacaacgtgaccgccgagcagctgttcctgaaggacatcatcgagaagaacctggtgatcaacctgacccaggactag

SEQ ID NO: 100878 - DNA, 996 bp, Artificial Sequence; identical to SEQ ID NO: 100877
  Description of Artificial Sequence: Synthetic coding sequence

SEQ ID NO: 100879 - DNA, 696 bp, Artificial Sequence
  Description of Artificial Sequence: Synthetic coding sequence
atgagaggctacctggtggccatcttcctgagcgccgtgttcctgtactacgtgctgcactgcatcctgtggggcaccaacgtgtactgggtggcccccgtggagatgaagagaagaaacaagatccagccctgcctgagcaagcccgccttcgccagcctgctgagattccaccagttccaccccttcctgtgcgccgccgacttcagaaagatcgccagcctgtacggcagcgacaagttcgacctgccctacggcatgagaaccagcgccgagtacttcagactggccctgagcaagctgcagagctgcgacctgttcgacgagttcgacaacatcccctgcaagaagtgcgtggtggtgggcaacggcggcgtgctgaagaacaagaccctgggcgagaagatcgacagctacgacgtgatcatcagaatgaacaacggccccgtgctgggccacgaggaggaggtgggcagaagaaccaccttcagactgttctaccccgagagcgtgttcagcgaccccatccacaacgaccccaacaccaccgtgatcctgaccgccttcaagccccacgacctgagatggctgctggagctgctgatgggcgacaagatcaacaccaacggcttctggaagaagcccgccctgaacctgatctacaagccctaccagatcagaatcctggacccctag

SEQ ID NO: 100880 - DNA, 741 bp, Artificial Sequence
  Description of Artificial Sequence: Synthetic coding sequence
atgcactgcagagactgcgccctggtgaccagcagcggccacctgctgcacagcagacagggcagccagatcgaccagaccgagtgcgtgatcagaatgaacgacgcccccaccagaggctacggcagagacgtgggcaacagaaccagcctgagagtgatcgcccacagcagcatccagagaatcctgagaaacagacacgacctgctgaacgtgagccagggcaccgtgttcatcttctggggccccagcagctacatgagaagagacggcaagggccaggtgtacaacaacctgcacctgctgagccaggtgctgcccagactgaaggccttcatgatcaccagacacaagatgctgcagttcgacgagctgttcaagcaggagaccggcaaggacagaaagatcagcaacacctggctgagcaccggctggttcaccatgaccatcgccctggagctgtgcgacagaatcaacgtgtacggcatggtgccccccgacttctgcagagaccccaaccaccccagcgtgccctaccactactacgagcccttcggccccgacgagtgcaccatgtacctgagccacgagagaggcagaaagggcagccaccacagattcatcaccgagaagagagtgttcaagaactgggccagaaccttcaacatccacttcttccagcccgactggaagcccgagagcctggccatcaaccaccccgagaacaagcccgtgttctag

SEQ ID NO: 100881 - DNA, 1011 bp, Artificial Sequence
  Description of Artificial Sequence: Synthetic coding sequence
atgaagaccctgatgagacacggcctggccgtgtgcctggccctgaccaccatgtgcaccagcctgctgctggtgtacagcagcctgggcggccagaaggagagacccccccagcagcagcagcagcagcagcagcagcagcagcaggccagcgccaccggcagcagccagcccgccgccgagagcagcacccagcagagacccggcgtgcccgccggccccagacccctggacggctacctgggcgtggccgaccacaagcccctgaagatgcactgcagagactgcgccctggtgaccagcagcggccacctgctgcacagcagacagggcagccagatcgaccagaccgagtgcgtgatcagaatgaacgacgcccccaccagaggctacggcagagacgtgggcaacagaaccagcctgagagtgatcgcccacagcagcatccagagaatcctgagaaacagacacgacctgctgaacgtgagccagggcaccgtgttcatcttctggggccccagcagctacatgagaagagacggcaagggccaggtgtacaacaacctgcacctgctgagccaggtgctgcccagactgaaggccttcatgatcaccagacacaagatgctgcagttcgacgagctgttcaagcaggagaccggcaaggacagaaagatcagcaacacctggctgagcaccggctggttcaccatgaccatcgccctggagctgtgcgacagaatcaacgtgtacggcatggtgccccccgacttctgcagagaccccaaccaccccagcgtgccctaccactactacgagcccttcggccccgacgagtgcaccatgtacctgagccacgagagaggcagaaagggcagccaccacagattcatcaccgagaagagagtgttcaagaactgggccagaaccttcaacatccacttcttccagcccgactggaagcccgagagcctggccatcaaccaccccgagaacaagcccgtgttctag

SEQ ID NO: 100882 - DNA, 1275 bp, Artificial Sequence
  Description of Artificial Sequence: Synthetic coding sequence
atgagcgaccacggcgacgtgagcctgccccccgaggacagagtgagagccctgagccagctgggcagcgccgtggaggtgaacgaggacatcccccccagaagatacttcagaagcggcgtggagatcatcagaatggccagcatctacagcgaggagggcaacatcgagcacgccttcatcctgtacaacaagtacatcaccctgttcatcgagaagctgcccaagcacagagactacaagagcgccgtgatccccgagaagaaggacaccgtgaagaagctgaaggagatcgccttccccaaggccgaggagctgaaggccgagctgctgaagagatacaccaaggagtacaccgagtacaacgaggagaagaagaaggaggccgaggagctggccagaaacatggccatccagcaggagctggagaaggagaagcagagagtggcccagcagaagcagcagcagctggagcaggagcagttccacgccttcgaggagatgatcagaaaccaggagctggagaaggagagactgaagatcgtgcaggagttcggcaaggtggaccccggcctgggcggccccctggtgcccgacctggagaagcccagcctggacgtgttccccaccctgaccgtgagcagcatccagcccagcgactgccacaccaccgtgagacccgccaagccccccgtggtggacagaagcctgaagcccggcgccctgagcaacagcgagagcatccccaccatcgacggcctgagacacgtggtggtgcccggcagactgtgcccccagttcctgcagctggccagcgccaacaccgccagaggcgtggagacctgcggcatcctgtgcggcaagctgatgagaaacgagttcaccatcacccacgtgctgatccccaagcagagcgccggcagcgactactgcaacaccgagaacgaggaggagctgttcctgatccaggaccagcagggcctgatcaccctgggctggatccacacccaccccacccagaccgccttcctgagcagcgtggacctgcacacccactgcagctaccagatgatgctgcccgagagcgtggccatcgtgtgcagccccaagttccaggagaccggcttcttcaagctgaccgaccacggcctggaggagatcagcagctgcagacagaagggcttccacccccacagcaaggacccccccctgttctgcagctgcagccacgtgaccgtggtggacagagccgtgaccatcaccgacctgagatag

SEQ ID NO: 100883 - DNA, 1275 bp, Artificial Sequence; identical to SEQ ID NO: 100882
  Description of Artificial Sequence: Synthetic coding sequence

SEQ ID NO: 100884 - DNA, 1275 bp, Artificial Sequence; identical to SEQ ID NO: 100882
  Description of Artificial Sequence: Synthetic coding sequence

SEQ ID NO: 100885 - DNA, 1275 bp, Artificial Sequence; identical to SEQ ID NO: 100882
  Description of Artificial Sequence: Synthetic coding sequence

SEQ ID NO: 100886 - DNA, 492 bp, Artificial Sequence
  Description of Artificial Sequence: Synthetic coding sequence
atgagcgaccacggcgacgtgagcctgccccccgaggacagagtgagagccctgagccagctgggcagcgccgtggaggtgaacgaggacatcccccccagaagatacttcagaagcggcgtggagatcatcagaatggccagcatctacagcgaggagggcaacatcgagcacgccttcatcctgtacaacaagtacatcaccctgttcatcgagaagctgcccaagcacagagactacaagagcgccgtgatccccgagaagaaggacaccgtgaagaagctgaaggagatcgccttccccaaggccgaggagctgaaggccgagctgctgaagagatacaccaaggagtacaccgagtacaacgaggagaagaagaaggaggccgaggagctggccagaaacatggccatccagcaggagctggagaaggagaagcagagagtggcccagcagaagcagcagcagctggagcaggagcagttccactag

SEQ ID NO: 100887 - DNA, 957 bp, Artificial Sequence
  Description of Artificial Sequence: Synthetic coding sequence
atgagcgaccacggcgacgtgagcctgccccccgaggacagagtgagagccctgagccagctgggcagcgccgtggaggtgaacgaggacatcccccccagaagatacttcagaagcggcgtggagatcatcagaatggccagcatctacagcgaggagggcaacatcgagcacgccttcatcctgtacaacaagtacatcaccctgttcatcgagaagctgcccaagcacagagactacaagagcgccgtgatccccgagaagaaggacaccgtgaagaagctgaaggagatcgccttccccaaggccgaggagctgaaggccgagctgctgaagagatacaccaaggagtacaccgagtacaacgaggagaagaagaaggaggccgaggagctggccagaaacatggccatccagcaggagctggagaaggagaagcagagagtggcccagcagaagcagcagcagctggagcaggagcagttccacgccttcgaggagatgatcagaaaccaggagctggagaaggagagactgaagatcgtgcaggagttcggcaaggtggaccccggcctgggcggccccctggtgcccgacctggagaagcccagcctggacgtgttccccaccctgaccgtgagcagcatccagcccagcgactgccacaccaccgtgagacccgccaagccccccgtggtggacagaagcctgaagcccggcgccctgagcaacagcgagagcatccccaccatcgacggcctgagacacgtggtggtgcccggcagactgtgcccccagttcctgcagctggccagcgccaacaccgccagaggcgtggagacctgcggcatcctgtgcggcaagctgatgagaaacgagttcaccatcacccacgtgctgatccccaagcagagcgccggcagcgactactgcaacaccgagaacgaggaggagtag

SEQ ID NO: 100888 - DNA, 414 bp, Artificial Sequence
  Description of Artificial Sequence: Synthetic coding sequence
atgagcgaccacggcgacgtgagcctgccccccgaggacagagtgagagccctgagccagctgggcagcgccgtggaggtgaacgaggacatcccccccagaagatacttcagaagcggcgtggagatcatcagaatggccagcatctacagcgaggagggcaacatcgagcacgccttcatcctgtacaacaagtacatcaccctgttcatcgagaagctgcccaagcacagagactacaagagcgccgtgatccccgagaagaaggacaccgtgaagaagctgaaggagatcgccttccccaaggccgaggagctgaaggccgagctgctgaagagatacaccaaggagtacaccgagtacaacgaggagaagaagaaggaggccgaggagctggccagaaacatggcctag

SEQ ID NO: 100889 - DNA, 1047 bp, Artificial Sequence
  Description of Artificial Sequence: Synthetic coding sequence
atgagcgaccacggcgacgtgagcctgccccccgaggacagagtgagagccctgagccagctgggcagcgccgtggaggtgaacgaggacatcccccccagaagatacttcagaagcggcgtggagatcatcagaatggccagcatctacagcgaggagggcaacatcgagcacgccttcatcctgtacaacaagtacatcaccctgttcatcgagaagctgcccaagcacagagactacaagagcgccgtgatccccgagaagaaggacaccgtgaagaagctgaaggagatcgccttccccaaggccgaggagctgaaggccgagctgctgaagagatacaccaaggagtacaccgagtacaacgaggagaagaagaaggaggccgaggagctggccagaaacatggccatccagcaggagctggagaaggagaagcagagagtggcccagcagaagcagcagcagctggagcaggagcagttccacgccttcgaggagatgatcagaaaccaggagctggagaaggagagactgaagatcgtgcaggagttcggcaaggtggaccccggcctgggcggccccctggtgcccgacctggagaagcccagcctggacgtgttccccaccctgaccgtgagcagcatccagcccagcgactgccacaccaccgtgagacccgccaagccccccgtggtggacagaagcctgaagcccggcgccctgagcaacagcgagagcatccccaccatcgacggcctgagacacgtggtggtgcccggcagactgtgcccccagttcctgcagctggccagcgccaacaccgccagaggcgtggagacctgcggcatcctgtgcggcaagctgatgagaaacgagttcaccatcacccacgtgctgatccccaagcagagcgccggcagcgactactgcaacaccgagaacgaggaggagctgttcctgatccaggaccagcagggcctgatcaccctgggctggatccacgtggagaccctgtggagcctgaagagcctgcacgccccctag

SEQ ID NO: 100890 - DNA, 813 bp, Artificial Sequence
  Description of Artificial Sequence: Synthetic coding sequence
atgagacagcagcagctggagagcgagcagttcctgttcttcgaggaccagctgaagaagcaggagctggccagaggccagatgagaagccagcagaccagcggcctgagcgagcagatcgacggcagcgccctgagctgcttcagcacccaccagaacaacagcctgctgaacgtgttcgccgaccagcccaacaagagcgacgccaccaactacgccagccacagcccccccgtgaacagagccctgacccccgccgccaccctgagcgccgtgcagaacctggtggtggagggcctgagatgcgtggtgctgcccgaggacctgtgccacaagttcctgcagctggccgagagcaacaccgtgagaggcatcgagacctgcggcatcctgtgcggcaagctgacccacaacgagttcaccatcacccacgtgatcgtgcccaagcagagcgccggccccgactactgcgacatggagaacgtggaggagctgttcaacgtgcaggaccagcacgacctgctgaccctgggctggatccacacccaccccacccagaccgccttcctgagcagcgtggacctgcacacccactgcagctaccagctgatgctgcccgaggccatcgccatcgtgtgcagccccaagcacaaggacaccggcatcttcagactgaccaacgccggcatgctggaggtgagcgcctgcaagaagaagggcttccacccccacaccaaggagcccagactgttcagcatctgcaagcacgtgctggtgaaggacatcaagatcatcgtgctggacctgagatag

SEQ ID NO: 100891 - DNA, 1311 bp, Artificial Sequence
  Description of Artificial Sequence: Synthetic coding sequence
atggaccagcccttcaccgtgaacagcctgaagaagctggccgccatgcccgaccacaccgacgtgagcctgagccccgaggagagagtgagagccctgagcaagctgggctgcaacatcaccatcagcgaggacatcacccccagaagatacttcagaagcggcgtggagatggagagaatggccagcgtgtacctggaggagggcaacctggagaacgccttcgtgctgtacaacaagttcatcaccctgttcgtggagaagctgcccaaccacagagactaccagcagtgcgccgtgcccgagaagcaggacatcatgaagaagctgaaggagatcgccttccccagaaccgacgagctgaagaacgacctgctgaagaagtacaacgtggagtaccaggagtacctgcagagcaagaacaagtacaaggccgagatcctgaagaagctggagcaccagagactgatcgaggccgagagaaagagaatcgcccagatgagacagcagcagctggagagcgagcagttcctgttcttcgaggaccagctgaagaagcaggagctggccagaggccagatgagaagccagcagaccagcggcctgagcgagcagatcgacggcagcgccctgagctgcttcagcacccaccagaacaacagcctgctgaacgtgttcgccgaccagcccaacaagagcgacgccaccaactacgccagccacagcccccccgtgaacagagccctgacccccgccgccaccctgagcgccgtgcagaacctggtggtggagggcctgagatgcgtggtgctgcccgaggacctgtgccacaagttcctgcagctggccgagagcaacaccgtgagaggcatcgagacctgcggcatcctgtgcggcaagctgacccacaacgagttcaccatcacccacgtgatcgtgcccaagcagagcgccggccccgactactgcgacatggagaacgtggaggagctgttcaacgtgcaggaccagcacgacctgctgaccctgggctggatccacacccaccccacccagaccgccttcctgagcagcgtggacctgcacacccactgcagctaccagctgatgctgcccgaggccatcgccatcgtgtgcagccccaagcacaaggacaccggcatcttcagactgaccaacgccggcatgctggaggtgagcgcctgcaagaagaagggcttccacccccacaccaaggagcccagactgttcagcatctgcaagcacgtgctggtgaaggacatcaagatcatcgtgctggacctgagatag

SEQ ID NO: 100892 - DNA, 1311 bp, Artificial Sequence; identical to SEQ ID NO: 100891
  Description of Artificial Sequence: Synthetic coding sequence

SEQ ID NO: 100893 - DNA, 1386 bp, Artificial Sequence
  Description of Artificial Sequence: Synthetic coding sequence
atggaccagcccttcaccgtgaacagcctgaagaagctggccgccatgcccgaccacaccgacgtgagcctgagccccgaggagagagtgagagccctgagcaagctgggctgcaacatcaccatcagcgaggacatcacccccagaagatacttcagaagcggcgtggagatggagagaatggccagcgtgtacctggaggagggcaacctggagaacgccttcgtgctgtacaacaagttcatcaccctgttcgtggagaagctgcccaaccacagagactaccagcagtgcgccgtgcccgagaagcaggacatcatgaagaagctgaaggagatcgccttccccagaaccgacgagctgaagaacgacctgctgaagaagtacaacgtggagtaccaggagtacctgcagagcaagaacaagtacaaggccgagatcctgaagaagctggagcaccagagactgatcgaggccgagagaaagagaatcgcccagatgagacagcagcagctggagagcgagcagttcctgttcttcgaggaccagctgaagaagcaggagctggccagaggccagatgagaagccagcagaccagcggcctgagcgagcagatcgacggcagcgccctgagctgcttcagcacccaccagaacaacagcctgctgaacgtgttcgccgaccagcccaacaagagcgacgccaccaactacgccagccacagcccccccgtgaacagagccctgacccccgccgccaccctgagcgccgtgcagaacctggtggtggagggcctgagatgcgtggtgctgcccgaggacctgtgccacaagttcctgcagctggccgagagcaacaccgtgagaggcatcgagacctgcggcatcctgtgcggcaagctgacccacaacgagttcaccatcacccacgtgatcgtgcccaagcagagcgccggccccgactactgcgacatggagaacgtggaggagctgttcaacgtgcaggaccagcacgacctgctgaccctgggctggatccacacccaccccacccagaccgccttcctgagcagcgtggacctgcacacccactgcagctaccagctgatgctgcccgaggccatcgccatcgtgtgcagccccaagcacaaggacaccggcatcttcagactgaccaacgccggcatgctggaggtgagcgcctgcaagaagaagggcttccacccccacaccaaggagcccagactgttcagcatccagaagttcctgagcggcatcatcagcggcaccgccctggagatggagcccctgaagatcggctacggccccaacggcttccccctgctgggcatcagcagaagcagcagccccagcgagcagctgtag

SEQ ID NO: 100894 - DNA, 267 bp, Artificial Sequence
  Description of Artificial Sequence: Synthetic coding sequence
atgagcatcatggaccacagccccaccaccggcgtggtgaccgtgatcgtgatcctgatcgccatcgccgccctgggcgccctgatcctgggctgctggtgctacctgagactgcagagaatcagccagagcgaggacgaggagagcatcgtgggcgacggcgagaccaaggagcccttcctgctggtgcagtacagcgccaagggcccctgcgtggagagaaaggccaagctgatgacccccaacggccccgaggtgcacggctag

SEQ ID NO: 100895 - DNA, 744 bp, Artificial Sequence
  Description of Artificial Sequence: Synthetic coding sequence
atgctgcagaacagcgccgtgctgctggtgctggtgatcagcgccagcgccacccacgaggccgagcagaacgacagcgtgagccccagaaagagcagagtggccgcccagaacagcgccgaggtggtgagatgcctgaacagcgccctgcaggtgggctgcggcgccttcgcctgcctggagaacagcacctgcgacaccgacggcatgtacgacatctgcaagagcttcctgtacagcgccgccaagttcgacacccagggcaaggccttcgtgaaggagagcctgaagtgcatcgccaacggcgtgaccagcaaggtgttcctggccatcagaagatgcagcaccttccagagaatgatcgccgaggtgcaggaggagtgctacagcaagctgaacgtgtgcagcatcgccaagagaaaccccgaggccatcaccgaggtggtgcagctgcccaaccacttcagcaacagatactacaacagactggtgagaagcctgctggagtgcgacgaggacaccgtgagcaccatcagagacagcctgatggagaagatcggccccaacatggccagcctgttccacatcctgcagaccgaccactgcgcccagacccaccccagagccgacttcaacagaagaagaaccaacgagccccagaagctgaaggtgctgctgagaaacctgagaggcgaggaggacagccccagccacatcaagagaaccagccacgagagcgcctag

SEQ ID NO: 100896 - DNA, 537 bp, Artificial Sequence
  Description of Artificial Sequence: Synthetic coding sequence
atgtacgacatctgcaagagcttcctgtacagcgccgccaagttcgacacccagggcaaggccttcgtgaaggagagcctgaagtgcatcgccaacggcgtgaccagcaaggtgttcctggccatcagaagatgcagcaccttccagagaatgatcgccgaggtgcaggaggagtgctacagcaagctgaacgtgtgcagcatcgccaagagaaaccccgaggccatcaccgaggtggtgcagctgcccaaccacttcagcaacagatactacaacagactggtgagaagcctgctggagtgcgacgaggacaccgtgagcaccatcagagacagcctgatggagaagatcggccccaacatggccagcctgttccacatcctgcagaccgaccactgcgcccagacccaccccagagccgacttcaacagaagaagaaccaacgagccccagaagctgaaggtgctgctgagaaacctgagaggcgaggaggacagccccagccacatcaagagaaccagccacgagagcgcctag

SEQ ID NO: 100897 - DNA, 537 bp, Artificial Sequence; identical to SEQ ID NO: 100896
  Description of Artificial Sequence: Synthetic coding sequence

SEQ ID NO: 100898 - DNA, 2733 bp, Artificial Sequence
  Description of Artificial Sequence: Synthetic coding sequence
atggccagcagcgcccagagcggcggcagcagcggcggccccgccgtgcccaccgtgcagagaggcatcatcaagatggtgctgagcggctgcgccatcatcgtgagaggccagcccagaggcggccccccccccgagagacagatcaacctgagcaacatcagagccggcaacctggccagaagagccgccgccacccagcccgacgccaaggacacccccgacgagccctgggccttccccgccagagagttcctgagaaagaagctgatcggcaaggaggtgtgcttcaccatcgagaacaagaccccccagggcagagagtacggcatgatctacctgggcaaggacaccaacggcgagaacatcgccgagagcctggtggccgagggcctggccaccagaagagagggcatgagagccaacaaccccgagcagaacagactgagcgagtgcgaggagcaggccaaggccgccaagaagggcatgtggagcgagggcaacggcagccacaccatcagagacctgaagtacaccatcgagaaccccagacacttcgtggacagccaccaccagaagcccgtgaacgccatcatcgagcacgtgagagacggcagcgtggtgagagccctgctgctgcccgactactacctggtgaccgtgatgctgagcggcatcaagtgccccaccttcagaagagaggccgacggcagcgagacccccgagcccttcgccgccgaggccaagttcttcaccgagagcagactgctgcagagagacgtgcagatcatcctggagagctgccacaaccagaacatcctgggcaccatcctgcaccccaacggcaacatcaccgagctgctgctgaaggagggcttcgccagatgcgtggactggagcatcgccgtgtacaccagaggcgccgagaagctgagagccgccgagagattcgccaaggagagaagactgagaatctggagagactacgtggcccccaccgccaacctggaccagaaggacaagcagttcgtggccaaggtgatgcaggtgctgaacgccgacgccatcgtggtgaagctgaacagcggcgactacaagaccatccacctgagcagcatcagaccccccagactggagggcgagaacacccaggacaagaacaagaagctgagacccctgtacgacatcccctacatgttcgaggccagagagttcctgagaaagaagctgatcggcaagaaggtgaacgtgaccgtggactacatcagacccgccagccccgccaccgagaccgtgcccgccttcagcgagagaacctgcgccaccgtgaccatcggcggcatcaacatcgccgaggccctggtgagcaagggcctggccaccgtgatcagatacagacaggacgacgaccagagaagcagccactacgacgagctgctggccgccgaggccagagccatcaagaacggcaagggcctgcacagcaagaaggaggtgcccatccacagagtggccgacatcagcggcgacacccagaaggccaagcagttcctgcccttcctgcagagagccggcagaagcgaggccgtggtggagtacgtgttcagcggcagcagactgaagctgtacctgcccaaggagacctgcctgatcaccttcctgctggccggcatcgagtgccccagaggcgccagaaacctgcccggcctggtgcaggagggcgagcccttcagcgaggaggccaccctgttcaccaaggagctggtgctgcagagagaggtggaggtggaggtggagagcatggacaaggccggcaacttcatcggctggctgcacatcgacggcgccaacctgagcgtgctgctggtggagcacgccctgagcaaggtgcacttcaccgccgagagaagcagctactacaagagcctgctgagcgccgaggaggccgccaagcagaagaaggagaaggtgtgggcccactacgaggagcagcccgtggaggaggtgatgcccgtgctggaggagaaggagagaagcgccagctacaagcccgtgttcgtgaccgagatcaccgacgacctgcacttctacgtgcaggacgtggagaccggcacccagctggagaagctgatggagaacatgagaaacgacatcgccagccacccccccgtggagggcagctacgcccccagaagaggcgagttctgcatcgccaagttcgtggacggcgagtggtacagagccagagtggagaaggtggagagccccgccaagatccacgtgttctacatcgactacggcaacagagaggtgctgcccagcaccagactgggcaccctgagccccgccttcagcaccagagtgctgcccgcccaggccaccgagtacgccttcgccttcatccaggtgccccaggacgacgacgccagaaccgacgccgtggacagcgtggtgagagacatccagaacacccagtgcctgctgaacgtggagcacctgagcgccggctgcccccacgtgaccctgcagttcgccgacagcaagggcgacgtgggcctgggcctggtgaaggagggcctggtgatggtggaggtgagaaaggagaagcagttccagaaggtgatcaccgagtacctgaacgcccaggagagcgccaagagcgccagactgaacctgtggagatacggcgacttcagagccgacgacgccgacgagttcggctacagcagatag

SEQ ID NO: 100899 - DNA, 2703 bp, Artificial Sequence
  Description of Artificial Sequence: Synthetic coding sequence
atggccagcagcgccgtgcccaccgtgcagagaggcatcatcaagatggtgctgagcggctgcgccatcatcgtgagaggccagcccagaggcggccccccccccgagagacagatcaacctgagcaacatcagagccggcaacctggccagaagagccgccgccacccagcccgacgccaaggacacccccgacgagccctgggccttccccgccagagagttcctgagaaagaagctgatcggcaaggaggtgtgcttcaccatcgagaacaagaccccccagggcagagagtacggcatgatctacctgggcaaggacaccaacggcgagaacatcgccgagagcctggtggccgagggcctggccaccagaagagagggcatgagagccaacaaccccgagcagaacagactgagcgagtgcgaggagcaggccaaggccgccaagaagggcatgtggagcgagggcaacggcagccacaccatcagagacctgaagtacaccatcgagaaccccagacacttcgtggacagccaccaccagaagcccgtgaacgccatcatcgagcacgtgagagacggcagcgtggtgagagccctgctgctgcccgactactacctggtgaccgtgatgctgagcggcatcaagtgccccaccttcagaagagaggccgacggcagcgagacccccgagcccttcgccgccgaggccaagttcttcaccgagagcagactgctgcagagagacgtgcagatcatcctggagagctgccacaaccagaacatcctgggcaccatcctgcaccccaacggcaacatcaccgagctgctgctgaaggagggcttcgccagatgcgtggactggagcatcgccgtgtacaccagaggcgccgagaagctgagagccgccgagagattcgccaaggagagaagactgagaatctggagagactacgtggcccccaccgccaacctggaccagaaggacaagcagttcgtggccaaggtgatgcaggtgctgaacgccgacgccatcgtggtgaagctgaacagcggcgactacaagaccatccacctgagcagcatcagaccccccagactggagggcgagaacacccaggacaagaacaagaagctgagacccctgtacgacatcccctacatgttcgaggccagagagttcctgagaaagaagctgatcggcaagaaggtgaacgtgaccgtggactacatcagacccgccagccccgccaccgagaccgtgcccgccttcagcgagagaacctgcgccaccgtgaccatcggcggcatcaacatcgccgaggccctggtgagcaagggcctggccaccgtgatcagatacagacaggacgacgaccagagaagcagccactacgacgagctgctggccgccgaggccagagccatcaagaacggcaagggcctgcacagcaagaaggaggtgcccatccacagagtggccgacatcagcggcgacacccagaaggccaagcagttcctgcccttcctgcagagagccggcagaagcgaggccgtggtggagtacgtgttcagcggcagcagactgaagctgtacctgcccaaggagacctgcctgatcaccttcctgctggccggcatcgagtgccccagaggcgccagaaacctgcccggcctggtgcaggagggcgagcccttcagcgaggaggccaccctgttcaccaaggagctggtgctgcagagagaggtggaggtggaggtggagagcatggacaaggccggcaacttcatcggctggctgcacatcgacggcgccaacctgagcgtgctgctggtggagcacgccctgagcaaggtgcacttcaccgccgagagaagcagctactacaagagcctgctgagcgccgaggaggccgccaagcagaagaaggagaaggtgtgggcccactacgaggagcagcccgtggaggaggtgatgcccgtgctggaggagaaggagagaagcgccagctacaagcccgtgttcgtgaccgagatcaccgacgacctgcacttctacgtgcaggacgtggagaccggcacccagctggagaagctgatggagaacatgagaaacgacatcgccagccacccccccgtggagggcagctacgcccccagaagaggcgagttctgcatcgccaagttcgtggacggcgagtggtacagagccagagtggagaaggtggagagccccgccaagatccacgtgttctacatcgactacggcaacagagaggtgctgcccagcaccagactgggcaccctgagccccgccttcagcaccagagtgctgcccgcccaggccaccgagtacgccttcgccttcatccaggtgccccaggacgacgacgccagaaccgacgccgtggacagcgtggtgagagacatccagaacacccagtgcctgctgaacgtggagcacctgagcgccggctgcccccacgtgaccctgcagttcgccgacagcaagggcgacgtgggcctgggcctggtgaaggagggcctggtgatggtggaggtgagaaaggagaagcagttccagaaggtgatcaccgagtacctgaacgcccaggagagcgccaagagcgccagactgaacctgtggagatacggcgacttcagagccgacgacgccgacgagttcggctacagcagatag

SEQ ID NO: 100900 - DNA, 705 bp, Artificial Sequence
  Description of Artificial Sequence: Synthetic coding sequence
atgaaccacctgcccgaggacatggagaacgccctgaccggcagccagagcagccacgccagcctgagaaacatccacagcatcaaccccacccagctgatggccagaatcgagagctacgagggcagagagaagaagggcatcagcgacgtgagaagaaccttctgcctgttcgtgaccttcgacctgctgttcgtgaccctgctgtggatcatcgagctgaacgtgaacggcggcatcgagaacaccctggagaaggaggtgatgcagtacgactactacagcagctacttcgacatcttcctgctggccgtgttcagattcaaggtgctgatcctggcctacgccgtgtgcagactgagacactggtgggccatcgccctgaccaccgccgtgaccagcgccttcctgctggccaaggtgatcctgagcaagctgttcagccagggcgccttcggctacgtgctgcccatcatcagcttcatcctggcctggatcgagacctggttcctggacttcaaggtgctgccccaggaggccgaggaggagaacagactgctgatcgtgcaggacgccagcgagagagccgccctgatccccggcggcctgagcgacggccagttctacagcccccccgagagcgaggccggcagcgaggaggccgaggagaagcaggacagcgagaagcccctgctggagctgtag

SEQ ID NO: 100901 - DNA, 705 bp, Artificial Sequence; identical to SEQ ID NO: 100900
  Description of Artificial Sequence: Synthetic coding sequence

SEQ ID NO: 100902 - DNA, 621 bp, Artificial Sequence
  Description of Artificial Sequence: Synthetic coding sequence
atgaaccacctgcccgaggacatggagaacgccctgaccggcagccagagcagccacgccagcctgagaaacatccacagcatcaaccccacccagctgatggccagaatcgagagctacgagggcagagagaagaagggcatcagcgacgtgagaagaaccttctgcctgttcgtgaccttcgacctgctgttcgtgaccctgctgtggatcatcgagctgaacgtgaacggcggcatcgagaacaccctggagaaggaggtgatgcagtacgactactacagcagctacttcgacatcttcctgctggccgtgttcagattcaaggtgctgatcctggcctacgccgtgtgcagactgagacactggtgggccatcgccctgaccaccgccgtgaccagcgccttcctgctggccaaggtgatcctgagcaagctgttcagccagggcgccttcggctacgtgctgcccatcatcagcttcatcctggcctggatcgagacctggttcctggacttcaaggtgctgccccaggaggccgaggaggagaacagactgctgatcgtgcaggacgccagcgagagagccgccctgatccccggcggcctgagcgacggctag

SEQ ID NO: 100903 - DNA, 555 bp, Artificial Sequence
  Description of Artificial Sequence: Synthetic coding sequence
atgaaccacctgcccgaggacatggagaacgccctgaccggcagccagagcagccacgccagcctgagaaacatccacagcatcaaccccacccagctgatggccagaatcgagagctacgagggcagagagaagaagggcatcagcgacgtgagaagaaccttctgcctgttcgtgaccttcgacctgctgttcgtgaccctgctgtggatcatcgagctgaacgtgaacggcggcatcgagaacaccctggagaaggaggtgatgcagtacgactactacagcagctacttcgacatcttcctgctggccgtgttcagattcaaggtgctgatcctggcctacgccgtgtgcagactgagacactggtgggccatcgccctgaccaccgccgtgaccagcgccttcctgctggccaaggtgatcctgagcaagctgttcagccagggcgccttcggctacgtgctgcccatcatcagcttcatcctggcctggatcgagacctggttcctggacttcaaggtgctgccccaggaggccgaggaggagaactag

SEQ ID NO: 100904 - DNA, 519 bp, Artificial Sequence
  Description of Artificial Sequence: Synthetic coding sequence
atgaaccacctgcccgaggacatggagaacgccctgaccggcagccagagcagccacgccagcctgagaaacatccacagcatcaaccccacccagctgatggccagaatcgagagctacgagggcagagagaagaagggcatcagcgacgtgagaagaaccttctgcctgttcgtgaccttcgacctgctgttcgtgaccctgctgtggatcatcgagctgaacgtgaacggcggcatcgagaacaccctggagaaggaggtgatgcagtacgactactacagcagctacttcgacatcttcctgctggccgtgttcagattcaaggtgctgatcctggcctacgccgtgtgcagactgagacactggtgggccatcgccctgaccaccgccgtgaccagcgccttcctgctggccaaggtgatcctgagcaagctgttcagccagggcgccttcggctacgtgctgcccatcatcagcttcatcctggcctggatcgagacctggttcctggactag

SEQ ID NO: 100905 - DNA, 684 bp, Artificial Sequence
  Description of Artificial Sequence: Synthetic coding sequence
atggagaacgccctgaccggcagccagagcagccacgccagcctgagaaacatccacagcatcaaccccacccagctgatggccagaatcgagagctacgagggcagagagaagaagggcatcagcgacgtgagaagaaccttctgcctgttcgtgaccttcgacctgctgttcgtgaccctgctgtggatcatcgagctgaacgtgaacggcggcatcgagaacaccctggagaaggaggtgatgcagtacgactactacagcagctacttcgacatcttcctgctggccgtgttcagattcaaggtgctgatcctggcctacgccgtgtgcagactgagacactggtgggccatcgccctgaccaccgccgtgaccagcgccttcctgctggccaaggtgatcctgagcaagctgttcagccagggcgccttcggctacgtgctgcccatcatcagcttcatcctggcctggatcgagacctggttcctggacttcaaggtgctgccccaggaggccgaggaggagaacagactgctgatcgtgcaggacgccagcgagagagccgccctgatccccggcggcctgagcgacggccagttctacagcccccccgagagcgaggccggcagcgaggaggccgaggagaagcaggacagcgagaagcccctgctggagctgtag

SEQ ID NO: 100906 - DNA, 1338 bp, Artificial Sequence
  Description of Artificial Sequence: Synthetic coding sequence
atgagcaagctgcccagagagctgaccagagacctggagagaagcctgcccgccgtggccagcctgggcagcagcctgagccacagccagagcctgagcagccacctgctgcccccccccgagaagagaagagccatcagcgacgtgagaagaaccttctgcctgttcgtgaccttcgacctgctgttcatcagcctgctgtggatcatcgagctgaacaccaacaccggcatcagaaagaacctggagcaggagatcatccagtacaacttcaagaccagcttcttcgacatcttcgtgctggccttcttcagattcagcggcctgctgctgggctacgccgtgctgagactgagacactggtgggtgatcgccgtgaccaccctggtgagcagcgccttcctgatcgtgaaggtgatcctgagcgagctgctgagcaagggcgccttcggctacctgctgcccatcgtgagcttcgtgctggcctggctggagacctggttcctggacttcaaggtgctgccccaggaggccgaggaggagagatggtacctggccgcccaggtggccgtggccagaggccccctgctgttcagcggcgccctgagcgagggccagttctacagcccccccgagagcttcgccggcagcgacaacgagagcgacgaggaggtggccggcaagaagagcttcagcgcccaggagagagagtacatcagacagggcaaggaggccaccgccgtggtggaccagatcctggcccaggaggagaactggaagttcgagaagaacaacgagtacggcgacaccgtgtacaccatcgaggtgcccttccacggcaagaccttcatcctgaagaccttcctgccctgccccgccgagctggtgtaccaggaggtgatcctgcagcccgagagaatggtgctgtggaacaagaccgtgaccgcctgccagatcctgcagagagtggaggacaacaccctgatcagctacgacgtgagcgccggcgccgccggcggcgtggtgagccccagagacttcgtgaacgtgagaagaatcgagagaagaagagacagatacctgagcagcggcatcgccaccagccacagcgccaagccccccacccacaagtacgtgagaggcgagaacggccccggcggcttcatcgtgctgaagagcgccagcaaccccagagtgtgcaccttcgtgtggatcctgaacaccgacctgaagggcagactgcccagatacctgatccaccagagcctggccgccaccatgttcgagttcgccttccacctgagacagagaatcagcgagctgggcgccagagcctag

SEQ ID NO: 100907 - DNA, 1284 bp, Artificial Sequence
  Description of Artificial Sequence: Synthetic coding sequence
atgagcaagctgcccagagagctgaccagagacctggagagaagcctgcccgccgtggccagcctgggcagcagcctgagccacagccagagcctgagcagccacctgctgcccccccccgagaagagaagagccatcagcgacgtgagaagaaccttctgcctgttcgtgaccttcgacctgctgttcatcagcctgctgtggatcatcgagctgaacaccaacaccggcatcagaaagaacctggagcaggagatcatccagtacaacttcaagaccagcttcttcgacatcttcgtgctggccttcttcagattcagcggcctgctgctgggctacgccgtgctgagactgagacactggtgggtgatcgccctgctgagcaagggcgccttcggctacctgctgcccatcgtgagcttcgtgctggcctggctggagacctggttcctggacttcaaggtgctgccccaggaggccgaggaggagagatggtacctggccgcccaggtggccgtggccagaggccccctgctgttcagcggcgccctgagcgagggccagttctacagcccccccgagagcttcgccggcagcgacaacgagagcgacgaggaggtggccggcaagaagagcttcagcgcccaggagagagagtacatcagacagggcaaggaggccaccgccgtggtggaccagatcctggcccaggaggagaactggaagttcgagaagaacaacgagtacggcgacaccgtgtacaccatcgaggtgcccttccacggcaagaccttcatcctgaagaccttcctgccctgccccgccgagctggtgtaccaggaggtgatcctgcagcccgagagaatggtgctgtggaacaagaccgtgaccgcctgccagatcctgcagagagtggaggacaacaccctgatcagctacgacgtgagcgccggcgccgccggcggcgtggtgagccccagagacttcgtgaacgtgagaagaatcgagagaagaagagacagatacctgagcagcggcatcgccaccagccacagcgccaagccccccacccacaagtacgtgagaggcgagaacggccccggcggcttcatcgtgctgaagagcgccagcaaccccagagtgtgcaccttcgtgtggatcctgaacaccgacctgaagggcagactgcccagatacctgatccaccagagcctggccgccaccatgttcgagttcgccttccacctgagacagagaatcagcgagctgggcgccagagcctag

SEQ ID NO: 100908 - DNA, 591 bp, Artificial Sequence
  Description of Artificial Sequence: Synthetic coding sequence
atgagcaagctgcccagagagctgaccagagacctggagagaagcctgcccgccgtggccagcctgggcagcagcctgagccacagccagagcctgagcagccacctgctgcccccccccgagaagagaagagccatcagcgacgtgagaagaaccttctgcctgttcgtgaccttcgacctgctgttcatcagcctgctgtggatcatcgagctgaacaccaacaccggcatcagaaagaacctggagcaggagatcatccagtacaacttcaagaccagcttcttcgacatcttcgtgctggccttcttcagattcagcggcctgctgctgggctacgccgtgctgagactgagacactggtgggtgatcgccgtgaccaccctggtgagcagcgccttcctgatcgtgaaggtgatcctgagcgagctgctgagcaagggcgccttcggctacctgctgcccatcgtgagcttcgtgctggcctggctggagacctggttcctggacttcaaggtgctgccccaggaggccgaggaggagagatggtacctggccgcccaggtggccgtggccagaggccccctgtag

SEQ ID NO: 100909 - DNA, 1338 bp, Artificial Sequence
  Description of Artificial Sequence: Synthetic coding sequence
atgagcaagctgcccagagagctgaccagagacctggagagaagcctgcccgccgtggccagcctgggcagcagcctgagccacagccagagcctgagcagccacctgctgcccccccccgagaagagaagagccatcagcgacgtgagaagaaccttctgcctgttcgtgaccttcgacctgctgttcatcagcctgctgtggatcatcgagctgaacaccaacaccggcatcagaaagaacctggagcaggagatcatccagtacaacttcaagaccagcttcttcgacatcttcgtgctggccttcttcagattcagcggcctgctgctgggctacgccgtgctgagactgagacactggagcagaagatggtgccccgtgcacagcagcctgagcagaagcagcagcctgagctgcagcgccaagggccacctggccacctgcagccccagcagcctgctgagcagccccggctggagacccggcagcctgaccagcaagagctaccccagaaagctgaagagaagcgacagcgccccccccggctacctggccgcccaggtggccgtggccagaggccccctgctgttcagcggcgccctgagcgagggccagttctacagcccccccgagagcttcgccggcagcgacaacgagagcgacgaggaggtggccggcaagaagagcttcagcgcccaggagagagagtacatcagacagggcaaggaggccaccgccgtggtggaccagatcctggcccaggaggagaactggaagttcgagaagaacaacgagtacggcgacaccgtgtacaccatcgaggtgcccttccacggcaagaccttcatcctgaagaccttcctgccctgccccgccgagctggtgtaccaggaggtgatcctgcagcccgagagaatggtgctgtggaacaagaccgtgaccgcctgccagatcctgcagagagtggaggacaacaccctgatcagctacgacgtgagcgccggcgccgccggcggcgtggtgagccccagagacttcgtgaacgtgagaagaatcgagagaagaagagacagatacctgagcagcggcatcgccaccagccacagcgccaagccccccacccacaagtacgtgagaggcgagaacggccccggcggcttcatcgtgctgaagagcgccagcaaccccagagtgtgcaccttcgtgtggatcctgaacaccgacctgaagggcagactgcccagatacctgatccaccagagcctggccgccaccatgttcgagttcgccttccacctgagacagagaatcagcgagctgggcgccagagcctag

SEQ ID NO: 100910 - DNA, 618 bp, Artificial Sequence
  Description of Artificial Sequence: Synthetic coding sequence
atggagggcctgagcgacgtggccagcttcgccaccaagctgaagaacaccctgatccagtaccacagcatcgaggaggacaagtggagagtggccaagaagaccaaggacgtgaccgtgtggagaaagcccagcgaggagttcaacggctacctgtacaaggcccagggcgtgatcgacgacctggtgtacagcatcatcgaccacatcagacccggcccctgcagactggactgggacagcctgatgaccagcctggacatcctggagaacttcgaggagaactgctgcgtgatgagatacaccaccgccggccagctgtggaacatcatcagccccagagagttcgtggacttcagctacaccgtgggctacaaggagggcctgctgagctgcggcatcagcctggactgggacgagaagagacccgagttcgtgagaggctacaaccacccctgcggctggttctgcgtgcccctgaaggacaaccccaaccagagcctgctgaccggctacatccagaccgacctgagaggcatgatcccccagagcgccgtggacaccgccatggccagcaccctgaccaacttctacggcgacctgagaaaggccctgtag

SEQ ID NO: 100911 - DNA, 576 bp, Artificial Sequence
  Description of Artificial Sequence: Synthetic coding sequence
atggagggcctgagcgacgtggccagcttcgccaccaagctgaagaacaccctgatccagtaccacagcatcgaggaggacaagtggagagtggccaagaagaccaaggacgtgaccgtgtggagaaagcccagcgaggagttcaacggctacctgtacaaggcccagggcgtgatcgacgacctggtgtacagcatcatcgaccacatcagacccggcccctgcagactggactgggacagcctgatgaccagcctggacatcctggagaacttcgaggagaactgctgcgtgatgagatacaccaccgccggccagctgtggaacatcatcagccccagagagttcgtggacttcagctacaccgtgggctacaaggagggcctgctgagctgcggcatcagcctggactgggacgagaagagacccgagttcgtgagaggctacaaccacccctgcggctggttctgcgtgcccctgaaggacaaccccaaccagagcctgctgaccggctacatccagaccgacctgagaggcatgatcccccagagcgccgtggacaccgccatggcctag

SEQ ID NO: 100912 - DNA, 642 bp, Artificial Sequence
  Description of Artificial Sequence: Synthetic coding sequence
atggaccccgccctggccgcccagatgagcgaggccgtggccgagaagatgctgcagtacagaagagacaccgccggctggaagatctgcagagagggcaacggcgtgagcgtgagctggagacccagcgtggagttccccggcaacctgtacagaggcgagggcatcgtgtacggcaccctggaggaggtgtgggactgcgtgaagcccgccgtgggcggcctgagagtgaagtgggacgagaacgtgaccggcttcgagatcatccagagcatcaccgacaccctgtgcgtgagcagaaccagcacccccagcgccgccatgaagctgatcagccccagagacttcgtggacctggtgctggtgaagagatacgaggacggcaccatcagcagcaacgccacccacgtggagcaccccctgtgcccccccaagcccggcttcgtgagaggcttcaaccacccctgcggctgcttctgcgagcccctgcccggcgagcccaccaagaccaacctggtgaccttcttccacaccgacctgagcggctacctgccccagaacgtggtggacagcttcttccccagaagcatgaccagattctacgccaacctgcagaaggccgtgaagcagttccacgagtag

SEQ ID NO: 100913 - DNA, 663 bp, Artificial Sequence
  Description of Artificial Sequence: Synthetic coding sequence
atggacttcaaggccatcgcccagcagaccgcccaggaggtgctgggctacaacagagacaccagcggctggaaggtggtgaagaccagcaagaagatcaccgtgagcagcaaggccagcagaaagttccacggcaacctgtacagagtggagggcatcatccccgagagccccgccaagctgagcgacttcctgtaccagaccggcgacagaatcacctgggacaagagcctgcaggtgtacaacatggtgcacagaatcgacagcgacaccttcatctgccacaccatcacccagagcttcgccgtgggcagcatcagccccagagacttcatcgacctggtgtacatcaagagatacgagggcaacatgaacatcatcagcagcaagagcgtggacttccccgagtacccccccagcagcaactacatcagaggctacaaccacccctgcggcttcgtgtgcagccccatggaggagaaccccgcctacagcaagctggtgatgttcgtgcagaccgagatgagaggcaagctgagccccagcatcatcgagaagaccatgcccagcaacctggtgaacttcatcctgaacgccaaggacggcatcaaggcccacagaacccccagcagaagaggcttccaccacaacagccacagctag

SEQ ID NO: 100914 - DNA, 3072 bp, Artificial Sequence
  Description of Artificial Sequence: Synthetic coding sequence
atgaccctgaacaactgcgccagcatgaagctggaggtgcacttccagagcaagcagaacgaggacagcgaggaggaggagcagtgcaccatcagcagccactgggccttccagcaggagagcaagtgctggagccccatgggcagcagcgacctgctggccccccccagccccggcctgcccgccaccagcagctgcgagagcgtgctgaccgagctgagcgccaccagcctgcccgtgatcaccgtgagcctgccccccgagcccgccgacctgcccctgcccggcagagcccccagcagcagcgacagacccctgctgagccccacccagggccaggagggcccccaggacaaggccaagaagagacacagaaacagaagcttcctgaagcacctggagagcctgagaagaaaggagaagagcggcagccagcaggccgagcccaagcacagccccgccaccagcgagaaggtgagcaaggccagcagcttcagaagctgcagaggcttcctgagcgccggcttctacagagccaagaactgggccgccaccagcgccggcggcagcggcgccaacaccagaaaggcctgggaggcctggcccgtggccagcttcagacacccccagtggacccacagaggcgactgcctggtgcacgtgcccggcgaccacaagcccggcaccttccccagaagcctgagcatcgagagcctgtgccccgaggacggccacagactggccgactggcagcccggcagaagatggggctgcgagggcagaagaggcagctgcggcagcaccggcagccacgccagcacctacgacaacctgcccgagctgtaccccgccgagcccgtgatggtgggcgccgaggccgaggacgaggacgacgaggagagcggcggcagctacgcccacctggacgacatcctgcagcacgtgtggggcctgcagcagagagtggagctgtggagcagagccatgtaccccgacctgggccccggcgacgaggaggaggaggaggccaccagcagcgtggagatcgccaccgtggaggtgaagtgccaggccgaggccctgagccagatggaggtgcccgcccacggcgagagccccgcctgggcccaggccgaggtgcagcccgccgtgctggcccccgcccaggcccccgccgaggccgagcccgtggcccaggaggaggccgaggcccccgcccccgcccccgcccccgcccccgcccaggacagcgagcaggaggcccacagcggcggcgagcccaccttcgccagcagcctgagcgtggaggagggccacagcatcagcgacaccgtggccagcagcagcgagctggacagcagcggcaacagcatgaacgaggccgaggccgccggccccctggccggcctgcaggccagcatgcccagagagagaagagacagcggcgtgggcgccagcctgaccagaccctgcagaaagctgagatggcacagcttccagaacagccacagacccagcctgaacagcgagagcctggagatcaacagacagttcgccggccagatcaacctgctgcacaagggcagcctgctgagactgaccgccttcatggagaagtacaccgtgccccacaagcagggctgggtgtggagcatgcccaagttcatgagaagaaacaagacccccgactacagaggccagcacgtgttcggcgtgccccccctgatccacgtgcagagaaccggccagcccctgccccagagcatccagcaggccatgagatacctgagaagccagtgcctggaccaggtgggcatcttcagaaagagcggcgtgaagagcagaatccagaacctgagacagatgaacgagaccagccccgacaacgtgtgctacgagggccagagcgcctacgacgtggccgacctgctgaagcagtacttcagagacctgcccgagcccatcttcaccagcaagctgaccaccaccttcctgcagatctaccagctgctgcccaaggaccagtggctggccgccgcccaggccgccaccctgctgctgcccgacgagaacagagaggtgctgcagaccctgctgtacttcctgagcgacatcgccagcgccgaggagaaccagatgaccgccggcaacctggccgtgtgcctggcccccagcatcttccacctgaacgtgagcaagaaggacagccccagccccagaatcaagagcaagagaagcctgatcggcagacccggccccagagacctgagcgacaacatggccgccacccagggcctgagccacatgatcagcgactgcaagaagctgttccaggtgccccaggacatggtgctgcagctgtgcagcagctacagcgccgccgagctgagcccccccggccccgccctggccgagctgagacaggcccaggccgccggcgtgagcctgagcctgtacatggaggagaacatccaggacctgctgagagacgccgccgagagattcaagggctggatgagcgtgcccggcccccagcacaccgagctggcctgcagaaaggcccccgacggccaccccctgagactgtggaaggccagcaccgaggtggccgccccccccgccgtggtgctgcacagagtgctgagagagagagccctgtgggacgaggacctgctgagagcccaggtgctggaggccctgatgcccggcgtggagctgtaccactacgtgaccgacagcatggccccccacccctgcagagacttcgtggtgctgagaatgtggagaagcgacctgcccagaggcggctgcctgctggtgagccagagcctggaccccgagcagcccgtgcccgagagcggcgtgagagccctgatgctgaccagccagtacctgatggagccctgcggcctgggcagaagcagactgacccacatctgcagagccgacctgagaggcagaagccccgactggtacaacaaggtgttcggccacctgtgcgccatggaggtggccaagatcagagacagcttccccaccctgcaggccgccggccccgagaccaagctgtag

SEQ ID NO: 100915 - DNA, 3072 bp, Artificial Sequence; identical to SEQ ID NO: 100914
  Description of Artificial Sequence: Synthetic coding sequence

SEQ ID NO: 100916 - DNA, 3312 bp, Artificial Sequence
  Description of Artificial Sequence: Synthetic coding sequence
atgcccctgctggacgtgttctggagctgcttcagaaaggtgaagtgcttccccctgctgcaggtgaagaagaacgccgaggccgaggccaagagagcctgcgagtggctgcaggccaccggcttcccccagtacgtgcagctgttcgaggagggcagcttccccctggacatcggcagcgtgaagaagaaccacggcttcctggacgaggacagcctgggcgccctgtgcagaagactgatgaccctgaacaactgcgccagcatgaagctggaggtgcacttccagagcaagcagaacgaggacagcgaggaggaggagcagtgcaccatcagcagccactgggccttccagcaggagagcaagtgctggagccccatgggcagcagcgacctgctggccccccccagccccggcctgcccgccaccagcagctgcgagagcgtgctgaccgagctgagcgccaccagcctgcccgtgatcaccgtgagcctgccccccgagcccgccgacctgcccctgcccggcagagcccccagcagcagcgacagacccctgctgagccccacccagggccaggagggcccccaggacaaggccaagaagagacacagaaacagaagcttcctgaagcacctggagagcctgagaagaaaggagaagagcggcagccagcaggccgagcccaagcacagccccgccaccagcgagaaggtgagcaaggccagcagcttcagaagctgcagaggcttcctgagcgccggcttctacagagccaagaactgggccgccaccagcgccggcggcagcggcgccaacaccagaaaggcctgggaggcctggcccgtggccagcttcagacacccccagtggacccacagaggcgactgcctggtgcacgtgcccggcgaccacaagcccggcaccttccccagaagcctgagcatcgagagcctgtgccccgaggacggccacagactggccgactggcagcccggcagaagatggggctgcgagggcagaagaggcagctgcggcagcaccggcagccacgccagcacctacgacaacctgcccgagctgtaccccgccgagcccgtgatggtgggcgccgaggccgaggacgaggacgacgaggagagcggcggcagctacgcccacctggacgacatcctgcagcacgtgtggggcctgcagcagagagtggagctgtggagcagagccatgtaccccgacctgggccccggcgacgaggaggaggaggaggccaccagcagcgtggagatcgccaccgtggaggtgaagtgccaggccgaggccctgagccagatggaggtgcccgcccacggcgagagccccgcctgggcccaggccgaggtgcagcccgccgtgctggcccccgcccaggcccccgccgaggccgagcccgtggcccaggaggaggccgaggcccccgcccccgcccccgcccccgcccccgcccaggacagcgagcaggaggcccacagcggcggcgagcccaccttcgccagcagcctgagcgtggaggagggccacagcatcagcgacaccgtggccagcagcagcgagctggacagcagcggcaacagcatgaacgaggccgaggccgccggccccctggccggcctgcaggccagcatgcccagagagagaagagacagcggcgtgggcgccagcctgaccagaccctgcagaaagctgagatggcacagcttccagaacagccacagacccagcctgaacagcgagagcctggagatcaacagacagttcgccggccagatcaacctgctgcacaagggcagcctgctgagactgaccgccttcatggagaagtacaccgtgccccacaagcagggctgggtgtggagcatgcccaagttcatgagaagaaacaagacccccgactacagaggccagcacgtgttcggcgtgccccccctgatccacgtgcagagaaccggccagcccctgccccagagcatccagcaggccatgagatacctgagaagccagtgcctggaccaggtgggcatcttcagaaagagcggcgtgaagagcagaatccagaacctgagacagatgaacgagaccagccccgacaacgtgtgctacgagggccagagcgcctacgacgtggccgacctgctgaagcagtacttcagagacctgcccgagcccatcttcaccagcaagctgaccaccaccttcctgcagatctaccagctgctgcccaaggaccagtggctggccgccgcccaggccgccaccctgctgctgcccgacgagaacagagaggtgctgcagaccctgctgtacttcctgagcgacatcgccagcgccgaggagaaccagatgaccgccggcaacctggccgtgtgcctggcccccagcatcttccacctgaacgtgagcaagaaggacagccccagccccagaatcaagagcaagagaagcctgatcggcagacccggccccagagacctgagcgacaacatggccgccacccagggcctgagccacatgatcagcgactgcaagaagctgttccaggtgccccaggacatggtgctgcagctgtgcagcagctacagcgccgccgagctgagcccccccggccccgccctggccgagctgagacaggcccaggccgccggcgtgagcctgagcctgtacatggaggagaacatccaggacctgctgagagacgccgccgagagattcaagggctggatgagcgtgcccggcccccagcacaccgagctggcctgcagaaaggcccccgacggccaccccctgagactgtggaaggccagcaccgaggtggccgccccccccgccgtggtgctgcacagagtgctgagagagagagccctgtgggacgaggacctgctgagagcccaggtgctggaggccctgatgcccggcgtggagctgtaccactacgtgaccgacagcatggccccccacccctgcagagacttcgtggtgctgagaatgtggagaagcgacctgcccagaggcggctgcctgctggtgagccagagcctggaccccgagcagcccgtgcccgagagcggcgtgagagccctgatgctgaccagccagtacctgatggagccctgcggcctgggcagaagcagactgacccacatctgcagagccgacctgagaggcagaagccccgactggtacaacaaggtgttcggccacctgtgcgccatggaggtggccaagatcagagacagcttccccaccctgcaggccgccggccccgagaccaagctgtag

SEQ ID NO: 100917 - DNA, 159 bp, Artificial Sequence
  Description of Artificial Sequence: Synthetic coding sequence
atgcccctgctggacgtgttctggagctgcttcagaaaggtgaagtgcttccccctgctgcaggtgaagaagaacgccgaggccgaggccaagagagcctgcgagtggctgcaggccaccggcttcccccagtacgtgcagctgttcgagggcggctag

SEQ ID NO: 100918 - DNA, 189 bp, Artificial Sequence
  Description of Artificial Sequence: Synthetic coding sequence
atgaagttcctggtgttcgccttcatcctggccctgatggtgagcatgatcggcgccgacagcagcgaggagaagttcctgagaagaatcggcagattcggctacggctacggcccctaccagcccgtgcccgagcagcccctgtacccccagccctaccagccccagtaccagcagtacaccttctag

SEQ ID NO: 100919 - DNA, 159 bp, Artificial Sequence
  Description of Artificial Sequence: Synthetic coding sequence
atgaagttcctggtgttcgccttcatcctggccctgatggtgagcatgatcggcgccgacagcagcgaggagtacggctacggcccctaccagcccgtgcccgagcagcccctgtacccccagccctaccagccccagtaccagcagtacaccttctag

SEQ ID NO: 100920 - DNA, 843 bp, Artificial Sequence
  Description of Artificial Sequence: Synthetic coding sequence
atgagatggttcctgccctggaccctggccgccgtgaccgccgccgccgccagcaccgtgctggccaccgccctgagccccgcccccaccaccatggacttcacccccgcccccctggaggacaccagcagcagaccccagttctgcaagtggccctgcgagtgcccccccagcccccccagatgccccctgggcgtgagcctgatcaccgacggctgcgagtgctgcaagatgtgcgcccagcagctgggcgacaactgcaccgaggccgccatctgcgacccccacagaggcctgtactgcgactacagcggcgacagacccagatacgccatcggcgtgtgcgcccacgccgtgggcgaggtggaggcctggcacagaaactgcatcgcctacaccagcccctggagcccctgcagcaccagctgcggcctgggcgtgagcaccagaatcagcaacgtgaacgcccagtgctggcccgagcaggagagcagactgtgcaacctgagaccctgcgacgtggacatccacaccctgatcaaggccggcaagaagtgcctggccgtgtaccagcccgaggccagcatgaacttcaccctggccggctgcatcagcaccagaagctaccagcccaagtactgcggcgtgtgcatggacaacagatgctgcatcccctacaagagcaagaccatcgacgtgagcttccagtgccccgacggcctgggcttcagcagacaggtgctgtggatcaacgcctgcttctgcaacctgagctgcagaaaccccaacgacatcttcgccgacctggagagctaccccgacttcagcgagatcgccaactag

SEQ ID NO: 100921 - DNA, 507 bp, Artificial Sequence
  Description of Artificial Sequence: Synthetic coding sequence
atggccaagaccgccatggcctacaaggagaagatgaaggagctgagcatgctgagcctgatctgcagctgcttctaccccgagcccagaaacatcaacatctacacctacgacgacatggaggtgaagcagatcaacaagagagccagcggccaggccttcgagctgatcctgaagccccccagccccaagaagaaggacctgagcctggaggagatccagaagaagctggaggccgccgaggagagaagaaagagccaggaggcccaggtgctgaagcagctggccgagaagagagagcacgagagagaggtgctgcagaaggccctggaggagaacaacaacttcagcaagatggccgaggagaagctgatcctgaagatggagcagatcaaggagaacagagaggccaacctggccgccatcatcgagagactgcaggagaaggagagacacgccgccgaggtgagaagaaacaaggagctgcaggtggagctgagcggctag

SEQ ID NO: 100922 - DNA, 564 bp, Artificial Sequence
  Description of Artificial Sequence: Synthetic coding sequence
atggccaagaccgccatggcctacaaggagaagatgaaggagctgagcatgctgagcctgatctgcagctgcttctaccccgagcccagaaacatcaacatctacacctacgacgacatggaggtgaagcagatcaacaagagagccagcggccaggccttcgagctgatcctgaagccccccagccccatcagcgaggcccccagaaccctggccagccccaagaagaaggacctgagcctggaggagatccagaagaagctggaggccgccgaggagagaagaaagagccaggaggcccaggtgctgaagcagctggccgagaagagagagcacgagagagaggtgctgcagaaggccctggaggagaacaacaacttcagcaagatggccgaggagaagctgatcctgaagatggagcagatcaaggagaacagagaggccaacctggccgccatcatcgagagactgcaggagaagctggtgaagttcatcagcagcgagctgaaggagagcatcgagagccagttcctggagctgcagagagagggcgagaagcagtag

SEQ ID NO: 100923 - DNA, 543 bp, Artificial Sequence
  Description of Artificial Sequence: Synthetic coding sequence
atggccagcaccatcagcgcctacaaggagaagatgaaggagctgagcgtgctgagcctgatctgcagctgcttctacacccagccccaccccaacaccgtgtaccagtacggcgacatggaggtgaagcagctggacaagagagccagcggccagagcttcgaggtgatcctgaagagccccagcgacctgagccccgagagccccatgctgagcagcccccccaagaagaaggacaccagcctggaggagctgcagaagagactggaggccgccgaggagagaagaaagacccaggaggcccaggtgctgaagcagctggccgagagaagagagcacgagagagaggtgctgcacaaggccctggaggagaacaacaacttcagcagacaggccgaggagaagctgaactacaagatggagctgagcaaggagatcagagaggcccacctggccgccctgagagagagactgagagagaaggagctgcacgccgccgaggtgagaagaaacaaggagcagagagaggagatgagcggctag

SEQ ID NO: 100924 - DNA, 510 bp, Artificial Sequence
  Description of Artificial Sequence: Synthetic coding sequence
atgaaggagctgagcgtgctgagcctgatctgcagctgcttctacacccagccccaccccaacaccgtgtaccagtacggcgacatggaggtgaagcagctggacaagagagccagcggccagagcttcgaggtgatcctgaagagccccagcgacctgagccccgagagccccatgctgagcagcccccccaagaagaaggacaccagcctggaggagctgcagaagagactggaggccgccgaggagagaagaaagacccaggaggcccaggtgctgaagcagctggccgagagaagagagcacgagagagaggtgctgcacaaggccctggaggagaacaacaacttcagcagacaggccgaggagaagctgaactacaagatggagctgagcaaggagatcagagaggcccacctggccgccctgagagagagactgagagagaaggagctgcacgccgccgaggtgagaagaaacaaggagcagagagaggagatgagcggctag

SEQ ID NO: 100925 - DNA, 1422 bp, Artificial Sequence
  Description of Artificial Sequence: Synthetic coding sequence
atgttcagcgtgcagctgagcctgggcgagcagacctgggagagcgagggcagcagcatcaagaaggcccagcaggccgtggccaacaaggccctgaccgagagcaccctgcccaagcccgtgcagaagccccccaagagcaacgtgaacaacaaccccggcagcatcacccccaccgtggagctgaacggcctggccatgaagagaggcgagcccgccatctacagacccctggaccccaagcccttccccaactacagagccaactacaacttcagaggcatgtacaaccagagataccactgccccgtgcccaagatcttctacgtgcagctgaccgtgggcaacaacgagttcttcggcgagggcaagaccagacaggccgccagacacaacgccgccatgaaggccctgcaggccctgcagaacgagcccatccccgagagaagcccccagaacggcgagagcggcaaggacgtggacgacgacaaggacgccaacaagagcgagatcagcctggtgttcgagatcgccctgaagagaaacatgcccgtgagcttcgaggtgatcaaggagagcggccccccccacatgaagagcttcgtgaccagagtgagcgtgggcgagttcagcgccgagggcgagggcaacagcaagaagctgagcaagaagagagccgccaccaccgtgctgcaggagctgaagaagctgccccccctgcccgtggtggagaagcccaagctgttcttcaagaagagacccaagaccatcgtgaaggccggccccgagtacggccagggcatgaaccccatcagcagactggcccagatccagcaggccaagaaggagaaggagcccgactacgtgctgctgagcgagagaggcatgcccagaagaagagagttcgtgatgcaggtgaaggtgggcaacgaggtggccaccggcaccggccccaacaagaagatcgccaagaagaacgccgccgaggccatgctgctgcagctgggctacaaggccagcaccaacctgcaggaccagctggagaagaccggcgagaacaagggctggagcggccccaagcccggcttccccgagcccaccaacaacacccccaagggcatcctgcacctgagccccgacgtgtaccaggagatggaggccagcagacacaaggtgatcagcggcaccaccctgggctacctgagccccaaggacatgaaccagcccagcagcagcttcttcagcatcagccccaccagcaacagcagcgccaccatcgccagagagctgctgatgaacggcaccagcagcaccgccgaggccatcggcctgaagggcagcagccccacccccccctgcagccccgtgcagcccagcaagcagctggagtacctggccagaatccagggcttccaggtgtag

SEQ ID NO: 100926 - DNA, 1515 bp, Artificial Sequence
  Description of Artificial Sequence: Synthetic coding sequence
atgaagagaggcgagcccgccatctacagacccctggaccccaagcccttccccaactacagagccaactacaacttcagaggcatgtacaaccagagataccactgccccgtgcccaagatcttctacgtgcagctgaccgtgggcaacaacgagttcttcggcgagggcaagaccagacaggccgccagacacaacgccgccatgaaggccctgcaggccctgcagaacgagcccatccccgagagaagcccccagaacggcgagagcggcaaggacgtggacgacgacaaggacgccaacaagagcgagatcagcctggtgttcgagatcgccctgaagagaaacatgcccgtgagcttcgaggtgatcaaggagagcggccccccccacatgaagagcttcgtgaccagagtgagcgtgggcgagttcagcgccgagggcgagggcaacagcaagaagctgagcaagaagagagccgccaccaccgtgctgcaggagctgaagaagctgccccccctgcccgtggtggagaagcccaagctgttcttcaagaagagacccaagaccatcgtgaaggccggccccgagtacggccagggcatgaaccccatcagcagactggcccagatccagcaggccaagaaggagaaggagcccgactacgtgctgctgagcgagagaggcatgcccagaagaagagagttcgtgatgcaggtgaaggtgggcaacgaggtggccaccggcaccggccccaacaagaagatcgccaagaagaacgccgccgaggccatgctgctgcagctgggctacaaggccagcaccaacctgcaggaccagctggagaagaccggcgagaacaagggctggagcggccccaagcccggcttccccgagcccaccaacaacacccccaagggcatcctgcacctgagccccgacgtgtaccaggagatggaggccagcagacacaaggtgatcagcggcaccaccctgggctacctgagccccaaggacatgaaccagcccagcagcagcttcttcagcatcagccccaccagcaacagcagcgccaccatcgccagagagctgctgatgaacggcaccagcagcaccgccgaggccatcggcctgaagggcagcagccccacccccccctgcagccccgtgcagcccagcaagcagctggagtacctggccagaatccagggcttccaggtgcactactgcgacagacagagcggcaaggagtgcgtgacctgcctgaccctggcccccgtgcagatgaccttccacgccatcggcagcagcatcgaggccagccacgaccaggccgccctgagcgccctgaagcagttcagcgagcagggcctggaccccatcgacggcgccatgaacatcgagaagggcagcctggagaagcaggccaagcacctgagagagaaggccgacaacaaccaggccccccccggcagcatcgcccaggactgcaagaagagcaacagcgccgtgtag

SEQ ID NO: 100927 - DNA, 1197 bp, Artificial Sequence
  Description of Artificial Sequence: Synthetic coding sequence
atgaaggccctgcaggccctgcagaacgagcccatccccgagagaagcccccagaacggcgagagcggcaaggacgtggacgacgacaaggacgccaacaagagcgagatcagcctggtgttcgagatcgccctgaagagaaacatgcccgtgagcttcgaggtgatcaaggagagcggccccccccacatgaagagcttcgtgaccagagtgagcgtgggcgagttcagcgccgagggcgagggcaacagcaagaagctgagcaagaagagagccgccaccaccgtgctgcaggagctgaagaagctgccccccctgcccgtggtggagaagcccaagctgttcttcaagaagagacccaagaccatcgtgaaggccggccccgagtacggccagggcatgaaccccatcagcagactggcccagatccagcaggccaagaaggagaaggagcccgactacgtgctgctgagcgagagaggcatgcccagaagaagagagttcgtgatgcaggtgaaggtgggcaacgaggtggccaccggcaccggccccaacaagaagatcgccaagaagaacgccgccgaggccatgctgctgcagctgggctacaaggccagcaccaacctgcaggaccagctggagaagaccggcgagaacaagggctggagcggccccaagcccggcttccccgagcccaccaacaacacccccaagggcatcctgcacctgagccccgacgtgtaccaggagatggaggccagcagacacaaggtgatcagcggcaccaccctgggctacctgagccccaaggacatgaaccagcccagcagcagcttcttcagcatcagccccaccagcaacagcagcgccaccatcgccagagagctgctgatgaacggcaccagcagcaccgccgaggccatcggcctgaagggcagcagccccacccccccctgcagccccgtgcagcccagcaagcagctggagtacctggccagaatccagggcttccaggccgccctgagcgccctgaagcagttcagcgagcagggcctggaccccatcgacggcgccatgaacatcgagaagggcagcctggagaagcaggccaagcacctgagagagaaggccgacaacaaccaggccccccccggcagcatcgcccaggactgcaagaagagcaacagcgccgtgtag

SEQ ID NO: 100928 - DNA, 1440 bp, Artificial Sequence
  Description of Artificial Sequence: Synthetic coding sequence
atgctgcagatcaaccagatgttcagcgtgcagctgagcctgggcgagcagacctgggagagcgagggcagcagcatcaagaaggcccagcaggccgtggccaacaaggccctgaccgagagcaccctgcccaagcccgtgcagaagccccccaagagcaacgtgaacaacaaccccggcagcatcacccccaccgtggagctgaacggcctggccatgaagagaggcgagcccgccatctacagacccctggaccccaagcccttccccaactacagagccaactacaacttcagaggcatgtacaaccagagataccactgccccgtgcccaagatcttctacgtgcagctgaccgtgggcaacaacgagttcttcggcgagggcaagaccagacaggccgccagacacaacgccgccatgaaggccctgcaggccctgcagaacgagcccatccccgagagaagcccccagaacggcgagagcggcaaggacgtggacgacgacaaggacgccaacaagagcgagatcagcctggtgttcgagatcgccctgaagagaaacatgcccgtgagcttcgaggtgatcaaggagagcggccccccccacatgaagagcttcgtgaccagagtgagcgtgggcgagttcagcgccgagggcgagggcaacagcaagaagctgagcaagaagagagccgccaccaccgtgctgcaggagctgaagaagctgccccccctgcccgtggtggagaagcccaagctgttcttcaagaagagacccaagaccatcgtgaaggccggccccgagtacggccagggcatgaaccccatcagcagactggcccagatccagcaggccaagaaggagaaggagcccgactacgtgctgctgagcgagagaggcatgcccagaagaagagagttcgtgatgcaggtgaaggtgggcaacgaggtggccaccggcaccggccccaacaagaagatcgccaagaagaacgccgccgaggccatgctgctgcagctgggctacaaggccagcaccaacctgcaggaccagctggagaagaccggcgagaacaagggctggagcggccccaagcccggcttccccgagcccaccaacaacacccccaagggcatcctgcacctgagccccgacgtgtaccaggagatggaggccagcagacacaaggtgatcagcggcaccaccctgggctacctgagccccaaggacatgaaccagcccagcagcagcttcttcagcatcagccccaccagcaacagcagcgccaccatcgccagagagctgctgatgaacggcaccagcagcaccgccgaggccatcggcctgaagggcagcagccccacccccccctgcagccccgtgcagcccagcaagcagctggagtacctggccagaatccagggcttccaggtgtag

SEQ ID NO: 100929 - DNA, 615 bp, Artificial Sequence
  Description of Artificial Sequence: Synthetic coding sequence
atgctgcagatcaaccagatgttcagcgtgcagctgagcctgggcgagcagacctgggagagcgagggcagcagcatcaagaaggcccagcaggccgtggccaacaaggccctgaccgagagcaccctgcccaagcccgtgcagaagccccccaagagcaacgtgaacaacaaccccggcagcatcacccccaccgtggagctgaacggcctggccatgaagagaggcgagcccgccatctacagacccctggaccccaagcccttccccaactacagagccaactacaacttcagaggcatgtacaaccagagataccactgccccgtgcccaagatcttctacgtgcagctgaccgtgggcaacaacgagttcttcggcgagggcaagaccagacaggccgccagacacaacgccgccatgaaggccctgcaggccctgcagaacgagcccatccccgagagaagcccccagaacggcgagagcggcaaggacgtggacgacgacaaggacgccaacaagagcgagatcagcctggtgttcgagatcgccctgaagagaaacatgcccgtgagcttcgaggtgatcaaggagagcggccccccccacatgtag

SEQ ID NO: 100930 - DNA, 195 bp, Artificial Sequence
  Description of Artificial Sequence: Synthetic coding sequence
atgctgcagatcaaccagatgttcagcgtgcagctgagcctgggcgagcagacctgggagagcgagggcagcagcatcaagaaggcccagcaggccgtggccaacaaggccctgaccgagagcaccctgcccaagcccgtgcagaagccccccaagagcaacgtgaacaacaaccccggcagcatcaccccctag

SEQ ID NO: 100931 - DNA, 1440 bp, Artificial Sequence; identical to SEQ ID NO: 100928
  Description of Artificial Sequence: Synthetic coding sequence

SEQ ID NO: 100932 - DNA, 1617 bp, Artificial Sequence
  Description of Artificial Sequence: Synthetic coding sequence
atgctgcagatcaaccagatgttcagcgtgcagctgagcctgggcgagcagacctgggagagcgagggcagcagcatcaagaaggcccagcaggccgtggccaacaaggccctgaccgagagcaccctgcccaagcccgtgcagaagccccccaagagcaacgtgaacaacaaccccggcagcatcacccccaccgtggagctgaacggcctggccatgaagagaggcgagcccgccatctacagacccctggaccccaagcccttccccaactacagagccaactacaacttcagaggcatgtacaaccagagataccactgccccgtgcccaagatcttctacgtgcagctgaccgtgggcaacaacgagttcttcggcgagggcaagaccagacaggccgccagacacaacgccgccatgaaggccctgcaggccctgcagaacgagcccatccccgagagaagcccccagaacggcgagagcggcaaggacgtggacgacgacaaggacgccaacaagagcgagatcagcctggtgttcgagatcgccctgaagagaaacatgcccgtgagcttcgaggtgatcaaggagagcggccccccccacatgaagagcttcgtgaccagagtgagcgtgggcgagttcagcgccgagggcgagggcaacagcaagaagctgagcaagaagagagccgccaccaccgtgctgcaggagctgaagaagctgccccccctgcccgtggtggagaagcccaagctgttcttcaagaagagacccaagaccatcgtgaaggccggccccgagtacggccagggcatgaaccccatcagcagactggcccagatccagcaggccaagaaggagaaggagcccgactacgtgctgctgagcgagagaggcatgcccagaagaagagagttcgtgatgcaggtgaaggtgggcaacgaggtggccaccggcaccggccccaacaagaagatcgccaagaagaacgccgccgaggccatgctgctgcagctgggctacaaggccagcaccaacctgcaggaccagctggagaagaccggcgagaacaagggctggagcggccccaagcccggcttccccgagcccaccaacaacacccccaagggcatcctgcacctgagccccgacgtgtaccaggagatggaggccagcagacacaaggtgatcagcggcaccaccctgggctacctgagccccaaggacatgaaccagcccagcagcagcttcttcagcatcagccccaccagcaacagcagcgccaccatcgccagagagctgctgatgaacggcaccagcagcaccgccgaggccatcggcctgaagggcagcagccccacccccccctgcagccccgtgcagcccagcaagcagctggagtacctggccagaatccagggcttccaggccgccctgagcgccctgaagcagttcagcgagcagggcctggaccccatcgacggcgccatgaacatcgagaagggcagcctggagaagcaggccaagcacctgagagagaaggccgacaacaaccaggccccccccggcagcatcgcccaggactgcaagaagagcaacagcgccgtgtag

SEQ ID NO: 100933 - DNA, 318 bp, Artificial Sequence
  Description of Artificial Sequence: Synthetic coding sequence
atgctgcagatcaaccagatgttcagcgtgcagctgagcctgggcgagcagacctgggagagcgagggcagcagcatcaagaaggcccagcaggccgtggccaacaaggccctgaccgagagcaccctgcccaagcccgtgcagaagccccccaagagcaacgtgaacaacaaccccggcagcatcacccccaccgtggagctgaacggcctggccatgaagagaggcgagcccgccatctacagacccctggaccccaagcccttccccaactacagagccaactacaacttcagaggcatgtacaaccagagatag

SEQ ID NO: 100934 - DNA, 1713 bp, Artificial Sequence
  Description of Artificial Sequence: Synthetic coding sequence
atggccaaccccaaggagaagaccgccatgtgcctggtgaacgagctggccagattcaacagagtgcagccccagtacaagctgctgaacgagagaggccccgcccacagcaagatgttcagcgtgcagctgagcctgggcgagcagacctgggagagcgagggcagcagcatcaagaaggcccagcaggccgtggccaacaaggccctgaccgagagcaccctgcccaagcccgtgcagaagccccccaagagcaacgtgaacaacaaccccggcagcatcacccccaccgtggagctgaacggcctggccatgaagagaggcgagcccgccatctacagacccctggaccccaagcccttccccaactacagagccaactacaacttcagaggcatgtacaaccagagataccactgccccgtgcccaagatcttctacgtgcagctgaccgtgggcaacaacgagttcttcggcgagggcaagaccagacaggccgccagacacaacgccgccatgaaggccctgcaggccctgcagaacgagcccatccccgagagaagcccccagaacggcgagagcggcaaggacgtggacgacgacaaggacgccaacaagagcgagatcagcctggtgttcgagatcgccctgaagagaaacatgcccgtgagcttcgaggtgatcaaggagagcggccccccccacatgaagagcttcgtgaccagagtgagcgtgggcgagttcagcgccgagggcgagggcaacagcaagaagctgagcaagaagagagccgccaccaccgtgctgcaggagctgaagaagctgccccccctgcccgtggtggagaagcccaagctgttcttcaagaagagacccaagaccatcgtgaaggccggccccgagtacggccagggcatgaaccccatcagcagactggcccagatccagcaggccaagaaggagaaggagcccgactacgtgctgctgagcgagagaggcatgcccagaagaagagagttcgtgatgcaggtgaaggtgggcaacgaggtggccaccggcaccggccccaacaagaagatcgccaagaagaacgccgccgaggccatgctgctgcagctgggctacaaggccagcaccaacctgcaggaccagctggagaagaccggcgagaacaagggctggagcggccccaagcccggcttccccgagcccaccaacaacacccccaagggcatcctgcacctgagccccgacgtgtaccaggagatggaggccagcagacacaaggtgatcagcggcaccaccctgggctacctgagccccaaggacatgaaccagcccagcagcagcttcttcagcatcagccccaccagcaacagcagcgccaccatcgccagagagctgctgatgaacggcaccagcagcaccgccgaggccatcggcctgaagggcagcagccccacccccccctgcagccccgtgcagcccagcaagcagctggagtacctggccagaatccagggcttccaggccgccctgagcgccctgaagcagttcagcgagcagggcctggaccccatcgacggcgccatgaacatcgagaagggcagcctggagaagcaggccaagcacctgagagagaaggccgacaacaaccaggccccccccggcagcatcgcccaggactgcaagaagagcaacagcgccgtgtag

SEQ ID NO: 100935 - DNA, 1044 bp, Artificial Sequence
  Description of Artificial Sequence: Synthetic coding sequence
agcctgctgaccaacgacgccagcagcgagagcatcgccagcttcagcaagcaggaggtgatgagcagcttcctgcccgagggcggctgctacgagctgctgaccgtgatcggcaagggcttcgaggacctgatgaccgtgaacctggccagatacaagcccaccggcgagtacgtgaccgtgagaagaatcaacctggaggcctgcagcaacgagatggtgaccttcctgcagggcgagctgcacgtgagcaagctgttcaaccaccccaacatcgtgccctacagagccaccttcatcgccgacaacgagctgtgggtggtgaccagcttcatggcctacggcagcgccaaggacctgatctgcacccacttcatggacggcatgaacgagctggccatcgcctacatcctgcagggcgtgctgaaggccctggactacatccaccacatgggctacgtgcacagaagcgtgaaggccagccacatcctgatcagcgtggacggcaaggtgtacctgagcggcctgagaagcaacctgagcatgatcagccacggccagagacagagagtggtgcacgacttccccaagtacagcgtgaaggtgctgccctggctgagccccgaggtgctgcagcagaacctgcagggctacgacgccaagagcgacatctacagcgtgggcatcaccgcctgcgagctggccaacggccacgtgcccttcaaggacatgcccgccacccagatgctgctggagaagctgaacggcaccgtgccctgcctgctggacaccagcaccatccccgccgaggagctgaccatgagccccagcagaagcgtggccaacagcggcctgagcgacagcctgaccaccagcacccccagacccagcaacggcgacagccccagccacccctaccacagaaccttcagcccccacttccaccacttcgtggagcagtgcctgcagagaaaccccgacgccagatacccctgctggcccggccccggcctgagagagagcagaggctgcagcggcggctag

SEQ ID NO: 100936 - DNA, 1296 bp, Artificial Sequence
  Description of Artificial Sequence: Synthetic coding sequence
atgagcttcctggtgagcaagcccgagagaatcagaagatgggtgagcgagaagttcatcgtggagggcctgagagacctggagctgttcggcgagcagccccccggcgacaccagaagaaagaccaacgacgccagcagcgagagcatcgccagcttcagcaagcaggaggtgatgagcagcttcctgcccgagggcggctgctacgagctgctgaccgtgatcggcaagggcttcgaggacctgatgaccgtgaacctggccagatacaagcccaccggcgagtacgtgaccgtgagaagaatcaacctggaggcctgcagcaacgagatggtgaccttcctgcagggcgagctgcacgtgagcaagctgttcaaccaccccaacatcgtgccctacagagccaccttcatcgccgacaacgagctgtgggtggtgaccagcttcatggcctacggcagcgccaaggacctgatctgcacccacttcatggacggcatgaacgagctggccatcgcctacatcctgcagggcgtgctgaaggccctggactacatccaccacatgggctacgtgcacagaagcgtgaaggccagccacatcctgatcagcgtggacggcaaggtgtacctgagcggcctgagaagcaacctgagcatgatcagccacggccagagacagagagtggtgcacgacttccccaagtacagcgtgaaggtgctgccctggctgagccccgaggtgctgcagcagaacctgcagggctacgacgccaagagcgacatctacagcgtgggcatcaccgcctgcgagctggccaacggccacgtgcccttcaaggacatgcccgccacccagatgctgctggagaagctgaacggcaccgtgccctgcctgctggacaccagcaccatccccgccgaggagctgaccatgagccccagcagaagcgtggccaacagcggcctgagcgacagcctgaccaccagcacccccagacccagcaacggcgacagccccagccacccctaccacagaaccttcagcccccacttccaccacttcgtggagcagtgcctgcagagaaaccccgacgccagacccagcgccagcaccctgctgaaccacagcttcttcaagcagatcaagagaagagccagcgaggccctgcccgagctgctgagacccgtgacccccatcaccaacttcgagggcagccagagccaggaccacagcggcatcttcggcctggtgaccaacctggaggagctggaggtggacgactgggagttctag

SEQ ID NO: 100937 - DNA, 1122 bp, Artificial Sequence
  Description of Artificial Sequence: Synthetic coding sequence
atgagcagcttcctgcccgagggcggctgctacgagctgctgaccgtgatcggcaagggcttcgaggacctgatgaccgtgaacctggccagatacaagcccaccggcgagtacgtgaccgtgagaagaatcaacctggaggcctgcagcaacgagatggtgaccttcctgcagggcgagctgcacgtgagcaagctgttcaaccaccccaacatcgtgccctacagagccaccttcatcgccgacaacgagctgtgggtggtgaccagcttcatggcctacggcagcgccaaggacctgatctgcacccacttcatggacggcatgaacgagctggccatcgcctacatcctgcagggcgtgctgaaggccctggactacatccaccacatgggctacgtgcacagaagcgtgaaggccagccacatcctgatcagcgtggacggcaaggtgtacctgagcggcctgagaagcaacctgagcatgatcagccacggccagagacagagagtggtgcacgacttccccaagtacagcgtgaaggtgctgccctggctgagccccgaggtgctgcagcagaacctgcagggctacgacgccaagagcgacatctacagcgtgggcatcaccgcctgcgagctggccaacggccacgtgcccttcaaggacatgcccgccacccagatgctgctggagaagctgaacggcaccgtgccctgcctgctggacaccagcaccatccccgccgaggagctgaccatgagccccagcagaagcgtggccaacagcggcctgagcgacagcctgaccaccagcacccccagacccagcaacggcgacagccccagccacccctaccacagaaccttcagcccccacttccaccacttcgtggagcagtgcctgcagagaaaccccgacgccagacccagcgccagcaccctgctgaaccacagcttcttcaagcagatcaagagaagagccagcgaggccctgcccgagctgctgagacccgtgacccccatcaccaacttcgagggcagccagagccaggaccacagcggcatcttcggcctggtgaccaacctggaggagctggaggtggacgactgggagttctag

SEQ ID NO: 100938 - DNA, 1047 bp, Artificial Sequence
  Description of Artificial Sequence: Synthetic coding sequence
atgagcttcctgaccaacgacgccagcagcgagagcatcgccagcttcagcaagcaggaggtgatgagcagcttcctgcccgagggcggctgctacgagctgctgaccgtgatcggcaagggcttcgaggacctgatgaccgtgaacctggccagatacaagcccaccggcgagtacgtgaccgtgagaagaatcaacctggaggcctgcagcaacgagatggtgaccttcctgcagggcgagctgcacgtgagcaagctgttcaaccaccccaacatcgtgccctacagagccaccttcatcgccgacaacgagctgtgggtggtgaccagcttcatggcctacggcagcgccaaggacctgatctgcacccacttcatggacggcatgaacgagctggccatcgcctacatcctgcagggcgtgctgaaggccctggactacatccaccacatgggctacgtgcacagaagcgtgaaggccagccacatcctgatcagcgtggacggcaaggtgtacctgagcggcctgagaagcaacctgagcatgatcagccacggccagagacagagagtggtgcacgacttccccaagtacagcgtgaaggtgctgccctggctgagccccgaggtgctgcagcagaacctgcagggctacgacgccaagagcgacatctacagcgtgggcatcaccgcctgcgagctggccaacggccacgtgcccttcaaggacatgcccgccacccagatgctgctggagaagctgaacggcaccgtgccctgcctgctggacaccagcaccatccccgccgaggagctgaccatgagccccagcagaagcgtggccaacagcggcctgagcgacagcctgaccaccagcacccccagacccagcaacggcgacagccccagccacccctaccacagaaccttcagcccccacttccaccacttcgtggagcagtgcctgcagagaaaccccgacgccagatacccctgctggcccggccccggcctgagagagagcagaggctgcagcggcggctag

SEQ ID NO: 100939 - DNA, 900 bp, Artificial Sequence
  Description of Artificial Sequence: Synthetic coding sequence
atgagcttcctggtgagcaagcccgagagaatcagaagatgggtgagcgagaagttcatcgtggagggcctgagagacctggagctgttcggcggcaagggcttcgaggacctgatgaccgtgaacctggccagatacaagcccaccggcgagtacgtgaccgtgagaagaatcaacctggaggcctgcagcaacgagatggtgaccttcctgcagggcgagctgcacgtgagcaagctgttcaaccaccccaacatcgtgccctacagagccaccttcatcgccgacaacgagctgtgggtggtgaccagcttcatggcctacggcagcgccaaggacctgatctgcacccacttcatggacggcatgaacgagctggccatcgcctacatcctgcagggcgtgctgaaggccctggactacatccaccacatgggctacgtgcacagaagcgtgaaggccagccacatcctgatcagcgtggacggcaaggtgtacctgagcggcctgagaagcaacctgagcatgatcagccacggccagagacagagagtggtgcacgacttccccaagtacagcgtgaaggtgctgccctggctgagccccgaggtgctgcagcagaacctgcagggctacgacgccaagagcgacatctacagcgtgggcatcaccgcctgcgagctggccaacggccacgtgcccttcaaggacatgcccgccacccagatgctgctggagaagctgaacggcaccgtgccctgcctgctggacaccagcaccatccccgccgaggagctgaccatgagccccagcagaagcgtggccaacagcggcctgagcgacagcctgaccaccagcacccccagacccagcaacggccccgtgcccgcccccagctag

SEQ ID NO: 100940 - DNA, 1257 bp, Artificial Sequence
  Description of Artificial Sequence: Synthetic coding sequence
atgagcctgctggactgcttctgcaccagcagaacccaggtggagagcctgagacccgagaagcagagcgagaccagcatccaccagtacctggtggacgagcccaccctgagctggagcagacccagcaccagagccagcgaggtgctgtgcagcaccaacgtgagccactacgagctgcaggtggagatcggcagaggcttcgacaacctgaccagcgtgcacctggccagacacacccccaccggcaccctggtgaccatcaagatcaccaacctggagaactgcaacgaggagagactgaaggccctgcagaaggccgtgatcctgagccacttcttcagacaccccaacatcaccacctactggaccgtgttcaccgtgggcagctggctgtgggtgatcagccccttcatggcctacggcagcgccagccagctgctgagaacctacttccccgagggcatgagcgagaccctgatcagaaacatcctgttcggcgccgtgagaggcctgaactacctgcaccagaacggctgcatccacagaagcatcaaggccagccacatcctgatcagcggcgacggcctggtgaccctgagcggcctgagccacctgcacagcctggtgaagcacggccagagacacagagccgtgtacgacttcccccagttcagcaccagcgtgcagccctggctgagccccgagctgctgagacaggacctgcacggctacaacgtgaagagcgacatctacagcgtgggcatcaccgcctgcgagctggccagcggccaggtgcccttccaggacatgcacagaacccagatgctgctgcagaagctgaagggccccccctacagccccctggacatcagcatcttcccccagagcgagagcagaatgaagaacagccagagcggcgtggacagcggcatcggcgagagcgtgctggtgagcagcggcacccacaccgtgaacagcgacagactgcacacccccagcagcaagaccttcagccccgccttcttcagcctggtgcagctgtgcctgcagcaggaccccgagaagagacccagcgccagcagcctgctgagccacgtgttcttcaagcagatgaaggaggagagccaggacagcatcctgagcctgctgccccccgcctacaacaagcccagcatcagcctgccccccgtgctgccctggaccgagcccgagtgcgacttccccgacgagaaggacagctactgggagttctag

SEQ ID NO: 100941 - DNA, 1134 bp, Artificial Sequence
  Description of Artificial Sequence: Synthetic coding sequence
atgagcctgctggactgcttctgcaccagcagaacccaggtggagagcctgagacccgagaagcagagcgagaccagcatccaccagtacctggtggacgagcccaccctgagctggagcagacccagcaccagagccagcgaggtgctgtgcagcaccaacgtgagccactacgagctgcaggtggagatcggcagaggcttcgacaacctgaccagcgtgcacctggccagacacacccccaccggcaccctggtgaccatcaagatcaccaacctggagaactgcaacgaggagagactgaaggccctgcagaaggccgtgatcctgagccacttcttcagacaccccaacatcaccacctactggaccgtgttcaccgtgggcagctggctgtgggtgatcagccccttcatggcctacggcagcgccagccagctgctgagaacctacttccccgagggcatgagcgagaccctgatcagaaacatcctgttcggcgccgtgagaggcctgaactacctgcaccagaacggctgcatccacagaagcatcaaggccagccacatcctgatcagcggcgacggcctggtgaccctgagcggcctgagccacctgcacagcctggtgaagcacggccagagacacagagccgtgtacgacttcccccagttcagcaccagcgtgcagccctggctgagccccgagctgctgagacaggacctgcacggctacaacgtgaagagcgacatctacagcgtgggcatcaccgcctgcgagctggccagcggccaggtgcccttccaggacatgcacagaacccagatgctgctgcagaagctgaagggccccccctacagccccctggacatcagcatcttcccccagagcgagagcagaatgaagaacagccagagcggcgtggacagcggcatcggcgagagcgtgctggtgagcagcggcacccacaccgtgaacagcgacagactgcacacccccagcagcaagaccttcagccccgccttcttcagcctggtgcagctgtgcctgcagcaggaccccgagaagagacccagcgccagcagcctgctgagccacgtgttcttcaagcagccctacttcgagttcctgtag

SEQ ID NO: 100942 - DNA, 843 bp, Artificial Sequence
  Description of Artificial Sequence: Synthetic coding sequence
ctgggctactgcagcgccagccagctgctgagaacctacttccccgagggcatgagcgagaccctgatcagaaacatcctgttcggcgccgtgagaggcctgaactacctgcaccagaacggctgcatccacagaagcatcaaggccagccacatcctgatcagcggcgacggcctggtgaccctgagcggcctgagccacctgcacagcctggtgaagcacggccagagacacagagccgtgtacgacttcccccagttcagcaccagcgtgcagccctggctgagccccgagctgctgagacaggacctgcacggctacaacgtgaagagcgacatctacagcgtgggcatcaccgcctgcgagctggccagcggccaggtgcccttccaggacatgcacagaacccagatgctgctgcagaagctgaagggccccccctacagccccctggacatcagcatcttcccccagagcgagagcagaatgaagaacagccagagcggcgtggacagcggcatcggcgagagcgtgctggtgagcagcggcacccacaccgtgaacagcgacagactgcacacccccagcagcaagaccttcagccccgccttcttcagcctggtgcagctgtgcctgcagcaggaccccgagaagagacccagcgccagcagcctgctgagccacgtgttcttcaagcagatgaaggaggagagccaggacagcatcctgagcctgctgccccccgcctacaacaagcccagcatcagcctgccccccgtgctgccctggaccgagcccgagtgcgacttccccgacgagaaggacagctactgggagttctag

SEQ ID NO: 100943 - DNA, 1257 bp, Artificial Sequence; identical to SEQ ID NO: 100940
  Description of Artificial Sequence: Synthetic coding sequence

SEQ ID NO: 100944 - DNA, 1260 bp, Artificial Sequence
  Description of Artificial Sequence: Synthetic coding sequence
atggagagcatcagcatgatgggcagccccaagagcctgagcgagaccttcctgcccaacggcatcaacggcatcaaggacgccagaaaggtgaccgtgggcgtgatcggcagcggcgacttcgccaagagcctgaccatcagactgatcagatgcggctaccacgtggtgatcggcagcagaaaccccaagttcgccagcgagttcttcccccacgtggtggacgtgacccaccacgaggacgccctgaccaagaccaacatcatcttcgtggccatccacagagagcactacaccagcctgtgggacctgagacacctgctggtgggcaagatcctgatcgacgtgagcaacaacatgagaatcaaccagtaccccgagagcaacgccgagtacctggccagcctgttccccgacagcctgatcgtgaagggcttcaacgtggtgagcgcctgggccctgcagctgggccccaaggacgccagcagacaggtgtacatctgcagcaacaacatccaggccagacagcaggtgatcgagctggccagacagctgaacttcatccccatcgacctgggcagcctgagcagcgccagagagatcgagaacctgcccctgagactgttcaccctgtggagaggccccgtggtggtggccatcagcctggccaccttcttcttcctgtacagcttcgtgagagacgtgatccacccctacgccagaaaccagcagagcgacttctacaagatccccatcgagatcgtgaacaagaccctgcccatcgtggccatcaccctgctgagcctggtgtacctggccggcctgctggccgccgcctaccagctgtactacggcaccaagtacagaagattccccccctggctggagacctggctgcagtgcagaaagcagctgggcctgctgagcttcttcttcgccatggtgcacgtggcctacagcctgtgcctgcccatgagaagaagcgagagatacctgttcctgaacatggcctaccagcaggtgcacgccaacatcgagaacagctggaacgaggaggaggtgtggagaatcgagatgtacatcagcttcggcatcatgagcctgggcctgctgagcctgctggccgtgaccagcatccccagcgtgagcaacgccctgaactggagagagttcagcttcatccagatcttctgcagcttcgccgacacccagaccgagctggagctggagttcgtgttcctgctgaccctgctgctgtag

SEQ ID NO: 100945 - DNA, 1473 bp, Artificial Sequence
  Description of Artificial Sequence: Synthetic coding sequence
atggagagcatcagcatgatgggcagccccaagagcctgagcgagaccttcctgcccaacggcatcaacggcatcaaggacgccagaaaggtgaccgtgggcgtgatcggcagcggcgacttcgccaagagcctgaccatcagactgatcagatgcggctaccacgtggtgatcggcagcagaaaccccaagttcgccagcgagttcttcccccacgtggtggacgtgacccaccacgaggacgccctgaccaagaccaacatcatcttcgtggccatccacagagagcactacaccagcctgtgggacctgagacacctgctggtgggcaagatcctgatcgacgtgagcaacaacatgagaatcaaccagtaccccgagagcaacgccgagtacctggccagcctgttccccgacagcctgatcgtgaagggcttcaacgtggtgagcgcctgggccctgcagctgggccccaaggacgccagcagacaggtgtacatctgcagcaacaacatccaggccagacagcaggtgatcgagctggccagacagctgaacttcatccccatcgacctgggcagcctgagcagcgccagagagatcgagaacctgcccctgagactgttcaccctgtggagaggccccgtggtggtggccatcagcctggccaccttcttcttcctgtacagcttcgtgagagacgtgatccacccctacgccagaaaccagcagagcgacttctacaagatccccatcgagatcgtgaacaagaccctgcccatcgtggccatcaccctgctgagcctggtgtacctggccggcctgctggccgccgcctaccagctgtactacggcaccaagtacagaagattccccccctggctggagacctggctgcagtgcagaaagcagctgggcctgctgagcttcttcttcgccatggtgcacgtggcctacagcctgtgcctgcccatgagaagaagcgagagatacctgttcctgaacatggcctaccagcaggtgcacgccaacatcgagaacagctggaacgaggaggaggtgtggagaatcgagatgtacatcagcttcggcatcatgagcctgggcctgctgagcctgctggccgtgaccagcatccccagcgtgagcaacgccctgaactggagagagttcagcttcatccagagcaccctgggctacgtggccctgctgatcagcaccttccacgtgctgatctacggctggaagagagccttcgaggaggagtactacagattctacaccccccccaacttcgtgctggccctggtgctgcccagcatcgtgatcctgggcaagatcatcctgttcctgccctgcatcagcagaaagctgaagagaatcaagaagggctgggagaagagccagttcctggaggagggcatgggcggcaccatcccccacgtgagccccgagagagtgaccgtgatgtag

SEQ ID NO: 100946 - DNA, 1473 bp, Artificial Sequence; identical to SEQ ID NO: 100945
  Description of Artificial Sequence: Synthetic coding sequence

SEQ ID NO: 100947 - DNA, 1473 bp, Artificial Sequence; identical to SEQ ID NO: 100945
  Description of Artificial Sequence: Synthetic coding sequence

SEQ ID NO: 100948 - DNA, 1365 bp, Artificial Sequence
  Description of Artificial Sequence: Synthetic coding sequence
atggagagcatcagcatgatgggcagccccaagagcctgagcgagaccttcctgcccaacggcatcaacggcatcaaggacgccagaaaggtgaccgtgggcgtgatcggcagcggcgacttcgccaagagcctgaccatcagactgatcagatgcggctaccacgtggtgatcggcagcagaaaccccaagttcgccagcgagttcttcccccacgtggtggacgtgacccaccacgaggacgccctgaccaagaccaacatcatcttcgtggccatccacagagagcactacaccagcctgtgggacctgagacacctgctggtgggcaagatcctgatcgacgtgagcaacaacatgagaatcaaccagtaccccgagagcaacgccgagtacctggccagcctgttccccgacagcctgatcgtgaagggcttcaacgtggtgagcgcctgggccctgcagctgggccccaaggacgccagcagacaggtgtacatctgcagcaacaacatccaggccagacagcaggtgatcgagctggccagacagctgaacttcatccccatcgacctgggcagcctgagcagcgccagagagatcgagaacctgcccctgagactgttcaccctgtggagaggccccgtggtggtggccatcagcctggccaccttcttcttcctgtacagcttcgtgagagacgtgatccacccctacgccagaaaccagcagagcgacttctacaagatccccatcgagatcgtgaacaagaccctgcccatcgtggccatcaccctgctgagcctggtgtacctggccggcctgctggccgccgcctaccagctgtactacggcaccaagtacagaagattccccccctggctggagacctggctgcagtgcagaaagcagctgggcctgctgagcttcttcttcgccatggtgcacgtggcctacagcctgtgcctgcccatgagaagaagcgagagatacctgttcctgaacatggcctaccagcaggtgcacgccaacatcgagaacagctggaacgaggaggaggtgtggagaatcgagatgtacatcagcttcggcatcatgagcctgggcctgctgagcctgctggccgtgaccagcatccccagcgtgagcaacgccctgaactggagagagttcagcttcatccagagcaccctgggctacgtggccctgctgatcagcaccttccacgtgctgatctacggctggaagagagccttcgaggaggagtactacagattctacaccccccccaacttcgtgctggccctggtgctgcccagcatcgtgatcctggacctgctgcagctgtgcagataccccgactag

SEQ ID NO: 100949 - DNA, 1365 bp, Artificial Sequence; identical to SEQ ID NO: 100948
  Description of Artificial Sequence: Synthetic coding sequence

SEQ ID NO: 100950 - DNA, 1365 bp, Artificial Sequence; identical to SEQ ID NO: 100948
  Description of Artificial Sequence: Synthetic coding sequence

SEQ ID NO: 100951 - DNA, 267 bp, Artificial Sequence
  Description of Artificial Sequence: Synthetic coding sequence
atggagagcatcagcatgatgggcagccccaagagcctgagcgagaccttcctgcccaacggcatcaacggcatcaaggacgccagaaaggtgaccgtgggcgtgatcggcagcggcgacttcgccaagagcctgaccatcagactgatcagatgcggctaccacgtggtgatcggcagcagaaaccccaagttcgccagcgagttcttcccccacgtggtggacgtgacccaccacgaggacgccctgaccaagaccaacatctag

SEQ ID NO: 100952 - DNA, 549 bp, Artificial Sequence
  Description of Artificial Sequence: Synthetic coding sequence
atggagagcatcagcatgatgggcagccccaagagcctgagcgagaccttcctgcccaacggcatcaacggcatcaaggacgccagaaaggtgaccgtgggcgtgatcggcagcggcgacttcgccaagagcctgaccatcagactgatcagatgcggctaccacgtggtgatcggcagcagaaaccccaagttcgccagcgagttcttcccccacgtggtggacgtgacccaccacgaggacgccctgaccaagaccaacatcatcttcgtggccatccacagagagcactacaccagcctgtgggacctgagacacctgctggtgggcaagatcctgatcgacgtgagcaacaacatgagaatcaaccagtaccccgagagcaacgccgagtacctggccagcctgttccccgacagcctgatcgtgaagggcttcaacgtggtgagcgcctgggccctgcagctgggccccaaggacgccagcagacaggtgtacatctgcagcaacaacatccaggccagacagcaggtgatcgagctggcctag

SEQ ID NO: 100953 - DNA, 1467 bp, Artificial Sequence
  Description of Artificial Sequence: Synthetic coding sequence
atgcccgaggagatggacaagcccctgatcagcctgcacctggtggacagcgacagcagcctggccaaggtgcccgacgaggcccccaaggtgggcatcctgggcagcggcgacttcgccagaagcctggccaccagactggtgggcagcggcttcaaggtggtggtgggcagcagaaaccccaagagaaccgccagactgttccccagcgccgcccaggtgaccttccaggaggaggccgtgagcagccccgaggtgatcttcgtggccgtgttcagagagcactacagcagcctgtgcagcctgagcgaccagctggccggcaagatcctggtggacgtgagcaaccccaccgagcaggagcacctgcagcacagagagagcaacgccgagtacctggccagcctgttccccacctgcaccgtggtgaaggccttcaacgtgatcagcgcctggaccctgcaggccggccccagagacggcaacagacaggtgcccatctgcggcgaccagcccgaggccaagagagccgtgagcgagatggccctggccatgggcttcatgcccgtggacatgggcagcctggccagcgcctgggaggtggaggccatgcccctgagactgctgcccgcctggaaggtgcccaccctgctggccctgggcctgttcgtgtgcttctacgcctacaacttcgtgagagacgtgctgcagccctacgtgcaggagagccagaacaagttcttcaagctgcccgtgagcgtggtgaacaccaccctgccctgcgtggcctacgtgctgctgagcctggtgtacctgcccggcgtgctggccgccgccctgcagctgagaagaggcaccaagtaccagagattccccgactggctggaccactggctgcagcacagaaagcagatcggcctgctgagcttcttctgcgccgccctgcacgccctgtacagcttctgcctgcccctgagaagagcccacagatacgacctggtgaacctggccgtgaagcaggtgctggccaacaagagccacctgtgggtggaggaggaggtgtggagaatggagatctacctgagcctgggcgtgctggccctgggcaccctgagcctgctggccgtgaccagcctgcccagcatcgccaacagcctgaactggagagagttcagcttcgtgcagagcagcctgggcttcgtggccctggtgctgagcaccctgcacaccctgacctacggctggaccagagccttcgaggagagcagatacaagttctacctgccccccaccttcaccctgaccctgctggtgccctgcgtggtgatcctggccaaggccctgttcctgctgccctgcatcagcagaagactggccagaatcagaagaggctgggagagagagagcaccatcaagttcaccctgcccaccgaccacgccctggccgagaagaccagccacgtgtag

SEQ ID NO: 100954 - DNA, 1467 bp, Artificial Sequence; identical to SEQ ID NO: 100953
  Description of Artificial Sequence: Synthetic coding sequence

SEQ ID NO: 100955 - DNA, 1467 bp, Artificial Sequence; identical to SEQ ID NO: 100953
  Description of Artificial Sequence: Synthetic coding sequence

SEQ ID NO: 100956 - DNA, 1467 bp, Artificial Sequence; identical to SEQ ID NO: 100953
  Description of Artificial Sequence: Synthetic coding sequence

SEQ ID NO: 100957 - DNA, 1497 bp, Artificial Sequence
  Description of Artificial Sequence: Synthetic coding sequence
atgagccaccagcccgccgtggccaccaagatgcccgaggagatggacaagcccctgatcagcctgcacctggtggacagcgacagcagcctggccaaggtgcccgacgaggcccccaaggtgggcatcctgggcagcggcgacttcgccagaagcctggccaccagactggtgggcagcggcttcaaggtggtggtgggcagcagaaaccccaagagaaccgccagactgttccccagcgccgcccaggtgaccttccaggaggaggccgtgagcagccccgaggtgatcttcgtggccgtgttcagagagcactacagcagcctgtgcagcctgagcgaccagctggccggcaagatcctggtggacgtgagcaaccccaccgagcaggagcacctgcagcacagagagagcaacgccgagtacctggccagcctgttccccacctgcaccgtggtgaaggccttcaacgtgatcagcgcctggaccctgcaggccggccccagagacggcaacagacaggtgcccatctgcggcgaccagcccgaggccaagagagccgtgagcgagatggccctggccatgggcttcatgcccgtggacatgggcagcctggccagcgcctgggaggtggaggccatgcccctgagactgctgcccgcctggaaggtgcccaccctgctggccctgggcctgttcgtgtgcttctacgcctacaacttcgtgagagacgtgctgcagccctacgtgcaggagagccagaacaagttcttcaagctgcccgtgagcgtggtgaacaccaccctgccctgcgtggcctacgtgctgctgagcctggtgtacctgcccggcgtgctggccgccgccctgcagctgagaagaggcaccaagtaccagagattccccgactggctggaccactggctgcagcacagaaagcagatcggcctgctgagcttcttctgcgccgccctgcacgccctgtacagcttctgcctgcccctgagaagagcccacagatacgacctggtgaacctggccgtgaagcaggtgctggccaacaagagccacctgtgggtggaggaggaggtgtggagaatggagatctacctgagcctgggcgtgctggccctgggcaccctgagcctgctggccgtgaccagcctgcccagcatcgccaacagcctgaactggagagagttcagcttcgtgcagagcagcctgggcttcgtggccctggtgctgagcaccctgcacaccctgacctacggctggaccagagccttcgaggagagcagatacaagttctacctgccccccaccttcaccctgaccctgctggtgccctgcgtggtgatcctggccaaggccctgttcctgctgccctgcatcagcagaagactggccagaatcagaagaggctgggagagagagagcaccatcaagttcaccctgcccaccgaccacgccctggccgagaagaccagccacgtgtag

SEQ ID NO: 100958 - DNA, 1374 bp, Artificial Sequence
  Description of Artificial Sequence: Synthetic coding sequence
atgcccgaggagatggacaagcccctgatcagcctgcacctggtggacagcgacagcagcctggccaaggtgcccgacgaggcccccaaggtgggcatcctgggcagcggcgacttcgccagaagcctggccaccagactggtgggcagcggcttcaaggtggtggtgggcagcagaaaccccaagagaaccgccagactgttccccagcgccgcccaggtgaccttccaggaggaggccgtgagcagccccgaggtgatcttcgtggccgtgttcagagagcactacagcagcctgtgcagcctgagcgaccagctggccggcaagatcctggtggacgtgagcaaccccaccgagcaggagcacctgcagcacagagagagcaacgccgagtacctggccagcctgttccccacctgcaccgtggtgaaggccttcaacgtgatcagcgcctggaccctgcaggccggccccagagacggcaacagacaggtgcccatctgcggcgaccagcccgaggccaagagagccgtgagcgagatggccctggccatgggcttcatgcccgtggacatgggcagcctggccagcgcctgggaggtggaggccatgcccctgagactgctgcccgcctggaaggtgcccaccctgctggccctgggcctgttcgtgtgcttctacgcctacaacttcgtgagagacgtgctgcagccctacgtgcaggagagccagaacaagttcttcaagctgcccgtgagcgtggtgaacaccaccctgccctgcgtggcctacgtgctgctgagcctggtgtacctgcccggcgtgctggccgccgccctgcagctgagaagaggcaccaagtaccagagattccccgactggctggaccactggctgcagcacagaaagcagatcggcctgctgagcttcttctgcgccgccctgcacgccctgtacagcttctgcctgcccctgagaagagcccacagatacgacctggtgaacctggccgtgaagcaggtgctggccaacaagagccacctgtgggtggaggaggaggtgtggagaatggagatctacctgagcctgggcgtgctggccctgggcaccctgagcctgctggccgtgaccagcctgcccagcatcgccaacagcctgaactggagagagttcagcttcgtgcagtgcgtggccaccagcagcgccggcaacaccggcagcggcaccagaagacccgagagccagagccaggacccccacctgcccgccccccaccaccagaccagcttcctgggccccagaagcttctgctgcagcctggtgcccgtgagcaccccctacggccaccaggaggacctgagctggaccagatag

SEQ ID NO: 100959 - DNA, 1467 bp, Artificial Sequence; identical to SEQ ID NO: 100953
  Description of Artificial Sequence: Synthetic coding sequence

SEQ ID NO: 100960 - DNA, 1374 bp, Artificial Sequence; identical to SEQ ID NO: 100958
  Description of Artificial Sequence: Synthetic coding sequence

SEQ ID NO: 100961 - DNA, 432 bp, Artificial Sequence
  Description of Artificial Sequence: Synthetic coding sequence
atggagatctacctgagcctgggcgtgctggccctgggcaccctgagcctgctggccgtgaccagcctgcccagcatcgccaacagcctgaactggagagagttcagcttcgtgcagagcagcctgggcttcgtggccctggtgctgagcaccctgcacaccctgacctacggctggaccagagccttcgaggagagcagatacaagttctacctgccccccaccttcaccctgaccctgctggtgccctgcgtggtgatcctggccaaggccctgttcctgctgccctgcatcagcagaagactggccagaatcagaagaggctgggagagagagagcaccatcaagttcaccctgcccaccgaccacgccctgagccccctgggcttcctgttcctggtggtgcagagcggcatcaccgtgtgcaagtag

SEQ ID NO: 100962 - DNA, 852 bp, Artificial Sequence
  Description of Artificial Sequence: Synthetic coding sequence
atggagaagacctgcatcgacgccctgcccctgaccatgaacagcagcgagaagcaggagaccgtgtgcatcttcggcaccggcgacttcggcagaagcctgggcctgaagatgctgcagtgcggctacagcgtggtgttcggcagcagaaacccccagaagaccaccctgctgcccagcggcgccgaggtgctgagctacagcgaggccgccaagaagagcggcatcatcatcatcgccatccacagagagcactacgacttcctgaccgagctgaccgaggtgctgaacggcaagatcctggtggacatcagcaacaacctgaagatcaaccagtaccccgagagcaacgccgagtacctggcccacctggtgcccggcgcccacgtggtgaaggccttcaacaccatcagcgcctgggccctgcagagcggcgccctggacgccagcagacaggccatcctgaagaaggagaaccccttcagcaccagcagcgcctggctgagcgacagctacgtggccctgggcatcctgggcttcttcctgttcgtgctgctgggcatcaccagcctgcccagcgtgagcaacgccgtgaactggagagagttcagattcgtgcagagcaagctgggctacctgaccctgatcctgtgcaccgcccacaccctggtgtacggcggcaagagattcctgagccccagcaacctgagatggtacctgcccgccgcctacgtgctgggcctgatcatcccctgcaccgtgctggtgatcaagttcgtgctgatcatgccctgcgtggacaacaccctgaccagaatcagacagggctgggagagaaacagcaagcactag

SEQ ID NO: 100963 - DNA, 1380 bp, Artificial Sequence
  Description of Artificial Sequence: Synthetic coding sequence
atggagaagacctgcatcgacgccctgcccctgaccatgaacagcagcgagaagcaggagaccgtgtgcatcttcggcaccggcgacttcggcagaagcctgggcctgaagatgctgcagtgcggctacagcgtggtgttcggcagcagaaacccccagaagaccaccctgctgcccagcggcgccgaggtgctgagctacagcgaggccgccaagaagagcggcatcatcatcatcgccatccacagagagcactacgacttcctgaccgagctgaccgaggtgctgaacggcaagatcctggtggacatcagcaacaacctgaagatcaaccagtaccccgagagcaacgccgagtacctggcccacctggtgcccggcgcccacgtggtgaaggccttcaacaccatcagcgcctgggccctgcagagcggcgccctggacgccagcagacaggtgttcgtgtgcggcaacgacagcaaggccaagcagagagtgatggacatcgtgagaaacctgggcctgacccccatggaccagggcagcctgatggccgccaaggagatcgagaagtaccccctgcagctgttccccatgtggagattccccttctacctgagcgccgtgctgtgcgtgttcctgttcttctactgcgtgatcagagacgtgatctacccctacgtgtacgagaagaaggacaacaccttcagaatggccatcagcatccccaacagaatcttccccatcaccgccctgaccctgctggccctggtgtacctgcccggcgtgatcgccgccatcctgcagctgtacagaggcaccaagtacagaagattccccgactggctggaccactggatgctgtgcagaaagcagctgggcctggtggccctgggcttcgccttcctgcacgtgctgtacaccctggtgatccccatcagatactacgtgagatggagactgggcaacctgaccgtgacccaggccatcctgaagaaggagaaccccttcagcaccagcagcgcctggctgagcgacagctacgtggccctgggcatcctgggcttcttcctgttcgtgctgctgggcatcaccagcctgcccagcgtgagcaacgccgtgaactggagagagttcagattcgtgcagagcaagctgggctacctgaccctgatcctgtgcaccgcccacaccctggtgtacggcggcaagagattcctgagccccagcaacctgagatggtacctgcccgccgcctacgtgctgggcctgatcatcccctgcaccgtgctggtgatcaagttcgtgctgatcatgccctgcgtggacaacaccctgaccagaatcagacagggctgggagagaaacagcaagcactag

SEQ ID NO: 100964 - DNA, 1080 bp, Artificial Sequence
  Description of Artificial Sequence: Synthetic coding sequence
atgcccgcccacctgctgcaggacgacatcagcagcagctacaccaccaccaccaccatcaccgccccccccagcagagtgctgcagaacggcggcgacaagctggagaccatgcccctgtacctggaggacgacatcagacccgacatcaaggacgacatctacgaccccacctacaaggacaaggagggccccagccccaaggtggagtacgtgtggagaaacatcatcctgatgagcctgctgcacctgggcgccctgtacggcatcaccctgatccccacctgcaagttctacacctggctgtggggcgtgttctactacttcgtgagcgccctgggcatcaccgccggcgcccacagactgtggagccacagaagctacaaggccagactgcccctgagactgttcctgatcatcgccaacaccatggccttccagaacgacgtgtacgagtgggccagagaccacagagcccaccacaagttcagcgagacccacgccgacccccacaacagcagaagaggcttcttcttcagccacgtgggctggctgctggtgagaaagcaccccgccgtgaaggagaagggcagcaccctggacctgagcgacctggaggccgagaagctggtgatgttccagagaagatactacaagcccggcctgctgatgatgtgcttcatcctgcccaccctggtgccctggtacttctggggcgagaccttccagaacagcgtgttcgtggccaccttcctgagatacgccgtggtgctgaacgccacctggctggtgaacagcgccgcccacctgttcggctacagaccctacgacaagaacatcagccccagagagaacatcctggtgagcctgggcgccgtgggcgagggcttccacaactaccaccacagcttcccctacgactacagcgccagcgagtacagatggcacatcaacttcaccaccttcttcatcgactgcatggccgccctgggcctggcctacgacagaaagaaggtgagcaaggccgccatcctggccagaatcaagagaaccggcgacggcaactacaagagcggctag

SEQ ID NO: 100965 - DNA, 729 bp, Artificial Sequence
  Description of Artificial Sequence: Synthetic coding sequence
atgcccgcccacctgctgcaggacgacatcagcagcagctacaccaccaccaccaccatcaccgccccccccagcagagtgctgcagaacggcggcgacaagctggagaccatgcccctgtacctggaggacgacatcagacccgacatcaaggacgacatctacgaccccacctacaaggacaaggagggccccagccccaaggtggagtacgtgtggagaaacatcatcctgatgagcctgctgcacctgggcgccctgtacggcatcaccctgatccccacctgcaagttctacacctggctgtggggcgtgttctactacttcgtgagcgccctgggcatcaccgccggcgcccacagactgtggagccacagaagctacaaggccagactgcccctgagactgttcctgatcatcgccaacaccatggccttccagaacgacgtgtacgagtgggccagagaccacagagcccaccacaagttcagcgagacccacgccgacccccacaacagcagaagaggcttcttcttcagccacgtgggctggctgctggtgagaaagcaccccgccgtgaaggagaagggcagcaccctggacctgagcgacctggaggccgagaagctggtgatgttccagagaagatactacaagcccggcctgctgatgatgtgcttcatcctgcccaccctggtgccctggtacttctggggcgagaccttctag

SEQ ID NO: 100966 - DNA, 813 bp, Artificial Sequence
  Description of Artificial Sequence: Synthetic coding sequence
atggcctgcagacccagaagcccccccagacaccagagcagatgcgacggcgacgccagcccccccagccccgccagatggagcctgggcagaaagagaagagccgacggcagaagatggagacccgaggacgccgaggaggccgagcacagaggcgccgagagaagacccgagagcttcaccacccccgagggccccaagcccagaagcagatgcagcgactgggccagcgccgtggaggaggacgagatgagaaccagagtgaacaaggagatggccagatacaagagaaagctgctgatcaacgacttcggcagagagagaaagagcagcagcggcagcagcgacagcaaggagagcatgagcaccgtgcccgccgacttcgagaccgacgagagcgtgctgatgagaagacagaagcagatcaactacggcaagaacaccatcgcctacgacagatacatcaaggaggtgcccagacacctgagacagcccggcatccaccccaagacccccaacaagttcaagaagtacagcagaagaagctgggaccagcagatcaagctgtggaaggtggccctgcacttctgggacccccccgccgaggagggctgcgacctgcaggagatccaccccgtggacctggagagcgccgagagcagcagcgagccccagaccagcagccaggacgacttcgacgtgtacagcggcacccccaccaaggtgagacacatggacagccaggtggaggacgagttcgacctggaggcctgcctgaccgagcccctgagagacttcagcgccatgagctag

SEQ ID NO: 100967 - DNA, 5328 bp, Artificial Sequence
  Description of Artificial Sequence: Synthetic coding sequence
atggccctgagcctgtggcccctgctgctgctgctgctgctgctgctgctgctgagcttcgccgtgaccctggcccccaccggcccccacagcctggaccccggcctgagcttcctgaagagcctgctgagcaccctggaccaggccccccagggcagcctgagcagaagcagattcttcaccttcctggccaacatcagcagcagcttcgagcccggcagaatgggcgagggccccgtgggcgagcccccccccctgcagccccccgccctgagactgcacgacttcctggtgaccctgagaggcagccccgactgggagcccatgctgggcctgctgggcgacatgctggccctgctgggccaggagcagacccccagagacttcctggtgcaccaggccggcgtgctgggcggcctggtggaggtgctgctgggcgccctggtgcccggcggcccccccacccccaccagacccccctgcaccagagacggccccagcgactgcgtgctggccgccgactggctgcccagcctgctgctgctgctggagggcaccagatggcaggccctggtgcaggtgcagcccagcgtggaccccaccaacgccaccggcctggacggcagagaggccgccccccacttcctgcagggcctgctgggcctgctgacccccaccggcgagctgggcagcaaggaggccctgtggggcggcctgctgagaaccgtgggcgcccccctgtacgccgccttccaggagggcctgctgagagtgacccacagcctgcaggacgaggtgttcagcatcctgggccagcccgagcccgacaccaacggccagtgccagggcggcaacctgcagcagctgctgctgtggggcgtgagacacaacctgagctgggacgtgcaggccctgggcttcctgagcggcagccccccccccccccccgccctgctgcactgcctgagcaccggcgtgcccctgcccagagccagccagcccagcgcccacatcagccccagacagagaagagccatcaccgtggaggccctgtgcgagaaccacctgggccccgcccccccctacagcatcagcaacttcagcatccacctgctgtgccagcacaccaagcccgccaccccccagccccaccccagcaccaccgccatctgccagaccgccgtgtggtacgccgtgagctgggcccccggcgcccagggctggctgcaggcctgccacgaccagttccccgacgagttcctggacgccatctgcagcaacctgagcttcagcgccctgagcggcagcaacagaagactggtgaagagactgtgcgccggcctgctgcccccccccaccagctgccccgagggcctgccccccgtgcccctgacccccgacatcttctggggctgcttcctggagaacgagaccctgtgggccgagagactgtgcggcgaggccagcctgcaggccgtgccccccagcaaccaggcctgggtgcagcacgtgtgccagggccccacccccgacgtgaccgccagccccccctgccacatcggcccctgcggcgagagatgccccgacggcggcagcttcctggtgatggtgtgcgccaacgacaccatgtacgaggtgctggtgcccttctggccctggctggccggccagtgcagaatcagcagaggcggcaacgacacctgcttcctggagggcctgctgggccccctgctgcccagcctgccccccctgggccccagccccctgtgcctgacccccggccccttcctgctgggcatgctgagccagctgcccagatgccagagcagcgtgcccgccctggcccaccccaccagactgcactacctgctgagactgctgaccttcctgctgggccccggcgccggcggcgccgaggcccagggcatgctgggcagagccctgctgctgagcagcctgcccgacaactgcagcttctgggacgccttcagacccgagggcagaagaagcgtgctgagaaccatcggcgagtacctggagcaggacgaggagcagcccacccccagcggcttcgagcccaccgtgaaccccagcagcggcatcagcaagatggagctgctggcctgcttcagccccgtgctgtgggacctgctgcagagagagaagagcgtgtgggccctgcagatcctggtgcaggcctacctgcacatgccccccgagaacctgcagcagctggtgctgagcgccgagagagaggccgcccagggcttcctgaccctgatgctgcagggcaagctgcagggcaagctgcaggtgccccccagcgaggagcaggccctgggcagactgaccgccctgctgctgcagagataccccagactgaccagccagctgttcatcgacctgagccccctgatccccttcctggccgtgagcgacctgatgagattcccccccagcctgctggccaacgacagcgtgctggccgccatcagagactacagccccggcatgagacccgagcagaaggaggccctggccaagagactgctggcccccgagctgttcggcgaggtgcccgcctggccccaggagctgctgtgggccgtgctgcccctgctgccccacctgcccctggagaacttcctgcagctgagcccccaccagatccaggccctggaggacagctggcccgccgccggcctgggccccggccacgccagacacgtgctgagaagcctggtgaaccagagcgtgcaggacggcgaggagcaggtgagaagactgggccccctggcctgcttcctgagccccgaggagctgcagagcctggtgcccctgagcgaccccaccggccccgtggagagaggcctgctggagtgcgccgccaacggcaccctgagccccgagggcagagtggcctacgagctgctgggcgtgctgagaagcagcggcggcgccgtgctgagccccagagagctgagagtgtgggcccccctgttcagccagctgggcctgagattcctgcaggagctgagcgagccccagctgagagccatgctgcccgtgctgcagggcaccagcgtgacccccgcccaggccgtgctgctgctgggcagactgctgcccagacacgacctgagcctggaggagctgtgcagcctgcacctgctgctgcccggcctgagcccccagaccctgcaggccatccccagaagagtgctggtgggcgcctgcagctgcctggcccccgagctgagcagactgagcgcctgccagaccgccgccctgctgcagaccttcagagtgaaggacggcgtgaagaacatgggcaccaccggcgccggccccgccgtgtgcatccccggccagcccatccccaccacctggcccgactgcctgctgcccctgctgcccctgaagctgctgcagctggacagcctggccctgctggccaacagaagaagatactgggagctgccctggagcgagcagcaggcccagttcctgtggaagaagatgcaggtgcccaccaacctgaccctgagaaacctgcaggccctgggcaccctggccggcggcatgagctgcgagttcctgcagcagatcaacagcatggtggacttcctggaggtggtgcacatgatctaccagctgcccaccagagtgagaggcagcctgagagcctgcatctgggccgagctgcagagaagaatggccatgcccgagcccgagtggaccaccgtgggccccgagctgaacggcctggacagcaagctgctgctggacctgcccatccagctgatggacagactgagcaacgagagcatcatgctggtggtggagctggtgcagagagcccccgagcagctgctggccctgacccccctgcaccaggccgccctggccgagagagccctgcagaacctggcccccaaggagacccccgtgagcggcgaggtgctggagaccctgggccccctggtgggcttcctgggcaccgagagcaccagacagatccccctgcagatcctgctgagccacctgagccagctgcagggcttctgcctgggcgagaccttcgccaccgagctgggctggctgctgctgcaggagagcgtgctgggcaagcccgagctgtggagccaggacgaggtggagcaggccggcagactggtgttcaccctgagcaccgaggccatcagcctgatccccagagaggccctgggccccgagaccctggagagactgctggagaagcagcagagctgggagcagagcagagtgggccagctgtgcagagagccccagctggccgccaagaaggccgccctggtggccggcgtggtgagacccgccgccgaggacctgcccgagcccgtgcccaactgcgccgacgtgagaggcaccttccccgccgcctggagcgccacccagatcgccgagatggagctgagcgacttcgaggactgcctgaccctgttcgccggcgaccccggcctgggccccgaggagctgagagccgccatgggcaaggccaagcagctgtggggcccccccagaggcttcagacccgagcagatcctgcagctgggcagactgctgatcggcctgggcgacagagagctgcaggagctgatcctggtggactggggcgtgctgagcaccctgggccagatcgacggctggagcaccacccagctgagaatcgtggtgagcagcttcctgagacagagcggcagacacgtgagccacctggacttcgtgcacctgaccgccctgggctacaccctgtgcggcctgagacccgaggagctgcagcacatcagcagctgggagttcagccaggccgccctgttcctgggcaccctgcacctgcagtgcagcgaggagcagctggaggtgctggcccacctgctggtgctgcccggcggcttcggccccatcagcaactggggccccgagatcttcaccgagatcggcaccatcgccgccggcatccccgacctggccctgagcgccctgctgagaggccagatccagggcgtgacccccctggccatcagcgtgatccccccccccaagttcgccgtggtgttcagccccatccagctgagcagcctgaccagcgcccaggccgtggccgtgacccccgagcagatggccttcctgagccccgagcagagaagagccgtggcctgggcccagcacgagggcaaggagagccccgagcagcagggcagaagcaccgcctggggcctgcaggactggagcagacccagctggagcctggtgctgaccatcagcttcctgggccacctgctgtag

SEQ ID NO: 100968 - DNA, 1056 bp, Artificial Sequence
  Description of Artificial Sequence: Synthetic coding sequence
atggccctgagcctgtggcccctgctgctgctgctgctgctgctgctgctgctgagcttcgccgtgaccctggcccccaccggcccccacagcctggaccccggcctgagcttcctgaagagcctgctgagcaccctggaccaggccccccagggcagcctgagcagaagcagattcttcaccttcctggccaacatcagcagcagcttcgagcccggcagaatgggcgagggccccgtgggcgagcccccccccctgcagccccccgccctgagactgcacgacttcctggtgaccctgagaggcagccccgactgggagcccatgctgggcctgctgggcgacatgctggccctgctgggccaggagcagacccccagagacttcctggtgcaccaggccggcgtgctgggcggcctggtggaggtgctgctgggcgccctggtgcccggcggcccccccacccccacccagcccccctgcaccagagacggccccagcgactgcgtgctggccgccgactggctgcccagcctgctgctgctgctggagggcaccagatggcaggccctggtgcaggtgcagcccagcgtggaccccaccaacgccaccggcctggacggcagagaggccgccccccacttcctgcagggcctgctgggcctgctgacccccaccggcgagctgggcagcaaggaggccctgtggggcggcctgctgagaaccgtgggcgcccccctgtacgccgccttccaggagggcctgctgagagtgacccacagcctgcaggacgaggtgttcagcatcctgggccagcccgagcccgacaccaacggccagtgccagggcggcaacctgcagcagctgctgctgtggggcgtgagacacaacctgagctgggacgtgcaggccctgggcttcctgagcggcagccccccccccccccccgccctgctgcactgcctgagcaccggcgtgcccctgcccagagccagccagcccagcgcccacatcagccccagacagagaagagccatcaccgtggaggccctgtag

SEQ ID NO: 100969 - DNA, 5328 bp, Artificial Sequence; identical to SEQ ID NO: 100967
  Description of Artificial Sequence: Synthetic coding sequence

SEQ ID NO: 100970 - DNA, 1056 bp, Artificial Sequence
  Description of Artificial Sequence: Synthetic coding sequence
atggccctgagcctgtggcccctgctgctgctgctgctgctgctgctgctgctgagcttcgccgtgaccctggcccccaccggcccccacagcctggaccccggcctgagcttcctgaagagcctgctgagcaccctggaccaggccccccagggcagcctgagcagaagcagattcttcaccttcctggccaacatcagcagcagcttcgagcccggcagaatgggcgagggccccgtgggcgagcccccccccctgcagccccccgccctgagactgcacgacttcctggtgaccctgagaggcagccccgactgggagcccatgctgggcctgctgggcgacatgctggccctgctgggccaggagcagacccccagagacttcctggtgcaccaggccggcgtgctgggcggcctggtggaggtgctgctgggcgccctggtgcccggcggcccccccacccccaccagacccccctgcaccagagacggccccagcgactgcgtgctggccgccgactggctgcccagcctgctgctgctgctggagggcaccagatggcaggccctggtgcaggtgcagcccagcgtggaccccaccaacgccaccggcctggacggcagagaggccgccccccacttcctgcagggcctgctgggcctgctgacccccaccggcgagctgggcagcaaggaggccctgtggggcggcctgctgagaaccgtgggcgcccccctgtacgccgccttccaggagggcctgctgagagtgacccacagcctgcaggacgaggtgttcagcatcctgggccagcccgagcccgacaccaacggccagtgccagggcggcaacctgcagcagctgctgctgtggggcgtgagacacaacctgagctgggacgtgcaggccctgggcttcctgagcggcagccccccccccccccccgccctgctgcactgcctgagcaccggcgtgcccctgcccagagccagccagcccagcgcccacatcagccccagacagagaagagccatcaccgtggaggccctgtag

SEQ ID NO: 100971 - DNA, 2100 bp, Artificial Sequence
  Description of Artificial Sequence: Synthetic coding sequence
atggccctgagcctgtggcccctgctgctgctgctgctgctgctgctgctgctgagcttcgccgtgaccctggcccccaccggcccccacagcctggaccccggcctgagcttcctgaagagcctgctgagcaccctggaccaggccccccagggcagcctgagcagaagcagattcttcaccttcctggccaacatcagcagcagcttcgagcccggcagaatgggcgagggccccgtgggcgagcccccccccctgcagccccccgccctgagactgcacgacttcctggtgaccctgagaggcagccccgactgggagcccatgctgggcctgctgggcgacatgctggccctgctgggccaggagcagacccccagagacttcctggtgcaccaggccggcgtgctgggcggcctggtggaggtgctgctgggcgccctggtgcccggcggcccccccacccccacccagcccccctgcaccagagacggccccagcgactgcgtgctggccgccgactggctgcccagcctgctgctgctgctggagggcaccagatggcaggccctggtgcaggtgcagcccagcgtggaccccaccaacgccaccggcctggacggcagagaggccgccccccacttcctgcagggcctgctgggcctgctgacccccaccggcgagctgggcagcaaggaggccctgtggggcggcctgctgagaaccgtgggcgcccccctgtacgccgccttccaggagggcctgctgagagtgacccacagcctgcaggacgaggtgttcagcatcctgggccagcccgagcccgacaccaacggccagtgccagggcggcaacctgcagcagctgctgctgtggggcgtgagacacaacctgagctgggacgtgcaggccctgggcttcctgagcggcagccccccccccccccccgccctgctgcactgcctgagcaccggcgtgcccctgcccagagccagccagcccagcgcccacatcagccccagacagagaagagccatcaccgtggaggccctgtgcgagaaccacctgggccccgcccccccctacagcatcagcaacttcagcatccacctgctgtgccagcacaccaagcccgccaccccccagccccaccccagcaccaccgccatctgccagaccgccgtgtggtacgccgtgagctgggcccccggcgcccagggctggctgcaggcctgccacgaccagttccccgacgagttcctggacgccatctgcagcaacctgagcttcagcgccctgagcggcagcaacagaagactggtgaagagactgtgcgccggcctgctgcccccccccaccagctgccccgagggcctgccccccgtgcccctgacccccgacatcttctggggctgcttcctggagaacgagaccctgtgggccgagagactgtgcggcgaggccagcctgcaggccgtgccccccagcaaccaggcctgggtgcagcacgtgtgccagggccccacccccgacgtgaccgccagccccccctgccacatcggcccctgcggcgagagatgccccgacggcggcagcttcctggtgatggtgtgcgccaacgacaccatgtacgaggtgctggtgcccttctggccctggctggccggccagtgcagaatcagcagaggcggcaacgacacctgcttcctggagggcctgctgggccccctgctgcccagcctgccccccctgggccccagccccctgtgcctgacccccggccccttcctgctgggcatgctgagccagctgcccagatgccagagcagcgtgcccgccctggcccaccccaccagactgcactacctgctgagactgctgaccttcctgctgggccccggcgccggcggcgccgaggcccagggcatgctgggcagagccctgctgctgagcagcctgcccgacaactgcagcttctgggacgccttcagacccgagggcagaagaagcgtgctgagaaccatcggcgagtacaacaagatgagaagcagccagccccaccaggccctgaaccccctgagcacccccgccctggtgtag

SEQ ID NO: 100972 - DNA, 3009 bp, Artificial Sequence
  Description of Artificial Sequence: Synthetic coding sequence
atggagctgctggcctgcttcagccccgtgctgtgggacctgctgcagagagagaagagcgtgtgggccctgcagatcctggtgcaggcctacctgcacatgccccccgagaacctgcagcagctggtgctgagcgccgagagagaggccgcccagggcttcctgaccctgatgctgcagggcaagctgcagggcaagctgcaggtgccccccagcgaggagcaggccctgggcagactgaccgccctgctgctgcagagataccccagactgaccagccagctgttcatcgacctgagccccctgatccccttcctggccgtgagcgacctgatgagattcccccccagcctgctggccaacgacagcgtgcagcagggctacagaggcagcgaggagaacagcctggaggaggacaagggcctgagacccatgacccccagaagcctggccgccatcagagactacagccccggcatgagacccgagcagaaggaggccctggccaagagactgctggcccccgagctgttcggcgaggtgcccgcctggccccaggagctgctgtgggccgtgctgcccctgctgccccacctgcccctggagaacttcctgcagctgagcccccaccagatccaggccctggaggacagctggcccgccgccggcctgggccccggccacgccagacacgtgctgagaagcctggtgaaccagagcgtgcaggacggcgaggagcaggtgagaagactgggccccctggcctgcttcctgagccccgaggagctgcagagcctggtgcccctgagcgaccccaccggccccgtggagagaggcctgctggagtgcgccgccaacggcaccctgagccccgagggcagagtggcctacgagctgctgggcgtgctgagaagcagcggcggcgccgtgctgagccccagagagctgagagtgtgggcccccctgttcagccagctgggcctgagattcctgcaggagctgagcgagccccagctgagagccatgctgcccgtgctgcagggcaccagcgtgacccccgcccaggccgtgctgctgctgggcagactgctgcccagacacgacctgctgcagctggacagcctggccctgctggccaacagaagaagatactgggagctgccctggagcgagcagcaggcccagttcctgtggaagaagatgcaggtgcccaccaacctgaccctgagaaacctgcaggccctgggcaccctggccggcggcatgagctgcgagttcctgcagcagatcaacagcatggtggacttcctggaggtggtgcacatgatctaccagctgcccaccagagtgagaggcagcctgagagcctgcatctgggccgagctgcagagaagaatggccatgcccgagcccgagtggaccaccgtgggccccgagctgaacggcctggacagcaagctgctgctggacctgcccatccagctgatggacagactgagcaacgagagcatcatgctggtggtggagctggtgcagagagcccccgagcagctgctggccctgacccccctgcaccaggccgccctggccgagagagccctgcagaacctggcccccaaggagacccccgtgagcggcgaggtgctggagaccctgggccccctggtgggcttcctgggcaccgagagcaccagacagatccccctgcagatcctgctgagccacctgagccagctgcagggcttctgcctgggcgagaccttcgccaccgagctgggctggctgctgctgcaggagagcgtgctgggcaagcccgagctgtggagccaggacgaggtggagcaggccggcagactggtgttcaccctgagcaccgaggccatcagcctgatccccagagaggccctgggccccgagaccctggagagactgctggagaagcagcagagctgggagcagagcagagtgggccagctgtgcagagagccccagctggccgccaagaaggccgccctggtggccggcgtggtgagacccgccgccgaggacctgcccgagcccgtgcccaactgcgccgacgtgagaggcaccttccccgccgcctggagcgccacccagatcgccgagatggagctgagcgacttcgaggactgcctgaccctgttcgccggcgaccccggcctgggccccgaggagctgagagccgccatgggcaaggccaagcagctgtggggcccccccagaggcttcagacccgagcagatcctgcagctgggcagactgctgatcggcctgggcgacagagagctgcaggagctgatcctggtggactggggcgtgctgagcaccctgggccagatcgacggctggagcaccacccagctgagaatcgtggtgagcagcttcctgagacagagcggcagacacgtgagccacctggacttcgtgcacctgaccgccctgggctacaccctgtgcggcctgagacccgaggagctgcagcacatcagcagctgggagttcagccaggccgccctgttcctgggcaccctgcacctgcagtgcagcgaggagcagctggaggtgctggcccacctgctggtgctgcccggcggcttcggccccatcagcaactggggccccgagatcttcaccgagatcggcaccatcgccgccggcatccccgacctggccctgagcgccctgctgagaggccagatccagggcgtgacccccctggccatcagcgtgatccccccccccaagttcgccgtggtgttcagccccatccagctgagcagcctgaccagcgcccaggccgtggccgtgacccccgagcagatggccttcctgagccccgagcagagaagagccgtggcctgggcccagcacgagggcaaggagagccccgagcagcagggcagaagcaccgcctggggcctgcaggactggagcagacccagctggagcctggtgctgaccatcagcttcctgggccacctgctgtag

SEQ ID NO: 100973 - DNA, 1890 bp, Artificial Sequence
  Description of Artificial Sequence: Synthetic coding sequence
atgttcagagaccaggtgggcgtgctggccggctggttcaagggctggaacgagtgcgagcagaccgtggccctgctgagcctgctgaagagagtgagccagacccaggccagattcctgcagctgtgcctggagcacagcctggccgactgcgccgagctgcacgtgctggagagagaggccaacagccccggcatcatcaaccagtggcagcaggagagcaaggacaaggtgatcagcctgctgctgacccacctgcccctgctgaagcccggcaacctggacgccaaggtggagtacatgaagctgctgcccaagatcctggcccacagcatcgagcacaaccagcacatcgaggagagcagacagctgctgagctacgccctgatccaccccgccaccagcctggaggacagaagcgccctggccatgtggctgaaccacctggaggacagaaccagcaccagcttcggcggccagaacagaggcagaagcgacagcgtggactacggccagacccactactaccaccagagacagaacagcgacgacaagctgaacggctggcagaacagcagagacagcggcatctgcatcaacgccagcaactggcaggacaagagcatgggctgcgagaacggccacgtgcccctgtacagcagcagcagcgtgcccaccaccatcaacaccatcggcaccagcaccagcaccaacgtgcccgcctggctgaagagcctgagactgcacaagtacgccgccctgttcagccagatgacctacgaggagatgatggccctgaccgagtgccagctggaggcccagaacgtgaccaagggcgccagacacaagatcgtgatcagcatccagaagctgaaggagagacagaacctgctgaagagcctggagagagacatcatcgagggcggcagcctgagaatccccctgcaggagctgcaccagatgatcctgacccccatcaaggcctacagcagccccagcaccacccccgaggccagaagaagagagccccaggcccccagacagcccagcctgatgggccccgagagccagagccccgactgcaaggacggcgccgccgccaccggcgccaccgccacccccagcgccggcgccagcggcggcctgcagccccaccagctgagcagctgcgacggcgagctggccgtggcccccctgcccgagggcgacctgcccggccagttcaccagagtgatgggcaaggtgtgcacccagctgctggtgagcagacccgacgaggagaacatcagcagctacctgcagctgatcgacaagtgcctgatccacgaggccttcaccgagacccagaagaagagactgctgagctggaagcagcaggtgcagaagctgttcagaagcttccccagaaagaccctgctggacatcagcggctacagacagcagagaaacagaggcttcggccagagcaacagcctgcccaccgccggcagcgtgggcggcggcatgggcagaagaaaccccagacagtaccagatccccagcagaaacgtgcccagcgccagactgggcctgctgggcaccagcggcttcgtgagcagcaaccagagaaacaccaccgccacccccaccatcatgaagcagggcagacagaacctgtggttcgccaaccccggcggcagcaacagcatgcccagcagaacccacagcagcgtgcagagaaccagaagcctgcccgtgcacaccagcccccagaacatgctgatgttccagcagcccgagttccagctgcccgtgaccgagcccgacatcaacaacagactggagagcctgtgcctgagcatgaccgagcacgccctgggcgacggcgtggacagaaccagcaccatctag

SEQ ID NO: 100974 - DNA, 1893 bp, Artificial Sequence
  Description of Artificial Sequence: Synthetic coding sequence
atgatgttcagagaccaggtgggcgtgctggccggctggttcaagggctggaacgagtgcgagcagaccgtggccctgctgagcctgctgaagagagtgagccagacccaggccagattcctgcagctgtgcctggagcacagcctggccgactgcgccgagctgcacgtgctggagagagaggccaacagccccggcatcatcaaccagtggcagcaggagagcaaggacaaggtgatcagcctgctgctgacccacctgcccctgctgaagcccggcaacctggacgccaaggtggagtacatgaagctgctgcccaagatcctggcccacagcatcgagcacaaccagcacatcgaggagagcagacagctgctgagctacgccctgatccaccccgccaccagcctggaggacagaagcgccctggccatgtggctgaaccacctggaggacagaaccagcaccagcttcggcggccagaacagaggcagaagcgacagcgtggactacggccagacccactactaccaccagagacagaacagcgacgacaagctgaacggctggcagaacagcagagacagcggcatctgcatcaacgccagcaactggcaggacaagagcatgggctgcgagaacggccacgtgcccctgtacagcagcagcagcgtgcccaccaccatcaacaccatcggcaccagcaccagcaccaacgtgcccgcctggctgaagagcctgagactgcacaagtacgccgccctgttcagccagatgacctacgaggagatgatggccctgaccgagtgccagctggaggcccagaacgtgaccaagggcgccagacacaagatcgtgatcagcatccagaagctgaaggagagacagaacctgctgaagagcctggagagagacatcatcgagggcggcagcctgagaatccccctgcaggagctgcaccagatgatcctgacccccatcaaggcctacagcagccccagcaccacccccgaggccagaagaagagagccccaggcccccagacagcccagcctgatgggccccgagagccagagccccgactgcaaggacggcgccgccgccaccggcgccaccgccacccccagcgccggcgccagcggcggcctgcagccccaccagctgagcagctgcgacggcgagctggccgtggcccccctgcccgagggcgacctgcccggccagttcaccagagtgatgggcaaggtgtgcacccagctgctggtgagcagacccgacgaggagaacatcagcagctacctgcagctgatcgacaagtgcctgatccacgaggccttcaccgagacccagaagaagagactgctgagctggaagcagcaggtgcagaagctgttcagaagcttccccagaaagaccctgctggacatcagcggctacagacagcagagaaacagaggcttcggccagagcaacagcctgcccaccgccggcagcgtgggcggcggcatgggcagaagaaaccccagacagtaccagatccccagcagaaacgtgcccagcgccagactgggcctgctgggcaccagcggcttcgtgagcagcaaccagagaaacaccaccgccacccccaccatcatgaagcagggcagacagaacctgtggttcgccaaccccggcggcagcaacagcatgcccagcagaacccacagcagcgtgcagagaaccagaagcctgcccgtgcacaccagcccccagaacatgctgatgttccagcagcccgagttccagctgcccgtgaccgagcccgacatcaacaacagactggagagcctgtgcctgagcatgaccgagcacgccctgggcgacggcgtggacagaaccagcaccatctag

SEQ ID NO: 100975 - DNA, 2154 bp, Artificial Sequence
  Description of Artificial Sequence: Synthetic coding sequence
atgttcagagaccaggtgggcgtgctggccggctggttcaagggctggaacgagtgcgagcagaccgtggccctgctgagcctgctgaagagagtgagccagacccaggccagattcctgcagctgtgcctggagcacagcctggccgactgcgccgagctgcacgtgctggagagagaggccaacagccccggcatcatcaaccagtggcagcaggagagcaaggacaaggtgatcagcctgctgctgacccacctgcccctgctgaagcccggcaacctggacgccaaggtggagtacatgaagctgctgcccaagatcctggcccacagcatcgagcacaaccagcacatcgaggagagcagacagctgctgagctacgccctgatccaccccgccaccagcctggaggacagaagcgccctggccatgtggctgaaccacctggaggacagaaccagcaccagcttcggcggccagaacagaggcagaagcgacagcgtggactacggccagacccactactaccaccagagacagaacagcgacgacaagctgaacggctggcagaacagcagagacagcggcatctgcatcaacgccagcaactggcaggacaagagcatgggctgcgagaacggccacgtgcccctgtacagcagcagcagcgtgcccaccaccatcaacaccatcggcaccagcaccagcaccatcctgagcggccaggcccaccacagccccctgaagagaagcgtgagcctgaccccccccatgaacgtgcccaaccagcccctgggccacggctggatgagccacgaggacctgagagccagaggcccccagtgcctgcccagcgaccacgcccccctgagcccccagagcagcgtggccagcagcggcagcggcggcagcgagcacctggaggaccagaccaccgccagaaacaccttccaggaggagggcagcggcatgaaggacgtgcccgcctggctgaagagcctgagactgcacaagtacgccgccctgttcagccagatgacctacgaggagatgatggccctgaccgagtgccagctggaggcccagaacgtgaccaagggcgccagacacaagatcgtgatcagcatccagaagctgaaggagagacagaacctgctgaagagcctggagagagacatcatcgagggcggcagcctgagaatccccctgcaggagctgcaccagatgatcctgacccccatcaaggcctacagcagccccagcaccacccccgaggccagaagaagagagccccaggcccccagacagcccagcctgatgggccccgagagccagagccccgactgcaaggacggcgccgccgccaccggcgccaccgccacccccagcgccggcgccagcggcggcctgcagccccaccagctgagcagctgcgacggcgagctggccgtggcccccctgcccgagggcgacctgcccggccagttcaccagagtgatgggcaaggtgtgcacccagctgctggtgagcagacccgacgaggagaacatcagcagctacctgcagctgatcgacaagtgcctgatccacgaggccttcaccgagacccagaagaagagactgctgagctggaagcagcaggtgcagaagctgttcagaagcttccccagaaagaccctgctggacatcagcggctacagacagcagagaaacagaggcttcggccagagcaacagcctgcccaccgccggcagcgtgggcggcggcatgggcagaagaaaccccagacagtaccagatccccagcagaaacgtgcccagcgccagactgggcctgctgggcaccagcggcttcgtgagcagcaaccagagaaacaccaccgccacccccaccatcatgaagcagggcagacagaacctgtggttcgccaaccccggcggcagcaacagcatgcccagcagaacccacagcagcgtgcagagaaccagaagcctgcccgtgcacaccagcccccagaacatgctgatgttccagcagcccgagttccagctgcccgtgaccgagcccgacatcaacaacagactggagagcctgtgcctgagcatgaccgagcacgccctgggcgacggcgtggacagaaccagcaccatctag

SEQ ID NO: 100976 - DNA, 2157 bp, Artificial Sequence
  Description of Artificial Sequence: Synthetic coding sequence
atgatgttcagagaccaggtgggcgtgctggccggctggttcaagggctggaacgagtgcgagcagaccgtggccctgctgagcctgctgaagagagtgagccagacccaggccagattcctgcagctgtgcctggagcacagcctggccgactgcgccgagctgcacgtgctggagagagaggccaacagccccggcatcatcaaccagtggcagcaggagagcaaggacaaggtgatcagcctgctgctgacccacctgcccctgctgaagcccggcaacctggacgccaaggtggagtacatgaagctgctgcccaagatcctggcccacagcatcgagcacaaccagcacatcgaggagagcagacagctgctgagctacgccctgatccaccccgccaccagcctggaggacagaagcgccctggccatgtggctgaaccacctggaggacagaaccagcaccagcttcggcggccagaacagaggcagaagcgacagcgtggactacggccagacccactactaccaccagagacagaacagcgacgacaagctgaacggctggcagaacagcagagacagcggcatctgcatcaacgccagcaactggcaggacaagagcatgggctgcgagaacggccacgtgcccctgtacagcagcagcagcgtgcccaccaccatcaacaccatcggcaccagcaccagcaccatcctgagcggccaggcccaccacagccccctgaagagaagcgtgagcctgaccccccccatgaacgtgcccaaccagcccctgggccacggctggatgagccacgaggacctgagagccagaggcccccagtgcctgcccagcgaccacgcccccctgagcccccagagcagcgtggccagcagcggcagcggcggcagcgagcacctggaggaccagaccaccgccagaaacaccttccaggaggagggcagcggcatgaaggacgtgcccgcctggctgaagagcctgagactgcacaagtacgccgccctgttcagccagatgacctacgaggagatgatggccctgaccgagtgccagctggaggcccagaacgtgaccaagggcgccagacacaagatcgtgatcagcatccagaagctgaaggagagacagaacctgctgaagagcctggagagagacatcatcgagggcggcagcctgagaatccccctgcaggagctgcaccagatgatcctgacccccatcaaggcctacagcagccccagcaccacccccgaggccagaagaagagagccccaggcccccagacagcccagcctgatgggccccgagagccagagccccgactgcaaggacggcgccgccgccaccggcgccaccgccacccccagcgccggcgccagcggcggcctgcagccccaccagctgagcagctgcgacggcgagctggccgtggcccccctgcccgagggcgacctgcccggccagttcaccagagtgatgggcaaggtgtgcacccagctgctggtgagcagacccgacgaggagaacatcagcagctacctgcagctgatcgacaagtgcctgatccacgaggccttcaccgagacccagaagaagagactgctgagctggaagcagcaggtgcagaagctgttcagaagcttccccagaaagaccctgctggacatcagcggctacagacagcagagaaacagaggcttcggccagagcaacagcctgcccaccgccggcagcgtgggcggcggcatgggcagaagaaaccccagacagtaccagatccccagcagaaacgtgcccagcgccagactgggcctgctgggcaccagcggcttcgtgagcagcaaccagagaaacaccaccgccacccccaccatcatgaagcagggcagacagaacctgtggttcgccaaccccggcggcagcaacagcatgcccagcagaacccacagcagcgtgcagagaaccagaagcctgcccgtgcacaccagcccccagaacatgctgatgttccagcagcccgagttccagctgcccgtgaccgagcccgacatcaacaacagactggagagcctgtgcctgagcatgaccgagcacgccctgggcgacggcgtggacagaaccagcaccatctag

SEQ ID NO: 100977 - DNA, 2157 bp, Artificial Sequence; identical to SEQ ID NO: 100976
  Description of Artificial Sequence: Synthetic coding sequence

SEQ ID NO: 100978 - DNA, 1038 bp, Artificial Sequence
  Description of Artificial Sequence: Synthetic coding sequence
atgatcctgacccccatcaaggcctacagcagccccagcaccacccccgaggccagaagaagagagccccaggcccccagacagcccagcctgatgggccccgagagccagagccccgactgcaaggacggcgccgccgccaccggcgccaccgccacccccagcgccggcgccagcggcggcctgcagccccaccagctgagcagctgcgacggcgagctggccgtggcccccctgcccgagggcgacctgcccggccagttcaccagagtgatgggcaaggtgtgcacccagctgctggtgagcagacccgacgaggagaacatcagcagctacctgcagctgatcgacaagtgcctgatccacgaggccttcaccgagacccagaagaagagactgctgagctggaagcagcaggtgcagaagctgttcagaagcttccccagaaagaccctgctggacatcagcggctacagacagcagagaaacagaggcttcggccagagcaacagcctgcccaccgccggcagcgtgggcggcggcatgggcagaagaaaccccagacagtaccagatccccagcagaaacgtgcccagcgccagactgggcctgctgggcaccagcggcttcgtgagcagcaaccagagaaacaccaccgccacccccaccatcatgaagcagggcagacagaacctgtggttcgccaaccccggcggcagcaacagcatgcccagcagaacccacagcagcgtgcagagaaccagaagcctgcccgtgcacaccagcccccagaacatgctgatgttccagcagcccggcagccaggtgcacagcggcctgtgcctgaccgacctgagaggctggctgagcctgagcggcgcccccagcatgcccgccctgaccgtgcccaagagcagccagggcgagttccagctgcccgtgaccgagcccgacatcaacaacagactggagagcctgtgcctgagcatgaccgagcacgccctgggcgacggcgtggacagaaccagcaccatctag

SEQ ID NO: 100979 - DNA, 981 bp, Artificial Sequence
  Description of Artificial Sequence: Synthetic coding sequence
atggccggccccaaccagctgtgcatcagaagatggaccaccaagcacgtggccgtgtggctgaaggacgagggcttcttcgagtacgtggacatcctgtgcaacaagcacagactggacggcatcaccctgctgaccctgaccgagtacgacctgagaagcccccccctggagatcaaggtgctgggcgacatcaagagactgatgctgagcgtgagaaagctgcagaagatccacatcgacgtgctggaggagatgggctacaacagcgacagccccatgggcagcatgacccccttcatcagcgccctgcagagcaccgactggctgtgcaacggcgagctgagccacgactgcgacggccccatcaccgacctgaacagcgaccagtaccagtacatgaacggcaagaacaagcacagcgtgagaagactggaccccgagtactggaagaccatcctgagctgcatctacgtgttcatcgtgttcggcttcaccagcttcatcatggtgatcgtgcacgagagagtgcccgacatgcagacctacccccccctgcccgacatcttcctggacagcgtgcccagaatcccctgggccttcgccatgaccgaggtgtgcggcatgatcctgtgctacatctggctgctggtgctgctgctgcacaagcacagaagcatcctgctgagaagactgtgcagcctgatgggcaccgtgttcctgctgagatgcttcaccatgttcgtgaccagcctgagcgtgcccggccagcacctgcagtgcaccggcaagatctacggcagcgtgtgggagaagctgcacagagccttcgccatctggagcggcttcggcatgaccctgaccggcgtgcacacctgcggcgactacatgttcagcggccacaccgtggtgctgaccatgctgaacttcttcgtgaccgagtgcaagtacctgttcagcgccagcatgagaatcagatag

SEQ ID NO: 100980 - DNA, 1437 bp, Artificial Sequence
  Description of Artificial Sequence: Synthetic coding sequence
atgcccgccagaagcagacacagacccagactgcacagcggcagcccccccagagccccccccccccccctggaggccctgcacagcggcgaggccggcagagcccccgacagcgacggcggcagcgacgccgacagcgaggtgggccccggcagccccaccagaaccgccgaggccgccgaggaggagatggccggccccaaccagctgtgcatcagaagatggaccaccaagcacgtggccgtgtggctgaaggacgagggcttcttcgagtacgtggacatcctgtgcaacaagcacagactggacggcatcaccctgctgaccctgaccgagtacgacctgagaagcccccccctggagatcaaggtgctgggcgacatcaagagactgatgctgagcgtgagaaagctgcagaagatccacatcgacgtgctggaggagatgggctacaacagcgacagccccatgggcagcatgacccccttcatcagcgccctgcagagcaccgactggctgtgcaacggcgagctgagccacgactgcgacggccccatcaccgacctgaacagcgaccagtaccagtacatgaacggcaagaacaagcacagcgtgagaagactggaccccgagtactggaagaccatcctgagctgcatctacgtgttcatcgtgttcggcttcaccagcttcatcatggtgatcgtgcacgagagagtgcccgacatgcagacctacccccccctgcccgacatcttcctggacagcgtgcccagaatcccctgggccttcgccatgaccgaggtgtgcggcatgatcctgtgctacatctggctgctggtgctgctgctgcacaagcacagaagcatcctgctgagaagactgtgcagcctgatgggcaccgtgttcctgctgagatgcttcaccatgttcgtgaccagcctgagcgtgcccggccagcacctgcagtgcaccggcaagatctacggcagcgtgtgggagaagctgcacagagccttcgccatctggagcggcttcggcatgaccctgaccggcgtgcacacctgcggcgactacatgttcagcggccacaccgtggtgctgaccatgctgaacttcttcgtgaccgagtacacccccagaagctggaacttcctgcacaccctgagctgggtgctgaacctgttcggcatcttcttcatcctggccgcccacgagcactacagcatcgacgtgttcatcgccttctacatcaccaccagactgttcctgtactaccacaccctggccaacaccagagcctaccagcagagcagaagagccagaatctggttccccatgttcagcttcttcgagtgcaacgtgaacggcaccgtgcccaacgagtactgctggcccttcagcaagcccgccatcatgaagagactgatcggctag

SEQ ID NO: 100981 - DNA, 765 bp, Artificial Sequence
  Description of Artificial Sequence: Synthetic coding sequence
atggccggccccaaccagctgtgcatcagaagatggaccaccaagcacgtggccgtgtggctgaaggacgagggcttcttcgagtacgtggacatcctgtgcaacaagcacagactggacggcatcaccctgctgaccctgaccgagtacgacctgagaagcccccccctggagatcaaggtgctgggcgacatcaagagactgatgctgagcgtgagaaagctgcagaagatccacatcgacgtgctggaggagatgggctacaacagcgacagccccatgggcagcatgacccccttcatcagcgccctgcagagcaccgactggctgtgcaacggcgagctgagccacgactgcgacggccccatcaccgacctgaacagcgaccagtaccagtacatgaacggcaagaacaagcacagcgtgagaagactggaccccgagtactggaagaccatcctgagctgcatctacgtgttcatcgtgttcggcttcaccagcttcatcatggtgatcgtgcacgagagagtgcccgacatgcagacctacccccccctgcccgacatcttcctggacagcgtgcccagaatcccctgggccttcgccatgaccgaggtgtgcggcatgatcctgtgctacatctggctgctggtgctgctgctgcacaagcacagaagcatcctgctgagaagactgtgcagcctgatgggcaccgtgttcctgctgagatgcttcaccatgttcgtgaccagcctgagcgtgtag

SEQ ID NO: 100982 - DNA, 1248 bp, Artificial Sequence
  Description of Artificial Sequence: Synthetic coding sequence
atggccggccccaaccagctgtgcatcagaagatggaccaccaagcacgtggccgtgtggctgaaggacgagggcttcttcgagtacgtggacatcctgtgcaacaagcacagactggacggcatcaccctgctgaccctgaccgagtacgacctgagaagcccccccctggagatcaaggtgctgggcgacatcaagagactgatgctgagcgtgagaaagctgcagaagatccacatcgacgtgctggaggagatgggctacaacagcgacagccccatgggcagcatgacccccttcatcagcgccctgcagagcaccgactggctgtgcaacggcgagctgagccacgactgcgacggccccatcaccgacctgaacagcgaccagtaccagtacatgaacggcaagaacaagcacagcgtgagaagactggaccccgagtactggaagaccatcctgagctgcatctacgtgttcatcgtgttcggcttcaccagcttcatcatggtgatcgtgcacgagagagtgcccgacatgcagacctacccccccctgcccgacatcttcctggacagcgtgcccagaatcccctgggccttcgccatgaccgaggtgtgcggcatgatcctgtgctacatctggctgctggtgctgctgctgcacaagcacagaagcatcctgctgagaagactgtgcagcctgatgggcaccgtgttcctgctgagatgcttcaccatgttcgtgaccagcctgagcgtgcccggccagcacctgcagtgcaccggcaagatctacggcagcgtgtgggagaagctgcacagagccttcgccatctggagcggcttcggcatgaccctgaccggcgtgcacacctgcggcgactacatgttcagcggccacaccgtggtgctgaccatgctgaacttcttcgtgaccgagtacacccccagaagctggaacttcctgcacaccctgagctgggtgctgaacctgttcggcatcttcttcatcctggccgcccacgagcactacagcatcgacgtgttcatcgccttctacatcaccaccagactgttcctgtactaccacaccctggccaacaccagagcctaccagcagagcagaagagccagaatctggttccccatgttcagcttcttcgagtgcaacgtgaacggcaccgtgcccaacgagtactgctggcccttcagcaagcccgccatcatgaagagactgatcggctag
